United States Patent 12,569,549 (FLAVIVIRUS VACCINE) - sequence listing, part 76

SEQ ID NO: 25836 - RNA, 9873 nt, synthetic construct
  misc_feature 1..9873: note = derived and/or modified CDS sequence (opt11) from DENV-3__HQ705619__SS-prME
  source 1..9873: mol_type = other RNA
acttctctgtgtctgatgatgatcctacctgcagcgttagcgttccatctcaccagccgggacggcgagccccgcatgatcgtcgggaaaaacgaacgggggaagagcctgctgtttaagaccgcctccgggatcaacatgtgcaccctcatagccatggacctcggcgagatgtgcgacgacacggtaacgtacaagtgtccccacataacggaagtggagcccgaggatatcgactgttggtgcaacctgaccagcacttgggtgacctacggaacgtgcaaccaggccggagagcaccggcgagacaaacggtcagttgcgctcgcacctcacgtcggtatggggctggatacccgcacccagacctggatgtcggccgaaggtgcctggcggcaggttgagaaggtggaaacctgggcgctgagacatccggggttcaccatactggcactgttcctggcccactacataggaacttccctaacccagaaggtggtcatcttcatcctgctgatgctcgtcacgccgtcaatgacgatgaggtgtgtgggggtgggcaaccgcgattttgtcgagggcctgagcggggccacgtgggttgacgtggtcctggaacatggcggttgcgtcacaacgatggccaagaacaagcccaccctcgacatcgagctgcagaagaccgaggccacccagctagcgactctccggaagctatgtatcgaaggaaaaattactaatatcaccaccgacagccgttgccccacccagggcgaggcgacactgcccgaggagcaggaccagaactacgtgtgcaagcacacttacgtcgatagagggtggggaaacgggtgcggcctattcgggaaaggcagtctagtgacttgtgccaagttccaatgtctagagcctattgaaggcaaggtggtgcaatatgaaaacttgaagtatacggtaatcatcaccgtgcacaccggagaccagcatcaggttggcaacgaaacccaaggggtgacagcagagatcacgccccaggcctctaccaccgaggcgattctcccggaatacggcacgctgggactagagtgttccccccgcacggggcttgacttcaacgagatgattttactcacaatgaagaacaaggcctggatggtccatcggcagtggtttttcgacctacctctaccctggaccagtggtgcgacgacggagaccctcacctggaatcgcaaggagctcctggtgacattcaagaacgcccacgcgaagaagcaggaagtggtcgtgctcgggtcgcaggagggcgcgatgcatactgccctgaccggggccaccgagatccaaaacagcggcgggacctccatctttgccggccatctcaaatgccggctcaagatggacaagttggaattaaagggtatgtcatatgcgatgtgtacgaatacgtttgtcctcaagaaggaggtttccgagacccagcatggtaccatactcatcaaggtggagtataagggcgaggacgtgccctgcaagatccccttcagcaccgaggacgggcagggcaaagcgcacaatggtcgtctcataaccgcaaaccctgtagtgaccaagaaggaagagcccgtgaacatcgaggctgagccaccgtttggggagtcgaacattgttatcggcataggggacaacgccttaaaaatcaactggtataagaagggctcgtcgatcggcaagatgttcgaggcgaccgcccggggagctcgccggatggccatcctgggcgacacggcctgggacttcgggtcggtagggggagtcctgaatagcttaggcaaaatggtccaccagatcttcgggtcagcgtataccgccctgttcagtggcgtgtcctgggtgatgaagataggcattggcgtcctgctgacttggattggcctcaacagcaaaaacacatccatgagcttcagctgcatcgctatcgggataatcacattatacctgggagctgttgtgcaggcagacatggggtgcgtcatcaactggaagggaaaggagttaaagtgcgggagcggaatcttcgtcaccaacgaggtgcacacgtggaccgaacagtataagtttcaggcggactccccaaaacgcttagccactgcaatagccggcgcttgggaaaatggggtctgcggcatacgtagcaccacccgcatggagaacctgctctggaaacagattgcgaacgagctgaactacatcctttgggagaacaacatcaagttaaccgtggttgtgggagacatcatcggagtgttggaacagggcaaacgcaccttaacacctcagcccatggaactcaagtacagttggaagacctgggggaaagctaaaatcgtgacggctgaaacgcaaaacagctcctttattatagacggcccgaacacgccggaatgcccgagcgtttcccgggcctggaacgtctgggaggttgaagactatgggttcggcgtcttcaccacaaatatctggcttaagctacgtgaagtgtatacacagctttgcgaccaccggcttatgtctgcagccgtgaaggatgagcgcgcagtccacgccgacatgggctattggatcgaatctcagaagaacgggagttggaagctcgaaaaagccagcctgatcgaggtgaagacatgtacctggccaaagtcccacacgttatggtccaacggcgtgctggagtctgacatgatcatccccaaatcacttgcaggtcccatctcccagcacaaccaccggccaggataccacacccagacggccgggccgtggcacctcggcaagctcgaactcgacttcaactactgcgaaggcaccaccgtcgttataaccgagaattgcgggacgcgcggtccaagccttcggaccacaaccgtatccgggaagctgattcacgagtggtgttgccgctcatgcaccctaccgcccctacgctacatgggcgaggacgggtgttggtacggaatggagatccgccccatctctgagaaggaggagaacatggttaagagcctggtctcggcgggcagcgggaaggtggataactttacaatgggtgtcttatgtcttgctatcttgtttgaggaggtgatgagaggaaagttcggcaagaagcacatgatcgccggggtattttttacctttgtattgctgctgagcggccagatcacttggcgcgacatggctcacaccctcataatgatcggcagtaacgcctccgacagaatggggatgggcgtgacttacctggcccttatcgccacgttcaagattcaacccttcctcgcactgggcttcttcctgcgcaaactcaccagccgtgagaacctgttactcggtgtgggcctggcgatggcaacaaccctgcagctaccggaggacatagagcagatggccaacggcattgccctagggttgatggcattgaaactaatcactcagtttgagacttatcagctgtggacggccctaatcagcctgacttgcagcaatacaatattcaccctaacggtcgcctggcgaaccgccacccttatcctggccggggtaagcctgctccctgtttgccagagctccagtatgcggaagaccgactggctgccaatggcagtagccgcgatgggggtaccccccctgcctctcttcatcttcggtcttaaggacactcttaagcggcgcagctggccgctcaacgagggcgtcatggctgtcggcctggtctccatcctcgccagctccctactgagaaacgacgttccaatggcggggcccctggttgccggcgggctcctgatcgcgtgctatgtgatcactgggaccagcgctgatctgactgtcgaaaaagctgctgacatcacgtgggaggaagaggctgagcaaacaggggtatcccacaacttgatgatcaccgtagatgacgatgggacaatgcggataaaagacgacgagacggagaacatactaaccgtcttattgaagacggcgctgttaatagtctcgggcattttcccttattccataccagctaccctgctcgtgtggcacacctggcagaaacagacccagcggagcggggtgctatgggacgtgccttctccgccagagacccaaaaggccgaattagaggaaggagtgtacaggatcaagcagcaggggatcttcggcaaaactcaggtcggtgtaggcgtgcagaaggagggcgtcttccatacgatgtggcacgtgacgaggggggcggtactgacgtacaatgggaaaaggctggagccaaactgggccagcgtgaaaaaggacctcataagctatgggggtgggtggcggctttcagctcaatggcagaagggagaggaagtccaggtaatcgcggtagagcctggcaagaaccccaaaaactttcaaactatgccaggcaccttccagacaacaaccggagaaatcggagcaatcgccctcgactttaaaccgggtaccagtggcagtcccataatcaacagggaaggaaaggtagttggcctgtacgggaatggtgtcgtgacaaaaaacggcggatacgtgagcggcatcgcccagaccaacgcggaaccagacggtccgactcccgagctcgaggaggaaatgttcaagaagcgtaacttaaccatcatggacctgcaccccggctcggggaaaacacgcaaatatctccccgccatcgtacgggaggcgataaagcgccggcttcgaacgcttatactcgcaccgacacgggtggtcgctgccgagatggaggaggccctgaaaggcctgcctatccgttaccagaccacagctaccaagagtgagcacaccggaagggaaatagtggatctcatgtgccacgctaccttcacgatgcgactgctgtccccggtacgcgtgccaaactacaatctcattatcatggacgaggcacacttcaccgatccagcttccatcgccgctcgcggctacatttccacccgcgtaggcatgggtgaggcggctgccatttttatgaccgcgactccaccgggcacagctgacgcctttccccagagcaacgccccgatccaggacgaggagagagacatccccgaacgctcctggaactccggtaacgaatggatcacagatttcgccggcaagaccgtctggtttgtgccatcgattaaggccgggaacgacatcgctaattgtctgcgtaagaatggcaagaaggtaatccagctatcaagaaagacgtttgacaccgaataccagaaaaccaagctcaacgattgggactttgtggtgaccacggacatttccgaaatgggcgcgaacttcaaagccgatcgggtcatcgatcctaggcgatgcctgaaaccggtgatcctgacagacggtcccgaaagggtcatcttggccggccccatgcccgtgaccgcggccagcgccgcacagagacgtggacgggtggggcgcaatccacagaaggagaatgaccagtacatattcacggggcagccgctaaacaatgatgaggaccatgcgcattggaccgaggcgaagatgcttttagacaatatcaacaccccagagggcatcatccccgcccttttcgaaccggagcgggaaaagtctgccgcaattgacggggagtaccggttaaagggggagagccggaaaaccttcgtggagctaatgcgccggggagatctgcccgtctggctggcacataaagtcgcctccgaagggattaaatacaccgaccgcaagtggtgcttcgacggccaaagaaacaaccagattttggaggagaacatggacgtagagatctggaccaaggaaggagagaagaagaagctgagacccagatggctggacgcccgaacgtatagcgaccctctagccctgaaggagttcaaggagttcgctgcgggtcgtaagtcgattgccctggatctcgtgaccgagatcggccgggttcccagccatctcgcccaccgcacgaggaacgccctggacaatctcgtaatgctgcacacctccgagcacgggggccgcgcctaccggcacgcggtggaggagctccccgagacgatggagacgctcctgctactcggactaatgatccttctgacaggcggagccatgctgtttctgatctcggggaaaggcattgggaaaacctcaatcggtctcatctgtgttattgcgagtagcgggatgctctggatggcggagataccccttcagtggatcgcatccgcaattgtgctcgagttctttatgatggttctcctgatcccggagccggagaagcagagaacaccccaggacaatcaattggcctacgttgtcattggcatccttactttggccgccattatcgccgcgaatgaaatgggcttgttggaaaccaccaagagagacctgggtatgtcaaaggaacccggagtagtttcgccgacgagctacctcgacgtggacttacaccctgcttcggcatggaccttatacgcggttgcgaccaccgtcataactcccatgctccgccataccatagagaacagcacggccaatgtctccctggctgcgatcgcaaaccaagcggtggtcctgatgggcctcgacaaggggtggcccatctccaagatggacctcggcgtcccgctactagcactaggctgttactcgcaggtgaacccccttaccctcactgccgccgttctgttgcttatcacccattatgccatcataggtcccggtttgcaagcaaaggccacacgtgaggcccagaaacgcacggccgccggcatcatgaagaacccaaccgtcgacggcattatgacgatcgatctggaccctgttatctacgacagcaaattcgaaaagcagctcggccaagtcatgctgcttgtactttgtgcggtacagctgcttctaatgcggacctcctgggccctgtgcgaggccctgaccctcgctacgggccccatcacgactctttgggaggggagccccggcaagttctggaatactacgatcgcggtctccatggcgaacatcttcagggggagttaccttgccggggccggtctagccttctccatcatgaagtccgtaggaaccggcaaaagagggaccggatcccaaggggagaccctgggcgaaaagtggaagaagaagctaaatcaactcagccgcaaggatttcgacctctataagaagtctgggatcaccgaggtggacagaacggaggcgaaggagggtctaaaacgcggcgagatcacccatcacgccgtatcccggggctcagcgaagttgcagtggttcgtcgaacgaaatatggtgattccagaaggcagagtgatcgacctggggtgtgggcgcgggggatggagttactattgcgccggcctgaagaaggtgacagaggtccggggttacaccaagggcgggcctggccatgaggaaccggtgcctatgtcaacgtacgggtggaacattgttaagctcatgtccggcaaggacgttttctatctgccaccggagaagtgtgacactcttctgtgcgacataggcgagagctcccccagccccaccgtggaggagagtcgcactattcgcgtgttgaagatggtagagccatggctgaagaacaaccagttttgcatcaaggtgctaaacccgtatatgcccacggtaatcgagcacctcgaaaggctgcagcgcaagcacggaggcatgctagttcggaacccattaagtcgcaattccacacatgagatgtactggataagcaacggcaccggaaacatcgttgcgtccgtcaacatggtcagccgcctcctgctcaaccgctttacgatgacacaccggcgacccactatcgagaaggacgtagacctgggggcgggtacccggcacgtaaatgctgagccggagaccccaaacatggacgtgatcggtgagcgcatcaagaggataaaagaagagcacaactcaacctggcactacgatgacgaaaacccctacaagacctgggcgtaccacgggagctacgaggtgaaggctaccggctccgccagctccatgatcaacggcgtcgtgaagctgctaacaaagccgtgggacgtcgtacccatggtgactcaaatggcgatgaccgacacgacgccgtttggacagcagagagtcttcaaggagaaggttgacacgagaacgccacggagtatgccgggaacgcggcgcgtcatgggaatcaccgccgagtggctctggcggaccctgggccgcaacaaaaagccccggctctgcaccagagaggagtttactaagaaagtcagaaccaacgcggctatgggcgctgttttcacggaggagaaccagtgggacagcgccaaggcggccgtggaagacgaagacttctggaaacttgtcgatcgggagcgtgagcttcacaaactcggcaaatgcgggtcctgcgtctacaacatgatggggaaacgggagaagaagctcggcgaattcgggaaggccaagggtagccgggctatctggtacatgtggttaggggcccggtacttggaattcgaagcactcggttttctgaatgaggaccactggttctcacgcgagaattcatactccggggtagagggtgagggcctccacaagttggggtacatactgcgggatattagcaagatccccggcggggcgatgtacgccgacgacacggcgggctgggacacgcgtatcaccgaggatgatttgcacaacgaggagaaaatcacgcagcagatggaccccgagcaccggcagcttgctaatgccattttcaagctgacctaccaaaacaaggtcgtgaaggtgcaacgcccgacacccaccggcaccgtaatggatattatttcccggaaggaccagcgcggtagcggccaggtgggaacgtacggtctcaacacatttaccaacatggaggcccagctgatacggcagatggagggggagggcgtgctgtccaaggcggacctggagaatcctcacctacccgagaagaaaatcacccagtggctggaaacgaagggcgtggagcgcttaaaacggatggcgatcagcggggacgactgcgtggtgaagccgatcgacgaccgcttcgccaacgcattgctggccttaaacgacatgggtaaggtcagaaaagacatcccccagtggcaaccttccaaggggtggcatgattggcagcaggtcccattctgctctcaccacttccacgagctgatcatgaaggacggccgcaagctggtagttccgtgccgcccccaagacgagctcatcggacgcgcacgaatctcacagggcgcggggtggagcctgaaggagacagcctgcctagggaaggcctatgcacagatgtggtcacttatgtacttccatcggcgcgatctgagactcgcgagcaatgcgatctgctccgccgtgcccgttcactgggtgcccaccagtcgcacgacatggtccatacacgctcatcaccagtggatgaccaccgaggacatgctcaccgtttggaaccgggtgtggatcgaggacaatccctggatggaggataaaacgcccgtcactacgtgggagaatgttccctacctgggcaagcgcgaggatcagtggtgtgggagcctgatcggcttgacctcacgggccacctgggcacaaaatatcccaactgccatccagcaggtccgttccctgatcgggaatgaggagttccttgactatatgccctctatgaaacggttcaggaaagaggaggagtccgaaggcgccatctggtga

SEQ ID NO: 25837 - RNA, 9873 nt, synthetic construct
  misc_feature 1..9873: note = derived and/or modified CDS sequence (opt11) from DENV-3__HQ705620__SS-prME
  source 1..9873: mol_type = other RNA
accagcctctgtctcatgatgatcctacctgccgcattagccttccacctcaccagccgggacggggagcccagaatgattgtggggaagaacgagcgcggaaagtctctgctgttcaagaccgcctccgggatcaatatgtgcaccttgatcgccatggacctgggcgaaatgtgtgacgacaccgtgacgtacaagtgtccccacataaccgaggtagaacccgaggacatcgactgctggtgcaacctgactagcacctgggtgacatacggcacgtgcaaccaggccggcgagcaccggcgcgacaagcggagtgtggccctcgccccccacgtgggcatggggctggacacccgtacccagacctggatgagcgcagaaggcgcctggcggcaggtagagaaggtcgagacgtgggccctgcgccatccgggtttcaccattctcgcgctgtttctggcccactacatcggcacctccctcacccagaaggtcgtgatcttcatcctgctgatgttggtcacgcccagcatgaccatgcggtgtgtgggggtgggcaaccgcgacttcgtcgagggcctgtccggggccacctgggtggacgtggtactggagcacggcgggtgcgtgacaacgatggccaagaacaagcctacccttgacattgagctgcagaagacggaggccacccagctggctacgctccggaagctgtgcatcgagggaaagataactaacatcaccaccgacagcagatgcccaacgcagggagaggccaccctccccgaggagcaagaccagaactacgtgtgcaagcacacctacgtggatcgggggtggggtaatgggtgcggcctgttcgggaagggctccctggtgacctgtgccaagttccagtgcctggagcctatcgagggcaaggttgtccagcacgaaaacctcaagtacacggtgatcattacggtgcacacaggagaccaacaccaggtcggcaatgagacccagggggtgactgccgagatcactccccaggccagcacaaccgaggcgatcctgcccgagtatgggaccttagggctggaatgctccccgcgcacgggcctggacttcaacgaaatgatccttctcaccatgaagaacaaagcctggatggtacatcggcagtggttcttcgacttgcccctgccctggacgagcggcgccacaaccgagacgcccacctggaaccgcaaggagctcctggtgacgttcaagaacgcccacgccaagaagcaggaggtggttgtactagggtcgcaggagggagcgatgcacacggcgctcactggggccaccgagatccagaacagcggcggaacgagtatcttcgccggacacctgaagtgtcggttaaagatggacaagctcgagctgaagggcatgagctatgcaatgtgcacaaacacctttgtgctaaagaaagaggtctcagagacccagcacggtaccatccttatcaaggtggagtacaagggtgaggatgtgccgtgcaagatccccttctcgaccgaagacgggcaaggcaaggctcacaacggccggctgatcaccgccaaccccgtcgtgaccaagaaagaggagcctgtgaacatcgaagcagagccgcccttcggggaaagcaatattgtcatcggcatcggtgataacgcgctgaagatcaattggtacaagaagggcagcagcatagggaaaatgttcgaggcgaccgcccgaggggcccgcagaatggctatcctcggcgacactgcctgggattttgggtccgtgggcggggtgctcaacagcttgggcaaaatggtccaccaaattttcgggagcgcatacaccgcccttttcagcggggtgtcctgggtgatgaagatcggcatcggggtcttgctgacgtgggtaggtctgaacagcaagaacaccagcatgagcttctcatgcatcgccatcgggatcataacgctatacctaggcgcggtggtccaagccgacatggggtgcgtgatcaactggaaggggaaggagctgaagtgtggcagcggaatctttgtgaccaacgaggtccacacctggaccgagcagtataagttccaggcggattcccccaagcgcttggccacggccatcgccggagcgtgggagaacggggtctgtggcatccgctcaaccaccagaatggagaatctgctgtggaagcagatcgcgaacgagctcaactacatcttgtgggagaacaacatcaagctgacggttgtcgtgggggacattatcggcgtactcgagcaaggcaagagaacactgacgccccagccgatggagctgaagtactcctggaagacgtggggcaaggctaagatcgtcaccgcagaaactcagaacagctccttcatcatcgacggacctaacaccccggaatgccccagcgtgtcccgggcctggaacgtgtgggaggtcgaggactacgggttcggcgtgttcaccaccaacatctggctcaagctacgcgaggtgtatacccaactgtgcgaccaccggctcatgagcgcagccgttaaggacgagcgcgccgtacacgccgacatggggtactggatcgagagccagaagaacgggtcctggaagctggagaaggccagcctgatcgaggtgaagacgtgtacctggccgaagtcccacaccctctggagtaacggcgtccttgagtccgacatgattatccccaaaagcctggcggggcctatctcccagcacaaccacaggccgggctaccatacccaaacagcgggtccctggcacctcggcaagctggagctggacttcaattactgtgaaggcaccaccgtggttatcaccgagaattgcgggactcgcgggcccagcctccgaaccaccaccgtcagcggtaagcttatacacgaatggtgctgcaggagttgcaccctgccgccgctccggtacatgggcgaggacggctgctggtacggcatggagatccgccccatctccgagaaggaggagaacatggtcaagagcctcgtgtccgccggcagcgggaaggtcgataacttcactatgggcgtgctgtgcctagcaatactgttcgaggaggtgatgcgggggaagttcggcaaaaagcacatgatagccggggtgttcttcacgttcgtgctgttactgtccgggcaaatcacctggcgcgacatggcacatacgctgatcatgatcgggagcaacgcctccgaccggatggggatgggtgtgacgtacttagccctgatcgccaccttcaagatccagcccttcctggccctcgggttcttcctgcgccggctgactagccgcgagaaccttctgctgggcgtcgggttagcgatggccacgaccctgcagctgccggaggacattgaacagatggccaacggaatcgcattgggcctcatggcgctgaagctcatcacccagtttgagacctaccaactgtggacagccctgatctccttaacctgcagtaacaccatcttcaccctgacggtggcctggaggaccgccactctgatcctcgccggggtcagcctgctgccggtctgccagtccagctctatgcgcaaaaccgactggctacccatggcagtggccgctatgggcgtgccgcccctccccctgttcatcttcagcctcaaggacacgctgaaacgccggtcctggcctctgaacgaaggggtgatggcagtcggcctcgtcagcatcctggcctcttcactgctccgaaacgacgtgcccatggcgggcccactcgtggccgggggccttctcatcgcatgctacgtgatcacggggacctctgccgacctgaccgtggagaaggccgcggacatcacgtgggaggaggaggccgagcaaacgggcgtgagccataacctgatgataaccgtcgacgacgacgggacaatgcggatcaaggacgacgaaaccgagaacatcctcacggtgctgctgaagaccgccctcttgatcgtgtccggcatcttcccgtacagcatcccggccactctgctcgtctggcacacctggcaaaaacaaacgcagcgctccggcgtactgtgggacgtgcccagcccgccagagacgcagaaggccgagctggaggagggggtctatcggatcaagcagcagggaatcttcggtaagacccaggtcggcgtgggggtccagaaggagggcgtgtttcacacgatgtggcacgtgacacgcggagcggtcctcacctacaacgggaagagacttgagcccaattgggcctccgttaagaaggatctgatctcgtacggcgggggctggaggctctccgcccagtggcagaaaggggaggaggtccaggtcatagccgtggaacccggcaaaaaccctaagaatttccaaacgatgcccggcaccttccagactaccaccggggagatcggcgcgatcgccctggacttcaagcccgggacgagcggcagccccattatcaaccgagaaggcaaagtggtagggctctatggtaacggcgtggtgacgaagaacggtgggtacgtgtccggcatcgcccagaccaatgccgagccggacggccccacccccgagctggaggaggaaatgttcaagaaacgcaacctcaccattatggacctgcacccagggagcggcaagacgcggaagtacctcccggccattgtgcgagaggcgatcaagcgacgcctgcggaccctgatactggcacccacccgcgtggtagcggccgaaatggaggaggccttgaaggggctgcccatccgctaccagacgacggcgaccaagtctgagcacacgggacgcgagatcgtggacttaatgtgccacgccaccttcacgatgcggctcctgagccccgtgcgcgtcccgaattataacctgatcatcatggacgaggcacacttcaccgaccccgcctccatcgccgcgcgggggtacatcagcacacgcgtgggcatgggcgaggcggccgccatcttcatgaccgcgacgccgcccggcaccgccgacgccttcccgcaatccaatgcccccatccaggacgaagagcgcgacatccccgagcggtcctggaactccggcaacgagtggatcaccgacttcgccgggaagacagtgtggttcgtcccgagcatcaaggcgggcaacgatatcgccaattgcctccgcaagaacggcaagaaagtgattcaactgtcccggaagacatttgacacggaataccagaagaccaagctgaacgactgggacttcgttgtcaccacggacatcagcgagatgggcgccaacttcaaggcggaccgcgtgattgaccctagacgctgcctcaagcctgtgatcctgaccgacggccccgaacgggtcatcttggccgggccgatgccggtgaccgcggcctccgccgcccagcgccggggtcgcgtgggtcggaacccccagaaggagaacgaccagtacattttcaccgggcagcccttgaacaacgacgaggaccacgcccactggaccgaggcgaagatgttattagacaacatcaacacgcccgaggggatcatcccggccctcttcgaaccggagcgcgagaagtccgccgccatcgacggtgagtaccggctgaaaggagagtcacgcaagacattcgtcgagctgatgcggaggggagacctccccgtgtggctggcgcacaaggtcgcctctgagggtatcaaatacaccgaccggaagtggtgcttcgacggacagcgcaacaatcagatcctggaggagaatatggacgttgagatctggacgaaggagggcgagaagaagaagctccggccccgctggctggacgcacgcacgtactcggacccgctggccctgaaggagtttaaggagtttgccgcgggccgcaagtctatcgccctggacctagtaaccgagatcggccgcgtcccctcccacctcgcccaccggacccgcaacgccctcgacaacctggtgatgctccacaccagcgagcacggcgggagagcctaccgccacgcggtcgaggagctgcccgagacgatggagacccttctccttctgggcctgatgatcctcctgacagggggcgccatgctgttcctgatcagcggcaaagggataggcaagacttccatcggcctgatctgtgtcatagccagttccggcatgctctggatggccgagatcccgctgcagtggatagccagcgcgatcgttcttgagttcttcatgatggtgctcctgatccccgagccggagaagcagcggacgccccaggacaaccagctggcctacgtcgtgattgggatcctcacccttgctgccatcatcgccgccaacgaaatgggcctgctcgagaccaccaagcgcgatcttggcatgtccaaggaaccgggggtggtcagccccacgtcctacctggacgtggacctccaccccgcctctgcctggaccctgtacgctgtggcgaccaccgtcatcacgcccatgttacgtcacaccatcgagaacagcaccgccaacgtgtcgctcgccgccatcgccaaccaggcggtggtcctaatggggctcgacaaggggtggccgatctctaagatggatctcggcgtgccgctgttggccctcggttgctatagccaggtcaaccccttgaccctgacggccgccgttctactgctaatcacacactacgccatcatcggccccggtctccaggcgaaggccacccgcgaagcccagaagcggaccgccgcggggatcatgaaaaacccgacggtggacggcatcatgacgatcgacctcgaccccgttatctacgacagcaagttcgagaaacagctggggcaggtcatgctcctcgtgctgtgtgcggttcagctcctgctcatgcgcaccagctgggcgctctgcgaggccttgaccctggccacgggccccatcaccaccctctgggagggctcccccgggaagttctggaacaccacgatagcggtcagcatggctaacattttccgtggctcgtacctggccggggccggcctggccttcagcatcatgaaatccgtggggacaggcaagcgagggaccgggtcccagggcgagactctcggagaaaagtggaaacggaagctgaaccagctgagccgcaaggacttcgacctctataaaaaatccggcatcactgaggtggaccgcacggaggcgaaggaggggttgaagcgcggcgagattacccaccacgctgtcagcaggggctccgccaagcttcaatggttcgtggagcgcaatatggtgatcccggagggccgggtcatcgacctcggctgcgggcgtggggggtggagctactattgcgccggattgaagaaggtaacagaggtccgcggctacaccaaagggggacccggacatgaggagccggtccccatgtccacgtacggctggaacatcgtgaaattgatgagcgggaaggatgtgttctacctcccacccgagaagtgtgacaccctactgtgtgatatcggcgagagtagcccctctcccaccgtcgaggagagccggaccatacgcgtgctgaagatggtggagccgtggctcaagaacaaccagttctgcatcaaagtcctgaacccttacatgcccacagtgatcgagcacctggaacggctccagcgcaagcacggggggatgctggtccggaatcccctgagccgcaacagcacccacgagatgtactggatatcgaacggcacggggaacatcgtcgccagcgtcaacatggtgtcccggctcctgctgaaccgcttcaccatgacgcaccggagaccgacgatcgagaaggatgtcgacctcggcgcgggcacccggcacgtcaacgctgaaccggagacccccaacatggatgtgattggggaacggatcaagcggattaaggaggagcacaacagtacgtggcactatgacgacgagaacccgtacaagacctgggcctatcacggctcctacgaggtcaaggccaccggaagcgccagcagcatgatcaacggagtcgtcaagctcctgaccaaaccctgggacgtcgtgcctatggttacgcagatggcgatgaccgacacgacccccttcgggcagcagcgcgtgtttaaggagaaggtggacacgcggaccccgcgcagcatgcccggcacgcgacgcgtcatgggtattaccgcggagtggctctggcggacgctggggcgcaacaagaagccccggctgtgcacccgagaggaattcaccaagaaggtgcgcaccaacgccgccatgggcgcggtgttcacggaggagaaccagtgggactccgctaaggccgccgtcgaggacgaggacttttggaagctagtggaccgggaaagagaactgcacaagcttgggaagtgcggctcttgcgtgtacaacatgatggggaagcgggagaagaagctcggcgagttcggcaaggccaaggggagcagggcgatatggtacatgtggctgggcgcccggtacttggagttcgaagctctcgggttcttgaacgaggaccactggttcagccgcgaaaattcctatagcggagtcgagggagagggactgcacaagctgggatatatcctgcgggacatctccaagatcccgggtggagccatgtacgcagacgacaccgcggggtgggacactcgcatcactgaggacgacctgcacaacgaggagaagatcacgcagcagatggaccctgagcaccgacagcttgccaatgccatcttcaagctgacctaccagaacaaggtcgtgaaggtccagcgccccaccccaaccggcaccgtcatggatatcatctcgcggaaggaccagcgcggatcaggccaggtgggcacttacgggctcaatacattcaccaacatggaggcccagcttattcggcagatggagggagagggcgtcctgagcaaggccgacctggagaatccccatctcccggagaagaagatcacccagtggctggaaacgaagggcgtggagcggctgaaacgtatggctatctccggcgacgattgcgttgtcaaacccatcgacgaccgctttgcgaacgccctcctggccctgaatgacatgggaaaggtgcgaaaggacatcccccagtggcagccaagcaagggctggcacgactggcagcaggtcccgttctgctcccaccactttcacgagctcatcatgaaggatggtcgtaagctcgttgtgccctgcaggcctcaggacgaactgatcggccgcgcccgcataagccagggcgcgggctggtccctgaaggagaccgcatgcctgggcaaggcctacgcccagatgtggagccttatgtacttccaccggcgcgacctccggctagcgtccaacgcgatctgcagcgcagtgcccgtgcactgggtgccgacctcccgcacgacttggagcatccacgcccaccaccagtggatgaccaccgaggacatgctgaccgtctggaatcgggtgtggatcgaggacaacccgtggatggaagacaagacgccagtgaccacctgggagaatgtgccttacttggggaagcgcgaggaccagtggtgcggcagcctgatagggctgacctcccgggccacgtgggcgcagaacatcccgacggcaatccagcaggtccgcagcctcatcggtaatgaggagtttttggattacatgccctccatgaagcggttccgcaaagaggaagagtcagagggggccatatggtga

SEQ ID NO: 25838 - RNA, 9873 nt, synthetic construct
  misc_feature 1..9873: note = derived and/or modified CDS sequence (opt11) from DENV-3__HQ705621__SS-prME
  source 1..9873: mol_type = other RNA
accagcctgtgcctcatgatgatcctgcccgccgccctggcctttcacctcaccagcagggacggcgaaccccggatgatagtaggcaagaacgagcggggcaagagcctcttgttcaagaccgccagcgggatcaacatgtgtacccttatagcgatggacctgggggagatgtgcgatgacaccgtgacctacaagtgcccccacatcacggaggttgagcccgaggacatcgactgctggtgcaatctgacgagcacctgggttacgtacggtacctgcaaccaggctggcgagcatcggcgcgacaagcgatccgtggcgctcgcgccccatgttgggatggggctggatacccgcacccagacctggatgagcgccgagggcgcctggcgccaggtggagaaagtcgagacctgggcactgaggcacccggggttcaccatactcgcgctattcttggcccactatatcggcacatcgctcactcagaaagtggtaatcttcatcctgttaatgttagttacgccaagcatgacgatgcggtgcgtgggtgttggcaaccgcgatttcgtcgaggggctgtctggtgcgacatgggtggacgtggtcctggagcacggcgggtgcgtgaccaccatggccaagaacaagcccaccctcgacatcgagctgcagaagaccgaagccacacagctggcgacactccggaaactgtgcatcgaggggaagatcactaacataaccaccgacagccgctgccccacgcagggcgaggccactctgcctgaggagcaggaccaaaactacgtctgcaagcacacttacgtcgaccggggctgggggaacgggtgtggtttgttcggtaagggctccctggtgacctgcgctaagttccagtgcctggagccaatcgaaggcaaggtggtgcagcacgaaaacttgaaatacacggtaatcatcactgtgcacaccggggaccagcaccaggtcggcaacgaaacccaaggggttacggccgaaatcacgccccaggctagcaccacggaggcgatcctccccgagtacggcaccctggggctcgaatgctcgccgcgcaccggtctggacttcaacgaaatgatccttctcaccatgaagaacaaggcgtggatggtccatcgacagtggttctttgacctgcccctgccctggacctctggggccaccacggaaacccccacatggaacagaaaggagctcctcgtgacctttaagaatgcgcacgcgaagaagcaggaggtggtcgtgctgggctcccaggaaggcgcgatgcacaccgccttgacgggggccaccgagatccagaactcaggcggcacctccatcttcgcaggccacctcaagtgccgcctgaaaatggacaagttagaactaaagggcatgagctacgcaatgtgtacgaatacgttcgtgctgaagaaggaggtctccgaaacgcagcacgggaccatcctaatcaaggtcgagtacaagggtgaggatgtgccgtgcaagatccccttcagcacggaggatggacaaggaaaggcccacaacgggcgcctcatcactgccaaccctgttgtgactaagaaagaggagcccgtgaacatagaggcggagcctcccttcggtgagtcaaacatcgtaatcggcatcggcgacaacgccctcaagatcaattggtataagaaggggtccagcatcggaaagatgttcgaggccaccgccagaggtgccagacggatggccatcctgggcgacaccgcctgggacttcgggtcggtgggaggggttctcaacagccttggcaagatggtccaccagatcttcgggtccgcgtacaccgccctgttctcaggagtgtcctgggtgatgaagatcggtattggtgttctccttacctggataggcctgaacagtaagaacacgtccatgagcttctcctgcattgccatcgggattatcacactctacctgggcgcggtagtgcaggccgacatggggtgcgtcatcaactggaaaggcaaggagctaaagtgcggcagcgggatcttcgtgaccaacgaggttcacacctggactgaacagtacaagtttcaggcggattcacccaaacgcttagccacggccatcgccggcgcctgggagaacggtgtctgtggcatccgcagcaccactcggatggagaacttactctggaaacagattgcgaacgagctcaattacatcctgtgggagaacaacataaagctgacggtggtggtcggcgatataatcggcgtgctcgaacaagggaagaggacgctcactccccagccgatggagctgaagtactcctggaagacctggggaaaggcgaaaatcgttaccgctgagacacaaaattcgtcgttcatcatagatggtcccaatactcccgagtgtccctccgtctccagggcatggaacgtatgggaggtggaggactacggattcggggtgttcacgaccaacatttggcttaagctgcgcgaggtatacacccagctatgcgatcatagactcatgagcgcggccgtgaaggacgaacgcgccgtccacgctgacatgggctactggatagagtctcaaaagaacggctcctggaagctagagaaggctagcctaatcgaggtcaagacgtgcacctggccgaagtctcacactctgtggagcaacggagtgctggagtccgacatgatcattcccaaaagcctggcaggtcccatctcccagcacaaccaccggcccggctatcacacgcaaacggccggaccctggcacctaggcaagttggagctggacttcaactactgcgaaggtaccacagtcgttatcacagaaaactgcgggacccgcggcccctcccttaggaccacaacagtgtccggtaagctgatccacgaatggtgctgccgcagttgcacgctacccccgctgcggtacatgggcgaggatgggtgttggtacggcatggaaatccgccccatctccgagaaggaggagaacatggtcaaaagcctggtttccgccggaagcggaaaggtggataacttcacgatgggcgtgctttgtctcgccatcctgttcgaggaggtgatgcgggggaagttcggcaaaaagcacatgatcgccggggtgttcttcacatttgttctgctcctgagtggccaaatcacctggagagacatggcgcatacactgattatgatcgggagcaatgcctccgacaggatgggaatgggcgtaacatacctcgcactgatcgccaccttcaagatccaacccttcctcgcactcgggtttttcctgaggaaactgaccagccgggagaatctcctcctcggcgtgggcctcgcgatggccacgactctgcagctgcccgaggacatcgagcagatggctaatgggattgctctcggcctgatggctctgaagctcataacccaatttgagatatatcagctgtggaccgcccttataagcctcacgtgcagcaacactatcttcaccttaaccgtcgcctggcgcacggccacactgattctcgccggggtgtcactgctgccgatgtgccagtccagctccatgcggaagaccgattggctgcccatggctgttgccgccatgggcgtgccgcctctccctctgttcatatttagcctcaaagatacacttaaacgccgctcctggcccctgaatgaaggcgtgatggccgtcggccttgtgtcaatactggcttccagcctcctccggaatgatgtgcccatggcgggccccctggtcgccgggggcctgctcatcgcgtgttacgtaatcaccgggaccagtgccgacctgaccgtggaaaaggccgcggacattacctgggaggaggaggccgagcagacgggagtcagtcacaacctgatgattactgtggatgatgacgggaccatgcgtatcaaggacgacgaaaccgagaacatcctcactgtgttactcaagacggccctcctgatcgtctcaggcatttttccatacagcatcccggccactctgttagtgtggcacacctggcaaaaacaaacccagcgttccggcgtgctgtgggacgtcccctcgccacccgagacgcaaaaggcggagctggaagagggggtctatagaatcaagcagcagggcatatttgggaagacccaggtgggcgtcggggtgcaaaaggaaggcgtgttccacaccatgtggcacgtcactcggggcgctgttctcacgtacaacggaaagcgcctggagcccaattgggcctccgtgaagaaggacttgatttcatacggcgggggctggcgcctatccgcccagtggcagaagggtgaggaggtccaggtgattgccgtggagcccggtaagaacccaaagaacttccagacaatgcctggaaccttccagaccacgaccggggagatcggcgcgatcgcgttggatttcaaacccggcaccagcggcagccccatcataaaccgcgagggaaaggtcgtaggtctgtatggcaacggcgtggtcaccaagaacggcgggtacgtgagtggaatagcccagaccaacgccgagcctgacggtcccacccccgaactggaggaggaaatgttcaaaaagcggaacctcaccatcatggacctgcaccccggatcgggtaagacgcgcaagtacctgccggccattgtgcgggaggcgatcaagcgccggctccgcacattgattctggcccccacccgggtcgttgcagctgaaatggaggaggccctcaaggggctgcctatccggtaccagaccactgcgacgaagtcggagcataccggccgagaaatcgtggacttgatgtgtcatgccaccttcaccatgcgcctcctgtcccctgtccgggtgccgaactacaacctgatcataatggacgaagcccacttcacggaccccgcctcgatcgccgcacgcggctacatcagcacacgggtaggcatgggcgaggccgcggccatcttcatgaccgcgacgcctccggggacggctgatgccttcccgcaatccaacgcccccatccaagacgaggagagggacattcccgagcgcagctggaactccggaaacgagtggatcaccgatttcgccgggaagaccgtctggttcgttcccagcatcaaagctggcaacgacatcgcgaattgccttcggaagaacggcaaaaaggtcatccagttgtctcgcaagaccttcgataccgagtaccagaagaccaagttgaacgactgggacttcgttgtaactacagacatttcggagatgggcgcgaactttaaagccgaccgggtaatcgatccgcgccggtgcctaaagcccgtcatcctgacggacggccctgaacgcgtaatcctggccggcccaatgccggtgaccgcggccagtgccgcccagaggaggggccgggtcgggcgcaatccccaaaaggagaatgatcagtacatatttactggacagcccctcaacaacgacgaggaccacgcccactggacagaagcaaagatgttactggacaatatcaacaccccagaagggatcatcccggccttatttgagcccgagcgggagaagtccgccgcgatagacggcgagtaccggctgaagggggagtcacggaagacgtttgtggaactcatgcgccgcggggacctccccgtctggctggcgcacaaggtagccagcgagggaatcaaatacacggaccgcaagtggtgtttcgacgggcagcggaacaaccagattctcgaggaaaacatggacgtggagatctggacaaaggagggcgagaagaagaagttaaggccccggtggctggacgcccgtacctactccgacccgctggctcttaaggagttcaaagagttcgccgcggggcgcaagagcatagccctggacttggttacggagatcggccgggtaccctctcacctcgcccaccgcacccgcaacgccttagacaatctagtgatgcttcataccagcgagcacggcgggcgcgcatatcggcacgccgtagaggagttgcccgagacgatggagacgctgctcctgctgggcctcatgatccttctgactgggggcgccatgctctttctgataagtgggaaagggatcggcaagacctctatcggccttatctgtgtgatcgccagctccggcatgctctggatggccgaaataccgctgcaatggatcgcgagcgcgatcgtgctggagttcttcatgatggttctcctgatccccgaacccgagaagcagcgcacgccccaggacaaccaattggcctacgtcgtgatcgggattctaacgctggccgccatcatcgctgcgaacgagatgggtctgctcgagaccacgaagcgggaccttggcatgtccaaggagccgggggtcgtgtcccccacctcctatcttgatgtcgacctccaccccgccagtgcctggacactgtacgccgtggcgacaaccgtgataacacccatgctgagacacacgattgaaaattccacggccaacgtgagcctcgccgccatcgccaaccaggcggtcgttctgatgggcctggacaagggttggccgatctctaagatggacttaggtgttcccctgctggcgctcgggtgctacagccaggtcaaccccctgaccctgaccgcggccgttctcctcctgatcacccattacgcaatcatcggccccggccttcaggctaaggccactcgggaggcccagaaacgcaccgccgcggggatcatgaagaaccccacagtggacggtatcatgacgattgacctcgacccggttatctacgactccaagttcgagaagcagctgggccaggtgatgttgctggtgctgtgcgtcgtgcagctcctgcttatgcgtacctcttgggccctctgcgaggccctgaccctagccaccggccccatcacgacgctatgggagggctccccagggaagttttggaacaccaccattgccgtgtctatggcaaacatcttccgcggctcctatctagcgggtgccggactggccttcagcatcatgaaatcagtcggtacgggcaagcgcggcactgggagccagggcgagacgttaggggaaaagtggaagaaaaagctgaaccagctctcgcgcaaggacttcgacctgtacaagaagagtggcatcaccgaggtggacaggaccgaggccaaagaggggctgaaacgcggcgaaataactcaccacgcggtgtcgcggggatccgccaagctgcagtggtttgtcgaacgaaacatggtcatcccggaggggagagtgatcgacctcggctgtggtcgcggcgggtggagctattactgcgccggcctgaagaaggtgaccgaagtgcggggctacaccaaaggagggcctggccacgaggagcccgtgccaatgtctacctacggttggaacatcgttaaactgatgagcgggaaggacgtattctatttacctcccgaaaagtgcgacactctgctatgcgacatcggtgaatccagcccctccccaaccgtagaggagtcacgtaccatccgcgtcctaaagatggtggagccgtggctcaagaacaaccagttctgcatcaaggtactgaatccctatatgcccaccgtcatagagcacctggagcggctccagcgcaagcacggcggtatgttagtgagaaatcccctttctcgcaacagcacgcacgaaatgtactggatctcaaatggcaccggcaacatagtcgcaagcgtgaacatggtgtcccggctcctgctgaaccgcttcacgatgacccatcggcgcccaacgatcgagaaagatgtggatctaggcgccggcaccaggcacgtcaacgcggagcccgagactccaaacatggacgtgatcggggagcggataaaacggatcaaggaggagcacaactcaacctggcaccatgacgacgaaaacccgtacaagacgtgggcctaccacggctcatacgaggtgaaggccacagggtccgcaagcagcatgattaacggcgtcgttaagctccttactaagccctgggatgtggtacccatggtgacccagatggccatgacggacaccacccccttcggacagcaacgtgtcttcaaggagaaagtagacactcggaccccgaggtccatgcccggcaccaggcgcgtgatgggtattacagcggagtggctatggcggacactggggcgcaacaagaagccccggctgtgtactcgagaggagttcaccaaaaaggtccgcaccaatgccgcgatgggggcggtgttcactgaggagaaccagtgggattccgcaaaggccgccgtggaggatgaggacttttggaagctggttgaccgcgagcgcgagctgcacaaacttgggaagtgcggcagttgcgtgtacaacatgatggggaagcgggagaaaaagttgggtgagttcggcaaggcgaagggatcacgcgccatctggtacatgtggctgggcgcgagatacctggagttcgaggccctcggctttctgaacgaggaccactggttcagccgcgaaaattcctacagcggcgtggaaggggagggcctgcacaagctaggctatatcctgagggatatctccaagatccctgggggtgccatgtacgctgacgacacggccgggtgggatacccgtatcaccgaagacgacctgcacaacgaggagaagatcacccagcagatggatccggagcatcgtcagttagctaatgccatcttcaagctgacgtaccagaacaaggtcgtcaaggttcagcgccccaccccgaccggcacagtaatggatatcattagccgtaaggaccagcgcggctccggtcaagtcggtacttacggcctgaacacattcacaaacatggaggcacaactcatccggcaaatggagggcgaaggggtgctgtctaaggcggatcttgagaacccccacctaccggagaagaagatcacccagtggctagagacaaagggcgtcgaacgcctgaagcggatggccatatccggcgacgattgtgtggtcaagcccatcgacgaccgcttcgcgaacgcattgttagctctgaacgacatgggcaaggtccggaaagacatacctcagtggcagccttctaaaggctggcacgactggcagcaagtcccgttctgctcacaccatttccacgagttgataatgaaggacgggcgcaagctggtggtaccgtgccggccgcaggacgagctgatcgggcgcgcccggatcagtcagggggccggttggtctctcaaggagacggcgtgcctaggcaaagcctacgcccagatgtggagcctgatgtatttccatcgccgtgacctccgactcgcgtccaatgctatctgctcagccgttcctgtacactgggtcccgacaagccgcaccacctggagcatacacgcgcaccaccagtggatgacgactgaggatatgctgaccgtgtggaaccgcgtctggatcgaggataatccctggatggaggacaagacacccgtaacgacctgggagaacgtcccgtacctcgggaagagggaggatcagtggtgcgggagcctgatcggcctgacctccagagcgacctgggcccagaacatcccgaccgccatccagcaggtcaggagcctcattggcaacgaggagttcctggactacatgccttccatgaagcggttccggaaagaggaggaaagcgagggggcaatctggtga

SEQ ID NO: 25839 - RNA, 9873 nt, synthetic construct
  misc_feature 1..9873: note = derived and/or modified CDS sequence (opt11) from DENV-3__HQ671176__SS-prME
  source 1..9873: mol_type = other RNA
acgtctctctgcctcatgatgatattgccggccgcattggcgtttcacctgaccagccgggacggcgaaccccgcatgatcgtggggaagaatgagcggggcaagtctctgctgttcaagaccgcctccgggatcaacatgtgtaccctaatcgccatggacctgggggaaatgtgcgacgacaccgtgacgtacaagtgcccccacatcaccgaggtggaacccgaagacatcgattgctggtgcaacttgacatccacctgggtgacctatggaacctgcaaccaagccggggaacaccggcgcgacaagagatccgtggccctcgcgccccacgtgggcatggggctggatacccgcacccagacctggatgagcgccgagggcgcctggagacaagttgagaaggtcgagacctgggcgctgcgccacccggggttcacaatactcgcgctgttcctggctcactatatagggacctccttgacgcagaaggtggtgatcttcatactgctgatgctcgttacgcccagcatgaccatgcgatgtgtgggcgtggggaaccgcgacttcgtcgaaggcctatccggggcgacctgggttgacgtcgtactggagcacggagggtgcgtcacgacaatggccaagaacaagcccaccctagatatcgagctgcagaagaccgaggccacccagctggcgacgttacggaagctgtgcatcgagggcaaaatcactaatataaccaccgactctcggtgccccacgcagggagaggccaccctgccggaggaacaggaccagaactacgtgtgtaaacacacctacgtcgaccgcggatggggcaacgggtgtggcctctttggaaagggctcgcttgtgacttgcgccaaattccagtgcttagagcccatcgaaggcaaggtggtccagcacgaaaacctcaaatacacggtgatcataactgtgcacaccggtgaccagcatcaagtcggcaacgagactcagggggtaacggccgagatcacgccacaagccagcacgaccgaggcgatactgcccgaatatggcaccctgggactcgagtgctccccgaggacgggcctagacttcaacgagatgattctgctcaccatgaagaacaaggcgtggatggtccatcgtcagtggttctttgacctacccctcccctggaccagcggcgcgaccacggagacccccacgtggaacagaaaagagttgcttgtgaccttcaagaacgcccatgccaagaagcaggaagtggtcgtgctcgggagccaggagggtgcgatgcatacggccctcaccggggccaccgagatccagaacagcggagggacctccatctttgcaggccatctgaagtgccggcttaagatggacaagctggagctgaagggcatgagctacgcgatgtgtacgaacacgttcgtgctgaaaaaggaggtcagcgaaacccaacatgggacgatacttataaaggtggaatacaaaggcgaggacgtgccgtgcaaaatcccgttcagcacggaggatggtcagggcaaggcccacaacggcaggctaatcacggctaaccccgtcgtgaccaagaaggaggaacctgtgaacatcgaagccgagccgcccttcggggagagcaacatcgtcatcggtatcggggacaacgccctgaagatcaattggtataaaaagggctccagtatcgggaagatgttcgaggcgaccgcccgtggcgcccgacggatggccattctgggcgacactgcctgggactttgggtcagttggcggggtcctcaactccttggggaaaatggttcaccagattttcggatccgcgtacaccgccctgttctcaggtgtctcctgggtcatgaagattggcatcggggtcctcctgacatggatcggcctgaactcgaagaacacctcaatgtcgttttcatgcatcgcaatcggcataatcacgctctacctgggcgccgtggtgcaggccgacatgggctgcgtaatcaactggaagggcaaagagctgaaatgcgggtctgggatcttcgtgaccaacgaggtgcacacctggaccgagcagtataagtttcaggcggactccccaaagagactcgccacagccatcgccggcgcctgggaaaacggggtctgcggcatccgcagcaccacccggatggagaatctgttgtggaagcagatagcgaacgagcttaactatatcctgtgggaaaacaacattaagctaaccgtggtggtcggggatatcatcggtgtgttagagcagggcaaaaggacattgacgccccagccgatggaattgaagtattcctggaagacgtggggcaaagccaagatcgtgaccgcagagacgcagaactcgtcctttatcatcgacggccccaatactcccgaatgccccagtgtctcaagagcctggaacgtctgggaggtggaggactacgggtttggtgtttttacgaccaacatttggctcaagttacgcgaggtgtatacccagttatgcgaccaccggctaatgagcgcagccgttaaggacgaacgtgcagtccacgccgatatgggctactggatcgagtcacaaaagaacgggtcctggaagctggagaaggcgtcgctgatcgaggtgaaaacgtgcacctggccgaagtcccataccttatggagcaacggtgtcctggaatccgacatgatcattcccaaaagcctggccgggcccatctcccagcataatcacaggcccggataccacacgcagacggccggtccatggcacctcggtaagctggaactggatttcaactactgcgagggcaccactgtagtgatcacagagaattgcggaactcgaggtccgagccttcggacaacgacagtgtctgggaaacttattcacgagtggtgctgtcggagctgcacgctacccccgcttcggtacatgggcgaggacgggtgctggtacggcatggaaatccgccccatctccgagaaagaggagaatatggtcaagtccctagtgtccgccggatcggggaaggttgacaacttcaccatgggcgtgctgtgcttggccatcttattcgaggaagtgatgcgggggaagttcggcaagaaacacatgatcgcaggagtattctttacctttgtcctgctcctgagtggtcaaattacttggcgcgacatggcgcatacgctgataatgattggcagcaacgcctccgaccggatgggtatgggagtgacctaccttgccctgatcgcaaccttcaagatccagccgttcttggcattggggttcttcctacgcaagctgacctcccgggagaacctcctactgggagtggggctagcgatggccacgaccctgcagctgcccgaagacatagaacaaatggccaacgggatcgcgctcggcctgatggcgctcaagctcatcacccagttcgagatctaccaactgtggaccgccttaatcagcctcacgtgctcgaacaccatcttcactttaaccgtcgcctggcgcaccgcaacgctgattctagctggagtgagccttttaccgatgtgccagtccagctccatgaggaagaccgactggctccccatggcggtagccgctatgggcgtcccgccactcccgttattcatcttctcactaaaggacacgctgaagcgccgtagctggcccctgaacgagggggtgatggccgtagggctcgtgtcgatcctggcctcttcgctgctacgaaacgatgtgcccatggcaggccccttagtcgccgggggtttactaatagcttgttacgtaatcacgggaacatccgccgacctaaccgtggagaaggccgccgatatcacctgggaggaggaggccgagcaaacgggcgtcagccacaacttaatgataaccgtggacgacgacgggactatgaggataaaggacgatgagacggagaacattctcaccgtactgctgaagacggccctgttaattgtcagcgggatctttccgtatagcatccctgccaccttgctggtgtggcacacctggcagaagcagacgcagcggtccggcgtcttgtgggacgtccccagcccgcccgagacgcagaaggccgaactggaggaaggggtgtaccgcatcaagcagcaaggtatcttcggtaagacccaggtgggggttggggtgcagaaggagggcgtctttcatactatgtggcatgtcacacggggtgcggtgctcacgtacaacgggaagcgcctagagccaaactgggcctccgtgaagaaggatctgatctcgtacggcgggggctggcggctcagtgcccaatggcagaagggagaggaggtccaggttattgctgtggagccaggcaagaaccctaagaacttccagacgatgcccggcacctttcagaccacgaccggcgaaatcggcgcgattgccctcgatttcaagcccgggacatcgggcagcccaattatcaaccgagagggaaaggtcgtggggttatacggaaacggggtggtgaccaagaacggcggctatgtgtccggcatcgcgcagaccaacgccgagccggacggacccacgccagagctcgaggaagagatgttcaagaaacgaaatttaaccatcatggatctgcatcccgggtccggaaagacgcgcaagtacctacccgccatagtaagagaggcaataaaaaggcggctccgtacgcttatcctggcacccacccgagtcgtagcagctgagatggaagaagccctgaagggcctgcccatacggtaccagaccaccgcgactaagtccgagcacaccggccgtgagattgtcgacctgatgtgccacgccaccttcaccatgcgcttactgagcccggtccgggtacccaactacaacctgatagtgatggatgaggcccacttcacggaccccgcctccatcgcggcgcgcggatacattagcacccgggttggcatgggcgaggccgccgccattttcatgactgcgacgccgcccgggacggccgacgccttcccgcaatccaacgcccccatccaggacgaggagcgtgatatccccgagcgctcatggaactccggaaatgagtggataaccgactttgcgggaaaaaccgtatggttcgttcccagcattaaggcgggcaacgacatcgcaaactgtctccggaaaaacgggaagaaggtcatccagctgtcccgaaaaaccttcgacacggagtaccagaagacaaaactcaacgactgggacttcgtagtgacaaccgatatcagtgagatgggagccaactttaaagcagaccgggtcatcgacccgagaaggtgcctcaagcccgtgatcctgacggacggcccggagcgcgtgatcctcgccgggcccatgccggtaaccgctgcctccgctgcacagcggcggggcagggtggggcggaacccccagaaggagaacgaccaatacatctttaccggccagcccctcaacaacgacgaggatcatgcccattggaccgaggcgaagatgctgctggacaatatcaatacccccgaaggtatcatcccggcgctattcgagcccgagcgggagaagtccgccgctatcgacggcgagtaccgcctgaagggcgagtcccggaagactttcgtggagctgatgcgccgcggcgacctaccagtctggctggcgcacaaggttgcctcagagggcatcaagtacaccgaccgtaagtggtgcttcgacgggcagcggaataaccagattctggaagagaacatggacgtcgagatctggaccaaggagggtgagaagaagaagctgcgtccgagatggctggacgcccgcacctactccgacccgttggctctcaaggagttcaaggagttcgccgctggccgcaaaagcatcgccttagaccttgtgacggagatcgggcgagtgccgtcccacctcgcccatcgtaccaggaatgccctcgacaacctggtgatgttacacaccagcgagcacggcgggagagcgtaccgtcacgcagtggaggagctgccagagacgatggagacgctgctcctcctgggcctcatgatcctgttaaccgggggcgccatgctgtttcttatcagcggcaaagggatcggcaagacttccatcgggctgatctgcgtgatagccagctccggcatgctatggatggcagagatcccgctgcagtggatagcctccgcgatcgtcctggagttcttcatgatggtgctcctaatccccgagcccgaaaaacagcgcaccccacaggacaatcagctcgcatatgtagtcatcggcatcctcacactggcagccatcatcgccgccaacgagatgggcctgcttgagaccactaagcgtgatctgggaatgtctaaagagccgggggtcgttagccccacctcctacctggacgtggacctacaccccgcttcagcctggaccctgtacgcagtggcgaccaccgtgatcacacccatgctgaggcacactattgagaactcgactgccaacgtcagcttggccgcgatcgcaaaccaagcggttgtgctgatgggcttggacaaggggtggccgatttccaagatggacctcggcgtccccctgctggccctcgggtgctactctcaggtgaaccccctaaccctgactgccgcggtgcttctgctgatcacgcactacgcgatcatcggccccggcctccaggcgaaggccacccgggaggcccagaaacgtaccgccgccgggatcatgaagaaccctaccgtcgatggcattatgaccatcgacctggaccccgtcatctacgattcgaagttcgagaagcagttaggacaggtgatgttattagtcctgtgcgcggtgcagctccttctcatgagaaccagctgggctctctgcgaggccctgaccctggccacgggccccattacgaccctctgggagggctctcccgggaagttctggaatacaacaatcgcggtaagcatggccaacatttttcgcggcagttacctggcaggggccggcctggccttcagcatcatgaagtccgtcgggacaggtaagaggggcaccggcagtcaaggagagacgttaggggagaagtggaagaagaaacttaaccagctatctcggaaagacttcgacctctacaagaaatccggcataacggaggttgaccggactgaggccaaagagggcctgaagcgcggagagattacgcatcacgccgtgtcacgtggcagtgccaagctacagtggttcgttgaacgcaacatggtcataccggagggacgggtcatcgacctcgggtgcggaagaggcggttggagctactattgcgcggggctgaagaaggtcaccgaggtgagagggtacacaaaaggagggccggggcacgaggagcccgtgcctatgtcaacctacggctggaatatcgtgaagttgatgagcgggaaggatgtgttttacctcccgcccgagaagtgcgatacgttgttgtgcgacatcggggaatccagcccctcgcccaccgtggaggaaagcagaaccattagagtcttgaagatggtggagccgtggctcaagaacaaccaattctgcatcaaggtattaaatccttacatgcccaccgttatagagcatctggagcggctgcagcggaagcatgggggaatgctggttcggaacccgcttagccgcaatagcacgcacgagatgtactggatatccaacggtacggggaacatagtggccagcgttaatatggtgtcacgactcctgctgaatcgctttacaatgacccaccgtaggcccacaatagagaaggacgttgacctcggcgcgggcacccgtcacgtcaacgccgagcccgagacccccaacatggacgtgatcggcgaaaggataaagcgtatcaaggaggagcataactcgacgtggcactatgacgacgagaacccgtacaagacgtgggcataccacggctcatacgaggtgaaggccactgggagcgcgagttccatgattaacggcgtcgtgaaactgctcaccaagccctgggatgtggtgcccatggtgacccagatggccatgacggacactacccccttcggccagcaacgcgtctttaaggagaaggtggatacgcgaacgccgcgcagcatgcccggcacccggcgcgtgatgggcatcactgcggaatggctctggagaaccctggggaggaataagaagccgcggctgtgcacgcgcgaggagttcaccaagaaggtcagaactaacgctgctatgggggccgtgttcaccgaggagaaccagtgggacagtgccaaagcggccgtcgaagacgaagacttctggaagctcgtcgaccgggagcgcgagctgcacaaacttgggaagtgcggaagttgcgtgtacaacatgatggggaagcgggagaagaaactcggcgagttcggtaaggccaaggggtctcgcgcgatctggtatatgtggttgggcgcccggtacctggagtttgaagccttagggttcctgaacgaagaccactggttcagccgcgaaaattcctacagcggagtggagggggagggtttgcacaagctcggctacatcctgcgggacataagtaaaattcccgggggcgccatgtacgcggacgacaccgcagggtgggacacccgtatcactgaggacgacctgcacaacgaggagaagatcacccagcagatggacccggaacaccgccagcttgccaatgccatattcaagctgacataccagaacaaggtcgttaaggtacagagaccgaccccaaccggcaccgtcatggacataataagccggaaggaccagcgcgggtccgggcaggtcggcacctacggcctgaacacgtttaccaacatggaagcccaactcatcaggcagatggaaggtgagggggtgctgagcaaggccgacctagagaatccccacctcccggagaagaagatcacccagtggctggagaccaagggcgtcgagcgcctgaaacggatggcgatctccggcgacgattgcgtcgttaaacccattgacgaccgcttcgccaatgccctcctagccctgaacgacatggggaaggtccggaaggacatcccccaatggcaaccgtcaaagggctggcacgactggcagcaggttccgttctgctcccaccacttccacgagctgatcatgaaggacgggcgtaagctggtcgtcccctgccggccccaggacgagcttattggcagagcccggatcagccagggtgctggctggagcctcaaagagactgcatgcctggggaaagcctacgctcagatgtggtctctcatgtacttccaccgacgcgacctccggctggcgtcgaatgccatctgctctgccgtccccgtccactgggtccctacctcgcgcacaacctggagcatccacgcccaccaccaatggatgacgaccgaggacatgctgaccgtgtggaaccgggtgtggatagaggataacccctggatggaagacaagacgccggtcacgacctgggaaaacgtgccctacttagggaagcgcgaggaccagtggtgtgggagcctgatcgggctgacctcccgagccacctgggcgcagaacattccgacggcgatccagcaggtacgctcgctcataggcaacgaggagttcctggattacatgccctccatgaagcggtttcgcaaggaggaggagagcgagggtgccatctggtga

SEQ ID NO: 25840 - RNA, 9873 nt, synthetic construct
  misc_feature 1..9873: note = derived and/or modified CDS sequence (opt11) from DENV-3__HQ705609__SS-prME
  source 1..9873: mol_type = other RNA
accagcctctgcttaatgatgattttacccgccgccctggcgttccacctcaccagccgagacggggagcctcgaatgatcgtggggaagaacgagcgcggaaaaagcctgctgttcaaaaccgcgtccgggatcaatatgtgcaccttgatcgccatggacctgggcgagatgtgcgacgacaccgtgacctacaagtgcccgcacataaccgaagtggaacccgaggacatcgactgttggtgcaacctgaccagcacctgggtgacttacggtacctgcaaccaggctggcgagcaccggcgcgacaaacgctccgtggcgctcgcgccgcacgtaggcatggggctggacacgcgaacccagacctggatgtctgctgaaggcgcatggcggcaggtcgaaaaggtggaaacgtgggccctccgccacccggggtttaccatcctcgcactattcctggctcactacatcggcacctccctcacccagaaagtggtgatcttcatcctgctgatgctcgtcacccccagcatgacgatgcggtgtgtgggggtgggcaaccgagacttcgtcgagggcctgtcaggggccacctgggtggatgttgtccttgagcacggcgggtgcgtgaccacgatggccaagaataagcccaccttagacatcgagctgcagaaaaccgaggccacgcagctcgccacgctccgcaagctgtgcattgagggcaagatcaccaacataacaaccgacagccgctgccccacgcagggcgaggccaccttgccggaggagcaggaccaaaactacgtgtgcaagcacacctacgttgaccgcgggtggggcaacgggtgcggcctctttggtaaaggctcactggtgacctgcgccaagtttcagtgcctggagcccatcgagggcaaggtagtacagtacgagaacctcaagtacacggtgatcatcaccgtccacaccggggaccagcaccaggtcggcaacgagacacagggggtgacggccgaaataacaccccaggccagtactaccgaggcaatccttcccgagtacgggaccttaggtctcgagtgctccccgcgcacgggcctggatttcaatgagatgatcctgctaaccatgaagaacaaggcctggatggtccaccggcagtggtttttcgacctgccactgccttggaccagtggcgccacgaccgagacacccacctggaaccgcaaggagctactagtgacttttaagaacgcccacgccaagaagcaagaagtggtcgtgctggggtcccaggagggcgctatgcatacggccctcaccggggccaccgagatccagaacagcggggggacctccatcttcgccggacacctcaagtgccgactgaagatggataagctcgagctgaagggcatgagctatgccatgtgcaccaacacatttgtgttgaagaaggaagtctccgagacccagcacggtacaatcctcatcaaagtcgaatacaagggcgaggatgtcccatgcaagattcccttcagcacggaagatgggcaaggtaaagcacacaacggccgcttaataactgccaaccccgtcgttactaagaaagaggagccagtgaacatcgaggccgagccgcccttcggggagagcaacattgtcatcggcatcggggacaacgccctgaagatcaactggtataagaagggctccagcatagggaagatgttcgaggcgaccgcacgtggcgcgcgacggatggccatactgggggacactgcctgggacttcgggagtgtgggcggggttctcaacagccttggcaagatggtccaccaaatcttcgggtctgcctacaccgccctgttcagcggcgtgtcctgggtcatgaagatcggcatcggagtcttactgacctggatcgggcttaacagcaaaaacacttccatgagcttctcttgcatcgccatcggaatcatcacgctctacctgggcgccgtcgtgcaggcggacatggggtgcgtcgtaaactggaaaggcaaggagctcaaatgcggtagcgggattttcgttaccaacgaggtacatacttggaccgagcagtacaaattccaggcggactcccctaaacgcttagccacggccatcgcgggggcttgggagaacggggtgtgcggcataaggtccaccacccggatggagaatctgctgtggaagcagatcgcgaatgagctgaactacatcctgtgggagaacaacattaagctgaccgtagttgtgggtgacatcatcggggtactggaacagggcaagcgcacattaaccccgcaacctaaagaactgaagtacagttggaaaacctggggaaaggccaagatcgtcaccgccgagacgcagaacagctcgtttatcatcgacggccccaacacccccgaatgcccaagcgtctcccgggcctggaacgtttgggaggtggaggactacggttttggggtgttcacaactaacatatggttgaagctcagagaggtctacacccagctgtgcgaccatcggctcatgagcgcggccgtgaaggatgagcgcgccgtgcatgcggatatgggttattggatcgagtcgcagaagaatgggtcttggaagctcgagaaagcaagcctcatcgaggtgaagacgtgcacgtggccaaaaagtcacaccctctggagcaacggcgtcctggaatccgacatgatcatcccaaagagcctggcggggcccatatcccagcacaatcaccgtccgggctaccacacccaaacagccgggccctggcacctcggcaaactggagctcgacttcaactactgtgagggcactaccgtagtaatcaccgagaactgtgggactcgcggacccagtctccggaccacaacagtctccgggaaactgatacacgagtggtgctgccgcagctgcacgttgccgccgttgagatacatgggtgaagacgggtgctggtacggcatggagatccgtcccatctccgaaaaggaagagaacatggttaagagcctggtttccgcgggcagcggtaaggttgacaactttaccatgggtgtgctgtgcctcgccatcctgttcgaggaagttatgcggggcaagttcggcaagaagcatatgattgctggggtcttcttcaccttcgtcctgctcctgtccggccagatcacctggagggacatggcgcatacgctgattatgataggcagtaacgccagcgaccgaatggggatgggcgtgacctacctcgccctgattgctaccttcaaaatccagcccttcctggctctcgggttttttctgaggaagctgaccagcagggagaacctcctactcggcgtcggcctcgcaatggccactaccctacagttacctgaggacattgagcagatggcaaatgggatcgccctcggcttgatggcgttgaaattgatcacccagttcgaaacctaccagctgtggacagctctcatcagcctgacctgcagcaacacaattttcacgctgacggtggcctggcgcaccgcaaccttaatcctagccggtgtgtcgttattaccggtgtgtcagtcctcatccatgcgtaaaacggactggctccccatggcggtggccgccatgggcgttccgcccctccctctgtttatttttagcctaaaggatacgctgaagcgccgctcctggcctctgaatgaaggggtgatggccgtcggtctcgtctcgatcctggcctcctccctgctccggaacgacgtgccgatggcgggcccccttgtggccggggggctgctcatcgcctgttacgtcatcaccgggactagcgcagatctgaccgtggagaaggcggcggacatcacatgggaggaggaagctgagcagaccggcgtgagccacaacctgatgattaccgtcgacgacgacgggaccatgcgcatcaaggacgacgagaccgagaacatcctcacggtgttactgaagaccgcactcctgatcgtgtccggcatcttcccgtacagcatcccggccaccctgttggtctggcacacatggcagaagcaaacgcagcgatccggcgtactttgggacgtgcccagcccgcccgagacccagaaagccgagctcgaagaaggggtctaccgcatcaagcaacagggcattttcgggaagacccaggtgggagtaggagtccagaaggagggcgtgttccacaccatgtggcacgtcacgaggggcgcggttcttacctacaacgggaagaggctggagccgaactgggcgtcagtgaagaaggatctgatcagctacggcggcggctggcgactctccgcacagtggcagaagggggaggaggtgcaggtcatcgccgtggagcctggcaagaaccccaagaacttccagacgatgcccggcaccttccagacgaccaccggggagatcggcgcgatcgcacttgacttcaagcccggcaccagcgggtcgccgatcatcaaccgcgagggcaaggtcgtcgggttgtacggcaacggggtggtgacgaagaacggtgggtacgtgtccggcatcgcccagacaaatgcagagccggacggccccactcccgaactggaggaggagatgttcaagaagcggaacctcaccatcatggaccttcaccccgggtcgggaaaaacgcgcaagtacctgccggctatcgtgcgggaagcgataaagagacggctacggaccctgatcttagcccccacacgagttgtcgcggccgagatggaagaagccctcaaggggctgcccatccgctaccaaaccacagcgactaagtctgagcacactggccgggagatcgtggacctgatgtgtcatgccaccttcacgatgcgcctgctgtcccccgtacgagttccgaattataacctgatcatcatggatgaggcgcacttcaccgatcccgcctccatcgccgcgcgcgggtacatcagcacccgggtggggatgggcgaggccgccgctattttcatgaccgcgacgccgcctgggaccgcggatgcctttccgcagtccaacgcccccatccaggacgaggagcgggacattcccgagcgcagctggaactccggcaacgagtggatcaccgacttcgcagggaagaccgtttggttcgtccccagcatcaaagcgggcaacgacatcgccaactgcctcagaaagaacggtaagaaggtgatccagctgtcccgcaagacgttcgacaccgagtatcaaaagaccaagctgaacgattgggacttcgtggtcaccacggacatcagcgaaatgggggccaacttcaaggccgatcgcgttatcgacccccggcggtgtctcaagcctgtgatcttaaccgacgggcccgagagagtcatactggcggggcccatgcctgtgactgcggccagcgccgcccagcggagaggccgggtgggtcgcaacccccagaaagagaacgaccaatacattttcaccggccagcccctcaacaacgacgaggatcacgcccactggaccgaggcgaagatgctgttagacaacatcaacacgcccgaggggatcatcccggccctcttcgagcccgagcgggaaaagtccgcggccattgatggggagtaccgtctgaagggcgagtcccgcaaaaccttcgttgagctgatgcgcagaggggacctccctgtgtggctggcgcataaggtagccagcgagggcattaagtataccgaccgcaagtggtgttttgacgggcagcggaataaccagatattagaggaaaacatggacgtcgagatctggaccaaggagggcgagaaaaagaaactccgcccccggtggctggacgccagaacgtacagtgaccctctggcgctcaaggaattcaaggagttcgcggcaggcaggaagtcaatagccctggacctggtgaccgagataggtcgagtcccgtcccacctcgcccaccgcacccgtaacgctttggacaatctggtaatgttgcatacgagcgagcacggcggccgcgcgtatcggcacgcggtggaggaattgcccgagacgatggaaaccttgctcctcctgggactcatgattctgctgacggggggcgccatgctctttctaatctcgggcaaagggatcggtaagacctccatcggactgatctgcgtcatcgccagctccggaatgctctggatggccgagatcccgctgcagtggattgccagcgctatagtgttagaattcttcatgatggtgctgctgatccccgagcccgagaaacagcgcacgccacaggataaccagctggcctatgtcgttattgggatactcaccttggcagccatcatcgccgcgaatgagatgggcctgctcgagacgacgaagagagatctgggcatgtccaaggagccgggggttgtcagccccacgtcctacctggatgtggacctccaccccgccagcgcatggaccctctacgccgtggcgacaacggtgatcacaccaatgctgcgccacaccatcgaaaacagtaccgcgaacgtgtcattggccgcaattgccaaccaggctgtggtcctgatgggcctagataagggatggccgatctccaagatggacctcggcgtgcccctgctggctctcgggtgctactcacaagtcaaccccttaaccctgacggcggccgttctcctgctgattacccactatgccatcatcggccccggcctccaggcaaaggccacccgggaggcccaaaagcgcaccgccgcggggatcatgaagaaccccacggtagacggcatcatgacgatcgacttagaccccgttatctatgactccaagttcgagaagcagctggggcaggtcatgctactggtgctctgcgcggttcagctcctgctgatgaggaccagctgggccttatgcgaagccctgaccctggcgaccggccccatcaccacgctctgggagggctcccctggaaaattctggaacactacgatcgcggtcagcatggccaacatctttcgcggctcctacctggccggtgcagggttagccttctccattatgaagtccgttgggaccggcaagcgggggaccgggtctcagggcgagacgctcggcgagaagtggaaaaagaagctgaaccagctgagccgcaaggacttcgacctctacaaaaagagcggtatcaccgaggtggaccggacggaggcgaaggagggtctgaagcgcggggagataacccaccacgccgtcagccgcggctccgcgaagttgcagtggtttgtggagcgcaacatggtgatcccggaagggcgggtcatcgacctggggtgcgggcgcggaggttggagctattactgcgccggcctgaagaaggtgaccgaggtccggggctatactaagggtggaccgggccacgaagagcccgtaccgatgtccacgtatggctggaacatagttaagctgatgagcggaaaggacgttttttacctcccgcctgagaagtgcgacaccctgctgtgcgacatcggcgagtccagcccctcccctatcgtagaagagtcaagaaccatcagagtgcttaagatggtggagccctggctcaagaacaaccagttctgcataaaggtcttaaatccctatatgcctaccgtgatcgagcatctggagcggctgcaacgcaagcacggcgggatgctggtgcggaatccgctgtcccgtaactctacacatgaaatgtattggatctccaatggcaccgggaacatcgtcgcatccgtgaatatggtgtcccggctcctgctgaaccgcttcaccatgacccaccggcgcccgacaattgagaaagacgtggacctcggcgcgggcacccggcatgtcaacgcagagcccgagacgcccaacatggacgtcataggtgagcgcatcaaacggataaaagaggaacacaacagtacctggcactatgacgacgagaacccgtataaaacatgggcataccacggctcctacgaggtaaaggccaccgggagcgcatccagtatgattaacggcgtggtcaagttgctgaccaagccctgggacgtggtgcccatggtcacccagatggcgatgacggacaccacccccttcggccagcagcgcgtgttccgggagaaggtggacacccgtactcctcggagcatgccgggcacccgccgggtcatgggtatcaccgccgagtggctctggcgcaccctgggccggaacaagaaaccacgcctgtgcacccgcgaggagttcaccaagaaagtgagaaccaatgccgccatgggagcggtcttcacagaggaaaaccagtgggactccgccaaggccgcggtcgaggatgaggacttctggaagctagtggaccgcgagcgggagctacacaagctggggaagtgcgggagctgcgtttacaatatgatggggaaaagagagaagaaattgggcgagttcggcaaggccaaagggtccagagcgatctggtacatgtggctgggcgcccgctacctggagttcgaggccctcgggttcctgaacgaggaccactggttctcccgggagaactcctatagcggcgtcgagggggagggactccataaacttggctatatactgcgcgatattagcaaaatacccggtggcgccatgtacgccgacgacactgcggggtgggacacaagaatcaccgaggatgaccttcacaatgaagagaagataacccagcagatggaccccgagcaccgccagctcgctaacgcgatcttcaagctgacgtaccagaacaaggttgtgaaggtgcagcgtccaacgccaaccggcactgtgatggacatcatcagtcgcaaggaccagcgaggctctggccaggtgggcacctacgggctgaacacgttcaccaacatggaggcccagctcattcgccagatggaaggcgagggggtcctgagcaaggctgatttagagaacccccacctcccggaaaagaaaatcacccagtggttggagaccaagggcgtggaacggctgaaacgcatggcgatctctggcgatgactgcgtggtaaaacccatagacgaccgtttcgccaacgcactcctggccctgaacgacatggggaaggtgcgcaaggacatcccccagtggcagccttcaaagggttggcacgactggcaacaagtacctttctgctcccaccacttccacgagttaatcatgaaggatgggcgaaagctggtcgtgccctgccgcccccaggatgagctgatcggccgggcccgcatcagccagggcgcgggctggtccttgaaggagacggcgtgcctggggaaagcgtacgcccagatgtggagcctgatgtactttcacagacgggacctccgcctggcgtccaatgccatctgctccgccgtgccggtccactgggtcccgacctcccggaccacctggtcgatacatgcccaccaccagtggatgacaaccgaagacatgctgaccgtgtggaacagagtctggattgaggataatccttggatggaggacaagacccccgtgacgacgtgggaaaacgttccatatctcgggaagcgtgaggaccagtggtgcggaagcctgatcgggctgacctcacgcgccacctgggcgcagaacattccgacggcaatccaacaagtccgtagcctcattggcaacgaggagtttctcgactacatgccctccatgaagagattccggaaggaagaggagagcgagggggcaatctggtga

SEQ ID NO: 25841 - RNA, 9873 nt, synthetic construct
  misc_feature 1..9873: note = derived and/or modified CDS sequence (opt11) from DENV-3__HQ705610__SS-prME
  source 1..9873: mol_type = other RNA
accagcctctgcttgatgatgatcctgcctgccgccctagcgttccacctcacctcacgggacggggagcccaggatgatcgtggggaaaaacgagcgtggaaaaagcctgttgtttaaaaccgcctccgggataaacatgtgcacacttatcgccatggacctgggggagatgtgtgacgacaccgtgacctacaaatgcccccacattaccgaggtggagcccgaggacatcgactgctggtgcaacctgaccagcacctgggtgacatacgggacgtgcaaccaagcgggggaacatcggcgggacaagcggtcagtggccttggcgcctcacgtgggaatggggctggacacccgtacacagacttggatgagcgcagaaggcgcctggcgccaggtcgaaaaggtcgaaacgtgggccctgaggcaccctgggtttaccattctcgctctgttcttagcccactacattggcacatccctcacccagaaggttgtaatcttcatactgctcatgctggtcaccccctccatgaccatgcggtgtgttggggtgggtaaccgcgacttcgtcgagggcctgtccggggccacgtgggtggacgtggtcttggagcacggcgggtgcgtgactacgatggccaagaacaagcccaccctagacatcgagctgcagaagactgaagccacccaattagccacgctccgtaagctgtgtattgagggcaagatcaccaacataaccaccgattctaggtgcccgacgcagggcgaggccaccctgccggaagagcaggaccaaaactacgtatgcaagcacacctacgtcgaccgggggtggggcaacggctgcggcctcttcggtaaaggctcgctagtgacctgcgccaaattccaatgcctggagcccatcgagggcaaggtggtacaatacgagaatctaaaatatacggtaatcatcacagtgcacactggggaccagcaccaagtcggcaacgagacgcaaggggttacggccgagataacacctcaggcctctacaaccgaagctatactgcccgagtatggtaccctggggctcgagtgctctccgcgcacgggcctagacttcaacgaaatgatcctgctcaccatgaagaacaaggcctggatggtccacaggcagtggtttttcgatctacccctgccctggaccagcggcgctaccacggaaacccccacctggaaccgcaaggagctgctggtcactttcaagaacgcccacgcgaagaagcaggaggtggtggttctggggagccaggagggcgcgatgcacactgccctgactggggcgaccgagatccagaacagcggcggcacctctatcttcgccggccatctgaagtgtcggttaaagatggataagctcgagctgaagggcatgagctacgcaatgtgcactaacaccttcgtgctaaagaaggaggtatctgagacccagcacgggaccatcctcatcaaagtggaatacaagggcgaggacgttccatgcaagatccctttcagcactgaggatgggcaaggcaaagcgcacaacggtcgcctcatcaccgccaatcccgtcgtgaccaaaaaagaggagcccgtgaacatcgaggccgagccacccttcggggagagcaacatagtcataggaatcggggacaacgcgctgaaaattaactggtacaaaaagggctccagcatcgggaaaatgttcgaggccaccgcgcggggggcccgccggatggccatcctgggcgacacggcctgggactttgggtccgtgggaggggtcctcaacagcctggggaagatggtccaccagatcttcggctccgcgtacactgccctcttctccggcgtgtcctgggtgatgaagatcggcatcggggtcctcctgacttggatcggcctgaacagcaagaacaccagtatgagcttctcctgcatcgcgatcgggataataacgctctatctcggtgccgtggtccaggcagacatggggtgcgtcattaattggaagggcaaggagctcaagtgcggtagtgggatctttgttaccaatgaggtgcatacctggactgagcagtacaagttccaggcggatagtcccaagcggctcgccacggccattgccggcgcctgggaaaacggggtctgtgggatccggtctactacccgtatggagaacctgttatggaagcagatcgcgaacgagctcaactacatcttatgggagaacaacataaagctgaccgttgttgtcggcgacattatcggcgtgctcgagcagggcaagcgcactctgacgccccagcctatggagctgaagtactcctggaagacctggggtaaggccaagatcgtgacagctgaaacgcaaaatagctcctttataatcgacggccccaacacccccgagtgcccctcggtcagccgggcttggaacgtgtgggaggtggaggactacgggttcggagtattcactaccaacatctggctcaaactacgggaggtctacacccagctgtgcgaccatcggctcatgagcgcggccgttaaagacgaacgcgccgtccacgccgacatgggctactggattgaaagccagaagaacggcagctggaagttggaaaaagcgagcctcatcgaggtcaaaacatgcacctggccgaagagccacacaatatggagcaacggagtgctggagtccgacatgattatacccaagagcctggcggggcccatctcgcagcacaaccatcggccgggttatcacacccaaacggccggtccctggcacctgggcaaactcgaattagacttcaactattgcgaggggacaaccgtcgtcatcacagagaactgcgggacccgcggccccagcctgcgtactaccactgtgtccggtaagttgatacacgaatggtgctgtaggagctgcacgctgcccccgttgcggtatatgggagaggacggatgctggtacggcatggagatccgccccatctctgagaaagaggaaaacatggtcaagagcttagtgtccgcgggtagcggtaaggtggacaattttaccatgggcgtcttgtgcctagctatccttttcgaagaagtgatgcgggggaaattcggcaaaaagcacatgatcgccggggtgttcctgaccttcgtacttctcctgtccggccagataacatggaaagacatggcgcacaccctaattatgatcggcagtaacgcctccgacaggatgggaatgggagtgacctatctcgccctgatcgccaccttcaaaatccaaccctttctcgccctcgggttcttcctccggaagctcacgtcgagggaaaacctcctgctgggggtgggcctggcgatggccactaccctccagctaccggaagacatcgagcagatggctaatgggatcgcgctcggactgatggcgctgaagctcatcacgcagttcgagacctaccagctgtggacggccctgatcagcctgacctgctccaacaccatctcgaccctgactgtggcttggcggaccgccacactaatcttggccggagtgtccctgctgcccgtatgtcaaagctcgagcatgcgcaagaccgactggctaccgatggcggttgccgcgatgggcgttccgccacttccgctgtttatcttttctctcaaagacacgctaaagcggcgctcttggcctctgaatgagggggtcatggccgtgggcttggtctccatacttgcaagctcccttctccgcaacgacgtacccatggccgggcccctggtggctgggggactgctcatcgcctgttatgttatcaccgggaccagcgccgacctaaccgtcgagaaggccgcggacatcacgtgggaagaggaggcggaacagaccggcgtctcccataatctaatgatcaccgtggacgacgacgggacaatgagaatcaaggacgacgaaaccgaaaatattctcacagtcctgctgaaaaccgcactcctcatcgtgagcggcatcttcccgtactcgatacccgccaccctcttagtgtggcatacctggcagaagcagacccagcgcagcggcgtcctgtgggatgtgccctcgccgcccgaaacccagaaggccgagctggaagaaggggtttacagaataaagcagcaaggcatcttcggaaagacccaagttggagtgggggtgcagaaggagggagtctttcacaccatgtggcacgttacgcgaggcgcggtgctgacctataacgggaagcggctggagcccaactgggctagcgtcaaaaaggacctgatctcgtacggcgggggctggcgactcagcgcccagtggcagaagggggaggaggtccaggtgatcgccgtggaaccgggcaagaacccgaaaaactttcaaaccatgccgggcacgttccagacgaccacaggggagataggggcgatcgcgttggatttcaagcccgggacctccggctcccctatcatcaaccgggagggcaaggtggtggggctgtatggcaacggcgtcgtgacgaagaatggcgggtacgtgagcggcatcgcacagaccaacgcagagcctgacggccccacccccgaactggaggaggagatgttcaagaagcgcaatctcaccatcatggatcttcaccccggctctggcaaaacgcggaaatacctaccggccatagtccgcgaggcgattaagaggcgcctccggaccctgatcctggctcccacccgggtagttgctgcggagatggaggaagccctcaagggactgcccattcggtaccagaccacggcgaccaagagcgagcacaccggccgcgagattgtagacctgatgtgtcacgccaccttcactatgcgactcctgtcaccggttagagtgcctaactacaacctgataatcatggatgaagctcacttcactgaccccgccagcatcgccgcgcgtgggtacatctctacccgtgtcggcatgggcgaggcggccgccatcttcatgacagctacgccccctgggaccgccgacgcctttccgcaaagcaacgcgcccatacaggacgaggaacgtgacatccccgagcggtcttggaacagcggtaatgagtggatcaccgacttcgccgggaaaaccgtctggttcgtgccttccatcaaggcgggaaacgacattgccaattgtcttagaaagaacgggaagaaggttatccagctgtcgaggaagacgttcgacaccgagtatcagaaaaccaagctgaacgattgggacttcgtggtcaccacggatatctccgagatgggcgccaacttcaaagccgacagagtcatcgaccccagacggtgccttaagccggtgatcctgacagatggccccgagcgggtgatcctagccggacccatgcccgtaacggcggcctcggcagcccagcgcagaggcagggttgggcggaacccacaaaaggagaacgaccagtacatcttcacgggccaacccctgaacaacgacgaggaccacgcccactggacggaagctaaaatgctgctcgacaatattaacacacccgaggggataataccagccctcttcgaaccggagcgcgagaagtccgccgctatcgacggcgagtaccggctgaaaggggagagccgcaagacctttgtggagctgatgcgccgcggggacttacccgtatggttagctcataaggtcgcctcagaggggatcaagtacaccgatcgcaagtggtgcttcgatggacagaggaacaaccaaatcctagaggagaacatggacgtcgagatctggaccaaggagggtgagaagaagaaacttcggccgcgctggttagacgcccgcacgtacagcgaccccctcgccctcaaggagttcaaggagttcgccgcaggccgcaagtccattgccctggacctggtcacggaaatcggccgtgtgccctcacatttagctcaccggacccgtaacgccctggataacctggtaatgctccacactagcgagcacggggggcgggcctaccgccatgctgtggaggagctgcctgaaacgatggagactttgctcctactgggcctcatgatcctgcttaccgggggcgcaatgttattcctgatctcgggtaaggggatcggtaagaccagcatcggactgatctgcgtgatcgcctccagcggtatgctctggatggcagaaatcccgttgcagtggattgcctccgcgatcgtactggagttctttatgatggtgctcctgatcccagagccagagaagcaacggacgcctcaggacaaccagctggcatacgttgtcatcgggatcttaacacttgccgccatcatcgctgcgaatgagatgggactgctcgagaccacgaagcgcgacctgggtatgagcaaagagccgggagtggtgtcgcccactagctacctggacgtcgacctccaccccgcctccgcctggaccttatacgccgtggcgacgaccgtgataacacccatgctgcggcacaccatcgagaacagcaccgccaacgtgtcccttgccgcaatcgcgaaccaggcggtggtgttaatgggcttggacaaggggtggcccataagcaaaatggacctaggcgtccccctactggccctcggatgctacagccaggtaaaccccctgacgttaacggccgctgtactcctgttgatcacacattacgccattataggcccgggcctacaggctaaggccacccgggaggcacaaaagcggaccgctgccgggatcatgaaaaacccgacggtcgacggcattatgacgatcgatttagaccccgtgatctacgacagcaaattcgagaagcagctgggccaggtcatgctcctggtactgtgcgtggtgcagctcctgctgatgcgaaccagttgggcgctctgcgaggccctgactttggccacgggccccatcaccaccctttgggagggtagtcccggcaagttttggaacacaacgatcgcggtctctatggccaacatcttccggggcagctacctggccggggctggcctggccttctccatcatgaagtccgtggggaccgggaagaggggcaccggctctcagggcgagaccctcggggaaaagtggaagaaaaagttaaaccagctatcccgtaaggacttcgacctctacaagaaatccggcatcacggaagtggacaggacggaggctaaggaggggctgaagaggggcgagatcacccaccacgcggtctcgcgcggctcagccaagttacaatggttcgtggagcgaaatatggtgatcccggaggggcgcgtcatcgacctcggctgtgggcggggcggatggtcctactactgcgcaggcctgaagaaagtgaccgaggtgcgtggctacaccaagggcgggccggggcacgaagaacccgtccccatgagcacgtatggttggaacatcgtcaagctaatgtcggggaaggacgtgttctacctcccgcccgagaaatgcgacaccttgctgtgcgatatcggcgagagctcgccctcaccaacagtcgaggaatcccggaccattcgcgtgctcaagatggtggaaccctggttgaaaaacaaccagttctgcatcaaggtcttaaacccctacatgccaacggtaatcgaacatttagagcgcttacagagaaagcacggcgggatgctggtacgcaatcccttaagccgcaactctacccacgagatgtactggataagcaacggcacagggaacatcgtcgcgtccgtgaacatggtgagccgcctcctgctcaaccgtttcaccatgacgcaccgtcggcccaccatcgagaaggacgtcgacctcggcgccggaactcgccacgtgaacgccgagcccgagacccccaacatggatgtaatcggggagcgaatcaagcgcatcaaggaggagcacaactccacgtggcactacgatgatgagaacccgtacaagacgtgggcctaccatggaagctacgaggtaaaggcaaccgggtccgcgagcagcatgatcaatggagtggtcaagctgctgaccaagccatgggatgtggtacccatggtcacgcagatggccatgacagacaccacccccttcgggcagcagcgggtcttcaaggagaaggtggatacgaggaccccgcggtccatgcccggcacacgccgggtcatgggtataaccgcggagtggctctggaggaccttggggcggaacaagaagcctcggctgtgtaccagagaggagttcacgaagaaggttcgcaccaacgccgccatgggcgccgttttcacggaggaaaaccagtgggactcggcgaaggccgccgtcgaggacgaagacttctggaaactcgtggaccgggagagagagctccacaagcttgggaagtgcggctcatgcgtgtacaatatgatggggaagagagaaaagaagctcggcgagttcggcaaagctaaggggtccagagccatttggtacatgtggctgggcgcgcgctacttggagtttgaggcgctcgggtttctgaacgaggatcactggttcagccgggaaaacagctactccggcgtcgagggggaggggctgcacaagttagggtacatcctgagggacatcagcaaaatccccgggggagccatgtacgccgacgatactgccgggtgggacacgagaataaccgaggacgatcttcataatgaggaaaagatcactcaacagatggacccggaacatcgacagttagcaaacgcgatcttcaagttaacctaccaaaacaaggttgtgaaggttcagcggcctacccccaccggcaccgtgatggacataatctcccgcaaggaccaacggggcagcggccaggtgggcacgtacgggttaaacaccttcaccaacatggaggcccagctcatccgccagatggagggcgagggagtgctgtccaaagccgacctggagaacccgcatctcccggagaagaagatcacccaatggctagagaccaagggtgtggaacgactgaagcgcatggctatcagcggcgacgactgcgtggtaaagcctatcgatgaccggttcgcgaacgcactgctggccctgaatgacatggggaaggtgcgcaaggacatccctcaatggcaaccctccaagggttggcatgattggcaacaggttcccttctgcagtcaccacttccacgaattaatcatgaaggacggtcggaagctggtcgtcccctgccggccgcaagacgaactgataggccgggctaggatctcccaaggggccggatggagcctaaaggagaccgcgtgtcttgggaaggcctacgcccagatgtggtccttgatgtactttcaccggcgcgatcttcgtctggcaagcaacgccatatgctccgctgtccccgttcactgggtgcctacctcgcgaaccacgtggtcgatccacgcacaccaccagtggatgaccaccgaggacatgctgacggtgtggaaccgcgtctggatcgaggacaatccgtggatggaggataagacgcctgtgaccacctgggagaacgtgccctaccttgggaagcgagaggaccagtggtgcggctcactgatcgggttaaccagccgagcaacgtgggcccaaaatattccgaccgctatccagcaagtgcggtcactcatcggcaacgaggagtttctggactacatgcccagtatgaagcgcttccggaaggaagaggagagcgaaggggccatctggtga

SEQ ID NO: 25842 - RNA, 9873 nt, synthetic construct
  misc_feature 1..9873: note = derived and/or modified CDS sequence (opt11) from DENV-3__HQ705611__SS-prME
  source 1..9873: mol_type = other RNA
accagtctgtgcctaatgatgatcctccctgcagccctagcgttccacctcactagcagggatggcgaaccacggatgatcgtagggaagaacgaaaggggcaagtcgctgctgttcaaaaccgcttccgggatcaacatgtgcaccctcatcgccatggacctgggcgagatgtgtgacgacactgtgacctataaatgcccccacatcaccgaggtggaacccgaggacattgattgctggtgcaacctgacaagcacgtgggtgacctacgggacctgcaaccaggccggcgagcatcggcgcgacaagcggtctgtggccttggcgccccacgtgggcatggggttggacacgcgcacccagacgtggatgagcgctgagggggcctggcgccaagtcgagaaggtcgagacgtgggcccttcgccaccccgggttcaccatcctcgcgctgttcttggcccactacatcggcacgagcttgacccagaaagtggtaatctttatactgctgatgctcgtgacgcccagcatgaccatgcggtgcgtgggggttggcaacagggacttcgtcgagggactgagtggtgccacatgggtagacgtggtccttgagcacggcggttgcgtaaccactatggcgaaaaacaaacccaccctcgatatcgagctccaaaagaccgaggccacacagctggcgacgctcagaaagctgtgcatcgagggcaagatcaccaacatcactaccgacagccgctgccccacgcaaggcgaggccaccctgccggaggagcaagatcagaactacgtgtgcaagcacacctacgtcgaccgggggtggggcaacgggtgtggcttgttcggaaaaggttccctggtgacctgcgccaagttccagtgcctggaacccatcgagggcaaagtggtgcaatacgagaacctcaaatacacggtgatcatcactgtccacaccggtgatcagcatcaagtcggcaacgagacccaaggggtgacggccgagatcacaccccaggcgagcaccaccgaggcgatcctgccagagtacggcacgctggggctcgagtgctccccgcgcacgggcttggatttcaacgagatgatcctgctcaccatgaagaataaggcctggatggttcatcggcagtggtttttcgacttgccactgccgtggaccagcggcgccactacagagaccccaacctggaaccgcaaggagctactggtgaccttcaagaatgcgcacgctaagaagcaagaggttgtcgtgctgggcagccaggagggcgcaatgcacaccgccctcaccggggccaccgagatccagaacagtggcggtacctctatcttcgcaggccacctgaagtgcaggttgaagatggataagctcgagctgaagggcatgagctatgccatgtgcactaacacattcgttctgaagaaggaagtctccgagacacagcacggcaccatcctcatcaaggtggagtataagggagaggacgtgccgtgcaagatcccattcagcacggaggacgggcagggcaaggcacacaacggccggctgatcaccgcaaacccggtcgtgaccaagaaggaggagcccgtgaatatcgaggccgaaccgccatttggagaaagcaatattgtcatcggcatcggggacaacgccctaaagataaactggtacaagaaaggatccagcatcgggaagatgtttgaggcgaccgcccggggcgcccgtcggatggcaatcttaggagacacggcctgggactttgggtcagtgggaggtgttctcaacagccttggcaagatggtccaccaaatcttcggttccgcgtacactgccctgttcagcggagtttcctgggtgatgaaaatcggcataggagtcctcctgacatggatcgggctgaacagcaaaaacacttcaatgagcttctcatgcatagctatcggtatcatcactctctacctgggcgccgtggtgcaggccgatatggggtgtgtcatcaactggaagggaaaggagttaaagtgcggcagtggaatcttcgtgacgaacgaggtgcacacttggaccgagcagtacaaattccaggcagactccccgaaacgcctcgccactgcgatcgctggcgcttgggaaaatggtgtttgcggcatacggagcactaccaggatggagaacctgctgtggaagcagatcgccaacgagctcaactacatcctttgggaaaataatataaagctgaccgtcgtggtcggggatataatcggtgtgctcgagcaggggaagcgaacgctgactccccagccgatggagctcaagtactcctggaaaacctggggcaaggccaagatcgtgacagcggagacacagaacagctcctttatcatcgatggtcccaacacaccggagtgcccctccgtctcccgggcctggaatgtgtgggaggtggaggactacgggttcggcgtgttcaccaccaacatctggctcaaactgcgagaggtgtacactcaactgtgtgaccaccgtttgatgagcgcagccgtgaaggatgagcgcgcagttcacgccgacatggggtactggatcgagtcgcagaaaaacgggtcctggaagctggaaaaggccagcctgatcgaggtgaagacgtgcacttggcctaagtcccataccctctggtcaaacggcgtgctggagtccgacatgatcatccccaagagcctggcggggcccatcagtcagcacaaccaccggccaggctaccacacccagacggccgggccctggcacctcggcaagctcgaactggatttcaactactgcgagggcaccaccgtcgtgatcaccgagaactgtgggacgaggggtcccagcctccggaccaccaccgtatccggtaagttaattcacgaatggtgctgccgctcgtgcacgctgcccccgctccggtacatgggcgaggacgggtgttggtacggcatggagattcgccccatctccgaaaaggaggagaacatggtcaaaagcctggtgtcagctggcagcgggaaggtggacaatttcaccatgggcgtcctttgcctcgcgatcctgtttgaggaggtgatgcgggggaagttcggcaaaaagcacatgatcgccggggttttcttcacctttgtcctgctcttatccggacaaatcacctggagggacatggcgcacacgcttatcatgatcggtagcaacgcctccgatcggatggggatgggagtaacctacctcgccctgatcgccacattcaagatacagcccttcctggctcttgggttcttcctccgcaagttaaccagccgagagaacctcctgctgggcgtgggcctcgcgatggcaacgacactgcagctacccgaggacatcgagcagatggccaacgggattgccctcggcctaatggcgctaaagctcataacccagttcgagacctaccagctgtggaccgccctgatttcactaacttgttccaacaccatcttcaccctgacggtcgcctggcggactgccaccctaatcctcgccggagtgtctctactgccagtctgccagtcctcctccatgcgcaagaccgactggctccccatggcagtggccgcgatgggcgtgccacccctcccgcttttcatcttcgggctcaaagacaccctgaagcgcagaagctggcccctgaacgagggcgtcatggccgtgggtctcgtctccatcctggcatcatccctactccggaatgacgtccctatggcggggcccctagtggccggcggccttctcattgcctgctacgtaattacagggaccagcgcggacctcactgtagagaaggccgcggacataacgtgggaagaggaggccgagcaaacgggggtctcccacaacctgatgataaccgtagacgacgacggcaccatgcgcattaaggacgacgagacagagaacatcctgacggtgctgctgaagaccgccctcctgatagtgagcggtatcttcccgtactcaatcccggccaccctgctggtgtggcacacctggcagaagcagacgcagcgtagcggggtgctgtgggacgtgccatcaccgccggagacacaaaaggctgagctagaagaaggagtgtaccgcatcaaacaacaaggaatctttgggaagacccaggtcggggtcggggtacagaaggaaggggtattccataccatgtggcacgtaacgagaggggcggtgcttacctataatggcaaacgcctggaaccaaactgggccagcgtcaagaaggacctgatcagttacggagggggctggcgtttatcagcgcaatggcagaaaggagaggaagttcaggttatcgcggtcgagccaggcaaaaatcccaagaactttcagaccatgcccgggacgtttcagacgacgaccggggaaatcggggctatagccttagacttcaagccggggaccagcggctcccccattataaaccgggaagggaaggtggtgggtctgtacgggaatggggtcgttacgaagaacggagggtacgttagtggcattgcacaaactaacgccgagcctgacgggcccacccccgaactggaggaggagatgttcaaaaagagaaacttaaccattatggacctgcaccccggatcaggaaagacgcgcaagtacctgccagccatcgtacgggaagcgatcaagcggcgcctccgcaccctgatcctggcccccaccagggtggtcgccgccgaaatggaagaggccttgaagggcctgcccatccgctaccaaaccacggcgaccaaatcggagcacaccgggcgggagatcgtcgacctgatgtgccacgccacctttactatgcgcctcctgtccccggtgcgagtgccgaactacaacctgatcatcatggacgaggcacatttcaccgacccagctagcattgccgcgcgaggctatatctccacacgggtcggcatgggggaggccgccgccatcttcatgaccgcgacgcctccaggcaccgcagacgccttcccgcaaagcaatgcgcccatccaagacgaggagcgcgatattcctgaacgcagctggaacagcggtaacgaatggatcaccgattttgcaggcaagacagtatggttcgtgccctccatcaaggcgggaaacgacatcgccaactgtctccggaaaaacggcaagaaggtcatccagctgagccgcaagacgttcgacaccgaataccagaagacaaagctgaacgactgggactttgtggtgacaactgacatctccgaaatgggcgctaacttcaaagccgaccgggtcatcgacccaagacggtgtctcaagcccgtaatcctgaccgacgggcccgagagagtgatactagccggcccaatgccggtcactgcggcgagcgccgctcagcggagagggcgggtggggcgcaacccccagaaagagaatgatcagtacatcttcactgggcaaccattgaacaacgatgaggaccacgcccactggaccgaggcgaagatgctcctggacaatattaacactcccgagggcatcatcccggcccttttcgagccagagcgagagaagtccgctgccatcgatggcgagtaccgcctcaagggtgagagccggaagacgttcgttgagctgatgcgccggggcgacctccccgtctggctcgcccacaaggttgcatcagaggggatcaagtacaccgatcggaagtggtgtttcgatggccagcggaataaccagatcctggaggagaatatggacgtggagatatggacgaaggagggcgagaagaagaagctcaggccccggtggctggacgcccgcacttacagcgacccgctcgccctcaaagagttcaaggagtttgccgcgggcaggaagtccatcgcgctggacctggttaccgagatcgggagagtgccgagccacctcgcccacagaacccgaaacgcactcgacaacctggttatgctacacaccagtgaacacggaggtcgagcctaccggcatgcggtagaagaactgcccgagacaatggagactttgctcctactgggactcatgatcctgttaaccggcggcgccatgctgttcctgatcagcggtaaaggtataggtaagacgagcataggcctgatttgtgtgatagcctcctccgggatgctctggatggcggaaataccactgcagtggatcgcgtccgcgatcgtccttgagttcttcatgatggtgctcctcatccccgagccagaaaagcaacgcacgccgcaggacaaccagctggcctacgtggtcataggcatcctcaccttagccgccataatagccgcgaacgagatgggcctgctcgagactaccaagcgcgacttggggatgagcaaggagccgggcgttgtatccccgacgagctacctggacgtagatctacaccccgcgtccgcatggaccctttatgccgtggcgaccaccgtgatcacgcccatgttacgccacacgatcgagaactccaccgctaatgtctccctggccgccatcgcaaaccaagcagtagtgctgatggggctggacaagggctggccgatcagtaagatggacctcggcgtccccctcctcgctctcgggtgttactcacaggtgaaccccctgaccctgacggccgctgttctcctgcttatcacccactatgccatcatcggcccagggctgcaggctaaggccacacgggaagcacagaagcgcacggccgccggcattatgaagaacccgacggtcgacggcatcatgactatcgacctggatccggtgatctacgatagcaagttcgagaagcaattgggccaggtgatgctcctggtcctctgcgcggtacaactccttctgatgagaacttcctgggccctctgcgaggccctgacactggccactggccccatcacgaccctctgggaggggagccccggtaagttttggaacaccacaatcgcggtgtccatggcgaacatcttccgcgggtcttacctcgctggcgcagggctggcgttcagtatcatgaagtcagtcggcaccggcaagcgggggaccggctcgcagggggagaccctgggtgaaaagtggaagaagaagctgaaccaactcagccggaaagacttcgacctgtacaagaagtccggcatcaccgaggtagaccgaacggaggcgaaagaaggcctcaagcggggtgagatcacacaccacgccgtgtcgcggggtagcgccaaactgcagtggtttgtcgagaggaacatggttatcccggagggccgagtgattgacctcgggtgcggtagagggggctggtcgtattattgcgccggcctaaagaaggtaaccgaggtgcggggatataccaaagggggccccggccatgaagaacccgtccctatgtcgacgtatgggtggaacatcgtcaagttaatgtccggcaaagacgtattctacttaccgcccgagaagtgcgacaccctgctgtgcgacatcggcgagagctcgccttcccccactgtggaggagtcccgcaccatcagagtcctgaagatggtcgagccgtggctcaaaaacaaccagttctgcatcaaggtgctgaacccctatatgcccacagtcattgagcacctggagcggctccagcgtaagcatgggggcatgctggtacggaatcccctgagccggaactccacccacgaaatgtactggatctccaatgggactgggaacatcgtggcctccgtcaacatggtgagccgactcttactgaaccgcttcacgatgacgcaccggcgcccaacaatcgagaaagacgtggacctcggcgccgggactagacacgtcaatgcggaacccgaaacccccaatatggacgtgatcggtgaacgcataaagaaaataaaagaggagcacaactccacttggcattacgacgacgagaacccgtacaagacttgggcttaccacgggagctatgaggtgaaggcgacgggttccgccagttctatgatcaacggagtcgttaagctgctgaccaagccttgggacgtcgtgcccatggtgacgcagatggcgatgaccgacaccaccccattcggtcaacaaagagtcttcaaggagaaggtggacacgcgcaccccgcggagcatgcccggaacccgccgggtgatgggtatcactgccgagtggctctggcgcacgctgggtcggaacaagaagccccgcctgtgtacccgggaggagttcacaaagaaggttcgcaccaacgcagccatgggggcggtgttcaccgaggagaaccagtgggatagtgccaaggccgccgtggaggatgaggacttctggaagctcgttgaccgcgaacgggaactgcacaagctgggcaagtgcgggtcttgcgtctacaatatgatgggcaaaagagagaagaagctgggagagtttgggaaagccaagggcagccgcgcgatctggtatatgtggctgggggcacgctacctggagttcgaggccctggggttcctgaacgaggatcactggttctcccgggaaaacagttattctggagttgagggcgagggtctacacaagctcggatacattctgcgcgacatatcaaaaatccccggaggggcaatgtacgccgatgataccgcgggttgggatacccggatcactgaggatgacctgcacaatgaggagaagatcacgcagcagatggatccggagcaccgacaactcgcgaacgccatcttcaaacttacctaccagaacaaggtagtgaaggtacagcggcccacccccacgggcaccgtcatggacatcatctcccgcaaggaccagcggggtagcggccaagtggggacctatggactgaacaccttcacgaacatggaagcccagttgatccgacagatggagggcgagggcgtgctttctaaggccgacctagagaaccctcacctaccggagaaaaagatcacccagtggttagaaactaaaggcgtggaacggcttaagcggatggcgatcagcggggacgactgcgttgtgaagccgatcgacgaccgcttcgccaacgcgctcctggctctgaacgatatgggcaaagtccgcaaggacatcccgcagtggcagcctagcaagggatggcatgactggcaacaggtgcctttctgcagccaccacttccacgaactcatcatgaaagacggccggaagctcgtggtcccttgccgcccgcaggacgagctgatcggccgggcccgcatctcccagggggcaggctggagcctcaaggagaccgcctgcctggggaaggcctacgcccagatgtggtcactcatgtatttccatcggagagacctccgcctggccagcaacgccatatgctctgcagtgcccgtgcattgggtcccaacaagtcggaccacgtggtcgatccacgcccatcaccagtggatgaccaccgaggacatgttaaccgtgtggaaccgcgtgtggatcgaggacaatccctggatggaggacaagacgcccgtaaccacctgggagaacgtgccctacctcggaaagcgggaggaccagtggtgcgggagccttatcggcctcaccagccgcgcaacctgggcgcagaatatcccgacagctatccagcaggttcggtccctcatcggtaacgaagagttcctggattacatgccctctatgaagcggtttcggaaggaggaggagtcggagggcgcaatctggtga

SEQ ID NO: 25843 - RNA, 9873 nt, synthetic construct
  misc_feature 1..9873: note = derived and/or modified CDS sequence (opt11) from DENV-3__HQ705612__SS-prME
  source 1..9873: mol_type = other RNA
accagcctctgtctcatgatgatcttacccgccgctctggctttccacctcacctcccgtgacggcgagccgcggatgatcgtggggaagaacgagcgaggcaagtccctactattcaagaccgcctccgggataaacatgtgcaccttgatcgcaatggacctgggcgagatgtgtgacgatacggtgacctataagtgtccccatatcacggaggtagagccggaagacatcgactgttggtgcaaccttacaagcacctgggtgacatatgggacctgcaaccaggccggcgagcacagaagagataagcggagtgtggccctcgcgcctcacgtgggcatgggcctggacacccgcactcagacatggatgtccgccgagggggcctggcgccaagtggagaaggtggaaacctgggcactgcgccacccggggttcaccatcctcgctctgttcctggcccattacattggcacctccctaacccagaaggtggttatcttcattctattaatgttggtcactcccagcatgacaatgcggtgcgtgggggtgggaaaccgcgacttcgtcgagggcctgtccggtgccacctgggtcgacgtggtcctggagcacggggggtgcgtgaccacgatggccaagaacaagcccaccctggatatagagctgcagaaaacggaggcaacccaattggcgacactccggaagctgtgcatcgagggcaaaatcactaacattaccaccgatagccgctgccctacgcagggcgaagccaccctgccagaggagcaggaccaaaactacgtgtgcaaacacacctacgttgatcgcggatgggggaacgggtgcgggctcttcgggaagggctctctggtaacgtgcgcaaagttccagtgccttgagcccatcgagggcaaagtggtccagtacgagaacctcaagtatacggtgatcatcaccgtgcacaccggggaccaacaccaggtcggcaacgaaacacagggggtaacggccgagatcacgccccaggcgagcaccacagaggcgatcctgccagagtacggaactctggggctcgaatgttccccgcgaacgggcctggactttaacgagatgatcctgctgaccatgaagaacaaggcctggatggttcaccggcagtggttctttgacctgcccctgccctggacctcgggcgctaccacggaaacccccacgtggaatagaaaggagttactggtcacttttaagaacgctcatgccaagaagcaggaggttgtggtccttgggtcccaggagggggcgatgcacacagcgctgaccggggccaccgagatccagaacagcggcggcacctccatcttcgccggccacctgaagtgccggctgaagatggacaaactcgagttaaagggcatgagctacgccatgtgcacgaacactttcgttctaaaaaaggaggtcagtgagacccagcacgggaccatcctcatcaaggtggagtataagggagaggatgtgccgtgcaagatcccgttctctactgaggatgggcagggcaaggcgcacaacggccgcctgatcacggccaacccagtcgtgacgaagaaggaggaaccagtgaacattgaggccgagccgcctttcggagaaagcaatatcgtcatcgggatcggggataacgcgttgaagatcaactggtataagaagggcagcagcatcgggaagatgtttgaagcgaccgcgcggggcgccagacggatggccatcctgggtgacacggcctgggatttcggatcagtgggcggggttctcaactctctggggaagatggtccaccagatcttcgggtcggcgtacacagcactgttctccggcgtgtcctgggtgatgaagatcggcatcggggtcctccttacctggataggcttaaatagcaagaatacgtccatgagcttctcctgtatcgccatcgggatcataaccctgtacctgggcgctgtggtgcaggccgatatggggtgcgtcatcaactggaagggcaaggagctaaagtgcggcagcgggatctttgtgaccaacgaggtgcacacttggactgagcaatacaagtttcaggcggacagccccaagcgtctcgcgaccgccatcgccggcgcgtgggaaaatggggtctgcggcatccgcagcaccacgcgtatggaaaacctgctctggaagcagatcgccaatgagctgaattacatcctgtgggagaacaatatcaagctgacggtggtggtcggggacattatcggcgtcctcgaacaaggaaagcgtacgctgacacctcaaccaatggaattgaagtattcttggaagacctgggggaaagccaagatagtgacggccgagacgcagaattcctccttcataatcgacggccccaacacccccgagtgccccagtgtctcccgggcctggaatgtgtgggaggtggaagattacggtttcggtgtcttcaccactaacatctggttaaaactgcgcgaggtgtacacccagctatgcgatcaccgactcatgagcgcggccgtgaaggacgagcgcgcggtgcacgccgatatggggtactggattgaaagccagaagaacggttcatggaagctggagaaggcctcgctgattgaggtgaagacgtgcacgtggccgaagagtcacacactctggagcaacggcgtgctggagtccgacatgatcatccccaagagcctagcgggacccatctcccagcacaatcaccggccgggctatcacacccaaacggctggaccctggcacctcggcaagctggagttggacttcaactactgcgagggcaccactgtcgtgatcaccgagaactgcgggacgcgtggacccagccttcggaccactactgtgtccgggaagctgattcacgagtggtgctgccgaagttgcaccctgcccccgctccggtatatgggtgaggacgggtgttggtacggcatggaaatccgcccaatttccgagaaggaggagaacatggttaaatcattagtatccgccgggagcgggaaggtggacaactttaccatgggggtgctgtgcctggccatcctgttcgaggaggtaatgcgggggaagttcggtaagaagcatatgatagccggggtgttcttcaccttcgtcctgctccttagcgggcagatcacctggcgcgatatggcgcacacgctgatcatgatcggaagcaacgcctccgaccggatggggatgggtgtgacctatttagctttaatcgccacctttaagatacagccattcctggccctagggttcttcctgcgcaaactgaccagccgagagaacctcctgctaggcgtgggcctcgccatggccactaccctgcaactgcccgaggacatcgagcaaatggccaacggcattgccttggggctgatggcgttgaagctcatcacacagttcgagacctaccaactgtggacggcattaatcagtctgacttgctccaataccatctttaccctgaccgtcgcctggcggaccgccacactaatcctcgccggggtgagcctgctgccggtctgccagtccagctccatgcgcaaaaccgactggctccccatggcggtggccgcgatgggggtcccgcccttgccgttattcatcttcgggctcaaggacacgctgaagcgccgcagctggcccctcaacgagggcgtcatggccgtgggcctcgtgtccatcctcgccagcagtctgctcaggaacgacgtccccatggcggggcccctggtggccggcgggttattaatcgcatgctacgtgatcaccgggaccagcgccgacttaaccgtcgagaaggccgctgacacaacctgggaagaggaagcggagcagaccggggtgagccataacctgatgataaccgtcgatgacgacggcaccatgcgcataaaagacgacgagacagagaacatcctcaccgtactgctcaaaaccgctctccttattgtgtctgggatcttcccgtacagcatacccgcgacattgctcgtgtggcacacatggcagaagcagacacagaggagcggggtactgtgggatgtgcccagcccgcccgagacccagaaggcggaactggaggagggcgtgtaccgaatcaagcagcaggggatcttcggtaagacgcaggtcggagtgggcgtccagaaagagggcgtcttccacacgatgtggcatgtgaccaggggggccgtcctcacccacaacgggaagcgcctggagcccaactgggccagcgtcaagaaggacctgatctcttatggcggcgggtggcgtctcagtgcccagtggcagaagggcgaggaggtgcaggttatcgccgtagagcccggtaagaacccaaaaaacttccagaccatgccagggacgtttcagaccaccaccggtgagatcggggctattgccctggacttcaagcccggcacgtccggttcacccatcatcaaccgcgaagggaaggtcgtaggcctctatgggaacggcgtcgtgacaaagaatgggggctacgtgtcaggtatcgcccagactaatgcggagccagatgggcccacccccgagctggaggaggagatgttcaagaaacggaacctcacgataatggacctgcaccctggctctgggaagacacgcaagtacctgccggcgatcgtgagggaggcgatcaagcgacggctgcgaaccctgatcctggcgcctacacgggtggtagcggctgagatggaggaggccctaaaaggcctgccgatccgctaccagacgaccgcaaccaagtcggagcacaccgggcgagagatcgtcgacctgatgtgtcacgcgacattcaccatgcgcctcctaagcccggttagagtaccgaactacaacttgatcatcatggacgaggcacacttcactgatccagcaagcatcgcggcgagaggctatatctccacccgggtgggcatgggggaggcagccgccatcttcatgaccgccacgccgcccggaacagcagacgcctttccgcagtctaacgcgcccatacaggacgaggaacgcgatatccccgagcgttcatggaacagtggtaatgagtggataaccgactttgccggcaagacggtatggttcgttccatccattaaggccggaaatgacatcgccaactgcctccggaaaaacggcaagaaggtgatccagctgagccgcaagacttttgacacagaatatcagaagactaaactgaacgactgggacttcgttgtgacgaccgacatctccgagatgggcgccaacttcaaggcagatcgggtcatcgatccgcgccggtgcctcaagccagtgatcctgaccgacgggcctgagagagtgatcctggccggccccatgccggtcaccgcggccagcgcagcccagcggcgcgggcgagttggcaggaacccacagaaggaaaacgaccaatacatctttaccgggcagcccctcaacaacgacgaggatcacgcgcactggaccgaggcgaagatgctgctcgacaacatcaacacccccgagggtataatccctgccctgtttgagcccgagcgggagaagtccgccgcgatcgacggtgaataccgcctgaagggggagagtcggaagaccttcgtagagcttatgcgccgaggggatctccccgtctggctggcgcacaaggtcgcctccgagggtatcaagtataccgaccgcaagtggtgctttgatggacagcggaataatcagatcctggaagagaacatggacgtcgagatttggacgaaggaaggcgagaagaagaagctacgcccccggtggttagacgcccgcacctacagcgacccgctggctctcaaagagttcaaagagttcgcggcagggcgcaaatccatcgccctggacttagtaacagaaattggccgggtgccgagccacctcgcgcacaggactcggaacgcgctggacaacttggtcatgctccacacgtccgagcacggtggtcgtgcctaccgacacgctgtcgaggagctccccgagaccatggagaccttattactgctggggctcatgatcctgctgaccggtggggctatgctgtttctcatctcaggtaagggcatcgggaagacttctatcggcctcatctgcgttatcgcctccagcggaatgctctggatggccgaaatcccgttgcagtggatcgccagcgccatcgtccttgagttcttcatgatggtgctcctgatccccgagcctgagaagcagcgaactccccaagacaaccagctggcctacgttgtcattggcatactcaccctggccgcgatcatcgccgcgaacgagatgggcttactcgagaccacgaagagggacctggggatgagtaaagagccgggcgtggtgtcccctaccagttacctcgacgtcgaccttcaccccgcgtcggcctggaccctgtatgcagtagcgaccacggtcataacccccatgctgcgccacaccatcgagaactccacggctaatgtctccctcgccgccatcgccaaccaggcggtggtgctgatggggctggacaagggctggccgatctcaaaaatggacctcggggtgcccctgctggccctcggctgttattcccaggtgaaccccctgacacttaccgctgctgtgctcctcctcatcacacactatgccatcattggtcccgggcttcaggccaaggcgacccgtgaagcccagaagcgaacagccgccggcatcatgaaaaacccgaccgtagacgggatcatgacgatcgacctagaccccgtaatctacgacagcaagtttgagaagcagctgggccaggtgatgcttttagtcttatgcgcggtacagctcctgctgatgcggacctcctgggcactctgcgaggccctgaccttagccaccgggcccatcaccacgctctgggagggaagccccgggaagttctggaataccaccatcgccgtctccatggctaacatcttccgcggaagctatctggccggcgccgggctagcattctccatcatgaagagtgtcggcaccggtaagcgggggaccggctcccagggtgagaccctcggcgaaaagtggaaaaagaagctgaaccagctgagccgcaaggatttcgatctctataagaaaagtgggataaccgaggtggacaggaccgaggcaaaggaagggctgaagagaggcgaaatcactcatcacgccgtgtctcgggggagcgcaaagctgcagtggtttgtcgagcgcaacatggtaatcccggagggtcgggtcatagacctcgggtgcggccgcggcggctggtcctactactgcgctggcctgaagaaggtcacagaagttcgggggtacacgaagggtgggcccggccacgaggagcccgtgcccatgagcacatatggttggaacatcgtgaagctgatgtcgggtaaagacgtgttctacctcccgcccgaaaagtgtgacaccctgctatgcgatatcggggagagctcacccagccccacagttgaagaatcccggacgatacgcgtcctaaagatggtggagccgtggctcaagaacaatcagttctgcatcaaggtactgaacccatatatgccgaccgtcattgagcacttagaacgactccagcgcaagcatgggggaatgctcgtccggaaccccctgagtaggaactccacccatgaaatgtactggattagcaacggtaccggcaacatcgttgcctctgtcaacatggtgagccggctcctgctcaaccgctttacgatgacccatcggcgcccgaccatcgagaaagacgtggatctcggggcggggacccgccatgtaaacgcggaaccggagactcccaacatggatgtgatcggcgagcgcattaagcggatcaaggaagagcataactccacgtggcactacgacgacgagaacccgtacaagacctgggcatatcatggttcctacgaggtgaaggccaccggctccgccagcagtatgatcaacggggtcgtgaagctgttaacgaaaccttgggatgtcgtgccaatggtaacgcagatggcgatgacggacacaacaccgtttggccagcagcgcgtatttaaggagaaggtggacacccggaccccgcgtagcatgcccggcacccgtcgagttatgggaatcacggccgagtggctctggcggaccctgggccgcaacaagaagccccgactgtgtacgcgcgaagaatttaccaaaaaggtccgcacgaacgcagccatgggggcggtgttcaccgaggagaaccagtgggacagcgccaaggctgccgtggaggacgaggacttctggaagctcgtcgaccgagagcgcgagttgcacaagctggggaagtgcggctcctgtgtgtacaatatgatgggaaaaagggagaagaagctcggcgaattcgggaaggcaaagggcagccgcgctatttggtacatgtggctgggggcccggtatctggaattcgaggccctcggcttcctaaacgaagaccactggttttcccgcgagaacagctactccggggtggagggcgagggcctgcacaagctagggtacatcttgcgggatattagcaagatccccggcggggccatgtacgcggatgacaccgcgggatgggacacacggatcacggaggatgatctgcacaacgaggaaaagatcacgcaacagatggacccggagcaccggcagctcgccaatgcgatcttcaagctgacctatcagaataaggtcgtgaaagtgcagcgccccactcctaccggcacggtcatggacatcatctcccggaaggaccagcgcggtagcggccaggtgggaacttacggcctcaacactttcaccaatatggaagcccaactgatccggcaaatggagggtgagggggtgctgagtaaggccgacctggagaacccccacctgccggagaaaaagatcacgcagtggctggagaccaagggcgtagagcgccttaagagaatggcgatctcgggggatgactgtgtagtgaaacccatcgacgaccgctttgccaacgcactgctggccctgaacgacatggggaaggtccggaaagacatccctcagtggcaaccctccaaggggtggcatgactggcagcaggtccccttttgctcgcaccacttccacgagctcatcatgaaggacggccgcaaactggtcgtgccttgtagaccccaggacgagctgattggaagggcacggatctcccaaggcgcgggctggagcttgaaggagaccgcctgcctggggaaggcctatgctcaaatgtggtccttgatgtacttccaccgccgcgacctccggctggcgagcaacgccatttgcagtgccgtaccagtacactgggtccctaccagccgcaccacgtggtccattcatgcccaccaccaatggatgactaccgaggacatgctgaccgtgtggaaccgggtgtggatagaagacaacccgtggatggaggacaagacccccgttaccacgtgggaaaacgtgccctacttgggaaagcgagaggaccaatggtgcgggagtctgataggcctgacgagccgcgcaacctgggcgcagaacatcccaaccgccatccagcaggtgcgctcccttatagggaacgaggagttcctggattacatgccgagcatgaagcggttccgaaaagaggaggagtccgaaggtgcgatatggtaa

SEQ ID NO: 25844 - RNA, 9873 nt, synthetic construct
  misc_feature 1..9873: note = derived and/or modified CDS sequence (opt11) from DENV-3__HQ705613__SS-prME
  source 1..9873: mol_type = other RNA
acgtctctatgcctaatgatgatcctcccggctgcacttgcgttccatctcacatccagggatggggaacccagaatgattgtggggaaaaacgaacgggggaaaagcctcctattcaaaacagccagtggcatcaacatgtgcacattaattgccatggacttaggggaaatgtgcgacgacaccgtaacatacaaatgtccgcacatcacagaagtagagcccgaggatatagactgttggtgcaacctgacaagcacgtgggtcacatacggcacatgcaatcaagctggtgaacacagacgcgataaaaggagcgtggcgctcgccccacatgtgggcatgggactcgacacaagaacacagacctggatgtcagctgaaggcgcgtggcgacaagtcgaaaaagtcgaaacatgggccctccggcatccaggcttcacaatactcgcgctgttcttggcacactacatcggcaccagtctgacccaaaaagtggtcatatttatcctactcatgctcgtaaccccatcgatgaccatgaggtgcgtaggcgtggggaatcgcgacttcgtcgaaggactctccggagccacgtgggtggacgtagtactagagcacggcggttgtgtaacaacgatggcgaaaaataaaccgacccttgacatcgagctgcagaaaacggaagccacgcaactagccacgctgagaaaattgtgcatcgaaggtaaaataacaaacatcaccacggactccaggtgtcctacgcagggggaagcgacactaccggaagaacaagaccaaaactatgtgtgcaagcacacctatgtggaccgaggatggggaaacgggtgcggactgttcggcaaaggaagcctagtaacttgcgccaaatttcaatgcctggagccaatcgaagggaaagtcgtgcagtacgaaaatctgaaatacacagtaattatcacagtccacacaggagaccaacaccaagtgggcaatgaaacgcagggggtcacggcagaaattacaccgcaagcatcaaccacagaagcgatcctaccggagtacgggactcttgggctcgagtgctccccgaggaccgggctggatttcaacgaaatgatcttgctaacgatgaaaaacaaagcatggatggtacaccgccaatggttcttcgacctgcccctcccatggacgtcgggcgcgacaaccgaaacacccacctggaaccgcaaagaactgctagtcacctttaaaaacgcgcacgcgaagaaacaagaggtagtagtcctgggctcgcaagagggcgcgatgcacaccgccctaacaggcgccacagaaatacaaaattcgggaggcacaagtatatttgccgggcacttgaaatgcagattgaagatggacaagctagaactaaaaggaatgagctacgccatgtgtacaaatacctttgtcctcaagaaagaggtcagcgaaacccagcacggaactatattaataaaggtcgaatacaaaggggaagacgtcccgtgtaagatccccttcagcaccgaagatggccaggggaaggctcacaacggaagactaatcacggcaaaccccgtagtcaccaagaaagaggaacctgtaaacatagaggcagagccaccattcggggaatcaaacatagtcatcggcattggcgacaatgcgctgaagataaactggtataagaaaggtagcagtatcgggaagatgttcgaagccaccgcgcgcggagcgcgccgtatggcaatattgggggatacagcatgggatttcggaagtgtcggaggagtacttaacagcctagggaaaatggtacatcaaatcttcggctcagcatacaccgcgctattctcgggtgttagctgggtcatgaagatagggatcggagtactccttacatggatcggcctcaatagcaagaacacgagtatgtcgttcagctgtattgccatcggcatcataaccctatacctcggggcagtcgtacaggcagacatgggctgcgtgatcaactggaagggaaaagagcttaaatgtggcagcgggatctttgtgacaaatgaagtccatacgtggactgaacagtataagtttcaagcagactctcccaagcgcctagcaacagccatcgcgggtgcctgggaaaatggtgtctgtgggatacggtcaaccaccagaatggaaaacttgctatggaaacagatcgctaatgagctcaactacatcctctgggaaaacaacatcaagttgacggttgtagtaggtgacatcatcggggtgttagaacaggggaaaaggaccctcactccacagccaatggaactaaaatactcgtggaaaacctggggaaaagcaaagattgtaacagcggaaacgcaaaatagcagcttcattatcgacgggcccaacacgccggaatgccctagcgtaagcagagcttggaacgtatgggaagtagaagactacggattcggagtattcactacaaacatctggctgaagctcagagaggtctacacgcagttgtgcgaccacaggctgatgagcgccgcagtcaaagacgagagagccgtccacgccgacatgggttattggatcgaaagccaaaagaacggctcctggaagctggagaaagccagcctcattgaagtaaagacctgcacctggcccaaatcgcacacgctctggagcaatggagtgctcgaaagcgacatgattataccgaaaagcctcgcaggccccatctcacagcataaccaccggcccggataccatactcagacagccgggccgtggcaccttggaaaattagaactggacttcaactactgcgaaggcaccaccgtggtgataaccgaaaactgcgggacgcggggccccagtctgcggacaaccacagttagtggcaaacttatacacgagtggtgctgtcgaagctgtacccttccaccccttcgatacatgggtgaggatgggtgttggtacggcatggagataagaccaataagtgagaaagaagaaaacatggtcaaaagcctcgttagcgcagggagcggcaaggtcgataattttacaatgggggtactctgcctcgcaatcctattcgaagaagttatgagaggaaaattcggcaagaaacacatgatcgcaggagtcttcttcaccttcgtactattgttaagcggccaaattacgtggcgagacatggcgcacactctcatcatgatcggctctaacgctagcgatcgtatggggatgggcgtaacgtacttggccctcatagccacgtttaaaatacaaccattcttggcactaggcttctttctgaggaaactaacaagccgggaaaatctgttactgggcgttggactagcaatggccacgacactccagttacccgaggatatagaacaaatggctaacggcatcgcactcggactaatggcattgaaactcataacccaattcgaaacgtatcaactctggacagcgttaatcagtttgacgtgctcaaacaccatattcaccctcaccgtagcatggaggacggccacgctgatactggctggcgtatcactattacctgtatgccaatcctcctcaatgagaaagaccgactggttacccatggctgtagccgcaatgggagtaccacctctaccattattcattttcggactaaaggatacactcaagcgtagatcctggccactcaacgagggtgtaatggccgtaggcctagtctcgattctagccagcagcctactgagaaacgatgtacccatggccggaccactggtagcaggaggtttactcattgcctgctacgtgataacagggacgtccgccgacctcactgtcgagaaggccgccgacatcacctgggaggaggaagcagagcaaacgggagtctcgcataacctaatgatcacagtagacgacgatggcactatgcgaataaaggacgacgaaaccgaaaacatcctaacggtgctcctaaagacagcactcttgattgtctcggggatctttccctatagtattccagcaaccctgctggtctggcatacgtggcaaaagcaaacacaaagatcaggcgtactatgggatgtaccgagccctccagagacccaaaaggcggaactagaagaaggagtgtaccgtataaagcaacaaggcatcttcggcaagacacaagtgggtgtcggcgtgcagaaagaaggagtcttccacacaatgtggcacgtcacaagaggggcggtattgacctataacggaaagcggctagagccgaactgggcgagcgttaagaaagatctgatctcgtacggaggaggatggcgactgtcggcacagtggcagaaaggggaagaggtacaggtcatcgccgtcgagccaggcaagaaccccaaaaattaccagactatgcccgggaccttccaaacgaccacgggcgaaataggtgcaatcgcattagacttcaaacctgggacttccggaagcccaataatcaaccgggagggcaaggtggttggactctatggcaatggagtggtgacgaaaaacggaggatacgtatccggtatcgcacaaacaaatgccgagcctgatggcccaacgccagaattagaagaagagatgtttaagaaaagaaacctcacgatcatggacctacaccctggaagcggcaaaacccgtaaatacctacccgccattgtgagggaagcaataaagagaagactccgaactctaattctcgccccgaccagggttgtcgcagctgaaatggaagaagcattaaagggattgccgatccgatatcagacaacggcgacgaaaagcgagcacacaggcagggaaatcgtggacctaatgtgccacgcaacctttacaacacgattgctatccccggtacgagtgccaaactataacctgataataatggacgaggcgcatttcaccgaccccgcgtctatcgcagctcgtggctacatttccacacgggttggaatgggggaagcagccgccattttcatgacggcaacgcccccggggactgcggacgcgtttccacagagtaatgcacccatccaggacgaagaaagagacataccagaacgcagctggaatagcggcaacgaatggatcaccgacttcgccggaaagacggtttggttcgtacctagcattaaagcagggaacgatattgctaactgcctcaggaagaacggaaagaaagtaatacagctatcacgaaagactttcgacacagaataccaaaagacaaaactaaacgactgggatttcgtagtgacgacggacattagtgaaatgggagccaacttcaaggcggatcgggtaatagatccaaggcgatgcctaaaacctgtcatcctcacggacggccccgaaagagtaatactcgcaggaccgatgcccgtgaccgcggcgagcgccgcccagcgccgtggcagagtaggacgaaacccgcaaaaagaaaacgaccaatacatattcaccggtcaaccgctcaacaacgacgaagaccacgcacactggacagaagccaagatgctgctagacaacattaacactcctgaaggaattatccccgccctcttcgagcccgaacgagaaaagtcggcggccatagacggagaataccgactgaagggggaatcccgaaagaccttcgtagaactaatgcgtcggggcgacttacccgtgtggctagcccataaagtggcgtcggagggaatcaaatatacggaccgtaaatggtgcttcgacgggcaacggaataatcagattttggaagagaacatggacgtcgaaatatggactaaggaaggcgagaaaaagaaactacgaccacgatggctagatgcgcggacctacagcgatcccctagcccttaaagagtttaaggagttcgcggctggccggaaaagcatagcactcgacctcgtcaccgaaatcggtagagtaccaagccacctagcgcacagaacccggaatgcgctagacaacctcgtgatgttacacacatcagagcacggaggacgagcttaccggcacgcagtcgaggaactacccgagacgatggagacgctgctccttctaggcctaatgatcctgctcacaggaggtgccatgctctttctaattagcggcaaaggcataggaaaaacgagtataggcttgatatgcgtcatagccagctcagggatgttgtggatggcggaaatacccctacaatggattgccagtgcgatagtcctagagttcttcatgatggtcctgctaatcccagaacccgagaaacaacggaccccacaagacaaccagctagcatacgtcgtgattggaatactcaccttagcagcaataatagcagcgaacgagatgggcctacttgaaaccacgaagcgggacttggggatgagtaaagagccaggggtcgtcagccccaccagctacctagacgtagacctgcaccctgcatcggcctggaccctatacgcggtagctacaaccgtaattacaccaatgctgcggcacacaatagagaactcaaccgcgaacgtctccctagctgcgattgccaaccaagcggttgttctcatgggattagacaaaggctggccaatatctaaaatggacctaggggtaccactgctcgccttgggatgctacagccaagtgaatccactcactctgacagcggcagtacttctactcattacacattatgcaataatcggacccggactacaggcgaaagcgacacgcgaggcgcagaaacgaacagctgcaggcatcatgaagaatcccaccgtcgacgggatcatgacgattgacctagatcctgtcatctacgactccaagttcgaaaagcaactcgggcaagtaatgctccttgtgctctgtgcagtgcaactcctactaatgaggaccagttgggcgctgtgtgaagccttaaccctcgcgaccggaccaatcaccacattatgggagggatcacccgggaaattttggaacaccacgatcgcagtaagcatggcgaacatattccgcggctcgtacctggcaggcgcagggctagcgttctcaataatgaaaagcgtggggacgggcaagcgcggaacagggtcgcagggggaaacgctaggtgaaaaatggaagaagaaactgaaccagctgagcagaaaagacttcgacttgtataagaaatcaggaataacagaggtggatcgcacagaagctaaagaaggcctaaaacgaggggaaatcacacaccatgcggtgtcgaggggaagcgcgaaactacagtggtttgtcgagaggaacatggtaattccggagggccgagtaatagacttagggtgtgggcgcggcggatggagctactactgcgccggtctgaagaaagtgactgaggtccgaggatatacaaaaggcggacctggccacgaagaaccagtccctatgagcacatacggctggaacatcgtgaagctcatgtctggcaaagatgtgttctacttacctcctgagaagtgtgatacactactgtgtgacattggcgaatcctcaccgagccccacggtagaggaatcacgaacaatcagagtactcaagatggtggagccgtggctcaagaataaccagttttgcataaaagtacttaacccgtatatgcccacagtaatcgaacacctagaacggttacaaaggaagcatggcggaatgctcgttcgaaaccctctaagtagaaacagcacccatgagatgtactggataagtaacgggactgggaacatagtcgcaagcgttaacatggtcagccgattactactaaacagattcacaatgacccatagaagacccacgattgaaaaggatgtagacctgggggccggtacccgacatgtaaacgcggaaccggaaactccaaacatggacgtaattggagagcgaataaaacgtatcaaggaagaacataactcgacatggcactatgacgacgaaaatccctataaaacgtgggcctaccacggcagctacgaagtgaaggcgaccggcagcgcttccagcatgatcaacggcgtggtaaagctgctcactaaaccatgggacgtcgtcccaatggtcactcaaatggctatgaccgacacaaccccgtttggccaacaacgtgttttcaaagaaaaagtagatacaagaaccccgagaagtatgcccggaacacggcgggttatgggcatcacggccgaatggctttggagaactcttgggcggaacaagaaacctcgactatgtaccagagaggagttcaccaagaaagtaagaaccaacgcggcaatgggtgccgtcttcaccgaagaaaaccagtgggacagtgccaaggctgcagtagaagacgaagacttttggaagctagttgacagggaacgcgagctacacaaactaggaaaatgtgggagctgcgtatacaatatgatgggtaagcgcgagaagaaactaggagagtttggaaaagcaaagggaagcagagcaatatggtatatgtggctaggagctcgatacctcgagttcgaagcgcttggatttttaaatgaagatcactggttcagcagagaaaactcatatagtggggtcgagggtgaagggttgcacaaactaggctacatccttcgggacatcagtaaaattccaggaggagcaatgtatgcggatgataccgcaggatgggacacccggatcacagaagacgacctacataacgaagaaaagataacccagcaaatggatccagagcacagacaactcgccaacgctatattcaaacttacctatcagaacaaggtagtaaaggtccaaaggccaacacccacgggtacagtgatggatatcataagccgcaaggatcaaagagggagtgggcaagtcggaacatacggactgaacacctttacgaacatggaagcacagcttattcgtcaaatggagggagagggtgtactatcaaaagccgacctagaaaacccgcacctaccagagaagaaaataactcagtggctggagacgaagggcgtggagcgcctgaaacgaatggcgatatcaggcgatgactgcgtggtcaaacccatagatgaccggttcgctaacgctctccttgctctcaacgacatggggaaagtgcgaaaggacattccacagtggcaaccgtcaaaaggctggcacgattggcaacaggtaccattctgttcccaccacttccacgaactaataatgaaggacggccgcaagctcgtagtgccatgccgcccgcaggacgaactcatagggcgggcccgaatctcccagggagcaggctggagcctaaaggaaacagcgtgcctaggtaaggcatacgcgcaaatgtggtcgctcatgtactttcacagaagagacctcaggctcgcaagcaatgcgatctgcagtgcagttccagtccattgggtaccgacgagcagaacgacttggagtatacatgcgcaccaccaatggatgacaaccgaagacatgttaactgtatggaaccgggtatggatcgaggacaacccgtggatggaagacaaaacaccggtcacaacctgggaaaacgtaccatacctaggaaaacgagaagaccaatggtgcgggtccctgatcgggcttacgtcgcgggccacctgggcacaaaacattccaaccgccatccagcaagtaagaagtcttatcggtaacgaagaatttctcgactacatgccgtcaatgaagcgtttccgcaaagaggaggaatccgagggcgccatctggtaa

SEQ ID NO: 25845 - RNA, 9873 nt, synthetic construct
  misc_feature 1..9873: note = derived and/or modified CDS sequence (opt11) from DENV-3__HQ705615__SS-prME
  source 1..9873: mol_type = other RNA
acgtccctatgcttaatgatgatcctgcccgcggccctagcgttccacttgaccagccgggacggggagccgcggatgatcgtggggaagaacgagcggggcaagagcctgctgttcaagaccgctagtgggatcaacatgtgcacgctcattgctatggacctgggggagatgtgcgacgataccgtgacctacaagtgccctcacatcactgaagtggagcctgaggacatagattgctggtgcaacctgaccagcacctgggttacctacgggacgtgcaaccaggccggagagcataggagagacaagcggtccgtggccctcgcgccccacgtgggcatggggctggacacccgcacccagacctggatgtcggccgagggtgcctggcgccaggtggagaaggtcgagacttgggcgctccgccacccgggttttaccatcctcgcactcttcctggcccactatattggcacctccctcactcagaaggtggtgatcttcatccttttaatgctcgtcacgcccagcatgactatgcggtgcgtgggtgtaggaaaccgcgacttcgtcgagggcctgtccggtgccacctgggtggacgttgtcctggaacacggtgggtgcgtgacgacgatggccaagaataagcctaccctcgacattgagctgcagaagacggaggccacccagctggcgacgctgcgcaagctgtgcatcgagggtaagattaccaatatcacaaccgacagtcgctgtcccacgcagggcgaggccacgctgccggaggaacaggaccagaactacgtctgcaagcacacctacgtcgaccgtgggtggggcaacgggtgtggcttattcggcaaaggctccctggtgacgtgcgccaagttccagtgcctggagcctatcgagggcaaggtggtccagtacgaaaacctaaagtacacggtgattataaccgtgcacaccggggaccagcaccaggtcggcaacgagacccagggggtgacagccgaaattacgccccaggccagcaccacagaggcgatccttcccgagtatggcacgctggggttggagtgctccccgaggacgggcctggacttcaacgagatgatcctcctcaccatgaagaacaaagcctggatggttcaccggcaatggttcttcgaccttcccctgccctggaccagtggcgccacaacggagacccccacctggaatcgcaaggagttactggtgaccttcaagaacgcccacgccaagaagcaagaggtggtcgtgctggggtcgcaggagggcgcgatgcacacggcgctcaccggggccacggagattcaaaatagcggcgggacctccatcttcgccggccacctgaaatgccggctgaagatggacaaactcgagctgaagggcatgagctacgccatgtgcacgaacaccttcgttctgaagaaggaggtctctgaaacccagcacgggaccatcctcatcaaggtcgagtacaagggcgaggacgttccgtgcaagatccccttcagcacggaggacgggcagggaaaagcgcacaacggtcgcttgatcactgccaaccccgtcgtgactaaaaaggaggagcccgtgaacatcgaggcggagccgccctttggggaatccaacatcgtcatcggcatcggggacaacgccctgaagatcaactggtacaaaaagggctcaagcattgggaagatgttcgaggctaccgcccggggcgcaagacggatggccatcctaggcgacacggcctgggacttcggatccgtaggcggggtgctcaacagcttaggcaagatggtccaccaaatcttcgggtccgcgtacaccgctcttttcagcggcgtttcctgggtaatgaagatcggcatcggggtacttctgacctggatcggcctgaacagcaagaataccagtatgagcttctcttgcatcgccatcgggatcatcacgttgtatctgggcgccgtggtgcaagcggacatgggttgcgtgatcaactggaagggcaaggaactcaagtgcggaagcgggatcttcgtgaccaacgaagttcacacctggaccgagcagtacaagttccaggcggattcccccaagcgcctggcaacggccatcgctggcgcgtgggagaacggggtctgcggcatccgcagcaccactcggatggagaatctgctgtggaagcagatcgcgaacgagttgaactatatcctgtgggagaacaacattaagctgaccgtcgtggtaggggacatcatcggcgtgctcgagcagggcaagcgaactctgacgccccagcccatggagttgaagtactcctggaaaacatgggggaaggcgaagatcgtgaccgccgagactcagaacagctccttcataatcgacgggcccaacacccccgagtgcccgtcagtctcccgggcctggaacgtgtgggaggttgaggactacgggttcggcgtcttcacaaccaacatctggctcaagctgcgcgaagtatacactcagttatgcgaccaccggcttatgagcgcggccgtgaaggacgagcgcgctgttcacgccgatatgggctactggatcgagagccaaaagaatgggtcctggaagttggagaaggccagcctgatcgaggtgaagacatgtacctggccgaagtctcacaccctctggagcaacggcgttctggagtccgacatgatcatacccaagtcgctggcggggccaatctcccagcacaatcatcggccgggctaccacacccagacggccgggccctggcacctcgggaagctggagcttgactttaactactgtgagggcactaccgtcgtgattaccgagaactgcgggacacgcggccccagcctccggaccactactgtgtccgggaaattaatccacgagtggtgttgccgcagctgcacgctgcccccacttagatacatgggcgaagacgggtgctggtacggcatggagatccgccccatttcggagaaagaggagaacatggtaaagagtctggtctcagctgggagcggcaaagtcgacaatttcaccatgggcgtcctgtgcctcgcgatcctgttcgaggaggtgatgcggggcaaattcggcaagaagcacatgatcgccggggtgtttttcacgttcgtcctgctcctctccggccagatcacctggcgcgatatggcgcacactctcatcatgatcggcagtaacgcctccgaccggatgggcatgggagtgacctacctagctctcatagccacattcaagatacagccgtttttagccctcgggttcttccttcgaaagctgacaagccgggagaacctcctgctgggcgtgggcttggcgatggccactaccctgcagctgcccgaggacatcgagcagatggccaacgggatcgccctcggcctgatggctctgaagctcataacccagttcgagacctaccagctgtggacggccctgatcagcctgacctgcagcaacaccatcttcaccctgaccgtcgcgtggcgcaccgccaccctcatcctagccggggtgtctctgctgcccgtatgccagtccagctccatgcggaagaccgattggctccccatggcggtcgccgccatgggagtgccacccctcccactgtttatattctcgttgaaggacacgttaaagcgccgttcctggcccctgaacgaaggcgtcatggccgtcggcctcgttagcatccttgcttccagcttgttacgtaatgacgtccctatggcgggccccctcgtggccgggggactactcatcgcttgttatgtgatcacagggacatccgccgatctcaccgtggagaaggccgccgacataacgtgggaggaggaggcggagcagaccggtgtgagccacaacctcatgatcgccgtggacgacgacggaaccatgcgcatcaaggacgatgaaaccgagaatatactcaccgtcttgctgaagacagctctcctgatcgtctccggaatcttcccgtactcaatccccgccaccctgctcgtgtggcacacctggcagaagcagactcagaggtctggcgtcctgtgggacgttccaagcccgcccgagacacagaaggcggagctggaggagggggtgtaccgcatcaaacagcagggcatcttcggaaagacgcaggtcggcgtgggtgttcagaaggagggcgtcttccacacgatgtggcacgtgaccagaggggcggttctcacttacaacgggaagcgtctggagcccaactgggcctccgtcaagaaagacctgatctcgtacggcggcggctggcggctcagcgcccagtggcagaagggcgaagaggtccaggtgatcgcagtcgagcctggtaagaacccaaagaacttccagaccatgccgggaactttccagacaacgaccggggagatcggcgcgatcgcgctggacttcaagcccgggacaagcgggagccctatcatcaatcgagagggaaaggtggtggggctatacgggaacggggttgtgaccaagaacggcggatacgtgtccggcatcgcccagacgaacgccgagccggacggccccacccccgaactggaggaagagatgttcaagaaacgcaatctcaccatcatggacctgcatcccggtagcggcaagacgcgcaagtatttgccagcgatcgttcgggaggcgatcaagcgccgacttcgaacgctgatcctagccccaacccgggtggtggccgcagagatggaggaggcgctcaaggggctgcccatcaggtaccagaccaccgccacaaagtccgagcacaccggccgggagatcgtcgacctcatgtgccacgccaccttcaccatgcgcctcctgagccccgtccgggtgccgaactacaacctgatcatcatggacgaggctcatttcacggaccccgcctccatcgctgcacgcgggtacatcagcacccgggtcggcatgggcgaggccgccgcgatcttcatgactgccactccacccgggacggccgacgccttcccccagtccaacgcccccattcaggacgaggaacgcgacatccccgagcgcagctggaactccggcaacgaatggatcactgacttcgcggggaagacggtgtggtttgtgcccagcatcaaggccggcaacgacattgccaactgtctcaggaagaacgggaagaaggtaatccagctgtccagaaagaccttcgatacggaatatcagaaaaccaagctgaacgactgggacttcgtggttaccaccgatatcagtgagatgggcgcgaactttaaggccgaccgggtgatcgacccgcgccggtgccttaagcccgtgatcctgacggacggccccgagcgcgtaatccttgcggggcccatgccggtcaccgccgccagcgccgcccagcggcgcggccgggtagggcgcaacccacagaaggaaaacgatcagtacatcttcaccggccagcccctcaacaacgacgaggaccatgctcattggaccgaggccaaaatgctgctggacaacatcaacacccccgaggggatcatccctgccctcttcgagcccgagcgggagaagtccgccgcgatcgatggcgagtaccgactgaaaggcgagtcccggaagacgttcgtggagctgatgcgacgcggtgacctgcccgtctggctggcccacaaggtggccagcgagggcatcaagtacaccgaccgcaagtggtgctttgacgggcagcggaacaatcagatccttgaagaaaacatggacgtcgaaatctggaccaaggagggcgagaagaagaaactgcgcccacgctggctggacgctcgcacttactccgacccgctggcactaaaggagttcaaggagttcgccgccggcagaaaaagcatcgccctggacctggtaacggaaatcggcagggtgccctcccatcttgctcaccgcacgcggaacgccctggataacttggtaatgctgcatacgagcgagcacggcgggcgcgcgtaccggcatgccgttgaagaactgcccgagaccatggaaacgctgctcctgctgggccttatgatcctgctgaccgggggcgccatgcttttcctgatcagtggtaaggggatcggcaagacctccattgggctgatctgcgtgatcaccagctccggcatgctctggatggccgagattccgcttcaatggatcgccagcgcgatcgtcctggagttcttcatgatggtgcttctgatccccgaacccgaaaagcagcgcacaccccaggacaaccagttggcctacgtggtcatcgggattctcaccctggccgccatcattgccgcaaacgagatgggcctgttagaaaccaccaagcgggacctggggatgtccaaggagccgggggtggtaagccccacgtcctacctggacgtcgacctccaccctgcaagcgcctggaccctgtacgccgtggcgaccaccgtaatcacgcccatgctgaggcacaccatagaaaactcgacggccaacgtaagcctcgccgccattgccaaccaggcggtggtgctgatgggcctggacaagggttggccgatatccaagatggatctcggcgtccccctgctggccctcggttgctactcgcaggttaaccccctgaccctgacggccgctgtgctcctgttgatcacccactacgcaatcatcggccccggcctccaagccaaggctacccgggaggctcagaagaggacggccgccggcattatgaagaatccgaccgtggacggcatcatgactatcgacctagaccccgtgatatacgacagtaagttcgaaaaacaactgggccaggtgatgctcctggtcctgtgcgcggtgcagctcctgctgatgcggaccagctgggctctctgcgaggccttgacactggccacgggccctatcaccaccctctgggagggctccccagggaaattctggaacactacgatcgcggtaagcatggccaacatctttcgtgggtcctacctggccggtgccggcctggccttcagcatcatgaagtccgtcgggaccggcaagcggggcaccgggagccagggtgagacgctcggggaaaagtggaagaagaagttaaatcaattaagccggaaagactttgatctctacaagaagagtggcatcaccgaagtggatagaactgaggcgaaggaggggctgaagcgcggcgagatcacccaccacgccgtgagccggggatcggccaaactgcagtggttcgtcgagaggaacatggtgatcccggaagggcgggtgatcgacctcggctgcgggcgcggcggatggagctaccactgcgccggcctcaagaaagtaacggaggtgcggggctacacaaaaggcgggcccggtcacgaggagcccgtgcccatgtccacgtacggctggaacatcgtcaaacttatgagcggaaaggacgtgttctacctcccgcccgagaagtgcgacaccctgctatgcgacatcggcgaatcctctccctcccccacagtggaggagagtcgcaccatccgcgtcctgaagatggtggagccgtggctcaagaacaaccagttctgcatcaaggtgctaaacccatacatgcccacggtcatagagcacctggagcggctccagcgcaagcacggcggcatgctagtgcggaaccccctgtcccgcaactctacccacgagatgtactggatatccaacggcaccgggaacatcgtggccagcgtcaacatggtgtccaggctcctgctgaaccgcttcaccatgacgcacagacgcccgaccatcgagaaggacgtggacctcggggcgggcacccggcacgtcaacgccgagccagagacccccaacatggacgtcataggggagcgcatcaagcggatcaaggaggaacacaacagcacttggcactacgacgacgagaacccctataagacttgggcctaccacggatcgtacgaggtcaaggccaccgggagcgcctcctccatgatcaatggcgtcgtcaagctgctgaccaagccctgggacgtcgtgccaatggtgacgcagatggcgatgactgacacgacccccttcgggcagcagcgcgtcttcaaggagaaggtggatacgcggaccccgcgctcgatgcccggtacgcggcgcgtgatgggcatcaccgccgagtggctgtggcggacgctggggcgcaacaaaaagccccgtttatgcacccgtgaggagttcaccaagaaggtccggaccaacgctgccatgggcgcggtgttcacggaggagaaccagtgggattccgctaaggccgccgtggaggacgaggacttctggaagctcgtagatagagagcgcgagctgcacaagctggggaagtgcggcagctgcgtgtataacatgatggggaagagggagaagaagctcggtgagttcggcaaggccaaggggtcccgcgcgatctggtacatgtggctgggcgcccggtacctggagttcgaggcgctcgggtttctgaacgaggaccactggttcagccgagagaactcctacagcggagtggagggggaaggactgcacaagctcggatacatcctgcgggacatctccaagatccccggcggcgccatgtacgccgacgacaccgcggggtgggatactcggatcaccgaggacgacctgcacaacgaggagaagatcactcagcagatggacccggaacatcggcagctcgccaacgctatcttcaagctgacctatcagaacaaagtcgtcaaggtgcagcgaccaaccccgaccggcaccgtcatggacatcatctcccggaaggaccagcgcgggtccggccaggttggcacgtacggacttaacacctttaccaacatggaggcccagctcatccggcagatggagggcgaaggggtgctgagtaaggccgacctggagaacccccacctcccggagaagaagataacccagtggctggagacgaaaggcgtcgaacgcctgaagagaatggcgatctccggcgacgactgtgtggtgaagcccatagacgaccgattcgccaacgccctcttagcactgaatgacatggggaaggtccggaaggatatcccccaatggcagccctccaagggctggcacgactggcaacaggtgcctttctgctcccatcattttcacgagctcatcatgaaagacggacgcaaactggtggtcccgtgccggccgcaggacgagctgatcggcagagcccggatcagccagggggcagggtggtccttaaaggagaccgcctgtttaggtaaggcttatgcccagatgtggagcctgatgtatttccaccgccgtgacctacgcctggcgtccaatgccatctgcagcgccgtgcccgtgcattgggtcccgacctccaggaccacgtggtccatccatgcccaccaccagtggatgacgaccgacgacatgctaacagtgtggaaccgggtgtggatcgaggacaacccctggatggaggacaagacccccgtaaccacctgggagaacgtgccctacctcgggaagcgcgaggaccagtggtgcggttcgctgatcggattgaccagtcgggccacgtgggcgcagaacatccctaccgccatccagcaggtccgcagcttgatcggcaatgaggagttcctcgactacatgccgtccatgaagcggttcagaaaggaagaagagtcggagggggccatctggtaa

SEQ ID NO: 25846 - RNA, 9873 nt, synthetic construct
  misc_feature 1..9873: note = derived and/or modified CDS sequence (opt11) from DENV-3__JF920398__SS-prME
  source 1..9873: mol_type = other RNA
accagcctctgccttatgatgatactgccggccgccctggcgtttcacctcacaagccgagacggggagccccggatgattgttgggaagaacgagcgggggaagtcactgctgttcaagaccgcctctgggatcaacatgtgcaccttaatagccatggacctgggggagatgtgcgacgacaccgtaacctacaaatgcccccatatcaccgaagtcgagccggaggatatcgattgctggtgcaacctgaccagcacctgggtaacgtacggaacgtgcaaccaagctggcgagcaccgacgcgataaacggtcggtggcccttgcgccccacgtgggtatgggtctggacacccgcacccagacctggatgtccgccgagggggcctggcgacaggtcgaaaaggtcgagacgtgggccctgcgacacccagggttcacaatcctagcgctgttcctggcccactatattggcacctccttgacccagaaggtcgtgatcttcatcttactgatgttggtcacgccgagtatgaccatgaggtgcgtgggggttggcaaccgcgacttcgttgaaggcctctcaggcgccacctgggtagatgttgtactggaacatggagggtgtgtgaccacgatggccaagaacaagcctaccctcgacatcgagctgcagaagaccgaggcgacccagctcgcgacgttacggaagctgtgcatcgaaggaaagattacgaatatcaccaccgacagccgctgcccgactcaaggcgaagcaaccctgccggaggaacaggaccagaactatgtttgcaagcatacgtatgtcgaccgtggatggggcaacgggtgcgggctattcggtaagggctccctggtgacctgcgcgaaattccagtgcttagagcccatagagggcaaggtggtccagtatgagaaccttaagtacacggtgattatcacggtgcacaccggggaccaacatcaggtcggcaacgagacacaaggggttacggcggagatcaccccgcaggctagcaccaccgaagcaatcctgcctgaatatggcaccttgggacttgagtgctcccccagaacgggactggacttcaacgagatgatactactaaccatgaaaaacaaagcctggatggtccaccggcaatggttcttcgatctgcccctgccgtggacgtccggcgcgaccaccgagacacccacctggaataggaaggaactcttggtgaccttcaagaacgcccacgcaaagaagcaggaggtggtggtgctgggatcgcaggagggggcgatgcataccgcactgaccggggccaccgaaatccagaattcaggtggaaccagtatcttcgccggccacctgaaatgtcggttaaagatggacaagctcgagctcaagggcatgtcttatgccatgtgcacgaacacgttcgtgctgaagaaggaggtcagcgagacgcaacatggcaccatcctcatcaaggtggagtataagggcgaggacgttccgtgcaaaattcccttcagcacggaggacgggcaaggcaaagcgcacaacgggcgcttgatcaccgctaacccggtcgtcaccaagaaggaggagcccgtgaacatagaggccgagccgccctttggcgagagcaacatcgtcatcggcattggcgacaacgcgctgaaaatcaactggtacaagaaaggctcgagcatcgggaagatgttcgaggcgacagcccggggagcacgcaggatggccatcctgggcgacacggcctgggatttcggctccgtgggcggggtattgaacagcctggggaagatggtccaccagatcttcgggtcggcgtataccgcccttttcagcggggtgtcctgggtgatgaagatcggcatcggggtactcctgacctggataggcctaaatagcaagaatacctcaatgagcttttcgtgtattgccatcgggatcatcactctttacttaggcgccgtggtgcaggcagacatggggtgtgttattaactggaagggcaaggagctgaagtgcggctcagggatcttcgtgaccaacgaggtgcacacctggaccgagcaatacaagttccaggcggactcaccaaaacgccttgccacggccatcgccggcgcttgggagaacggggtctgcggcatacgaagtaccacacgtatggagaatttactgtggaagcagattgcgaacgagcttaattatatcctttgggagaacaacatcaagcttaccgtcgtagtcggggacatcatcggcgtcctcgagcagggcaaaaggacgctgacgcctcagccgatggagcttaagtatagttggaagacctggggtaaggccaagatagtgaccgccgagacacaaaactcctccttcatcatcgacggcccgaacacccccgagtgccccagcgtctccagagcctggaacgtgtgggaggttgaagactatggattcggcgtctttaccaccaatatttggctcaagctaagggaggtgtacacacaactgtgtgaccaccgcctcatgtccgcggccgtgaaggacgaaagggcggtccacgccgacatgggttattggatcgaaagccaaaagaacgggtcatggaagctggaaaaagcctcattgatcgaggtgaagacgtgcacatggccgaagagtcacaccatttggagcaatggggtcctcgagtccgacatgatcattcccaagtcacttgcggggcccatctcacaacacaaccaccggccaggctaccacacccagacggcgggcccctggcacctgggcaagctcgagctggacttcaactactgcgaaggcaccacagtcgttatcaccgaaaactgcgggacgcgcggccccagcctgaggacgactacagtaagcgggaaactcatacatgaatggtgctgccgaagctgcacgctgcccccacttcggtacatgggggaggacgggtgctggtacggcatggagatccggcccatctcggagaaggaggagaacatggtcaagtcgctggtgtccgccggaagtggtaaggtggacaacttcacaatgggcgtcctgtgccttgccatactttttgaggaagtaatgagagggaagttcggcaagaagcacatgatcgccggcgtgttcctgaccttcgtcttactgctgtcaggccagatcacctggcgcgacatggcgcacacgctgatcatgataggctcaaacgccagtgatcggatgggcatgggtgttacctatctggccctaattgccaccttcaagatccagccctttctggccttggggttcttcctgcgcaagctgacctctcgggagaacctcctactgggggtgggtctggccatggcgacgactctgcagctccccgaggacattgagcagatggctaacgggatcgccctcggcttaatggcccttaagcttattacgcagttcgagacgtatcagctctggacggctctgatctcacttacctgctccaataccatcttcaccctgactgtcgcctggagaactgccaccctgattttagccggggtgagtctactccctgtgtgccaatccagctctatgcggaagaccgactggttgccgatggctgtcgccgcgatgggggttccgcccctcccgctgttcattttcagcctgaaggacaccctgaaacgccgctcctggcctctgaacgagggggtaatggccgtaggtctcgtatctatacttgcctccagcctgctccggaacgacgtcccgatggcgggccccttagtagccgggggcttgctcattgcctgctacgttatcaccgggaccagtgcagacctgaccgtcgaaaaagcagcggacatcacctgggaggaggaggccgagcagacaggcgtgtcccacaacctgatgatcactgtcgatgacgatgggactatgcgcatcaaggacgacgagaccgaaaatatcctcacggtcctactgaagacagccttattgatcgtttccggcattttcccatacagcatcccggccacccttctggtgtggcacacatggcagaagcagacgcaacggagtggcgtcctgtgggacgtgcccagcccgccggagacacagaaagccgagctggaggaaggggtgtaccgcatcaagcagcagggcatattcgggaagacccaggtcggggtaggagtgcaaaaggagggcgtgttccacaccatgtggcacgtgacacggggcgcggttctcacctacaacgggaagagactggagcccaactgggcgtccgtcaagaaggacctgattagctatggggggggatggaggctctccgcccagtggcagaagggggaggaggtccaggtgattgcagtagaacccggcaaaaaccccaagaactttcagaccatgccgggcaccttccaaaccactaccggggagatcggcgctatagcgcttgacttcaagccggggacgagcggcagtcccattatcaaccgcgagggcaaggtagtgggtctgtacggcaatggggtcgtgacgaagaacggaggttacgtgtccggcatcgctcagaccaacgctgaaccggatggtcctacccctgagctggaggaggagatgtttaagaagaggaacctcaccatcatggacctgcaccccggtagcggaaaaacccgcaaatacctgccggccatcgtccgggaggcaataaagcgcaggctgcgcaccctaatcctagcccccacacgggtggtagcggccgagatggaggaggccctcaaagggctgcccatccgctaccaaaccacggctaccaaatctgagcacacgggccgggagatcgtcgatctcatgtgccacgcaacgtttacgatgcgcttattgagccctgtgcgggtccccaactacaacctgataatcatggacgaagcccacttcaccgaccccgcctctatagccgcacgaggctacatcagcacccgggtcggtatgggcgaggcagcagccatcttcatgaccgcgacccccccagggactgcggacgccttcccgcagtctaacgccccgatacaggacgaggaacgcgacatccccgaacgcagctggaactccggcaacgaatggatcactgattttgccgggaagacggtatggttcgtgcccagtattaaggcgggcaacgatatcgccaactgcctccggaagaacggcaagaaggtcattcagttatcccgcaaaactttcgatacggagtatcaaaaaaccaagctgaacgactgggacttcgtggtaaccacagacatcagcgaaatgggagcgaacttcaaggccgaccgggtcatcgacccgcgtagatgcttaaagcccgtaattttaaccgacggccccgagcgcgttattctagccggtcccatgccggtcactgcggcgtccgcagcccagcggcgcggacgggtgggacgtaacccgcagaaggagaacgaccagtacatattcaccggccagcccctcaacaacgacgaggaccacgcccactggaccgaggctaaaatgcttctcgacaacatcaacacgcccgaggggatcatcccggccttgttcgagcccgagcgggaaaaaagtgccgccatcgatggcgagtaccgccttaagggggagagtcggaaaaccttcgtggaactgatgcgccgcggcgacttacccgtgtggctggcgcacaaggtggccagcgagggcattaagtacaccgaccgaaagtggtgttttgatgggcagcgtaacaaccagatcctggaggaaaacatggacgttgagatctggaccaaggagggcgagaagaaaaagctaagaccgcggtggctggacgcccgcacgtactccgatccgctggccctcaaggagttcaaagaattcgccgcgggcagaaagtcgatcgccctggacctagttactgaaataggacgggtgccctcccatcttgcccaccggacccggaacgccttagataacctggtgatgctccacaccagcgagcacggaggccgcgcttaccggcacgctgtggaggaactgcccgaaactatggaaaccctgctcctactgggactcatgatcctgttgaccgggggcgccatgctattccttatcagcgggaaagggatcggcaagacctccatcgggcttatctgcgtaatcgcatcttccggcatgctctggatggccgagatcccgctccaatggatcgcctcagcgatagtcctggagttctttatgatggtgctcctgataccggagcctgagaagcaacgcacgcctcaggacaaccagctggcctacgtggtcataggcatcctcaccttggctgccatcatcgcagcgaacgagatgggcctcctagagacaactaagcgagacctgggaatgtcgaaggaaccgggggtggtgtcacccacttcctacctggatgtggacctccatcccgccagcgcctggaccctgtacgccgtggcgactaccgtgatcacgccaatgctgcgccacactatcgagaatagcacggcgaacgtcagcctggccgctatcgcgaaccaggcagtggtgctgatgggcttggataaaggctggccgatctccaaaatggacctcggcgtcccactgcttgccctagggtgctacagccaggtgaaccccctgaccctgacggcggctgtgctgctgctgatcacccattacgccatcatcgggcccggcctccaggctaaggccacccgcgaggcacaaaagcgaaccgccgcaggcataatgaaaaaccccactgtcgacggcattatgaccatcgacttggaccccgtgatttacgacagcaagttcgagaagcagctgggccaggtcatgctactcgtcttgtgtgcagtgcagctccttctgatgagaaccagctgggctctctgcgaggctctgacactggccaccggccccatcactaccctctgggagggctcacccgggaaattctggaacaccacgatcgcggttagtatggccaacatcttccgtggatcctacctggcgggggctggcctagcatttagcattatgaaatccgtcgggaccggcaagcgcggcaccgggagccagggcgagaccctcggggagaagtggaagaagaagttgaaccagctgagccgcaaggacttcgacctgtataaaaagtccgggatcacagaggtggatcggacggaagcaaaggaggggctgaagcgcggcgagataacgcaccatgccgtgtcccggggctccgcaaagctgcagtggttcgttgagcgcaacatggtgatcccggaaggtcgggttatcgatttaggctgcggacgcggagggtggagttactattgcgcgggcttaaagaaggtcaccgaggtgcggggctacaccaaaggcgggcctgggcacgaggaaccggtgcctatgtccacgtacggatggaacattgtcaagctgatgagcggaaaggacgtgttctacctcccgcccgagaaatgcgacaccctgctgtgcgacatcggcgaatcctcgccctcccccaccgtggaagagagcaggacaatacgtgtcttgaagatggtggaaccgtggctcaagaacaaccagttctgtatcaaggtgttaaacccctatatgcccaccgtcattgagcacctcgaacggctacagcgtaagcacggaggtatgctggtgagaaaccctctgtcccggaacagcactcacgagatgtactggatatcaaacggcacagggaacatcgtggccagcgttaatatggtgagtcggctcctgttgaaccgcttcactatgacgcaccgacgcccaaccatagagaaggatgtcgaccttggcgcaggtactcggcacgtcaacgccgaacccgagaccccgaacatggacgttataggggaacgcatcaagcggatcaaagaggagcacaattccacgtggcactacgacgatgagaacccctacaagacctgggcataccacggctcctacgaggtgaaggccaccgggtcagcctccagcatgatcaacggcgtagtgaagctgctgaccaagccctgggacgttgtgcccatggtgacgcaaatggctatgacagacacgacccccttcgggcagcagcgcgtcttcaaggagaaggtggacacacgtaccccgcgctcaatgcccggtacacggcgcgtgatgggcataactgcagagtggctctggcgtacgctggggagaaataagaagccccgtctgtgtacccgtgaggagttcacaaaaaaggtccgcaccaacgccgccatgggcgcggtatttaccgaagagaatcagtgggactccgccaaggctgccgtagaggacgaggatttttggaagctcgtcgaccgggagcgcgagctccacaagctggggaaatgcgggagctgcgtgtacaacatgatggggaagcgggagaagaagctcggcgagttcggcaaggccaaggggtcacgcgcaatctggtatatgtggttgggcgcccggtatctagagttcgaggccctagggttccttaacgaggaccactggttcagccgcgagaactcctacagcggcgtggagggggagggccttcacaaactcgggtacattctgagagatatctcaaagattcccgggggcgccatgtatgccgatgacaccgcggggtgggacactcgcatcaccgaagacgacctgcacaacgaagagaaaatcacgcaacagatggacccagagcaccgtcagctcgccaatgccatcttcaagctcacctaccagaataaggtggtgaaggtgcagcgcccaacccctacgggcactgtcatggacattatctcaaggaaggatcaacgcggctccggacaagtgggtacgtacggcctgaacaccttcaccaatatggaggcccaactcatccggcaaatggagggcgagggggtgctgagtaaggccgacctggagaacccccacctgccggagaagaagatcacccagtggctggagacgaagggcgtggagcgcttaaagcgcatggcgatctctggcgacgattgcgtggtgaaacccatcgatgaccgcttcgcaaacgccctgctggcccttaacgatatgggcaaggtccgcaaagacatcccacagtggcaaccgagcaaaggctggcacgattggcagcaggtcccgttctgctcccatcatttccatgaactcatcatgaaagacgggcgtaagctggtggtcccctgccgcccgcaggatgaactcatagggcgcgcccggatctcacagggagcgggctggtccctcaaggagaccgcctgccttggaaaggcatacgcccagatgtggagcctgatgtacttccaccgccgggaccttcggctggcgtccaacgccatctgctctgcagtgcccgttcactgggtcccgacgagtcgcaccacgtggagcatccacgcccaccaccaatggatgactaccgaggacatgcttaccgtgtggaaccgggtctggattgaagataacccctggatggaagacaagactcctgtcacgacctgggagaacgtgccctacctcgggaaacgcgaagatcaatggtgtggcagcctcattgggctcaccagccgggccacgtgggcgcagaacatcccaaccgcaatccagcaggtcaggtcacttatcggaaacgaagagttcttagattatatgccctcaatgaagcggttccgcaaggaggaagaaagcgaaggggccatttggtga

SEQ ID NO: 25847 - RNA, 9873 nt, synthetic construct
  misc_feature 1..9873: note = derived and/or modified CDS sequence (opt11) from DENV-3__JF920402__SS-prME
  source 1..9873: mol_type = other RNA
acttccctctgtttgatgatgatactgccggcagcactagctttccacctgacctcgcgcgacggggaacccaggatgatcgtcggcaaaaacgaaagaggaaaaagtttgcttttcaaaactgcatcgggaataaacatgtgcaccctgattgctatggaccttggcgaaatgtgtgatgataccgtaacctacaaatgccctcatatcaccgaagtcgaaccggaagacatcgactgctggtgcaacctaacaagtacatgggtcacatatggcacgtgcaaccaagcaggagaacacagacgagacaaacggtccgtagctttggcgcctcacgtgggtatggggcttgacacgcgcacacaaacttggatgtccgcagaaggagcctggcgacaagtcgaaaaggtagaaacctgggcactacggcatccgggctttaccatattagcattgtttctagcccactacatcggaaccagcctcacgcaaaaagttgtcatctttattctcctaatgctcgtaactccctcaatgacaatgcggtgcgttggggttgggaaccgagacttcgttgaaggcctgagcggagcaacgtgggtcgacgtggtcctcgaacacggaggatgcgtgacaacgatggccaaaaacaaaccgacactagacatcgaattgcagaaaacagaagcaacacagctagccactctacgcaagttgtgtattgaaggcaaaatcacaaatatcacaaccgactcacggtgccccacacaaggcgaggccaccctacccgaggagcaagaccaaaactacgtgtgcaagcacacctacgtagaccgcggttggggcaatggatgtgggttattcgggaagggaagcctagtgacctgcgcgaaatttcaatgtttagagccgatagagggcaaagttgttcaacatgagaacctaaaatataccgtgatcataacagtacacaccggcgaccaacatcaagtaggtaatgaaacccaaggtgttaccgcagaaataacgccccaggccagcacaacggaagcgatactacccgagtacggaaccttaggcttagagtgtagtccccgaacagggctagacttcaacgaaatgatactattaaccatgaaaaacaaagcatggatggtccacaggcaatggttcttcgacctacctctaccgtggacatctggagccacgaccgagacccccacgtggaatcggaaagagctgctagttacattcaaaaacgcccacgccaagaaacaagaagtagtcgtacttgggtcccaagaaggcgcaatgcacaccgcgctgacaggcgccacggagattcagaactctggcggaacttctatcttcgcaggccatctaaaatgtcgtctaaagatggacaaactggaactgaagggcatgagctacgctatgtgcacgaatacgttcgtgctcaagaaagaagtttcagaaacccagcacggaacgatcttgatcaaagtggagtataaaggcgaagacgtcccttgtaaaataccattcagtacagaagacggccaaggaaaggcccacaacggaaggttaataacggccaacccagtggtcacaaagaaagaagaaccagtaaacattgaagcagaaccaccctttggagagagcaacatagttatcggtataggggataacgcccttaaaattaactggtacaagaaagggtcaagcataggcaaaatgttcgaggcgacagcacgaggtgccaggcggatggcaatactcggagacacagcctgggacttcggtagcgtagggggagtcctgaactccctcggaaaaatggtccatcagatattcggatctgcctacactgccctattcagcggtgttagttgggtaatgaaaatcggtataggagtactgttaacgtggataggactgaatagtaagaacacatcgatgagcttttcatgtatcgcgataggcattataacattgtacttaggagccgtagtacaagccgatatgggctgcgtaataaactggaaagggaaggaactaaaatgcgggagcggcattttcgtcacaaacgaagttcacacttggacggaacaatataaattccaggccgactcaccaaaaagactcgctactgcaatagcgggcgcctgggaaaacggcgtgtgcggaattaggtcaacaacgcgaatggaaaatctgctttggaaacaaatcgcaaacgagctcaattacatcctctgggaaaacaacataaaactaacagtagtcgtaggagacattataggtgtacttgagcaagggaagaggacactcacccctcaaccaatggaactgaaatactcgtggaagacctggggaaaagccaagatagtgacagcagaaacccaaaactcttccttcatcattgacggcccgaacacaccagagtgcccctcagtatcccgagcatggaatgtatgggaagttgaagactacggttttggggtattcactaccaacatatggctcaaactaagggaggtatatacgcaactgtgcgaccatagactcatgagcgcggccgtaaaggacgaaagggcagtacatgcggacatgggatactggatcgaaagccagaaaaacgggagctggaaactcgaaaaggcgtcattaatagaggtcaagacgtgtacgtggcctaaatcccacacgctctggtccaacggagttcttgagtctgatatgataatcccaaagtcacttgctgggccaattagccagcacaaccacagaccgggctaccacacccagacggcagggccctggcatctgggaaagctcgaattagattttaactactgcgaaggcacaacagtcgtcatcacagaaaactgcggggcaagaggtccgagcctacggaccacgacagtatctggtaagctaatacacgaatggtgctgtagaagctgcacacttccgccgctaagatacatgggtgaagacgggtgttggtatggcatggaaataaggcctataagcgagaaggaagaaaacatggtaaagtcgctcgtatcagccggcagcgggaaagtggacaacttcactatgggcgtcctgtgcctcgctatactcttcgaagaggtcatgaggggcaaattcggcaaaaagcatatgatcgcaggagtctttttcactttcgtcctacttctcagcggccagataacgtggcgggacatggcgcacaccctaataatgatcggtagcaacgcaagcgacagaatgggcatgggagtgacatatctagcactcatcgccactttcaagatacagccatttctagcactggggttcttcctcagaaaactaaccagcagggagaacctcctgctaggcgtaggattggccatggcgaccacgctgcaactacccgaagatatcgaacagatggccaacggcatcgccctcgggctcatggctctcaaacttataacgcagttcgagatctaccaactctggaccgcgctgatcagcctaacatgcagtaacaccatattcacccttactgtcgcttggagaacggcgactctgatactagccggggtatccctgctgccgatgtgccaaagttcatccatgcgaaaaacagactggcttccgatggccgtcgcagcaatgggagtccctccgttgccactattcatattctcgcttaaggacacacttaaacgaagatcatggcccctcaacgaaggagttatggcagtagggctcgtaagcatattagccagtagcctactgcgcaacgacgtaccaatggccggaccgctggtcgccggtgggctactgatagcgtgctatgttataaccggaacttcagcagatctgaccgtggagaaggccgccgacattacctgggaggaagaggcagagcagactggtgtgtctcacaacctgatgataaccgtcgatgatgacgggacaatgagaataaaagacgacgagaccgaaaacatactgacggtactcctcaaaacagcgttactgatagtgagcggcatcttcccgtactcaataccagcgacgttattagtatggcacacctggcaaaagcaaacgcagagatcaggggtgctatgggacgtacccagcccgcccgagacccaaaaggcagaattagaggaaggcgtctacagaattaagcaacaaggaatatttggtaaaacccaggtaggggttggtgtccaaaaagaaggagtcttccacacgatgtggcacgtcactagaggcgcagtgctaacttacaacgggaagcggctagaaccaaattgggcatcagtaaagaaagatttaatctcctacggaggagggtggcggctctcagcccagtggcaaaagggggaagaggtacaagtgatcgcagtggaacccgggaaaaacccgaaaaacttccagacaatgccaggaacgttccagacaacgaccggagagatcggagccattgctctggatttcaagccaggaacaagtgggagcccgatcatcaatagagaaggtaaggtcgtcggcctgtatgggaacggggtagtcacgaaaaacggtgggtacgtgtccggaattgcccagaccaacgctgaaccggatggccccactcccgaacttgaagaagagatgttcaaaaagagaaacctaactataatggaccttcacccgggttcgggtaaaacaagaaaatatctcccggcgatcgtccgggaagccatcaaacgccgcttgagaacactgatcctcgcgccgacacgtgtggtggctgcggaaatggaagaagctctgaaggggctgccgattcggtaccaaacaactgcaacaaaatccgaacataccggacgcgagatcgtggacctgatgtgccacgcaacgtttaccatgagactactatcaccggtacgtgtacccaattacaacctaattatcatggacgaagcccacttcaccgacccagcctcgatagcggcgagaggctatatctcaacccgggtaggaatgggagaagccgcggccatttttatgactgccacgcctccgggaactgcagacgcgtttccccagagcaatgcaccaatacaagacgaggaacgagacattcccgaacggtcctggaactccggaaacgagtggatcaccgacttcgctggcaaaaccgtctggtttgtcccaagcatcaaagcggggaacgacatagccaactgcctcaggaagaatggaaagaaggtcattcaactgtccagaaagacattcgacaccgaataccagaaaacaaaactgaacgattgggactttgtagtaacaaccgacattagcgaaatgggggcgaacttcaaggctgacagagtcatcgacccacgacgttgcttgaaaccagtaatattgactgatggccccgaacgagtgatactcgcgggtcccatgcccgtaacagcggcctcggcagctcagagacgcggccgggtgggcaggaacccgcaaaaggaaaatgaccaatacatatttacaggacaacccctgaataacgacgaagatcacgcacattggaccgaagccaagatgcttctcgacaatataaataccccagaaggtatcattcctgcgttattcgaacctgaacgagagaaaagcgcagccatcgacggggaataccgtctaaaaggggaatccagaaagacctttgttgaactgatgcgccgaggcgacctgccggtgtggttggcgcacaaagtagcgtccgagggcataaagtacacggaccgcaaatggtgcttcgacggccagcgcaacaatcaaatattggaagagaatatggacgtagagatttggacgaaagaaggcgagaaaaagaagctccgtcctaggtggctcgatgccaggacgtacagcgacccactggccctgaaggagttcaaagagttcgccgctggcagaaaatccattgcactcgacctggtaaccgagatcggacgcgtcccaagccacctggcacaccgcacccgtaatgccctcgacaacctagttatgctgcacacaagcgaacacgggggcagagcataccgacatgcagtagaagaactcccagaaacaatggaaaccctcctgctgcttggcctcatgatcttgctaacgggcggcgctatgctctttctaataagcggaaaaggaataggaaagacaagcatcggactcatctgcgtaatcgcttcaagtggaatgctgtggatggccgagatcccgttgcagtggatcgcctccgccatcgtactagagttctttatgatggtactgttaatcccggaaccggagaaacagcgaacaccacaggacaaccagctagcgtacgtagtgatagggatcctaacacttgcggccattatagcagccaacgaaatgggcctgctggagacgacaaaacgcgacttaggcatgagtaaagaaccgggagttgtatcgcccacgtcatacctcgatgtagacctccatcccgcaagtgcctggacgctctacgccgtggccacaacggtcatcacgcctatgcttcgacacacaatagagaacagtaccgcgaatgtcagcttggcggcgatcgctaatcaagccgtggtcttaatgggactcgacaagggctggcccatttcaaagatggacttaggcgtgccgctcctagccctgggttgttacagtcaggtcaatccactgacgctaacagcggccgtcctccttctaataacgcattacgccatcatcggaccgggactccaggcaaaagccaccagagaggcccagaaaaggacggcagccggcatcatgaagaacccgaccgtagatggtatcatgactattgatttagacccggtaatatacgatagtaagttcgagaaacagcttggacaagtcatgctgttggtcctctgcgtggtacagctactgctcatgaggacctcatgggcactctgcgaggccttgacgctcgcaaccggccccatcacaacactttgggaaggtagcccagggaaattctggaacaccaccattgctgtgagcatggcaaacatattccgaggcagctacctcgccggtgcgggactagcgtttagcatcatgaaaagtgtaggcacagggaagagaggcactgggtcccaaggcgagaccctcggggagaaatggaaaaagaaattaaaccaactgtctagaaaggactttgacctctacaagaaaagtggaataacagaagtcgaccgaacagaagccaaagaaggactgaaacgaggcgagataacacatcatgcagtctcccgtggcagcgcaaagctacaatggttcgtcgaacgcaatatggtcatacccgaaggacgggtcatagacctgggctgcgggcggggaggctggagctattactgtgcaggactcaagaaggttaccgaagttcgggggtacacgaagggcgggcccgggcacgaagaacccgttccgatgagtacgtacggctggaacatcgtcaaactcatgagcggtaaagacgtcttctacctacccccagagaagtgcgatacactcctctgcgacataggcgaatccagccccagtccaaccgtagaagaatcaaggacaatcagggtgctcaagatggtcgagccttggctcaagaataaccaattctgcatcaaagtcctgaacccctacatgcctacagtaatcgagcacctagagaggctccaacgcaaacacgggggaatgcttgtgcgcaaccccctcagcaggaactccactcacgagatgtattggatatcaaacggaactgggaatatcgtggctagcgtaaacatggttagccgactgctactaaacagatttacgatgacgcatagacgccccaccattgagaaggatgtggacttgggggcgggtacccgccacgtcaacgccgagccggagactccaaacatggacgtaataggagagagaataaaaaggatcaaggaggaacataactcaacctggcattacgacgacgagaacccatataaaacctgggcttaccacggaagttatgaagtcaaggcgaccggaagcgcgtccagcatgatcaatggcgtggtaaaactactgaccaaaccctgggatgtcgttcccatggtcacccaaatggcaatgacggacactacccctttcggacaacaacgtgtctttaaagaaaaggtcgacacccggacgccgaggtccatgccaggcacccgacgagtaatgggtataacggccgagtggctctggcgcacactcggaagaaacaagaagccgagactgtgcacaagagaagaatttacaaagaaagtacggactaacgcagccatgggagcagtcttcactgaagagaatcaatgggactccgctaaagctgcggtggaagatgaagacttctggaagctcgtagatcgagagcgcgaactccacaagctcggcaagtgcggatcatgcgtctacaacatgatgggcaagcgcgaaaagaagctcggggagttcggaaaagcgaaaggaagtcgggcgatatggtatatgtggctcggggctagatatctcgagttcgaagcactgggcttcttgaacgaggatcactggttctcacgcgaaaactcatactccggggtcgagggagaaggcctccataaacttggatacatcctccgagacattagcaaaataccaggaggagccatgtacgctgacgatacagcaggttgggacacccgcatcaccgaagacgatctacacaacgaagagaagattacgcaacaaatggacccagagcatcgacagctcgccaacgccatcttcaagttaacgtatcaaaataaggttgtaaaagtacagcggccaacccccacgggaaccgtaatggacataatcagccggaaagaccagcgcggctctggccaagtcgggacgtacggactaaacaccttcaccaacatggaggctcaattaatacgacagatggaaggcgaaggggtactcagcaaagctgacctagaaaacccccacctcccggagaagaagataacccaatggttagagaccaaaggagtcgagcgactgaaacgaatggcaatttcgggtgacgactgcgtagtgaaaccgatcgacgataggttcgcaaacgccctcctggcgctgaacgacatggggaaggtaagaaaggatatcccgcagtggcagccttcgaaagggtggcacgactggcaacaggtgccgttctgcagccaccacttccacgagctcatcatgaaagacggaagaaaacttgtcgtaccatgtcggccgcaggacgagctgataggacgggctaggatatcgcaaggagcgggctggagtctgaaagaaaccgcatgccttgggaaagcgtacgctcaaatgtggtctctgatgtacttccacagacgcgacctccgactagcatccaacgcgatatgttcagctgtaccagtccattgggtaccgacaagccgaaccacctggtccatacacgctcatcaccaatggatgaccaccgaggacatgttgaccgtgtggaaccgagtctggattgaagacaatccatggatggaggacaagacgcccgtgactacttgggaaaatgtcccgtacctgggcaaacgcgaagaccaatggtgtggtagcctcattggtttaacatcacgagctacatgggcccagaacataccgacggcaatacaacaggtgagaagtctaatcgggaacgaagagttcctcgactacatgccgtctatgaaaagattcagaaaggaagaggaatccgaaggagcgatctggtaa

SEQ ID NO: 25848 - RNA, 9873 nt, synthetic construct
  misc_feature 1..9873: note = derived and/or modified CDS sequence (opt11) from DENV-3__JF937652__SS-prME
  source 1..9873: mol_type = other RNA
accagtctctgcctcatgatgatcctgcccgctgccttggcgttccacctcactagccgggacggcgaaccccggatgatcgtgggtaagaatgaacgagggaaaagtttactgttcaagaccgcctccgggatcaacatgtgcactttaatcgccatggatttgggggaaatgtgcgacaacacggtgacctacaaatgcccccacataaccgaggtcgagcccgaagatatcgactgttggtgtaacctgacctccacctgggtgacttacgggacgtgcaaccaggccggcgagcaccggcgggacaagcggtccgtggccttggcgccccatgtagggatggggctggatactcgcacccagacctggatgtcagccgaaggcgcctggcggcaagtcgagaaggtagaaacctgggcactgagacaccccgggttcaccatactcgcgctttttctggcccactacatcgggacttccttgactcagaaggtagttatcttcatcctgcttatgctggtcactccgagcatgactatgcggtgcgtcggggtggggaaccgcgatttcgtcgaggggctatccggcgcaacgtgggtggacgtagtccttgagcacggcgggtgcgtaaccaccatggccaagaacaagcccaccctcgacatcgagctccagaagacggaggcgacgcagctggcgacgctccggaagttgtgcatcgagggcaaaatcaccaacattaccaccgactcacgctgccctacgcagggggaggccaccctgcccgaggaacaggaccagaactatgtatgcaaacacacctacgtcgaccgggggtgggggaacgggtgcggccttttcgggaaaggctccttagtgacctgtgccaagtttcaatgcctggagcctatagagggtaaggttgtacagtatgagaacctcaaatatacggtgatcatcaccgtgcacacgggggaccaacaccaggtcggaaacgagacccagggggtgaccgccgagatcacgccccaggccagcaccaccgaggcggtcctgcccgagtacggcaccctgggactcgaatgttccccgcgtacgggcctcgattttaatgagatgattctgctgaccatgaagaacaaggcatggatggtgcaccggcagtggtttttcgacctgccgctaccatggacctctggagctaccacggagacacccacgtggaaccgcaaggagttgctggtgaccttcaagaacgcccacgcaaagaagcaagaggtcgtggtgctcgggtcccaagagggggcaatgcacacggccctcactggggccaccgagatccagaacagcggcgggacctctatcttcgctggccacctgaagtgccgcctgaaaatggacaagctggagctaaagggcatgagctatgccatgtgcacgaatactttcgtcctgaagaaggaggtgtccgagacccagcacgggactatactcatcaaggtggagtacaagggcgaggacgtaccgtgcaagatacccttctctacggaggacgggcagggcaaggctcataacggacgcttgatcaccgccaaccccgtggtgaccaagaaggaggagttggtcaacatcgaggccgagcccccgttcggggagagcaacatcgtgatcggcattggggataacgcactgaagatcaactggtacaagaagggttccagcattgggaagatgttcgaggcgaccgcccgaggcgcccgccggatggccattctcggcgacacagcctgggacttcgggtccgtgggcggggtcctaaattcactcggcaagatggtgcaccaaatcttcggcagcgcgtacaccgccttatttagcggcgtgtcctgggtaatgaagatcggcatcggggtactgcttacctggatcggcctcaatagcaaaaacacctcaatgagcttctcctgcatagccatcggcatcatcacgctgtacttaggcgccgtggtccaggctgacatgggatgcgttatcaactggaaaggcaaggagcttaagtgcggctcggggatcttcgtgactaacgaggtccacacctggaccgagcagtacaagttccaggcggactcgcccaagcgcctggcgacggccattgctggcgcatgggagaacggggtgtgcggaatacgcagcaccactagaatggagaacctgctctggaagcagatcgcgaacgagttgaactatatcctgtgggagaacaacataaagctcaccgtggtcgtgggggacatcatcggggtactcgaacaggggaagcgcacgctgactccgcagcccatggagctcaagtatagttggaagacctggggtaaagccaaaatcgtaaccgccgagacgcagaactcgtccttcataatcgacgggccgaacacaccggaatgcccgagcgtgtcccgggcctggaacgtgtgggaggtcgaggactacgggttcggcgtgttcaccaccaacatctggttgaaactgcgcgaagtgtacacccagctctgtgaccaccggctgatgtcggcggccgtgaaggatgaacgcgcagtgcatgccgacatgggctactggatcgaaagccagaagaacgggtcctggaagttagaaaaagctagcttaatcgaggtgaagacctgcacctggccgaagtcccacaccctgtggagcaacggcgtcctggagtcagacatgatcatccccaagtccctcgcggggccaatctcccagcacaactaccggcccggctaccacacgcaaacggccgggccgtggcacctgggtaagctagagctcgactttaactactgcgaaggcaccacagtggtgatcactgagaactgtgggacgcgaggccccagcctgcggacgaccaccgtctccgggaagctgatccacgagtggtgctgtcgcagctgcacgcttccgcccctacggtacatgggcgaggacggatgctggtacggcatggagattcgaccgatctccgagaaggaggagaacatggttaagtctttagtatccgccggctccggaaaggtcgacaatttcaccatgggcgtgttgtgcctggccatactgttcgaggaagtgatgagaggtaagttgggcaagaagcacatgatcgcgggagtattctttacgttcgtgctgctgctctccggccagatcacctggcgtgatatggcgcacacgctgattatgataggcagcaacgcctccgaccggatgggtatgggcgtgacctacctggctctcatagccactttcaagatccagcccttcctggcccttgggttcttcctcagaaagctgaccagccgggagaatcttctactgggcgtcggcttagcgatggccactaccctccagctgcccgaggacatcgagcaaatggcaaacgggatcgccctgggcctcatggcgctgaagctgatcacccagttcgagacctaccagctctggactgccctgatctcgttgacctgctccaacaccatcttcacgctcacggtggcctggagaacggcgacactgatcctggccggagtcagccttctgcccgtgtgccagtccagctccatgcgcaagaccgactggctgccgatggcagtggcggcaatgggcgttccaccccttcccctgttcatcttcggcctgaaagacacgctcaagcgccgcagctggccgctgaacgagggcgtgatggccgtgggcctagtctccatactggctagctccctgctgcggaatgacgtgcctatggcggggccgctcgtggcaggagggctgttgatcgcctgctacgtcatcaccggcacatctgccgaccttaccgtggagaaagccgcggatatcacgtgggaggaagaagcagagcagaccggagtgtcccacaacctgatgatcaccgtcgacgacgacggcaccatgcgcatcaaggacgacgaaactgaaaacatcctgaccgtgctgttaaagaccgcgctgctcatcgtgagcggcatattcccatattccatcccagccaccctgctggtctggcacacctggcagaagcagacgcagaggagcggtgtcctctgggacgttcctagcccgcccgaaacccaaaaggcagagttggaggagggcgtatatcgcataaagcagcaggggatctttggcaagacccaggtgggggtaggagtacagaaggagggtgtattccacacgatgtggcacgtgacgcgcggggcggtcttaacctataatggcaaacgccttgagccgaactgggccagcgtgaaaaaggacctgatatcctacggaggagggtggaggcttagcgcccagtggcagaagggcgaggaggtgcaagtcattgccgtggaacccggcaaaaaccctaagaacttccaaactatgcccgggaccttccaaacgaccacaggggagatcggggcgatcgccctggactttaagccgggcacctccggcagccccatcatcaaccgcgaggggaaggtggtcggcctctatgggaacggggtagttacaaagaacgggggctacgtcagcggaatcgcccagaccaacgccgagcccgatgggccgaccccagagctggaggaggagatgttcaagaagcgtaacctgaccataatggacttacaccccggctccgggaagacgcgcaagtacctacccgccatcgtgcgggaggcgatcaaacgccgcctgcgcaccttgatcctggctcctacccgcgtggtcgcggcggaaatggaggaggccctgaaaggcttgcccataaggtaccagaccacagcgacgaaaagcgagcataccggacgggaaatcgtggacttaatgtgtcacgccaccttcaccatgcgtctcctatcccccgtacgggtcccaaactacaacctgatcattatggatgaagcgcatttcacggacccggcgtcaattgccgcgcgcggctacatttccacccgggtgggcatgggcgaggctgccgccatctttatgaccgcgacgccgcccggcaccgccgacgctttcccacagtctaacgctccgatccaggacgaagaaaaggacattcccgagcgctcctggaactcaggcaacgagtggatcaccgatttcgctggcaagaccgtttggttcgtcccatccatcaaagcggggaacgacatcgcgaactgcctgagaaagaacggcaaaaaggtgatacagctctcccggaagacattcgacaccgaataccagaagaccaaactgaacgactgggatttcgtggtcaccactgatatctccgagatgggcgcgaacttcaaggccgaccgcgtgatcgacccgcggcgctgcctgaagccggtgatcctcaccgacggacccgagcgcgtcatcctagccggccccatgcccgtgaccgcggccagcgccgcccagcgccgggggagagtggggagaaacccgcagaaggagaacgaccagtacatcttcaccgggcagcccctgaacaacgacgaggaccacgctcactggaccgaggcgaagatgttactggacaacatcaacacgcccgaaggtattattcccgccctgttcgaaccggagcgcgagaagtccgccgccatcgacggtgagtaccggctcaagggggagagccgcaagaccttcgtcgagctgatgcggcgcggcgatttacctgtgtggctcgcgcacaaggtcgcctccgaagggatcaagtacaccgaccggaaatggtgcttcgacggccagcgcaacaaccagatactggaggagaacatggacgtggagatctggaccaaagagggcgagaagaagaagctgcggccccgctggttggacgcccggacgtacagcgatcccttggccctgaaggagttcaaggagttcgccgcggggcgcaagtccatcgccctcgacctggtgaccgagatcggccgcgtcccaagccacctggcccaccggaccaggaacgccttagataacctggtgatgctgcacacgtccgagcacgggggccgggcctaccgccatgcggtggaggagctccccgagacgatggagaccctactactcctggggctgatgatcttgctgaccggcggcgccatgctgttcctcatcagcgggaagggcatcgggaagaccagcatcggcctaatatgcgtaatagcaagcagtgggatgttatggatggccgagatccccctccagtggattgcgagcgctatcgtcctagagttcttcatgatggtgttactcatccccgaacccgaaaagcagcggacgccccaggacaaccagctggcgtatgtcgtgatcggcatcttaaccctcgctgccatcatcgccgcgaacgagatgggtctgcttgagaccaccaaaagagacctcggcatgtcgaaggagcctggtgtggtgtccccaacgtcatacctggacgtggacctgcaccccgcgtccgcatggaccttgtacgctgtggcgacgaccgtcatcacacccatgctgagacacaccatcgaaaacagcactgcaaacgtgtctctggccgccatcgcgaaccaggcggtggtccttatggggttggacaaaggctggccaatcagcaagatggaccttggggtcccgctcctggccctgggatgctattcccaggtaaaccccttgaccctgacggccgccgtgctgctcctgatcacccactatgccatcatcggacctgggttgcaggcgaaagccacgcgggaagcccagaagcggaccgccgccggcatcatgaagaatccaaccgttgacgggatcatgaccatcgacctcgacccggtgatctacgactcaaagttcgagaagcagctgggccaggtcatgcttctcgtgctctgcgcggttcagctgctcctgatgcgcaccagctgggccctgtgcgaggcgctcaccctggcaacgggccccatcaccaccctgtgggaggggagccccggcaagttctggaacaccacgatcgcggtctccatggctaacatctttcgcgggagctacctcgccggagccggactggccttctccatcatgaagtctgtgggcaccggaaagcgcggcaccggctcccaaggggagaccctgggcgagaagtggaagaagaaacttaaccaactcagcaggaaggatttcgacctatacaagaagtccgggataaccgaggtggaccgcacggaggcaaaggagggcttgaagcgtggcgagatcacccaccacgccgtctcccgcggcagtgccaagctgcagtggttcgtggagcggaacatggtgatccccgagggccgcgtaattgacctgggatgtggccgtgggggctggtcatattactgcgcaggcctcaagaaggtgaccgaggttcgcgggtacactaagggcgggccggggcatgaggagccagtccccatgagcacgtacgggtggaacattgtgaaactgatgtccggcaaggacgtattctacctaccacccgaaaagtgcgacacactgctctgcgacattggggagagctccccctcacccacggtcgaggagtcccgaactatccgcgtactgaagatggtggagccctggctcaaaaataaccaattctgtattaaggtcctaaacccgtacatgcccacggtgatcgagcacttggagcgcctgcagcggaaacacgggggcatgctagtgcgcaatccgctgagccgaaactccacacatgagatgtactggataagcaacgggaccggcaacatagtcgcctccgtgaacatggtgtccagactgttactgaaccgattcacaatgacccacagacggcccacgatcgagaaggacgtcgatctaggcgccgggacccggcacgtcaacgccgagccggagacccctaacatggatgttatcggcgagcggataaagagaatcaaggaggagcacaactccacgtggcattacgacgacgagaatccctacaagacctgggcctaccatggttcgtacgaggtcaaggccaccggctccgccagctccatgataaacggcgtcgtcaagctcctaacaaaaccttgggacgtcgtgcccatggtcacccagatggccatgaccgacaccacgcccttcggccagcagcgcgtgtttaaggagaaggtggacacgcgcacgccccgtagcatgccgggcacacgccgggttatgggaataaccgccgagtggctgtggcgaacactcggccggaacaaaaagccccgcttgtgcacccgcgaggagttcactaagaaggtgcgtacaaacgccgccatgggggctgtgtttacggaggagaaccaatgggatagcgcgaaagccgccgtcgaagacgaggacttctggaagctggtggatcgcgaacgggaactccataagctgggaaagtgcgggtcctgcgtgtataacatgatgggcaagcgcgagaagaaactgggcgagttcgggaaagctaaaggcagccgggcgatctggtacatgtggctcggggcccgctatctcgagttcgaggccctgggcttcctcaacgaggaccactggttctcacgagagaactcgtactccggagtagaaggcgagggcctgcacaaactggggtacatcctccgcgacatttctaagatacctgggggtgcaatgtacgccgacgataccgcgggctgggatacacggatcaccgaggacgacctgcataacgaggagaaaataacacagcagatggaccccgagcacagacagttggcaaatgccatattcaagctgacgtaccagaacaaggtggtgaaagtccaaagaccgacaccgacaggcaccgttatggacatcatctcccgaaaggaccagcgaggcagcggccaggtggggacgtacggtctgaatacattcaccaacatgggggcccagctgatccggcaaatggagggtgagggcgtcctctccaaggcagacttagagaatccccacctcccggagaagaagatcacccagtggctcgagacgaagggcgtggagcggctcaagcgcatggcgatctccggcgacgactgtgtggtcaaaccgatcgatgacaggttcgccaatgctctgctcgccctgaacgacatggggaaggtgcgaaaggacatcccccaatggcagccctccaagggttggcacgactggcagcaagtcccgttctgcagccaccatttccacgagctgataatgaaggacgggcggaagctcgttgtgccgtgccggccccaagacgagctgatcggccgggcacgcatttcccagggcgcagggtggagcctgaaggaaaccgcctgcctcggcaaggcgtatgcccagatgtggtccctgatgtacttccatcggcgcgacctgcgactcgcgtcaaacgccatctgctccgcagtgcccgtccactgggtgcccaccagcaggaccacctggtccatccacgcccatcatcagtggatgactaccgaggacatgctgacagtgtggaacagagtctggatcgaggacaacccttggatggaggacaagacacccgtcaccacgtgggagaacgtgccctacctggggaaacgggaggaccagtggtgcggcagcttgattgggctaaccagccgcgctacgtgggcgcagaacatccctaccgcgatccagcaggtccggagtctgatcggtaacgaggagtttctcgattacatgccgtccatgaagcgcttccggaaggaagaggagtccgagggcgccatctggtga

SEQ ID NO: 25849 - RNA, 9873 nt, synthetic construct
  misc_feature 1..9873: note = derived and/or modified CDS sequence (opt11) from DENV-3__JF920404__SS-prME
  source 1..9873: mol_type = other RNA
acctcgctgtgtttaatgatgatcctgcccgccgccctggcgtttcacctcacaagccgggacggggagccccggatgatcgtgggaaagaacgaacggggcaaaagcctgctcttcaagaccgccagcggtatcaacatgtgcaccctaatcgccatggacctgggcgagatgtgcgacgacaccgtgacctataagtgcccccacatcaccgaggtcgagcccgaagacatcgactgctggtgcaacctgaccagcacctgggtgacctacggaacgtgcaatcaggctggcgagcaccggcgcgacaagcggtctgtggccctcgcgccgcacgtaggtatggggctggacacccgcacccagacctggatgagcgcagagggcgcgtggcgtcaggtggagaaggtggagacgtgggccctgagacacccggggttcactattctcgcgctgtttctggcacactacatcggcacttccctcactcagaaggtggtgatcttcattctgctgatgctcgtcactcccagcatgaccatgcgctgcgtgggggttggcaaccgggactttgtcgaaggactgtccggggccacttgggtggacgtggtcctggagcacggcggatgcgtgaccacgatggccaaaaataagcccaccttggacatagaactgcagaagaccgaagccacccagctggccactctccgaaaactgtgcatcgagggcaagatcaccaacataaccaccgacagccgctgcccgacgcaaggcgaggcgactctaccggaggagcaggaccagaactacgtgtgcaagcacacatacgtcgaccgggggtggggcaacggttgcgggctcttcgggaaaggctccctggtgacttgcgccaagttccagtgcctcgagcccatagagggaaaagtagtccagtatgaaaacctcaagtacacggtgatcatcaccgtgcacaccggggaccagcaccaggtcggcaacgagacccaaggggtgacggccgagatcacgccccaggccagcaccaccgaagcgatcctgcccgagtatggcacactggggctcgagtgctccccgcgcacgggcctggacttcaatgagatgattctactcacaatgaagaacaaggcatggatggtccacaggcagtggttcttcgacctgcccctgccctggacaagcggcgccaccacggaaacccccacctggaacagaaaagaacttctcgtgactttcaaaaacgcccacgccaagaagcaggaggtggtcgtgctggggtcccaggagggcgcgatgcacacggcactcaccggtgccacagagatacagaacagcggcgggacctccatatttgccggccacctaaagtgccgtctgaagatggacaagctcgagctgaagggcatgagctacgccatgtgcacgaacgcgttcgtgcttaagaaggaagtctccgaaacccagcatggcaccatcctcatcaaggtagagtacaagggcgaggacgtgccgtgtaagatacctttcagcaccgaagatgggcagggcaaggcccataacggccgcctgatcacggccaaccccgtcgtgaccaagaaggaggagcccgtgaacatcgaagccgagccgccctttggcgagagcaacatcgtcatcggcattggggacaacgcgctgaagataaactggtacaagaagggctccagcatcgggaagatgtttgaggccactgcgcggggcgccagacggatggccattctgggggacaccgcgtgggacttcgggtcggtgggaggggtgctcaattccttaggcaagatggtccaccagatcttcggttcggcctacacagccctgttttctggcgtttcctgggtaatgaagattggcatcggggtcctcctgacctggatcggcctgaacagcaagaacacctccatgagcttctcctgcatcgcgatcggtatcatcaccctctacctgggggccgtagtgcaggcggacatggggtgcgtcatcaactggaagggaaaagagctgaagtgcggctctgggatctttgtgacgaacgaggttcacacctggaccgagcagtacaagtttcaggcggactcccccaagcgcctcgccaccgccatcgccggcgcttgggaaaacggagtctgcggaatccgcagcacgacccggatggagaacctgctgtggaagcagatcgccaacgagcttaactacatcctgtgggagaacaacatcaaactcaccgtggttgtaggggatatcatcggcgtgttggagcagggcaagcgcactctgacgccgcagccgatggagctgaagtactcctggaagacctgggggaaggccaagatcgtgaccgccgagacacaaaactcctcctttatcatagacggacccaacacgccggagtgtccaagcgtctcccgggcgtggaacgtgtgggaagttgaggactacgggttcggggtcttcaccaccaacatctggctcaaactgcgcgaggtctatactcagttgtgcgatcaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaaatcacacaccctctggagcaacggcgtgctcgagagcgacatgatcattcccaagagcctggccgggcctatcagtcagcacaaccaccggccgggctaccacacccagaccgccggtccatggcaccttggaaagctggaactggactttaactactgcgagggcacgaccgtcgtgatcaccgagaactgtggcacccgcggtcccagcctccgcacgaccaccgtgtccgggaagctaatccatgagtggtgctgtcgcagctgtacccttccccccctccggtacatgggcgaggacgggtgctggtacggcatggagatccgccccatatctgagaaggaggagaacatggtcaagtccctggtgtccgccggcagcggtaaggtagacaatttcacgatgggagtcctgtgcctcgcgatcttatttgaagaggtgatgcgggggaagttcggcaagaaacatatgatcgcgggggtgttcttcaccttcgtcctactcctgtccggccagataacctggcgggacatggcccataccctaatcatgatcggcagcaacgccagtgaccggatggggatgggtgtgacctacttagccctgattgccacatttaagatccagccgttcttagcactcgggttcttccttcgcaagctgaccagccgggaaaatttgctgctgggcgtgggcctcgccatggctaccacgctgcaactgcccgaggacatagagcagatggcgaacgggatcgccctcggcctgatggccctgaagctcatcacccagttcgagacctaccagctttggaccgccctaatctctctcacatgcagcaacaccatctttaccctgaccgttgcctggagaacggcgacgctaatcctcgctggggtgagcctgctgccggtctgccagtcgagctccatgcggaagaccgactggctacccatggccgttgccgccatgggcgtgcctcccctcccgctcttcatcttcggtttaaaggacacccttaagcgccgtagctggcccctgaacgagggggtaatggccgtgggcctcgtgtccattctggcgtcttccctactccgtaacgacgtgcccatggccggccccctggtggccggcgggctgctcatcgcttgctacgtgatcacgggcacctcggccgacctgaccgtcgagaaggcggcggacattacatgggaggagggggccgagcaaacgggggtgagtcacaacttaatgatcaccgtggacgacgacggaaccatgcggatcaaagatgatgagaccgagaacatcctcaccgtgctattaaagacggcactcctaatcgtgagcgggatcttcccgtactccattcccgcgaccctgctcgtgtggcacacgtggcagaagcagacccaacggagcggcgtcctgtgggacgtgccatctccgcccgagacacagaaggcggagctggaggagggcgtttaccgcatcaagcagcagggcatcttcgggaagacccaggtgggcgtgggcgtacagaaggagggggtattccataccatgtggcacgtgacccggggcgccgtgttaacgtacaacgggaaacgcctggagcccaactgggccagcgtcaagaaggacctgatctcgtatggcgggggctggcggctcagcgcccaatggcagaagggcgaggaggtccaggtaatcgctgtggagcccgggaagaaccccaagaacttccagaccatgccgggaaccttccagacaacgaccggggagatcggcgcaatcgccctggacttcaagcccggcaccagcgggagccccatcatcaaccgcgaaggcaaggtggtggggctgtatggcaacggggtagtgaccaagaacggcggctacgtgagcgggatcgcccagacgaacgccgaaccggacggccccaccccggagctggaagaagaaatgttcaagaagaggaacctcaccatcatggacctgcaccccgggtccggcaagacccgcaaatacctgccggcgatcgtccgggaggccatcaagcgccggctccggacacttatcctggcccccacccgggttgtggccgcagagatggaggaggcgctcaaggggctgcccatccgctaccagaccaccgcgaccaaatccgagcacaccggtcgtgagattgtagacctgatgtgccacgccaccttcaccatgcgcctcctgtcccccgtacgggtccccaactacaacctgatcatcatggacgaggcccacttcacggaccccgccagcatagctgcccgcggatatatctccacgcgggtcgggatgggcgaggcagccgcgatcttcatgaccgccacgccccctgggacggccgacgcgttcccgcagagcaacgcacccatccaggacgaggagcgcgacattccggaacgctcctggaacagcggcaacgagtggatcaccgacttcgcgggaaagaccgtgtggttcgtcccctccatcaaagctggcaacgacatcgcgaactgcctccggaagaacggcaagaaggtcatccagctgtcacgtaagacgtttgatacggagtatcagaagaccaagctgaacgattgggacttcgtggtgacaaccgacatctccgagatgggggccaatttcaaagccgacagggtaattgacccgaggcgctgcctcaagcccgtgatcctgactgacgggcccgaacgcgtgatcctggcagggccgatgccggtcaccgccgccagcgccgctcagcggcgaggtcgggtggggcgcaacccccaaaaggagaacgaccagtatatcttcaccggccagcctctcaacaacgacgaagaccacgcccactggacagaagccaagatgctgctggacaacatcaacacccccgagggcatcatcccggccctcttcgagcccgagcgggagaagagcgcggcaatcgatggcgagtaccgtctgaagggagagagccgaaagacgttcgttgagctgatgcgccgcggggacctccccgtctggctggcccacaaggtggcgtcagagggcatcaaatacaccgatcgaaagtggtgtttcgacggccagcggaacaaccagattctggaggagaacatggacgtagagatttggaccaaagagggggagaagaagaagctccgcccccggtggctggacgcccgcacctacagcgacccgctggccctcaaggagttcaaggagttcgcggccggtcgcaagtctatcgccctggacctggtgacggagatcgggagagtgccctcacacctcgcccatcgcacccggaatgctttggacaacttagtcatgctccatacctccgagcacggcgggcgcgcgtaccggcacgccgtggaggagctgcccgagacaatggaaacgctgctcctactgggcctcatgatcctgctgacgggcggtgccatgctgttcctgatctctggtaagggaatcggaaagaccagcatcgggctgatctgcgtgatcgcctccagcggcatgctctggatggccgagatccctctgcagtggatcgcgtccgcaatcgtcttagaattcttcatgatggtgctcctgatccccgagcccgagaaacaacgcacaccccaggataaccaactggcctacgttgtcatcggcatcctcacattggccgccatcatcgcggccaacgagatggggctgctcgagaccaccaagcgggacctgggaatgagcaaggagcccggggtggtgtcccccaccagctacctggacgtcgacctccaccccgcctccgcatggacgctgtacgctgtcgccaccacagtgatcacccccatgctgcgccacacaatcgagaacagcaccgccaacgtctccctagccgctatcgcgaaccaggccgtagtgctgatgggcctggacaagggttggccgatcagcaagatggatctcggtgtgcccctgctagccctcggctgctactcccaagtgaatcccttaacattgaccgccgcagtgctcctgctgatcacgcactacgcgatcatcgggcccggactccaggccaaggcgacccgtgaggcccagaagcgcaccgccgcggggataatgaagaacccgacagtagacggcatcatgacgatcgacctggaccccgtaatctacgatagcaagttcgaaaagcagctgggccaggtgatgctactagtcctgtgcgccgtgcagctcctgctaatgcgaacctcttgggccctttgcgaggccctaactctcgcgaccgggcccatcacgaccctctgggagggcagccctggaaaattctggaataccaccatcgccgtgtctatggccaacatcttccgcggcagctacctggccggggccggtttggcgttctcgatcatgaagtccgtgggcaccggtaagcgcggcaccggatcccagggcgagaccctcggtgagaagtggaagaagaagctgaatcagctgagccgcaaggactttgacctctacaagaagtccgggatcaccgaagtagaccgaactgaggccaaggagggcctgaaacgcggcgaaatcacgcaccatgccgtctcccggggcagcgccaaattacagtggttcgttgagcgcaacatggtcattccggaggggagggtgatcgacctcggctgcgggaggggcggttggtcgtactactgcgccgggctgaagaaggtcaccgaggtgcggggctacaccaagggcgggcccggacacgaggaacccgtgccgatgagcacatacggctggaacatcgtcaagctaatgtccggcaaggacgtgttctacctcccgcctgaaaaatgtgacactctgctgtgcgacatcggggagagctctcccagtcccaccgtcgaggagagtcgcaccatccgcgtcctgaagatggtggagccgtggcttaaaaacaatcagttctgcatcaaggtgctgaacccctacatgcccactgtaatcgaacacctagagcggttgcagcgcaagcacggcgggatgctggtgcgaaaccccctgagccgcaactccacgcacgagatgtattggatcagcaacggcaccggcaacatcgtagcgtccgtcaacatggtgagcaggctcctgctgaatcgcttcaccatgacccaccgacgcccgacgatcgagaaggacgtggacctcggggccggcacccgacacgtcaacgccgagcccgagacccccaacatggacgtgatcggggagcgcatcaagcggatcaaagaggagcacaactccacctggcactatgacgacgagaacccgtataagacgtgggcttaccatggcagctatgaggtgaaggccactgggtccgcgtcaagtatgatcaacggcgtcgttaaattactgaccaagccatgggacgtcgtgccgatggttactcagatggccatgactgacaccacccccttcggacaacagcgcgtcttcaaggagaaggtggacacccggactccgcgcagcatgccggggacccggcgcgtgatgggcataaccgcagagtggctatggcgtaccctggggcgcaataagaagccccggctatgcacacgcgaggagttcaccaagaaggtccgcacaaacgctgccatgggcgccgtgtttactgaagagaaccagtgggatagcgcgaaggccgccgtagaagacgaggacttctggaagctcgtcgaccgggagagggagttacacaagctggggaagtgcggctcctgcgtgtacaacatgatgggcaagcgggagaagaagctcggggagttcggcaaggcgaaagggagccgcgccatctggtacatgtggctgggcgcacgctacctggagtttgaggccctcgggttcttgaacgaggaccactggttctcccgcgagaacagctactccggcgtggagggcgaggggctgcacaagctcggctatatcctgcgggacatcagcaagatccccgggggcgccatgtacgcggacgatacggccggctgggacactcgcatcaccgaggacgacctgcacaacgaggagaagatcacacagcagatggaccctgagcaccgtcagctagccaacgccatcttcaagctgacgtaccaaaacaaggtggtgaaggtgcagcgccccaccccaactgggaccgtcatggatatcatctcccggaaggaccagcggggcagcggccaggtgggcacctatgggctgaacacgttcacgaacatggaggctcagctcatccggcagatggagggcgagggcgtgctgtccaaggctgacttagagaatccccacttacccgaaaagaagatcacccagtggctggagacaaagggggtcgagcgcttaaagcggatggccattagcggggatgactgcgttgtgaagcccatcgacgaccgcttcgccaacgccctcctggccctgaacgacatgggtaaggtccggaaggacatcccccagtggcaaccctccaagggatggcacgactggcagcaagtcccgttctgcagccaccacttccacgagctcatcatgaaggacggtcgcaagctggtggtcccctgccggccccaggacgagctgatcggcagagcacggatctcccaaggagccgggtggagccttaaggagacagcctgcctaggcaaggcctacgcgcagatgtggtccctgatgtacttccaccggcgcgacctccggctggccagcaatgccatctgctccgccgtgcccgtgcactgggtcccgaccagccgcacaacctggtccatccacgcccaccaccagtggatgacaaccgaggatatgctgaccgtgtggaatcgggtgtggatagaggacaacccctggatggaggacaaaaccccggtcacgacctgggagaacgtgccatacctcgggaaaagggaagaccagtggtgcggcagcctgatcgggctaacgagtagagcgacctgggcccagaacatccctactgccatccagcaggtacggtccctcataggcaacgaagagttcctggactatatgccctccatgaaacggttccgcaaggaggaggagtccgagggcgccatatggtaa

SEQ ID NO: 25850 - RNA, 9873 nt, synthetic construct
  misc_feature 1..9873: note = derived and/or modified CDS sequence (opt11) from DENV-3__JF937641__SS-prME
  source 1..9873: mol_type = other RNA
acgagcctctgcctgatgatgatattgcccgcggcacttgccttccacttaacttcgcgtgacggagaaccgcgaatgattgtaggcaaaaatgaaagaggaaaaagcctactcttcaaaacagcgagcgggataaacatgtgcacactgatcgcgatggatctaggagaaatgtgcgatgataccgtgacatataaatgcccccacatcaccgaagttgaaccggaagacatagactgctggtgcaacctcacatccacgtgggtaacctacggaacatgtaaccaagctggagaacaccgccgtgataaacgaagcgtagcgctcgcgccccacgtaggaatgggactagacacaaggacgcaaacctggatgagcgcagagggagcctggaggcaagtggaaaaagtcgaaacttgggcactgagacacccaggattcaccatactcgcactcttcctagcgcactacatagggacatcgctaacgcaaaaagtagtcatcttcatactcctgatgctagtaacaccctccatgacaatgcggtgcgtaggagtgggaaacagagacttcgtggaaggcctgtccggggccacatgggtagacgtggtactcgagcacggcggctgcgtcacaacgatggccaaaaacaaaccaacactggacatagagttgcagaaaacggaggccacgcagttggcgacgctccggaagttgtgtatcgaaggcaaaatcacgaatataacaactgacagcagatgcccaacgcagggagaggcgaccctgcccgaagaacaagaccagaactacgtatgcaaacacacgtatgtcgacagaggttgggggaacggttgtggattgttcggcaagggtagcttggtgacctgtgcgaaatttcaatgcttggagccaattgaaggcaaagtagttcagtacgaaaacctgaaatacacggtaataataacagtgcataccggcgaccagcaccaggtaggcaacgaaacgcaaggcgtgaccgccgaaatcacaccccaagcaagcacaacagaagcaatacttcccgagtacggtactttaggcctggagtgttcaccccgcacagggcttgacttcaatgagatgatcttgttaacgatgaaaaacaaagcgtggatggtgcaccgccagtggttcttcgacctgccactgccgtggacgtcaggagctactacggagacgccaacgtggaaccgaaaagaattattggtaactttcaaaaacgcccatgcaaagaaacaagaagtggtggtactaggaagtcaggagggggcgatgcatacagcactaacgggcgcgaccgaaatacaaaactccggtggtacatccatcttcgccggacatctgaagtgcagactcaaaatggacaaacttgagcttaaaggaatgagctacgccatgtgtaccaacgcgtttgtcctcaagaaagaggtaagcgagactcagcacggtacgattttaataaaggtcgagtacaagggggaggacgtgccctgcaaaatcccattcagtacagaggacggccaaggaaaagcgcacaacggccggcttatcactgccaaccccgtcgtaacgaagaaagaagaacctgtcaacatcgaagcggaaccgccgttcggcgaatccaatatagtaatagggatcggcgataatgccctaaaaataaattggtacaagaaaggaagttcaataggtaaaatgtttgaggcaactgcaaggggagctcgcagaatggccatcctcggagatacagcatgggactttgggtccgttggcggagtactaaacagcctcggaaaaatggtccatcagatattcggaagcgcgtacactgccttattctcgggtgtgagctgggtaatgaaaataggcatcggagtccttttgacgtggataggattaaatagtaaaaacacaagcatgagtttctcatgcatagcgataggcattattacactatatctcggagccgtggtccaagcagacatggggtgtgtaataaattggaaaggaaaagaactaaaatgcggcagtggcatctttgtcacgaacgaggtccacacgtggactgagcagtacaaatttcaagccgactcgccaaaacggctagccaccgctatcgccggggcctgggaaaacggcgtatgcggaatacgcagtacgacccgcatggaaaatctcctgtggaaacaaatagcgaacgaattaaactatatactatgggaaaacaatataaaacttacggtagtggtaggcgacattataggggtactagagcagggcaaacgcaccctgacaccacaaccaatggaattaaaatacagttggaaaacctggggaaaagccaagatcgttacagctgaaacacaaaatagctcattcattatcgatggaccaaacacaccagaatgccctagtgtatctagagcctggaacgtctgggaggtagaagactacgggttcggtgtcttcacgacgaacatttggctaaaactccgggaagtttacactcaactatgtgaccataggctaatgtcggcagcagtaaaagacgagcgggctgtccacgcagacatgggttactggatcgagagccaaaagaacggaagctggaagctcgagaaggctagcctcatcgaagtaaagacctgcacatggccaaagtcacatactctgtggtcaaacggggtactagagtcggatatgatcattccaaagtctctggcagggccaatctcgcagcacaaccaccgccccggctatcacacgcagacggccggcccttggcacctagggaaactcgagcttgactttaattactgtgagggtacgaccgttgtcataactgaaaactgcggcactaggggaccgtccctgagaacaacaacagtttccgggaaactcatccatgagtggtgctgtcgcagctgcactttacccccactcaggtatatgggtgaagacggatgttggtatggaatggagatccgaccgatctcagaaaaagaggaaaatatggtcaagtccctagtttccgcgggaagcggtaaagtcgacaacttcactatgggcgtgctctgcctcgccatcctgtttgaagaagtgatgcgcgggaaatttgggaagaaacacatgatcgcgggcgtcttctttacattcgtcctattgctgagcggacaaatcacgtggagagacatggcgcacacactcataatgatcggaagcaacgcctcagatcgaatgggaatgggcgtaacataccttgccctaatcgcaaccttcaaaattcaaccgttcctcgccctagggtttttcctaagaaaactgacgtcgagagaaaacctactactaggagtgggactggctatggccacaacgctacagctgcctgaagacatcgagcagatggccaacggcattgctctcggactaatggccctcaaactgatcacgcagttcgaaacctaccagctctggacagcactgattagcctcacgtgttccaacactatattcacgctcacggtcgcttggcgaaccgcaactctaatcctggcaggcgttagtctcctaccggtatgccaatcctcctccatgcgcaagacggactggttaccaatggccgtagccgcgatgggggtgccaccactaccgttattcatattcggacttaaggatacgttaaagcggcgaagctggccgctgaacgaaggggtaatggctgtagggttagtaagcatcctagcgagttccctgctacgcaacgatgtcccaatggccgggccactcgtcgccgggggtctgctgatcgcttgctatgtcataacggggaccagcgccgacctaacagtcgaaaaggcagcagacataacatgggaagaagaggcggagcagacaggagtgagccataacctaatgatcacggtagacgacgatggaacaatgcgaatcaaagacgacgagacggagaacatactcacagtgctactgaaaacagctctactcatagtgtcaggcatcttcccctacagcataccagcgaccctgttagtgtggcacacatggcaaaagcagacacaacgaagtggagtcttatgggacgtaccgtccccaccagaaactcaaaaggcggaattagaggaaggggtttacagaataaaacaacaaggaatttttggaaaaacccaagtcggggttggggtccaaaaggaaggagtctttcatactatgtggcacgtgactcgcggggcagtgctcacctataacggcaagcgcctagagccgaattgggcgtcagttaagaaagacctgatcagctacggagggggttggagactcagtgcacaatggcaaaagggggaggaagtccaggtaatagcggtagaaccggggaagaacccaaagaacttccaaacaatgcccggaaccttccagactacgactggggagatcggggcaatcgcactggacttcaagcccggcacaagcggttcacccatcataaacagagaagggaaagtggtaggcctgtacgggaacggcgtggtcacgaaaaacggagggtatgttagcggtatcgcacaaaccaatgctgagccagatggtcccacgcccgagctagaagaggagatgttcaagaaacgaaacctgaccataatggacctgcacccaggcagtggaaaaacccgaaaatatctcccagccatcgtcagagaagcgattaaaagaagactgcgaactctgatactcgcaccaacacgggtggttgcagctgaaatggaggaggcactcaaaggcctacccatccgataccagaccacggccacgaagagtgaacacaccggaagagagatagttgacctaatgtgccatgctacatttacgatgcggctgctatcaccggtacgggtgccaaactataacctcataattatggatgaggctcactttacagaccccgcatcaatagcggcacgaggttatatatcaacacgcgtgggaatgggggaggcggcagctatcttcatgacagcgaccccaccaggaaccgccgacgcatttccacaatctaacgcgcccatccaagacgaggagagggacatacccgaaaggagctggaactcagggaacgaatggatcacagacttcgccggcaaaaccgtgtggttcgtgccctcaataaaagccggcaatgacatagcgaattgcctcaggaaaaacggaaagaaggtcatacaactgagccgtaaaacgtttgacacggaataccagaaaaccaaactgaatgactgggacttcgtagttacgacagacatctcggagatgggagcaaacttcaaagccgaccgggtaatagatccaaggcgttgcctcaaacccgtgatactcaccgatgggcccgaacgtgtaatcctggcgggaccgatgccagtgaccgctgcctccgcagcgcaacggagaggacgagtggggaggaatccgcaaaaggaaaacgatcaatacatatttacaggacaacctttaaacaatgatgaagaccacgcacactggactgaggcaaagatgctgctagacaacataaataccccagaaggaataatacccgccctcttcgaaccagagcgagagaaaagcgccgcaatcgatggcgaatatcgcctcaaaggggagagtcgcaaaacattcgtagagctcatgagacgcggagatttacctgtctggctcgcacacaaggtagcaagcgaaggaataaaatataccgatcgaaagtggtgcttcgacggccagcgaaataaccagatattagaggaaaacatggacgtcgagatctggaccaaggagggcgagaagaagaaactgcgaccgcgttggctggatgccaggacatattctgacccactggcactaaaagagttcaaagaatttgcagcggggcgcaaatccatagcgctagatctggtaaccgagataggccgcgttccatcacacctagcacaccgtacgaggaacgccctagataacctcgtgatgctacacacatcagagcacggcggcagggcgtacagacatgcagtagaagaactgcccgagacgatggaaacgctactcctccttggactaatgatactactgaccggaggcgcgatgctctttttaatcagcgggaaagggataggaaagaccagcataggcttaatttgtgtaatagcgagcagcgggatgctctggatggccgaaattcctctccaatggatcgcttccgcgatagttctcgagttcttcatgatggtactattgataccagaacccgagaaacaacgtacgccgcaagacaaccaacttgcttacgtcgtcatcggcatactcacactcgcggcaatcatcgccgcaaacgaaatgggcctactcgaaacgacaaaaagggacctcggaatgagtaaagaacccggcgtagtgtcaccgacttcctacctggacgttgacctgcaccctgccagcgcatggacactatacgcagtggcaacaaccgtgataacgccaatgctgaggcacacgatcgaaaacagcacggcaaacgttagcctcgcggccatagcaaatcaggcggttgtactaatggggttagacaaaggctggcccatctccaaaatggatctaggcgtcccgttgctcgcacttggttgctatagccaagtgaatcccctgacgctcaccgcagctgtgctactgctcataactcactacgccatcatcggcccgggactgcaggcgaaagcaacccgcgaagcccagaaaagaaccgccgccggcatcatgaagaatccgaccgtcgatgggatcatgaccatcgacctggaccctgttatttacgacagcaaattcgaaaaacaattaggccaagtcatgctgctagtactgtgcgcggtacaactgttgttaatgcgcacatcatgggcgctctgtgaagcactgacgttggctacgggcccgatcacgactctatgggaaggcagcccgggaaaattctggaacacgacaatagcagtaagcatggccaacatctttcgcggctcatacctggccggggcagggctggctttttctattatgaagtcggtaggaacaggcaaaagaggaacaggatcccaaggagaaacgttgggagagaaatggaagaagaaactcaaccagctaagccggaaagacttcgacctgtacaaaaagtctggaataacagaggttgaccgtaccgaggccaaagaaggcctgaaacggggcgaaatcacgcaccacgctgttagccgcggaagtgctaagctacaatggttcgtggagcgcaatatggtcataccagaaggtagagtgatcgatctagggtgcgggcgtggtgggtggtcatactactgcgcgggactaaagaaggtcacagaagtaaggggatacacaaaaggcggccccggccacgaagaacccgtgcccatgtccacatacggctggaacatagtcaaactaatgtccggcaaagacgtcttttacttaccaccggagaagtgcgatactctcctgtgtgacataggggaaagctccccgagcccgactgtagaagaatcacggacgataagagtgttaaaaatggtagagccatggctcaaaaacaatcaattctgcatcaaggtcttaaacccttacatgccgacagttatagagcacctggaaagactgcaaagaaagcacggcggcatgttagtgagaaatccccttagcaggaactcgacacacgaaatgtactggatatcaaatggaacaggaaacatagtagccagcgtaaacatggtctctcgcctcttattaaacaggttcacgatgacacacaggagacctaccatagaaaaagatgtagacctaggcgccggcacacgccatgtcaacgcggagcccgaaacaccaaatatggacgtaataggagaaagaatcaagcgcataaaggaagaacataacagcacctggcactacgacgacgaaaacccgtacaagacatgggcatatcatggaagctacgaagtgaaagcgacaggaagcgcaagcagtatgattaacggcgtagttaagctcctcacgaaaccctgggacgtcgtaccgatggtaacgcaaatggccatgaccgacacgacgccgttcggccagcagcgagtgtttaaagaaaaagtcgacacccgaacccctcgttcgatgccaggtaccagacgcgtcatgggaataacagcagaatggctatggcgcacactcgggcgtaataagaaaccacgcctatgcaccagagaggagttcaccaagaaagtacggactaacgcagcgatgggggcagtcttcacggaggagaaccaatgggactcagccaaagcagcagtcgaggacgaggacttctggaagctcgtcgatagggaaagagaattacataagctaggaaagtgcggatcgtgcgtgtataacatgatgggcaagagggagaagaagctgggtgagttcgggaaggcgaagggaagccgggccatctggtacatgtggctaggagctagatacctggagttcgaagcactgggattcttaaacgaagaccactggttcagcagggaaaacagctattcaggcgttgaaggagagggactacacaagttaggctacatactgcgtgacatctcaaaaatcccagggggcgctatgtacgcggacgacacggcaggttgggacacccgaatcacagaagacgacttacataacgaagagaaaataacccaacaaatggacccggagcaccggcaactggccaacgcgatattcaagctgacctaccagaacaaggtagtcaaagtccagagacctacaccaaccggcaccgtaatggacataatctcccgaaaggatcagagggggtcaggacaggtggggacgtatggacttaacacattcaccaacatggaagcccaactcataagacaaatggaaggggaaggggtactgagtaaggcggacctagagaaccctcatttaccggagaagaaaatcacgcagtggttagaaaccaaaggggttgaacgcctaaaacggatggccatttccggcgacgactgcgtagttaagcccatcgatgatcgatttgccaatgcactattagctttgaacgatatgggaaaagtaagaaaggacattccgcaatggcaaccatcgaagggttggcatgactggcaacaggtcccattctgtagccaccatttccacgagcttattatgaaagatggccgtaagctagtagtaccctgccggccccaagacgagctgatcggccgcgcacgaatcagtcagggcgccgggtggagtcttaaggagactgcgtgtctaggaaaggcatacgcccaaatgtggtcactcatgtacttccaccgacgagacctacgactggcctccaatgcgatctgctcagctgtaccagtccactgggtgcccacctcccggacgacatggtcaattcacgcccaccaccagtggatgacgaccgaggacatgctcacagtgtggaaccgcgtgtggatcgaggataacccatggatggaagacaagacgccggtgacaacctgggaaaacgtcccctacctcggcaaaagagaagaccagtggtgcggatcgctcatcggcctaactagccgagcgacctgggcccaaaacataccgaccgctatccaacaggtgagatcactaataggaaacgaagagttcctagactacatgccctccatgaaaaggtttcgcaaggaggaggaatcagaaggagccatctggtaa

SEQ ID NO: 25851 - RNA, 9873 nt, synthetic construct
  misc_feature 1..9873: note = derived and/or modified CDS sequence (opt11) from DENV-3__JF920396__SS-prME
  source 1..9873: mol_type = other RNA
acgtcattatgcctgatgatgattctccccgccgccctggcgttccacctcaccagcagagacggggaacccagaatgatcgttgggaagaatgagcggggcaagagcctgcttttcaagaccgcctccgggatcaacatgtgtacgctcatcgccatggatcttggcgaaatgtgcgacgacaccgtaacctacaaatgcccccatatcaccgaggtggagcctgaggacattgattgctggtgcaacctcacgagcacttgggttacctacgggacgtgcaaccaggccggtgagcacaggcgcgacaagcggtccgttgcactggcaccccacgtggggatggggctggatacccgcacccagacctggatgagcgccgagggcgcctggcgtcaggttgagaaggtggagacgtgggcactgcgccacccggggttcaccatcctcgcgctgttcctggcccactacatcggcacctccctcacccagaaggtggtgatattcatccttctgatgctcgtcacaccctccatgaccatgcggtgcgtgggtgtggggaaccgcgacttcgtcgaaggcctgtccggggccacctgggttgacgtggtcctggagcacggcggctgcgtgacaaccatggccaagaataagcccacgttggacattgagctgcagaaaaccgaagccacacaactggcgacgctccggaagctgtgtatcgaggggaaaatcaccaacatcaccaccgacagccgctgccctacgcagggtgaagctaccctgccggaggagcaggatcagaactatgtgtgtaagcacacctacgtggaccgggggtgggggaacgggtgcggactcttcgggaagggatccctagtgacctgcgccaagttccagtgcctggagcccattgagggcaaggtggtccagtacgaaaacctcaaatacacggtgatcatcaccgtgcacaccggggaccagcaccaggtcggtaatgagacgcagggggtgacggccgagatcacccctcaggcctcgaccaccgaggcgattctgcccgagtatggcacacttggactcgagtgttctcctcgcacgggactggacttcaacgagatgatcctgctcaccatgaaaaacaaggcctggatggtgcaccggcagtggttcttcgacctgcccctaccctggaccagcggggccaccacggagacccccacctggaaccgcaaagagcttctggtgaccttcaagaacgcgcatgccaagaagcaggaggtggtcgtgctggggtcccaggaaggcgctatgcacacggcgctcactggtgcgaccgagattcagaacagcggcgggacatccatcttcgctggccacctgaagtgccgtctgaagatggacaagctcgagctgaaaggaatgtcgtacgcaatgtgcacgaataccttcgtgctgaaaaaggaggtgtctgagacccaacacgggacaatcctcatcaaggtggagtacaagggagaggatgtgccgtgcaaaatacccttctctacggaggacgggcagggcaaggcccacaacggtcgcttgattaccgccaaccccgttgtgaccaagaaggaggagccggtgaatatcgaggccgaaccacccttcggggagagcaacatcgtcattgggatcggagacaacgccctgaagatcaattggtacaagaagggctccagtatcggtaagatgttcgaagcgaccgccaggggcgcccgtcgaatggccatcctaggcgacactgcctgggacttcgggtccgtgggcggggtgctcaacagcctgggcaagatggtccaccagatattcgggtccgcatacaccgcactgttcagcggcgtttcctgggtgatgaagattggcatcggggccctcctgacctggatcggtctgaacagcaagaacaccagcatgagcttctcctgtatcgccatcgggatcattacgctctacctgggcgccgtagtgcaggcagacatgggctgcgtggtcaactggaaggggaaggagctgaagtgcggcagcgggatcttcgtgaccaatgaggtgcacacctggaccgagcagtacaagttccaggccgattcccccaagcgcctagccaccgccatcgccggcgcgtgggagaacggagtctgcggcattcgcagtaccaccagaatggagaacctcttatggaagcagatcgccaacgaattgaattacatcctgtgggagaacaacattaaacttaccgtggtcgtcggggacatcatcggcgtcctcgagcaaggcaagcgcaccctgacgccgcagccgatggagctgaagtactcctggaagacctgggggaaggccaagattgtaaccgcagagacgcagaacagctccttcatcatcgatggccccaacaccccggaatgccccagcgtctcacgggcgtggaacgtgtgggaggttgaggattacgggttcggggtcttcaccacaaacatctggctcaagctgcgcgaggtatatacccagctgtgcgaccaccggctcatgagtgcggctgtgaaggacgagcgcgccgtgcacgccgacatgggttattggatcgagtcacaaaagaatgggtcctggaagctggagaaggcctcgttaatcgaagtgaagacgtgcacctggcccaagtcgcacactctctggagcaacggcgtgctggaatccgacatgatcatccccaagtctctggccggtcccatctcccagcacaatcaccggcccggctaccacacccagaccgccgggccatggcatctgggaaagctggaattggactttaactactgcgaaggcacaaccgtcgtgatcaccgagaactgtgggacacgcggcccgagtctccgtaccaccaccgtgtccgggaagctgatccacgagtggtgctgccgcagctgcactctgcccccgcttagatacatgggcgaggacgggtgctggtacggcatggaaatccgccccatcagcgagaaggaggaaaacatggttaagagcctggtgagcgcgggaagcgggaaggtggataacttcaccatgggcgtactgtgcttagcgatcttgttcgaggaagtgatgcggggaaagttcggcaagaagcatatgatcgcgggagtatttttcaccttcgtacttcttctgtccggacagatcacctggcgcgacatggcgcacacgctcattatgataggcagcaacgcctccgaccggatggggatgggtgtgacatatctcgcgttgatcgccaccttcaagatccagcccttcctcgcgctggggttcttcctgcgcaagctgaccagccgggagaacctccttctgggcgtaggcctcgccatggctacgaccctgcaattgcccgaagatatcgagcaaatggccaatgggatcgcgttgggtctgatggccttaaagctcatcacccagttcgaaacttaccagctgtggaccgccctgatcagtctgacctgctccaacaccatcttcaccctgacggtcgcgtggcgcaccgccaccctgatactcgccggggtgtcactgttgccggtctgccaatcctctagcatgcggaaaaccgattggctcccgatggccgtggcggccatgggagtgccaccccttccgctgttcatctttagcctaaaggatacgctgaagaggagatcttggcccttaaacgagggtgtcatggccgtgggtctcgtgagtattctggcgtcctcgctgctccgcaacgacgtccccatggccggcccccttgtggccgggggcctgctaatcgcctgctacgtgatcaccgggacctccgccgacctgacagtcgagaaggcggccgatatcacgtgggaagaggaggccgaacagaccggcgtgagccacaacttaatgattaccgtggatgacgacgggacgatgcgcatcaaagacgacgaaaccgagaatatactcacggtcctgttgaagaccgccctcctcatcgtatcaggcatcttcccgtactctatccccgcgaccttactcgtgtggcatacctggcagaagcagacgcagcgctccggcgtactgtgggacgtgccttcaccgccggaaacccagaaagctgagctggaggaaggggtgtaccggattaagcagcagggcatattcgggaaaacccaggtcggtgtgggggtgcagaaggaaggagtcttccacaccatgtggcacgttacccgcggggccgtgctaacctacaatgggaagcggctggagcccaactgggcctcggtcaagaaggacctgatcagttacggcggtggctggcggctctctgcccagtggcagaaaggggaggaggtccaggtgatcgcagtcgagcccggcaagaaccccaagaacttccagaccatgccaggcactttccaaacgaccactggtgagatcggcgccatcgccttagattttaaacccgggacctcgggcagccccatcatcaacagagagggcaaggtagtggggctgtacggaaacggtgtcgtgacgaagaatggcgggtacgtgtccggcatcgcccagaccaacgctgagccggacggcccgaccccggagctggaggaggagatgttcaagaaacggaacctcaccatcatggacctgcacccggggagcggcaagacgcgcaagtatctgccggcgatagtccgggaggccatcaaacgccggctccgcacgctgatcctggcccccacccgggtcgtggcagccgagatggaggaggcgctcaaggggctgccgatcagataccagaccacagctaccaagtccgagcacactgggagggagatcgtcgacctgatgtgccacgccacgttcacgatgcgcctcctgtcaccagtccgggtgccaaactacaacttgatcataatggacgaggcccacttcaccgatcctgcctccatcgctgcccgcgggtacatcagtacacgggttgggatgggtgaggcagccgcgatattcatgaccgccacgcccccagggaccgccgacgccttcccgcagtccaatgcccccatccaagacgaagaacgcgacatccccgagcgcagctggaactccggcaacgagtggatcaccgacttcgcggggaaaaccgtgtggttcgtgcccagtatcaaggcaggcaatgacatcgccaactgtcttcggaaaaacgggaagaaggtgatccaactgagccgcaagacgtttgataccgaataccagaagacaaagctgaacgactgggacttcgtggtgaccactgacattagcgaaatgggcgcgaacttcaaggccgacagggtcatcgacccgcgccggtgcctcaaacccgtgatcctgacggacggccccgagcgcgtcattctggcgggtcccatgcccgtcaccgccgcatcggccgcccagcggcgaggtcgggttgggaggaacccccaaaaagagaacgatcagtacatctttaccggccagcccctcaacaacgacgaagatcacgcccactggacggaggccaagatgctgctggacaacataaacacgcccgaagggatcatccccgccctattcgagcccgagagagagaagtccgccgcgatcgacggggagtaccgcctgaagggagagtcccgcaagacattcgtggagctgatgcgccgcggggacctcccagtctggctggcccacaaagtagcttcagagggtatcaagtacaccgacaggaaatggtgtttcgacggccagagaaacaaccagattctggaggagaacatggacgtcgagatctggacgaaggaaggcgagaagaagaagctacgcccccggtggctggacgcccggacgtactccgatccgcttgccctcaaggagtttaaagagtttgctgccggcaggaaaagcatcgcgctggacctggtgaccgaaatcgggcgggtacccagccatctagcgcaccgcacccggaacgccctggataaccttgtcatgctacacacaagcgagcacggcgggcgcgcatatcggcacgccgtcgaggagcttccggagacgatggaaaccctcttactgctgggcctcatgatactgctgacagggggcgcgatgctgttcctaatcagcggcaaggggatcggcaagacgtccatcgggctgatctgcgtgatagcgagctccggtatgctgtggatggccgaaatcccgctgcagtggatcgcgagcgccatcgtcctggagttcttcatgatggtacttctcatccccgagcccgagaagcagagaacaccccaggacaaccaactggcgtacgtggtcatcgggatcctcaccctggccgccattatagcggcgaacgagatgggcctgctggagacgacgaagcgagacctgggcatgtccaaggagccgggggtggtgagccccacctcctacctggacgtcgacctccaccctgcttcggcttggaccttgtacgcagtagcaaccaccgttattacgcccatgttaagacatactatcgagaactctaccgccaacgtcagcctcgcggccatcgcgaatcaggccgtagtactgatgggccttgacaaggggtggccgatctctaaaatggaccttggtgtcccgctactggccctcgggtgttacagccaggtgaaccccctgactctgacggccgccgtgctcctgctgatcacccactacgcgataatcggccccggccttcaggctaaggccacccgggaggcccaaaagcgcaccgccgcgggcatcatgaagaacccgacggtagatggcatcatgaccatagacttagaccctgtgatatacgattccaagttcgagaagcagctgggacaggtgatgctcctggtcctgtgcgccgtccagctcctcttgatgcgcaccagctgggccctctgcgaagccctgaccctggctaccggacccatcaccacgttatgggagggctcacccgggaagttctggaacacaacgatcgccgtttctatggctaacatcttccgcggctcctatctggccggagccggactggccttcagcatcatgaagtccgtcgggaccggcaagaggggcaccggaagccagggagagaccctcggggagaagtggaagaagaagttaaatcagctgagccgtaaggacttcgacctctacaagaaatctggcatcaccgaggtggaccggacggaagccaaagaggggctcaagaggggagagatcacgcaccatgcagtgagccgggggtccgccaagctgcagtggttcgtcgagaggaacatggttataccagaaggacgggtgatcgacctcggatgcggacgcggcgggtggagctactactgtgccggactgaaaaaggtaaccgaagtgcggggctataccaagggcgggccggggcacgaagaacccgtgcccatgtccacgtacggctggaacatcgtcaagctgatgagcgggaaggacgtgttctaccttccgcccgagaagtgcgataccctgttatgcgacatcggagagtcgagcccctcgcccactgtcgaggagagccgcaccatccgcgttctaaagatggtggagccttggttgaaaaacaaccaattttgcatcaaggtcctgaacccttacatgccaacggtcatagagcacctggagcggctccaacgcaagcacggcgggatgctggttcggaaccccctgtctcgcaacagcacccacgagatgtactggatcagtaacggcaccgggaacatagtggcgagcgtcaacatggtgtcccggctcctgctgaaccgcttcaccatgacgcaccggaggccgaccatcgagaaggacgtggacctcggagccggcacccggcacgtcaacgccgaaccggagacgcccaacatggacgtgatcggagagcgcatcaaacggatcaaggaagaacataactcaacctggcactacgacgacgaaaacccgtacaaaacctgggcataccacggctcctacgaggttaaagcgaccggaagcgcgtccagcatgatcaacggcgtcgtgaagctgctgactaagccctgggacgtcgtgcccatggtgacgcagatggctatgaccgacaccacccccttcgggcagcagcgcgtcttcaaagagaaggttgacacgcggacaccgcggagcatgcccggcaccagacgcgtgatgggcattacggccgagtggctctggcggaccctgggtcgcaacaagaagccccgcctgtgtacccgcgaggagttcaccaagaaggtccgcaccaacgccgctatgggcgccgtgttcacggaggagaaccagtgggactccgcgaaggccgccgtagaggacgaggacttttggaaacttgtcgaccgggagcgagaactgcacaagctggggaagtgtggctcgtgtgtgtacaacatgatggggaagcgggagaaaaagctgggggagttcggtaaggcgaaggggtcccgcgccatctggtacatgtggctgggggccagatatctggagttcgaggccttgggatttctgaacgaggaccactggttcagccgcgagaactcctatagcggggtggagggggaaggtctgcacaagttaggctacatcctgcgggacatctcgaagatcccgggaggcgccatgtacgcggacgatactgccgggtgggacacccgcatcactgaagacgacttacataacgaggaaaagattactcaacagatggacccggagcaccggcagttagcaaacgcaatcttcaagctgacctaccagaataaggtcgtgaaggtgcaacggcccacccccaccggcacggtcatggacatcatcagccgaaaggaccaacgcggctccggacaggtgggaacgtacgggctgaatacgttcaccaacatggaggcccaactcatccggcagatggagggcgagggagtgctgagtaaagcagatctcgagaacccccacctccccgagaagaaaatcacccagtggctcgagacgaagggcgtagaacgcctgaagagaatggccatctccggagacgactgcgtggtgaagcccatcgacgaccgcttcgctaacgccctcttggccctgaacgacatggggaaggtccgaaaggacatcccccagtggcaacccagcaagggatggcacgattggcagcaagtccctttctgctcccaccacttccacgagctcatcatgaaggatgggcgcaagctcgtggtcccctgcaggccccaggacgagctgatcggccgcgcgcggatctcccagggggcgggctggtccctgaaggagaccgcctgcctgggcaaagcgtacgcgcagatgtggtcactgatgtacttccacaggagagacctgcggctggcctccaacgcgatctgtagcgccgtgcccgttcactgggtcccgaccagccgcaccacgtggagcatccacgcccaccaccagtggatgaccaccgaggacatgttgacggtgtggaaccgggtttggatcgaggacaacccctggatggaggacaagacgcccgtcacaacctgggaaaacgtgccctacctggggaagcgcgaggatcaatggtgcggaagcctgatcggactaacatctcgtgcgacgtgggcccagaatatcccgactgctatccaacaggtacgcagcctcatcggtaacgaggagttccttgactacatgccctccatgaagcgtttccgtaaggaggaagagagcgagggcgctatctggtga

SEQ ID NO: 25852 - RNA, 9873 nt, synthetic construct
  misc_feature 1..9873: note = derived and/or modified CDS sequence (opt11) from DENV-3__JF920406__SS-prME
  source 1..9873: mol_type = other RNA
accagcttgtgcctcatgatgatacttcccgccgccctggccttccatctcaccagccgggacggggagccacggatgatcgtggggaaaaacgagcggggcaagagcctgctttttaagacagccagcgggatcaatatgtgtaccctcatcgccatggacctgggcgagatgtgcgacgacacggtgacatataagtgcccccacatcaccgaagtggagcccgaggacatcgactgctggtgcaacctgaccagcacctgggtaacctacgggacctgcaaccaggcaggggagcaccggagggacaagcggtccgtggccctcgcaccccacgtgggcatggggctggatacgaggacccaaacttggatgagcgccgagggcgcatggcggcaggtggaaaaagtggagacgtgggccctgcgccacccggggttcaccatcctcgcgctgttcctggcacactatatcggcacgtccttgacacagaaggtggtgatcttcatccttctgatgctcgtcacgccctccatgacaatgcgctgcgtgggggtcggtaatcgcgactttgttgaaggactttccggggccacatgggtggacgtcgtgctggaacatggcgggtgcgtgacaacgatggccaagaacaagcccacactcgacatcgagctgcagaagaccgaagccacccagctggcgacgctccgtaagctctgcatcgagggcaagattaccaatataaccaccgacagccggtgccccacgcagggcgaggccacactgccggaggagcaggaccagaactacgtgtgcaagcatacctacgtcgacagagggtggggtaacggttgcgggttgtttggtaagggctcactggtgacctgcgccaaatttcagtgtttagaacccattgagggcaaggtggtccagtacgagaacctcaagtacacggtgatcatcaccgtgcataccggggaccagcaccaggtcggcaacgagacccagggtgtgacggctgagatcacgccccaggcctcaacaacggaggcgatcttacccgaatacggtaccctcggcttggagtgctccccgcgcacggggctggacttcaacgagatgatcctgctcaccatgaagaacaaggcctggatggtacaccggcagtggttcttcgaccttcccctaccgtggaccagcggtgctactacggagactcccacctggaacaggaaggagctcctggtgacctttaagaatgcccacgccaagaagcaggaggtggtcgtgctggggtcccaagagggcgcgatgcacacggcactcacgggggcaaccgagatccagaacagcggcggcacttccatattcgccggccacctgaagtgccggctgaaaatggacaagctcgagctgaagggcatgagctacgcgatgtgcacgaacgcgttcgttctgaagaaggaggtctccgagacccagcacgggaccattctcatcaaagtggagtacaagggcgaggacgtgccatgcaaaatacccttcagcaccgaggacgggcagggcaaggcccataacggccgcctgataacggccaaccccgtagtgacaaagaaggaggagccagtgaacatcgaggcggagccgccctttggggagtctaacatcgtcatcggcatcggagacaacgcgctgaagatcaactggtacaagaagggctccagcatcggtaaaatgttcgaggcaaccgctcggggcgcccgccgaatggccatcctgggagatacagcgtgggatttcgggagtgtgggcggggtgttgaactcactgggcaagatggtccaccaaatctttgggtcggcctacacggccttattctctggagtatcctgggtgatgaaaatcggcatcggggttctcttaacctggatcggcctgaacagcaagaacacctccatgagcttctcctgtatcgcaatcgggatcatcaccctctaccttggcgcggtggtgcaggctgacatgggctgcgtcatcaactggaagggcaaggagctgaagtgcggctccgggatcttcgtgaccaacgaggtccatacctggacagagcagtacaagtttcaggccgacagccccaagcgtctcgcaaccgccatcgccggcgcgtgggagaacggggtctgtggcatccgcagcacgacccggatggagaacctgctgtggaagcagatcgccaacgagttgaactacatcctctgggagaacaacatcaagctaacggtagtggtcggggatatcatcggcgtcctcgagcagggcaagcgcaccctaacgccccagccaatggagctgaaatactcctggaagacctgggggaaggccaagatcgtaaccgccgagacccagaacagttccttcatcatcgacggccccaacacgcccgaatgccccagcgtctctcgtgcgtggaacgtgtgggaagttgaggattacgggttcggagtctttactacaaacatctggctcaaacttcgcgaggtgtacacccagctctgtgaccatcggctcatgagcgcggccgtgaaagatgagcgggccgtccacgcagacatgggctactggattgagtcccagaagaacgggtcatggaagttggagaaagcgagcctgatcgaggtgaagacctgcacgtggccgaaatcccacaccctatggagcaatggcgtgctggaatccgacatgatcatccccaagagcctcgcaggtcccatttcccagcacaaccaccgcccgggataccacacgcagacagcggggccctggcacctcgggaaacttgaactggacttcaactactgtgagggcacgaccgtcgtgatcaccgagaactgcgggacccgcggtcccagcctccggactaccaccgtgagcggcaagctgattcatgagtggtgttgtcgctcttgcaccctgcccccgttgcgctacatgggcgaggacgggtgctggtatggcatggagatacgcccaatctccgagaaggaggagaacatggtcaagagcctggtctccgccggctccgggaaggtggacaacttcacgatgggagtcctgtgtctggccatcctgttcgaggaggtgatgcgggggaagttcggtaaaaagcatatgatcgcaggtgtgttcttcaccttcgtcctgcttttatccggccagattacctggcgagatatggcccataccctgatcatgatcggcagcaacgcgagcgatcggatggggatgggcgtgacgtacttggccctcatcgccacattcgagatccagccctttctggcgctcggttttttcctgcgcaagttgaccagccgggagaacctcctgctgggcgtgggccttgccatggcgaccacgctgcagctacccgaggacatcgagcagatggctaacgggattgcgctcggccttatggctctcaagctcatcacacagtttgaaacctaccagctatggaccgctctgatcagcctcacctgttcgaacaccatattcaccctgaccgtggcctggcgcacggccaccctgatcctcgcgggggtaagcctgctgccggtgtgccaatccagctccatgcgcaaaactgactggttgcccatggccgtggccgccatgggcgtgccgcccctcccgctgttcattttcgggctcaaagatacactaaaacgcagatcctggcccctcaacgagggcgtcatggctgtgggcttggtcagcatactggcgagctcactgctccggaacgacgtccccatggccggacccctggtggccgggggactgctgatcgcgtgctacgtgatcacgggaacctcggccgacctgaccgtggagaaggcggccgacattacctgggaggaggaggccgagcagacgggggtatcccacaacctaatgattaccgtggacgacgacgggaccatgcgaataaaggacgacgagaccgagaacatcctcaccgttctgctgaagacagcactcctgatcgtgagcggcatctttccgtacagtatccccgcaaccctgctcgtttggcacacgtggcaaaagcagacccagcggagcggcgttctgtgggacgtaccgagcccgcccgagacacagaaggcggagctggaggagggcgtatatcgcatcaagcaacagggaatcttcggcaagacccaagtgggggtgggagtgcagaaggagggcgtcttccacaccatgtggcacgtgacgcgcggagctgtactcacgtacaacggcaagagactggagccgaattgggccagcgtcaagaaggacctgatctcatacgggggtgggtggcggctcagcgcccagtggcagaagggcgaggaggtccaggtgatcgccgtcgaacccggcaagaaccccaagaacttccagaccatgcccgggacgttccagaccacgaccggcgagatcggggcgatcgccctggacttcaaacctggcacctcgggctcacccatcattaatcgcgaggggaaggtggttggcttgtacgggaacggcgtcgtaaccaagaatggcggctatgtgagcgggatcgcccagacgaacgccgagccggacgggcccaccccggagctggaagaagagatgttcaagaagcggaacctcaccatcatggacctgcaccccggctccggcaagacccgcaagtatctgccggcaatcgtccgggaggccatcaagcgccggctccgcaccctgatattagcccccacccgggtggtggctgccgagatggaagaggcgctcaagggcctccccatccgctaccaaacgaccgccacgaagtccgagcacaccgggcgcgagatcgttgacctgatgtgtcatgcgaccttcaccatgcggctactgtcacccgtacgggtaccgaactacaacctgatcataatggacgaagcccatttcacggaccccgcatctatcgccgccaggggctacatctcaacccgagtcggcatgggagaagccgctgccatcttcatgaccgccaccccgcccggcacggcggacgccttcccacagagcaacgcccctattcaggatgaagagcgcgatattcctgagcgttcctggaatagcgggaacgagtggatcacggacttcgctggcaaaactgtgtggttcgtgccgtccataaaggccgggaatgacatagcgaactgcctccggaagaacggcaagaaggtgatccagctgtcgcgcaagaccttcgacacggagtaccagaagaccaagctcaatgactgggacttcgtggtaaccacagacatctccgagatgggcgccaacttcaaggcagacagagttatcgacccgcgccgatgcctcaagcccgtcattctgacagacgggcccgaacgcgtgatcctggctggccctatgccggttacagccgccagcgccgctcaaagacgagggcgggtggggcgcaacccccagaaagagaacgaccagtacatattcaccgggcagcccctcaacaacgacgaagaccacgcgcactggaccgaggccaaaatgctgcttgacaacatcaacacgcccgaggggataatcccggctctcttcgaacccgagcgggagaagtccgccgcgatcgatggcgagtaccgcctgaagggggagagccggaagacgttcgtggagttaatgcgccgtggcgacctcccggtttggctggcccataaggtggccagtgaggggatcaagtacaccgatcgaaagtggtgcttcgacgggcagcggaacaaccagattctggaggagaatatggacgtagagatctggaccaaggagggcgagaaaaagaagctccgacctcggtggctggacgccaggacttacagcgacccgctggccctcaaggagtttaaggaattcgcggcggggcgcaagtccattgcgctggacctggtgacggagatcggccgagtgccgagccacctggctcaccgaactcggaatgccctggacaacctggtcatgctccacacctccgagcacgggggccgagcgtatcgccacgccgtagaggagttacccgagacgatggagacgttgctcttactagggttgatgatcttgctaaccggcggtgccatgttattcctgatcagcgggaaggggatagggaagacaagcatcggtctgatatgcgttatagcgtccagcgggatgctctggatggcggagatcccgctgcaatggattgcgagcgccatcgtactggaattcttcatgatggtgctcctgatccctgagcccgaaaagcagcgcaccccccaggataaccagctggcatacgtcgtgatcggcattctcaccctggccgctatcattgccgccaacgagatgggcctgctcgagaccaccaaacgggacctgggaatgagtaaggagccaggagttgtgtcgcccactagctacctggacgtagacctccatcccgcctccgcctggaccctgtacgcggtggctaccaccgtgatcaccccaatgctgcgccacacgatcgagaatagcaccgctaacgtttccctcgccgctatagcgaaccaggccgtggtgctcatgggcctggacaagggatggccgatcagcaaaatggatctgggggtccccctgctggccctgggctgctactcccaggtaaaccccttaaccctgaccgccgctgtcctcctgcttattacgcactacgcgatcatcggccccgggctccaagccaaggccacgcgtgaggcccagaaacgcactgccgcgggtataatgaaaaacccgaccgtcgacgggattatgacgatcgacctcgaccccgtgatctacgacagcaagttcgagaagcagctggggcaggtaatgctactggtcttgtgcgccgtgcagctcctgctgatgcgcacctcctgggccttatgcgaggccttaaccctggcgaccggccccatcacgaccctctgggaggggagcccgggcaaattctggaatacaacaatagccgtgtccatggccaacatcttcagggggagctacctggccggcgccgggctggcgttctccatcatgaagtccgtcggcacgggcaaacgcgggaccggttcccagggtgagaccctcggcgaaaaatggaagaagaagctgaatcaactgagccgcaaggactttgacctctacaaaaagtccgggatcaccgaagtggatcgaaccgaagccaaggagggcctgaagagaggcgagattacgcaccacgccgtgtcgcgggggagcgccaaattgcagtggttcgtagagcgcaacatggtgataccggagggccgggtgatcgacctcggctgtggccgagggggatggtcatattactgcgccggcctgaagaaagtcaccgaggtccgggggtacaccaagggcggaccgggccacgaggagcccgtgcccatgagcacctacgggtggaacatagtcaagctgatgtccggcaaggatgtgttttacctcccgccagagaagtgcgacacgctgctgtgcgacatcggtgagtcctcccccagcccaaccgttgaggagtcccgcacgatcagagtcctgaagatggtggagccgtggctcaagaacaaccagttctgcataaaagtgctaaacccgtacatgcccaccgtcatcgagcacctggagcgactccagcgcaagcatgggggcatgctggttcggaaccccttgagcagaaactcaacccacgagatgtactggatcagcaacgggaccggcaacatcgttgcgtccgtcaacatggtcagcaggctcctgctgaaccgcttcaccatgacccatcggcgcccgaccatcgagaaggacgtggatctcggcgcagggacccggcacgtgaatgccgagcccgagacccccaacatggatgtgatcggcgagcgcataaagcggatcaaggaggagcacaacagcacctggcactacgacgacgagaacccgtacaaaacgtgggcctaccacgggtcgtacgaggtgaaggcaaccggctccgcgagctccatgatcaacggggtcgtgaagctgctgaccaagccctgggacgtcgtgccgatggttacccagatggccatgacggacacaaccccattcggccagcaacgcgtcttcaaggagaaagtggacacccggacgccgaggtcgatgccagggacacggcgtgtgatggggattactgccgagtggctctggcggaccttgggcaggaacaagaagccgcggctgtgcacgcgggaggagttcaccaagaaggttcgcacaaacgccgcgatgggggccgtgttcaccgaggagaaccagtgggacagtgccaaggccgccgtggaggacgaggacttctggaagctcgttgaccgagagcgggaactccacaaactggggaagtgcgggagctgcgtgtacaacatgatgggcaagcgggagaagaagctcggtgagttcgggaaggcgaaagggagccgcgccatttggtacatgtggctgggcgcccggtaccttgagttcgaggctctcggtttcctgaatgaagaccactggttctctagagagaactcatactccggggtggaaggcgaaggactgcataaactcgggtacatcctccgggacatcagcaagatccccggcggggccatgtacgcggacgatacggccggctgggacactcgaatcacggaagacgacctgcacaacgaggagaagatcacccagcagatggatccggaacaccggcagctcgccaacgccatcttcaagttaacgtatcaaaacaaggttgtgaaagtgcagcgccccacccccacaggcactgtcatggatatcatctcccggaaggaccagcgcggaagcggccaggtggggacctacggcctgaatacatttacaaacatggaagcccagctcatccggcagatggagggggagggcgtgctttccaaagcggacctggagaaccctcacctccccgagaagaagatcacccagtggcttgagaccaaaggcgtcgaacgcctgaagcggatggccatcagcggggatgactgcgtggtgaagccgatcgatgaccgtttcgccaacgccttgctggccctgaacgacatgggcaaggttcggaaggacataccccaatggcagcccagcaaaggttggcacgattggcagcaggtcccgttctgctcccaccatttccacgagctcattatgaaagatggccgcaagctggtggttccctgcagaccccaggatgaattgatcgggcgagcgcggatctcgcaaggggcagggtggtcactcaaagagacggcgtgcctagggaaggcctacgcgcagatgtggtccctgatgtatttccaccgccgggacctccggttagccagcaacgccatttgcagcgccgttcccgtgcactgggtccccaccagccgcaccacctggagtatccatgcccaccaccagtggatgacgaccgaggacatgctgacggtctggaaccgggtttggatcgaggacaatccctggatggaggataagacccccgtcacgacctgggaaaacgttccgtacctcggtaagcgcgaggatcaatggtgcggcagcctgatcgggttgaccagccgggccacgtgggctcagaacatcccgacagccatccagcaagttcggtcgctcattgggaacgaggagttcctggactacatgcccagcatgaagagattccggaaggaagaggagtccgagggagccatatggtga

SEQ ID NO: 25853 - RNA, 9873 nt, synthetic construct
  misc_feature 1..9873: note = derived and/or modified CDS sequence (opt11) from DENV-3__JF920409__SS-prME
  source 1..9873: mol_type = other RNA
accagcttgtgcctcatgatgatcttacctgccgccctggcgtttcatctcacaagccgagatggggagcccaggatgatcgtcggcaagaacgagcggggcaagagcctactgttcaagaccgcctccgggatcaacatgtgtaccctcatcgcgatggatttaggcgagatgtgcgacgacaccgttacatacaaatgtccccacatcaccgaggtggagcccgaggacatagactgctggtgcaacctgacaagcacttgggtgacgtacgggacgtgtaaccaggccggtgagcaccggcgcgacaagcggtctgtcgcactcgcgccccatgtggggatggggctggacaccagaacacaaacctggatgagtgccgaaggggcctggcggcaggtcgaaaaggtggagacttgggccctgcgccacccgggttttaccatccttgccctgttccttgcccactacattggcacctcactcgcgcagaaggtggttatcttcatcctactgatgctcgtcacaccaagcatgacgatgcggtgcgtgggggtgggcaaccgagacttcgtcgagggtttgtccggtgcaacctgggtggacgtggtactcgagcacggtgggtgcgttaccaccatggcgaaaaacaagcccacgctagacatcgagctacagaagactgaggcgacccagctcgccaccctgcggaagctgtgtattgagggcaagattacgaacattaccacggacagccggtgccccacccagggcgaggcgacattacccgaggagcaggatcagaactatgtttgcaagcatacctacgtggatagggggtggggcaacgggtgcggtctctttgggaagggctccctggtgacttgcgccaagttccagtgcttggaacccatcgaaggaaaggtggttcagtatgagaaccttaagtatacagtgattataaccgtgcacacgggggaccagcatcaggtcgggaatgaaactcagggtgtgaccgccgagataaccccccaagcgagtaccacagaggccattctaccggagtacggtacactggggctcgagtgctcccccagaaccggcctggactttaacgaaatgatcctgctcacgatgaagaataaggcctggatggtgcatcggcagtggtttttcgacctgcccctaccctggaccagcggcgctacgaccgaaactcccacctggaaccgtaaggagctattggtgaccttcaaaaatgcacacgccaagaagcaggaggtggtcgtgctgggcagccaagagggggccatgcacacagccctcacgggggccacggagatccagaacagcggcggtacctccatattcgcgggccacttaaagtgccggttgaaaatggacaagctcgagctgaaaggcatgagctacgctatgtgtacgaacacgtttgtgctgaaaaaagaggtctccgaaacgcaacacgggacgatcctcattaaggtggagtataagggcgaggacgtcccgtgtaagatcccctttagcacagaggacgggcagggcaaagcccacaacggccgactgatcacggctaaccccgtcgtgacaaagaaggaagagccagtgaacatcgaggccgagccccccttcggtgagagcaacatcgtcattggcatcggagacaacgcccttaagatcaactggtacaagaagggctcaagcatcggaaagatgttcgaggcaaccgcccgaggcgcgcgcagaatggctatcctgggcgacactgcttgggactttggatccgtgggcggggttctcaatagcctgggaaagatggtccaccagattttcgggagtgcctacacggctctgttctcaggtgtatcctgggttatgaagatcggcataggggtcctcctgacctggatcgggctgaactcgaagaacacttccatgagtttctcctgcatagcaatcggcatcataacgctctacttaggcgccgtcgtacaggcggacatgggctgtgtgattaactggaagggcaaggagcttaagtgcggaagcgggatcttcgtaactaacgaggtgcacacctggaccgaacagtacaagttccaagccgactcccccaagcgactcgcgaccgccatcgccggggcctgggagaacggggtctgcgggatccggagcacgactcggatggagaatttactgtggaagcagatcgcaaacgaactgaactacattctgtgggagaacaatatcaagcttactgtagtcgtcggcgacataataggcgtgctcgagcagggcaagaggacccttacgccgcaaccgatggagctgaagtattcctggaagacctgggggaaggccaagatagtgaccgcagaaacccagaacagctccttcattatcgacggcccgaacacgcctgagtgcccgtcggtatcccgggcctggaacgtgtgggaggtggaagactatgggtttggggtattcaccaccaacatttggctgaagctgcgcgaggtatacacccagctgtgtgaccaccggctgatgagcgccgcagtgaaggacgagcgagccgtccacgcagatatgggttactggatcgagagccagaagaacgggtcctggaagttagaaaaggcgagcctgatagaggtgaagacatgcacgtggccgaaaagtcacaccctctggagcaacggggtgctggagtccgacatgatcatcccaaaaagcctggccggtcctatctcccaacataaccaccggccgggttaccacacccagaccgccgggccctggcacctcggcaagctggaactggacttcaactactgcgaggggacgacggtcgtgattaccgaaaactgtgggacccgcggccctagcctcagaacgaccaccgtgtccgggaagctgattcacgagtggtgctgccgctcgtgtaccctgccacctctccggtacatgggcgaggacggatgctggtacggcatggagatccgtcccatttccgagaaggaagagaacatggttaagagccttgtgtccgccggtagcgggaaagtggacaacttcacgatgggcgtcctgtgcctggcgattctgttcgaagaagtgatgcgggggaagttcggcaagaaacatatgatagcgggggccttcttcatgttcgtgctgctactgtccggacaaatcacctggcgggacatggcacacaccttaattatgatcgggagcaacgcctcagatcggatggggatgggcgtgacctacctcgccttaattgcgacgtttaagatccagcccttcctagctcttgggttcttcctccgtaagctgaccagccgggaaaacctcctgcttggcgtgggcctggcaatggccacgaccctgcaactccccgaggacatcgagcagatggctaacgggatcgccctcggcctcatggccttaaagctcatcacacaattcgagacctatcagctgtggaccgctctaatcagcctgacctgctcgaacacgatattcaccttaaccgtggcttggcgcactgcgacgctgatccttgccggggtcagcctgctgccagtgtgccagtccagttccatgcggaagaccgactggctacctatggcggtagccgccatgggagtgccgccgctcccgttgtttatcttctctctcaaggacaccctgaagcgcaggtcctggccactgaatgaaggggttatggcggtcggcctcgtgtccattctggcctccagcctactccggaacgacgtgccaatggccggccccttagtagctgggggactccttatcgcctgctatgtgatcacagggacgtctgcagacctgaccgtggagaaggcggccgatatcacctgggaggaggaggccgagcagacaggggtctcacacaatctgatgataacggtcgacgacgacggcaccatgcgcatcaaggacgacgagtccgagaacatccttaccgtgctgctgaagaccgccctcctgattgttagcggcatcttcccgtactccatccccgcgaccctgctagtgtggcacacatggcaaaagcaaacccagcggtccggagttttgtgggatgtcccctccccgcccgagacccagaaggccgagctcgaagaaggggtgtatcgcatcaaacagcaaggcatctttgggaagacccaagtgggcgtaggggtccagaaggagggcgtattccacacgatgtggcacgtgacccgcggggccgttctcacctataacgggaagcgcttggaacccaactgggcaagcgtgaagaaggacctgatctcctacggcgggggctggcggctctccgcgcagtggcagaagggtgaagaggttcaggtgatcgccgtagagcccggtaaaaaccccaagaactttcagaccatgcccggcacgttccagacaaccaccggggagattggcgcgatagcacttgacttcaagcccggcacgagcggctcccccatcatcaatcgcgagggcaaggtcgtggggctgtacggcaacggggtggtgaccaagaacggcgggtacgtgagcggcatagcccagaccaatgccgagccggacggccccaccccggagctggaggaagagatgtttaagaaacggaacctcacgattatggacctgcatcccgggtcgggcaagacacgcaagtatctgccggccatcgtgcgggaggccatcaagcgcagactccgaactctgatcttggcccccacccgagtcgtagccgctgagatggaggaggccctgaaggggctgcccatccggtaccagacgaccgccaccaagagcgagcacacgggccgggagatcgtggacctgatgtgccacgccacgtttaccatgcgcctcctgtcccccgttcgggtccccaattacaacctgatcatcatggacgaggctcacttcacggaccccgcgagcatcgcagcccgcggttatatctctacccgggtgggcatgggtgaggccgctgccatatttatgacggccacaccgcccgggacagccgacgccttcccgcagagcaacgcgcccatccaggatgaggagagagacataccagaacgcagttggaacagcggtaacgagtggataaccgacttcgcagggaaaacagtctggttcgtgccctccatcaaggccggcaatgacatcgccaactgcctccgcaagaatgggaaaaaggtgatccagctgagccgcaagaccttcgacaccgagtaccaaaagaccaagttgaacgactgggattttgtcgtcacgaccgacatctccgagatgggggcaaacttcaaggcggaccgggtgatcgatccaagacggtgcctcaagcccgtcatcttgacagatggccccgaacgagtgatactggccgggcctatgccagtgaccgccgccagcgccgcgcagcggcgcggccgcgtcggaagaaacccccagaaggagaacgaccagtatatctttacgggtcagcccctaaacaacgacgaggaccacgcccactggactgaggcaaaaatgctgctggataacataaataccccggaggggatcatacccgccctctttgagcccgagcgggaaaagtctgctgccatcgacggcgaatacaggctgaagggtgaatctcggaagacctttgtggagttgatgcgccgcggggacttaccggtgtggctcgcacacaaggttgcatccgagggtatcaagtacacagaccgcaagtggtgctttgatggacaaaggaacaaccagatcttggaggagaacatggacgtggagatctggacgaaggagggcgagaagaagaagctccgcccccggtggcttgacgctagaacttacagcgacccgctggcgctcaaggagttcaaggagttcgcagcgggccgcaagagtattgcccttgatttggtcaccgagatagggcgggtgccctcgcatcttgcccatagaacccgaaacgctctggataacctggtgatgctgcacaccagcgagcacggcgggcgcgcctacagacatgccgttgaggagctgcctgaaacaatggaaacattactgctgctaggcttaatgatcttgttgaccgggggcgccatgttgttcctgatttccggcaagggtatcggcaagactagtatcgggttaatctgcgtgattgcgtcaagcggcatgctctggatggcggagatcccgttacagtggatcgcgtccgccatcgtgctggaattcttcatgatggtcttgctgattcccgagccggagaagcaacgtacaccccaggacaaccagctggcgtacgttgtgattgggatactcacactagccgcgataatagccgcaaacgaaatgggactgctcgaaacgactaagcgggacctggggatgagcaaggagccgggggtcgtatctcccaccagctacctggacgttgacttacaccccgccagtgcgtggaccctgtacgctgtagccaccacggtaatcacccccatgctgcgccacaccatcgagaacagcaccgccaacgtgagtctagccgcgatcgccaaccaggccgtcgtccttatgggtctggacaaagggtggccgatcagcaagatggacttgggcgtgccgctgctggccctcgggtgctacagtcaggtcaacccactgacgttgaccgccgcggttctactgctcatcacccactacgccatcatcggacccggactccaggcaaaggctacccgggaggcccagaagcgaacggcagcaggtatcatgaagaaccctacggtggatggcatcatgaccatcgatctagaccccgtcatctacgatagcaaatttgaaaaacagctcggccaagtgatgctcctggttctgtgtgcggtccagctgctgctgatgaggacctcctgggccctctgcgaggcgttgaccctagcgaccggccccatcaccaccctttgggaagggagccccgggaaattctggaacacgaccatcgccgtgtctatggctaacatcttccgaggttcttaccttgccggggctgggctggctttctccatcatgaaatccgtcgggacgggcaaacggggcaccggaagccagggcgagacgctcggtgagaaatggaagaagaagttaaaccaactgtctcggaaggacttcgacctctacaagaagtccggcatcacggaggtcgatcggaccgaggccaaggaggggctgaagcgcggcgaaatcacgcaccacgccgtttcccggggcagcgccaagctgcaatggttcgtggagcgcaatatggtcattccggagggtcgggtgatcgacctcggctgcgggcgcggcgggtggtcgtactactgcgcgggcctaaagaaggtcacagaggttagaggctacactaagggcgggcccggtcacgaggagcctgtgcccatgagcacctacggctggaatatcgtgaagttaatgtctgggaaagatgtattctatctcccgcccgagaagtgcgacaccctgctgtgcgacatcggcgagtcatcccccagcccgaccgtagaagaaagtcgcacgatccgcgtattaaagatggtcgagccttggctcaagaacaaccagttctgcatcaaggtactaaacccctacatgcccacggtgattgagcacctcgaacggctccaacgcaagcacggcggaatgctggtgcggaaccccctgagccgtaattccacacacgagatgtattggatcagcaacggcaccgggaatatcgtggcgtccgttaacatggtcagccggctgctgctaaatcgattcacgatgacacaccggcgcccgacaattgagaaggatgtggacctcggtgccggcactcggcatgtgaacgccgaacccgaaacacccaacatggacgtaatcggggagaggataaagcggattaaggaggagcataacagtacctggcactacgatgacgaaaacccttacaagacgtgggcctaccacggttcttatgaagtgaaagcgaccggttccgccagctcaatgatcaacggcgtagtcaaactgctgaccaaaccctgggacgtggtccccatggtgacccagatggccatgaccgacaccacacccttcgggcagcaacgcgtatttaaagagaaggtcgacacaagaaccccacgctccatgcccggcacccggcgcgtaatggggatcacggcggaatggctatggaggacactgggtaggaacaaaaaaccccggctatgcacccgtgaggagtttaccaagaaggtgcgcacgaacgcggccatgggcgccgtcttcaccgaggagaaccagtgggacagcgccaaggccgcggtcgaagacgaggacttctggaagctcgtagacagagagcgagagctgcacaagctagggaagtgcggctcctgcgtctataacatgatggggaagagggaaaagaagctcggtgagttcggcaaggccaaggggagccgtgccatctggtacatgtggcttggcgctcggtacctggaattcgaggccctagggttccttaacgaggaccattggttctcccgcgaaaatagctattcgggcgtggagggggaaggcctgcacaagcttggctacatcctgcgtgatatcagcaagatccccggaggcgcgatgtacgccgacgacaccgcgggttgggacacgcgcatcacggaagacgatctccacaatgaggagaagataacccaacagatggatccggagcaccggcagcttgccaacgcgatcttcaagctgacctaccagaacaaagtggtaaaggtgcagaggccaacccctacgggcaccgtgatggacatcatatctcgcaaggaccagcgcggcagcggacaggtcggcacttatggcctgaacaccttcactaatatggaggcgcagcttatacggcagatggagggcgaaggggtgctgtcgaaggccgacctagagaatccccacctcccggagaagaagatcacgcagtggctggagaccaagggcgtggagcgcctgaaacgcatggcgatcagtggcgacgattgcgtagtgaaacccatcgacgaccgcttcgccaacgctctcttggcactgaacgacatggggaaggtgcgcaaagacataccccaatggcaaccgtccaagggctggcacgactggcagcaggtcccgttctgcagccaccactttcacgagctaataatgaaggacggacgcaagctggtagtcccctgccggcctcaagatgagctgataggccgcgcccgcatatcccagggggcgggctggtcgttgaaggaaaccgcctgcctcggtaaggcgtacgcccagatgtggagcctgatgtacttccaccgccgcgacctccggctggccagcaacgctatctgctccgccgtccccgtacactgggtgccgacctcgcgcaccacctggagcatccatgcgcaccatcagtggatgaccaccgaggacatgctgaccgtatggaatcgggtgtggatcgaggacaacccctggatggaagacaagacccccgtgaccacgtgggagaacgtcccctacctcggaaagcgcgaggaccaatggtgcggctccctgatcgggctgaccagccgggccacctgggctcagaacatcccgaccgccatacagcaggtacgctccctcatcggcaacgaggagttcctagattacatgcccagcatgaagcggttccgtaaggaagaggagtcagagggagcgatctggtga

SEQ ID NO: 25854 - RNA, 9873 nt, synthetic construct
  misc_feature 1..9873: note = derived and/or modified CDS sequence (opt11) from DENV-3__JF920408__SS-prME
  source 1..9873: mol_type = other RNA
acctctctgtgtctcatgatgatcctacccgcagccctggcgttccacctcaccagccgggatggtgagccgcggatgatagtcgggaagaacgaacgtgggaagagcctgctgttcaagacggccagcgggatcaacatgtgcaccctcatcgccatggacctgggcgaaatgtgcgacgacactgtgacctacaagtgcccgcacatcactgaggtggagcccgaggacattgactgttggtgcaacctgaccagcacatgggtgacctacgggacgtgcaatcaggccggcgagcatcggcgcgacaagcgatccgtggctctagcgccccacgtgggcatggggctggacaccaggacccaaacctggatgagtgctgagggcgcctggcgccaggtggaaaaagtggagacttgggccttacgacacccgggattcaccatcctcgccctgttcctggcccactatataggcacctccttaacccaaaaggtagtgatctttatcctgctgatgctagtcacgccgagcatgaccatgcggtgcgtgggggtgggcaaccgcgattttgtggagggattgtccggggccacctgggtggacgtggtcctggagcacggggggtgtgtgaccaccatggccaaaaacaagcccaccctagacatcgagctacagaagaccgaagccactcagcttgcgacgcttaggaagttatgcatcgaaggcaagattaccaacatcacgaccgacagccgctgccccacccagggcgaggccaccctgcccgaggagcaggatcagaactacgtctgtaagcacacctacgtcgaccgggggtggggaaacgggtgcgggctctttgggaaaggctccctcgtgacctgcgccaaattccagtgcctggaacccatcgagggcaaggtggtccagtacgaaaaccttaaatacacggtcatcatcaccgtgcacaccggggaccaacaccaggtcggtaacgggacacagggcgtgacggcagagattacaccgcaagcctctaccaccgaggcgatactgcccgagtacgggaccctgggcctcgaatgctccccgcgcacgggcctggacttcaacgaaatgatcctgctaacaatgaaaaataaggcgtggatggtccatcggcagtggttcttcgacctgccgctgccctggaccagcggggcgaccacggagacccccacctggaaccgcaaggagctcctcgtgaccttcaagaacgcccacgcaaaaaaacaagaggtggttgtgctgggatctcaggagggtgcgatgcacactgccctcaccggcgccaccgagatacaaaatagcgggggaaccggtatattcgccggacacctaaagtgccggctaaagatggacaagctcgagctgaagggcatgtcctacgcgatgtgcacgaacacctttgtgctgaagaaggaggtcagcgagacccagcacggcaccatcctcatcaaggtggagtacaagggcgaggacgtcccctgcaagatccccttcagtacagaagacggccagggaaaagctcacaatggcaggttaataaccgctaatcccgtcgttacgaagaaggaggaacccgtgaacatagaggccgagccgccgtttggggaatccaacatcgtcatcggcatcggggacaacgccctgaagattaactggtacaagaagggcagctccatcggcaagatgtttgaggcaaccgctcgcggggcccgccggatggccatcctgggcgatacggcttgggacttcggcagcgtgggcggggtcctgaactccctggggaagatggtccaccagatctttggctcggcgtacactgccctgttttccggggtgagttgggtgatgaagatcggcatcggggtcctcctaacctggatcgggcttaattccaagaacacctccatgtccttctcgtgtatcgccatcggtatcatcacgctctatctgggagctgtagtgcaggcagatatgggctgcgtcatcaattggaaggggaaagaactcaaatgtggctccgggatcttcgtcacgaacgaggtgcacacctggactgaacagtacaagtttcaggcggactcgcccaagcgcctcgccacggccatcgccggggcctgggaaaacggggtctgcggcatccgctccaccacccggatggaaaacctgttatggaaacagatcgcgaatgaactcaactacatcctgtgggagaacaatatcaagttaaccgtggtggtcggcgatatcatcggggtactcgagcagggcaagcgcacactgactccccagccgatggagctgaagtacagctggaagacctggggcaaggccaagatcgtgaccgccgagacgcagaactccagttttatcatcgacggccccaatacccccgagtgcccctccgtcagccgggcctggaacgtgtgggaagtcgaggactacggcttcggagtattcactacaaacatctggctcaagctgcgcgaggtgtacacccagctgtgcgaccaccggctcatgtccgcagccgtgaaagacgagcgcgccgtccacgccgacatgggctactggatcgagtcgcagaaaaacggtagctggaagctagagaaggcgtccctgatcgaggtgaagacgtgcacgtggcctaagtcccacaccctatggtccaacggcgtgctggagagcgacatgatcatccccaagtcccttgctgggccaatctcccagcataaccaccggccaggctaccacacgcagacggccggcccctggcacctcgggaaactggagcttgacttcaactactgcgagggcaccaccgttgtgatcaccgagaactgcgggacgcgcggcccctcactccggactaccactgtgtcagggaagctaatccatgagtggtgctgccgctcctgcacgttacccccgctcaggtacatgggagaggacggctgctggtacgggatggaaattcgtcccattagcgagaaggaggagaacatggttaagtccctggtttcggccggctccgggaaagttgacaatttcaccatgggcgtcttatgcctcgccatcctctttgaagaagtgatgcgcggcaagttcggcaagaagcacatgatcgccggcgtgttcttcaccttcgtccttctgttgagcggccaaatcacgtggcgcgacatggctcatacgctgatcatgatcgggtccaacgccagtgataggatgggaatgggcgtgacatatctcgccctgattgctaccttcaagatacagcccttccttgccttaggcttcttcttgcgcaagctgacctccagagagaacctcctgctgggggtagggctcgcgatggccacgaccctgcagctgcccgaggacatagagcagatggcgaatgggattgccctcggcctgatggcgctaaaactcatcacacagttcgagacttaccagctgtggacggccctgattagcctgacctgcagcaacaccattttcacattgacggtcgcttggcgtacagccaccctcatcctcgccggcgtgtcgttactaccggtttgccagagctccagcatgcggaagaccgactggctcccaatggcggtggccgccatgggcgtgccacctttgccgctgttcatattcggcctcaaggacacgctgaagaggcgctcctggccccttaacgaaggggttatggcggtgggactcgtgagcatcctagccagctccctgctccggaacgacgtcccgatggcgggacctctagtggccggcgggctgctcatcgcttgctacgtgataaccggcacttccgccgacctgaccgtcgagaaagcagcggacatcacgtgggaggaggaggccgagcagacaggcgtgagccacaacctgatgatcaccgtggacgacgacggcaccatgcgcatcaaggatgacgagaccgagaatatcctcacggtcctgctgaaaaccgccctactgatcgtatccggcattttcccgtacagcatccccgcaaccctgctagtttggcacacgtggcagaagcagacgcagcgctctggcgtcctgtgggatgttccctccccgcccgagacacagaaggctgaattggaggagggggtgtaccgaatcaaacaacaggggattttcggcaagacgcaggtgggtgtaggtgtgcagaaggagggagtattccataccatgtggcacgtaacgcgcggcgcggtgctcacctacaacggtaagcgcctggagccaaactgggcctccgtcaagaaagaccttatcagctacggcggcggctggcgactttccgcccaatggcagaagggcgaggaggtccaggtcatcgccgtcgaaccgggcaagaaccccaagaacttccaaacgatgcccgggaccttccagacgaccaccggcgagattggcgcgatagccctggatttcaagcccgggacgtctggctcacccatcatcaacagagaggggaaggtggtgggcctgtacggaaatggtgtcgtgacgaagaacggcgggtacgtgtctggtatcgcgcagaccaacgccgagcccgacggacccacccccgagttggaggaggagatgttcaagaagcgaaatctgacgatcatggacctgcaccccggaagcgggaagacgcggaagtacctgccggccatcgttcgggaggcgatcaagcgcagactccgcaccctgatcctggcgcccacccgggtggttgccgctgagatggaggaggcactcaaaggcctgcccatccggtaccagaccacagctaccaagagcgagcacacgggccgggagatcgtcgacttgatgtgccacgccaccttcacgatgcgcctcctgagccccgtgcgggtgccgaattacaacttaatcatcatggacgaggctcacttcaccgaccctgcctccatcgccgcgcgggggtacatcagcacccgggtcggcatgggggaggccgccgcgatctttatgaccgctacgccgcccggcaccgccgatgccttcccgcaatccaacgcgcccattcaggacgaggagcgcgacatccccgagcgctcttggaactccggcaacgaatggatcaccgacttcgccggaaaaaccgtgtggttcgtgcccagcatcaaagccggaaacgacattgccaactgcctccggaagaacgggaagaaggtcatccagctgtcccgcaagacgttcgacacggaatatcagaagaccaagctgaacgattgggatttcgtagtgaccacggacatcagcgagatgggcgccaactttaaggccgaccgtgtcatcgacccgcgacggtgcctcaagccagtgatcctaaccgacgggcccgaaagggtgatcctggccggacccatgccggtcaccgcggcgtccgccgcgcagcgccgtgggagggtaggaagaaacccccagaaggaaaatgaccagtacatcttcacgggccagcccctcaacaacgatgaggaccacgcccactggaccgaggcaaagatgctcctggataacatcaatacgcctgaggggattatcccggccctcttcgagcctgaaagagaaaaatccgcagccatcgacggtgagtaccgcttaaagggggagtccagaaagactttcgtggagctgatgcgccggggcgacctccccgtatggctggcgcacaaggtagccagtgaggggatcaagtacactgaccgtaagtggtgcttcgacgggcagcggaacaaccaaatcctggaggagaacatggacgtcgaaatttggacgaaggagggcgagaagaagaagctccgcccacggtggctggacgcgcgcacgtactcagacccgctggccctcaaggaatttaaagagttcgctgccgggcgcaagagcatcgccctggacctggtgaccgagatcggacgggtgcccagccacctcgcccatcggacacggaacgccctggacaatctggtcatgctccataccagcgagcacgggggccgcgcctaccggcacgcggtggaggagctgccagagacgatggagacgctactcctgctgggcctgatgatcctcctgaccggaggggccatgctgttcctgatctcggggaagggcatagggaagaccagcataggcctgatctgcgttattgccagctccggtatgctctggatggcagagataccgttgcagtggatcgcgagtgcaatcgtactggagttcttcatgatggtgctactaatcccggagcctgagaagcagcgcacgccccaggataaccaacttgcttatgtcgtcatcgggatcctcacgttggccgccatcatcgcagcgaacgaaatgggccttctggagaccaccaagcgggacctcgggatgtccaaggagcctggcgtcgtcagcccgacgtcctacctggacgtcgacctccaccccgcctcggcctggaccttatacgccgtggcgaccacggtgatcacgccaatgctgcgccacaccatcgagaactccaccgcaaatgtctccctcgccgccatcgccaaccaggcggtggtactgatggggctggacaaaggctggccgatctccaagatggacctcggcgtccccctgctagccctcgggtgttacagccaggtgaacccactcacgctgacggccgcggtgctcttgctaattacacattacgctatcatcggtcctgggctccaagcgaaggccacacgagaggcccagaagcgcaccgccgccggcattatgaagaacccgacggtcgacgggatcatgaccatcgacttagaccccgtcatctatgattccaaattcgagaaacagctgggccaggtgatgctactggtactgtgtgcggtgcagctcctgcttatgcgaactagctgggccctctgcgaggccctgaccctggccacgggcccgatcaccaccctctgggaggggtcccccggaaaattctggaataccactattgcggtgtccatggccaacatcttccgcggctcctacctggccggcgccggcttggctttcagcatcatgaagtccgtcgggaccggtaagcgggggacaggcagccaaggagagaccctcggcgagaagtggaaaaagaagctgaaccagcttagtcgcaaggacttcgacctctataagaagtctggcatcactgaggtggaccgcactgaggcgaaggaggggctgaagcgcggtgagataacacaccacgcagtgagccgggggtcggcaaaactgcagtggtttgtcgagcgcaacatggtgataccggagggccgggtgatcgacctcgggtgtggacgcggtgggtggagctactactgcgccggcctgaagaaagtcaccgaggtgcggggatacaccaagggagggcccggccatgaggagcccgtccccatgtctacgtacggctggaacatcgtcaagctgatgtctgggaaggacgtgttttacctacctcctgagaagtgcgacacccttctgtgcgacatcggcgaatccagcccctccccaaccgtggaggagtcccgcacgatccgcgtcttaaaaatggtggagccttggctgaagaacaaccagttctgcatcaaggtgctgaacccctacatgcctacggtcattgaacacctggagcgcttacagagaaaacatgggggaatgttagtccggaaccccctgtcacgaaatagcacccacgagatgtactggatctccaacggtaccggtaacattgtggcatcagtcaacatggtatcccgactcctgctgaaccgcttcaccatgacgcaccggcgcccgaccatcgagaaagacgttgatcttggcgcggggactcggcacgtcaatgccgagcccgagacccccaacatggaggtgatcggcgagcgcatcaaacggatcaaggaggagcacaacagcacgtggcactacgacgacgagaacccgtataagacctgggcctaccacggctcatatgaggtgaaggccaccggcagtgcttcaagcatgatcaatggtgtcgtgaagctgctgaccaagccctgggacgtcgtgccaatggtgacacagatggcgatgaccgacaccaccccgttcggacagcagcgtgttttcaaagagaaagtggacacgcggaccccgcgttccatgcccggcacccgccgcgtcatggggataaccgccgagtggctctggcgcacattgggcagaaataagaaaccccggttatgcacccgcgaggagttcaccaagaaggtccgcacaaacgccgccatgggggcggtgttcacggaggaaaatcagtgggacagcgccaaagccgcagtggaggacgaggatttctggaagctggtcgatcgggagcgcgagctgcacaagctcggcaagtgcggcagttgcgtttacaacatgatggggaagcgcgagaagaagctcggtgagttcgggaaggctaagggctccagggcgatctggtacatgtggctgggggcacggtacctggagttcgaggccctgggcttcctaaacgaggaccactggttcagccgcgaaaactcgtacagcggcgttgagggggagggcctgcacaaattagggtacatccttcgggatatcagtaagattcccggaggggccatgtacgccgatgacaccgcgggatgggacacccgtatcaccgaagacgacctgcacaacgaggagaagatcacgcagcaaatggaccctgagcaccggcagctcgccgacgcgatattcaagctgacctatcagaacaaggtcgtgaaggtgcagcgccccacccccacggggacagtcatggacatcatctcaagaaaggaccagcgcgggtccggccaggtgggaacgtatggcctgaacacctttactaacatggaggcccagctcatccggcagatggagggcgaaggcgttctgagcaaggccgaccttgaaaacccccacctcccagaaaagaagataacccagtggctggagacgaagggcgtcgaacggctgaagcgtatggcgatttccggggacgattgcgtggtgaagcctatcgacgaccgctttgccaacgcactcctggccttaaacgacatgggaaaggtccggaaggatatacctcagtggcagcccagcaaggggtggcacgactggcagcaggtcccgttctgttcccaccactttcacgagctcatcatgaaggacggcaggaagctggtagtcccctgccggccccaggacgagttgatcggccgcgctcggatcagccaaggggcgggctggtcgctcaaggaaaccgcctgcctgggaaaggcctacgcccagatgtggtccctgatgtacttccaccgcagggacctcagactggcgtccaacgccatttgcagcgccgtgcccgtgcactgggtcccgacctcccgaaccacctggagcatccacgctcaccaccagtggatgacaaccgaggacatgttgaccgtctggaaccgggtgtggattgaggacaacccttggatggaggacaagacgcccgtcactacctgggagaacgtcccatacctcggcaagcgtgaagaccaatggtgcgggtcgctgatcggcctcacgagccgggccacgtgggctcaaaacatcccaacggctatccagcaggtccgcagcctcatcggcaacgaggagttcctggactacatgccctccatgaagcggttccgtaaagaggaagaatcagagggggcgatatggtga

SEQ ID NO: 25855 - RNA, 9873 nt, synthetic construct
  misc_feature 1..9873: note = derived and/or modified CDS sequence (opt11) from DENV-3__JF920397__SS-prME
  source 1..9873: mol_type = other RNA
accagtctgtgcctcatgatgattctgccagcggcgttggccttccacctcaccagtagagacggagaaccccgtatgatcgtggggaaaaacgagagaggcaagagcttattattcaagactgcgtccggaatcaacatgtgcacccttatcgccatggacctgggggagatgtgcgatgacaccgtgacctacaaatgcccccacataaccgaggtggaacccgaggacatcgactgctggtgcaaccttacgtcaacttgggtgacctacgggacatgtaatcaagccggcgagcaccggcgtgacaagagatctgtcgccctggcgccccacgtgggaatgggcctggacacccgcacccagacctggatgagcgccgagggcgcctggcgacaggttgaaaaggtcgagacctgggccctgcgacaccccgggttcacgatcctagctttattcctggcgcactacatcggcacctcccttacccaaaaagtggtgatattcatcctgctgatgttggtcacgcccagcatgaccatgcggtgcgtgggagtgggtaaccgagacttcgtcgaagggctgagcggtgccacctgggtagacgtagtcctcgaacacggcgggtgcgttaccactatggcaaagaataagcccaccctcgacatagagctgcagaagaccgaggccacccagctggcgacgctccggaagctgtgcatcgaaggcaaaattaccaacatcacgaccgactcccgctgtcccacgcagggcgaggcgacactgccagaggagcaagaccagaattacgtatgcaagcacacatacgttgatcgcgggtggggcaacggctgtggcctctttgggaagggctccctggtgacatgtgctaagttccaatgcttagagcccatcgaggggaaggtcgtacagcacgaaaacctcaagtacactgtaatcattaccgtccacaccggggatcaacaccaagtcggcaacgaaacacagggggtgaccgccgagattacgcctcaggcctcaactacagaggcgatcctgccagagtacggcaccctagggttggagtgctccccacgcactggcctggactttaacgaaatgatcctgctgaccatgaagaacaaggcctggatggtccaccggcagtggttcttcgacctgcccctgccctggacctcgggtgccactacggagacccctacctggaatcgaaaggaccttctcgttaccttcaaaaatgctcacgccaaaaagcaggaggtggtggtgctggggagtcaagagggagcgatgcataccgccctgaccggagccaccgagatacagaactccggagggacctccatattcgccggccacctgaaatgtcgcctgaaaatggacaagttagaactgaagggcatgagttacgccatgtgcacgaacacattcgtgctgaagaaggaggtttccgagacccagcacggtacgatcctgatcaaggtggagtacaagggtgaggacgtaccatgtaaaatccccttctcgacggaggatgggcagggcaaggcgcacaacggtcgactgattaccgccaaccccgtcgtaaccaagaaggaggagccagtcaatatcgaggccgaaccgcccttcggagagagtaacatcgtgatcggcatcggggacaacgccttaaagatcaactggtacaagaagggctccagcatcgggaagatgttcgaggcgacagctcgcggggcccgccggatggccatcttgggtgacacggcctgggactttggatccgtgggcggcgtgctcaactcccttggcaagatggtgcaccagatcttcgggtctgcgtacaccgctttattttcgggcgtctcatgggtgatgaagattgggatcggagtgctcttaacctggatcggactaaatagcaagaacacctcaatgagcttctcctgtatcgcgatcggtataatcacgctctacctgggcgctgtagtgcaggcggacatggggtgtgtcatcaactggaagggtaaggagctaaagtgcggctcaggcattttcgtgaccaacgaggtgcacacctggaccgagcaatacaagttccaggcggattccccaaagcgcctcgccacagccatcgcgggcgcatgggagaatggggtatgcgggatccgctccacgacgcggatggagaatttactttggaaacagatcgcgaatgaactcaactacatcctgtgggagaacaacattaagctgacggtagtggtcggggacatcatcggcgtgctcgagcagggcaagagaacgctcacgccccagccgatggaactcaaatattcctggaagacgtggggtaaggcaaaaatcgtgaccgccgagacacagaactcaagctttataattgacggcccgaacacacccgaatgccccagcgtctcccgggcctggaacgtgtgggaggtggaggactacggattcggcgtcttcactacgaacatctggttaaaactccgcgaggtgtacacccagctgtgcgaccatcggctcatgagcgcggccgtaaaggatgaacgcgccgtccatgccgatatgggatattggatcgaaagccaaaagaatgggtcctggaagcttgagaaagccagcctgatcgaggttaagacgtgcacctggccgaaatcccacaccctctggagcaacggcgtcctggagagcgacatgataatccccaagagcctggcggggcccatctcccagcataaccaccgtccgggctaccacacgcagactgccggaccctggcacctcggcaagctggagctggacttcaactactgcgagggcaccaccgtcgtgatcactgagaactgcggaacgcgcgggcccagtctccggaccaccaccgtctccgggaagctgattcacgagtggtgttgtcgaagctgcacgcttcccccacttagatacatgggggaggacggctgctggtatggcatggagatccgccccatttccgagaaggaagagaacatggtgaagagtcttgtatccgccggctccgggaaggtcgacaacttcaccatgggcgtcttgtgcctcgccattttatttgaggaggtcatgcgagggaagttcgggaaaaaacacatgattgccggagtattcttcacgttcgtactgctcctgtctggccagatcacctggagggacatggcgcatacgctgatcatgatcggcagcaatgccagtgaccggatggggatgggcgtgacatatctcgccctgatagccaccttcaaaatccagcccttcctggcccttgggttctttcttcgcaagctaaccagcagagagaacctcctgttgggcgtaggcctcgcgatggccacgaccctgcagttaccagaggacatcgagcagatggcgaacgggatagccctcggcctgatggcgcttaagcttatcacccagttcgagatttaccagctgtggacagccctgatcagcttaacgtgctccaacactatcttcaccctgaccgtcgcctggcgaactgctaccctgattctcgccggggtgtcgctgttaccgatgtgccagtccagcagtatgcggaagaccgactggctccctatggcagtcgccgccatgggcgtgccgccccttccactgtttatatttagcctcaaggacaccctgaagcgccgctcctggccgctaaacgagggggtgatggcagtcggtcttgtgtcaatcttagccagtagtttgctacgaaatgacgtgcccatggcgggccccttagtcgccggtgggttactcatcgcctgctatgttatcacggggacatccgccgacctgaccgtggagaaggccgctgacattacctgggaagaggaggccgagcagacgggcgtcagccataacctgatgattaccgtagacgacgatgggaccatgagaatcaaggacgacgagaccgaaaacatcctcaccgtgctgctcaagaccgccttgctgatcgtcagcggcatcttcccgtatagcatacctgcaacccttcttgtatggcatacctggcagaaacagacccaacggtccggggtgctgtgggacgtcccaagccctcctgagactcagaaggccgagttagaggagggagtgtatcgtatcaagcaacagggcattttcgggaagacccaggtgggagtcggggtgcaaaaagaaggggtgttccatacaatgtggcacgtcacacggggcgcggtgctcacctataatggcaaacgcctggagccaaactgggcctcggtgaagaaggacttgatctcctatggcggggggtggcggctctccacccagtggcagaagggggaggaagtgcaggtgatcgccgtggagcccggcaagaaccctaagaacttccagaccatgccgggcaccttccagacgaccaccggggagataggtgccatcgcgttagatttcaagcccggtacctctggcagccccatcataaaccgcgagggaaaggtcgttggactgtacggcaacggagtggtcacgaagaacggcgggtacgtgtccggaatcgcccaaaccaacgcggagcctgacggccccacccctgagctggaggaggaaatgttcaaaaaacggaacctcactataatggacctgcaccccgggagtggcaaaacgcggaagtacctgccggccattgtgcgggaggcaatcaagcgcagattaagaaccttaatcttagcccccacccgggtcgtagccgccgagatggaggaggcgctcaaggggctccccatccgctaccagaccacggcgaccaagagcgagcatacgggccgggagatcgtggacctgatgtgccacgcaacctttactatgcgactcctgagcccagtccgggtgccgaactacaacctgatcatcatggacgaggcccatttcaccgatcccgcctctattgcagcccgcggatacatctctacccgtgtcggcatgggcgaggcggccgccatcttcatgaccgccacgccgcctggtacggcagatgcgttcccccagagcaatgccccaattcaggacgaagaacgggacatacccgagagaagctggaactccggaaacgagtggatcacagacttcgccgggaagaccgtctggttcgtgcccagcatcaaggctggcaacgacatcgcgaactgcctacggaagaacgggaagaaagttatccagctgtcccgcaagacattcgacaccgagtaccagaagaccaaattgaacgactgggattttgtcgtgaccacggacatcagcgaaatgggcgcgaactttaaagccgaccgagtgatcgacccgaggcgatgcctcaaacccgtcatccttaccgatggcccggagcgcgtaatccttgccgggcctatgccggtgaccgccgcatccgccgcacagcggcgaggcagggtaggccggaatcctcagaaagagaatgaccagtacatcttcactggccagcccctcaacaacgacgaggaccacgcccactggaccgaagccaaaatgctgttggacaacatcaacacgcccgaggggatcatcccggccctcttcgaacccgagagagaaaaatccgccgcgatagacggcgaataccgcctgaagggcgagtcccggaagacgttcgtagagctgatgagacgcggggatctacccgtgtggttggcccacaaggtcgcgagcgagggcatcaaatacaccgaccgcaagtggtgcttcgacgggcagcggaacaaccaaatcctggaggagaatatggacgtagagatctggaccaaggagggcgagaagaagaagcttcgacccagatggctggatgcccgtacctacagcgatccactggccctcaaggagttcaaggagttcgctgccggcagaaagtcgatcgcgctggatctggtcacagagatcggcagggtaccttcccaccttgcccataggacgcggaatgccctggacaatctggtgatgctacatacaagcgagcacggcgggcgcgcgtatcggcacgcagttgaggagctgcccgaaacgatggagactctgctccttctgggccttatgatcctgctaaccgggggcgcgatgctgtttttaattagcggaaaggggatcgggaagacatccatcgggcttatctgcgtgatcgccagcagtggcatgctctggatggctgaaatcccgctgcagtggatcgcttcggccatcgtgctggagttcttcatgatggtcctcctgataccagagccggaaaaacagcgcacgccccaggacaaccagttagcgtacgttgtgatagggatccttaccttagccgcaatcatcgccgccaacgaaatgggcctcctagagaccaccaagcgggacctaggcatgtccaaggagccgggtgtcgtgagtccgacgtcgtatctggatgtggacctccatcccgctagcgcctggactctatacgccgtcgcgaccactgttatcacgcccatgctgcgccacactatagagaactcgacagcgaacgtctcgctcgccgctatcgcaaaccaggccgtcgtgctaatgggcttggacaagggttggccgatctccaagatggatctcggtgtgcccctgctggcgctggggtgctacagccaggtgaacccactgactctcactgccgccgtgctgctactgatcacccactacgccataatcggccccggcttgcaggccaaggcgacacgagaggcccagaagcgcaccgccgccgggatcatgaaaaacccgactgtggacggcatcatgacaatagacctggaccccgtaatctacgactctaaattcgagaaacagctggggcaggtaatgctccttgtgttgtgcgtcgtgcaactactgctcatgcggactagctgggccctctgtgaggcgttgaccctggcaacgggacccatcaccaccctctgggagggctcaccagggaagttctggaacaccactatcgccgtcagtatggccaatatcttccgcggatcctacctggcgggggccggcctagccttctccatcatgaagtccgtcggtaccggcaagcgggggaccggcagccaaggcgagactttgggcgagaagtggaagaagaaacttaaccagctgtcacgcaaggacttcgacctctacaagaagtccggcataaccgaggttgaccggacggaggccaaggaggggctcaagcgcggcgagataacccatcatgccgtatcgcggggatccgcgaagttgcagtggttcgtcgagcgtaatatggtgataccggaggggcgggtgatagacctcggctgcgggcggggcgggtggagctattattgcgccggattaaagaaagtcaccgaagtgcgcggctacaccaagggcgggcccgggcacgaagaacccgtgcccatgtccacgtacggatggaacatcgtcaaactaatgagcggtaaggacgtgttctatctccctcccgagaagtgcgacacactgctatgcgacatcggcgagtccagccccagtccgaccgtggaggaaagccgcaccatacgcgtactgaagatggtggaaccgtggctcaaaaataaccagttctgtatcaaggtgctgaacccctatatgcccacggtgatagaacatttagagcgtcttcaacgcaagcacggggggatgctagtgcgcaatccgctctcccgcaatagcacccatgagatgtactggatttccaacggcacggggaacatcgtggcctcagttaacatggtgtcccggctacttctcaaccgcttcaccatgactcaccgacgccctacaatcgagaaggatgtggatttgggcgccggcactcggcacgtcaacgccgagcccgagaccccaaatatggacgtgattggggaaagaattaagcggatcaaggaggagcacaactcaacgtggcactacgatgacgagaacccatataagacctgggcttaccacggctcctacgaggtgaaggccaccgggtccgcgtcctctatgatcaatggcgttgtgaaactgctgaccaagccctgggacgtcgtgcctatggtcactcagatggccatgacggacacgacccccttcgggcagcagcgcgtgttcaaggaaaaggtcgatacacgaacgccgcgcagcatgccaggcacacggagggtgatgggcatcaccgccgaatggctctggcgtacgctggggcggaacaagaagcctcgactgtgcacaagagaggagttcacgaaaaaggtaaggacgaacgcggccatgggtgccgtgttcacggaggaaaaccagtgggactccgcaaaggcagccgtggaggacgaggacttttggaagctcgtcgatcgggagcgtgagctacacaagctggggaagtgcggaagttgcgtgtacaacatgatggggaagcgggaaaagaagctcggagagttcgggaaggccaaggggtctcgcgcgatctggtacatgtggctgggcgccagatacctggagttcgaggcgctcgggtttcttaacgaggaccactggttcagccgcgagaactcctacagcggcgtggagggtgaaggcctgcacaaactgggctacatcttacgggacatatccaagatacccgggggcgccatgtacgcagacgacactgccgggtgggacaccaggatcacagaggacgacttgcacaacgaggagaaaatcacgcagcagatggaccccgagcaccggcagctcgctaatgcgatattcaagctcacctatcagaacaaggtcgtaaaggtacagcgccccacccccaccggcaccgtcatggacatcatcagccggaaggaccagcgcggctccggccaagtgggaacatatgggttgaataccttcaccaacatggaagcccagttaatccggcagatggagggcgagggggttctgagcaaggcggacctagagaacccccacctaccagagaagaagataacccagtggctggagacgaagggagtcgagagactcaagcggatggccatctccggcgacgactgcgtggtgaaacctatcgacgaccgcttcgcgaacgcgctcctagccctgaacgacatggggaaagtccgaaaggacatcccccagtggcagcccagcaaggggtggcacgactggcagcaggtcccgttctgctcccaccactttcatgagctcatcatgaaggacgggcgtaagctggtggtaccgtgtaggccccaggatgaactaatcgggcgagcacggatcagccagggagcaggatggtccctgaaagaaacggcgtgcctcggcaaggcgtacgctcagatgtggagcctgatgtacttccatcgtcgagatctccggctggcctcaaacgccatctgcagcgcggttccagtgcattgggtcccgacatcacgcaccacatggtctatccatgcccaccatcaatggatgaccaccgaagatatgctgaccgtttggaaccgggtgtggatcgaggacaacccctggatggaagacaagactcccgtgaccacttgggagaatgtgccctacctcgggaagcgcgaggaccaatggtgcggaagcctgatcggattaacctcccgggctacttgggcccagaacataccgaccgcaatccagcaagtccgttcgcttatcggcaatgaggagttcctcgactacatgccttccatgaaacggtttcgcaaagaggaggagagcgagggagcgatttggtag

SEQ ID NO: 25856 - RNA, 9873 nt, synthetic construct
  misc_feature 1..9873: note = derived and/or modified CDS sequence (opt11) from DENV-3__JN093513__SS-prME
  source 1..9873: mol_type = other RNA
accagcctctgcctcatgatgatccttcctgcggccctcgcgttccacctcaccagccgggatggcgagccccggatgatcgtggggaagaacgaacgcggcaagagcctcctgtttaagacggcatcagggatcaacatgtgcaccctcatcgcaatggacttgggcgaaatgtgcgacgacaccgtgacctacaaatgcccccacatcaccgaagtggaacccgaggacatcgactgctggtgcaacctgaccagcacctgggtgacctacgggacgtgcaaccaggccggcgaacacagacgcgataagcggtccgtcgccctggcgccccacgtgggcatgggactggacactcgcacccagacctggatgtctgccgagggagcctggcgccaggtggaaaaggtggagacgtgggctctacgccacccggggttcactatcctcgcgctgttccttgcccactatatcggcacctccctcacccagaaggtggtgatcttcattctgctgatgctcgtcacacccagcatgacaatgcgatgcgtgggggtgggaaaccgcgacttcgtcgaaggcctgtccggggcgacctgggtggacgtggtcctcgaacatggtgggtgcgtgaccacgatggcaaaaaacaagcccacgctcgacatagagctgcaaaagaccgaggccacccaattagcgacacttcggaagctgtgcatcgagggcaagatcaccaacatcaccactgatagcagatgccccacccagggcgaggctactctgccggaggagcaagaccagaactacgtgtgcaagcacacctacgttgaccgggggtggggcaacggatgcggtctcttcgggaaaggatcgctggtgacctgcgcaaagtttcagtgcttagagcccatcgagggcaaagtggtccagcacgagaatctaaagtacacggtgattatcacagtccacacaggggaccagcaccaggtcggcaacgagacgcagggggtgacagccgagatcacgcctcaggcaagcaccaccgaggcgatcctgcccgagtacggcaccttagggcttgagtgttccccacgcacgggcctggacttcaacgagatgattctcctcaccatgaagaataaggcctggatggtccaccggcagtggttcttcgacctgccgctgccatggaccagcggcgccactacggagacccccacctggaaccgcaaggagctcctggtgacgttcaagaatgcgcatgccaagaagcaagaagtggtcgtgctgggctcccaggagggtgcgatgcacacagcactcactggggccaccgagatccagaacagtggcgggacctccatcttcgccggccacctgaaatgccgcctgaagatggataagctcgagctgaagggcatgagctacgccatgtgcacgaacactttcgtgctgaaaaaggaggtttccgagacacaacacgggaccattttaatcaaggtcgagtacaagggagaggacgtgccgtgcaaaatccccttcagcacggaggacgggcagggcaaggcgcacaacggccgccttatcaccgccaaccccgtcgtcaccaagaaggaggagcccgttaacatcgaggccgagccgcccttcggggaaagcaacatcgtcatcggcatcggcgacaacgccctgaaaatcaactggtacaagaagggctcctcgatagggaaaatgttcgaggcgacagcccggggcgctcgacgtatggccatcctgggggatacggcctgggacttcgggtccgtgggcggggtgttgaactccctgggtaagatggtacaccaaatcttcgggtccgcctataccgccctattcagcggcgtgtcctgggtgatgaagatcggcatcggggtcctcctgacctggatcggtctgaacagcaagaacacctccatgagcttctcctgcatcgccatcgggatcataacgctctacctgggtgccgtggtgcaggccgacatggggtgcgtgattaactggaagggcaaagagctgaagtgcggaagcgggatctttgttaccaacgaagtgcacacgtggacagagcagtacaagttccaggcggactcccccaagcggctcgccactgccatcgccggcgcctgggagaacggtgtatgcggcatccgcagcaccacccggatggagaacctgttgtggaaacagatcgcgaacgagctcaattacatcctgtgggagaacaacatcaaactgaccgtggttgtcggggacatcatcggcgtgctagagcagggcaagcgcacactaacgccccagccgatggagctgaagtactcctggaagacgtgggggaaagccaagattgtgaccgcggagactcagaacagctccttcatcatcgatggccccaacacgcccgagtgccccagcgttagccgggcctggaacgtgtgggaagtggaagactatgggtttggtgtattcaccaccaacatttggctcaaactgcgcgaggtgtacacacagctttgcgaccaccggctcatgagcgcggccgtaaaggacgagcgcgccgttcatgctgatatgggctactggatcgagagtcagaagaacgggtcctggaagctagaaaaggcttcactgattgaggtgaaaacttgtacctggccgaaatcccacaccctctggagcaacggcgttctggagtcagatatgattatccctaagagcctggcggggcccatctcgcagcacaaccaccggccgggctatcacacccaaacggcgggcccgtggcacctcggcaagttagagttagacttcaactactgcgagggcaccaccgtcgtcatcaccgagaactgtgggacacgggggcctagcctccggaccaccacggtatccggcaagctgatccacgaatggtgctgccgtagctgtacgttacccccgctccggtacatgggcgaggacgggtgctggtacggcatggaaatacgccccatctccgagaaggaggaaaacatggtgaagtcactggtgtccgctggcagcgggaaggtcgacaactttaccatgggggtcctgtgtctagccattctgttcgaggaggtgatgcgggggaagttcggcaagaagcacatgatcgcaggtgtgttcttcaccttcgtcctactcctgtccggccagatcacctggcgcgacatggcgcacacgctgatcatgatcgggagcaacacctccgaccgtatggggatgggggtgacgtacctcgccctcatcgcaaccttcaagattcagcccttcctggccctcggatttttcctgcgcaagctgacgagccgagagaaccttctgctgggcgtgggcctcgccatggccacgaccctgcagctaccggaggacatcgagcagatggcaaacggcatcgccttaggcctgatggcccttaagttgatcacccagttcgagatctaccagctgtggacggcgctgatcagcttgacctgctcgaacactatttttaccctgactgtcgcgtggcgcacggccaccctaatcctcgccggggtgtcactgcttccggtctgccaatcctcttccatgcggaagaccgattggctgcccatggccgttgcggccatgggcgttccgcccctcccgctgttcatcttcggactgaaggacacgctgaagcgccgcagctggcccctgaacgagggagtaatggccgtggggctggtgtccattctcgccagttcgttgctccggaacgacgtccccatggccgggccacttgtggcgggcgggctgctcattgcctgctacgtgatcaccggcaccagcgccgacctgactgtcgaaaaggcagcggacatcacgtgggaggaagaggcggaacagaccggggtgtcgcacaatctgatgataaccgtggacgacgacggaaccatgaggatcaaggatgacgagaccgagaacattctcacggtcctgctcaagaccgccctcctgatcgtgagcggaatatttccgtattccatccccgccacgctgctcgtgtggcacacctggcagaaacagacgcagcggtctggggtcctttgggacgtgcccagcccgcccgaaacccagaaggcagagcttgaagagggcgtgtaccgcatcaagcagcaggggatcttcggcaagacccaggtcggggtgggagtgcaaaaggaaggggtgttccacaccatgtggcacgtaacgaggggtgcggtgctcacctataacggcaagcggctggagcccaactgggcgagcgtcaagaaagatctcatctcatatgggggcgggtggcggctctcagcccagtggcagaagggcgaggaggtccaagtgatcgccgtcgagcccggcaagaaccccaaaaacttccaaaccatgcccggcacctttcagacgaccactggcgagatcggggccatcgcgctggacttcaaacccggcacctccggcagccccatcataaaccgcgaaggtaaggtggtgggcctgtacgggaacggcgtagtgacgaagaacgggggctatgttagcggaatcgcccagaccaacgccgagccagacggccccactccagagttggaggaggagatgttcaagaagagaaacttgacgatcatggacctgcaccccggctccgggaagacgcgcaagtaccttccggcaatcgtacgggaagccatcaaacgccggttgcgcaccctgatcctggcgcccacccgggtggtggccgccgagatggaggaggccctcaagggcctgcccatccgttaccaaactacggccactaagagcgagcacaccgggcgagaaatcgtcgacctgatgtgccacgcaaccttcacaatgcggctcctgtcccccgtgagggtaccaaactacaacctgatcatcatggacgaggcgcacttcacggatcccgcctcgatcgccgcccgcggctatatatcgacccgggtcggaatgggggaggcagctgccatcttcatgacggccacccctcccggcaccgcggacgcattcccgcagagcaacgcccccatccaggacgaggagcgcgacatccccgagcgctcctggaacagcgggaacgagtggatcacagactttgccggcaagaccgtctggtttgttccctctatcaaggccgggaacgatatcgcgaactgcctcaggaagaacggcaagaaggtcatccagctgagccgcaagacttttgacacagagtaccagaagaccaagttgaacgactgggacttcgtggtcaccacagacatatctgagatgggagccaactttaaggccgaccgggtcatcgacccgcgccggtgtctcaagcccgtaatactgactgacgggcccgaacgcgttatcttagccggccccatgcctgtcaccgccgcgagcgccgcccagcggcgtgggcgggtgggccgcaacccccagaaagagaacgaccagtacatcttcaccgggcagcccctcaacaacgacgaggatcacgcccactggactgaggccaagatgctgctggacaacatcaacacgccggagggcataattccggctctcttcgagcccgaacgagagaagtccgcggccatcgacggcgagtaccgcttaaaaggggaaagccggaagacctttgtcgagctgatgcgccggggggaccttcccgtctggctcgcccacaaggtggcgtccgaggggatcaagtacaccgaccgcaagtggtgtttcgacggccagagaaacaaccagatcctggaggagaacatggacgtcgaaatctggaccaaagagggcgagaagaagaagctccgcccccggtggctggacgctcgcacgtacagcgacccgctggccctcaaggagttcaaggagttcgccgccgggcgaaagtccatcgccctggacctggtgaccgagattggaagggtgcccagccacctcgcccacagaacccggaatgccctggacaacctcgtcatgctccacacttccgagcacgggggacgcgcctatcggcacgccgtggaagaacttcccgagacaatggagactctgctcctgctggggctcatgatcctgctgactggcggcgcgatgctgttcctgatcagcgggaagggcatcgggaagactagcatcggcctcatctgcgtgatcgcgtccagcgggatgctctggatggccgaaatcccgctgcagtggatcgcctcggccatcgtcctggagttttttatgatggtgctcctgatccccgagcccgagaagcagcgcacgccccaggacaaccagctggcgtacgtggtcatcggcatcctcaccctggccgccatcatcgccgccaacgagatgggcctgctcgagaccacgaagcgggacttggggatgagcaaggagccgggcgtggtctccccgaccagctacctggacgtcgacctacaccccgcgtccgcctggaccctctacgccgtggctaccaccgtgatcacgcctatgctgcgacacactatcgagaacagcactgcgaacgtctccctcgccgccatcgccaaccaggccgtggtattgatggggctggacaagggttggccgatctctaaaatggaccttggtgtccccctgctagcgctcggctgctactcccaggtgaaccccttaactctgacggccgccgtgctcttactgatcacccactacgccatcatcgggcccgggctccaggccaaggcgacccgggaggcccagaagcggaccgccgcaggcatcatgaagaacccgacggtcgacgggatcatgaccatagaccttgatcccgtgatctacgactctaagttcgagaagcagctgggacaggttatgctcctggtcctgtgtgccgtccagctccttctgatgcggacctcctgggctttgtgtgaggccctgaccttggcgacgggtcccatcacgaccttatgggagggtagccccgggaagttctggaacaccacaatcgccgtgtcaatggcgaacatcttccgcgggtcatacctggccggcgccggcctggccttctccatcatgaagtccgtcggcacggggaagcgggggaccggcagccagggggagaccctcggtgagaagtggaagaagaagctgaaccaactgagccgcaaggatttcgacctctacaagaagtccgggatcaccgaggtggaccggacggaggccaaggagggcctgaagcgcggcgagatcacccaccacgcggtgtcccgagggagtgccaagctgcagtggttcgtcgaacgcaatatggtgatcccggagggtcgggtgatagacctcgggtgtggccgcgggggatggtcctactactgtgccgggctcaagaaggtcaccgaggtgcgcgggtacaccaagggcgggcccggccacgaggagcccgtgcccatgagcacgtacgggtggaacatcgtcaagttaatgtccggcaaggacgtgttctacctcccacccgagaagtgtgacaccctgctgtgcgacatcggcgagagctcccccagccccaccgtcgaggagtcccgcaccatccgcgtcctgaaaatggtggagccgtggctcaaaaacaatcagttctgcatcaaagtcctgaatccctacatgcccacggtgatcgagcacctcgaaaggctccagcgcaagcatgggggcatgctggtgcggaatcccttatcacgcaattccacccacgagatgtactggatcagcaatggcaccggcaacattgtggcctccgtcaacatggtgtcccggctcctgctgaaccgatttaccatgactcaccgtcgcccgacgatcgagaaggacgtggatctcggcgccgggacccggcacgttaacgcggagcccgagacccccaacatggacgtgatcggcgagcgtatcaagcggataaaggaggaacacaactcgacgtggcactacgacgatgaaaacccgtacaagacgtgggcctaccacggaagctacgaggtaaaggccaccggctcggccagctccatgataaacggggtcgtgaagctgttgaccaagccatgggacgtcgtgccaatggtgacacagatggccatgaccgacaccacccctttcggccagcagcgcgtcttcaaggagaaggtggacacgcggaccccacgctccatgcccggaactaggcgcgtgatgggtatcaccgcggagtggctctggcggacgctgggccgcaacaagaagccccggctgtgcacccgcgaggagttcacaaagaaggtccgcaccaacgccgccatgggtgccgtcttcacggaggagaatcagtgggacagcgcgaaggccgccgtggaggacgaggacttctggaagctcgtcgaccgggagcgcgagctgcacaagctgggcaaatgcgggtcctgcgtgtacaacatgatgggcaagcgggaaaagaagctgggcgagttcgggaaggccaagggcagcagggccatctggtatatgtggctgggggcgcggtacctggagttcgaggccctcggcttcctcaacgaggaccactggttctcccgcgagaacagctacagtggtgtggagggagagggcctgcacaagctcgggtacattctccgggatatcagcaagatccccggcggcgcgatgtacgccgacgacactgccggctgggacactcgaatcaccgaggatgacctgcacaacgaggagaagatcacgcagcaaatggacccagaacaccgacagctggcgaacgccatattcaaattgacctaccagaataaagtcgtgaaagtgcaacgccccacccccaccgggaccgtaatggatatcatctcccgcaaagaccagcgcgggtcgggccaggtggggacgtacggcctgaacactttcaccaatatggaggcccagctcatccggcagatggagggtgaaggagtgttgtctaaggccgacttagagaacccccacctgccggagaaaaaaatcacccaatggctggagacgaagggcgttgagcgcctgaagcggatggccatcagcggggacgactgcgtggtgaagccaatcgacgacagattcgctaatgccctcctggccctgaacgacatgggcaaagtgcggaaggacatcccccagtggcagccctctaaggggtggcacgactggcagcaggtcccattttgcagccaccacttccacgaactcatcatgaaagatggccgcaagctggtggtcccctgccggccccaggacgaactgatcgggcgcgcacggatctcccaaggggccggctggtctctcaaggagaccgcgtgcctggggaaggcctacgcccagatgtggtccttaatgtacttccaccgtcgtgacctccggctggccagcaatgcgatctgctccgccgtccccgtacactgggtcccgaccagccgtaccacgtggtccatccatgcccaccaccaatggatgaccacggaggacatgctgacggtgtggaaccgggtgtggatcgaggacaacccctggatggaggacaaaacgcccgttaccacctgggagaacgttccctacctcggcaagcgcgaagaccagtggtgcgggtcactgatcggcctgacaagcagagctacgtgggctcagaacatcccgaccgcgattcagcaggtccgctcccttataggaaatgaggagttcctggattacatgcccagcatgaagcggttccgcaaagaggaagagtccgagggcgctatttggtga

SEQ ID NO: 25857 - RNA, 9873 nt, synthetic construct
  misc_feature 1..9873: note = derived and/or modified CDS sequence (opt11) from DENV-3__JF937624__SS-prME
  source 1..9873: mol_type = other RNA
accagcctatgcctcatgatgatcctgcccgccgccctagcgttccatctcaccagcagagacggcgaaccccggatgatcgtggggaagaacgagagaggcaagagcctgttgttcaagactgccagcgggatcaacatgtgcaccctcatcgcgatggacctgggagagatgtgcgacgataccgttacctataaatgcccacacatcaccgaggtggagcccgaggacatcgactgctggtgcaacctgaccagcacctgggttacctacgggacttgcaaccaggccggcgagcaccggcgcgacaagcggtccgttgccctcgcgccccacgtgggcatggggctggacactcgcacccagacctggatgagcgcggagggcgcctggcgccaagtggagaaggtggaaacatgggcgctgcgccatccggggttcactatcttagccctgttcctggcccactacatcggtacttccctcactcagaaagtggtgatctttatcctgctgatgctcgttacgccgagcatgacgatgcgatgcgtcggggtgggcaatcgcgacttcgtggagggcctgagcggggccacctgggtggacgtggtactggagcatggagggtgtgtgacgacgatggccaagaacaagcctaccttggacatcgaactgcagaagaccgaggccacacagctggctacgctccggaagctgtgcattgagggtaagatcaccaacatcaccaccgactctcgctgccccacgcagggcgaggctaccctgccggaggagcaggaccagaactacgtgtgcaaacacacctacgtcgacagagggtggggaaacgggtgcggtctcttcgggaaaggctccttagttacctgcgccaagttccagtgcctggagccgatcgagggcaaggtggtccagtacgagaacctcaagtacacggttattatcaccgttcataccggggaccagcatcaagtcggcaatgaaacccagggggtgacagccgagatcacaccccaagcctctaccaccgaggcaatcctgcccgaatatggtacgttgggtttagagtgctcgccgcgcacgggcctggatttcaacgagatgatcctgctcaccatgaagaacaaggcttggatggtccaccggcagtggttcttcgacctgcccctaccgtggaccagcggcgccaccacggagacccctacctggaaccgcaaagagctcctggtgacattcaagaacgcccacgccaagaagcaggaggtcgtggtgctgggatcccaggaaggcgcaatgcacacggcccttaccggggccactgagatccaaaatagcggcggaacttccatcttcgccgggcacttaaaatgccggctgaagatggacaagttagagcttaagggcatgagctacgctatgtgcacgaataccttcgtgttgaagaaagaggtctctgagacccaacatgggaccattctcataaaggtggagtacaagggcgaggacgtgccgtgtaaaataccattttcgacggaggacgggcagggaaaagcgcacaacggcagactgatcaccgccaaccccgtcgtcactaagaaggaggagcccgtgaacattgaggcagagccgcccttcggggagagcaacatagtcatcgggatcggggacaacgccctgaagatcaactggtacaagaagggcagcagcatcgggaaaatgttcgaggcaaccgcccggggtgcccggcggatggcaatacttggcgacaccgcctgggacttcgggagtgtgggtggtgtcctcaacagcctcggcaagatggtccaccagatcttcgggtcagcctacacggccctgttctctggcgtgagctgggttatgaagatcggtattggagtcctactgacctggattggcctgaattctaaaaacacgtccatgagcttttcgtgtatcgccatcggaatcatcactctctacttaggagccgtggtccaggctgacatggggtgcgtcatcaactggaagggaaaggagctaaagtgtggcagcgggattttcgtcaccaacgaggtgcacacatggaccgaacagtacaagttccaggcggattcccccaagcgcctagccaccgccatcgccggcgcatgggagaacggggtctgcggcattcggtcgaccacccggatggagaacctgctttggaagcaaatagcgaacgagctcaactacatcctgtgggagaacaacattaagctgaccgtggtggtcggggacataatcggagttctcgagcagggtaagcgcacgctaactccacagccgatggagttaaagtactcctggaagacctgggggaaggccaagattgtcactgccgaaacgcagaactcgtcctttatcatagatggccctaacacccccgagtgccccagcgtatcccgggcctggaacgtttgggaggtggaggattacggatttggcgtcttcaccacaaacatctggctaaagttgcgcgaagtgtacacacagctgtgcgaccacaggttgatgagcgcggccgtgaaggacgagcgcgccgtccacgccgatatgggttactggatcgagtctcagaagaacgggtcgtggaagctggagaaggcgtctttaattgaggtgaaaacgtgcacctggcctaagtcccatacgctctggagtaacggcgtgctagagtccgacatgatcatacctaagtctctggcggggcctatctcccagcacaaccaccgcccgggctatcacacccaaacggccgggccctggcacctcggcaagcttgagcttgacttcaactattgcgagggcacaaccgtcgtgatcaccgaaaactgcggtacccgcggcccgagcctccggacaaccaccgtgtccgggaagctgatccacgagtggtgttgccgctcctgcacgcttcccccgctccggtacatgggggaagacgggtgttggtacggcatggagatccgccccatctccgagaaggaggagaacatggtgaagagcctggtgtccgcgggcagcgggaaggttgacaacttcactatgggcgtgctatgcttagcgattctgtttgaagaagtgatgagaggcaagttcggcaagaagcacatgattgctggggtgttcttcacgtttgtcctactcttgtcaggacagatcacttggcgggacatggcgcacacgctgatcatgatcggcagcaatgcctccgaccggatgggcatgggcgtgacatacctcgcgctgattgcgaccttcaagatacaacccttcctggccctcgggttcttcctgcgcaagctgacctccagggagaatctcctgctgggcgtgggcctcgcgatggccacgacgctacagctgcccgaggacatcgagcagatggcgaacgggatcgccctcggtctaatggcgctcaagctcatcacccaattcgagacgtaccagctgtggacggccctgatcagcctgacatgctccaacaccatcttcaccttaacggtcgcctggcgcactgccaccctgatccttgccggggtgagcctgctgcctgtatgccagtccagctcaatgcggaagactgactggctccctatggcggtggccgccatgggtgtgccgcccctgccactctttatcttcgggcttaaggacacgctgaagcgccgcagctggcctctgaacgagggggtgatggccgtgggcctagttagtatacttgcctcgagtctgctacggaatgacgtccctatggcgggacctctagtagccggagggctgctcatcgcctgctacgtgatcacgggaaccagcgcagacctgacagttgagaaagccgcagacatcacgtgggaggaggaggccgagcagaccggggtgtcccacaatctgatgattaccgtggacgacgatggcaccatgcgcattaaggatgacgagactgagaacattctcacggtcttgctgaagaccgccctcctgatcgtgagcgggatttttccttacagtatccccgccaccctgctcgtatggcacacctggcagaagcaaacccagcggagtggagtcctgtgggacgtgcccagcccgccagagacccagaaagccgagctggaggaaggcgtgtaccgcatcaagcagcagggtatcttcggtaagacgcaggtcggggtgggcgtacagaaggagggcgtcttccacacaatgtggcatgttacgcgtggtgcggtgctcacctacaacggcaagagactggagcctaactgggcctcagtcaagaaggacttgatcagttatgggggtggctggcgcctcagcgcacaatggcagaagggcgaggaagtgcaagtgatagctgtcgagcccggtaagaaccccaagaatttccagactatgcccggcacctttcagacgatcaccggcgagatcggcgcgatcgccctggacttcaagcccggcacctccggcagccccattattaaccgcgaggggaaggtagtgggcttgtacgggaatggcgtcgtgaccaaaaacgggggctatgtgtcagggatcgcccagactaacgcggagccggacgggcccacccccgagctggaggaggagatgttcaagaagcggaaccttaccatcatggacctgcaccccggctctgggaagaccaggaagtacctaccggcaatcgtgcgtgaggcaatcaaaagacggctccgcacgttgatcctggctcccacccgggtggtggccgccgaaatggaggaggccctcaagggcctgcctatccgctaccagactaccgcgaccaagtccgagcacacggggcgggagatcgtcgacctgatgtgccatgccacctttaccatgcgcctcctgtcccccgtgcgggtgccgaactataatctgatcatcatggacgaagcccacttcacggaccccgccagcatcgccgcgcgcggttacatctcgacccgggttggcatgggggaggccgcggccatcttcatgaccgctacgccgcccggtacggccgacgccttcccgcagagcaacgcccccatccaggacgaagagcgcgacatccccgagcgctcctggaatagcgggaacgagtggataaccgactttgccggcaagaccgtgtggttcgtgccctccatcaaggcggggaacgacattgcaaactgcttgcggaagaacggcaagaaagtcatccagctgagccgcaaaacctttgacacggagtaccagaagacgaaactgaacgactgggattttgtagtgaccaccgacatcagtgagatgggcgccaactttaaggccgaccgggtcatcgacccgcgccggtgcctcaagccggtgatcctgacggacgggcccgagcgcgtgatactggccggccccatgccggtcaccgcggccagcgcagcccagcgccgggggcgagtaggccgcaatccccagaaggagaacgaccagtacatcttcaccgggcaaccgctcaacaacgacgaggaccacgcccactggacagaggcgaagatgcttctggacaacataaacactcccgagggcatcatcccagccctcttcgagcccgagcgggaaaaatcagccgccatcgacggagaataccgcctgaagggggagtctaggaagacgttcgtggagctgatgcgccggggcgacctccccgtctggctggcgcacaaggtggcctccgaagggatcaagtataccgaccgcaaatggtgtttcgacggccagcgcaacaaccagatcctggaggagaacatggacgtcgagatctggactaaggagggcgagaagaagaaactccggccccggtggctggacgcccgcacatacagcgacccgctggcgttaaaggagttcaaggagttcgccgcggggcggaagtccatcgccctggacctggtcacggagatcggacgggtgcccagtcacctcgcccaccgcacccggaacgccctggacaacctggtaatgctccacacctccgagcatggtggccgcgcctaccggcacgcagtggaggagttacccgagaccatggagacgctgctactgctggggctcatgatcttattaaccggaggcgctatgctgttcctgattagcggaaagggcattggaaagactagcataggactgatttgcgtaatcgcctcctcggggatgctctggatggccgagatcccgctgcagtggatagcttccgctatcgttctagagttcttcatgatggtactcctgatccccgagcccgagaagcagcgcacgccccaggacaatcagctggcttacgtagtcatcggcatcctcacgctggccgccatcatcgccgcgaacgaaatgggcctgctcgaaaccaccaagcgggacttaggtatgagcaaggagccgggcgtggtgtcccccactagctacctggacgtcgacctacaccccgcctcggcctggacactgtacgccgtggcgacgactgtgatcacccccatgttacgccacactatcgagaatagcaccgccaacgtgtccctcgccgccatagccaaccaggctgtggtactgatggggcttgacaagggctggccgatcagcaaaatggatctcggggtccccctgctggctcttggctgctactcccaggtaaaccccctgaccctgaccgccgccgtgctcctgctgataactcactacgccatcatcggtccggggctccaggcgaaggccacccgggaggcccagaagagaaccgccgccggcatcatgaagaacccgaccgttgacgggattatgacgatagaccttgaccccgtgatatacgacagcaagtttgaaaagcagctgggccaggtaatgctacttgtcctgtgtgcggtgcagctcctgctgatgcggaccagttgggccctctgcgaggctctgacgttggcaaccggacccatcacgaccctctgggaggggagcccaggtaagttctggaacaccacaatcgcggtgtccatggctaacatattccgcgggtcctacctcgccggagcagggctggccttttccatcatgaagtccgtcggcacgggcaagcgggggacgggctcccagggggagaccctcggcgagaaatggaagaagaaactaaaccaactgagccgcaaagattttgatctctacaagaagtccgggataactgaggtggatcgaactgaagcgaaggagggcctaaagaggggcgagataactcatcacgccgtgtcccggggtagcgctaagctgcagtggttcgtcgagcgtaacatggtgatcccggagggccgagtgatcgacctcgggtgcggaagagggggttggtcctactactgcgcaggcctgaagaaggttacagaggtacgggggtatactaagggggggcccggccacgaggaacccgtgcccatgagcacttacgggtggaacatcgtcaagcttatgagtggcaaagacgtgttctatctccctccggagaagtgcgacacgctgttgtgtgacatcggcgagtcgtccccctcacccaccgtggaggaatcccgcaccatccgcgtcctgaagatggtggagccgtggctcaagaacaaccagttttgtatcaaggtgttaaacccttatatgcctaccgtgatcgagcacctggagagattacaacgcaagcacgggggcatgctggtccggaaccccctaagccgcaactccacgcatgagatgtactggatctctaacggtaccggcaatatcgtcgcaagtgtgaatatggtgagccggctgctgctgaacaggttcaccatgacccaccgccgcccgacgatcgagaaggacgtggacctcggcgcggggacccgacatgtcaacgctgaacccgagactcccaacatggacgtgatcggcgagcgaatcaaaaggatcaaggaggagcacaactccacctggcactacgacgacgagaacccgtacaagacgtgggcctaccacggcagctacgaggtgaaggccaccggttccgcaagctccatgatcaacggggtcgtgaagctgctaacaaagccctgggatgtcgtacccatggtcacccagatggcaatgacggacaccaccccctttggtcagcagcgcgtattcaaggaaaaggtggacacccgcacgccgcgcagcatgcccggcacccggagaattatggggattaccgccgaatggctctggcgcaccctcggccgcaacaagaagcccaggctgtgtacgcgagaggaattcaccaagaaggtgcgcacgaacgccgccatgggggcggtgttcaccgaggagaaccaatgggacagcgccaaggccgcggtggaagacgaggacttttggaagctcgttgaccgggagcgtgagctgcataagctgggaaagtgcgggtcttgtgtctataacatgatgggcaagcgggagaagaagctcggagaatttgggaaggccaagggcagccgcgctatctggtacatgtggttgggggcaagatatctggagttcgaggctctcggattcctgaacgaagaccactggttctcccgcgagaatagctactcgggtgtggagggagaaggccttcacaagctcgggtatattctgagagacatcagcaagattcccggtggggccatgtacgctgacgacacggcgggctgggacacccgcatcaccgaggacgatctgcacaacgaggagaagatcacccagcagatggacccggagcaccggcagctcgccaacgccatattcaagctgacgtatcagaataaggtggtcaaagtgcagcgacccacccccaccggcaccgtgatggacatcatctcccggaaggaccagcgcgggtccggccaggtcgggacctacggcctgaacacgttcactaacatggaggcccagctcatccgtcagatggagggggagggcgtgctctccaaggccgacctggagaaccctcacctcccagaaaagaagatcacccagtggctggagactaagggcgtggagcgattgaagcggatggcgatcagcggggacgactgcgttgtgaaacccatcgacgacagattcgccaacgcccttctagccctaaacgatatgggcaaggtgcgaaaggacatcccccaatggcaaccctccaaggggtggcacgactggcagcaagtcccgttctgctcacatcacttccacgagttaatcatgaaggacggccgcaagctagtagttccctgtcggccccaggacgagcttatagggcgcgcccggatctcccaaggcgcgggctggagcctgaaggagacagcttgcctgggcaaggcctacgcccaaatgtggtcgctgatgtacttccataggcgcgacttacggctggcgagcaatgcaatatgctcagccgttccagtgcactgggtgcccacgagccgcacaacttggtctatccacgcccaccaccagtggatgacaactgaggatatgctgaccgtctggaacagagtgtggatcgaggataacccatggatggaagacaaaacccccgtcacgacctgggagaacgtcccctacctcggaaaacgcgaggaccagtggtgcgggagcctgattggcctgacgagccgggccacctgggcgcaaaatattccgaccgccatccagcaggttcgcagcctcatagggaacgaggaattcctggactacatgccgtccatgaagcgttttagaaaggaagaggagtccgagggcgcaatttggtga

SEQ ID NO: 25858 - RNA, 9873 nt, synthetic construct
  misc_feature 1..9873: note = derived and/or modified CDS sequence (opt11) from DENV-3__JN000938__SS-prME
  source 1..9873: mol_type = other RNA
accagcctctgcttgatgatgatccttcccgcagccttagccttccacctcacaagccgggatggggagcccagaatgatcgtggggaaaaacgagcggggcaagtctctgctgttcaagacagccagcgggatcaacatgtgcaccttgatcgccatggatctgggagagatgtgcgacgacacggtgacatataaatgcccccatatcaccgaggtggagcccgaggacatcgattgctggtgcaacctgaccagcacctgggtcacatacgggacatgcaatcaagccggcgagcaccggcgcgacaagagatccgttgccctcgctccccacgttggcatggggctggacacacgcacacagacgtggatgagcgccgagggcgcgtggcgccaagtggagaaggtggagacgtgggcgctgcgtcacccggggttcaccatccttgcgttattcctggcacactacatcggtacctcgctcacccagaaggtggtgattttcatcctccttatgctagttacgcctagcatgacgatgaggtgcgtcggggtgggcaaccgcgactttgtcgagggcctttccggggcaacctgggtggatgtcgtcctggagcacggcgggtgcgtgaccacgatggccaagaataaacctaccctcgacatcgaactgcaaaagaccgaagcaacccagctggcaaccttacggaagctgtgtatcgagggcaaaatcaccaacatcactaccgatagtcgatgccccacgcagggcgaagccaccctgcctgaggagcaggaccagaactacgtctgcaagcacacctacgtagaccgtgggtggggcaacgggtgcggccttttcggcaaaggctccctcgtgacctgcgccaagttccagtgtctggagcccatcgaaggcaaggtggtccagtacgaaaatctcaagtatacagtgatcattaccgtgcacaccggggatcagcaccaggttggcaacgagacccagggagtgacggctgagatcacgccccaggcctctaccaccgaagcaatcctgccagagtatggaacgctggggctcgaatgctccccgcgcacgggcttggacttcaatgaaatgatcttactgaccatgaaaaacaaggcctggatggtgcaccggcagtggtttttcgacctacccctgccctggaccagcggcgccaccaccgagacccccacgtggaaccgcaaagagctcctggtgacctttaagaacgcccacgcgaagaagcaggaggtggtcgtgctgggctctcaggagggcgcaatgcacactgccctgaccggggctaccgagatccagaacagtggcggtacctctatcttcgccggtcacctcaagtgccggctgaagatggacaagctcgagctgaagggcatgagctatgccatgtgtactaacacgttcgtcctgaaaaaagaggtctccgagacccagcatggtactatcctcataaaggtggaatataagggcgaggacgtgccgtgcaaaatccccttctctaccgaggacgggcaggggaaggcgcacaacggcaggctgatcaccgcgaaccccgtggtgaccaagaaggaagagccggtgaacatcgaggccgagccgcccttcggggagagcaacatcgtcattggcattggggacaacgccctgaagatcaactggtacaagaagggttccagcattgggaagatgttcgaggcgaccgccaggggcgcccgccggatggctatcttgggcgacacggcttgggatttcgggtccgtgggcggggtcctcaacagtctggggaagatggttcaccagatatttgggtctgcgtacaccgccctgttcagcggagtatcctgggtgatgaagatcggcattggggtgctcctaacctggatcggcttgaacagcaagaataccagtatgagcttttcctgtatcgctatagggatcataacgctctacctgggcgccgtagtgcaggcggacatggggtgcgtcatcaactggaagggcaaggagctgaagtgcgggagtgggattttcgttaccaatgaagtgcacacatggaccgagcaatataagttccaagcggactcccccaagcgcctggccacggcaatcgctggagcctgggagaatggggtctgcggaattcgcagcaccacgcggatggagaacctgctgtggaaacagatcgctaacgagttgaactacatactgtgggaaaacaacatcaagctcactgtggtagtgggggatataattggcgtgctcgagcagggcaagaggactctgacgccacaaccgatggagctgaagtactcgtggaagacatgggggaaggccaagatcgtgaccgccgagacgcagaactcctccttcataatcgacggcccgaacactcccgaatgccccagtgtctcccgggcctggaacgtgtgggaggtggaagactacgggttcggcgtattcaccaccaacatctggctcaagctgcgcgaggtgtacacccagctgtgcgaccaccgcctcatgagcgcggcggtgaaggacgaacgcgcagtccacgccgacatgggctactggatcgagagccagaagaacgggtcctggaagctggagaaggccagcttgatcgaggtgaagacatgcacctggcccaaatcccataccctatggtcaaatggcgtgctggagtccgacatgatcatcccaaagagcctggcggggcccatctcccagcacaaccaccggccggggtatcatacccaaactgccgggccctggcacctcggcaagctcgagcttgatttcaactactgcgaaggcaccaccgtcgtaatcaccgaaaactgcgggacgcgcggcccaagcctccggaccaccaccgtgtccgggaagctgatccacgaatggtgctgccgctcttgcacgctgcccccgctccgttacatgggcgaggacggctgctggtacggcatggagatccgccccttctccgaaaaggaagagaacatggtcaaatcactggtatccgccggcgggggcaaggtggataacttcacgatgggggtcctgtgtctcgctatccttttcgaggaggtgatgcggggcaagttcggcaagaaacacatgatcgctggcgttttctttaccttcgtcctactcctgagcggccagatcacctggcgggacatggcgcatacgctgatcatgataggtagtaatgccagcgaccggatgggcatgggggtgacttatctcgcccttatcgccaccttcaagattcagccctttctggcactcggctttttcttgagaaagctgaccagccgggagaacctgctcctgggcgtggggctcgctatggctacgacattgcagctgcccgaggatatcgagcagatggccaacgggatcgccctcgggctcatggcgctgaagttaataacccagttcgagacctaccagctgtggactgccctgatctcgctgacctgcagcaacaccatattcactctgacggtcgcgtggcgcaccgccaccctgatccttgccggcgtgtccttactgcccgtctgccagagctccagcatgagaaagacggactggctccctatggctgtggccgctatgggtgtcccgcccctcccgctgttcatattcggcttaaaggacactctgaagcgacgatcctggccccttaacgaaggagtgatggccgttgggctggtgtctatcctggcttccagcctgctccggaacgatgtccccatggctggcccgttggtggctggaggccttctcattgcgtgctacgttattaccgggacctccgccgacctgaccgtcgagaaggccgctgacatcacgtgggaagaagaagccgaacagaccggcgttagccacaacttgatgatcacggtggacgacgacggtacgatgcgcatcaaggacgacgagaccgagaacatactcaccgtcctgttaaagaccgccctcctcatcgtgtccgggatattcccgtacagcatcccggccaccctgctcgtgtggcacacatggcagaagcaaacgcagcgttctggcgttctttgggatgtacccagcccgccagagacccagaaagcagagctggaggagggggtgtaccgcataaagcagcagggcatcttcgggaagacacaagtcggagtgggtgtccagaaggagggtgtcttccacaccatgtggcatgtgacgcggggcgcggtgctcacgtacaacgggaagcgcctggagcccaactgggcgagcgtgaagaaggatctaatcagctacggcgggggctggcgactctctgcccaatggcaaaagggggaggaggtacaagtgatcgccgtcgagcccgggaagaaccccaagaacttccagaccatgccagggacctttcaaacgactaccggcgaaatcggcgcgatcgcactagactttaagcccggcactagcgggagtccaataatcaatcgcgaaggcaaggtggtggggctgtacggcaacggggtcgtgaccaagaatggtggctatgtgagcgggatcgcccagaccaacgccgagccggatggccccacacccgagctcgaggaggagatgttcaaaaagcgcaatctcacaatcatggacctgcaccccgggtccggcaagacgcgcaagtatttgccggccatcgtacgggaggctatcaagcgccgcctccgcaccctaatcctggccccaacccgggtggtggcggctgaaatggaggaagcactcaagggtctgccaatccgctatcaaaccacggccaccaaatccgagcacaccggccgggagatcgtcgatctaatgtgtcacgccactttcactatgcgcctcctgagccccgtgcgggtaccgaactacaacctgataatcatggacgaggcacatttcaccgacccagcctcaatcgccgcgcgcggttacatcagcacccgggtggggatgggtgaggcggccgctatcttcatgaccgcgaccccgcctggaaccgccgacgccttcccgcaaagtaacgcccccatccaagacgaagagcgcgacatacccgaacgaagctggaattctggcaatgagtggatcaccgatttcgccgggaagactgtgtggttcgtgccctcaatcaaggcgggcaacgatatagcaaactgtctccgaaagaacggaaagaaggtgatccagctgtccagaaagacgttcgacaccgagtaccaaaagaccaagctgaatgactgggacttcgtggtgaccacggatatctcagagatgggggccaacttcaaggctgaccgggtcatagaccctcgccgttgccttaagcccgtgatcttaaccgacggcccagagcgggtgatcctggccggccccatgccggtcaccgcggcctccgccgcccagcggcgcggccgggtgggacgtaacccccagaaggagaacgaccagtacatattcaccggccagcccctgaacaacgacgaggatcacgcccattggaccgaggcgaagatgcttctggacaacatcaacacgccagagggcattatcccggccctttttgagcccgagagagagaaatccgccgccatcgatggggagtaccgcctgaagggcgagtcccggaagaccttcgtggagctgatgcgccgcggggacctccccgtgtggctggcgcacaaggtggccagcgagggcatcaagtacacggaccgcaagtggtgctttgacggccagcgaaataaccagatcctggaggagaacatggacgtcgaaatctggaccaaggagggggagaagaagaagctgcgcccccggtggctagacgcccgcacttactcggaccccctggcgcttaaggagtttaaggaattcgccgcgggccgaaaaagcatcgcactggatctcgttaccgaaatcggccgcgtgccgtcccacctcgcccaccggacccgaaacgcccttgacaatctggtgatgctccacactagcgaacacggcggaagggcctaccgtcacgcggtggaagagctgcctgagaccatggagaccctgttactgctgggcctcatgatcctactgacgggcggcgccatgctgtttttaatctccgggaagggcattggtaagaccagcatagggctgatatgtgtgatcgcctcctctggtatgctgtggatggccgaaattcccctacagtggatcgccagcgccatcgtcttggagttcttcatgatggtgctactgatccccgagccagagaagcagagaacgccccaggacaatcaattggcctacgtggtcatcggcatcctcaccctcgctgccatcatcgctgctaacgagatgggactgctagagaccaccaaaagagacctggggatgtccaaggaaccgggcgttgtgtcacctacttcctaccttgatgtcgacctccacccggcctctgcctggactctctacgccgtggcgacgacagtgatcacgcctatgctgcgccacacgattgagaactccaccgccaacgtcagcctcgccgccatagccaaccaggcagtggtgctgatgggtcttgacaaggggtggccgatctccaagatggacctcggggtacccctcttagcactcggttgctacagccaagtgaatccactgaccctcacggccgcagtgctcctgctgatcactcattacgccatcatcggacctggcctccaggctaaggccacccgggaagcgcagaaacgcaccgccgccgggataatgaagaaccccacggtcgacggcatcatgaccatcgatctggaccccgtgatctacgactctaaatttgagaagcagctggggcaggtgatgctcctagtcctgtgtgcggtgcagctccttctgatgcggaccagctgggccctctgcgaggccctgactctggcaaccggacccatcaccaccctctgggagggttcccccggcaagttctggaacaccacgatcgccgtcagcatggcaaacatcttcaggggctcctacctggctggggccggcctggcctttagcattatgaagtccgttggcaccggcaagcgaggcaccggtagccagggggagaccctcggggagaagtggaagaaaaaactgaaccagctttcaaggaaggacttcgacctctacaagaagtcagggatcacggaggtggaccggacggaagcgaaagagggcctgaagcgcggagagataacccatcacgccgtgagtcgcggctccgctaagctacagtggttcgtggagagaaatatggtgatcccggagggacgggtcattgacctcggctgtgggcggggcgggtggagctactactgcgccgggctgaaaaaggtcacagaggtgcggggatacaccaagggagggcccgggcacgaggagcccgtgcccatgtccacgtatggctggaacatagtcaagctgatgtcgggcaaagacgtgttctacttgccacccgagaaatgcgacacccttctgtgcgacatcggggagtcctcgccctcccctaccgtggaggaaagcagaaccattcgggtcctcaagatggttgagccatggctcaagaacaaccagttctgcatcaaggttctgaacccctacatgcccacggtcatagagcacctggagcggctccagcgcaagcatggaggaatgctggtgcggaatcccctgtcccgcaactccactcatgagatgtactggatctctaatggcaccggcaacatcgtggccagcgtaaacatggtgtcccggctcctactgaaccgatttaccatgacgcatcggaggccgactatagagaaggatgtggacctcggggcgggtaccaggcatgtcaacgccgagcccgagacccccaacatggacgtgatcggggagagaatcaagcggatcaaggaggagcacaacagcacttggcactacgatgacgagaacccttacaagacctgggcttaccacggctcctacgaggtgaaggccactggcagtgcctcaagcatgatcaacggggtcgtgaagctgctgactaaaccctgggacgttgtacccatggtgacgcagatggcgatgaccgacaccacacccttcggccaacagcgcgtctttaaggaaaaggtggacacgaggacgccgcgcagcatgccgggtacacggagggtcatgggaatcaccgcagaatggctctggaggacactcggtagaaacaagaaaccccggctgtgcacgcgcgaagagttcacgaagaaagtgcgaaccaacgccgcgatgggcgcggtgttcactgaggagaatcagtgggacagcgcaaaggccgcagtggaggatgaggacttttggaagctggtcgaccgggagcgagaattacacaagttggggaaatgcggcagctgcgtgtacaatatgatgggtaaacgcgaaaagaagctcggggagttcggcaaggctaagggctccagggcgatatggtatatgtggttgggcgcccggtacctggagtttgaggccctcgggtttctcaacgaggatcactggtttagccgcgagaattcctacagcggcgtcgaaggcgaagggctgcacaagctcgggtacatcctgcgggacatatccaagataccgggtggcgccatgtatgccgacgacacagcgggctgggacacgaggatcaccgaggacgatctgcataacgaggagaaaataacgcagcagatggacccggaacaccggcagttagctaacgcaatatttaagctgacctatcagaacaaggtcgttaaggtacagcgtcccacccccacggggaccgtgatggatatcatatctcggaaggaccagcggggttccggccaagtcggcacctacggtttaaacacctttaccaacatggaggcccagctcatccgacagatggagggcgagggtgtgctatcgaaggccgacttggagaacccccacctaccggagaaaaagataacccaatggctggagactaagggggtagagcgcctgaagcggatggcgatatccggggacgactgcgtcgtgaagcctatagatgaccgctttgcaaacgcgctcctggcattgaacgacatggggaaggtccggaaggacatcccccagtggcagccctcgaaaggctggcatgactggcagcaggtcccgttttgctcccaccacttccacgaactcatcatgaaggacggaaggaaactcgtggtaccctgtagacctcaggatgagctgattggccgcgcccggattagccagggtgcagggtggagtctcaaggagaccgcctgcctgggcaaggcctacgctcagatgtggtctttaatgtatttccaccgccgtgatctgcggctcgcgtctaacgctatctgctcagccgtgcccgtacactgggtgcctacatcccggaccacgtggagcatccatgcacaccaccaatggatgacaaccgaggacatgctcaccgtctggaaccgggtgtggatcgaggataacccgtggatggaggacaaaacgcccgtcaccacctgggagaacgtgccgtacctcggcaagcgcgaggaccaatggtgcggctccctcatagggctgaccagccgcgccacttgggcgcagaacatcccgaccgccatccagcaggtgaggtccttgatagggaacgaggaatttctggattacatgcctagcatgaagcgttttcgcaaggaggaagagagcgagggagccatctggtga

SEQ ID NO: 25859 - RNA, 9873 nt, synthetic construct
  misc_feature 1..9873: note = derived and/or modified CDS sequence (opt11) from DENV-3__JN093515__SS-prME
  source 1..9873: mol_type = other RNA
accagcctgtgcctcatgatgatactgccggccgcattagcgtttcacttaactagccgggacggggaacctcggatgatagtgggcaagaatgagcggggcaagagccttctcttcaagaccgccagtgggatcaacatgtgcaccctcatagccatggacctgggagagatgtgcgacgacaccgttacctacaaatgccctcatatcaccgaggtagaaccggaggacatagattgctggtgtaatctaacctccacctgggttacgtacgggacctgcaaccaggccggtgaacaccggcgcgacaagcgctcggtggcacttgctccccacgtggggatgggcctcgataccagaacgcagacctggatgtcagccgagggggcgtggcgccaagtagagaaggtggagacttgggccttgagacacccggggttcactatcctcgcgctgtttctggcccattacatcgggacgtccctgacacagaaggtagtaatcttcatcctgctgatgttggtaacgccctccatgacaatgagatgcgtgggggtaggcaatagggacttcgtcgaagggctaagtggggccacgtgggtggacgtggtcctggaacacggagggtgcgtgactacgatggcgaagaacaagcccaccctagatatcgagttacagaagaccgaggccacccagctcgctacgctccggaaactgtgcatcgaaggcaagatcacgaacattactaccgacagcagatgccccactcagggcgaagccactttgccggaggagcaggaccagaactatgtatgcaagcacacatatgtagacagagggtggggaaacgggtgcggcctcttcggcaaaggctcccttgtgacatgtgccaaattccaatgcctggagcccatcgaaggcaaggttgtgcaacacgagaaccttaagtacaccgttatcatcacagtacacacaggggatcagcaccaagtcggcaacgagacacagggggtgaccgccgagatcacgcctcaggcctctacaacggaggcgatcttacccgagtacggcactctagggctagagtgcagcccacgcactggcctggacttcaacgagatgatcctgttaactatgaagaacaaggcctggatggttcatagacaatggttctttgacctgcccctgccatggacctcgggtgccaccacggagacgcccacctggaacaggaaagagttgctagtgacgttcaagaacgcccacgcgaaaaagcaggaggtggtcgtgttggggtcacaagagggcgcgatgcataccgcccttaccggcgcgaccgagatccagaacagcggcggcacgagtatcttcgcgggacacctaaagtgccggttgaaaatggacaaactggagctaaagggcatgtcctacgcaatgtgcacgaacaccttcgtgcttaagaaagaggtcagtgagacgcagcacgggaccatcctcatcaaggtggaatacaagggcgaagacgtgccttgcaagatccccttcagcacggaggacgggcaaggcaaggcgcacaacggacgactaatcaccgccaaccccgtcgttaccaagcgtgaagaacctgtgaacatagaggcggagccgccgttcggagaatctaatatcgttattggcatcggcgacaacgcactcaaaatcaattggtataagaaggggtcttccatcggcaagatgttcgaggcgacagcccggggcgctcggcggatggctatcctgggcgacacggcttgggactttggaagcgtaggaggggtgcttaatagcctgggaaagatggtccaccaaatcttcggctccgcatacaccgcactgttctcaggagtgtcttgggtgatgaagataggcatcggtgttctcctgacctggatcgggctgaatagcaagaacacctctatgagcttctcatgcatcgccatcgggatcatcacgctttacctgggcgccgtggtgcaagccgacatgggttgtgtcataaactggaaggggaaagagctgaagtgcggctcgggaatcttcgtgaccaacgaagtgcatacttggaccgagcagtacaaattccaagcggacagcccgaagcgcctcgcgacggccattgctggcgcctgggaaaacggggtctgcggcattcgcagcacaacccggatggagaatctgctgtggaaacagatcgccaacgagctgaactacatcctatgggagaacaacatcaagctgaccgtggtagtgggggacatcatcggtgtactcgagcagggcaagagaacgctgacgccgcaacctatggagctgaagtactcatggaagacgtggggcaaggcgaagatcgttactgctgagacacagaacagctcctttatcatagacgggcccaacacccccgagtgcccttcggtctcccgcgcctggaacgtctgggaggtagaggactatgggttcggcgtatttaccaccaatatctggcttaaactgcgagaggtgtacactcagctgtgcgaccatcgcctaatgtctgctgccgtcaaggacgaacgagcggttcacgccgacatgggctattggatagagtcacagaagaatgggagctggaagctggagaaagcctcgctgatcgaggtcaagacgtgtacctggcctaaatctcacaccctatggagcaacggggtactggaaagtgatatgataattccaaaaagcctggccgggcccataagccagcataaccatcgccccggctaccatacccagactgccgggccctggcacttaggaaagctggagctggatttcaactactgtgaaggaaccaccgtcgttatcaccgagaattgcggtacgcggggcccttcattaagaaccaccaccgtgtccgggaagttaatccacgagtggtgctgtagatcgtgcaccttgccaccgctccgctatatgggcgaggacggttgctggtacggcatggagatccggcccatttccgagaaggaggaaaacatggttaagtcgctggtttcggccggttcggggaaagtcgataacttcaccatgggcgtcctgtgtctcgccatcctgttcgaggaggtgatgcgcggaaagttcggtaaaaagcatatgattgccggggtgttcttcacattcgtcctgttgttatccggacaaatcacctggcgggacatggcacacaccctaatcatgatcggatctaacgcctccgaccgcatgggtatgggggtaacctatctagccttgatcgcgacattcaagatccagccctttttggctcttgggttctttctgcggaaactcaccagccgcgaaaacctcctcctgggtgtaggtctagcgatggccacgacccttcagctgcccgaggacattgagcaaatggccaatggtatcgccctcggccttatggcgctcaagctcatcacccagtttgaaatctaccagctgtggactgccctgattagcctcacatgctctaacacaatcttcactctaactgtcgcttggcggacggccacgttaatactggccggggtgtccctgctgccgatgtgccagtccagctccatgagaaaaactgactggctccccatggcggttgccgccatgggcgtgccgcccctccccctgttcattttctcgctaaaggacaccctgaagcggaggtcctggcctttgaacgaaggcgtgatggccgtaggcctcgtgagcatccttgccagcagtttgctccgcaacgacgtgcccatggctggccccttagtcgccgggggcctcctcattgcctgctacgtgatcacgggaacctcggccgaccttaccgtggagaaagccgcagacatcacctgggaagaggaggcagagcagacaggcgtcagccacaacttaatgatcaccgtggacgacgatggtaccatgcgcataaaggacgacgaaaccgaaaacatactgacggtgctgctcaagaccgcactcctgatcgtctccggaatctttccttactctatcccagccactctgctagtttggcacacctggcaaaaacaaacacaaagatccggcgtgctgtgggatgtcccctcgccgccggagacgcagaaagccgagctggaggaaggtgtgtaccgaatcaagcagcagggaatcttcgggaagacacaggtgggcgttggagtgcagaaggaaggagtgttccacaccatgtggcatgtcacgcgcggcgccgtcctgacgtataacggcaagcggctggaacccaactgggcgtccgtgaagaaggacttgattagctacggcgggggctggagactcagtgcccagtggcagaaaggggaggaggtccaggtgattgccgtagagccaggtaagaaccccaaaaacttccagaccatgcccggtacattccaaaccacgaccggggaaatcggcgcgattgccctcgactttaagcccgggacgagcggcagccccatcatcaaccgggagggcaaggtcgtggggctatatggcaacggggtggtaactaaaaacggtggctacgtgtccggcatcgcccaaacgaatgccgagccggacgggcccactccagagttagaagaagagatgttcaaaaagcggaacctcacaatcatggatctccaccccgggtctggtaaaacccggaagtatctgcccgccatcgtacgcgaggcgattaagcgccgcttaaggaccctgatcctggccccaacgcgcgtcgttgccgcggagatggaggaggcgctcaaagggctgcccatccggtaccagactactgcaacgaagtccgagcacacaggccgcgaaatcgtggacctgatgtgccatgccaccttcaccatgcggctcctgagccccgtccgcgtccccaattacaacctgatcatcatggacgaagcccacttcacggaccccgcatccatcgccgcgcgcggctacatctcgactcgcgtgggcatgggcgaggccgccgccatctttatgaccgcgacgcccccagggactgctgacgctttcccgcaaagcaacgctccaatccaagacgaagaacgcgatatacccgagcgtagctggaatagcgggaacgagtggatcaccgacttcgctggaaaaaccgtctggttcgtgccgagtatcaaggcggggaacgatatcgcaaactgccttcgcaagaacgggaagaaagtaatccagctctcccgcaaaaccttcgacacggagtaccagaaaaccaagctaaacgattgggacttcgtggtgactaccgatatctccgagatgggagcaaacttcaaggccgatcgcgtgatcgatcctagacgatgcctcaagcctgtcatactgacggacggccccgagcgggttatcttggcagggcctatgccggtcaccgcggcctcagccgcacagcgtcgggggcgcgtgggtcggaaccctcaaaaggagaacgaccagtatatattcaccggccagccattgaacaacgacgaggaccacgcccactggacagaagcgaagatgctgctggacaacatcaacacaccggaggggataatcccggccctgttcgaacccgagcgcgagaagagtgctgcaatcgatggagagtaccgactgaaaggcgagtcccggaaaacttttgtcgaattgatgcggagaggggatctgcccgtgtggctggcgcataaagtcgctagcgaaggcatcaaatacaccgaccgaaagtggtgcttcgacgggcaacgcaacaatcagatactggaggagaacatggacgtggaaatatggaccaaggagggagagaagaagaaacttaggcctcgatggctcgatgcgcgtacctactcggaccctcttgccctcaaagaatttaaagagttcgcggcgggccgcaagagcatagccttggaccttgtcacggagataggacgcgtgccgtcccacttagcgcaccggacccgcaacgctctggacaacctggtaatgctccacaccagcgagcacggtgggcgtgcctaccgacacgcggtcgaggagttacccgagaccatggagacgttactcctgctgggcctcatgatcctgctgaccgggggcgccatgttgttcctgatctccggcaaggggattggcaaaacatccatcggtcttatctgcgtcatagcgtcctccggaatgctctggatggccgagattccactgcagtggatcgcctccgcgatcgtgctggagttcttcatgatggtcctcctgatccccgagccggagaagcaacgcacaccccaggacaaccagctggcctacgtagtgatcggaatactcacgcttgctgcaataattgccgcgaatgagatggggctgttagaaaccaccaaacgcgatctgggtatgtccaaagaaccgggggttgttagtcccacaagttacctcgacgtcgatctccaccccgctagcgcctggacactgtatgctgtagcgaccaccgtcatcacgcccatgctgaggcacacgatagagaactcgaccgctaatgtgtcgctggccgccatagccaatcaagcggtcgttcttatgggcttagataaagggtggccgatctcgaagatggacctcggtgtccccctgcttgcattaggatgctacagccaggtcaacccgctgacgctcactgccgcggtgctactgttgatcacccactacgccattatcggtcccgggctacaagccaaggccactagggaggcacagaagcggaccgctgccggcataatgaagaacccaaccgtcgatgggatcatgacgattgacttagaccccgtcatctacgacagcaagttcgagaagcagctgggccaggtaatgctgctcgtgctgtgcgtcgtgcagctcctgctgatgcgtacgagctgggcgctctgcgaagcattaactctggctaccggccccataaccaccctttgggaaggttctcccggaaagttctggaataccaccatcgccgtctcgatggcgaacatcttcagaggtagctacctcgccggcgccggcctggcctttagtatcatgaagagtgtcgggacgggaaagagaggcaccggcagccaaggcgaaacattaggggaaaagtggaagaagaaactgaatcagctgtcaagaaaggacttcgacctctacaagaagtcaggcatcaccgaagtggaccgcaccgaagccaaagaggggttaaaacggggtgagataacacaccatgcggttagtcggggctccgctaagctccagtggttcgttgagaggaacatggtaataccagagggtcgagtgatcgacttaggctgcgggcggggcgggtggagttactactgcgcgggcttaaagaaagttaccgaggtgcgaggctacacaaagggcgggcccgggcacgaggagcccgtgcccatgtcaacctatggctggaacatcgtcaaacttatgagcggcaaggacgtgttctacctcccgccagagaaatgtgacacgttgctgtgcgatatcggagagtcctcaccctctccgaccgtggaagagtcccggaccatcagagtcctgaagatggtggagccatggctaaagaataaccagttctgtattaaggtactgaacccctacatgcccaccgtgattgagcacttagagcgcctccagaggaagcacggcggcatgctggtgcgcaaccccctttcccgaaacagcacgcacgaaatgtattggatcagcaacggtactgggaacatcgtggcctctgtcaacatggtctcccgcctcctgttgaatagatttaccatgacccatcgccgaccgacgattgagaaggacgtggacctcggcgccggaaccagacacgtcaatgcggagcccgaaacccccaatatggacatcatcggtgaacggataaagcgcattaaggaggaacacaactcaacctggcactacgacgacgagaatccgtacaaaacttgggcctaccacggctcctacgaagtgaaggctaccgggtcagccagcagcatgatcaatggagtcgtaaagttactgaccaagccgtgggatgtagtacccatggtgacccagatggccatgacggacacaaccccgtttggccagcagagggtgttcaaggagaaggttgacactcgcacgcccaggtccatgcccggcacccgccgggtgatgggcataacggcggagtggctttggcgcaccctagggcggaacaaaaagccccgcctgtgcacgagagaggagttcaccaagaaagtgaggaccaacgccgctatgggcgctgtcttcactgaagagaaccagtgggatagtgcaaaggccgcagtggaggatgaagacttctggaaacttgtcaaccgcgagcgagagctccacaagctgggtaaatgcggctcgtgcgtttataacatgatggggaagagagaaaagaaacttggtgagttcggtaaggccaaggggagtcgggcgatctggtacatgtggctgggtgcgcgctacctggaatttgaagccctcgggtttttaaacgaggatcactggttctcacgggagaactcctactcgggtgtagaaggggagggcctgcacaaactcggctacatcctccgcgacataagtaagatccctggcggtgctatgtacgccgacgatacggctgggtgggacaccagaattaccgaggacgatctgcacaacgaggagaagatcacacagcagatggacccggagcaccgccagttggcgaacgccatcttcaaactaacgtatcaaaataaggtggtcaaagtgcagcggccaacccctaccggaacagttatggacatcatatcacgcaaagaccagcggggcagtggtcaagtcggcacctacgggctgaatactttcaccaatatggaggcccaactcatccgccaaatggagggtgaaggggtccttagtaaagccgacctggagaatccacacctcccggaaaagaagattacccaatggctggagacaaaaggggtggagcggctgaagcgcatggctatctccggcgacgattgcgtcgtcaagccgatcgacgaccggttcgccaacgcactcttagccttgaacgacatgggcaaggtgcgcaaggacatcccccagtggcaacctagcaaaggctggcacgattggcagcaggtcccgttctgctcccatcacttccacgaactcattatgaaggatgggcggaagttagttgtgccctgccgcccgcaggacgagctcataggccgcgccaggattagccaaggggcaggctggtccctcaaggaaactgcgtgccttggcaaggcctatgcccaaatgtggagcttgatgtacttccatcgccgggacttacggttagcttccaacgccatctgctctgctgttcctgtgcactgggtgccgacctccagaactacctggtctatacacgcccaccaccagtggatgacgaccgaggatatgctgaccgtatggaatcgagtttggatagaagacaacccatggatggaggacaaaactcccgtgacgacttgggagaacgtgccctatttgggtaaacgggaagatcagtggtgcggcagcctaatcggcttaacgtccagggctacctgggctcagaacatccccacggcgatccagcaagttcggagcttgatcgggaacgaggagttcctagactatatgccctcaatgaaacgcttccggaaggaagaggagtctgagggagcgatatggtag

SEQ ID NO: 25860 - RNA, 9873 nt, synthetic construct
  misc_feature 1..9873: note = derived and/or modified CDS sequence (opt11) from DENV-3__JF937646__SS-prME
  source 1..9873: mol_type = other RNA
accagcctgtgcctcatgatgatcctgcccgccgccctagcgtttcacctcacgagccgggacggcgagccgcggatgatcgttgggaaaaacgagaggggtaaaagcctgctatttaagaccgccagcgggattaacatgtgcaccctcatagccatggaccttggcgagatgtgcgacgacaccgtgacctacaaatgcccccacatcaccgaagtagagccagaggacatcgactgctggtgcaatctaaccagcacgtgggtgacctacgggacgtgtaaccaggcgggggagcatcggcgcgataagcggtccgtggcccttgcgccccacgtgggcatggggctggacacccgcacccagacctggatgagcgcggaaggcgcttggagacaggtggagaaggtagagacgtgggccctgcgacaccctgggttcaccatcctcgctctgttcttggcccattacatcggtacctccctaacccagaaagtggtgatcttcatcttattaatgctcgtcactcccagcatgactatgcggtgcgtggggatcgggaaccgggacttcgtggagggcctatctggagccacctgggttgatgtggtgctggagcacggagggtgcgttaccacgatggccaagaacaaacccacccttgatatcgagctgcagaagaccgaggctacacagctggccacactcagaaagctgtgcatcgagggcaagatcaccaacatcactaccgactcacgatgccccacgcagggcgaggccaccctgcctgaggaacaggaccagaattacgtgtgtaagcatacctacgtggaccggggatggggcaacgggtgcggcctctttggaaagggcagcctggtgacctgcgccaagttccagtgcctggagcccatagaggggaaggtggtgcagtatgaaaacctcaaatacacggtcattataaccgtgcacaccggggaccagcaccaagtaggaaacgagacccagggggtaacggcggaaatcacaccccaggccagcaccaccgaggcaatcttgcctgagtacggcaccctggggctcgagtgttccccgcgaactggcctggacttcaacgagatgatcctgttaacgatgaaaaacaaagcgtggatggtgcaccggcagtggttctttgacctgcccctaccgtggaccagcggcgccaccacagaaacgccgacctggaaccgcaaagagctcctggtaacctttaaaaacgctcatgccaagaagcaggaagtggttgtactgggttcccaggagggagcgatgcacacagccctcacaggggccaccgagatccagaacagcggaggaacctccatcttcgcaggccacctgaagtgccggctgaagatggataagttggagttgaaggggatgagctacgccatgtgtacgaacgctttcgtgctgaaaaaggaggttagtgagacccagcacgggaccatcctgatcaaggtcgagtataagggagaggacgtaccatgcaaaatcccattcagcaccgaggacggacagggcaaagcccataacggccgccttatcacggcaaaccccgtggtcaccaagaaagaggagcccgtgaacatagaggccgaacccccattcggggagagcaacatcgtgataggcataggggataacgccctgaaaattaactggtataagaaggggagcagcattgggaagatgttcgaggccaccgcgcgcggcgctcgccggatggcaatactaggggacaccgcgtgggatttcgggtctgtcggcggggtccttaacagcctgggcaagatggtgcaccagatcttcgggtccgcttacacggcgctatttagcggcgtatcctgggtgatgaaaattggcatcggggtgctgctgacctggatcggcctgaactctaagaacacgtccatgagcttttcttgcatcgccatcgggatcataaccctctacctgggagccgtcgttcaggcggacatggggtgcgtcatcaactggaaggggaaggagctaaagtgtggcagcgggatattcgtcacgaatgaggtgcacacctggactgaacagtacaagttccaggcagacagccccaagcgcctcgccaccgccatagccggcgcgtgggaaaacggggtgtgtggaatacgcagcacgacccggatggagaacctgctgtggaagcagatcgccaacgagctgaactacatactctgggagaacaacatcaaactgaccgtagtcgtcggggacatcatcggcgtccttgagcaggggaagcgcacgttgacgcctcagcctatggaactcaagtactcctggaagacctgggggaaggcgaagatcgtgaccgcagaaacacagaacagctcctttatcatcgatggccccaacacgcccgagtgcccctctgtttcccgggcgtggaacgtctgggaggtggaggactacgggttcggtgtgttcaccaccaacatatggctcaagctgcgcgaggtctacacccagctgtgcgaccaccggcttatgagcgcagcggtaaaggacgaacgcgccgtgcacgccgacatgggctattggatcgagagccagaagaacgggtcctggaaactggagaaggcgagccttatcgaggtaaagacctgtacgtggccgaagtcccatacactctggtctaacggcgtattggagtcggacatgattatccccaagagcctggccggtcccatatcgcagcacaaccaccggcccgggtaccatactcagaccgccgggccctggcacttaggcaagctggaactggatttcaattactgtgaagggaccacagtggtcattaccgagaactgcgggacccgcggcccctcgctacggacgaccaccgtatccgggaagttaattcacgagtggtgctgtcgcagctgcacactgcccccgctccgatacatgggagaggacgggtgctggtatggtatggagatccgtccgatatccgagaaggaggagaacatggtcaagagcctggtcagcgctgggagcggtaaggtagacaacttcacgatgggcgtgctgtgtctcgccatcctcttcgaggaggtcatgagggggaagttcggcaagaagcacatgattgcgggcgtgtttttcaccttcgtgctgctcctttccggacagatcacgtggcgcgatatggcccacacactgataatgatcggcagcaacgcctcagaccgcatggggatgggtgtcacatacctcgccctaattgccaccttcaaaatccagccctttctagccctaggctttttcttgcgcaagctgacctcaagagagaacttgctgctgggcgtgggattagccatggtgaccacgctacagctgcctgaggacatcgagcagatggccaatgggatcgcgctcggcctaatggcgctgaaattgataacccagtttgagacgtatcagttatggaccgcgttgataagcctcacgtgcagcaacaccatctttaccctcaccgttgcctggagaacggccaccctaattctcgccggtgtcagcctattgcccgtctgccagtctagctccatgcggaagaccgactggctccctatggcggtggccgccatgggagtgccaccccttccgctgtttatatttggacttaaggacaccttgaagcgccgctcgtggccactgaacgagggcgtcatggcagtgggccttgtgtcgattctggccagctccctgctccgcaacgacgtccccatggcgggacccttagttgccggcggtctgctcattgcctgctacgtgatcacgggaaccagcgcggacctgacggtcgaaaaagccgcggacatcacctgggaggaggaggcagagcaaacgggggtatcccacaacctgatgatcaccgtcgacgacgacggtaccatgcgcatcaaagatgacgagaccgagaacatcctcaccgtcctgctgaaaacggcacttctgatcgtgtctggcattttcccatactccatccccgccaccctgctcgtttggcacacctggcagaagcagacgcagcggagcggggtcctttgggacgtgccctcaccgcccgagacgcagaaggcggaactcgaggagggcgtttaccgcataaagcagcagggcatcttcggcaagactcaggtcggggtgggcgtccagaaggagggggtgttccacacgatgtggcacgtaacccgcggtgccgtgctcacgtacaacggcaagcgcctggaacccaattgggcctctgtaaagaaggacctgatctcgtacgggggcgggtggaggctcagcgcccagtggcagaaaggcgaggaggtacaggtgatcgcggtggagcccggcaagaaccctaagaacttccagaccatgccagggaccttccaaactacgacaggtgagatcggggccatcgccctggacttcaagccgggcaccagtgggtctcccatcataaaccgggaggggaaggtggtgggcctgtacgggaacggtgtcgttaccaagaacggagggtacgtgagcggcatagcgcaaacaaacgcagaaccggacgggcccacccccgagctggaggaggagatgttcaagaagcggaatctcaccatcatggacctgcaccccggctccgggaagacacgcaagtacttgccggccatcgtgcgggaagcgatcaagaggcggcttcgcactcttattctggcccccaccagagtggtggccgctgaaatggaggaagccctcaaggggctgcccatccggtatcagacaaccgcaactaagtccgagcacacagggcgggagatagtcgatctgatgtgccacgccacgttcaccatgcgcctcctgtcacccgtaagagtgcccaactacaacctgattatcatggatgaggcccacttcaccgaccccgccagcattgctgcccgaggctacatctccacccgggtcggcatgggtgaggccgccgccatcttcatgaccgcgacgccgcctggcacggccgatgccttcccgcagagtaatgcccccatccaggacgaggagcgcgacatcccggaacgctcctggaactcagggaatgagtggatcaccgatttcgcaggcaagacagtctggtttgtgccctctatcaaagtcgggaacgacatcgcgaactgcctccgcaagaacggcaagaaggtcatccaactaagcaggaaaaccttcgacacggagtaccagaagaccaaattgaacgactgggacttcgttgtcacaactgacatttccgagatgggcgccaactttaaggcagaccgagtgatcgacccgcgccgctgtcttaagccggtgatcctgacggacggtcctgagcgcgtcatcctggcgggcccaatgccggtgaccgcagcgagcgccgctcagcggcgcgggcgggtgggcaggaatcctcagaaggagaacgaccagtacatcttcaccggtcagcccctcaacaacgacgaggaccacgcccactggaccgaggccaagatgctgctggacaacattaacacccctgagggcataatcccggcactattcgagcccgaacgggagaagtctgccgccatcgatggcgaatacaggctgaagggcgaaagcaggaagaccttcgttgaactgatgcgccggggagatctccccgtgtggctggcccacaaggttgcgtccgaggggatcaaatacactgaccgcaaatggtgctttgacggccagcggaacaaccagatcctggaggagaacatggatgtggaaatctggaccaaggaaggagaaaagaagaaactccgcccccggtggctagacgctcgcacctacagcgaccctctggccctaaaagagttcaaggagttcgcagccgggcgcaagagcatagcgctggacctggtgactgaaatcggtagggtcccttcacacctagcacaccgcacccggaacgccctggataacctcgtgatgctccatacctcggagcacggcggccgcgcctaccgtcacgccgtggaggagctgcctgagaccatggagacgctgctcctgctagggctcatgatcctgcttactggtggtgcgatgctgtttctgatcagcgggaagggcatcggtaagacaagcatcggacttatctgtgtcattgcctcctcggggatgctgtggatggccgagatccctctgcaatggatcgcttccgccatcgtgctggagttcttcatgatggtactcctaatacccgaacctgagaagcagcgcacgcctcaggacaatcagctggcatacgtggtcatcggcattctcacgctggccgccatcatagccgccaacgagatgggtctgctagagactaccaagagagacctgggaatgtcaaaggagccgggcgtggtctccccaacgagctacctggatgtggacctccaccccgcgtccgcgtggacactctacgccgtggccacgaccgtcataacacccatgcttcgccacacgatcgagaacagcactgctaacgtgagtttggctgcgatcgccaaccaggccgtggtcctgatgggtcttgacaagggctggccgatctccaagatggacttaggcgtgcccctcctggctctcggctgctattcccaagtgaatcccttaacgctcacggccgccgtcctcctgctgattacgcactacgcgatcatcggccccgggctccaggccaaggcgacccgggaagcccagaagcgtaccgccgcaggtatcatgaaaaatcctactgtggatgggatcatgacaatagacctggacccagtcatttatgatagcaagttcgagaagcagctgggccaggtcatgttgctggtgctgtgcgctgtgcagctactgctaatgcgaacctcctgggcgttgtgcgaggcactgaccctggccaccggccccatcaccaccctctgggagggctcccccggaaaattttggaacacaaccatcgccgtctccatggcgaacatattccgcggcagctacctagcgggcgccgggctggccttctccatcatgaagtccgttgggactggcaaacggggcacaggctcacagggggaaaccctcggcgagaaatggaagaagaaactgaaccaattgtctagaaaagacttcgacctctacaagaaatccggcatcacggaggttgaccggacagaggccaaagaagggttaaaacgcggcgaaatcacgcaccacgctgtgtcccggggtagcgccaaactgcagtggttcgtggaaagaaacatggtgatcccggagggaagagtcatcgatctcgggtgcggccgcggcggctggagttactactgcgccggcctcaagaaagtgaccgaggtccgtgggtacaccaagggcgggccgggccacgaggagccggtccccatgtcaacatacgggtggaacatcgttaagctgatgtctggcaaggatgtcttctatctcccgcccgaaaaatgcgacacgctgctgtgcgacatcggagaaagctccccgagccccaccgtggaagaatcccgcacaatacgcgtgctaaagatggtggagccctggttgaagaacaaccagttctgcatcaaggtcctgaatccttatatgcccacagttatcgagcacttagagcggctacagaggaagcacgggggaatgctggtgcggaacccactgagcaggaacagcacgcacgaaatgtactggatcagcaacggaaccggcaacattgtcgcttccgtgaacatggtcagccggctgctattgaaccggttcacgatgacccaccggcgcccgaccatcgagaaagacgtcgatctgggcgccgggacacgacacgtgaatgcggagccagagaccccgaacatggacgtgatcggcgagcgcatcaagcggattaaggaggagcacaactccacgtggcactacgacgacgagaacccgtacaagacgtgggcataccacggaagctacgaggttaaggccaccggctcagccagcagcatgataaacggagtggtcaagctgctaaccaagccgtgggacgtggtgcccatggtcacccagatggcgatgacggacaccaccccgttcggccagcagcgcgtattcaaggagaaagtggacacccggacacctcgctctatgcccggcacgcgtcgcgtcatgggtattactgcagagtggctctggcggacattgggacggaacaagaagcctcggctgtgcactcgcgaggagttcaccaagaaagtgcgcactaacgctgcaatgggagcagtgttcactgaggagaaccagtgggacagtgcgaaggccgccgtcgaggatgaggacttctggaaacttgtggaccgcgaacgagaactccataagttggggaagtgcgggtcctgcgtatataacatgatgggcaagagggagaagaagctcggcgaatttgggaaggccaagggaagccgagccatctggtacatgtggctgggggcgcggtacctggagttcgaggcactaggcttcctgaacgaggaccattggttttctcgcgagaatagctactccggggtagagggcgaaggcctgcacaagctcggatacatcctgcgggacatcagcaagatacccggcggggccatgtacgcggacgacaccgcgggctgggacacccggattacggaggacgacttgcacaacgaggaaaagatcacccaacagatggaccctgagcaccgacagttagcgaacgccattttcaagctgacgtaccagaacaaggtggtgaaggtccagcgccccacccccaccggcacagtgatggacatcatttcccgaaaggaccagcgcgggagcggccaggtggggacctacggactgaacacgttcaccaatatggaggcccagctcattcgtcagatggagggggagggcgtcctgtccaaggccgacctggaaaacccgcaccttccggaaaagaaaatcacacagtggctcgagaccaagggagtggagcgcctcaagaggatggccataagcggtgatgattgcgtggtgaagcccatagatgacaggttcgcaaacgccctcctggcactgaacgacatgggcaaggtacggaaggacatcccccagtggcaaccatccaaggggtggcacgactggcaacaggtcccgttctgcagtcatcacttccacgagctcatcatgaaggacggcaggaaattagtcgtgccctgtcggccccaggacgagctgatcgggcgcgcccggatatcgcagggtgccggatggtcgctcaaggaaactgcgtgcctggggaaagcctacgcccagatgtggtccctgatgtactttcatcgcagggacctcaggctggcctctaacgcgatctgctctgctgtacccgtccattgggtgcccacgtcgagaaccacctggtccatccacgcccaccaccagtggatgacgaccgaggacatgctaaccgtttggaaccgggtttggatcgaagacaacccttggatggaagataaaacccccgtgacaacgtgggagaatgtgccctacctcggcaagcgcgaggaccagtggtgcgggagcctgattggcttaacttctagggcgacctgggcccagaatataccgacggcaatccaacaggtgcgctccctcatcgggaacgaagagttcctggactacatgccctcaatgaaacggttccgcaaggaggaggagtccgagggcgcaatctggtaa

SEQ ID NO: 25861 - RNA, 9873 nt, synthetic construct
  misc_feature 1..9873: note = derived and/or modified CDS sequence (opt11) from DENV-3__JF937633__SS-prME
  source 1..9873: mol_type = other RNA
acttctctctgcctcatgatgatactaccagccgcgctcgcgttccacctcacctcacgagatggagagccccggatgatcgtggggaagaacgagcggggtaagtcgctgctgttcaagaccgcctccgggattaacatgtgtaccctcatagccatggacctgggtgaaatgtgcgacgacactgtgacctataagtgcccccatatcacagaggttgagccggaggacatcgactgctggtgtaacctcacaagtacttgggtgacatatggaacttgtaatcaggccggcgaacaccggcgcgacaagcggtccgtggccctcgcaccccacgtgggcatgggtctggacacccgaacccaaacctggatgagcgccgagggcgcatggcgacaggttgaaaaggtcgaaacgtgggccctgcgccacccagggttcaccatcctcgctctcttcctggcgcactacataggcacctccctcactcagaaagtggtcatcttcatcctgctgatgctcgtcacgccctctatgactatgcggtgtgtcggggtgggcaaccgcgacttcgtcgagggcctgtccggggccacctgggtggacgtcgtcctggagcatggtgggtgcgtgaccacgatggccaaaaacaagcccacgcttgacatcgaactgcagaagaccgaggccacccagttggccacgcttcgaaaattatgcatcgaggggaagattaccaacataaccaccgacagccgctgccctacgcaaggcgaggccaccctccccgaagaacaggaccagaattacgtttgcaaacacacctacgtcgaccggggttggggcaacgggtgtggattatttgggaagggctccctggtgacctgcgccaagtttcagtgtctggagcccatcgagggcaaggtggtacagtacgagaacctgaagtacactgtgatcatcactgtgcataccggggaccagcatcaggtcggcaacgaaacccagggggtaacggccgagataacgcctcaggccagcaccaccgaggcaatcttaccggagtacgggaccctggggcttgagtgctcgccacgcacaggcctggacttcaacgaaatgatcctgcttaccatgaagaataaggcctggatggtccaccggcagtggttcttcgacttgcctctgccctggacaagcggcgccaccacggagacgcctacctggaaccgcaaggagctcctggttaccttcaaaaacgcccacgccaagaagcaggaggttgtagtgttggggtcccaggagggcgcgatgcacacggccctcaccggagcgaccgagatccagaactccggcgggacgagtatcttcgctggccacctgaagtgcaggctgaagatggacaagctcgagctgaagggcatgagctatgccatgtgcacgaacactttcgtgttgaagaaggaggtctccgaaacccagcacgggaccatcctcatcaaggtagagtacaagggggaagacgtgccgtgcaagatccccttcagcactgaggacggccagggcaaggcgcacaacggccgcctgataacagccaacccagtcgtgacgaaaaaggaggaaccagttaacattgaggccgaaccgcccttcggcgagtctaacatcgtcatcggcataggggacaacgccctgaaaattaactggtacaaaaagggttccagcatagggaaaatgtttgaggcgaccgctcggggtgccagacggatggccatcctgggcgacacggcctgggacttcgggagcgttggtggtgtgttgaacagcctgggcaagatggtccaccagatcttcgggtccgcgtacaccgccctgttcagtggtgtgtcctgggtaatgaagataggcatcggggtcctccttacctggataggcctgaacagcaagaatacctccatgagcttctcctgtatagcgatcgggatcatcacgctctacctgggagccgtggtgcaggctgacatgggctgtgtcatcaactggaagggcaaagagctgaagtgtggaagcgggatcttcgtcaccaacgaggtgcacacctggaccgaacaatacaagttccaggcggactcccccaaacgcctggccacggcaatcgccggtgcgtgggagaacggggtttgtggcatccgctccactacccggatggagaatctgttgtggaagcagatcgcgaacgagttgaactacatcctttgggagaacaacatcaagctgaccgtggttgttggtgacatcatcggcgtgctcgagcaaggcaagagaacgctgacaccacaacctatggagctgaagtatagttggaaaacctgggggaaggcaaagatcgtgaccgccgagacgcaaaacagctctttcataatagatggccccaacacaccggagtgccccagcgtctccagagcctggaacgtctgggaggtggaggactacgggtttggcgtgttcaccaccaacatctggctcaagctgcgcgaggtgtacacccagctttgcgaccatcggttgatgagcgcggccgtcaaagatgaacgcgccgtccacgccgacatgggctactggatcgaaagccagaagaacggatcctggaagctggagaaggccagtctgattgaggtgaagacttgcacctggccgaagtctcataccctctggagcaacggtgtgctggagtccgatatgatcatcccgaaaagcctggcggggcccatcagccagcacaaccaccgtccgggctaccacacccaaacggcagggccctggcacctcggtaagctggagttagacttcaattactgcgagggtaccaccgtagttatcaccgagaactgcggtacccgcggccccagcctccggaccaccaccgtttccggcaaactgatacacgagtggtgctgccgcagctgcacgctgcccccgttgcggtacatgggcgaggacgggtgctggtatggcatggagatccgccccatcagtgagaaggaggagaacatggtgaagtcgttagtgtctgccggcagcgggaaggtggacaacttcaccatgggcgtgttatgcctagccatcctgttcgaggaggttatgaggggaaaattcggcaaaaagcacatgattgcgggggtcttctttaccttcgtcctgctcctgtctgggcagatcacttggcgcgacatggcccacacgttaatcatgatcggctcgaacgcctcggacagaatggggatgggcgtgacctacctcgcattaatcgcaaccttcaagatacagccctttctggctctcggctttttcctgagaaaattgactagccgggaaaacttactgctgggcgtgggcctcgctatggccacgacgctgcaactgcccgaggatatcgagcagatggccaacgggatcgccctcggcctgatggcgctgaagctcataacgcagttcgagacctaccagctgtggacagcgctgattagcctgacctgctcaaacacgatcttcaccctgacagttgcctggcgcaccgccaccctgattctcgcgggagtgtcgctgctcccggtctgccagtcctcatccatgcggaagaccgattggctccccatggccgtcgcggccatgggcgttccgccgttgccgttattcatctttgggctcaaggatacgctgaagcgccgctcatggccactaaatgagggcgtcatggccgtgggactcgtctccatcctggcctcatccctacttcggaatgacgtgcccatggccggtcccttggtggccggtgggctgttgatcgcctgctacgtgatcacgggcacaagtgccgacctcacggtcgaaaaggccgcagacatcacatgggaggaggaggccgagcagactggggtgtcgcataacctgatgatcaccgttgacgatgacgggaccatgcgcatcaaggacgacgagaccgagaacatcctcacggtactcctgaagactgccctccttattgtgagcggcatcttcccgtactcgatcccggctaccctgctagtgtggcatacgtggcagaagcagacgcagcgcagcggggtcctttgggacgtgccgtcaccgcccgagacccaaaaggccgagctggaggagggcgtgtatcgcatcaagcagcaaggcatcttcggcaaaacccaggttggagtgggcgtccaaaaggagggcgtctttcataccatgtggcacgtgacacgaggtgcggtgctcacttacaatgggaaacgcctggagcccaattgggctagcgtcaagaaggacctgatttcctatgggggcgggtggcggctgagcgcccagtggcagaagggcgaagaggtccaggtgatcgccgtcgagcccggcaagaaccccaaaaacttccagaccatgcccgggaccttccagacgaccactggcgagatcggggcaatcgccctggactttaagcccggaacctccggctccccaatcattaaccgcgaagggaaagtggtaggcctctacgggaacggcgtcgtgacgaaaaacggaggctacgtgagcggcatcgcccaaaccaacgcagagccggacggtcccactccagagctggaggaggagatgttcaagaagcggaatttaactatcatggatctgcatcccggttccgggaaaacccgcaagtacctgccggccatcgtacgggaagcgatcaagcgccggctcagaacgttaattctggcccccacccgggtggtagctgccgagatggaagaggcgcttaagggcttgcccatcagatatcagacgaccgcgaccaagagcgagcacaccgggcgggaaatagtcgacctcatgtgccacgccaccttcacgatgcgcctcctgtccccggtgagagttccgaattacaatctgattatcatggacgaggcccacttcacggaccccgccagtatcgccgcacgcggctacatctcaacacgagtcggaatgggcgaagccgccgccatcttcatgactgcgacgcctcccggaaccgcggacgctttcccgcagtcgaacgcccccatccaggacgaggagcgggacatccccgaaagatcgtggaactcggggaatgaatggatcaccgacttcgccggcaagaccgtgtggttcgtgccctccattaaagctgggaacgacatcgccaactgcctccgcaaaaatggcaagaaggtcattcagctgagcagaaagactttcgataccgagtatcagaagacaaagctgaacgactgggacttcgtggtgaccactgacatttccgagatgggcgctaatttcaaggccgaccgagttatcgacccgcgccgatgcctcaagcccgtcatccttacggacgggcccgaacgcgtgatcctggccgggcctatgccggtcaccgcggcatccgctgcccagcggcgcgggcgcgtgggacgcaacccccagaaggagaacgaccagtatattttcaccgggcagcccctaaacaatgacgaagatcatgcgcactggaccgaggcgaagatgttgctggacaacatcaacacccccgaggggatcatcccggccttgttcgagcccgaacgggagaaatccgccgccatcgacggcgagtacagactcaagggggaaagccggaagaccttcgtggagctgatgcgccggggcgacctccccgtatggctggcgcataaggtggcgtccgagggcattaagtacaccgacagaaagtggtgcttcgatggccagcgcaacaaccaaattctggaggagaacatggacgtagagatctggaccaaagagggcgaaaagaagaaacttcgcccccggtggctggatgccagaacgtacagcgacccattggccctcaaagagttcaaggagttcgccgcggggcgtaaatccatcaccctggacctggtaaccgagatcggaagagttccgtctcaccttgcccaccgaacgcggaacgctctcgacaacctggtcatgcttcacacgagtgaacacgggggcagagcctaccgtcacgccgtagaggagctacccgagacaatggagaccctgctcctcctcgggctcatgatcctgctgaccggcggcgctatgctgttcctgatcagcgggaaaggcataggaaagacaagcataggcctgatctgcgtgatcgcctcctcggggatgctctggatggccgaaataccgctccagtggatcgctagcgccattgtacttgagttcttcatgatggtgctcctgattcccgagccagaaaagcaacgaacgccgcaggacaaccagctcgcgtacgtggtcataggaatacttacactggcggccattatcgctgccaacgagatgggcctgctcgagaccacgaagcgtgatttagggatgtcaaaggagcccggcgtggtgtcccccacctcatacctggacgtcgacctccacccggcgtctgcgtggactctgtatgccgtagcgacgacggtaatcacgcccatgttgcgccatacaatcgagaacagcaccgctaacgtctccttagccgccatcgccaaccaagctgtcgtactgatggggttggacaagggctggccgatcagcaaaatggacctaggggtccccctgttggcgctcggctgctactcccaggtgaaccccctgactctgaccgccgccgtgctcctgcttatcacccactatgccattatcggtccagggctccaggcaaaagcgacccgtgaagctcagaaacgtaccgccgccggcatcatgaagaacccgaccgtcgacggaatcatgacaattgatctcgaccccgttatctacgacagcaagttcgagaagcagctgggccaggtgatgctcctggtcttatgtgcagtgcaactgttactcatgaggacctcctgggcgttgtgcgaggccctgacgctggcaaccggccccattaccaccctctgggaggggagccctggtaagttctggaacactaccattgccgtgtctatggcaaatatcttccgcgggagctacctcgccggcgccgggttagccttctccatcatgaagtccgtcggcaccggcaaacgggggaccggcagccagggggagaccctgggagagaagtggaagaagaagctgaaccagctgagcagaaaggacttcgacctctacaagaagtccggtatcacggaggtcgaccgcaccgaagcaaaagaggggttgaagcgcggggagatcacccaccacgcggtgtcccggggttcagccaagctgcagtggttcgtggagaggaacatggtaatcccggagggacgtgtgatcgatctcggatgcggccgcggaggatggtcctactactgcgccggcctaaagaaagtcacagaggtgcggggctacacgaagggtgggcccggccatgaggagcctgtacccatgagcacctacgggtggaacatcgtaaagctgatgtccgggaaagacgtgttctaccttccgccggagaagtgcgacacgctgttatgcgacataggcgagagctcgccttcgccaaccgtggaagaaagtagaacaatccgcgtcctgaagatggtagagccttggctcaagaataaccagttctgcattaaggtgttaaacccctacatgcccaccgtcatcgagcacctggagcggctccagcgcaagcacggtggtatgctagtccggaaccccctttcccgcaactcgacccatgaaatgtattggatcagcaacgggaccggcaacatcgtggcatccgtcaacatggtgtcccggctcctgctgaatcgcttcaccatgacccaccggagaccgacgatagagaaagacgtagacctcggcgccgggacccggcacgtcaacgcggagcccgagacccccaacatggatgtcatcggcgagcgcatcaagcggatcaaggaggagcacaactccacctggcactacgacgacgagaacccgtacaagacatgggcctaccacggcagctacgaggtgaaggccaccggctccgctagctccatgatcaacggggtcgtgaagctactgacgaagccctgggacgtggtaccaatggttacccagatggccatgaccgataccacgcccttcggccagcagagagtctttaaggagaaagtggacactcgtaccccacgatcaatgcctgggacacggcgcgtgatgggcatcacggcggagtggctgtggcggactttaggacgcaacaagaaaccaaggctgtgcacccgcgaagaatttacgaaaaaggtcaggacgaacgccgccatgggggccgtgttcaccgaggaaaaccaatgggacagcgcgaaggcggccgtggaggacgaagacttctggaagctcgtcgatcgggagcgggagttgcacaagctgggaaagtgcggatcctgcgtctacaatatgatgggtaagcgagagaagaagctcggggagttcgggaaagctaagggaagccgcgccatctggtacatgtggctcggcgcgcggtacttggagttcgaggccctcggcttcctgaacgaggaccactggtttagcagagaaaactcgtactccggcgtagagggcgagggcctgcataagctcgggtatatcctgagagacatcagcaagatccccggcggagccatgtacgccgacgacactgccggctgggatacccgcattacggaggacgacctgcacaacgaagagaagataacccagcagatggatcctgaacacagacagctcgcaaacgccattttcaagctgacctaccagaataaggtcgtgaaagtgcaacgccccacccccaccgggacggtcatggacataatctccaggaaagaccaacgcggaagcggccaagtagggacctacggtctgaataccttcaccaacatggaggcccaactcattcggcaaatggagggggagggcgtgctgtcaaaggccgacctcgagaacccccacctcccagagaaaaagatcacgcagtggctggagaccaagggcgtcgaacgcctgaaacggatggccatcagcggggacgactgcgtggtgaagcccatcgacgaccgttttgctaacgccctcctggctctgaacgacatgggcaaggtccggaaggatatccctcagtggcaaccctccaaggggtggcacgactggcagcaggtccctttctgcagccatcacttccacgagctgatcatgaaggacggtagaaagctggtggtgccctgccgtccgcaggacgagctgatcgggcgcgcccggatatcccaaggcgccggttggagtctcaaggaaactgcgtgcctggggaaggcgtacgcgcaaatgtggtcgctgatgtatttccataggcgcgacctcagactggccagcaacgctatttgcagtgccgtgcccgtgcactgggtccccacctcccgcactacttggtcgatccacgcccaccatcagtggatgaccaccgaggacatgctgaccgtgtggaatcgggtatggatcgaggataacccctggatggaggacaagacccctgtcaccacgtgggagaacgtgccctatctaggcaagcgcgaggaccaatggtgcggaagtttaatcggcctgaccagccgggccacctgggcacagaacatccccacagcgatccagcaggtcaggtccctaatcggcaacgaggagttcctggactatatgcccagcatgaagcgatttcgcaaggaggaggagagcgagggcgccatctggtga

SEQ ID NO: 25862 - RNA, 9873 nt, synthetic construct
  misc_feature 1..9873: note = derived and/or modified CDS sequence (opt11) from DENV-3__JF937634__SS-prME
  source 1..9873: mol_type = other RNA
acgagcctctgcctcatgatgatcctacccgccgctctggcgttccacctgactagcagagacggtgagcctcggatgatagtggggaaaaacgagcgcggcaagagcctgttattcaagaccgcgtcaggcatcaacatgtgcactctcatcgccatggatctgggcgaaatgtgcgacgataccgttacctataagtgcccccatataaccgaggtcgagccagaggatatcgactgctggtgcaacctcaccagcacctgggtgacctacgggacgtgcaaccaagccggggagcatcggcgagataaacggtccgtagctctcgcgccccacgtgggcatggggctggacacgcgcacccagacctggatgtccgccgaaggcgcctggcggcaggtcgagaaggtcgaaacgtgggcccttcgccaccctgggttcaccatcctcgcgctgttcctggcccactacatcgggacctccctgacccagaaggtggtgatctttatcctgctaatgctcgtgacgccctccatgacaatgcgctgcgtgggagtgggcaaccgcgacttcgtagaaggcctgtccggggctacttgggtggacgtggtgctggagcacggcgggtgcgtgaccaccatggcaaagaacaaacccacgctcgatatcgagctgcaaaagaccgaggccacccagttagcgaccctgcggaagctgtgcatcgagggaaagatcaccaacatcaccaccgacagccgctgccccacgcagggcgaggcgaccctgccagaggaacaggaccagaactacgtttgcaagcacacctacgtcgatcggggttggggcaacggatgcggcctcttcggtaagggctccctcgtaacctgcgccaagttccagtgcctggagccaatcgaaggcaaggtggtccagtatgagaacttaaagtacacggtgatcatcaccgtacacaccggggaccagcaccaagtcggcaacgaaacgcagggagtgacagccgagatcacgccacaggcgagtaccaccgaggccatactgcccgaatatgggactctggggctcgagtgctccccgaggacgggcctggatttcaacgagatgatcctgctcaccatgaagaacaaggcgtggatggtccatcgccaatggttctttgacttgcctctaccctggacgagcggcgccaccacggaaacccccacctggaaccgtaaggaactcctggtcaccttcaagaacgcccacgccaaaaagcaggaggttgttgttctagggtcccaggaaggcgcgatgcacacggccttaaccggtgccacagaaatccagaacagcggcgggacttccatcttcgccggtcacctgaagtgcagactcaagatggacaagctcgagctgaagggcatgagttacgccatgtgcaccaacaccttcgtgctgaagaaggaggtctccgaaactcagcacggcaccatcctcatcaaggtggagtacaagggcgaggacgtgccctgcaagatccccttcagcacagaagacgggcaaggtaaggcgcataacggccgcctgatcaccgccaaccccgttgtgaccaagaaggaagagcccgttaatatcgaggccgagccgcccttcggggagagcaacatcgtcatcggaatcggggacaatgcgctgaagatcaactggtacaaaaagggctcctctatcgggaagatgttcgaggcgactgcccggggcgcccgccggatggccatcctaggcgatacggcctgggactttgggtccgttggcggggtgctcaacagccttggcaagatggtccaccagatctttgggtccgcctacaccgcactgttcagcggtgtgtcctgggtgatgaagatcggcataggggtgctcttgacctggattggcctgaacagcaagaacacctccatgtctttctcatgcatcgccataggaattataactctctacttaggcgcggtagtgcaggccgatatgggctgcgtaatcaactggaagggcaaagagcttaagtgcggaagcggaatcttcgtgacgaacgaggtgcacacgtggaccgagcagtacaagttccaggcggattcccccaagcgactcgccacggccatcgccggcgcctgggagaacggggtatgcggcatccggagcaccacccggatggagaacctgctatggaagcagatcgtgaatgagctcaattacatcctgtgggagaacaacataaagctaaccgttgtcgtgggcgacatcatcggcgtgctcgagcaaggaaagcgcacgttgaccccccagccgatggagctgaagtacagctggaagacctgggggaaagccaagatcgtcacagcggagacgcagaatagctcgtttatcattgacggccccaacacccccgagtgcccctcagtgtcccgggcatggaacgtatgggaagtggaggactacgggttcggcgtgttcaccacgaacatctggttgaaattgcgcgaagtgtacacccaactttgtgaccaccgcctcatgagcgccgcggttaaggacgagagggccgtgcacgccgacatgggttactggatcgaaagccagaagaacggctcctggaagctggagaaggccagccttatcgaggtgaagacatgcacctggccgaaatcccacaccctctggagcaacggcgtactggagtccgatatgatcatacccaagagcctggccgggcccatctcccagcacaaccaccggccgggctatcacacgcagactgctgggccctggcacctaggcaagctggagctggactttaactactgtgagggcaccacagtagtaataactgagaactgtggaactcgcggccccagcttgcggaccaccaccgtctccggaaagctgatccacgaatggtgttgcagaagctgcaccctgcccccgctccggtatatgggcgaggacgggtgctggtacggcatggagatccgccccatatccgagaaggaggagaacatggtcaagagcctggtgtcagccgggagcgggaaggtagataacttcaccatgggagtgctgtgcctggccatcctgtttgaggaggtgatgcgtgggaagttcggcaagaaacacatgattgcaggggtgttcttcacctttgtgctgcttctatccgggcagattacctggcgcgacatggcccatactctaatcatgatcggcagcaacgcgtccgatcggatggggatgggcgtgacctacctcgccctgatcgccaccttcaagatccagcccttcctggcactcgggttctttcttcgcaagttgacctctcgggaaaatctcctgttgggggtcggtctcgcgatggccacgaccctacagctgccggaggacatagagcagatggccaacggaatcgccctcggcctgatggccttgaagctcattacacagttcgagacctaccaactctggaccgcgctgatcagcctaacctgttccaataccatcttcactttgacggtcgcatggcgcaccgctaccctgatcctcgccggggtcagtctgctacctgtgtgccagtccagctccatgcggaagactgactggcttccgatggccgtggcggccatgggggtcccgcccctcccactctttatcttcgggctcaaggacacgctgaaacgccgtagttggccgctgaacgagggcgtgatggccgtgggcttagtctccatcctggcgtcgtccctgctgcgaaacgacgtgcccatggccggccctctggtggcgggagggctgctgattgcctgctacgttatcactggcaccagcgccgacctgacagtggagaaggccgccgacataacatgggaggaagaggctgagcagaccggcgtgagccacaacctaatgatcaccgtagatgacgatggcaccatgcgcataaaggacgacgagaccgagaatattctcacggtgctgctaaaaaccgccctcctgattgtgagcggcatttttccgtattccatcccagccaccctgctcgtctggcacacctggcagaagcagactcagcggagcggtgttctgtgggacgtgccttcgccacccgagacgcagaaggccgaactggaggagggcgtctaccgcatcaagcagcaagggattttcggcaagacacaagtgggggttggcgtccagaaagagggggtgttccacacgatgtggcatgtgacacggggcgcggtcttaacttacaacgggaaacggctagagccaaattgggcgtcagtgaagaaggacttgatcagctacgggggggggtggcggctcagcgctcagtggcagaagggcgaagaggtgcaagtgatagccgtggagcccgggaagaaccccaagaactttcagactatgcctgggaccttccaaacgaccaccggcgaaattggtgccatcgcgctggacttcaaacccggaacctccggcagccccattataaaccgcgaggggaaggtagtggggctgtacggcaacggggtggtgacgaagaacggggggtacgtctctggaatagcccagaccaacgcagagccggacgggccaacccccgagctcgaagaggagatgttcaaaaagcggaacctcacgatcatggacctgcaccccggcagcgggaagacgcgcaagtatctacctgccatagttcgggaggccatcaagcgccggctcagaaccttgatcctcgcgcccacccgagtggtcgccgccgagatggaggaggccctcaaggggttaccaatccggtaccagactactgccaccaaatcagagcataccggtcgggaaatcgtagatctgatgtgccacgcgaccttcacgatgcgcctcttgtcccccgtgagagtcccgaattacaacctgatcatcatggacgaggcccacttcacagaccccgcctcgatcgccgcccgcggctatatctctacacgggtgggcatgggtgaggcggccgccatattcatgacagccacgccgcccggcacagcggacgccttcccgcagagcaacgcgcccatccaggatgaggagcgcgacatccccgagaggtcttggaacagtgggaacgagtggatcaccgacttcgccggaaaaaccgtgtggttcgtgccctccattaaggccgggaacgacattgcaaattgcctccggaagaacggcaagaaggtgattcagctgagccgtaagacgttcgacacggaataccaaaagacaaagctgaacgactgggacttcgtcgtgaccacggatatctccgaaatgggtgccaacttcaaggcggaccgggtcatcgatcctcgccggtgcctcaagcccgtgatcctgaccgacgggcccgagcgcgtcatactggccggccctatgccggtgactgccgcgagcgccgcccagcggcgcgggcgggtgggtcgcaacccccagaaggagaatgaccagtatatcttcaccgggcagcccctcaacaatgacgaggaccacgcccactggaccgaggccaagatgctgctggacaacatcaacacgcccgaaggcatcatcccggccctctttgagcccgagcgggaaaagagcgccgccattgacggcgagtaccgcctgaaaggggagtctcggaagaccttcgtcgagctgatgcgccgtggcgatctacccgtgtggctggctcacaaggttgcgtctgaagggatcaagtacaccgaccgcaagtggtgcttcgatggccagcggaataaccaaatcctggaggagaacatggacgtggagatctggaccaaggaaggcgaaaagaagaagctccgtccacggtggctagatgcccgcacctatagcgacccgctggccctcaaggaattcaaggaattcgctgctggtcgcaagtccatcgcactggacctcgtgaccgaaatcggccgggtccccagccacctcgcccataggacccggaacgccctggacaacttagtgatgctccacacctccgagcatggtggccgtgcttacaggcatgccgtagaagagctgccggagacgatggaaaccttgctcctgctggggctcatgatcctgctgaccggcggcgcaatgctgttcctgatcagtggaaagggaattggaaagacgagcatcgggctgatctgcgtgatcgcctccagcgggatgttgtggatggccgagatcccgctgcagtggatcgcctcagcgatagtactagagttcttcatgatggtcttactgatcccagagcccgaaaagcaacgcacgccccaggataaccagctggcctatgtcgtgataggcatcctcacgctggccgccatcatagccgccaacgagatggggttactcgagaccaccaagcgggacctggggatgtcgaaggagcccggtgtggtctcccccacctcgtacctggatgtcgacctccaccccgcgagtgcttggaccctgtacgctgtggccaccaccgtcatcacacccatgctgcgccacaccatcgagaatagcaccgcgaacgtgtccctcgccgccatcgccaaccaggccgtcgtcctgatggggctggacaagggctggccgatcagcaaaatggacctcggggtacccctgctggcgctcggctgctactcccaggtgaaccctctgacgctgaccgcggccgtcctcctgctgatcacccactacgccatcatcggacctggactccaggcgaaggcgacccgcgaggctcagaagcgaaccgcagccggcatcatgaaaaatccgacggtggacgggatcatgaccatcgacctggaccccgtaatctacgatagcaagttcgagaagcagctgggccaggtcatgcttctggtgctgtgcgctgtccagctcctactgatgaggacctcctgggcgctctgcgaggcccttaccctcgccacgggccccatcaccaccttgtgggaggggtcacccggcaagttctggaacaccacgatcgctgtctccatggcgaacatctttcgcgggagctacctggccggagccgggctggccttctccatcatgaagtccgtaggcaccggcaagcgagggaccggctcgcagggggaaaccctcggcgagaagtggaagaaaaagctgaaccaactgagcagaaaagacttcgacctctataagaagtccgggatcaccgaggttgatcggaccgaagccaaggagggtctgaagagaggcgagatcacgcaccatgcggtctcccgggggagcgccaagctgcagtggttcgtggaacgcaacatggtgattcccgagggccgggtaatcgacctcggatgtggacgcgggggctggtcctactattgtgctggcctgaagaaagtgaccgaagtgcgaggttacacgaagggcgggcccgggcacgaggagcccgtccccatgtcgacgtacgggtggaacatcgtaaaactgatgtccggaaaggacgtgttctatctcccgcccgagaagtgcgacaccttgctgtgcgatatcggcgaaagctcccccagccccacggtggaagaatcccgcaccatccgtgtgcttaagatggtggagccgtggctgaaaaacaaccagttctgcatcaaggtgctgaacccttatatgcccacggttatcgagcacctagagcggctgcagcgcaagcacgggggcatgctggtgcggaaccccctcagccgcaactccacccacgagatgtactggatcagcaacgggaccggcaacatcgtcgcctccgtgaacatggtaagtcgcttgctgctgaaccgttttactatgactcaccggcggcctaccatagagaaagatgttgacctcggcgccgggacccggcacgtgaacgctgagccggagacacccaacatggaggtgatcggcgaacgcataaagagaatcaaggaagagcacaactctacatggcactatgatgacgagaacccgtacaaaacctgggcctaccacgggagctatgaggtaaaggccaccggatctgctagcagtatgattaacggggtggtcaagttactcaccaagccatgggacgtagtgcccatggtcacgcagatggccatgacagacaccacaccattcggccagcagcgcgtgttcaaggagaaagtcgacaccagaaccccgcgcagcatgccaggcacgagacgggtcatggggatcaccgctgagtggctctggcgcacgctgggccgtaacaagaagcccagattatgcacccgcgaggagttcaccaagaaggtccgcacgaacgccgccatgggggccgtgttcacggaagagaatcagtgggactcggcgaaggccgccgttgaggacgaggatttctggaagctcgtagatagagagcgcgagctgcacaaactcggcaagtgtgggtcctgcgtgtacaacatgatgggaaaacgggagaagaagctcggcgagttcgggaaagccaagggctctcgcgccatctggtacatgtggctgggggcccgttacctggagtttgaggcactcggtttccttaacgaggaccactggttctctcgtgagaacagctactccggggtcgagggcgagggtctgcacaagctcgggtacatcctgcgggacatatcgaagattcccggcggggccatgtacgccgatgacaccgccggctgggacaccagaatcacggaagacgacttgcataacgaggagaagatcacacaacagatggacccggaacaccggcaactagcggacgccatattcaagttaacctaccagaataaggtggtgaaggtccagcgcccgactccaacgggcacggtaatggacatcatatctcggaaggatcaacgcgggagcggccaggtgggtacgtacggtcttaacacattcaccaacatggaggcccagctcatccggcaaatggagggggaaggtgtgttatcaaaagccgacctggagaacccccacctgccggagaagaagatcacgcagtggctggagacgaagggggtggagagactgaagcgtatggccattagcggagacgattgcgtagttaagccaatcgacgacaggtttgcgaacgctctactggcactaaatgacatgggcaaggtgcggaaggacataccccagtggcagccctccaaggggtggcatgattggcagcaggtcccattctgcagccaccacttccatgagctcatcatgaaggacggccggaagctggtcgtgccgtgccggccccaggacgagctcatcgggcgtgctcggatctcgcagggcgcgggttggtcgctcaaggagaccgcgtgcttagggaaggcttacgcccaaatgtggagcctgatgtacttccaccgccgcgacctccggctagccagcaacgcgatttgctctgccgtgccagtccactgggtgcctacctctcgcaccacgtggtcgattcacgcccaccaccagtggatgaccaccgaagacatgctgaccgtgtggaaccgggtctggatcgaggacaacccttggatggaggacaagacgcccgtgaccacctgggagaatgtgccgtacctgggcaagagagaggaccagtggtgcggaagcctgatcggcctgaccagccgggcaacctgggcccaaaacatcccgacggcgatccagcaggtcaggtccctcatcggaaacgaagagttcttagattatatgccctccatgaagcggttcagaaaggaggaggagtcagagggggccatctggtga

SEQ ID NO: 25863 - RNA, 9873 nt, synthetic construct
  misc_feature 1..9873: note = derived and/or modified CDS sequence (opt11) from DENV-3__JF937636__SS-prME
  source 1..9873: mol_type = other RNA
accagtctgtgtctcatgatgatcctgcccgcagccctcgcgttccacctaacctccagggacggcgaaccccgaatgatcgtcgggaagaatgaacggggcaagagcctgctgttcaagaccgcctccgggatcaacatgtgcacactcatcgccatggacttgggggagatgtgcgacgacacagtgacctacaaatgcccccacatcaccgaggtagagcccgaggatattgactgttggtgcaacctgaccagcacctgggtcacttacgggacgtgcaatcaggccggcgagcaccggcgcgacaaacgttccgtagccctggctccccacgtcggtatgggtctggacacccgtactcagacatggatgtcagccgagggcgcctggaggcaggttgaaaaggtcgagacgtgggccctgaggcacccggggttcaccattctcgcgctgttcctggcacactacattggaacctcccttacccaaaaggtggtgatcttcattctgctgatgctcgtcacgccgagcatgaccatgcggtgcgtgggggttggtaaccgtgacttcgtcgagggcctatccggggcaacctgggtcgacgtggtcctggagcacggcgggtgcgtgacaacgatggccaaaaacaaaccaaccctcgatatcgagctgcagaagaccgaggcgacccagctagcgacgctccggaagctgtgcatcgagggcaaaatcacaaacatcaccaccgacagccgctgccccacgcagggcgaggccaccttgcccgaggagcaggaccagaactacgtgtgcaaacacacttatgttgatcgggggtggggcaacgggtgcggcctcttcggtaagggctccctggtgacctgcgccaaatttcagtgcctggagcccatagagggcaaagtggtccagtacgagaatctcaagtatacggtgatcatcacagtgcacactggagaccagcaccaagttggcaacgaaacccaaggggtgacggcagagatcacgccccaagccagcaccaccgaggcaatactgcctgagtatggcacactgggtctcgagtgctccccgcgaaccggcctggactttaacgagatgatcctgctcacaatgaagaacaaggcctggatggtccaccggcagtggttctttgacttacccctgccttggaccagcggcgccaccacggaaacccccacctggaaccgcaaggagctcctggtgactttcaaaaacgcgcatgccaagaagcaggaagtcgttgtgctgggttcccaggagggcgcgatgcacacggccctcaccggagccaccgagatccagaacagcggtgggacctccatcttcgccggccacctgaaatgccggctgaagatggacaagctagagctgaaaggtatgtcttacgccatgtgcacgaacaccttcgtgctgaagaaggaggtctccgagacccagcacgggactatcctcatcaaggtggagtataagggcgaagacgtgccatgcaagatccccttcagcacggaagacggacagggcaaggcgcacaacggccgcctgataaccgcgaaccctgtcgtgacgaagaaggaagaacccgtcaacatcgaggccgagccgcccttcggcgagagcaatatcgtcatcggtatcggcgataacgccctgaagatcaactggtacaagaaggggtcctctattgggaagatgttcgaggcgaccgcccggggcgcccgacggatggccatcctgggcgacacggcatgggactttgggtccgtcggcggagtgctcaacagccttgggaagatggtccaccagatcttcgggtccgcgtacaccgccctctttagcggcgtgtcctgggtgatgaaaatcggcatcggggttctcttgacttggatcggcctgaatagcaagaacacatccatgagcttctcctgcattgccatcggaatcatcaccctctacctgggcgccgtggtgcaggccgacatggggtgcgtcatcaactggaaaggcaaggagctgaagtgcggcagcgggattttcgtgaccaacgaggtgcacacctggaccgaacagtataaattccaggcggactcccccaagcgcctcgccacagccatcgccggcgcttgggaaaacggggtctgcggcatcagaagcaccactagaatggaaaacctgctgtggaagcagatagcgaatgaactcaactacatcctctgggaaaataacatcaaactgaccgtggtggtgggggacatcatcggcgtgctcgaacaaggtaagagaacactgacgccccaaccgatggagcttaagtactcctggaagacctgggggaaggccaagatcgtaaccgccgagacgcagaacagctccttcatcatagatgggcccaacacccccgagtgtccttccgtctcccgcgcctggaacgtgtgggaggtggaggactacgggtttggtgtattcaccacgaacatctggctcaagctgcgcgaggtgtatacgcaattatgcgatcaccggctcatgagcgcggctgtgaaggacgagcgcgcggttcacgcggatatgggctactggatcgagagccagaagaatgggtcctggaaactggaaaaggcttcactgatcgaggtaaagacctgcacgtggccgaagtcccacaccctctggagcaacggcgtgctagagtccgacatgatcattcccaagtctcttgcggggcccatctcccagcacaaccaccggccgggctaccacacccagacggcagggccatggcatctcggaaagctggaactggacttcaactattgcgagggcacgaccgtcgtaataaccgagaactgcgggacgcgcggccccagcctccgtaccaccaccgtgtccgggaaacttatacacgaatggtgctgccgcagctgcacgctgccgccgctccggtacatgggcgaggacgggtgctggtacggcatggaaatccgccccatcagtgagaaggaggaaaacatggtcaagagccttgtgtccgccggcagcgggaaggtggataatttcaccatgggcatcctgtgcctcgccatcttattcgaggaggtcatgcgcggaaagttcggcaagaaacacatgatcgccggggtgtttttcacattcgtactgctcctgtcaggacagatcacgtggcgcgacatggcgcacacgctgataatgatcggctcaaacgcctccgatcggatggggatgggggttacctacctcgcactgatcgcgacctttaagatccagccctttctggccctcggattcttcctgcggaagctgacaagcagagagaacctcctgctcggtgtgggcctcgccatggccactaccctgcagttgcctgaggacatagagcagatggccaacgggatcgccctcggcctgatggctctgaagctcatcacccagttcgagacctaccagttatggacggccctgatcagcttgacctgctccaataccatattcaccttgacggtggcatggcgtaccgccaccctgatcctcgcaggagtcagcctgctgccggtatgccagtctagctccatgcgcaagaccgactggctcccgatggcggtcgccgccatgggcgtgccacccctcccgctgttcatcttcagcctcaaggacacgctgaagcgccgctcctggcctctgaacgagggggtgatggccgtcggcctggttagcatcttagcctccagcttactccgaaacgacgtgcccatggcgggacctctcgtcgccgggggcctgctaatcgcctgttatgtgatcaccgggacgagtgccgacctgaccgtggagaaggctgcggacatcacgtgggaggaggaggccgagcagacaggcgtcagccacaacctgatgatcactgtggacgatgacgggaccatgcgcatcaaggacgacgagacagagaacattctcacggtactgctaaagaccgccctattaatcgtctccggcatattcccgtacagcatccccgccaccctgctcgtgtggcacacctggcaaaagcaaactcaaaggtcaggcgttctgtgggacgtgcccagtcccccggagacccagaaggcagagctcgaggagggggtgtatcgcatcaagcaacagggcatcttcggtaagactcaggtgggtgtgggggtgcaaaaggagggcgtgttccacaccatgtggcacgtcacgcggggagccgtgctcacatacaacgggaagcgcctggagcccaactgggccagcgtgaagaaagatctgatcagctacggcgggggttggcggctctctgcccagtggcagaagggtgaagaggtacaggtgattgccgtagagcccggcaagaaccccaaaaacttccagaccatgcccggcacctttcagacgaccaccggagagattggggcgatcgcgcttgacttcaagcccgggacgtcgggaagccccataatcaatcgagaggggaaggtcgtggggctatatggcaacggggtggttacgaagaacgggggttacgtgagcggcatcgctcagaccaacgcggagcccgacgggcccacacccgagctagaggaggagatgttcaagaagcgtaacctcacaataatggacctgcaccccggatcgggcaagacgagaaaatatctgccggccatcgtgcgggaggccatccgtcggcgacttcgcacactaatcctggcccctacccgcgtcgttgctgcagaaatggaggaagccctcaagggtctgcccatccggtatcagaccactgccaccaagtccgagcataccggccgcgagatagtggacttgatgtgtcacgccaccttcacgatgcggctattaagcccagtccgcgtccctaattataacctgatcatcatggacgaggctcactttaccgatcctgcctccatcgccgcgcgggggtacatatcaacccgcgtcggcatgggcgaagccgcggccatttttatgaccgcgacgccgcccgggaccgccgacgcgttccctcagtccaacgcccctatccaggacgaggagcgcgacatacccgagcggagctggaactctggcaacgagtggatcaccgacttcgccgggaagacggtctggttcgtgcccagcatcaaagcgggcaacgacatcgccaactgcctcaggaagaatgggaagaaggtgatccagctgtcccggaagacgttcgacaccgagtaccagaagacaaagctgaacgactgggacttcgtcgtgaccacggacattagcgagatgggcgccaacttcaaggccgaccgcgtgatcgacccccggagatgcctcaagcccgtcatactgaccgacggccccgagcgggtcatcctggccgggcctatgccggtgaccgcggcgtccgccgctcagcgccggggccgcgtcgggcggaacccccaaaaggagaacgatcagtacatattcaccggtcagcccttaaacaacgacgaggaccacgcccactggacggaggccaaaatgctgctggacaacatcaacactcccgagggaatcatcccggcactgttcgagcccgagcgcgagaagtctgctgccattgatggcgagtaccgtttgaagggcgaatcgcgaaaaacgttcgtggagctgatgagacgcggggacctccccgtctggctcgcgcacaaggtcgctagcgaagggatcaaatacacggaccgcaaatggtgcttcgacgggcagagaaacaaccagatcttagaggagaacatggacgtggaaatatggacaaaggagggtgagaagaagaagttaaggccacgctggctggatgcccgcacatactccgacccgctggcattaaaggagttcaaggagttcgccgcggggcgcaagagcatcgccctcgacttggtcaccgaaatcggtcgcgtgccctcacacttagcccaccggacccgtaacgccctggacaacctcgttatgctccatacgtcggagcacggcgggcgcgcctaccgacacgcggtagaggaactccccgagacgatggagaccctgctattgctgggactcatgatactactgacgggcggcgcgatgctgtttctgattagcgggaaggggatcggcaagaccagcataggcctgatctgcgttatcgccagctcgggcatgctctggatggcggagattccgctgcaatggatcgccagcgccatcgtgctcgagttctttatgatggtcctcctgattcccgagcccgagaagcagcggacgccccaggacaaccagctggcctacgtagtgatcgggatactcacccttgccgccatcatcgctgcgaatgagatggggctgctcgagaccaccaagcgcgacctgggcatgtccaaggagccgggcgtcgtgtctccaacgtcctacttggatgtggacctccatccagccagcgcctggacgctgtacgctgtcgcgacgaccgtcatcacgcccatgctgcggcacacgatcgagaactccaccgccaatgtgagcttagccgccatcgccaaccaggcagtggttctgatgggtctggacaaggggtggccgatctccaagatggacctcggcgtacccctgctggcactcggatgctacagccaggtcaacccgctgaccctgacggctgctgtgctgctgttaatcacccactacgccatcatcgggcccggcctccaggccaaggccacacgcgaggcccagaagcggactgccgccggaataatgaagaaccctacggtggacgggatcatgaccatcgacctggaccccgtaatctatgactccaagttcgagaaacagctgggtcaggtgatgctcctggtgctgtgtgcggtccagctcctcctgatgcgcactagctgggcgctctgtgaggccttgaccctggccactggtcccatcaccaccctctgggaaggctcgcccgggaagttttggaacaccacgatcgcggttagcatggccaatatctttcggggctcctatctggccggagcgggcctggccttttctatcatgaagtcagtagggacgggcaagcgcgggaccgggagccagggtgagactctgggggagaaatggaagaagaagctgaaccagctgagccggaaggatttcgatctctacaagaagtccggcataaccgaagtcgaccggactgaagccaaggagggacttaagaggggcgagataacccaccacgccgtgagcagaggctccgctaagctgcaatggttcgtggaacggaacatggtcatccctgagggccgcgtgatcgacctcggctgcggtcgcggagggtggagctactactgcgccggcctgaagaaggtgaccgaggtacgcggctacaccaagggcggtccggggcacgaggagcccgtgcccatgtccacgtatggctggaacatcgtgaagctgatgtcagggaaggacgtcttctacctcccgcccgagaagtgcgacaccctactgtgcgacatcggcgagtcctctccctcccccacggttgaggagtcccgcaccataagggtgctgaagatggtcgagccgtggctcaaaaacaaccagttctgtataaaggtgctgaacccctacatgcccacggtaatcgagcacctagagaggcttcagcggaaacacggcgggatgctagtaaggaaccccctttcccggaatagcacccacgaaatgtactggatctccaacggcaccgggaatatcgtggctagcgttaatatggtctcccggctcctgctgaaccggttcaccatgacgcaccgccggccgaccatcgagaaggatgtggacctcggcgcgggcacacgccacgtgaatgcggagccagagactcccaacatggacgtaatcggggaacggatcaaacgcatcaaagaggagcacaacagtacgtggcactacgacgacgagaacccgtataagacgtgggcctaccatggttcctacgaggtgaaggccaccgggtcggccagcagcatgatcaacggcgtggtcaagctgctgaccaagccctgggacgttgtcccgatggtgacgcaaatggcgatgaccgacaccacccccttcgggcagcagcgtgtgttcaaggagaaggtcgatacacgaactcccagaagcatgcccggcacccggcgggtcatgggcataaccgccgaatggctgtggcgcacactggggcggaacaagaagccccgcctgtgcacacgcgaggaatttactaagaaggttcggaccaacgccgccatgggcgccgtgtttacggaggagaaccaatgggactccgccaaggccgccgttgaagacgaggacttctggaagctcgtggaccgggagagggaactacacaaacttggtaagtgcggaagctgcgtatacaacatgatgggtaagcgcgaaaagaaactcggcgagttcggcaaggcgaaggggtcccgtgcgatatggtacatgtggcttggcgcccgctacctggagtttgaggccctgggtttcctgaacgaggatcactggttcagccgggagaactcctacagcggcgtggagggggagggacttcacaaactcggctacatcctacgagacatctccaagatccccggcggcgcaatgtacgccgacgacacggcggggtgggacacacggatcaccgaggatgaccttcacaacgaggagaaaatcacacagcagatggatccagagcaccgacagctggccaatgcgatcttcaagctgacctaccaaaacaaggtggtcaaagtgcagagacccacccccacaggtaccgtgatggatatcatcagccgtaaagaccagcggggatccggtcaagtcgggacgtacggactgaacactttcacaaacatggaggcccagctcatccgccagatggagggcgagggggtgctgagcaaggccgacttagagaacccgcacctcccggagaagaaaattacgcagtggttggagacgaagggcgttgagcggctaaagcgcatggccatctccggggacgactgcgtcgttaagcccatcgacgaccgcttcgccaacgccctcctagctctgaacgacatgggcaaggtgcgcaaggacatcccccaatggcaaccgagcaagggttggcacgactggcagcaggtccctttctgcagtcaccactttcacgagctcatcatgaaggacgggcggaagctggtggtgccttgccgcccgcaggatgaacttattggcagggcccgcatcagccagggggcgggctggtccctcaaggagacggcgtgcctgggtaaggcctacgcccaaatgtggtcgctgatgtactttcatcgccgggacctccgcttagcgtccaacgccatctgcagcgccgtcccagtgcactgggttccgacgagccggaccacgtggagcattcacgcacaccaccagtggatgacaaccgaggatatgctgacagtctggaacagggtgtggatagaggacaatccttggatggaggacaagactcccgtgaccacctgggaaaacgtcccgtacctcgggaagcgggaggaccagtggtgcggctcgttgatcgggctgacctcccgagccacatgggcacagaacattccgaccgccattcagcaggtacggtcactcatcggaaacgaggagttccttgactatatgccctccatgaagaggttcagaaaggaggaggagtctgagggggccatatggtaa

SEQ ID NO: 25864 - RNA, 9873 nt, synthetic construct
  misc_feature 1..9873: note = derived and/or modified CDS sequence (opt11) from DENV-3__JF937626__SS-prME
  source 1..9873: mol_type = other RNA
accagcctgtgcctgatgatgatcctcccagctgcacttgcattccatttaacatcacgcgacggtgaaccaaggatgatcgtagggaaaaacgaacgagggaaaagtctactattcaaaaccgccagcgggatcaacatgtgcaccctcatagcgatggaccttggcgaaatgtgcgatgacacagtaacatacaaatgcccacacatcacagaagtggaaccggaagacattgattgctggtgcaacttgaccagcacatgggttacatacggcacgtgcaaccaagccggggaacaccgccgggacaaacgctcggtggcgttggcgccgcacgtcggcatgggcctcgacacccgcacccagacatggatgtcagcggaaggggcctggcgccaggtggagaaagttgagacatgggcactccgccatccgggattcacaatactagcattgtttttggcccactacatcggcaccagtctaacacagaaagtcgtaatatttatcctcctaatgcttgtaacaccaagcatgacaatgcgatgcgtaggcgtaggcaacagagacttcgttgaaggtctctctggagcaacctgggtagacgtagtccttgagcacggaggatgtgttacgacaatggctaagaataaacccacgctcgacatcgaactgcagaaaacggaggcgacgcaactcgccacgctccgaaaattatgcatcgagggaaaaataaccaacatcacaacggactcacggtgcccaacacagggcgaggctaccctcccggaggagcaagaccaaaattatgtctgcaaacacacatacgtggaccgagggtggggaaacggctgcggcttattcggcaaaggctctctagtgacgtgcgcaaaattccaatgtctggagccaatagagggaaaggtagtccagtacgaaaaccttaagtacacagtaataattaccgtacatacaggagaccaacaccaagttggtaacgaaactcagggagtaacagcggagatcactccacaagcgagcacaacggaagcaatactccccgagtacggaacgctggggctagaatgttcgcccaggacgggcttagacttcaacgaaatgatcctactgacgatgaagaacaaagcgtggatggtacaccgacagtggttcttcgacctgccactgccatggacgtcaggtgcaactacggagacaccgacctggaaccgaaaagaactgctcgtgaccttcaagaatgcgcacgcgaaaaagcaagaagtcgtagtcctaggttcgcaggaaggagccatgcatacagccctaacgggggctacggagattcaaaacagcgggggcaccagcatatttgcgggtcacctcaagtgccgactaaagatggacaaattggagctaaagggaatgtcgtatgcaatgtgtactaacaccttcgtgctaaagaaagaagtctcagaaacacagcacggcaccattctaataaaggtagagtacaaaggcgaagacgtgccctgtaaaataccgttttccacggaagacgggcagggcaaggcccacaacggaagactaataaccgctaatcccgtcgtgacgaagaaagaggagccggtaaacatagaggctgagccacctttcggcgagtctaacatcgtcattgggatcggagataatgctctgaaaataaactggtacaagaaagggagtagcataggcaaaatgttcgaggcaaccgcaaggggcgcgcggcgcatggctatcctgggtgacacggcatgggacttcggcagcgtgggaggcgtccttaattcactggggaagatggtacaccagatcttcggctccgcctatacggccctcttcagcggtgtctcctgggtcatgaaaattggtattggagtgttactgacatggatcggcttaaattccaagaacacctctatgtccttttcctgcatcgcgatcggaatcataactctgtacctcggcgcagtcgtccaggccgacatgggctgcgtcattaactggaaaggcaaggagttgaaatgtggatcaggaatattcgtgaccaacgaggtccacacctggaccgagcagtataagttccaagcagacagccccaaacggctggcaaccgccatagctggagcctgggaaaatggtgtctgcggcattcgcagtacaactcgcatggaaaacctcttatggaaacaaatcgccaatgagctcaactatatactatgggagaataacatcaaattgacggttgttgtaggtgacatcataggtgtactcgagcaaggaaaaaggacactcacgccccagccaatggagctcaagtactcctggaagacatggggcaaagccaagattgtaactgcagaaacacagaacagctcgttcataatagacggcccaaatactccggaatgcccctccgtgtcaagagcctggaacgtatgggaagtcgaagactacggcttcggtgtcttcacgacgaacatttggctgaaactaagagaggtttacacacagctgtgcgaccatagactgatgagcgcggccgtaaaagacgagcgcgcagtccacgccgacatgggctactggattgaaagccagaaaaatggttcatggaaactcgaaaaggcatctctcatcgaggtaaaaacatgtacatggccgaaatcacacactctatggagcaacggtgtgctcgaatccgacatgatcataccaaagagcttagccggccccatcagtcaacacaatcacagacccggataccacacgcaaaccgcaggaccgtggcatctagggaagctggagcttgacttcaactactgtgaaggcaccactgtagtcatcaccgaaaactgtgggacccgtgggccaagtctccgtaccaccacggtttccggaaagttgatccatgaatggtgctgccgatcgtgtacgttacccccactgaggtatatgggcgaagacggatgctggtacggaatggagatccgacccatcagcgaaaaagaagaaaatatggtgaaatctctcgtgtcagccgggagtggaaaagtcgataattttaccatgggagtcctttgccttgcgatcctatttgaagaagttatgcgaggcaaattcgggaagaaacatatgatcgccggcgtgttctttacattcgtactactcctgtctggacaaattacatggagagatatggcgcacacgctaatcatgatcggcagcaacgcgagcgaccgcatggggatgggggtgacgtatctggcgctaatcgccacattcaaaattcagcccttcctagcgttaggattcttcctacgaaaacttacatcacgagaaaacttactactaggcgtaggactagcaatggcaactacactgcagctgcccgaagacatcgaacagatggccaacggtatagctctgggcctgatggcactaaaattaataacccaattcgaaacctaccaactttggacggcgctgataagcctaacctgcagtaatactatatttacgctgacagtagcatggcgcaccgcaacccttatcctggctggagtgagcctcttacctgtatgccagagctcatccatgcgaaagacagactggctaccaatggccgtcgccgccatgggcgtaccgccgctccccctattcattttcgggctaaaagacacgttgaaacgcagaagttggccactgaatgaaggcgttatggccgtcggcctagtatccatcttagcaagttctctgctgcggaatgacgttcccatggccggacccttagtcgccggcggactcctcatcgcgtgctacgtaataacaggaacctctgccgacctgaccgtagagaaggcggccgacatgacgtgggaagaagaggccgaacagacaggtgtgagtcataatctcatgatcacagtagacgatgatgggaccatgaggatcaaagatgacgagactgagaacatcctgacagtattattaaagaccgcactactcatcgtcagcggcatcttcccatactccatcccagcaacgttactggtatggcacacgtggcaaaaacaaacgcaacgaagcggggtcctctgggacgtaccgagtccaccagaaacgcaaaaagccgagctcgaggaaggcgtataccgtataaagcagcagggaatatttggaaagacccaagtaggagtaggtgtacaaaaggaaggcgtcttccacaccatgtggcacgtgacgcgaggagcagtgctcacatacaacggcaaacggctcgaacccaattgggcaagcgttaagaaagacctaattagctacggaggaggctggagacttagtgcccaatggcaaaaaggggaggaggtacaagtcatcgcagtcgagcccggcaaaaaccccaaaaactttcagacaatgcctggcacatttcagaccacgaccggagaaatcggagccatagcattagacttcaaaccgggtacaagtggatctcccatcatcaacagagagggtaaagtagttggtctgtacgggaatggcgtcgtgaccaaaaacggcggctacgtgagcggcattgcgcaaacgaacgcagaacctgatggccccacgccggagctcgaagaagaaatgttcaagaaacgaaacttgaccatcatggacctccacccaggcagtggaaagacacgcaagtacctccccgctatagtgcgcgaggccataaaaaggcgcctccgcactttgatactggctcccacaagagttgtagcggccgagatggaggaagctctgaaaggactaccgatccgataccagaccaccgccactaaatccgaacataccgggagggagatcgtcgacctgatgtgtcacgccacctttacaatgcgcctgctctctccggttagagtgccgaactacaaccttatcataatggacgaagcccactttaccgatccggcaagcatagcagctagaggatacatttcaacgcgggttggtatgggcgaggcggcggcaatcttcatgacggcaacaccgccgggtaccgcagacgccttcccacaaagcaacgcgcctattcaggacgaagagagggatatacccgaacgatcgtggaatagcggaaatgaatggatcacagacttcgcgggcaaaaccgtatggttcgtaccttccataaaagccggcaacgacatagccaactgcctcagaaagaacggcaagaaagttatccagctatcacgaaaaacctttgatacagaataccagaagacaaagctaaacgattgggatttcgtagttaccactgacatcagcgagatgggtgccaacttcaaagcggaccgggtaatcgacccccgccgctgcctgaaacccgtgatcctcacggacggaccagaaagagtaatattggccggtccaatgccagtaaccgccgcttctgctgcacaacgccgaggacgcgtcggccgaaaccctcagaaggaaaacgatcaatacatattcaccggacagccactcaataacgacgaagaccacgcgcactggacagaggcgaaaatgctcctcgacaatataaatacaccagagggtataatccccgcgttattcgaaccagagcgggagaaaagtgccgccatagacggcgagtacagactcaaaggggaatccagaaaaacctttgtagagttaatgcgaagaggagacctcccagtctggttagcccacaaagtggcatcagagggcatcaaatacaccgacagaaaatggtgcttcgatggtcagcgcaacaaccagatcctcgaggaaaacatggacgtagaaatatggaccaaggaaggtgagaagaaaaagctacgccccaggtggcttgacgctcgcacctacagtgaccccctagcattgaaagagttcaaagagtttgcagcgggccggaaaagcatagcattagatctcgtaaccgagataggccgagtgccaagccacctagcacatcgaacacggaacgcactggataacttggtcatgctccataccagcgagcacggagggcgagcctacagacatgcggtagaggaactaccggagaccatggagacgctgctcttactcggactcatgatcctactaacaggaggagcaatgttgttcctcattagcgggaaaggaataggtaaaaccagcatcggattgatctgtgtgatcgcgtcatcagggatgctatggatggccgaaatcccacttcaatggatcgccagcgcaatagtactggagtttttcatgatggtcctcctgataccggaaccagaaaagcaacggacaccccaggataaccagctcgcatacgtggttataggcatccttacactcgcggccatcatcgcagccaacgaaatgggactgctagaaacgactaaacgagatctgggtatgtccaaggaacctggggtagtttcgcccacgtcgtaccttgacgtcgacctccaccctgccagcgcttggaccctttacgcggtggcgactacggtcatcaccccaatgctacgccataccatcgagaactctactgcgaatgtatctctggcggctatcgcgaatcaggccgttgtgctaatgggactcgataagggatggccgatttccaaaatggatctaggagtgcctttgctcgcgctgggttgctactcacaagtcaaccccctaactctaacggccgccgtgcttttactaataacgcactacgcaattatcggacccgggctacaagccaaagcgacaagagaggcccaaaagcgcacggccgccgggatcatgaagaaccccaccgtagacggaattatgaccatagatctagatcccgtaatatatgacagcaagttcgaaaagcagctcgggcaagttatgctcttagtcctatgcgcagtacaactactgctaatgcgaacctcatgggccctctgcgaggcccttactcttgcaactgggccgataacaacgctatgggaaggaagtcccggcaaattttggaacaccaccatagcagtgtccatggccaatatcttcaggggatcttacctcgccggggcgggactagccttcagcataatgaaaagcgttggaacgggtaaacgtggaacaggctcacaaggcgaaacactcggagagaaatggaagaagaaactaaatcagctaagccggaaagactttgatctttacaagaaaagcggaataaccgaagtcgacagaacagaggcgaaagagggccttaaacgaggcgaaatcacgcatcacgctgttagccggggatcagcaaaacttcagtggttcgtcgaacggaacatggtcgtccccgaagggcgcgtgatagacctgggatgcggcagaggagggtggagctactattgcgccggactcaagaaagtcaccgaagtccgcggctatacaaaaggcgggccaggtcatgaagaaccggtcccgatgagcacctacggatggaacatagttaaacttatgtccggcaaggacgtcttctacctaccgcccgaaaaatgtgatacacttttatgcgacatcggggaaagtagcccaagcccgaccgtggaagagagtcgaaccatacgcgtcctaaaaatggttgagccatggctaaagaacaatcaattctgcataaaagtcctaaacccctacatgccaaccgttatagagcacctagaacgattacagcgaaagcacggcggaatgttagtacggaaccccctatctaggaatagcacacatgagatgtattggatttcaaacgggaccgggaacattgttgcctcggtaaatatggtctccagattgctacttaacagatttaccatgacccaccggcgacccaccatcgagaaggacgtcgatttaggagcaggcacccgtcacgtcaacgcagaaccggaaaccccaaatatggacgtcattggcgaacgtattaaacggatcaaggaggagcacaactcaacgtggcattacgatgacgaaaacccctacaagacatgggcgtaccacggcagttacgaagtgaaagcgaccggtagtgcgtcgagcatgataaatggagtggtcaaacttctaacaaagccctgggacgtagtccccatggtcacgcaaatggctatgacggacaccaccccgttcggacagcagcgagtctttaaggagaaggtagacacgaggactccaagaagtatgccagggacacgacgagtcatgggcatcacagcagaatggctctggaggacgctgggccgcaacaaaaagccaagactctgtacaagggaagaatttacaaagaaagtaaggacaaatgcggctatgggagccgtcttcacggaggaaaaccaatgggacagcgcgaaagcagccgttgaggatgaggacttctggaagctcgtggaccgcgaacgagagctacacaaactgggaaaatgcggtagctgtgtttataacatgatgggaaagcgcgagaagaaacttggagagttcgggaaggcaaaaggatcacgggcaatatggtacatgtggttaggagcccgctacctggagttcgaggccctcggtttcttaaacgaagatcactggttctcccgggaaaactcttattcgggagtagaaggggagggactccacaaactcggatacatcttgagggatattagcaagatcccaggcggagccatgtacgctgacgacaccgcgggatgggacacccgtatcaccgaagatgacttgcataacgaggagaaaataacgcaacaaatggaccccgagcaccgtcagctcgcgaacgctatatttaagctaacctaccaaaataaagtcgtaaaggtgcaaaggccaacacccacgggtacggtcatggacataataagccggaaggaccaacggggatcaggccaagtaggcacatacggcttgaatacattcaccaacatggaggcccaactaattcggcagatggaaggggagggcgtcctcagcaaagccgaccttgaaaatccacacctaccagagaagaaaattacccagtggctggagacgaaaggagttgaaaggcttaagcgaatggccataagcggggacgactgtgtcgtgaagccgatcgacgacagattcgcgaatgcactactcgcactgaacgatatggggaaggtacggaaggatataccccagtggcaaccttcgaagggctggcatgactggcaacaggtcccgttctgctctcaccacttccacgagctcattatgaaggacgggaggaaactcgtagtaccatgccgcccccaagatgaactaatagggcgagcacgcatcagccagggagccgggtggtcgttaaaagagactgcgtgcctagggaaggcgtacgcccaaatgtggtctctgatgtacttccaccgacgagacctaagacttgccagtaatgccatatgctcggctgtcccagtacactgggtacccacgtcacgaacaacatggagtattcacgcacatcaccagtggatgacaacggaagacatgcttaccgtctggaaccgagtatggatcgaggataacccctggatggaagacaaaactcccgtcacaacgtgggagaacgtaccctatttaggaaaacgcgaagaccagtggtgcggttccctgatcggcctcacaagccgcgcgacatgggcccaaaacataccaaccgcaatccagcaggtacggagcttaataggcaacgaggaatttctagattacatgccgtctatgaagcggtttcgaaaagaagaagagtcggagggagccatctggtaa

SEQ ID NO: 25865 - RNA, 9873 nt, synthetic construct
  misc_feature 1..9873: note = derived and/or modified CDS sequence (opt11) from DENV-3__JF937621__SS-prME
  source 1..9873: mol_type = other RNA
acaagtttatgccttatgatgatcctgccggccgccctggctttccatctcaccagcagagacggtgagccccggatgatcgtggggaagaacgagagaggcaagagcctgctgttcaagacagcatcaggaatcaacatgtgcacactcatcgccatggatctgggcgagatgtgcgacgataccgttacatacaaatgcccccacatcaccgaggtggagcccgaggacatcgactgctggtgcaacctgaccagcacttgggtgacatacgggacgtgcaaccaggccggcgaacaccggcgcgacaagcggtccgtcgccttggcgccccacgtaggcatggggttggacacacgcacccagacctggatgagcgccgagggggcgtggcgacaggtggagaaggtcgagacgtgggccctacgccaccccgggttcaccatcctcgcactgttccttgcccactatatcggaacctccttgacccagaaggtggtgatctttattctgctgatgctcgtcacgcccagcatgacaatgcggtgcgtgggggtgggaaaccgcgacttcgtagagggcctgtccggggccacctgggtggacgtggtcctcgagcacggcgggtgcgtgaccacgatggcaaaaaacaagcccacgctcgacatagagctgcagaagaccgaagcaacccaactggcgacgctccggaaactgtgcatagaggggaagatcaccaacattaccaccgacagccgctgccccacacagggcgaggccaccctgcctgaggagcaggaccagaactacgtgtgcaagcacacctacgtcgaccgggggtggggtaacgggtgtggcctctttgggaagggctcccttgtgacatgcgccaaattccagtgcctagagcccattgagggcaaggttgtacagtacgagaacttaaagtacaccgtgatcatcactgtccacaccggggatcaacaccaggtcggtaacgagacccagggggtgacggcggagattacgccccaggccagcacgacggaggcgatcctgcctgaatacggcacactggggttggaatgttccccccgcacagggctggacttcaacgagatgatcctgttgactatgaagaacaaagcctggatggtccaccggcagtggttcttcgacctacccctgccatggacaagcggcgccaccacggagacccccacttggaaccgcaaggagctcctggtgacctttaagaacgcccacgccaaaaaacaggaggtggtcgtccttgggtcccaagaaggcgccatgcacacggcgctcaccggggctactgagatacagaactccggtgggacctcgatcttcgcaggccacctgaaatgccggctgaagatggacaagctcgaactaaaggggatgagctacgccatgtgcacgaacaccttcgtactgaaaaaggaggtctcggagacccagcacgggaccatcctcataaaagttgagtataagggcgaggacgtgccgtgcaagatccccttcagcacggaggacggacagggtaaggcgcacaacggacgcctgataaccgccaaccccgtcgtgaccaagaaggaggagcccgtgaacatcgaggctgagccgcctttcggggagagcaacatcgtcatcggcatcggagacaacgccctgaagatcaactggtacaagaagggctcctcgatcggcaagatgttcgaggcgacagcccggggtgcccgccggatggccatcctaggcgatacagcctgggacttcgggtctgtgggcggggttctcaatagcctcgggaagatggtacaccagattttcgggtccgcgtacacagcgttgttttcgggcgtgtcctgggtcatgaagataggcatcggggttctactgacatggatcggtctgaacagcaaaaacacctccatgagcttctcttgcatcgcaatcgggatcatcacgctctaccttggcgcggtggtccaggccgacatggggtgcgtgatcaattggaaaggtaaggaactgaagtgcggcagcgggatcttcgtaactaacgaggtgcatacctggaccgagcagtacaagttccaagcggactcccccaagcgcctcgccacggcgatcgccggcgcgtgggaaaatggggtctgcggcatccgcagcaccacccggatggagaacttactgtggaagcagatcgcgaacgagctcaactacatcctgtgggaaaacaacatcaagctaaccgtagtggtgggggacatcatcggcgtgctcgagcagggcaagcgcaccctgacgccccagccgatggagctgaagtactcctggaagacctgggggaaggccaagatcgtgaccgccgaaacgcagaatagcagtttcatcatcgacggacccaacacccccgagtgcccgagcgtctcccgagcctggaacgtgtgggaggtggaggactacgggtttggcgtctttacaaccaacatttggctcaaactacgcgaggtgtacacccagctgtgcgaccaccggctcatgtcggcggcagtgaaagacgagcgcgcggtccatgctgatatgggttactggattgaaagccagaagaatgggtcctggaaactggaaaaggccagtctgatcgaggttaagacgtgcacttggccgaagtcccataccctctggagcaacggcgtcctggagtccgacatgatcattcctaagagtctggcggggccaatttcccagcacaaccacaggcctggctatcacacccaaacggcgggcccctggcacctgggcaaactagaactggacttcaactactgcgagggcacaaccgtcgtgatcaccgagaactgcgggacgaggggccccagcctccggaccaccacggtatccgggaagctgatccacgagtggtgttgccggagctgcactctgcccccgctccgatacatgggcgaggacgggtgttggtacgggatggagatccgccccatttccgagaaggaggagaacatggtcaaaagcctggtgtccgcgggctctggaaaggtggacaattttaccatgggagtcctgtgcctcgccatcctgttcgaggaggtgatgagaggcaagttcggcaagaagcatatgatcgctggggtgttctttaccttcgtcctgctcttgtccggccagatcacgtggagagacatggcgcacacgttgataatgatcggcagcaacgcctccgatcggatggggatgggagtgacctacctggcccttatcgccacttttaagatccagccgtttctcgccctcgggttctttctgcgaaagctgactagccgggaaaacctcctgctgggcgtgggcctcgctatggccacgaccctgcagcttcccgaggatatcgagcaaatggccaacgggatcgcactaggcttgatggcgctgaaactcatcacccagtttgagacgtatcagttatggacggccctgattagtctgacctgctccaacaccatcttcacgctgacggtcgcctggcgcaccgctaccctgatcctcgctggtgtgagcttgctgccggtctgccagtccagttccatgcgaaagaccgactggctccccatggcggttgccgctatgggcgtaccccccctcccgctgttcatcttcgggctcaaagatacactgaagagacgctcctggcccctgaatgagggcgtcatggccgtgggccttgtgtccatcctggcgagctccctgttgcgcaacgacgtcccgatggcgggcccactggtggccggaggactgttaatcgcctgttacgttatcaccggcacgtctgccgacctgacagtcgagcgggccgccgacatcacttgggaggaagaggccgagcagaccggtgtgtcccacaacctcatgatcaccgtggatgacgacggcaccatgcggatcaaggacgacgagaccgagaacatcctcacggtcctgttgaagaccgccctcttaatcgtgagcggcatcttcccgtactcaattcccgctactctgctcgtgtggcacacatggcagaagcagacgcagcgcagcggggtcctgtgggacgtgcccagcccgcctgagacccaaaaggccgaactggaggagggcgtttaccgaatcaagcaacaggggatctttggcaaaacacaagtcggcgtgggggtgcagaaggaaggcgtttttcacaccatgtggcacgtgacacgcggagcggtactaacctacaacggaaaacggttagagcccaactgggcaagcgtcaagaaagacctgatatcctacggaggcgggtggcgcctctctgctcaatggcagaagggcgaggaggtccaagtaatcgccgtggagccaggaaagaatcccaagaacttccaaaccatgcccgggaccttccagacgactaccggcgagatcggggcaatcgccctggacttcaagcccggcacatcaggaagccccatcatcaaccgggaggggaaggttgtcggcctgtatggaaacggggtggttacgaagaacgggggctacgtgtctggaatcgcacaaaccaacgccgagccggatggaccaacccctgaacttgaggaggagatgttcaaaaagcgcaacctcacaatcatggacctgcacccaggctccggaaagacgcgtaagtacctgccggccatcgtccgtgaggctattaagaggcgtctccggaccctgatcctggcgccgacccgggtagtggccgccgagatggaggaggccctcaaaggcctgccgatccggtaccagactacggcgaccaaaagcgaacacacggggagagagatcgtagacctgatgtgccacgccaccttcacgatgcggctcctatcccccgtgcgcgtgcctaattacaacctcatcatcatggacgaagcccattttacagatcccgccagcatagccgcgcggggatacatctccactagagtcggaatgggggaggccgccgccatcttcatgaccgcgaccccgccaggcaccgcggacgctttcccccagagtaacgcccccatccaggacgaggagcgcgacatccctgaaagatcctggaacagtgggaacgagtggatcactgacttcgccggcaagacggtctggttcgtcccctccatcaaggctgggaatgacatcgccaactgtctgcgaaagaacggcaagaaggtcatccagctgagtcgaaagacatttgacaccgagtaccagaagaccaagctcaatgactgggatttcgtggtgaccactgacatcagcgagatgggggccaacttcaaagccgatcgggtcattgatcctcgaaggtgcctcaagcccgtgatcttaaccgacgggcccgagcgggtgatccttgcaggccccatgccggtcaccgcggcaagcgccgctcagcgccgggggcgcgttggccggaacccccagaaggagaacgaccaatatatcttcaccgggcaacccctaaacaacgacgaggaccacgcccactggaccgaggcgaagatgctgctggacaacataaacacccccgaggggataatcccggctctcttcgagcccgaaagggagaagtccgccgccatcgacggcgagtatcggctgaagggggaatctagaaaaacctttgtggaactaatgcgccgcggcgacctccccgtgtggctcgcccataaggtggcttccgagggcatcaagtataccgaccggaaatggtgcttcgacggtcagcgcaacaaccagatcctggaggagaacatggacgtagaaatctggaccaaggagggcgagaagaaaaagctccggccccgttggttggacgcccgcacgtacagcgatccgctggccctgaaggaattcaaggagttcgccgcgggccggaagtccatcgccctggacctggtgacagagatcggtagggtgccctcacacctagcgcacagaaccagaaacgcactggacaacttggtaatgctacatacatcagagcatgggggccgggcataccgccacgccgtagaggagctgcccgagactatggagaccctacttctgctgggactcatgatcctgcttacaggcggcgccatgcttttccttatttcagggaagggcatcgggaagacatcaatcggcctgatctgcgtgatcgcctcctccgggatgctctggatggccgaaatcccgctgcaatggatcgcctccgcgatcgtcctggagttcttcatgatggtgcttctgatcccggagcccgagaaacagagaacgccgcaggacaaccagctggcctacgtggtcattggcatcctcactctggccgccattatcgccgcgaacgaaatggggctgctcgagacaacgaaacgcgacctggggatgagcaaggagccgggggtggtgtcccccacgagctacctagacgtcgacctccacccagcctccgcctggacgctatacgccgttgctacgaccgtaatcacgcccatgctgcggcacaccattgagaacagcaccgcgaacgtctccctcgccgccatagcaaaccaggcagtggtactgatggggctggataagggctggccgatcagcaagatggacctcggggtccccttactggccctcggctgctactcccaggtgaacccgctaactctgacagcagccgtgctcctactgatcacccactatgccataatcggcccaggactccaggcgaaggccacccgagaggcacagaagaggaccgccgctggcatcatgaagaacccgacggtcgacggaattatgaccatcgacctggatcccgtcatctatgacagcaagttcgagaagcagctgggccaggtgatgctccttgtcctgtgtgcggtgcagctcttactgatgcgcaccagctgggccctctgtgaggccttaaccctggctacgggccccatcacaaccctctgggaggggagtcctggcaagttctggaacaccacgatcgcggtgtcaatggccaacatctttcgggggagctacttagcaggcgccgggctggcattttcaatcatgaagagtgtaggcacgggcaagagggggacaggctcccagggggagaccctaggtgagaagtggaagaagaagctgaatcagctgagccggaaggacttcgacctatataaaaagtcgggaatcacggaggtggatagaacggaggcaaaggagggtctcaagcggggcgagataacccaccatgctgttagccgcggctctgccaagctgcagtggttcgtcgagcggaacatggtgataccggagggccgcgtgatcgacctcggatgcggccgcgggggatggtcctactactgtgccgggttaaagaaggtaaccgaagtgcgagggtataccaagggggggcccggccacgaggagcctgtgcccatgagcacgtacgggtggaacatcgtcaagcttatgtccggcaaggacgtgttctacctcccgcccgagaagtgcgacaccctgctgtgcgacatcggcgagagctcccccagccccaccgtggaggagtcccgcacaatccgtgttctgaagatggtcgagccgtggctcaagaacaaccagttctgcatcaaagtgttgaacccttacatgcccacggtcatcgagcacttggagcgcttgcagcggaagcacggtggcatgctggtgcgcaaccctctgagccggaactccacccacgagatgtactggattagcaacgggaccggcaacattgtggcctccgttaacatggtgagccgactcctgctgaacaggtttaccatgactcaccgccggccgacgatcgagaaagacgtcgacctcggtgcggggacccgccacgtcaacgccgagccagagactcccaacatggacgtgatcggggagcggatcaagcgcatcaaggaggagcacaactccacgtggcactacgacgacgaaaatccatacaagacttgggcctaccacgggagctatgaggtgaaagccacgggctctgccagctctatgatcaacggggttgtgaagctgctcaccaagccctgggacgtcgtgcccatggttacacagatggcgatgactgacaccactccgttcggacagcagcgggtcttcaaggagaaggtggacacgaggacgccgcggagcatgcccggcacgcgccgggtgatggggataaccgccgaatggctctggaggacgctgggaaggaacaagaagccccgcctgtgtacccgcgaggagttcaccaagaaggtccggaccaacgccgccatgggggcggtattcacagaagaaaaccagtgggacagtgccaaggccgccgtggaagacgaggacttctggaagctcgtcgaccgagagcgagagctgcacaagctaggcaagtgcggctcctgcgtgtacaacatgatgggcaagcgcgagaagaagctcggcgagttcgggaaggcgaagggcagccgggctatctggtacatgtggctgggggcccgctacttggaattcgaagccctcggctttcttaacgaggaccactggttctcccgggagaactcttactctggggtggagggcgagggcctgcataagctcggctacatcctgcgcgacattagcaagatccccggcggtgccatgtacgccgacgacaccgcgggctgggacacccggatcaccgaagacgacctgcacaacgaggagaaaataactcagcagatggacccggagcaccgccagttagccaacgccatcttcaagctgacttaccagaacaaggtagtaaaggtgcagcgtcctaccccaacgggaaccgtcatggatataatatcccgtaaggaccaacgggggagcggtcaggtgggtacttacggactgaatacattcaccaacatggaggcccagctcatccgccagatggagggtgagggcgtgttatccaaggccgacctggagaacccgcacctcccggaaaagaagataacccagtggctagagaccaaaggcgtggagagacttaaacgcatggcgataagcggggacgactgcgtcgttaagccgatcgacgaccggttcgccaacgccctcctggccctgaatgacatgggcaaggtccggaaggacattccgcagtggcagccctccaaggggtggcatgactggcagcaagtcccgttctgcagccaccactttcacgaactcatcatgaaggacgggcggaagttagtagtcccgtgccgcccccaggacgagcttatcgggcgggcccgcatctcccagggcgcgggatggagcctcaaagagaccgcatgcctgggaaaagcatacgcccagatgtggagtctgatgtacttccacagacgggacctccgcctcgccagcaacgccatttgctccgccgtacccgtgcactgggttccgacctcccggaccacttggtctatccacgcccaccaccagtggatgaccaccgaggacatgctgaccgtgtggaaccgcgtttggatcgaagacaacccctggatggaagacaagacgcccgtgaccacctgggagaacgtgccctacctaggcaagcgagaagaccaatggtgcgggagcctgatcggcctgacctcacgcgccacttgggcgcagaacattccgaccgccatccaacaggtccggtccttgatcgggaacgaggagttcctggactacatgccgagcatgaaacgcttccggaaggaggaggagtccgagggcgctatctggtga

SEQ ID NO: 25866 - RNA, 9873 nt, synthetic construct
  misc_feature 1..9873: note = derived and/or modified CDS sequence (opt11) from DENV-3__JF937623__SS-prME
  source 1..9873: mol_type = other RNA
gccagcctgtgcctcatgatgatcctgcccgccgcccttgccttccacctcacgtcgcgggacggcgaacccaggatgatcgtgggtaagaacgaacggggcaagagcctgttattcaagaccgcatcagggatcaacatgtgtaccctcatcgccatggacttgggcgaaatgtgcgacgacaccgtgacctacaagtgcccccacattaccgaagtggagccagaggatatcgactgctggtgcaacctgacgagcacctgggtgacctacgggacctgcaaccaggcaggcgagcaccgacgcgacaagcggagcgtcgcgctcgcgccccatgtgggcatggggttggacacacgcacccagacctggatgagcgccgagggcgcctggcgccaggtggagaaggtcgagacctgggcgctgcgccacccggggttcacgatcctcgccctgttcctggcccactatatcgggacttccctcacccagaaggtggtgatattcattctcctcatgctcgtcactccctctatgacgatgcggtgtgtcggggtcggcaaccgcgacttcgtcgagggcctgagtggcgccacctgggtggatgtggtcctggagcatggcgggtgtgtcaccaccatggccaagaataaacccacgctcgacatcgagctgcagaagaccgaggcgacccagctggctactctccggaagctgtgcatcgagggcaagatcacaaacataaccacagacagtcgctgcccgacccagggcgaggccacgctgccggaggagcaggaccagaactacgtgtgcaagcatacctacgtcgaccgggggtggggcaacgggtgcggcctcttcgggaaggggtccctcgtaacctgcgccaagttccaatgcctggagcccatcgagggcaaggtagttcaatacgaaaacttaaagtacaccgtgataatcacggtgcacaccggcgaccagcaccaggtcggcaacgagacgcagggggtgaccgccgaaatcacgccacaggcgagcacaaccgaggccatcctgcccgagtacggcacactggggttagagtgctccccgcgcaccggcctggacttcaacgagatgatcttgctcacaatgaaaaacaaggcctggatggtccaccggcagtggttctttgacctgcccctgccgtggaccagcggtgctaccaccgagacgcccacctggaacagaaaggagctcctggtgaccttcaagaacgctcacgcgaagaaacaggaagtggtcgtactggggtcccaggagggcgccatgcacaccgccctcacgggcgcgaccgagatccagaactcgggcgggacctccatcttcgctggccacctcaaatgccgtcttaagatggacaaactcgagctgaagggcatgtcttacgctatgtgcaccaacacgttcgtgctcaagaaggaggtctccgagacacagcacgggaccatcctcatcaaggtggagtacaagggtgaagacgtgccttgcaagatccctttcagtaccgaggacgggcagggcaaggctcacaacggccgtctgataacggctaaccccgtagtgacgaagaaggaggaacccgtgaacatcgaggccgaaccgcccttcggggagagcaacatcgtcataggcatcggggacaacgcgctgaagatcaactggtacaagaaaggttccagcatcggcaaaatgttcgaggccaccgctcggggcgcacgccgtatggccatcctgggcgacaccgcgtgggacttcgggagtgtaggaggggtgttgaactcactaggcaagatggtccaccaaatcttcggttccgcatacacggccctgttcagcggcgtatcctgggtgatgaagatcggcatcggtgtcctcctgacctggatcggcttgaacagcaagaacacctccatgagcttctcctgcatagccatcgggatcatcaccctctacctgggggcggtggttcaggcggacatggggtgcgtcattaattggaagggcaaggagctgaagtgcggcagtgggatattcgtaacgaacgaggtgcacacttggaccgagcaatacaaattccaggccgactcacccaagcgactcgccaccgccatcgccggcgcctgggagaacggcgtctgcggcatacgctcaacgacccgcatggagaacctactgtggaagcagatagccaacgagctcaactacatcctgtgggagaacaatatcaagctgaccgtcgtggttggggatatcatcggcgtgcttgagcagggcaagcgcaccctgactccccagccgatggagttaaagtattcttggaagacctgggggaaggccaaaatcgtgaccgccgagacgcagaactctagcttcatcatcgacggccccaacacgcctgagtgccccagcgtcagccgggcatggaacgtctgggaggtagaggactacggtttcggcgtcttcaccaccaacatctggctcaagctgcgcgaggtgtatacccagctatgcgatcaccggctcatgagcgccgccgtgaaggacgagcgcgccgtccacgctgacatgggctactggatcgagagccagaaaaacgggtcctggaagctggaaaaggcgtctctaatcgaggtcaaaacctgcacgtggcctaagtcccataccttgtggagcaacggcgtgctggagtccgatatgataatcccaaagtcgcttgccgggccaatatcccagcacaaccatcggccgggctaccacacccagaccgccgggccctggcacctcggcaagctggagctggacttcaactactgcgagggcacgaccgtcgtgatcacagagaactgcgggacacgaggccccagcctccggacgaccaccgtctccgggaaacttatccacgagtggtgttgtcgcagctgcacgctgcccccgctccggtacatgggcgaagatgggtgctggtacggcatggaaatccgccctatatcagagaaggaggagaacatggtcaagtccctggtgtccgccgggagcgggaaggtggacaacttcacgatgggggtcctgtgcctcgccatcctgttcgaggaggtgatgagaggaaagttcggcaagaagcacatgatcgcgggaatcttcttcaccttcgtgctgctcctgagcggccagattacctggcgcgacatggcccacaccctgatcatgatcggaagcaacgcctcggaccggatgggtatgggcgtgacgtacctcgccctgatcgcaacgttcaaaatccagcccttcttagcgctcgggttcttcctgcgcaagctgacctcccgggaaaacttactgctgggcgtgggcctcgccatggccaccacgctgcaactgccggaggatatagagcagatggcgaacgggatcgccctcggcctcatggccctgaaactcattacccaattcgaaacgtatcaactgtggacggccctgatcagcttaacgtgctcaaacaccatcttcaccctgaccgtcgcctggcgcacggccaccctcatcctcgctggggtcagtctgctgccggtgtgtcagtcaagctccatgcggaagaccgactggctccccatggccgtagccgccatgggcgtcccgcccctcccgctgttcatattcggcctcaaggacacactgaagcgacgcagctggcccttgaacgagggtgtgatggccgtcggcctcgtgtccatcctggcgtcgtccctgctccggaatgacgtgcccatggccgggcccctcgtggcgggcggcctcctcatcgcctgctacgtgatcacgggcacaagcgccgatctcaccgtggaaaaggctgccgacatgacctgggaggaagaggccgaacaaacgggcgtctcccacaatctgatgatcaccgtggacgacgacggcaccatgaggatcaaggacgacgagaccgaaaacatcctcaccgtgctgcttaaaacggctctcctgatcgtgagtggcatcttcccgtattccattcccgcgaccttactcgtgtggcacacctggcagaagcagacccagcggagcggggtgctgtgggacgtcccgagcccgcccgagacgcagaaggcggaactggaggagggcatctaccgcatcaagcagcaggggatcttcggcaagacccaggtcggggtgggcgtccagaaagagggcgtgtttcacaccatgtggcacgtgacccgcggggcagtcctcacgtacaacggcaaacgcctggagcccaactgggccagcgtgaagaaggacctcatcagctatgggggagggtggcggctaagcgcacagtggcagaagggcgaggaggtgcaggtcatagcggtggagcccggcaaaaatcccaaaaacttccagaccatgcccgggaccttccagacgaccaccggcgaaatcggggccattgccctggacttcaagccaggaacctcgggctcacccatcatcaaccgcgaagggaaggtggttggcctgtacgggaacggtgtggtgaccaagaacggagggtacgtcagcggcatcgcccagactaatgccgagcccgatggtccgacccccgaactggaagaggagatgtttaagaagcggaacctaaccatcatggacctgcatcccggctccgggaagacacgcaagtatctgccggcgatcgtgcgagaggccatcaagcgccggctccgcaccctgatcctggcgccaaccagggtggtcgccgccgaaatggaagaagcgctaaagggcttacccatacgctatcagaccacagccactaagtccgagcacaccgggcgggagatcgttgacttgatgtgccatgctaccttcaccatgcgcctcctgtcccccgtgcgggtcccgaactacaacctaatcatcatggacgaggcccacttcacggacccagcaagcatcgctgcacgtggctacatctccacgcgggtgggcatgggagaggccgcggccatattcatgaccgccacgccacccggcacggccgacgccttcccgcagtcaaacgcccccatccaggacgaagaacgcgatatccccgagcgctcctggaacagcggcaacgagtggattaccgactttgcgggcaagactgtgtggttcgtcccatccataaaggcagggaacgacatcgctaactgtctccggaaaaacgggaagaaggtgatccagctgtctcgcaagactttcgacacggaataccaaaagactaagctgaacgactgggacttcgtggtcacgaccgacatcagcgagatgggcgccaacttcaaagccgaccgggtgatcgacccgcgcagatgcctgaagcccgtgattttgacggacgggccggagagagtcatcttagcgggacccatgcccgtgaccgccgccagcgccgcccagcggcgcgggcgggtgggcaggaatccccagaaggaaaacgaccagtacatcttcacagggcagccacttaacaacgacgaggaccacgcgcactggaccgaagccaagatgctgttagacaacatcaacacccccgagggcatcatcccagctttgttcgagccagagcgggaaaagtccgccgcgatcgatggcgagtaccgcctgaagggggagagccggaagacgttcgttgagctgatgcgccgaggcgacctccccgtgtggctggctcataaagtggcctccgaggggatcaagtacaccgaccgcaagtggtgtttcgatgggcagcggaacaaccagatcctggaggagaacatggacgtagagatatggacaaaggagggcgagaagaagaagctccgcccccgctggctggacgcccgcacctacagcgatccgctggccctcaaggagttcaaggagttcgcggctgggcggaagtccattgccctcgacctggtgacagagatcggtagagttccaagccacctcgcccaccgcacgcggaacgccctggacaacctggtgatgctccacacttccgagcatgggggccgcgcgtaccggcacgccgtggaggagctgcccgagacgatggaaacgctgcttctgctggggctcatgatcctgctgaccggtggcgccatgctgttcctgatctccgggaagggcattggtaagaccagcatcggcctgatctgcgtcatcgcctccagcgggatgctctggatggccgagatcccgttacagtggatcgcgtccgctatcgttctggagttcttcatgatggtgcttctgatccctgagcccgaaaagcagcgaacaccccaggacaatcagctggcctacgtggtgatcggcatcctgacgttggcggccatcatagcggccaacgagatgggcctactggagaccacaaagcgggacttagggatgagcaaggagccgggtgtagtcagccccaccagctatctggacgtagacctccaccccgcctccgcctggactctgtacgcggtggccaccaccgttatcacccccatgctgcgccacacgatagagaactcaaccgccaacgtgtctcttgccgccatcgcgaaccaggccgtggtccttatggggctcgataagggttggccgatcagcaagatggacctgggggtgcccctgctggccctaggctgttactcccaagtgaaccccctgacactgaccgccgccgtcttgctgctgatcacgcactacgcgatcatcggccccgggctccaagccaaggccacccgtgaggcacagaagcgcactgccgcgggtattatgaagaacccgaccgtggacgggatcatgaccatcgacttggaccccgtgatctacgacagcaagtttgaaaagcagctgggccaggtcatgctgctggtgctgtgtgccgtgcaactcctattgatgcggacatcctgggctctctgcgaggcactgaccctggcgacgggccccatcaccacgttgtgggaagggagccccggcaaattctggaacaccaccatagcggtctccatggccaatatcttccgagggagctacctggccggcgccgggctggccttctccatcatgaagtcggtgggcacggggaagaggggcaccggaagccagggggagaccctcggcgagaaatggaagaagaagctgaatcagttgagtcgcaaggacttcgacctctacaagaagtctgggatcacagaggtggaccggaccgaggccaaggagggcctgaagagaggcgagatcacgcaccacgcggtttcccggggcagcgccaagctgcagtggtttgtggagcgcaacatggtgatccccgagggccgggtcatcgacctcgggtgcggccgcgggggctggtcctactactgcgccggcctgaaaaaggtcaccgaggtgcgggggtataccaaaggcgggcccggccacgaggagcccgtccccatgagcacatacggatggaacatcgtgaaactgatgtccggcaaggacgtgttctatctaccgcctgaaaagtgcgacacgctgctgtgcgacatcggcgagagctcccccagccccaccgttgaggagtcccgcaccatccgcgtgctgaagatggttgagccttggctcaagaacaaccagttctgcatcaaggtattgaatccgtacatgcccaccgtgatcgaacacttggagcggttgcagcgcaagcacggagggatgctggtacggaatcccctgagccgcaactccacacacgagatgtactggatcagcaacgggacgggcaacatcgtcgcgtccgtgaatatggtgagccggctcctcctgaatcggttcaccatgacacaccggcgccccacgattgagaaggacgtggatttaggcgccgggacccggcacgtgaacgccgaacccgaaacgcccaacatggacgtgatcggcgagcgcatcaagcgaattaaggaggagcacaactccacctggcactacgacgacgagaacccgtacaagacgtgggcataccacgggtcttacgaagttaaagcgaccggctccgcgtcatccatgattaacggtgtcgtgaagctgttaaccaagccctgggacgtagtgccgatggtcacccagatggccatgacggacaccaccccgttcggccagcagagggtgttcaaggaaaaagtggacacccggaccccgcgcagcatgccaggcacccggcgggtaatgggaatcaccgcagagtggctctggcggaccctgggccgcaacaagaagccccggctgtgtacgagggaggagttcaccaaaaaggtccgcaccaacgccgcaatgggcgccgtattcaccgaggagaaccagtgggactcggccaaggccgccgtcgaggacgaggacttctggaaacttgtggaccgggaacgcgagctgcataagctgggcaagtgcggctcctgcgtgtacaacatgatgggcaaacgggagaaaaagctgggcgagttcggaaaggcgaagggcagccgtgccatctggtacatgtggctgggggcccggtacctggagttcgaggccctcggctttctgaacgaggaccactggttctccagagaaaactcttactccggggtagagggtgaaggcctgcacaagttggggtacatcttacgtgacatctccaagatcccgggcggggccatgtacgcggacgacactgcaggctgggacacccgcatcaccgaggacgacctgcacaacgaggagaaaataacgcagcagatggacccggaacaccggcagctggcgaacgccatcttcaagctgacgtaccagaacaaggtggtgaaggtccagcgccccaccccaaccggcaccgtgatggacatcatctcccgaaaggaccagcgcggaagcggacaggtggggacttacggcctgaatacgttcaccaatatggaggcccagctcattcggcagatggagggggagggcgtcctgagtaaggcggatctggagaacccccacctcccggagaagaaaatcacccagtggctggagaccaagggcgtggagcgcctgaagcgcatggccatcagcggggacgactgcgtagtcaagccaatcgacgaccgtttcgccaacgccttactggccttgaacgacatgggcaaggtgcggaaggacataccccagtggcagccctccaaagggtggcacgactggcagcaggtcccgttctgcagccaccacttccacgagctcatcatgaaggacgggcggaagctggtcgtgccctgtcggccccaggatgaattgatcggcagagcgaggatctcccaaggcgccggctggtctctcaaggaaacggcctgcctggggaaggcctacgcgcagatgtggagtttgatgtacttccaccggcgcgacctccggctggcctccaacgccatctgcagtgccgtgcccgtccactgggttccgactagcaggacgacctggtccatccacgcccaccatcagtggatgacgaccgaggacatgctgaccgtgtggaaccgggtctggatcgaggataacccgtggatggaggacaagaccccggtaaccacctgggagaacgtcccctacctcggcaagcgcgaggaccagtggtgcgggagcctgatcggtctgactagccgggcgacttgggcgcagaacatcccgacggccatccagcaggtccggtccctcatcggcaacgaggagttcctagactacatgccctcgatgaagcggttccgcaaggaggaggagtccgagggcgccatctggtga

SEQ ID NO: 25867 - RNA, 9873 nt, synthetic construct
  misc_feature 1..9873: note = derived and/or modified CDS sequence (opt11) from DENV-3__JF937637__SS-prME
  source 1..9873: mol_type = other RNA
accagcctgtgcctgatgatgatcttacccgcagccctagcgttccacctgaccagccgggacggcgaacccaggatgattgtggggaagaacgaacggggcaagagcctgctgttcaagaccgcgagcgggatcaacatgtgcaccctcatcgccatggatctgggcgaaatgtgcgacgataccgtgacatacaagtgcccccacatcaccgaggtggagccggaagacatcgattgttggtgcaatctgaccagcacatgggtaacgtatggcacgtgcaaccaggccggagagcaccgaagagacaagcggtccgtcgcactcgcgccgcacgtgggcatggggttagacacaagaacccagacctggatgtcagccgagggggcctggaggcaggttgagaaggtggagacgtgggccttacgccacccggggttcacaatcctagcgctgttcctcgcccactatatcggcacttccctcacacagaaggtagtgatcttcatcctgctaatgctggtcacgccaagcatgaccatgcggtgcgtgggcgtgggcaaccgcgacttcgttgaaggcctgtccggggccacctgggtggacgtggttctggagcacggcgggtgcgtgacgacaatggccaaaaacaaaccaacacttgacatcgagttacagaagaccgaggcaacccagttagcgacacttaggaagttatgcatcgagggcaagatcacaaacataaccaccgacagcagatgccccacccagggcgaggctaccttaccggaagaacaggatcagaactacgtgtgcaaacacacctacgtcgatcgtgggtggggcaatggatgtggactcttcgggaaaggcagtctggtgacctgcgccaagttccagtgtctggagcccatcgagggcaaggtggtccagtatgagaacctgaaatacacggttatcataacagtacacaccggggatcagcaccaggtgggtaacgagacccagggggttactgccgagatcacaccccaggcctcaaccaccgaagccatcctccccgagtacggcactctggggctcgagtgctccccgcgcaccggtctcgatttcaatgagatgattcttctcaccatgaaaaacaaggcctggatggtccaccggcagtggttctttgacctgccgctgccctggaccagcggtgccactacggaaacgccgacctggaatcgcaaggaattgctggttacatttaagaacgcccacgccaagaaacaggaggtggtcgtattggggtcccaggagggtgcgatgcacacggccctcacaggggccacggaaatccaaaatagtggcgggacctccatcttcgccggccatcttaagtgtcggctgaagatggataagctcgagctgaaaggtatgagctacgcgatgtgcacgaacgcgttcgtacttaagaaagaagtatcggagacccagcacgggacgatcctcataaaggtggaatacaagggcgaggacgtgccatgtaagattccctttagcacggaggatgggcagggcaaggcacataacggccggctgataacggcgaaccccgtggtgaccaaaaaggaggaacccgtgaacatagaagcggagccgcccttcggggagagcaacatcgttatcggcattggagacaacgcgctgaagataaactggtacaagaagggttccagcatcgggaagatgttcgaggcaacagcccggggcgcgcgcaggatggccatcctgggcgacacggcgtgggatttcgggtccgtgggcggggttttaaacagcctgggaaaaatggtccaccagatatttggatcggcctacacggcgctgttcagcggagtgtcctgggtaatgaaaatcggcatcggggtgctcttgacatggatcgggctgaatagcaagaacacctccatgagcttctcctgcattgccatcggcatcatcaccctatacctgggcgccgtggtgcaggctgacatggggtgcgtcataaactggaaaggcaaggagctgaagtgcggttccgggatctttgtgaccaacgaggtgcacacctggacagagcagtacaaattccaggctgacagcccgaagcgcttagcgactgccatcgccggcgcgtgggaaaacggggtctgcgggattcgcagcacgactcggatggaaaatttattatggaaacagatcgccaacgagctcaactatatcctgtgggagaacaatattaagttgaccgtggtcgttggggacatcatcggcgtgctcgagcaggggaagcgtaccctgacgccccagccgatggaactgaagtactcctggaagacctgggggaaagccaaaattgtgaccgcggagacccagaacagctctttcatcatagacggccccaatacgccggaatgccccagcgtctcgagggcgtggaatgtgtgggaggtggaggattacgggttcggcgtcttcacgacaaacatttggctgaaacttcgcgaagtgtatacccagctgtgcgaccaccgtttgatgagcgccgccgtcaaagacgaacgcgcggtccacgcagatatgggatactggatcgagagccagaagaatgggtcctggaaactggagaaagctagcctcatcgaggtgaagacctgcacgtggccgaagtcccacacgctctggagcaatggggtgctcgaatccgacatgataattcctaagagcctggccgggcccatctcccagcacaatcaccgcccgggctaccatactcaaaccgcagggccctggcatctgggtaagttagaactggacttcaactactgtgagggcacgaccgtcgtgatcacggagaactgcgggaccagaggccccagcttgcggacgactaccgtatccgggaaactgatacacgagtggtgctgccggtcttgcacactgcccccgctccggtacatgggcgaggacgggtgctggtacggcatggagatccggcccatcagtgagaaggaggagaacatggtgaagtcattggtgtccgcaggaagcggtaaggtggacaacttcacgatgggcgtactgtgcctcgcaatcctgttcgaggaggtcatgcggggaaagttcggcaaaaagcacatgatcgcaggggtgttctttaccttcgtcttgctcctgtccggccaaatcacctggagggatatggcccacacgcttatcatgataggcagcaacgccagcgatcggatggggatgggcgttacgtacctcgccctgatcgcgacctttaagattcagccgttcctggcgctaggctttttcctgcgcaagctgacctcaagagagaatctcctactgggggtcgggctcgccatggcaaccacgcttcagctgccagaggacattgagcagatggcgaacgggattgcgctaggcctcatggcgctgaaactaatcacccagttcgaaacctaccagctgtggaccgccctcatcagcctcacttgcagtaatactatctttaccctgaccgtagcctggcgcacggccaccctgatcttagcgggggtatcgttgctgccggtctgccagagcagttccatgcggaaaactgattggctacccatggccgtagcagccatgggtgtaccgccccttccgctgttcatattcgggttaaaggacacgctgaagcgccggtcgtggcccctgaacgagggcgtcatggcagtgggcttagtgagcatcttagccagctcactgctccggaacgatgtccccatggcagggccgctcgttgcgggcggacttttaatcgcttgctacgtcatcacgggaacatcggccgacctcaccgttgagaaggcggctgacatcacctgggaggaggaagccgaacagacgggtgtgtcacataacctgatgatcactgtggacgatgacgggaccatgcgcatcaaggacgatgagaccgagaacattttgaccgtcttgcttaagacggcactcttaatagtaagcgggatcttcccatactccatccccgccaccttgctagtgtggcacacctggcaaaaacagacccagcggagcggtgtcctttgggacgtgccgagcccgcccgaaactcagaaggctgagttagaggagggcgtgtaccgcataaagcagcaggggatcttcggcaagacccaggtcggtgttggcgttcagaaggagggcgttttccacaccatgtggcacgtgacccgaggcgcggtgctaacgtataacggcaaacgtctggagccgaactgggccagcgtcaaaaaggatctgatctcctatgggggcgggtggcggctcagcgcccaatggcagaagggcgaggaggtccaggtgatcgcggtcgagcctggcaagaaccccaagaacttccagaccatgcccgggacattccagaccacgaccggcgagatcggggctatcgctctggactttaagcccggcacctccgggagccccataatcaaccgcgaaggaaaggtggtgggactgtacgggaatggcgtcgtgaccaaaaacgggggctacgtttcgggcatcgcacagacgaatgccgaaccggacgggcctacccctgagttagaagaggagatgttcaaaaagcggaacctcacaatcatggatctgcaccccggttctggcaagacccgcaagtatcttcctgcgatagtccgtgaggccataaagcgacggctcaggacgctgatcctggcccccacccgagtggttgccgccgagatggaggaggcactcaaggggcttcccatccggtaccagaccaccgcgacaaagtccgagcatacagggcgggagatcgtagacctgatgtgccacgccaccttcaccatgagactgttgtcgcctgtgcgcgtgccgaactacaaccttatcatcatggatgaggcccatttcactgaccccgccagtatcgctgcaaggggctatatttccacccgcgtcggtatgggtgaggcagccgcgatcttcatgaccgcgactccaccggggacggcggatgccttcccgcagagcaacgcacccatccaggatgaggaacgcgacatccccgagcgttcatggaacagcggaaacgagtggatcaccgactttgcgggtaagactgtgtggttcgttccatccataaaggccggaaacgatatcgccaactgcctccggaagaacggcaagaaggtaatacagttgtcgcgcaaaacgttcgatactgagtatcaaaagaccaagttaaacgattgggactttgtggttaccaccgacatttccgagatgggcgccaattttaaggccgaccgtgtcatcgacccgagaagatgcctcaaaccagtgatcctaacggacggccccgagcgcgtaatcttggcagggcccatgcccgtcaccgccgccagcgccgcgcagcggcgcggtcgggtgggtcgaaacccccagaaagagaacgaccagtacatcttcaccgggcagcccctcaacaacgacgaagatcacgcccattggaccgaggccaagatgctgctagacaacatcaacacccccgaaggaataatcccggccctgttcgagcctgagcgagagaaaagtgccgctatcgacggcgagtacaggttgaagggggagagccggaagacgtttgtggagctaatgcgtcggggcgacctgcccgtctggcttgcccacaaagtggccagcgaggggatcaagtacacggacaggaaatggtgttttgacggacagcggaacaaccaaatcctcgaagagaacatggatgttgagatctggaccaaagagggagagaaaaagaagctccgcccccggtggctggacgcccgcacctactctgacccgctggccctcaaagagttcaaagagttcgcagctggccgcaagtctatagccctggacctagtgaccgagatcggccgggtacccagccacctcgcacaccgcacacgcaatgccctcgacaacctagtcatgctccacacatccgagcacggtggcagggcgtatcggcacgcagtcgaggagctgcccgagaccatggaaactctgctcctgctggggctcatgattctgctgaccggaggcgccatgctgttcttaatcagcggcaaaggcatcggtaagaccagcattggcttaatttgcgtgatagccagttccgggatgctctggatggccgagatcccactgcagtggatagcttccgctatagtcctggaatttttcatgatggtgcttctaatccccgagcctgaaaagcagcggacgcctcaggacaaccagctggcctacgtggtcataggaattttgacgctcgccgccatcatcgcggccaacgagatgggcctgctagagaccaccaagcgggatttagggatgtcgaaggagccgggcgtagtcagccctaccagctacttggatgtcgaccttcatcccgcatccgcgtggacgttatatgccgtggctaccacagtaattacgcccatgctgcgccatacgatagagaacagcaccgccaatgtctccctcgcagccatcgcgaaccaggccgtggtgttgatggggctggacaagggctggccaatctcgaaaatggacctcggggtccccctgctggccctcgggtgctactcccaggtgaaccccctgaccctgaccgccgccgtgctcttactgatcacgcactacgcgatcatcggcccaggtctccaggccaaagccacccgggaggcgcagaaacgcaccgccgcgggcattatgaagaacccaacagttgacgggatcatgacgatagatctggatcccgtgatctatgatagcaagtttgagaaacaactgggacaggtgatgctccttgtactgtgcgccgtccagctcttgcttatgcggacctcctgggccctctgcgaggccctaaccctggctaccggccccatcacgacactctgggaagggagccccggcaaattttggaacaccactatcgcggtttccatggcaaacatcttccgcgggtcgtacctggccggcgccggattggcgttctcaattatgaagtccgtcggtacggggaagagggggaccggctcccaaggagagaccctaggcgagaaatggaagaagaagttaaaccaactcagccgcaaggacttcgatctttacaagaagtccgggatcacagaggtggaccggacagaagccaaagagggtctgaagcgcggcgaaatcacccaccacgcagtatcccgcgggtcagccaagctacagtggttcgtcgagcgcaatatggttataccagaaggcagggtgatcgatctcgggtgcggtagagggggctggtcctactactgcgccggcctgaagaaagtcacagaggtgcgggggtacaccaaaggcgggcccggccatgaggaacccgtgccgatgagcacttacggctggaacatagtcaagctgatgtccggcaaggacgtgttttacctgcctcctgagaaatgcgacactctgctgtgtgacataggcgaaagctcgccctctcctaccgtggaagagtcccgcacaatacgagtcctaaagatggtggaaccgtggctcaagaataaccagttctgcataaaggtgctgaatccctacatgcctaccgttatagaacacctggaaagattgcagcgcaagcacggtggaatgctggttagaaaccccctgtcgcgcaactccacgcacgagatgtactggataagtaatgggactggcaatatcgtggcgagtgtcaatatggtgagccggttactgctgaaccggttcactatgacccaccggcgccctacaattgaaaaggacgtggacctcggcgccggcacccgccacgtcaacgcggaacccgagacacccaacatggacgtgatcggagagcgaatcaagagaatcaaggaggaacataactccacctggcactacgacgacgagaacccgtacaagacgtgggcctatcacgggagctacgaggtgaaggcaaccggaagcgcgagctctatgattaacggggtggtgaaactgctcacgaagccttgggacgttgtacctatggtaactcagatggccatgacggacaccaccccttttggacagcagagggtgttcaaggaaaaggtggacacccggacgccacgtagcatgccgggcactcggcgagtgatggggatcaccgccgagtggctctggcggacattgggacgcaacaaaaagcctcggctttgtacgcgggaggagtttacgaagaaagtgcgcacaaacgccgcgatgggggcagtcttcacagaggagaatcagtgggactctgcgaaggccgcggtagaagatgaggacttttggaaactcgtcgatagggagcgcgagctgcataagctgggcaagtgcggtagctgcgtgtacaatatgatgggaaagcgggaaaagaagttaggcgagttcgggaaggccaagggcagccgggccatctggtatatgtggcttggggcccgctacctggagttcgaggccctgggattcttgaacgaagaccactggttcagccgcgagaacagttattctggagtggaaggcgagggcctgcacaaactcgggtacatactgcgggacattagcaagatccccggcggggccatgtacgctgacgacacggcgggctgggacacccgcatcactgaagacgacttacataacgaagagaaaatcacccaacaaatggaccccgagcacaggcagttagccaatgcaatcttcaaactcacgtatcagaacaaggtcgtgaaggtacagcgccctacccccaccggcactgttatggacatcatcagtcggaaggaccagcgcgggagcggccaagtagggacctacggattgaacacgttcaccaacatggaggcccagctcatcagacagatggaaggggaaggagtgttactgaaggcggacctggagaacccccatctccccgagaagaaaatcacgcaatggttagagaccaagggcgtggagcgcttgaagcggatggctatttccggggacgactgcgtggttaaaccaattgacgacagatttgccaacgccctgctggcgcttaacgacatgggaaaggtcaggaaggacatcccgcagtggcagccgagcaaggggtggcacgactggcaacaggtgcccttctgcagtcaccacttccacgagctaattatgaaagacgggagaaaacttgtggttccctgccgccctcaggacgaactcatcgggcgcgcacggatctcgcaaggcgcaggctggtccctgaaggaaacggcctgcctagggaaggcctacgcgcagatgtggagcctcatgtacttccaccgccgcgacctgcggctggcctccaatgcgatctgcagcgctgttcccgtgcactgggtcccgaccagtcgcaccacctggagcatccacgcccaccatcagtggatgacgactgaggatatgctgaccgtgtggaaccgggtttggatcgaggataatccctggatggaagacaagacccccgtcacgacgtgggagaacgtgccctacttagggaagcgggaggaccagtggtgcggctccctgatcggcctcaccagcagagcaacctgggcccagaacatccctacggccatccaacaggtgaggtccctgatagggaacgaagagttcttggactatatgccctccatgaagcggtttcgcaaggaggaggagagcgagggcgccatctggtga

SEQ ID NO: 25868 - RNA, 9873 nt, synthetic construct
  misc_feature 1..9873: note = derived and/or modified CDS sequence (opt11) from DENV-3__JF937638__SS-prME
  source 1..9873: mol_type = other RNA
accagcctgtgcctcctgatgattctgcccgccgcgttggcctttcatctgacctcacgagacggcgagccacggatgatcgtggggaagaacgagagaggaaagagcctgctgttcaaaactgcctccgggatcaatatgtgcaccctgatcgccatggatctgggcgagatgtgcgacgacaccgtgacatacaagtgccctcacatcacggaggtagaacccgaggacatagactgctggtgcaaccttacgagcacgtgggtgacttacggaacgtgtaaccaggccggcgagcatcggcgagacaagcggtccgtcgccctggctccacacgtaggcatgggtctcgacacacgcacccagacatggatgagcgccgagggtgcctggcgacaggtggagaaggtggaaacgtgggccttgcgccatccgggatttaccatcctcgcgctgttcctcgcccactatatcgggacgagcctgacccagaaggtggtaatcttcattctgcttatgctggtaacacccagcatgaccatgaggtgcgtgggggtgggcaatcgggacttcgtcgagggcctgtccggggccacctgggtggacgtggtcctcgaacatggtgggtgcgtgacgacgatggccaaaaacaagccaaccctagacatcgagctgcagaagacggaggctacccagctagcgaccctacggaagctatgtatcgagggaaagatcaccaacatcaccaccgacagccggtgccccacgcagggcgaagctacccttccggaggagcaggaccagaactacgtgtgcaagcacacatacgtggaccgggggtgggggaatgggtgcggcttgtttgggaagggctccctggttacctgtgccaaatttcagtgcctcgagcccatcgagggaaaggtcgtccagtacgagaatctcaagtacacggtcatcataaccgtgcacaccggggaccagcaccaggtcggcaacgagactcaaggggtcacggccgagatcacgccccaggctagtaccacagaggcaatcctgcccgagtatgggactttggggctggaatgctccccgaggacggggcttgattttaacgagatgatcctgttgaccatgaagaacaaagcatggatggttcaccggcaatggttcttcgacttaccactcccctggaccagcggcgcaacgacggaaacccccacgtggaaccgcaaggaactgctagttaccttcaagaatgctcatgccaagaagcaggaagtcgtcgtgcttgggagtcaggagggcgcgatgcacacggctctgaccggggctaccgagatacagaacagcggcgggacctccatcttcgccggccaccttaagtgtaggctcaagatggacaagctggagctgaagggcatgagctatgccatgtgtaccaacacgttcgtgctcaagaaggaggtaagtgaaacccaacacgggaccatcttgatcaaggtggagtacaagggcgaggacgtgccgtgtaagatccctttttccacggaggacggccagggcaaggcgcacaacggccgcctgatcaccgctaaccccgtcgtgaccaagaaagaggagcccgtgaatatagaggccgagccccccttcggggagtccaacatcgtcatcggcatcggggacaacgctctcaagatcaactggtacaagaagggctcatcgatagggaagatgtttgaggcgaccgcgcgaggcgcccgcaggatggccatcctcggcgataccgcatgggatttcggttctgtgggcggggtgctgaactctctgggcaaaatggtacatcagatattcgggtcggcgtacaccgccctcttcagcggcgtctcctgggtgatgaagatcggaatcggggtcctgttgacctggattggcctcaacagcaagaacaccagcatgagcttctcctgtatcgccatcggcattataacgctctatctgggcgcggtggtgcaagccgacatgggatgcgtcatcaactggaagggcaaggagctcaagtgcggatccgggattttcgtgacgaacgaggtgcacacctggaccgaacaatacaagttccaggcggactcccccaagcgcttggctacggccatagctggcgcgtgggagaacggggtttgcgggatcagatccaccaccaggatggagaacctgctctggaagcaaatcgcgaacgagctgaactacatcctgtgggaaaataacatcaagctgacagttgtggtcggggacattatcggcgtgctggaacaaggtaaacgcacgctgactccccagccgatggagttgaagtactcctggaagacctggggcaaggcgaaaatcgtgaccgccgagacacagaacagctcatttataatcgacgggcccaacacgcccgagtgccccagcgtctcccgtgcctggaacgtttgggaggtggaggattacggctttggggtcttcacaaccaacatttggctgaagttacgcgaggtgtacacccagctctgcgaccaccgactgatgagcgcggctgtcaaagacgagcgcgccgtgcacgccgatatgggctactggatcgagagccagaagaacggtagttggaagctggagaaggcctccctcatagaagttaagacctgcacctggccaaaaagccatactttatggagcaacggagtgttggagtccgatatgatcatccccaaaagcctggcggggcccatctcccagcacaaccaccggccgggctaccacacccagacagcagggccctggcacctcggcaagctagagttagactttaactactgcgagggcaccaccgtcgtgatcactgagaactgcgggacgaggggccccagcctgcggaccaccaccgtgtcagggaaattgatccacgaatggtgctgccgcagctgcacgctgccgcccctgcgatatatgggcgaggacggctgctggtacgggatggagatccgccccatctcggagaaggaggagaacatggtgaagagcctagtttccgccggctccgggaaggtggataacttcacaatgggcgtcctgtgcttggccatcctgttcgaggaggtgatgcgggggaagtttggcaagaagcacatgatcgctggggtgttcttcactttcgtcctcctgctgagtggccagatcacctggcgcgacatggcgcacaccctcatcatgatcggctccaacgcctccgatcggatggggatgggcgtgacatacctggccctgatcgccaccttcaagatccagcccttcctcgcactggggtttttcctccgccggctcaccagcagggagaatctgctgctcggcgtaggcctagcgatggcgaccaccttacaactccccgaggacatcgagcagatggctaacgggatcgccctgggcctgatggctcttaagctgattacgcagttcgagacctaccagctgtggacggcactcatcagtctgacctgcagtaacaccatcttcaccctgacggtcgcctggcggaccgccacattgatcttagccggggttagcttactcccagtctgccgctcctcttccatgcgcaagaccgactggctgccaatggcggtcgccgccatgggcgtgccgcccctgccgctcttcatattcagcctcaaggacacgctgaagcggcgctcgtggccactaaacgagggggtcatggccgtaggcctcgtgtcgatcttagcctcctccctcctacggaacgacgtccctatggcgggaccccttgtggccggcggccttctgatcgcctgttacgtgatcacagggacctcagccgacctgaccgtcgaaaaggccgcggacataacatgggaggaggaggccgagcagaccggcgtgtcacataacctaatgatcacggtggacgacgacgggaccatgcgcataaaggatgatgagacggagaacatcttaacggtcctgctcaaaaccgccctgctcatagtctccgggatcttcccgtactcaatccccgccaccctcctggtttggcatacctggcagaagcaaacgcagcggagcggcgtcctgtgggacgtaccgtccccgcccgagacgcagaaggccgagctcgaggagggcgtgtaccgcatcaagcagcaggggatcttcgggaagacacaggtcggcgtgggggtgcagaaggagggcgtctttcacaccatgtggcacgtgacgcggggcgcggtgctgacttacaatgggaagcgccttgagcccaactgggcctccgtaaagaaggaccttatcagctacggcgggggttggaggctgagcgctcagtggcagaagggggaggaggtccaggtcatcgccgtcgagcccggcaagaaccccaaaaacttccaaaccatgcccggcaccttccagacgaccaccggggagatcggcgcgatcgccctggacttcaagcccgggacctccggcagtcccataatcaaccgtgagggcaaggtggtcgggctttatggcaacggggtcgtgacgaaaaacggggggtacgtttctggcatcgcgcagaccaacgcagaacctgacggccccacccccgagctcgaagaggagatgttcaagaagcgtaacctgacgatcatggatctgcaccccggatcgggtaaaacgcgaaagtacctccccgcgattgtccgggaggccattaaacgccggctgagaacgctgatccttgcccccacccgagtggtcgccgccgagatggaggaggccctcaaggggctgccaatccgctatcagactaccgcgacaaaatccgaacataccggtagagagatcgtcgatctcatgtgccacgcgactttcacgatgcggcttctgagtcccgtgcgtgtgcctaactacaaccttatcatcatggacgaagcacacttcaccgaccccgcaagcatcgccgcgcgggggtacatcagcactcgcgtaggcatgggcgaagccgccgcaatcttcatgacggctacgccgcccgggaccgccgatgcatttccacagtccaatgcccccatacaggacgaggaacgggatatccccgagcgcagctggaactccggcaatgagtggatcactgacttcgccgggaaaaccgtttggttcgttccgagcatcaaagcgggcaacgacatcgccaattgcctccggaagaacggtaaaaaagtcatccagttgtcccgcaaaacgtttgacacggagtaccagaagaccaagttgaacgactgggacttcgtggttacaacggatataagtgagatgggcgctaacttcaaggccgatcgggtcatcgacccgaggcggtgtctcaagcccgtgatcttgaccgacgggcccgagcgcgtgatcctcgccgggccaatgccagtcactgcggcgagtgcagctcagcggcgcggccgggtgggacgcaacccccagaaggaaaacgaccagtacatctttactggccaaccccttaacaacgacgaagaccacgcccactggaccgaggcgaagatgcttctagacaacatcaacacgcccgaggggataatcccggccctgtttgagccggaacgggagaagtccgccgccatcgatggcgagtaccgcctgaagggcgagtcgagaaaaacgttcgtggagctaatgagaaggggtgatctgcccgtctggctcgctcacaaggtggcctcggagggcatcaagtacactgacaggaaatggtgcttcgacgggcaacggaacaaccagattctcgaagagaacatggatgtcgagatatggacaaaggaaggcgagaagaaaaaactgcgccccaggtggctggacgcccggacttacagtgacccgctcgccctgaaggaattcaaggagtttgccgcgggccgcaagtcgatcgccctggacctggtaaccgagatagggcgggtgccctcccacctggcgcatcgcactcggaatgccctggacaacctagttatgctgcacactagcgaacacggagggcgcgcctaccggcacgcggtggaggagttgccagagacgatggagaccctgctgctgttaggcctcatgatcctactcaccgggggtgccatgcttttcctcataagtggcaaagggatcggaaagacttccatcgggctcatctgtgttatcgccagctccggcatgctctggatggctgaaatcccgctgcagtggatcgccagcgcgatagtcctcgagtttttcatgatggtgctgttgattcccgagcccgagaaacagcgcacgcctcaggacaaccagctcgcatacgtggtcatcgggatcctcacactggccgcaatcatcgcggcaaacgagatggggctcctggagaccaccaagcgggacctgggcatgtccaaagagccgggggtggtcagccccacgtcctacctcgacgtcgacctgcacccagctagtgcctggacactctacgcagtggctaccaccgtgatcacgcccatgctccgccacaccatcgaaaattccaccgctaatgtcagcctagccgcgattgcaaaccaggcggttgtgctgatgggcctcgataaggggtggccgatctccaagatggatctgggggtccccttgcttgcgctggggtgctatagccaagtgaaccctctgaccctcacggcggctgtgctgctgctcatcacccactacgccataatcggtcccggtctgcaggcgaaggccacccgggaagcccagaaaaggaccgccgccgggataatgaagaacccgacggtagatggaattatgaccatcgaccttgaccctgttatatacgactcgaagttcgagaagcagctcggccaggtgatgctgctagtcctctgcgccgtgcagctgctgctcatgcgcaccagctgggccctttgcgaggccctgacccttgccaccgggcccatcactacattatgggaggggtcccccgggaagttctggaacactacgatcgcggtgagcatggccaacattttccggggatcctacctggccggggcgggcctagccttctctatcatgaagtccgtcgggacaggcaagcggggcactgggagtcagggcgagacgctgggagaaaagtggaaacgtaagctgaaccaactcagccggaaggattttgacctgtacaaaaaatccggcatcaccgaggttgaccgcacggaagcgaaggaggggttgaaacgaggcgagatcacccaccacgccgtgagccgcggctctgctaagctgcagtggttcgtcgaacgcaacatggtgacgccggaggggagggtaattgaccttggctgtgggcggggtgggtggagctactattgcgccggcctaaagaaggttaccgaggtgcggggctacacgaagggcgggcccggtcacgaggagccggtacccatgtcaacttacggctggaacatcgtcaaactcatgagcgggaaggacgtcttttacttaccgcccgaaaagtgtgacaccctgttgtgcgacatcggcgagtccagcccctctcccaccgtagaggagagcagaacgatccgggttctcaagatggttgagccctggctgaagaacaatcagttctgcatcaaggtgctgaacccttacatgcctaccgtaatcgagcacctcgaacgcctgcagcggaagcacggcggcatgctggtgcgcaaccccctttcgcgaaacagcacgcacgagatgtactggatctcgaatggaaccgggaatatcgtggcctcagtcaacatggtcagcagactcctgctcaacagattcacgatgacccacagacggccgacgatcgaaaaggacgttgatctgggcgctggcacccgccacgtcaacgcagagcctgaaacacccaacatggatgttatcggggagcggatcaaacgcataaaggaggagcacaacctgacctggcactacgacgacgagaacccttataaaacgtgggcataccacggcagttacgaagtcaaagccacggggtccgcttcatccatgatcaacggcgtcgtgaagctcttgaccaagccctgggacgtcgtgcctatggtgactcaaatggctatgacggataccacaccctttgggcagcagagagtattcaaggagaaagtagacacccgcactccgcggagcatgcctggcactcgccgggtgatgggcataacggcagaatggctgtggcgcaccctgggaagaaataagaagcccagactgtgcacccgagaggagtttaccaagaaggtcagaacgaacgctgcaatgggcgccgtgtttaccgaggagaaccagtgggatagcgccaaggccgccgtggaggacgaggacttctggaagttggtcgatcgcgaacgcgagctccacaagctagggaagtgtggctcttgcgtatacaacatgatggggaagagagaaaagaagctgggcgagttcggcaaggccaaggggtctcgtgccatctggtacatgtggcttggcgccagatacctggagttcgaggccctgggattcctcaatgaggaccactggttctctcgggagaatagctactccggcgtcgagggggagggcctgcacaagctcggttacatattgagggacatcagcaaaatacccgggggcgctatgtacgccgacgacaccgcggggtgggacacacggatcacagaggacgacctccacaatgaggagaaaatcacccagcagatggacccggaacaccgacagctggccaatgccatattcaaactcacataccagaacaaagtcgtgaaggtacagcggcccacccccacaggcacggtcatggacatcatctcccgcaaggaccagcgcggcagtggtcaggtgggaacatacggcctgaacaccttcaccaacatggaggcccaaataatccgccaaatggagggcgagggtgtgctgtccaaggcagacctcgagaacccccacctccccgagaagaagataacacagtggctggagaccaagggtgttgagcgactcaaacgcatggcgatcagcggcgacgattgcgtagttaagcccatcgacgaccggttcgccaacgccctgctagctctcaacgacatggggaaggtccgcaaggatatcccccagtggcagccctccaagggctggcacgattggcagcaggtccccttctgctcacatcacttccacgaactgatcatgaaggacgggcgaaagctagtggtcccatgtcgcccacaggacgagctcataggacgggcccgaatatcccagggggcggggtggagcctaaaggaaaccgcctgcctgggcaaggcctatgcccagatgtggagcctcatgtatttccaccgccgagacctgcgcctggccagcaatgccatctgttccgcggtacctgtgcactgggtcccgacttcacggacgacctggtccatccacgcccaccaccagtggatgaccaccgaggacatgctcacggtgtggaaccgcgtgtggatcgaggacaacccctggatggaagacaagacccccgtgaccacctgggaaaacgttccatacctcggaaagagggaggatcagtggtgcggctctcttatcgggctgacttctagggctacctgggcacagaacatcccgaccgccatccagcaagtacggtccttaatcggtaacgaagaattcctggactacatgccgagtatgaagcgattccgaaaggaggaggagtccgagggtgccatctggtga

SEQ ID NO: 25869 - RNA, 9873 nt, synthetic construct
  misc_feature 1..9873: note = derived and/or modified CDS sequence (opt11) from DENV-3__JF937639__SS-prME
  source 1..9873: mol_type = other RNA
acctcactctgcctgatgatgatcttgcccgccgctctagcgttccacttaaccagccgcgacggcgagccccgaatgattgtcgggaagaacgaacgcggcaagagcctgctctttaaaacagcttcggggataaatatgtgtactctcattgccatggatctgggcgagatgtgcgatgatacggtcacctataaatgcccccacataaccgaggtagagcccgaagatatcgactgttggtgcaacctcacctcaacttgggtgacctatgggacttgcaaccaggccggtgagcaccggcgcgacaagaggtccgtagccctcgcgccgcacgtgggtatgggcctggacacccgcacccagacgtggatgtcggccgaaggggcctggcgccaggtagagaaagtagagacgtgggccctgcgccacccggggtttactatcctcgcacttttcctggcgcactatatcggcacgtccctcacgcagaaggttgtaatattcatcctgctgatgcttgtcacgcccagcatgaccatgcggtgcgttggggtgggcaaccgcgacttcgtcgaaggactgtccggtgcgacgtgggtggacgtggtcttggaacacggcggctgcgtcactacaatggcaaagaacaagccgaccctcgacattgagctccagaagaccgaggccacccagctggcgactctccggaagctgtgtatcgagggcaagatcaccaacataaccaccgatagccgctgccctacgcaaggtgaggccacactgccggaggagcaggaccaaaactatgtttgcaagcatacctacgtcgaccgggggtgggggaatgggtgcggcctcttcgggaaggggtccctggtcacatgcgccaagtttcagtgcctggagccaattgagggcaaggtagtgcagtatgagaacttaaagtacacggtcatcatcaccgtgcacacaggggaccagcatcaggtcggcaacgagacccagggtgtgacggccgagatcacgccccaggccagcaccaccgaggcgatcctgcccgagtacggcaccctggggctcgagtgctctccgcgcaccggcctggactttaacgagatgattctcctcaccatgaagaacaaggcctggatggtccacagacaatggttcttcgacctgcccctgccctggacttctggcgccaccacggaaacccccacttggaatcgcaaggagctcctcgttaccttcaaaaacgcccacgccaagaagcaagaagtggtagtgctagggtctcaggagggcgcaatgcacacagcgctgaccggagccaccgaaatccagaacagcggcggtacttcaatcttcgccggccacctgaagtgccggttaaaaatggacaagcttgagttgaagggcatgagttacgccatgtgcacgaacacattcgtgctgaagaaggaggtctccgagacccaacacgggaccatcctcatcaaggtggagtacaaaggggaggacgccccgtgcaagatccccttcagcacagaggacgggcagggcaaggcccacaatggcaggctgatcaccgccaacccggtggtcactaaaaaggaggagcccgtgaacatcgaggccgaaccacccttcggtgagagcaacattgtaataggaataggggacaatgcgttaaagatcaactggtacaaaaaggggtcaagtatcgggaagatgttcgaggcaactgcacgcggtgcccgccgaatggccatcctgggggacacggcgtgggatttcgggtccgtcggtggggtgctcaacagccttggcaagatggtccaccagattttcgggtcggcctacaccgccctgttcagcggcgtctcctgggtcatgaagatcggcatcggggttctgctgacctggataggcctgaacagcagaaacacttccatgagcttctcttgcatcgccatcggtatcattaccctctaccttggcgccgtcgtgcaggcggacatggggtgcgtgatcaactggaaaggcaaggaactgaaatgcggtagcgggatcttcgtcacgaacgaggtccacacctggaccgagcagtacaagttccaggctgactcgcctaaacgcctggcaacagcaatcgcaggcgcgtgggagaacggagtatgtggcatacgcagcacgacccgcatggagaacctgctgtggaagcaaatcgccaacgagctcaactacatcctgtgggagaacaacatcaagctgaccgtcgtcgtgggggacatcatcggcgtcctcgagcaaggtaagcggacgttgactccccagccgatggagttaaagtactcctggaaaacctgggggaaggctaaaatcgttaccgccgagacgcagaattcttccttcataatcgacggcccgaacacccctgagtgccccagcgtaagtcgcgcttggaatgtctgggaggttgaggactatggttttggggttttcaccacgaacatctggctcaaactgcgggaagcctacacccagctttgcgaccaccgcttaatgtcagccgccgttaaggacgagcgggctgtgcacgcagatatgggctactggatcgaatcacagaagaacgggtcctggaagctggagaaggccagtctgattgaagtcaaaacttgcacctggccgaagagccacaccatatggtcgaacggtgtcctcgagtccgacatgatcatcccaaaatcgctggccgggcccatttcccagcacaaccatcgccccggttaccacactcagacggccgggccctggcatttaggcaagctcgagttagacttcaactactgtgaaggcaccacggtggtgatcaccgagaactgcgggacgcgggggccgagcctccgcaccactactgtctctgggaagctgatccacgagtggtgttgccgctcctgcactctccccccgcttcgctacatgggcgaggacgggtgctggtatggcatggagatacggcccatctccgagaaagaggagaacatggtaaagagcctcgtctcagccggcagcggaaaggtcgacaacttcactatgggcgtgctctgcctggcgatactcttcgaagaggtgatgcgagggaaattcggaaaaaagcatatgatcgcgggggtcttcctgaccttcgtgctgctcctgtccggccaaattacctggagagacatggcacatacgctcatcatgatcggctcaaacgccagtgaccgcatgggaatgggcgtaacctacctcgccctgatcgcgaccttcaagatccagcccttcctggccctcggattcttcctgcgcaagctgacaagccgcgagaatctcctgctgggcgtcggtctggccatggccacgaccctccagctgcccgaggacatagagcaaatggcgaatgggatcgccttaggcctgatggccttaaagctcataacccagttcgagacctaccagctgtggacggctttgatcagccttacctgctcgaacaccattttcaccctgactgtggcctggcggaccgcgacacttattctcgccggggtcagcctgctccctgtctgccagtcttcatccatgcgcaaaaccgactggctccccatggccgtggcggcaatgggcgtgccccccttgcccctgttcatattcagcctcaaggacacgctcaaacgcaggagctggccgctgaacgaaggggtgatggccgtaggcctcgtcagcatcctggcctccagcctgctccgcaatgacgtgccgatggccggacccctcgtggccgggggcctgctgatcgcctgctacgtcataaccgggacctccgcggatctgaccgtggagaaggccgccgacatcacttgggaggaggaggccgaacaaaccggtgtatcacacaacctgatgatcacagtggacgatgatgggaccatgcggatcaaagacgacgagaccgaaaacattctcactgttctgctgaagaccgcgttgttgatcgtgtccggcatcttcccgtacagcatccctgcgaccctcctagtttggcacacttggcagaagcaaacgaagcgctccggcgtgctttgggatgtgccctcaccgcccgagacgcagaaagccgaactggaggagggcgtatatcggatcaagcagcaaggcatctttggaaaaacccaggtgggcgtgggagtccaaaaggagggcgtattccacacaatgtggcacgtcacccgaggcgcggttctcacctataacggaaagcggctggagcccaactgggccagcgttaagaaagacctgatcagctacggcgggggttggcgtctaagcgcgcaatggcagaaaggggaggaagtccaagtcatcgccgtggagccaggcaaaaaccccaagaacttccagaccatgcccggcacattccagacgaccactggagaaattggagccatagcgctggacttcaagcccgggactagcggtagccccatcatcaaccgggagggcaaggtggttgggctgtacggcaacggtgtggttacaaagaacggagggtatgtctcggggatcgcccagaccaatgccgagccggatggacccacccccgagctggaggaggagatgttcaagaagcgcaacctcaccattatggacctgcaccccgggagcggcaaaacgcggaagtatctccccgccattgtgcgcgaggccattaaacggcggttacggacgctgatcctggcacccacccgtgtggtggctgcggaaatggaggaagcccttaagggcctacccatccggtaccagaccaccgcgaccaagtccgagcacaccggccgcgagattgtggaccttatgtgccatgccacctttacgatgagactcctgagccccgtgcgcgtcccgaactacaatctgatcatcatggacgaagcccactttacagaccccgcgtccatcgccgcgcggggttatatcagcacccgcgtgggtatgggcgaggcagcggctatatttatgacagcaacgccgcctggaaccgccgacgccttcccacaatccaatgcgcccatacaggacgaggaacgagacatcccggagaggtcgtggaactccggcaatgagtggattaccgacttcgctgggaaaacagtgtggttcgtccccagcataaaggccggtaatgacatcgcgaactgccttaggaaaaacgggaaaaaggtgatccagctctcccgcaagacgttcgacaccgagtaccagaagacaaagctgaacgactgggacttcgtggtcaccacggatatctctgagatgggtgccaacttcaaggctgaccgcgtgatagacccaagacgctgtctcaaacctgtgatcctcacggacggccccgagcgggtaatactggccgggcccatgcctgtgacagccgcgtccgccgcgcagcgccggggccgcgtgggtcggaaccctcagaaggaaaacgaccagtacatcttcaccggccagcccctcaacaacgacgaggatcatgcccactggacagaggcaaagatgctgctggacaacatcaacacccccgaggggataataccggccttatttgagcccgagcgcgagaaaagcgctgccatcgacggcgagtacagactgaagggggagtcacggaagacctttgtcgagttaatgcggcgcggagatctccctgtgtggctggcccacaaggttgcttctgaggggatcaagtatacagatcgtaagtggtgttttgacggccagcgcaacaatcagatcctggaagaaaacatggatgtcgagatctggaccaaggagggcgagaagaagaagttgcgaccccgctggctggatgcacgcacgtactccgaccccctggccctcaaggagttcaaggagtttgccgccggccgcaaaagcatagccctggacctcgtgaccgagatcgggcgcgtcccctcccatctcgcccaccggactcgaaacgcgttggataacctggtaatgctccatactagcgagcatggtgggcgagcctaccgacacgccgtggaggagcttcctgagaccatggagactctattactgctgggcctcatgatcctgctaaccgggggcgccatgctgtttctgatctctggtaagggtatcggcaagacctccattgggctgatatgcgttattgcaagctccggcatgctatggatggcagagatccccttacagtggattgccagcgccatcgtgctggaattctttatgatggtgctcttaattcctgagccggaaaagcagcgaaccccgcaggacaatcagcttgcctacgtcgtgatcgggatactcacactggccgcaatcatcgcggctaacgagatgggcctgctagagaccaccaagcgcgatctgggcatgtcaaaggagccgggagtggtcagccccacttcctacctggacgtcgatctgcacccagccagcgcgtggaccctgtacgcagtggcaaccactgttatcacccccatgctccggcacacgattgagaactcgaccgcgaatgtttccctcgccgcgatcgccaaccaagctgttgtcctgatgggcctggacaaagggtggccgatatccaagatggaccttggcgtgcccctcctggcgctcgggtgctacagccaggtaaaccccctaaccctgacggcagcggtcctcctgctgattacccactacgccataataggacccggcctacaggccaaggccactagagaggcccagaaacggaccgcggccgggataatgaagaatccgacggtggatggcatcatgactatcgacctggacccagtgatctacgactccaaattcgagaaacagctggggcaggtcatgctcctggtattatgcgcggtgcagctcctgctgatgcgaacctcttgggccctctgtgaagcgctgaccctagcaacaggccccattaccaccctgtgggaaggctcccctgggaagttctggaacaccacgatcgccgtcagcatggcaaacattttccgggggtcctacctggcaggggctgggctggcattcagcatcatgaagtccgtcggaaccggaaagcgcggcaccgggagccaaggcgagactctcggagagaagtggaagaagaagctgaaccagctaagcaggaaagacttcgacctctacaagaagtccggcatcaccgaggtggaccgtactgaggctaaggaggggctcaagcggggcgaaatcacccatcacgcggtcagccgcggctctgccaagctgcagtggttcgtggagcggaacatggtcataccggaggggcgcgtaatcgacttgggctgcggccggggcggctggagctattattgcgcaggcctgaagaaggtgaccgaagtgcgcggctacactaaaggcgggcccggtcatgaagagccggtaccgatgtctacgtatggctggaatatcgtgaaactgatgtctggcaaagacgtgttctaccttcctcccgagaaatgcgacaccctcctgtgtgacataggtgagtcctccccatcccccacggtcgaggagagccgcacaatccgggtgctcaagatggtagagccgtggctaaagaacaaccagttctgcatcaaggtcctgaacccctacatgcctacggtgatcgaacacctggaacgcctccaacggaagcacggcgggatgctagtgcgtaaccctctgtcccgaaactcaacgcatgaaatgtattggatctccaatggcaccgggaatatcgtcgcctcagtgaacatggtgtcccgtttgctgctgaatcgattcacgatgacccaccgacggccgacaatagagaaggacgtagacctgggcgcaggcaccagacacgtgaacgccgaacccgagacccccaatatggatgtgatcggggagcggataaagcgcatcaaggaggagcacaattctacatggcattatgacgatgagaacccgtataaaacttgggcctaccatggctcctacgaggtcaaggcgaccgggagcgcctccagcatgataaacggcgttgtgaagctgctgaccaagccttgggacgtcgtgccaatggtcacgcagatggccatgacagacaccacccccttcggccagcagcgggtattcaaggaaaaagtggacactcgcacaccgcggtcgatgcctgggacaaggcgggtgatgggcataaccgccgagtggctgtggcgcacgttggggaggaacaagaagcctcgcctgtgcacacgcgaagagttcaccaagaaggtgcggacgaacgcggccatgggtgccgtgttcaccgaggaaaaccagtgggactcggcaaaggcggcggtcgaggacgaggacttctggaagctcgtggaccgcgagcgcgagctgcacaagctggggaagtgcggaagctgcgtttacaacatgatgggcaagcgcgaaaagaaacttggcgagttcggcaaggccaaaggctctagagccatttggtacatgtggctgggcgcccgctacctggagtttgaggccctcgggttcctcaatgaggaccactggttcagccgggaaaactcctacagcggggtcgagggggagggcctgcacaagctcggctacatcctgcgcgatatctctaagatccctggaggcgcgatgtacgccgacgacacggccggttgggacacccgaatcaccgaagacgacctgcacaacgaggagaagatcactcagcagatggacccggagcaccgccagctcgcaaacgcaatctttaagctgacctaccagaataaagtggtgaaggtccagcggccaacccctacagggaccgtgatggatataattagccgcaaagatcagcggggctccggccaggtgggaacgtacgggctgaacacattcacaaacatggaggcgcagctcatccgccagatggaaggcgagggggtactgtcgaaggccgacctggagaacccccaccttccggagaagaagattacacaatggctggaaacgaaaggcgttgaaagactgaagagaatggccatctccggggacgactgtgtcgtcaaacccatcgacgatcggttcgccaacgccttattagcgctgaacgatatggggaaggtccgcaaagacatccctcagtggcagcctagcaaaggctggcacgactggcagcaggtgccattctgctcacaccacttccacgagcttatcatgaaggacgggcggaagctggtcgtgccttgccgcccccaagatgagctgataggccgggcgcgcatcagccagggggccgggtggtccttgaaagagaccgcatgcctgggcaaagcgtatgcccagatgtggagcctgatgtacttccaccggcgggacctccgcctggctagtaacgctatttgcagtgccgtgcccgtgcactgggtaccgacctcccggaccacatggagcatccacgcgcaccaccagtggatgactacagaagacatgctaaccgtgtggaacagggtctggatcgaagataacccttggatggaggacaagacgcctgtgacgacctgggagaacgtgccctatctcgggaagcgcgaggaccagtggtgcggcagcctgatcgggctgacgtcgcgcgccacgtgggcccagaacatcccgaccgccatccagcaggtccggagcctgataggcaacgaggagttcctcgactacatgcccagtatgaagcgtttccggaaggaggaggaaagcgagggggcgatctggtag

SEQ ID NO: 25870 - RNA, 9873 nt, synthetic construct
  misc_feature 1..9873: note = derived and/or modified CDS sequence (opt11) from DENV-3__JF937627__SS-prME
  source 1..9873: mol_type = other RNA
accagcctttgcttaatgatgatcctgcccgccgccctggcgttccacctcaccagccgtgatggggaaccccggatgattgtggggaagaacgagcgcggtaagagcctgctgttcaagaccgcctccgggattaacatgtgcaccctcatcgccatggacctgggggagatgtgcgacgacaccgtcacctacaagtgtccccacatcaccgaggtggagcccgaggacattgattgctggtgtaacctgacctcgacctgggtgacctacgggacctgcaaccaagctggcgagcaccggcgggataagcgctcggtcgctctcgcgccccatgtgggcatggggctggacaccaggactcaaacctggatgagcgctgagggcgcctggagacaggtggaaaaggtcgagacctgggccctgcgccaccccgggttcacaatcctcgcgctgtttctggcccactacatcggcacctccttaacacagaaggtggttatcttcatcctgctcatgctcgtcacacccagcatgaccatgcgttgcgttggggtgggcaatagagacttcgtcgagggcctctccggcgccacatgggtggacgtggtcctggagcacggcgggtgtgtgactacgatggccaagaacaagccaactcttgacatcgaattgcagaagaccgaagccacccagttagccacgctccggaagctgtgcatcgagggcaagatcaccaacatcaccaccgacagccgctgccccacgcagggcgaggctactctgcctgaggagcaagaccaaaattacgtgtgcaagcacacttacgtcgaccgggggtgggggaacgggtgtggcctctttgggaagggctccctggttacctgcgcaaaattccagtgcctggagcccatcgagggtaaagtggtccagcatgagaacctcaagtacaccgtgatcatcaccgtccataccggcgaccagcatcaagtcggtaatgagactcagggggtgaccgccgagatcacgccccaggcctcgaccaccgaagctattttgccggagtatggcaccctgggactcgagtgctccccgcgcacgggcctggacttcaatgagatgattctactgaccatgaaaaacaaggcctggatggtccaccggcagtggtttttcgacctgcccctcccctggactagcggcgccaccacggaaacccccacttggaaccgaaaggagctcctggtgaccttcaagaacgcccacgccaagaagcaggaggtggtggtgctgggtagccaagagggcgcgatgcacaccgccctaaccggagccaccgagatccagaacagcggcgggacctccattttcgccggccacctgaagtgccggctgaagatggacaaattagagctgaaaggcatgtcgtacgccatgtgcacaaacaccttcgtgctgaagaaggaggtctccgagacccagcacgggaccatacttatcaaggtggagtacaagggggaggacgtgccgtgcaagatccccttctccactgaggacggccagggcaaggcgcacaacggccgactgatcaccgcgaacccagtcgtgactaaacgggaggagcccgtgaacatcgaggccgagccgcccttcggtgagagcaacatagtaatcgggatcggggacaacgccctgaagatcaactggtataagaagggctcaagcattgggaagatgttcgaggcgacggcccgcggcgctcgccgcatggccattctgggagacacggcttgggacttcggctccgtaggaggggtgctcaacagcctgggcaagatggttcaccagatctttgggtccgcgtacacggccctgttcagcggtgtatcctgggtgatgaagatcggcataggggtcctcctgacatggatcggcttgaacagcaagaacacctccatgagtttttcctgcatcgccatcgggatcatcacgctctacctaggggccgtcgtgcaggccgacatggggtgtgtaatcaactggaaaggcaaggagctaaagtgcggctcaggtattttcgtgaccaacgaggtgcacacctggaccgagcaatacaagttccaggcggactcccctaagcgcctcgctacggcgatcgccggggcctgggaaaacggggtctgcggcatccggtctacgacccgtatggaaaatctgctatggaagcaaatcgcgaacgagctcaactacatcttatgggagaacaacatcaagctgaccgtggtagtcggggacatcatcggggtgctcgagcagggcaagcggacgctgacgccccagccgatggagctgaagtactcctggaagacctggggaaaggccaagatcgtcaccgccgagacgcagaacagctccttcatcatcgatggccccaacacccctgagtgccccagcgtatccagagcatggaacgtatgggaggtggaggattacgggtttggcgtcttcaccaccaacatctggctcaagttgcgggaggtgtacacccagctatgcgaccaccgcctgatgagcgcggccgtcaaggacgagcgggccgtgcacgccgacatgggctactggatcgagtctcaaaagaatgggtcctggaaacttgagaaggcttcactgatcgaagtgaagacgtgtacctggccgaagtctcacaccctatggagcaacggcgtgctggagtccgacatgatcatccccaagagcctggccgggcccatctcccaacacaaccatcgtccgggctaccatacccagacggccggtccctggcacctgggcaagctagagctggacttcaactactgtgagggaaccaccgtcgtgatcaccgaaaactgcgggacgcgtggaccatccctccgcacaaccacagtgtcaggaaagctcatccacgagtggtgctgccggagctgcacgctgcccccgctccgctacatgggcgaggacgggtgttggtacggcatggagatccgtccaatctccgagaaggaggagaacatggtcaagagcctggtgtcagccggcagcgggaaggtggacaacttcaccatgggcgtgctgtgcctcgcaatcctgtttgaggaagtgatgcgggggaagtttggcaaaaagcatatgatcgccggcgttttcttcaccttcgtcctgctcctgtccggccaaatcacctggcgggacatggcgcacacgttgatcatgatcggcagcaacgcgtccgaccgcatgggaatgggcgtgacttacctcgccttaatcgccaccttcaagatccaacccttcttagcactcgggtttttcctgcggaagctcaccagcagagagaatctgctgctgggcgtgggactcgcgatggccacgacactgcagctacccgaggatatcgaacagatggccaacgggatagcccttggcctgatggcgcttaagctaatcacccaattcgaaatctaccagctgtggaccgccctgatctctctcacgtgctccaacaccattttcaccctgactgtcgcctggcggacggccaccctgatcctcgccggggtaagcctgctgccgatgtgccagtccagctcgatgcgcaagaccgactggctcccaatggcggtcgcggcaatgggtgtgccgcccctccccctgttcatcttcagcctcaaggacaccctgaagcgccggtcctggcccctgaacgagggggtgatggcggtcggcctggtcagcatcctggccagtagcctgctccgcaacgacgtgcccatggcgggccccttggtcgccgggggcctgctgatcgcctgctacgtgatcacggggacctccgccgacttgaccgtggaaaaagccgcggacatcacctgggaggaggaagcagagcagacgggcgtctcacacaatctgatgatcaccgtcgacgacgacggtacaatgcggataaaagacgacgaaaccgagaacatcctcacagtgctgctgaaaacggctctactgatcgtctccggaatcttcccgtacagcattcccgccaccctgttggtgtggcacacctggcagaagcagacccagcgatccggcgtgctgtgggacgtacccagcccgcccgaaacgcagaaggccgaactggaagagggcgtgtaccgtataaagcaacagggcatcttcgggaagacccaagtgggcgtcggggtgcagaaggagggcgtgttccacaccatgtggcacgtcacccgcggcgcggtgctaacgtacaacgggaagcggctggagcccaactgggcctccgtgaagaaggacctgataagctacggcgggggctggcgcctctccgctcagtggcaaaagggagaggaggttcaggtgatcgccgtagaacccggcaagaaccctaagaatttccagaccatgcccggcaccttccagaccacgacaggggagatcggcgccatagccttggacttcaagcccgggaccagcggcagccccatcattaatcgggagggcaaggtcgtggggctgtacgggaatggggttgtcaccaagaacggcgggtacgtgtccggcatcgcgcagaccaacgccgagccggatggccccacccccgagctggaggaagagatgtttaagaagaggaacctcaccatcatggacttacaccccgggagcggcaaaactcggaagtacctcccggccatcgtgcgcgaagcgatcaagcgacgcttgaggacgctgatcctggcccccacccgcgtcgtggccgccgagatggaggaggccttgaagggactgccaatacggtatcagaccaccgcgacgaagtccgagcacaccggccgcgagattgtggacttgatgtgccatgccacttttaccatgcggctcctgagcccagtccgcgtgccgaactacaacctgatcatcatggatgaggcccacttcacggaccccgcttccatagccgcgcggggatacatctccacccgcgtcggaatgggggaggccgccgccatattcatgaccgcgacgccacccgggacggccgatgccttcccgcagtccaacgctcccatacaggacgaggagcgcgacatacccgagcgcagctggaactccggtaatgagtggatcaccgacttcgccgggaagaccgtatggttcgtgccctcgataaaggcgggcaacgacatcgccaactgcctccgcaagaacgggaagaaggtgatccagctgtcccggaagaccttcgacacggagtaccagaaaaccaagctgaacgactgggactttgtcgtgaccaccgacatcagcgagatgggcgccaacttcaaggccgatcgcgtaatcgacccccggcgctgcttgaagcccgtcatcctgacggacggccctgagagagtgatccttgccgggcccatgccggtgaccgcggcgtccgccgcccagcgccgggggcgcgtcggacggaacccccagaaggagaacgaccagtacatcttcaccggccagcccctcaacaacgacgaagaccatgcccattggaccgaggccaagatgctgctggataacatcaacactcccgagggtatcatccctgccctcttcgagccagagcgcgagaaatccgccgccatcgatggcgagtaccgcctgaagggcgagtcccgcaagacgttcgtagagctgatgcggcgcggagacctacccgtgtggctggcacacaaggtagccagcgagggcatcaagtacacagatcgtaaatggtgcttcgacgggcaacgcaacaaccagatcttggaggagaatatggacgtggagatctggacgaaggagggagagaagaagaagctccggccacgctggctggacgcccgtacctactccgacccgctggccctcaaggagttcaaggagttcgcagcgggccgcaagtcgatcgcccttgacctggtcacggagatcgggcgcgtgccctcccacctagcccaccggactcgcaatgcgctggacaacctggtcatgctccacaccagcgaacacggcgggcgggcctaccgccatgcggtcgaggagctgcccgaaacgatggagacgctgctcctgcttggcctaatgatcctgctgaccgggggcgccatgctgttcctgatcagcggcaagggtatcggcaaaacctcgatcgggctgatttgcgtgattgccagctccggcatgctctggatggccgagatcccactgcaatggattgccagcgctatcgtgctggagttcttcatgatggtgctcctgatccccgagcctgagaagcagcgaacgccccaggacaatcagcttgcctacgtggtgataggaatactcactctggccgccatcatcgccgctaacgagatggggctgctcgagaccaccaaacgcgacctgggcatgagcaaagaaccgggggtcgtgtcgcccacctcctacctggacgttgacctccaccccgcctcagcatggacgctgtacgccgtcgcgacaacggtgatcacccccatgctccggcacactatcgagaactccaccgccaatgtcagcttggcagccatcgccaaccaagcggtcgtcttgatgggcctggataaggggtggccgatctccaagatggacctcggcgtgcccttgctggccttagggtgctacagccaggtcaaccccctgaccctgacggccgccgtgctcctgctaatcacgcactacgcgatcatcggccctggtcttcaggcaaaagccacccgcgaggcccagaagcggaccgccgccgggatcatgaaaaacccgaccgtggacggcatcatgacgatcgacctggaccccgtcatttatgactccaaattcgagaagcagctgggccaggtaatgttacttgtgctgtgcgtagtgcagctcctgctcatgcgcaccagctgggccctctgcgaggccttgaccctcgcgactggccccatcacgaccctctgggagggctcccccgggaagttctggaataccaccatcgccgtgagcatggcaaacatctttcgtggctcgtacctggccggggccggcttggccttcagcatcatgaagtccgtcgggacggggaagcgaggaaccgggagccagggcgagaccctcggagagaagtggaagaagaagctgaaccagctcagccgaaaggacttcgatctttacaagaaatccggcatcaccgaggtggacaggacagaggccaaggaggggctgaagcggggcgagataacgcaccacgctgtgagtcgcggatccgccaagctgcagtggtttgtcgagcggaacatggtgatcccggaagggcgcgtcatcgacctcggctgcggacgaggagggtggagctactactgcgcgggcctgaagaaggtcaccgaggtgcgcggctacaccaagggcggccccgggcacgaagaacccgttcccatgtccacctacggctggaacatcgtcaaactgatgagcgggaaggacgtgttctacctcccgcccgagaagtgcgacacgctgctgtgcgacataggcgagtcttccccctcccccaccgtggaagagagccgcacaatccgggttctcaagatggtcgagccatggctcaagaacaaccagttctgcatcaaggtgttaaacccctacatgcccaccgtcatcgagcacctggagcgcctccagcggaaacacggcggaatgctggtccgcaacccgctgagccggaatagcacgcacgagatgtactggatctccaatggcacgggcaacatcgttgcaagtgtcaatatggtgtcccgcttgctcctgaaccggttcaccatgacccaccgcagaccgacgatcgaaaaggacgtcgacctcggagccggcacccgccacgtgaatgcggagcccgagacccccaacatggacatcattggggagcggatcaagcgcataaaagaggagcacaatagcacctggcactacgacgacgagaacccgtacaaaacgtgggcctaccacggctcctatgaggtgaaggcgacggggagtgccagcagcatgatcaacggcgtggtcaaactgctgaccaagccatgggatgtggtccccatggtgacccagatggccatgacggatacaacacccttcgggcagcagagggtgttcaaggagaaggtcgatacccgcacgccgcggagcatgccaggcacacgccgggtcatgggaatcacggcggaatggctctggcggaccctggggcggaataagaagccccgcctatgcacgcgtgaagagttcaccaagaaagtgcggaccaacgccgcgatgggggccgtattcaccgaggagaaccagtgggactccgctaaagccgcggtggaggatgaggacttctggaagctcgttaacaaggagcgtgagctgcacaagctcggtaagtgcgggagctgcgtctacaacatgatggggaagcgggagaagaagctgggcgagttcggcaaggccaaggggtcccgcgctatctggtacatgtggctaggtgcgcggtacctcgagtttgaggctctcgggtttctgaacgaggaccactggttcagccgcgaaaattcctacagcggtgtggagggggagggcctgcacaaacttggctacatcctgcgggatatctcgaaaatccccgggggcgccatgtacgccgacgacacggcagggtgggacacccgtatcaccgaggacgacctgcataacgaggagaagatcacccagcaaatggatccggagcacaggcaactcgcgaatgccatctttaagttgacgtatcagaacaaggtggtcaaggtgcagcgccccacccccaccggcaccgtgatggacatcatcagccggaaggaccagcgcggctcggggcaagtcggcacctatgggttgaatacgttcaccaacatggaggcccagctcataagacagatggagggcgagggtgtgctgagcaaggccgacctggagaacccccatctgcccgagaagaagatcacccagtggctggagaccaagggcgtagaacgcctgaagcggatggccatctccggcgacgactgcgtcgtgaagcccatcgacgaccgcttcgcgaacgccttgcttgccctcaacgacatggggaaggtgaggaaggacatcccccaatggcagccaagcaagggctggcacgactggcaacaggtgcccttctgctcccaccacttccacgagctcatcatgaaggatgggcgcaagctggtggtgccctgtaggccccaggacgaactgattggacgtgcccggatcagccaaggtgctgggtggtccctcaaggagacggcgtgcctgggcaaggcgtacgcccagatgtggagcctgatgtacttccaccgccgcgacctcagactggcctccaacgcgatctgctccgccgtccccgtgcactgggtgccgaccagtcgcactacctggagcattcatgctcatcatcagtggatgacgacggaggatatgctgaccgtctggaaccgggtgtggatcgaggacaacccctggatggaggacaaaacccccgtgacgacgtgggagaacgtcccctacctcggtaagcgtgaggatcaatggtgcggcagcctgatcggtctgacctcccgggccacctgggcacagaacatcccgacggcgatccagcaagtccgcagccttatcggcaacgaggagttcctggactacatgccttccatgaaacggttccgtaaggaggaggagtctgagggggccatctggtga

SEQ ID NO: 25871 - RNA, 9873 nt, synthetic construct
  misc_feature 1..9873: note = derived and/or modified CDS sequence (opt11) from DENV-3__KF973476__SS-prME
  source 1..9873: mol_type = other RNA
accagcctctgccttatgatgatcctgcccgccgcactggcgtttcacctcaccagccgtgacggcgaaccccgcatgatcgtggggaaaaacgaacggggtaagagcttgcttttcaagaccgcgtcagggatcaacatgtgtactctcatcgccatggacctgggcgaaatgtgtgacgacaccgtgacgtacaagtgcccgcacatcaccgaggtcgagccggaggacatcgactgctggtgcaatctgaccagtacctgggtgacctacgggacatgcaaccaggcgggcgagcacaggcgagacaagcggtccgtggcgttagctccccacgtgggcatggggttagacacccgtacccagacctggatgagcgcggagggggcctggcgccaggtagagaaagtcgagacctgggcactacgtcacccggggttcaccatcttggcgctgttcctggcacactacataggcacctccctcacgcagaaggtcgtgatattcatcctgctgatgctggtcacgccatcaatgaccatgcggtgcgtgggggtgggcaaccgtgatttcgtcgagggcctgtctggggcgacctgggtagacgtggtcctggaacacggcgggtgcgtaacgacgatggccaagaataagcctaccctggacatcgagctgcagaaaaccgaggcaactcagctggctacattacggaaactgtgcatcgaagggaagatcacgaatattaccaccgactctcgttgccccacgcagggggaggccaccctgccggaggagcaggaccagaactacgtgtgcaagcatacatacgtcgatcgggggtggggtaacgggtgcggcctctttggtaaaggcagcttagtgacatgcgccaaattccagtgcctggaaccgattgaaggcaaggtggtccagtacgagaatttgaaatataccgtgatcataaccgtgcacaccggcgaccaacaccaggtgggcaacgagacacaaggcgtgacagctgaaataacccctcaggcctccaccacggaggcgatcttacccgaatacggtacgctggggttggagtgctccccgcgcaccggcctggattttaacgagatgatcttgctcaccatgaagaacaaggcatggatggttcaccggcaatggttcttcgacttaccattgccctggaccagcggggctaccacggagacccccacctggaaccgcaaagaactcttagtgacgtttaagaacgcccatgccaagaagcaggaagtggttgttctcgggtcccaggagggcgcgatgcacacggcgctcaccggggccaccgaaatccagaacagcggagggacatctattttcgccggtcacctgaagtgcagactgaagatggacaagctcgaactgaagggcatgtcgtacgcaatgtgcacgaacactttcgtgctcaagaaggaagtctccgagacccagcacggcaccatcctcatcaaagtggaatataaaggcgaggatgtgccgtgcaagattcccttcagcacggaggacggacaaggcaaagcgcacaacggcaggctaatcaccgcgaatcccgtagtaactaaaaaggaggaacccgttaatatcgaggccgagcccccgttcggggagagcaatattgtcatcggcataggtgacaacgccctcaagatcaactggtacaagaagggctcgagcatcgggaagatgttcgaggcgacagcgaggggcgcccgccggatggccatcctgggcgatacggcgtgggacttcgggtctgtgggcggggtcctaaacagcttaggtaagatggtccaccaaatatttggttccgcgtacaccgcactgttcagcggcgtttcctgggtaatgaaaatcggcatcggagtgctcctcacctggataggcctgaacagcaaaaacacctccatgagcttttcatgcatagccatcgggatcattacgctctatctaggcgccgtggtgcaggccgacatggggtgcgtcatcaactggaagggcaaagagctgaagtgcggctccgggatcttcgtgaccaacgaggttcacacctggaccgaacagtacaagttccaggcggacagtcccaagcgtctcgccacggcgatcgcaggcgcctgggaaaacggggtctgtggcatccgcagtaccacccggatggagaacctgctgtggaagcagatcgcgaatgagctcaactacatactctgggagaacaacatcaagctgaccgtcgtcgtgggggacatcatcggtgtgctagagcaaggaaaacgcacgctgacgccccagccgatggaactgaaatattcctggaaaacatgggggaaggcaaagatcgtgactgccgaaacgcaaaacagctccttcatcatcgatggccccaacacccccgagtgccccagcgtctcccgggcgtggaatgtgtgggaggtggaggactacgggttcggcgttttcactaccaacatttggctcaagttacgggaagtgtacacccagctatgcgaccaccggttaatgtctgctgccgtgaaggacgagcgcgctgttcacgccgacatgggttactggatcgagagccagaagaatgggtcgtggaaattggaaaaggccagcttgatcgaagtcaagacgtgcacctggccaaaatcccacacgttatggtcaaacggcgttttagagtccgatatgatcatccccaagtccctggccggacccatatcccagcataaccaccggccgggctaccacacccagacggccgggccatggcacttaggcaagttagagttggacttcaactactgcgaaggcaccaccgtcgtgatcaccgagaactgcgggacgcgcggccccagcctgcggaccaccaccgtaagtgggaagctgatacacgagtggtgctgccgctcttgcaccctgcccccgctccggtacatcggggaggacgggtgctggtatggcatggagatccgccccatttccgagaaagaggagaacatggtcaaaagtctggtgagcgccgggtcagggaaggtagacaactttaccatgggggtcctctgcctagctatcctgttcgaagaggtgatgcgcgggaagttcggcaagaaacacatgatcgccggggtgttcttcacatttgtcctgctcttgtccggtcagatcacatggcgtgacatggcacatactcttatcatgatcggaagcaacgcttccgaccggatggggatgggcgtgacctatctcgccctgatcgcaaccttcaagatccagccctttctggccctcggtttcttcttacgccgcctgacgagccgcgaaaacctcctgcttggtgtgggcctcgctatggccacgaccctgcagctgcccgaggacatcgagcaaatggccaacgggatcgccctcggcctgatggcgctgaagctaatcacgcagttcgagacctaccagctctggacggccctgatatcactgacctgttccaataccatcttcacactgacagtcgcgtggcggacagctaccctgatcctagccggggtcagcctactgccggtctgtcagtcaagttcgatgaggaaaactgactggctccccatggcggtggccgccatgggggtgcctcccctgccgctgtttatcttttctctcaaggatacgctaaagcgccggtcctggcccctgaacgagggggtcatggcagttggacttgtgagcatcctggcctcctctctgctccgcaacgacgtccccatggcgggcccccttgtggctgggggcctgctcatcgcctgctatgtgattaccggcaccagcgccgacctgacggtcgaaaaagccgcggacatcacctgggaggaggaggccgaacagacaggagtgagccacaacctgatgatcacggtggacgacgacggtacgatgcggatcaaggatgatgagacggagaatatcctcacggtcttattgaagaccgccctcctgatcgtgtccggcatcttcccgtatagcatccccgccaccctactcgtgtggcatacctggcagaagcagacgcaacgctctggcgtgctgtgggacgtgcccagcccgcccgagactcagaaggccgagctggaagagggggtgtaccggatcaagcaacagggtattttcgggaagactcaggtcggcgtgggggtccaaaaggagggcgtattccataccatgtggcacgtgacgcgcggcgcggtgctcacctacaatgggaagcggctggagcccaactgggcttccgtcaagaaggacctgatcagttacggtgggggctggcgcctctccgcccaatggcaaaagggtgaggaggtccaggtgatcgcggttgagcccgggaagaaccctaaaaacttccagaccatgcccggaaccttccaaacgaccacaggcgagatcggcgcaatcgcccttgacttcaagcccggtacctctggcagccccataattaaccggggagggaaggtggtgggactgtacgggaacggcgtggtgactaaaaacgggggctacgtatccggcatagcccagaccaatgccgagccggacgggcctacacccgagctggaggaggagatgttcaagaaacgcaacttaacgataatggatttacacccagggagcggtaagacgcggaaatacctgccggcgatcgtccgggaggcgatcacccgccggcttcggaccctgatcctggcccccacccgcgtggtcgccgccgaaatggaggaagccctcaagggtctgcctatccggtaccagaccaccgcgaccaagagtgagcacacagggcgcgagatcgtggacctgatgtgccatgccacgttcaccatgcggctccttagcccggtgcgggttccgaactacaacctaatcattatggacgaagcccacttcaccgaccccgcctccatcgcggctcgaggctacattagcacacgcgtcggcatgggtgaagccgcggcgattttcatgacggcgacgccgcccggcaccgctgacgcgttcccgcagtccaatgcccccatccaggacgaagaacgagatattcccgaacggagctggaactccgggaacgaatggatcaccgactttgccggaaagacggtgtggttcgtgccgagcatcaaagcagggaacgacatcgccaactgcctccgcaagaatggcaagaaggtcatccaactgtcccggaagaccttcgacaccgagtaccagaagaccaaactcaacgactgggatttcgtggtgacaaccgacatcagcgagatgggcgccaacttcaaagccgatcgcgtcatcgacccgcggcgctgcctcaagcccgtgatcctcaccgacgggcccgagcgggtgatcctggcgggccctatgccggtaaccgcagcttccgccgcccaacgccgggggcgcgtaggacggaatcctcagaaggaaaacgatcagtacatctttaccgggcaacctctgaataacgatgaggaccacgcccactggacagaggcgaagatgttgctggacaacattaacacgcccgaggggatcatcccagccctctttgagcccgaaagggagaagtccgccgcagttgacggcgagtaccgtttgaaaggggagtcccgcaagaccttcgtcgagctgatgcggcgcggcgacctccccgtgtggctggctcataaggtcgctagcgagggcattaagtacaccgaccggaagtggtgcttcgacgggcagcgcaacaaccagatcctggaagagaacatggacgtggaaatttggaccaaggagggcgagaaaaagaaactccgaccacgctggctggacgcgcgcacctacagtgatccgctggcactcaaggagtttaaagagttcgcagcggggcgaaagtcgatcgcgctagacctggtgacagagattggcagagtcccctcccacttggcccaccggactaggaacgccctggacaacctggtgatgctccacactagcgaacacggtggccgggcataccggcacgcggtggaggagctgcccgaaactatggagaccctgcttttactggggctcatgatactgcttaccgggggcgctatgctattcctgatctctgggaaaggcatcgggaagacgtccataggcctgatctgcgtcatcgcatccagtgggatgctctggatggccgagattccgctgcagtggatcgcctcagcgatcgtcctcgagttcttcatgatggttttactgatacccgaacccgagaagcagcgtactccccaagacaaccagttagcatacgtcgtgatcggcattttaactctcgctgccattatcgctgcgaacgagatgggcctgctcgagacaactaagcgcgacctgggaatgtccaaggagccgggtgtggttagccctacctcctaccttgacgtagatctacaccccgcgtccgcctggaccctgtacgccgtggctaccacggtgatcacccccatgctgcgacacactatcgaaaattccaccgccaacgtaagcctcgccgctatagccaaccaggcggtagtactgatgggcttagacaaaggctggcccatttccaagatggatctcggggtgccactgctggccctaggctgttacagccaggtgaatcccctgacgctcaccgccgccgtcctcttactgatcactcactacgctatcatcggcccgggactccaggcgaaggccacgcgcgaagcccagaaaagaacggctgctggcattatgaagaacccgaccgtggacggaatcatgaccatcgacctggaccccgtgatctacgactccaagtttgaaaagcaactgggccaggtcatgcttctggtgctgtgcgcagtgcagctactgctgatgcgcacgagttgggcactctgcgaggccctaacgctggccacggggcccatcaccaccctctgggaggggtcccccgggaagttctggaacacgacgatcgcggtgtccatggcgaacattttccggggctcctacctggccggcgcggggctggccttcagtatcatgaagtccgtgggcacaggcaagcggggcaccggaagccagggtgagaccctcggcgagaagtggaaacggaaattgaaccagctgtcgcgcaaggactttgatctctacaaaaagtcggggatcacggaggtggacagaaccgaggcgaaggaaggcctgaagcggggcgagataacacatcacgccgtaagccggggatccgccaaactccagtggttcgtggagcgcaacatggtgataccggaaggcagggtcattgatctcgggtgcggaagaggtggctggagctactactgcgccgggctcaagaaggtgaccgaggtaagaggatacacgaagggcgggcccggccacgaggaacccgtccccatgtccacttatggatggaatatcgtgaagctgatgtccgggaaggacgtgttttacctcccgcccgaaaaatgcgacacactgctctgtgacatcggcgagtcttcgccgtcccccaccgtcgaggaaagcagaacgatccgcgtgctgaagatggtggagccgtggctcaagaacaaccaattttgcataaaggtcctgaacccctacatgcccaccgtgattgagcatctggagcggctccagagaaagcatggagggatgctggtgcgaaaccccctgtcccgcaatagcacgcatgagatgtactggatctccaatgggaccggcaatatcgtcgcctcagtgaatatggtcagcaggctcctgctgaacaggttcacgatgacccatcgtcgcccgaccatcgagaaggacgtcgatctcggcgcggggacccggcacgtcaacgcggagcctgagacgcctaacatggacgtgataggagagcgcattaagcggatcaaggaagaacacaacagcacctggcactacgacgatgaaaacccgtacaagacctgggcgtaccacgggtcctacgaagttaaggcgaccggcagcgcctcatcaatgatcaatggagtagtcaagctgttgacgaagccgtgggacgtcgtgcccatggtgacccagatggcgatgacggataccacgcccttcggtcagcaacgcgtattcaaggagaaggtggacacccggactccgcgctccatgcctggaactcggcgcgtcatggggatcacagccgaatggctctggaggacgttaggccgcaataagaagcctcgcctttgcacccgggaggagttcacgaagaaggtgcgcacgaatgcagcgatgggggccgtgtttaccgaagagaaccagtgggactccgccaaggccgccgttgaagacgaagacttttggaagctcgttgacagggagcgcgagctgcacaagctgggtaagtgcgggagctgtgtgtacaacatgatgggcaagcgagagaagaaactcggggagtttgggaaggccaagggctccagggcgatatggtacatgtggctgggggcccggtacctggagtttgaagccttgggtttcttaaacgaggaccactggttcagcagggaaaactcctacagcggggtcgaaggggagggcctgcacaagctcggatacatcttacgggatatctccaagatccccggaggggccatgtacgcggatgacacggcgggctgggacacccgcatcacggaggacgacctccacaatgaggagaaaatcacccagcagatggatccggagcaccggcagctcgccaacgccatctttaaactgacctaccagaacaaggtggtgaaggtccagcgaccaacccccaccggcactgtaatggatattattagccggaaggaccagcgcgggtccggccaggtggggacctacgggctcaataccttcactaacatggaggcccagctcatccggcagatggagggggagggcgtactgagcaaggccgacctggagaatccctacctccctgagaagaaaattacgcagtggctggagaccaagggagttgaacgccttaagcggatggcgatcagcggggacgactgcgttgtcaaacccatcgatgaccgcttcgcgaacgccttattggccctgaacgacatgggcaaggtgcgcaaggacatccctcaatggcagcctagtaaggggtggcacgactggcaacaggtgcccttctgctcccaccactttcacgaactcatcatgaaggacggcagaaagctggtcgttccctgcagaccgcaggacgagctgatcggacgcgcccgcataagccagggcgcaggctggtccctcaaggagaccgcatgcctggggaaggcctatgcccagatgtggagcttgatgtactttcaccggcgcgacctccggctggcgtccaacgccatctgtagcgccgtgccagtccactgggttccgacctcccggacgacatggagcatacacgcccatcaccagtggatgaccacggaggacatgttaacggtgtggaaccgggtctggatcgaggacaatccatggatggaggacaagaccccggtcaccacgtgggagaacgtgccctacctcggcaagcgcgaggaccaatggtgcgggagcttgataggtctgacgtcccgggccacttgggcccagaacatcccgaccgcgatccagcaggtccgcagcctcatcgggaacgaggagttcctggactacatgccctccatgaagcggttccgcaaagaggaggaaagcgagggcgccatctggtga

SEQ ID NO: 25872 - RNA, 9873 nt, synthetic construct
  misc_feature 1..9873: note = derived and/or modified CDS sequence (opt11) from DENV-3__KF973478__SS-prME
  source 1..9873: mol_type = other RNA
acgagcctctgccttatgatgatcctgcccgccgcactagcgttccacctcacgagccgtgacggagaacccagaatgatcgttgggaaaaatgagcgcggcaaaagcctcctgtttaagactgccagcgggatcaatatgtgtacgttgatcgccatggacctgggcgagatgtgcgacgacaccgttacctacaagtgcccgcacataaccgaagtcgagcccgaggacatcgattgctggtgcaatctgactagcacgtgggtgacatatgggacgtgtaaccaggccggagagcatcggcgtgacaagagaagtgtggccctcgcaccccacgttggcatgggcctggatacccgcactcaaacgtggatgagcgccgaaggcgcttggcgccaggttgaaaaggtggaaacgtgggcactgcgccaccccgggtttaccatactcgcgctgttcctggcccattacatcggtacctcactcactcagaaggtggtgatcttcatcctgctgatgctcgtcacaccaagcatgacgatgcggtgcgtgggggtgggcaaccgcgacttcgtcgagggtttaagtggggccacgtgggtcgatgtggttctggagcacggcggatgcgtgaccacgatggccaagaacaagccgacgctcgacattgaattgcagaagaccgaggctacacagcttgcgacgctccggaaactgtgcatcgagggaaaaattaccaacatcactacggacagccgctgccccacgcagggcgaggccaccttgccggaggagcaggatcagaactacgtgtgcaaacacacctacgtagaccgggggtggggcaacgggtgcggcctcttcgggaagggcagtctagtgacctgcgccaaattccagtgcttggagccgatcgagggcaaggtggtgcagcacgagaatctaaagtacactgtgatcatcaccgtgcacacgggggaccagcaccaggtcggcaacgaaacccagggggtcaccgccgagatcaccccgcaggcctcgacgaccgaggcgatcctgcccgagtacgggaccttagggctcgagtgtagcccgcgcacgggcttagactttaacgagatgatactgctcaccatgaagaacaaggcctggatggtacaccggcagtggttcttcgacctgcctctcccctggaccagcggcgccaccacggagacccccacttggaacaggaaggaactccttgtgaccttcaagaatgcccacgctaagaagcaggaggtggttgtgctagggtcacaggagggcgcgatgcacaccgccctcaccggggccaccgagatccaaaacagcggcggtacctccatcttcgctggccacctgaaatgccggctgaagatggacaaacttgagctgaagggcatgtcttacgcaatgtgcacgaacacattcgtgttaaagaaggaggtttccgaaacccaacacgggaccatcttgattaaggtcgagtacaaaggcgaggacgtgccatgcaagattcccttcagcacggaagacgggcagggcaaggcgcacaacggacgcttgatcaccgccaaccccgtcgtaaccaagaaggaagaacccgtgaacatcgaggccgagccgcccttcggggagtcgaacatcgtcatcggcatcggagacaacgccctgaaaatcaactggtataagaaagggtccagcataggcaaaatgttcgaggcgaccgcacgaggcgcccgccggatggccatccttggcgacacggcctgggacttcggctccgtgggaggcgtcctcaacagcctgggaaagatggtccaccagattttcgggtccgcgtacaccgccctgttcagcggcgtgtcttgggtgatgaagattggcatcggggtgttgctcacttggataggcctgaacagcaagaacacttctatgagcttctcctgcatcgccataggaatcatcacgttgtatctcggcgcagtcgtgcaggcagacatggggtgcgtcatcaactggaaaggaaaggagctgaagtgcggcagcggaatcttcgtgacaaacgaggtacatacgtggaccgagcaatacaagttccaggcggactcaccgaagcgcctcgccacggccatcgccggcgcctgggagaacggggtctgtggcatccgaagcaccaccagaatggaaaacctgctttggaagcaaatcgctaacgagttgaactacatcctgtgggagaacaatatcaagctgaccgttgtggtcggggacataatcggcgtgttggagcagggcaaacgcacgctgaccagtcaaccaatggagctgaagtacagttggaagacttggggcaaagccaagatcgtgactgccgaaacgcaaaacagctcattcatcattgacggcccgaacaccccagagtgcccctcggttagccgggcctggaacgtgtgggaggtggaggactacgggttcggcgtcttcactaccaacatatggctcaagctgcgcgaggtgtacacgcagctgtgcgatcaccggttaatgagcgcagccgtgaaggacgagcgcgccgtccacgccgacatgggatattggatcgagtcgcagaagaacggaagttggaagctggagaaggcctccctgattgaagtgaagacgtgcacctggcccaagagccacaccctctggtccaacggcgttctggagagcgacatgatcatcccgaagtccctggcgggacccataagccagcacaaccaccggcccggctaccacacccaaacggccgggccgtggcacttaggcaagctagagctggacttcaactactgcgagggcaccactgtggtgataaccgagaactgtgggactagaggcccatccctccgaaccaccaccgtcagcggtaagctcattcacgagtggtgctgccgatcctgcacgttaccgcctctcagatacatgggcgaggacgggtgctggtacggcatggagatccggccgataagcgagaaggaagagaacatggtcaagtccctggtgagtgccggctccgggaaggtggataacttcaccatgggcgttctgtgcctggccatcctgttcgaggaggtgatgcggggtaagttcggcaagaagcacatgatcgccggggtattcttcacattcgttcttctcctgagcggccagataacctggcgcgacatggcccacactctgattatgatcggctccaacgccagcgaccggatgggcatgggcgtgacctacctcgctctgatagccaccttcaagatccagccgttcctggccctcggtttcttcttacgcaagctgacttcgcgcgagaatctcctattgggcgtgggactcgcgatggccacgaccttacagctgcctgaagacatcgagcagatggccaatgggatcgccctcggcctaatggcgctgaagctcataacccaattcgagacctaccagctatggacggccttgatctctctgacctgtagcaacacaatcttcaccttgacggttgcctggcgcaccgccaccctgatcctcgccggggtgtccctcctgcccgtctgccagagctcatccatgcggaagaccgactggctcccgatggcggtagccgccatgggagtgccgccactccccctgtttatctttggtctcaaagacaccctgaagcgcaggtcctggccgctgaacgagggcgtcatggctgtgggcctcgtgagcatcctggcgtccagcctcctccggaatgacgtccccatggcggggcccctggtggccggcgggttactcatcgcctgttatgtgatcaccggcacctccgcggacctgaccgtcgagaaggcggcggacatcacgtgggaggaggaggcggagcagacaggggtgagccataacctgatgattacagtggacgacgacggcaccatgcgcatcaaagacgatgagaccgagaacatcctcacggtcctgctcaagaccgcgctcctgatcgtgagcggcatcttcccctactccatcccggccactctgctcgtgtggcacacttggcagaagcagacgcagcggtccggggtcctgtgggatgtaccctccccgcccgagacccagaaggccgagctagaggagggtgtgtaccgcatcaagcagcaggggatcttcgggaaaacccaggtgggcgtgggcgtgcagaaagaaggggttttccataccatgtggcacgtgacgcgtggggcagtgttgacatacaacggcaaacgcctggagccgaattgggcctccgtgaagaaagacctgatcagctacgggggcgggtggcggctatccgcgcaatggcagaagggcgaagaggtccaggttatcgccgtcgagcctggcaagaatcccaagaactttcagaccatgccaggaaccttccagacgaccacaggcgagattggggcgatcgccctggacttcaagccgggcacgagcggcagcccaatcatcaatcgcgaaggtaaggtggtgggcctgtacgggaacggcgtcgtgacgaagaacgggggttacgtatccggcatcgcccaaaccaacgcagaacccgacgggccgactcccgaattagaggaagagatgttcaagaagcgtaacctcaccatcatggacctgcaccccggcagcgggaaaactcggaagtacctgcccgccatcgtccgggaggcgataaagcgcagactccgcacgttgatcctggcccctacccgggtggtggcagccgagatggaggaggctctcaagggcctgcccatccgctaccagaccacggcgaccaaatccgagcacaccgggcgggagatcgtcgacctgatgtgccatgcgaccttcacaatgcgcctcttgagccccgtgcgggtacccaattacaatctgattatcatggacgaggcccacttcaccgacccggccagcatcgccgctcgcggttacatcagcacccgggttggcatgggtgaggctgccgccatcttcatgaccgcgacgccgcccgggacagcggacgccttcccccagagcaacgccccgatccaggacgaggaacgggacatcccggaacgcagctggaactccgggaacgagtggatcacagatttcgccgggaagaccgtgtggttcgtgcccagcatcaaggccgggaacgacatcgccaattgcctgcggaagaacggcaaaaaggtcatccaactgtcccgcaagacgttcgacaccgagtaccagaagaccaaactgaatgactgggacttcgtggtgaccacagacataagcgagatgggagccaatttcaaggctgaccgggtcatcgacccccgccggtgcctcaagccggtgattctgaccgacggacccgagagggtcatcctggctgggccaatgcctgtcactgcggcctcggctgcccagcggcgcgggcgggtgggccgcaacccgcagaaggagaatgaccagtatatctttaccgggcagcctctcaataacgacgaagaccacgcacattggaccgaggcaaagatgctgctggacaacatcaatacccctgaaggcatcattcccgcattgttcgagcccgagcgtgaaaagtccgccgcgatcgacggcgagtaccgcctgaagggggagtctcggaagacctttgtggagctgatgcgccggggtgacctccccgtctggctggcgcacaaggtggccagcgagggaatcaaatacaccgaccgcaagtggtgctttgacggccagcggaacaaccagatactggaggagaatatggatgtggagatctggaccaaagagggcgaaaagaagaaactccgcccccggtggttagacgcccgcacgtactccgaccccctggccctcaaggagtttaaggagttcgccgcggggcggaagagtatagcactggacctggttacagagatcggccgggtgccgagccatttggcccatagaacccggaatgccctggacaatctggtgatgctccacacgagcgagcacgggggcagggcctaccggcatgcggtggaggaactgccggagacgatggagacgttgctcctgctggggttgatgatcctgctgacgggcggagccatgctattcctgatctccgggaagggcataggcaagacctcaatagggctaatatgcgtgatcgctagctccgggatgctgtggatggccgagatccctctgcagtggatcgcctcggctatcgttttagagtttttcatgatggtgttactgatcccggagcccgagaagcagcgcacgccacaggacaaccaactggcctacgtcgtaatcggcatcttgaccctggccgcaatcatcgccgcaaatgagatgggcctgctcgagacaactaagcgggatctggggatgtccaaggagcccggcgtggtgagccccacgtcctatctggatgtggacctccaccccgccagcgcgtggacactgtacgccgtggcgacaaccgtgataactcccatgttgcgccacaccatagagaactccaccgctaacgtcagcctcgcagcgatcgccaatcaggcagtggtcctgatggggctagacaaggggtggcccatctccaagatggacctaggtgtcccgctgctggccctcggctgttacagtcaggtaaacccgctgaccctgaccgccgccgtgctcctgctgatcactcactacgccatcattggacccgggcttcaggcgaaggctactcgggaggcgcagaagcgcacggcagcgggcatcatgaagaaccccaccgttgacgggatcatgactatcgacctggacccggtgatttacgactccaagttcgagaagcagctgggccaagttatgctactggtcctgtgcgcggtacaactccttctgatgcggaccagctgggccctgtgcgaggccctgaccctcgccactggccccatcactaccctttgggaagggagtcccggcaagttctggaacacgaccatagcggtgagcatggcgaacatcttccgcgggtcatatctggccggcgccgggctggcctttagcatcatgaagtctgtcggcaccggcaaacgcgggacggggagccagggggaaaccctcggcgaaaagtggaagaaaaagctgaaccagctgtcgcggaaggacttcgatctttacaagaagtccgggatcaccgaggtggatcggacggaggcaaaggagggccttaagcgcggtgagatcacccaccacgcagtcagccggggctcggctaagctccagtggtttgtcgagcgcaacatggtaattccagaggggcgcgtgatcgatctcgggtgcggacgcggtggatggagctattactgtgcgggtctgaaaaaggtcactgaggtgcgtggatacaccaaaggcgggcctggccacgaggagcccgtgcccatgtccacgtacgggtggaacatcgtgaaactgatgtcgggcaaggatgtgttttacctcccgcctgagaagtgcgacaccctgctctgtgacatcggcgagtctagccccagtcccactgtggaggagtcacgcaccatacgcgtcctgaaaatggtagagccctggcttaagaataaccagttctgtattaaggttctgaacccttatatgcccacggtcatcgagcacctggaacgtctccagcgcaagcacgggggcatgctggtgcggaaccccctgtcccgcaacagcacccacgagatgtattggatatccaacggtactggaaacattgtggcctctgtcaacatggtgtccaggctcttgctgaaccgcttcaccatgacgcatcggagacccactatcgagaaggacgtggacctcggagcaggaacccggcacgtcaacgccgagccggagacccccaacatggacgtcatcggagagcgcatcaaacggatcaaggaggagcataactccacttggcactacgacgacgagaatccgtacaagacctgggcctaccacgggtcctatgaggttaaggccactggaagcgcctcctcgatgatcaatggggtcgtgaagttgctgaccaagccttgggatgtcgtgcccatggtgacccagatggcaatgacggacaccacccccttcggccagcagagggtcttcaaggagaaggtggacacgcggacaccccggagcatgcctggcacaaggcgcgtaatgggaattaccgctgagtggctgtggcggacactgggccgcaacaaaaagcctcggctatgcactcgagaggagttcactaagaaggtgcgcactaacgccgccatgggggcggtgttcacggaggagaaccagtgggactcggccaaggccgccgtggaggatgaggacttctggaaactcgtggaccgagagcgcgagctgcacaagttaggtaagtgcgggagctgtgtgtacaacatgatgggaaagcgggagaagaagttaggcgagtttggtaaggccaaaggctcccgcgcgatctggtacatgtggctgggggcgcggtacttagagttcgaggccctcggattcctgaacgaagaccactggtttagccgcgagaactcgtacagcggtgtggagggcgagggtcttcaccggctcggttacatcttgcgagacatctccaagatccccggcggggcgatgtacgcggacgacaccgcgggctgggacactcggattaccgaagacgaccttcacaacgaggagaagatcacgcagcaaatggacccggagcaccgccagctcgccaacgccatcttcaagctgacctatcagaacaaggtcgtgaaggtccaaagaccgaccccaacaggcacggttatggacatcatcagccgtaaggaccagcgggggtccggccaggtggggacctatggcctgaacactttcaccaacatggaggcccaattgatacgccaaatggaaggtgagggtgtgctatccaaagccgacctagagaaccctcatctacccgagaagaaaatcacccagtggctggagacgaaaggcgtagagcggctgaagcgcatggccatctccggggacgactgcgtggtaaagccgattgacgatcggttcgccaacgccctcctggcacttaatgacatggggaaggtacgcaaggacatcccccagtggcagccttccaaggggtggcacgactggcagcaggttcccttttgctcacaccacttccatgagttgatcatgaaggatggccggaagctggtggtgccgtgccgcccacaggatgaacttatcgggcgggcccgcatcagccagggcgcgggttggtccttaaaggaaacagcctgcctggggaaagcctatgcccagatgtggagcctgatgtacttccaccgcagggacctccgcctggcctcgaacgccatctgtagcgccgtgcccgtgcactgggtccccacctctcggaccacgtggagcatccacgcccaccaccaatggatgactaccgaggacatgctgaccgtgtggaacagggtatggatcgaggacaacccgtggatggaagacaagacgcccgtgactacctgggagaacgtcccgtacttgggaaagcgggaagaccagtggtgcggttcactaatcggcctgacgtcccgcgccacgtgggcgcagaatattcccaccgccatccagcaggtccggagcctcatcgggaatgaggagttcctggactatatgccgagtatgaaacgcttccgtaaggaggaggagagcgagggtgcaatctggtga

SEQ ID NO: 25873 - RNA, 9873 nt, synthetic construct
  misc_feature 1..9873: note = derived and/or modified CDS sequence (opt11) from DENV-3__KF973479__SS-prME
  source 1..9873: mol_type = other RNA
accagtctgtgcctaatgatgattctgcccgcagccctggcgtttcatctcaccagcagagacggcgaaccgcgtatgatcgtggggaagaatgagcggggcaagagcctactgttcaagaccgcgtccgggatcaacatgtgcaccttgatcgcaatggatctgggcgagatgtgcgacgacacggtgacgtacaagtgcccccacatcaccgaggtggagcccgaagacatcgactgttggtgcaacctgaccagcacgtgggtgacctacgggacgtgcaaccaggctggcgagcaccggcgcgacaagcggtccgtcgcccttgcgcctcacgtgggcatggggctggacacccgcacccagacttggatgagcgccgagggtgcctggcgccaggttgagaaggtcgaaacatgggccctgcgacacccggggttcaccattctcgcgctgttcctggcccactacatcggcacctcccttacccagaaagtggtgatcttcatcctgttgatgttagtcacgcccagcatgaccatgcggtgcgttggggtgggcaaccgggacttcgtcgaggggctgtcgggggccacctgggtggacgtggtcctggaacacggcggctgtgttaccacgatggccaagaacaaacccaccctcgacatcgaacttcagaagaccgaggccacccaactggcgacgctccggaaactgtgcatcgagggcaagataaccaacatcaccaccgacagccgctgccccacgcagggcgaggccaccctgccggaggagcaggaccagaactacgtttgcaagcacacctacgtcgaccggggctggggcaacggatgcggcctcttcgggaagggctccctggtgacctgcgcgaagttccagtgcctggagcccatcgagggaaaggtagtccagtacgaaaatctcaagtatacggtaatcatcaccgtgcacaccggggaccagcaccaggtcggaaatgaaacccagggggtgacggccgagatcacgccgcaggccagcaccaccgaggcgatcttgcccgagtacggcaccctgggtctcgagtgctccccacgcacgggtcttgacttcaacgaaatgatcctgttaactatgaagaataaggcatggatggtacatcggcaatggttcttcgacctgcccctgccctggaccagcggcgctaccacggagacacctacctggaatcgcaaggaactcctggtgaccttcaagaatgcacacgccaagaagcaggaggttgttgtcttaggaagtcaagagggcgcgatgcacaccgccctcactggggccaccgaaatccaaaacctgggcgggacgagcatcttcgccggccacctgaagtgccggttgaagatggacaagctggagctgaaaggtatgtcctacgccatgtgcacgaacacattcgtgctcaaaaaggaggtatctgagacccaacacggcaccatcctgatcaaagtggagtacaagggagaggacgcgccgtgcaagatccccttcagcacggaggacgggcaaggtaaggcccacaatggccgcctgattaccgccaatcccgtggtcaccaagaaggaggagcccgtgaatatcgaagccgagccgccctttggagaaagcaacattgtcatcggcatcggggacaacgcgctgaagatcaattggtacaagaaaggcagctccatcgggaagatgttcgaggccacagcccggggcgcccgccgaatggccatcctcggcgacacggcgtgggatttcggctcagtcggcggtgtgctgaactcgctgggcaagatggtgcaccagatctttgggagtgcttacaccgccctcttctccggcgtatcttgggtgatgaagataggcatcggggttctgttgacctggataggcctcaattccaagaacaccagcatgtccttcagctgcattgccatagggatcatcacgctgtacctgggggccgtcgtgcaggcggatatggggtgcgtgatcaactggaagggcaaggagctcaagtgcggctccgggatcttcgtcacaaacgaggtgcacacttggaccgagcagtataagtttcaggccgacagccccaagcgcctggccacggcaatcgccggcgcatgggagaacggggtgtgcggcattcggagcaccacccggatggagaacctgctctggaagcagatcgccaacgagttaaactacattttatgggagaacaacatcaagctcaccgtcgtcgtgggggacatcattggcgtcctggaacaggggaagcgcacgttaacgccccagccgatggaactcaagtatagctggaaaacctggggtaaggccaagatagtcaccgccgagacgcaaaactccagcttcatcatcgacggccccaacacccccgagtgcccctccgttagccgggcctggaacgtctgggaggtggaggactacggattcggcgtgttcaccacgaacatctggctgaagctgcgcgaggtctacacacaactctgcgaccatcggctgatgtccgccgcggttaaagacgagcgggccgtgcacgcagacatgggctattggatcgagagccagaagaacgggagttggaagctggagaaggcgtccctgatcgaggtcaagacgtgcacctggcccaaatcacacaccctatggtccaatggcgttctggagtcggacatgattatccccaaatccctcgccgggcccatcagccagcacaaccaccggccgggctatcatacacagacggcagggccttggcacttaggcaagctggagctcgacttcaactactgcgagggcaccaccgtggtcatcaccgagaactgcgggacgcgcgggccgtccctgcgaaccaccaccgtgtctgggaaactcatccatgagtggtgctgccgctcctgcactctgcctcccctgcgatacatgggcgaggacgggtgctggtacggcatggaaatccgccccatcagcgagaaggaggaaaacatggtgaagtccctggtcagcgccggctccgggaaggtagacaacttcaccatgggcgtgctatgcttagcgatcttgttcgaggaagtcatgcgggggaaattcggtaagaagcacatgatcgcgggtgtgttcttcacctttgtgctcctgctgagcggccaaatcacttggcgcgacatggctcacaccctcatcatgatcggctccagcgcctccgaccggatggggatgggggtcacctacctggccctgatcgccaccttcaaaattcagcctttcctcgcgctcgggttcttcctgcgcaagctcacatctcgggagaacctgttgctcggcgtgggcctggccatggccacgactctgcagctacccgaagacatcgagcagatggccaatgggatagcgctgggacttatggcgctgaagctaattacgcaattcgaaacctaccagctgtggacggccctcatcagcttaacctgttccaacaccatcttcaccctgacggtggcgtggcgcaccgcgaccctcatcctggcgggggtctccctcctcccggtctgccagtcctcgtcgatgcggaagaccgactggctgcccatggccgtcgcggccatgggcgtgccacccctccccctgttcatcttcgggttaaaggacacgctgaagcgccgcagctggccgctcaacgaaggcgtgatggccgtcggcctggtgtccatcctggcgtccagcctcctgcggaacgacgttcccatggccgggcccctggtggccggtgggctccttatagcctgctacgtgatcacgggcaccagcgcagacctgacagtggagaaggcagcggacatcacgtgggaggaggaagccgaacagaccggggtttcccataacctcatgatcaccgtggacgacgacggcaccatgcgcatcaaggacgacgaaacagagaacatcctgacggtgctgctcaagaccgccctgctgatagttagcggcatcttcccgtactccatccccgccacccttctggtgtggcacacgtggcaaaagcagacgcagcgtagcggggtgctgtgggacgtcccctccccaccagagactcagaaggcggagctcgaggaaggcgtgtaccgtatcaaacagcaggggatcttcggcaaaacccaagttggggtcggagtgcaaaaagaaggcgtgttccacaccatgtggcacgtcactcgcggggccgtgctgacctataacggcaagcgcctggaacccaactgggccagcgtgaaaaaggacctcatttcctacgggggagggtggcggctttcggcccagtggcagaagggggaggaggtccaagttatcgcagtggagcccggcaagaaccctaagaacttccaaacgatgccggggaccttccagacgaccaccggcgagatcggtgctatcgccctggacttcaagcccggcacctccggcagccccatcatcaaccgcgaggggaaggtcgtcggactgtacgggaacggcgtggtcactaagaacgggggctacgtcagcggcatcgcccagaccaacgccgagccggatgggcccacccccgagctcgaagaggagatgttcaagaagcggaacctgaccatcatggacctgcaccccggctccgggaagacgcgcaagtacctcccagcgatcgtgcgggaagccatcaagcgccgtctacggaccctgatcctcgcccccaccagggtcgtggccgccgagatggaggaggcgttgaagggcctgcccatccgttaccagaccacggccactaagagcgagcatactgggcgggagatcgtggacctcatgtgtcacgccaccttcacgatgcgcctgttatcccccgtccgggtgccaaactacaacctcatcatcatggatgaggcccacttcaccgaccccgccagcatcgcagcccgcgggtacatatccacccgtgtgggcatgggggaggccgccgcgatcttcatgaccgccaccccgcccggcaccgcagacgctttcccgcagagcaacgcccctattcaagatgaggagcgcgacatccctgagagatcctggaacagcgggaacgagtggatcaccgacttcgcgggcaagaccgtctggttcgtgccatccatcaaggccgggaacgacatcgccaactgcctgcggaagaacggcaagaaggtgatccaactaagccgcaaaacgttcgatacagaataccagaagacgaagctcaacgattgggacttcgtagtcaccacggatatctctgagatgggggccaacttcaaggccgaccgggtgatcgacccgcgccggtgcttgaagcccgttattctgaccgacgggcccgagcgagtgatcctcgcgggccccatgccggtgaccgccgctagcgccgcccagcggcgcgggcgggtcggccggaacccccagaaggaaaatgatcagtatatattcacggggcagcctcttaataacgacgaggaccacgcgcattggaccgaggccaaaatgctgctcgacaacatcaatacgccggagggcatcatcccggccctcttcgagcccgagcgggagaaatccgccgcgatcgacggcgagtaccgcttgaagggggaaagccggaagaccttcgtggaactcatgcgccggggcgacctgcccgtgtggctcgcccacaaagtcgcctccgaggggatcaagtacaccgaccgcaagtggtgtttcgacggccagcggaacaaccagatcttagaggaaaatatggacgtcgagatatggaccaaggaaggggagaaaaagaagttgcgccctcggtggctggacgcccgcacgtacagcgacccgttagccctgaaggagttcaaagagtttgcggcggggcgcaagtcaatcgcccttgacctcgttaccgagatcgggagagtccccagccacctggcccacagaacacggaacgcgctcgacaacctcgtgatgctgcatacctccgagcacgggggccgcgcgtacaggcacgccgtcgaggagctgcccgagacgatggagaccctcctgctcctagggctaatgatcctgcttaccggaggcgccatgctgttcctgatcagcggcaaaggcatcggtaagaccagcatcggcctcatatgcgtgatagcctccagcgggatgctgtggatggccgagataccgctgcagtggatcgcgtccgccatcgtgcttgagttctttatgatggtgctgctcatccccgaaccggagaagcagcggactccccaggataaccaactcgcctacgtggtgattggcatactgacgctggccgccatcatagctgcaaacgagatgggcctgctggagaccaccaagcgggacctcggcatgtccaaagagccgggtgtcgtatcacccacgagctacctcgacgtggacctgcaccccgcctcagcatggaccctgtacgcggtcgccaccaccgtgatcactcccatgctgcgtcacaccatcgagaacagcaccgccaacgtgagtctggccgccatagctaaccaggccgtcgtgctaatggggctcgataagggctggccgatcagcaagatggacttgggggtgcccctgctcgccctggggtgctactcccaggtcaaccccctgacactcacggcggccgtgctgctgctcatcacacactacgcgatcattggccccgggttgcaggccaaagccacccgggaggctcagaagcgcaccgccgcgggcattatgaagaacccaacggtggacgggatcatgaccatcgacctggaccccgtcatctacgacagcaagttcgagaagcagctcggccaggtgatgcttctggtgctctgtgccgtccagctgctgcttatgcggacatcctgggccctctgcgaggcccttaccctcgcgacagggcccatcaccactctgtgggaggggagccccggcaagttttggaacaccacgatcgccgtttccatggccaatatcttccgcgggtcatatctcgccggcgccgggctcgcgttctccatcatgaagtccgtgggcaccggtaagcgggggaccggatcccagggggaaaccctgggggagaagtggaagaaaaagctgaaccagctcagccgcaaggacttcgacctgtacaagaaaagcgggattacagaggtcgacagaacggaggccaaggagggcctgaaacgcggcgagatcacccaccacgccgtgtcccgagggagcgctaagttgcagtggttcgttgagcgcaacatggtcataccagagggccgagtgattgacctggggtgcggcagagggggctggtcatactactgtgccggccttaagaaggttaccgaggtccgggggtacacaaaaggagggcccggtcacgaggaacccgtccccatgagcacgtacggctggaatatcgtgaaacttatgtccggtaaagacgtcttctacctgccgccagagaaatgtgacaccctgctgtgtgacatcggcgagagctccccaagtcccaccgtggaggagtcccgcacaataagagtgctcaagatggtcgagccatggttaaagaacaaccagttctgcatcaaggtgttgaacccttacatgcccaccgtgattgagcacctcgagaggctgcagcgcaagcacgggggcatgctggtccggaaccccctctcccgaaactccacccacgagatgtactggatcagcaacgggacgggcaatatcgttgcgtccgtgaacatggtctcccgactgctactcaaccgcttcaccatgacgcatcgccggccaaccatcgagaaggatgtggacttaggcgccgggacaagacacgttaacgccgagcccgagacgcccaacatggatgtcatcggcgaacgcatcaagcggatcaaggaggaacacaattccacttggcattacgacgacgagaatccgtataagacctgggcctaccacgggagctacgaggtcaaggcaaccggttccgcgtcttccatgattaacggggtcgtcaagctgctaacgaagccctgggatgtggtgccgatggttacacagatggctatgactgacactactcccttcggacaacagcgcgtcttcaaagagaaggttgacacgcggaccccgcgctcaatgcccggcacacggcgcgtgatgggtatcaccgccgagtggctgtggcggacgctgggccgcaacaagaagccccggctctgcaccagagaagagttcaccaagaaggtgcggaccaatgccgcgatgggcgcggtcttcacggaggaaaaccagtgggactcggccaaggccgccgtggaggacgaggacttctggaagctggtggaccgggagcgcgagctgcacaagctcggcaagtgcgggtcctgtgtgtacaacatgatgggcaaacgggagaagaagctgggagagttcgggaaggcgaagggctcgcgcgccatctggtacatgtggctgggagcccggtatctcgagttcgaggcactgggcttcctgaacgaggaccattggttctcccgagagaatagctactccggggtggagggcgagggcctccacaagctggggtacatcctaagggacatcagcaagatcccgggcggggccatgtacgcggacgacaccgccggctgggacacccgcatcaccgaggacgacctccacaatgaggagaagataacgcagcagatggacccggaacaccggcagctggccaacgcgatcttcaagctgacctaccagaacaaggttgtcaaagtgcagcgccccacccccaccggaaccgtaatggacatcatctcccggaaggaccagcgcgggagcggccaggtcgggacttacgggctcaatacctttaccaacatggaggcacagcttatccggcaaatggagggggaaggcgtgctatctaaggctgacctcgagaatccccacctaccggagaagaagatcacgcagtggctggagacgaagggcgtggaaaggctcaagcggatggccatctcgggggacgactgcgtggtgaagcccattgacgacaggtttgccaatgcactgctcgccctcaacgacatgggcaaggtgcggaaggacataccccagtggcagccatccaaggggtggcacgattggcagcaggtcccgttctgcagccaccacttccacgagctgatcatgaaggacgggcgcaagctggtggtcccctgccgtccccaggacgagttgatcgggcgcgcgaggatatcccagggcgccggatggagcctgaaggaaactgcttgcctgggaaaggcctacgcgcagatgtggtcccttatgtacttccaccgccgcgacctgcggctggccagcaatgccatctgctccgccgtcccggtgcactgggtgccgaccagccgcacaacgtggagtatccacgctcaccatcagtggatgactaccgaggacatgctcaccgtgtggaatcgggtgtggatcgaggataatccatggatggaggacaagacgccagtgactacctgggaaaacgtcccctatctgggcaaacgcgaggaccagtggtgtggttcactgattggactcaccagccgggcgacgtgggcccagaacatcccgaccgcgatccagcaggtccgctccctgatcgggaacgaggagttcttagactacatgccctctatgaaacggttcagaaaggaggaggagtccgagggcgccatctggtaa

SEQ ID NO: 25874 - RNA, 9873 nt, synthetic construct
  misc_feature 1..9873: note = derived and/or modified CDS sequence (opt11) from DENV-3__KF973480__SS-prME
  source 1..9873: mol_type = other RNA
accagcttgtgtctcatgatgatcctgcccgcagctctggcgttccatctcacatcccgagatggcgagccacggatgatcgtgggtaagaacgagagagggaagagcctgctctttaagacagcctcgggaatcaacatgtgcaccttgatcgccatggacctgggcgagatgtgcgatgacacggtgacttacaagtgcccacacatcacggaggtagagcccgaggacatcgactgttggtgcaatctgaccagcacatgggttacgtatgggacatgcaaccaggccggtgagcaccgacgggacaaacggtccgtcgcgctagcaccccacgtgggcatggggctggatacccgtacacagacctggatgagcgctgagggcgcctggcgccaggtagagaaggtcgaaacatgggctctgcgccatccgggattcactattctcgcgctttttcttgcacactacatcggcacctcactcacccaaaaagtcgtaatcttcacgctgctgatgctagtcacccccagcatgaccatgcggtgcgtgggggttggcaaccgcgactttgtagagggcctcagtggcgccacctgggtcgacgtggttctagaacacggcggatgcgtgacgaccatggccaaaaacaagccgaccctcgacatcgagttgcagaagacagaggccacgcagttggcgaccctcaggaagctgtgcatcgagggtaagataaccaacattacaacggactcgcgttgcccgacgcagggcgaggcaaccctacccgaggagcaggaccagaactatgtatgcaaacatacctatgtagatcgagggtggggcaacgggtgcggcctgttcgggaagggctccctggtgacctgcgctaaattccagtgcttggagccgattgagggcaaagtcgttcagtacgagaacctcaagtacactgtgatcatcactgttcacaccggggaccagcaccaggtcggcaacgagacgcagggggtgaccgccgaaataactccccaggcaagcaccacggaggcgatcttgcccgagtacggaacgctggggctcgagtgcagtccgcgcaccggcctggacttcaacgagatgattctccttaccatgaagaacaaagcgtggatggtccaccggcaatggttcttcgacctgcccttaccgtggactagcggagcgacgacagagacccccacatggaatcgcaaggagttactggtgacgtttaagaacgcccacgcaaagaagcaggaggtggtcgtgctggggtcccaggagggcgcgatgcacaccgccttgaccggcgcaaccgagattcagaacagcggcggtacgtccatcttcgccggccacctgaagtgtcggttaaagatggataagctcgaactgaagggaatgagctacgcgatgtgtaccaacaccttcgtgcttaaaaaggaggtctccgagacccagcatggtacgatcctcatcaaggtggagtataagggcgaagacgtgccttgcaaaattccgttttctaccgaagacgggcagggcaaggcgcataacgggcgcctgatcaccgcgaaccccgtcgtgaccaagaaggaggagcccgtgaatatcgaggccgagccgcccttcggggagagcaacatcgtcatcgggatcggagacaatgccttgaagatcaactggtacaagaaaggcagtagcatcgggaagatctttgaggcgactgcacggggcgctcggagaatggccattctgggggacaccgcatgggacttcggatccgtgggcggtgtcttaaacagcctgggaaagatggtccaccagatattcgggtccgcctataccgccctgttttcgggtgtgtcctgggtcatgaaaatcggcattggggtactcctgacttggatcggcctgaacagcaaaaatacctccatgagcttctcgtgcatagcaatcggaatcatcaccctgtacctcggcgcagtggtgcaggccgatatggggtgcgtcatcaactggaagggcaaggagctgaaatgtggtagcggtatcttcgtgaccaacgaggtgcatacgtggacggagcagtataagttccaagcggactccccgaagcgcctcgccacggcgatcgccggcgcctgggaaaatggggtctgtgggatccgcagcactactcggatggagaacctgctgtggaagcagatcgcaaacgagctcaactacatcctgtgggagaacaatatcaaattgactgtagtcgtcggagacataatcggcgtgctagagcaagggaaacgcaccctgacgccccaaccaatggaactgaagtactcctggaagacctgggggaaggccaagatcgtgacggccgagactcagaatagctcattcatcatcgacggccccaacacccctgagtgccccagcgtctctcgggcgtggaacgtatgggaggtggaggattacggcttcggcgtcttcaccaccaacatctggctcaagcttagagaggtctacacgcagttgtgcgatcatcgtctcatgagtgcggctgtgaaggatgagcgcgctgtccacgccgacatgggctactggattgaaagccagaagaacgggtcctggaaactggaaaaagcttccctaatcgaggtgaagacgtgtacctggcctaagtctcacaccttatggtcaaatggcgtgctggaatcagatatgataatcccaaagagccttgcgggcccgatctcccagcacaatcaccgccctggctaccacacgcagaccgccgggccgtggcacctcggcaaactggagctggacttcaactactgcgaaggaactacggtggtgatcacggagaactgcgggacccgcggcccctccctccggaccaccacggtgtcgggcaagttgatacacgagtggtgctgccgcagctgcacacttccccccctccggtatatgggcgaggacggatgctggtacggcatggaaatccgccccatatcagagaaggaggagaacatggtcaaaagcctcgtttccgcgggcagtggcaaggtggacaacttcaccatgggggtcctttgcctagctatcctgttcgaggaggtgatgcgggggaagttcgggaaaaagcacatgatcgccggggtgttcttcacattcgcgctgctcctctccggccagatcacgtggcgcgatatggcccacacgctgatcatgataggtagtaacgcctccgatcgtatggggatgggcgtcacctacctcgccctgatcgccaccttcaagatccagcccttccttgcgctcgggttcttcctgcgcaagctgacgagccgagagaacctcctacttggcgtggggctcgccatggccaccaccctacagctgcccgaggatatcgaacagatggcaaacggaatcgcgctcggcttgatggccctaaagttaatcacgcagttcgagacgtaccagctttggactgccctgatctccctgacctgcagtaacactatatttacattgaccgtggcatggcgcaccgcgaccttgatactcgcgggggtaagcctcctgccggtgtgccagtcgagctcaatgcggaagacggactggttacccatggcggtcgctgccatgggagtgccgccgctgccgctgttcatcttcgggctcaaagacaccctgaagcgccgcagctggcctctgaatgaaggcgtgatggccgtcggcctcgtgtctatccttgcgtcgtccctgctccggaacgacgtgcccatggccggacctttagtcgccggcgggctgcttatcgcctgctacgttatcaccgggaccagcgccgacctcacagtggaaaaagccgccgacatcacctgggaggaggaggccgagcagactggggtatcccataatctaatgatcaccgtggacgacgacggcacaatgcgcataaaggacgacgagacggagaacatcctcactgtgttactaaaaacggcgctactaatcgtcagcggcatcttcccgtattccatcccagctaccctgctcgtatggcacacgtggcaaaagcagacgcagcgtagcggcgtgctgtgggacgtcccttccccgcccgagacccaaaaggcagagctggaagaaggtgtgtaccgcatcaagcagcaggggatcttcggcaagactcaggtgggggtcggcgtgcagaaagagggtgtgttccacacgatgtggcacgtcacacgcggggcagtccttacctacaacggcaagcgcctagagcccaactgggccagcgtaaagaaagacctaatctcatacggaggcgggtggcggctcagcgcccagtggcagaaaggcgaggaagtacaggtgatcgcggtggagcccgggaagaacccaaagaactttcagaccatgcccggtacgttccagacaaccaccggtgaaatcggggcaatcgcactggacttcaagcccggcacatccggaagcccaatcattaaccgcgaggggaaggtcgtgggcctgtacggcaacggcgtggtcaccaagaacgggggctacgttagcgggatcgcccagaccaacgccgagccggatgggcccactcccgagctggaggaggagatgttcaaaaagcggaacctcacgataatggacctgcatcctggctctgggaagactcgcaagtacctgccagcgatcgtgcgggaggccatcaagcgccggctccgcaccctgatactggctcccacccgagtcgtggccgcggagatggaggaagccctcaagggcttgcccatccgctaccagaccaccgccaccaagtccgagcacaccgggcgtgagatcgtggacctgatgtgtcacgccacgttcaccatgcggctcttaagccccgtgagagtgccaaactacaatctgatcatcatggacgaggcccactttaccgaccccgcgagcattgcggcccgcggatacatctccacccgagttggtatgggggaggctgccgcgatcttcatgaccgccacaccgcccggcaccgccgacgcatttccgcagtcgaatgcccctatccaggacgaggagagagacataccggagcgctcctggaactctgggaacgaatggattaccgacttcgcgggcaagacggtctggtttgtgccctccatcaaggccgggaacgatatagccaactgcctgcgtaagaacggcaaaaaagtaatccagctgtcacgcaagactttcgacacagagtaccagaaaaccaagctgaacgactgggactttgtcgtgacgacggatatcagcgagatgggcgccaacttcaaggccgaccgtgtgatcgaccctcgccggtgtctcaagcccgtcattttgaccgatgggcccgagcgcgtgattcttgcgggccccatgccagtgaccgcggccagcgcagcccagcggcgcgggcgggtcggccgaaacccccagaaagaaaacgatcaatacatcttcaccggacagcccctcaacaatgatgaagatcacgcgcattggacggaggcaaaaatgctgcttgataacatcaacacgcccgaggggataatcccggccctctttgagcccgagagagagaaatcggccgccattgacggcgagtacaggctgaaaggggaaagccggaagacatttgtcgaactgatgaggcgcggcgatctccccgtgtggctagcccacaaggtcgcctccgagggtatcaagtacacggaccgcaaatggtgcttcgacggacaacggaataaccagatccttgaggagaatatggacgtggagatctggacgaaggagggagagaaaaaaaagttgcgaccacggtggcttgatgcccgcacctactccgacccattggccctcaaggaattcaaggaattcgcggcggggcgcaagtccattgctctggatctggtcacagagataggccgggtgcccagccacctcgcacaccgcacccgcaacgccctggacaaccttgtgatgttacatacctctgagcacgggggcagggcgtataggcatgccgtcgaagagctgcccgagaccatggagaccctgctcctgctgggtctgatgattctgctgaccggcggcgccatgctctttctgatcagcgggaaaggcatcggcaagacgagtatagggctgatttgcgtgattgcctccagcggaatgctctggatggctgaaattccgctgcaatggattgcgagtgccatagtcctggagttcttcatgatggtcttactgatccccgaacccgagaagcagcgcacgccgcaagacaatcagctggcctacgtggtgatcggaatcttgactttggccgccatcatcgcggccaatgagatgggcctgttggagaccaccaagcgggacttggggatgagcaaagagcccggcgtcgtttcccccaccagctacctggatgttgacctccacccggcctccgcctggactctatacgcggtcgccaccacggtgattacccccatgctccgtcacaccatcgagaacagcacggccaacgtgtccctcgcagcgatcgccaaccaggcagtcgtgttaatggggctggataagggctggccgatcagtaagatggacctcggggttccacttttggccctgggatgctactcccaggtcaacccccttacgctgaccgccgcggttttgctgttgatcacccactacgcgatcataggtcccgggctgcaggctaaagcaacccgagaggcccagaagcgcaccgccgcgggcatcatgaagaacccgaccgtggatgggatcatgaccatcgacttagacccagtgatatacgacagcaagttcgaaaagcaactgggacaagtgatgcttctggtcctctgcgccgtccagctcctgctgatgcgaacctcttgggccctctgcgaggccctgacgctggcaaccggcccgatcaccaccctctgggaggggagccccggcaagttctggaacacaaccatcgccgtgtccatggccaacatatttcgtggtagctatctggctggcgcaggactcgcattctccataatgaaatccgtgggaaccggaaagcgggggaccggctcccaaggggaaaccttaggggagaagtggaagaagaagcttaaccagctgagccgcaaagacttcgacctttataagaagtccgggatcacggaggtggaccgaaccgaggccaaggaaggcctgaaacgcggtgagatcacgcaccacgccgtgagtcgggggagcgcgaagttacagtggttcgttgaacgcaacatggtaatcccggagggacgggtgatagacctggggtgcggccgcgggggctggtcctactattgcgccggactgaagaaggtgacggaggtccggggttacacaaagggaggtcctggacatgaagaacccgtccccatgagcacctatgggtggaacatcgtcaagcttatgtccgggaaggacgtgttctacctcccgcccgaaaaatgcgacacactgttatgcgacataggcgagagctccccctctcccaccgtggaggagtcccggacgatccgcgtgctgaagatggtcgaaccgtggctcaagaacaaccagttctgtatcaaagtgcttaatccctacatgcctaccgttatcgaacatctggagcgtctccaacgcaagcacggaggtatgctggtcagaaacccactgagcaggaacagtacccacgagatgtactggatcagcaacggtacaggtaacattgtggcgtccgtcaacatggtcagccggctcctgctgaacaggtttactatgacccaccggcgcccgactatcgagaaagacgtagacttgggcgccggaactaggcatgtcaacgccgagccagagacgcccaatatggacgtcataggcgaacgcatcaagaggatcaaggaggagcacaactccacctggcactacgacgacgaaaacccatacaagacttgggcctatcacgggagctatgaggttaaggcaacgggctccgcgtcatccatgatcaatggtgtggttaagctgttaacgaagccctgggatgtggtccccatggtgacccagatggccatgaccgacaccacaccattcggccagcagcgcgttttcaaggagaaagtggacacccggaccccacgcagcatgcccggaactcggcgcgtgatggggataacggccgagtggctgtggcgaaccctgggacgtaacaagaagccccgtctgtgcacgcgcgaggagttcactaagaaagtgcgcacgaacgccgccatgggcgccgtattcactgaagagaaccaatgggatagcgccaaggccgccgtggaggatgaggacttttggaagctagtagaccgagagagggagctccacaagctcgggaagtgcggatcgtgcgtctacaacatgatgggcaagcgggagaaaaaactaggtgagttcggtaaggcgaaaggcagccgcgccatttggtacatgtggctgggggcccggtacctggaatttgaggcgctaggcttcctgaacgaggaccattggttctcgagagagaacagctactccggggtcgagggggaggggttgcacaaactcgggtacatattaagagacataagcaaaatccccggcggggccatgtacgcggacgacaccgccggctgggacacgcgcatcacggaggacgacttacataacgaggagaagatcacccagcagatggaccccgagcaccggcagctcgcgaatgccatcttcaagcttacataccagaacaaggtggtgaaggtgcagcgacccacccccaccggcacggtgatggacatcatatcccggaaggaccagcgcggcagcggtcaggtcggaacctacgggctcaacaccttcaccaacatggaggcgcaactgatacggcagatggagggggagggagtgctgtccaaggctgacctggaaaacccccatctcccggaaaagaagattactcaatggctggagaccaagggcgtcgagaggttaaaacgtatggcgatcagcggagatgactgcgtcgtgaagcctatcgacgaccgcttcgccaacgcgttattagccttgaatgacatgggcaaggtgcggaaggacatcccccagtggcaaccatctaagggatggcacgattggcagcaagtcccgttctgcagccaccacttccacgagttaatcatgaaggatggccgaaagctggtggtaccctgccgtccacaggatgagttaatcggccgggcgcggatctcccagggcgccggatggagcctcaaagagaccgcctgtttagggaaggcctacgcgcagatgtggtcgctgatgtacttccatcgccgtgacctccggctagccagtaacgccatctgctccgccgtacccgtccactgggtaccaaccagccgcacgacctggtccatccatgcccatcaccagtggatgaccaccgaggacatgttaacggtctggaatcgtgtgtggattgaagacaacccatggatggaggataagactcccgtgaccacctgggagaacgtcccctaccttgggaaacgggaggaccagtggtgtgggagcctgattggcctgacgagcagagcgacctgggctcagaatatcccgaccgcaatccagcaggtccgttccttaatcgggaacgaggagttcctggactacatgcccagtatgaaacggttccgtaaggaggaagagtccgagggcgccatttggtga

SEQ ID NO: 25875 - RNA, 9873 nt, synthetic construct
  misc_feature 1..9873: note = derived and/or modified CDS sequence (opt11) from DENV-3__KF973481__SS-prME
  source 1..9873: mol_type = other RNA
acaagcctttgcctaatgatgatcctgcccgccgcacttgctttccacctcaccagccgggacggtgaaccccggatgatcgtggggaagaacgaacggggcaagagcttactgttcaagaccgccagcggtatcaacatgtgcacgctaatcgccatggatctgggggagatgtgcgacgacaccgtcacctacaagtgcccccacatcaccgaggtggagcccgaagacatcgactgttggtgcaaccttaccagtacctgggtgacttacgggacgtgcaaccaggccggcgagcatagaagggacaagcggtccgtggccctcgctcctcacgtgggaatgggcctcgacacccgaacccagacctggatgtcagcagagggcgcatggcgccaggtggagaaggtggagacgtgggccttgcgccatcccggcttcactatccttgctttgttccttgctcactatataggcacctccttgacgcagaaggtggtgatcttcatacttctgatgcttgtgacgcccagtatgaccatgcggtgcgtgggggtcggtaaccgcgactttgtggagggcttatccggggcgacctgggtggacgtggtcttggaacacggcgggtgcgttaccacgatggccaagaacaagccgacactcgacatcgagttacagaagaccgaggccactcagctggcgacgctccggaagttgtgcatagagggcaagataacgaacatcaccaccgactcccggtgtcccacccagggcgaggccaccctgccggaagaacaagaccaaaactacgtctgcaagcatacgtacgtcgaccgagggtggggcaacgggtgcggactcttcggaaagggctctctagtaacctgtgccaagttccagtgtctggagcccatagaaggcaaggtggtccagtacgagaacctcaagtatacaatcatcatcaccgtgcacacaggcgatcaacaccaggtgggcaatgagacccagggggtcacggccgagatcacgcctcaggcctccactaccgaggcgatactgcccgagtacggcaccctggggctcgagtgctccccacgcactggcctagatttcaacgagatgatcctgctaacgatgaagaataaggcatggatggtgcaccggcaatggttcttcgaccttcctctgccgtggaccagcggggctacaaccgagacccccacttggaatagaaaggagctcctggtcacgttcaagaatgcgcacgccaagaagcaggaggtggtggtcctgggttcccaagagggcgcgatgcacacggccctaaccggggccaccgagatccagaacagcggcgggacttctatcttcgccggccacctgaaatgtcggctgaagatggataagctggagctgaagggcatgtcatacgccatgtgcacaaacaccttcgtgttgaagaaagaggtgtccgagacacagcacggaaccatacttatcaaggttgagtacaagggcgaggatgtgccgtgcaagatcccattcagcacagaagacggtcagggtaaagcgcacaatggccgcctgatcactgccaacccagtcgtgaccaagaaggaggagcccgtgaacatcgaagccgagccgccgttcggtgagtctaacatagttatcggcatcggagataacgccctgaaaatcaactggtataaaaagggcagctcaatcgggaagatgttcgaagcgaccgcacggggcgcgcgtcggatggccatcctgggcgatactgcatgggactttgggtccgtgggcggggtcttaaattctctggggaagatggtgcaccagatcttcgggtccgcgtacaccgctctcttcagcggcgtctcctgggtgatgaagatcggcatcggtgtcctcctgacctggatcggcttgaatagtaaaaacacctcaatgagcttctcctgcatcgccatcgggatcatcacgctctacctaggcgccgtggttcaggccgatatggggtgtgtgataaactggaagggtaaggaactgaagtgcggtagcgggatcttcgtcaccaatgaggtccacacttggaccgagcagtacaagttccaggcggactcccccaagcgcctcgctacggctatcgctggcgcctgggagaatggggtttgcggcatcaggagcactacccgtatggagaacctcctgtggaagcaaatcgcgaacgagctcaattacatcctatgggagaacaacataaaactgaccgtggtggtgggagatataatcggcgttttggagcagggcaagcgcacgctgactccccagccaatggaattgaagtactcctggaaaacctgggggaaggccaagatcgttaccgccgagacccaaaattctagcttcataatcgacggacccaatacgccggagtgcccatcggtctcccgggcctggaacgtttgggaggtggaggactacggattcggcgtgttcaccaccaacatctggctcaaactgagagaagtgtacacccagctatgcgaccaccggctcatgagcgcggccgtaaaggacgagcgggcagtacatgccgacatgggctactggatagagtcacagaagaacgggtcatggaagttggagaaggccagcctgatagaggtaaagacgtgcacctggccgaagtcccacacgctctggtccaacggcgtactggaatccgacatgatcatacccaagtccctggcggggcccatctctcagcacaaccaccggccgggctaccatacccaaacggcaggtccatggcacttaggcaaacttgagctggacttcaattactgcgagggcacaaccgtcgtcatcaccgagaactgcggcacgcgcgggccctcactccgtaccacgaccgtttccgggaagctgatccacgagtggtgctgtcgcagctgcacgctgccaccgctcaggtacatgggcgaagatggctgctggtacggcatggagatccgccccatatccgagaaggaagagaacatggtcaagtcactggtgtccgccgggagcgggaaggtggacaacttcaccgtgggcgtcctgtgtctcgcgatactattcgaggaagtcatgcggggtaagttcggtaagaagcacatgattgcaggggtatttttcacttttgtcctgctcctgtccggccagattacatggagggacatggcgcacacgctgattatgattggcagcaacgcgtccgatcggatggggatgggagtgacctacttagcactgattgccaccttcaagatccagcccttcctggccctcgggttcttcctccgcaagctcaccagcagggaaaacctgctgttaggagttgggctcgcaatggccacgaccctgcagctgcccgaggatatagagcaaatggccaacggaatcgccctcggcctgatggcattaaaattaatcacccaattcgagacctaccagttgtggacggccttgataagcctgacctgctccaacaccatcttcaccctgaccgtcgcttggcgtaccgccaccctgatcctagccggtgtgagccttctgccagtctgtcagtccagctccatgcgtaaaacagactggctcccaatggcggtagcggctatgggcgtgccgcctttgcctctgttcatttttgggctcaaggacacgttaaagcgacggtcctggcccttgaacgagggcgtcatggccgtgggcctcgtgtcgatcctggcaagctcactgctccggaacgacgtccctatggctggccctctggtagcgggcggcttactaatcgcctgctatgtgattacagggacctcggccgatctgactgtggagaaggccgcggacattacatgggaagaggaagcggaacaaacaggcgtgtcccataacctgatgataaccgtggacgatgacggcaccatgcgcataaaagacgacgaaaccgagaacatcctcacggtcctgttgaaaacggctctcctgatcgtgagcggcattttcccatactccatcccagccacactactcgtttggcacacctggcagaaacagacacaaagatcgggcgtcctgtgggacgtgcctagcccgcccgagacccagaaggccgagctggaggaaggcgtgtaccgcatcaaacagcagggtatcttcggcaagacccaggtaggggtcggcgtacagaaggagggcgtcttccacaccatgtggcacgttacgcgcggggccgtcttaacatacaatggcaagagactcgagcccaactgggccagcgtcaagaaggacctgatctcatacgggggcgggtggaggctcagtgcccaatggcagaagggcgaggaagtgcaagtgatcgcagtcgagccgggtaaaaaccccaagaactttcaaacaatgcccgggacgttccaaaccactacgggcgagataggggccatcgcattagattttaagcctgggacctcagggagccccatcataaaccgcgaggggaaagtggttgggttgtacgggaacggtgtcgtgacgaaaaacggaggctacgttagcggaatcgcccagaccaacgccgagcctgacgggcccacccccgagctggaggaggagatgttcaagaagcggaacttgaccatcatggacctgcaccccggttccggcaagacgcgcaagtacctgccggcgatcgtccgggaggcaattaagaggcggctccgcaccttaatcctggcccctacccgggtggtggccgccgaaatggaagaggccctcaagggcctgccgatccgctaccagaccacggcgaccaagagcgagcataccgggcgggagattgtcgacctgatgtgccatgctaccttcacgatgcggctactgtctcccgtgcgggtgccgaattacaatctaatcatcatggatgaagcccactttaccgaccctgccagcatcgccgcccgcggctacatatccacgagagtagggatgggggaggccgcggccatctttatgactgcgacgccacccggcaccgccgacgcttttccccagagcaacgcccccatccaggacgaggagcgcgacatccccgagcgctcatggaacagcgggaacgagtggataactgactttgcgggtaaaaccgtgtggttcgtgccatccataaaggcggggaacgacatcgcgaactgcctccggaagaacggcaagaaagtaatccagttaagcaggaagacgttcgataccgagtaccagaaaaccaagctcaacgattgggatttcgtggtgaccacggatatcagtgagatgggcgccaactttaaggccgaccgggtcatcgacccgcgcagatgcctcaagccggtgatcctgaccgatgggcctgagcgcgtgatactagccgggcccatgccggtcactgctgccagcgccgcacaaaggcgcggacgggtgggtcgcaacccccagaaggagaacgatcagtacatcttcaccggtcagccgctcaacaacgacgaggaccacgcccactggacagaggccaagatgctgctggacaacattaacactccggagggcatcatcccagctttattcgagccagagcgggaaaagtccgccgcgatcgacggcgagtaccgcctgaaaggggaatctcgcaagaccttcgtggaactgatgcgccggggcgacttgcccgtttggctggcacacaaggtggccagtgaggggatcaagtacaccgaccgcaagtggtgcttcgacggacagaggaacaaccagatactagaagaaaacatggacgtggagatctggaccaaggagggcgaaaagaagaagctccgcccccggtggctggacgcgcgcacctactcggatccgctggcgctcaaggagttcaaggagttcgccgcgggccgcaagtccatcgccctggacctggtcactgagatcggccgagtgcccagccacctcgcccaccgcactcgcaacgccctggacaacctggtcatgttgcacacttccgaacacgggggccgcgcgtaccggcacgcggtcgaagaactacctgagacaatggagacactgttgctgctggggttaatgatcctgctgaccggcggggccatgctgttcctcatctcggggaagggcattggcaagacctctattggcctaatatgcgtcatcgcaagcagcgggatgctctggatggctgagatcccgctgcagtggatagcctctgcgatcgtactggagttcttcatgatggtgctcctgatcccagaacccgagaagcagcgcacgccccaagacaaccagctggcctatgtggtcatcggcattttgaccctggccgccatcatcgcggctaacgagatgggcctgctagagaccacgaagcgggacttggggatgagcaaggagccgggcgtggtttcccccacgtcgtatctggacgtcgacctccatccagcctctgcctggaccctgtacgccgtggcgaccaccgtgatcacccccatgttaagacataccatagagaactctaccgccaacgtttcattagccgccatagccaatcaggcggtcgtgttgatgggtttagacaagggctggccgatcagcaagatggacttaggagtccccctgcttgcgctcggctgctacagtcaagtgaaccccctgaccctgacggccgccgtgcttttactgatcacccactacgccatcatcggccctgggttacaggcgaaggcaactcgggaggctcagaagcgcaccgccgccggcatcatgaagaacccaactgttgacgggatcatgacaatcgacctggatcccgttatctacgacagcaagttcgagaagcagctgggacaggtgatgctccttgttttgtgcgcggtgcagctcctgctaatgcggacctcctgggccttatgcgaggcgcttaccctggccacgggccccatcacaaccctatgggaggggagccccggcaagttctggaacaccacgatcgcggtgtctatggccaacatcttccgcggaagctatcttgccggcgccgggttagccttttccatcatgaagtccgtcggcacaggcaagcgggggaccgggtcgcagggggagaccctcggggagaagtggaagaagaagctgaaccagctaagccgtaaggatttcgacctctacaagaaatccgggatcactgaggtggaccggacggaggcgaaagagggcctgaagagaggagagatcacccaccacgccgtatcccgggggagcgcaaagttgcagtggttcgtcgagcggaatatggtgatacccgagggtcgggtgatagaccttgggtgcggacgcgggggctggagctactactgcgcgggccttaagaaggtcaccgaagtgcgggggtacactaaaggagggcccggccacgaggaacccgtgcccatgagtacgtatgggtggaacatcgtcaagttaatgtccggcaaagatgtcttctacttgccgcccgagaagtgcgacacactcctgtgcgacatcggcgagagctcgcctagccccaccgtagaagagtcccgcacgatccgcgtccttaagatggtggaaccttggctaaagaacaaccaattttgcatcaaggtactgaacccctacatgcccacggtcatcgaacacctggagcgcctccagagaaagcatgggggcatgctcgtgcggaacccactgagccgcaactccactcatgagatgtattggatcagcaatgggaccggcaacatcgtcgcgtccgtgaacatggtgtcccggttgctgctgaaccgcttcaccatgacgcaccggcgaccgaccattgagaaggacgtggacttaggggcggggaccagacatgtcaacgccgaaccagagacacccaacatggacgtgatcggtgagaggatcaagcggatcaaggaggagcacaactccacatggcactatgatgacgagaacccgtacaagacttgggcgtatcatgggagctatgaagtcaaagccacgggctctgccagcagcatgataaacggagtcgtgaaacttctaacaaagccctgggatgtggtgcccatggtgacgcagatggcaatgactgacacgacaccgttcggccagcagcgcgtctttaaggagaaagtggacactcggaccccgcgcagcatgccgggtacgcggcgggtgatggggatcaccgctgagtggctctggcggacccttggccgaaacaagaagccccgcctgtgcacgcgcgaggagttcaccaagaaggttaggacgaacgccgccatgggggccgtttttacggaggagaaccagtgggacagtgccaaagccgcagtggaggatgaggatttctggaagctagtggacagggagcgagagctgcacaagctgggaaaatgcggatcatgcgtgtacaacatgatggggaagcgtgagaagaaacttggcgagttcgggaaggccaagggctcacgcgcgatctggtatatgtggctgggggcccgttacctggagttcgaggccctcggcttcctgaacgaggatcactggttctctcgcgaaaacagctactccggggtagagggcgagggcctgcataagctcgggtacatactgcgggatatcagcaagatccccggcggtgccatgtacgccgacgataccgcgggttgggacacccgcatcaccgaggatgacctacacaatgaggagaagatcacccagcagatggacccggagcatcggcagctcgccaacgcgatcttcaagctgacctaccagaacaaggtcgtgaaggtccagcgaccaacccccaccggcaccgttatggacatcatttcccggaaggaccagcgcgggagcggccaggtgggcacatacggcctgaacaccttcacgaacatggaggcacagttaatccggcagatggagggagagggcgtccttagcaaagcagacctggagaacccacacctcccggagaagaagatcacccagtggctggaaacgaagggagtcgagagattaaagcggatggcgatctcaggggacgattgcgtggtgaaacctatagatgaccgcttcgccaacgccctcctggccttaaacgacatgggcaaggttcggaaggacatccctcagtggcaaccctccaagggttggcacgactggcagcaggtcccgttctgtagccatcacttccacgagctcatcatgaaggacggccgcaagctggtggtcccctgtagacctcaggacgaactaatcgggcgcgcacggatatcacagggcgcgggctggagcctaaaggaaaccgcgtgtctggggaaggcctacgcccagatgtggtccctgatgtacttccaccgtcgcgacctccggctggctagcaacgccatatgctccgccgttcccgttcattgggtcccgaccagtagaaccacttggtcgatccatgcccatcaccagtggatgaccactgaggatatgttaaccgtgtggaacagggtatggatagaagacaacccctggatggaagataagacgcccgtcaccacatgggaaaatgtgccctacctcggcaagcgtgaggaccagtggtgcgggtcgctgattggcctaaccagcagggccacgtgggcacagaacattccgaccgcgatacagcaagtcaggagtctcatcgggaatgaggagtttctggactatatgcccagcatgaagcggttccggaaggaggaagagtccgagggtgccatttggtga

SEQ ID NO: 25876 - RNA, 9873 nt, synthetic construct
  misc_feature 1..9873: note = derived and/or modified CDS sequence (opt11) from DENV-3__KF973482__SS-prME
  source 1..9873: mol_type = other RNA
accagcctatgtttgatgatgatcctgcccgccgcgttagcgttccacctcaccagccgggatggggaaccccgaatgatcgtgggtaagaatgaacgggggaagtccttgctgttcaaaactgcctccggaatcaatatgtgcaccctgatcgccatggatcttggcgagatgtgcgacgacacggtgacgtataagtgcccccacatcactgaagtggagcccgaggatatcgattgctggtgcaacctaacaagcacctgggtgacctacgggacttgcaaccaggccggcgagcaccggcgcgacaagcggtccgtggccttagctcctcacgtgggcatggggctagacactcgcacccagacctggatgagcgccgagggcgcctggcgccaggtggagaaagtggagacgtgggccctgcgacacccggggttcactatccttgctctcttccttgcccattatatcgggacaagtctaactcagaaggtagtgatcttcatcctactgatgctcgtgacgcccagcatgaccatgcgatgcgtgggggtggggaatcgtgacttcgttgaagggctgagcggtgccacctgggtggatgtggtcctggagcacggagggtgcgtgactacgatggctaagaacaagcccacacttgatatcgaactgcagaagacggaagccacccaactggcaacgctccggaagctgtgcatcgagggcaagatcactaacattacgaccgacagtagatgccccacgcagggcgaggccaccctaccggaggagcaagaccaaaactatgtttgcaagcacacctacgtcgaccgagggtggggcaacggttgcggactctttgggaagggctccctggtaacctgtgccaagtttcagtgcctggaacccatcgagggcaaggtggttcagtatgagaatctcaagtacactatcatcatcaccgttcacaccggggaccagcaccaggttggtaacgagacccagggagtgacggccgagatcacgccccaggcgagcaccacggaggcgatccttcccgagtacggcaccctgggcctagagtgcagcccgcgcacgggcctggactttaacgagatgatcctgctcactatgaagaacaaagcctggatggtacacaggcagtggttcttcgacctgccactgccctggacctcaggtgccaccacggaaacccccacgtggaaccgaaaagaactcctggtaactttcaagaacgcccacgctaagaaacaggaggtggtggtcctagggtcccaggagggcgctatgcacactgctctcacaggcgccaccgagattcagaacagcggcgggacgtccatttttgccggccacctaaagtgcagactgaaaatggacaagctcgagctaaagggtatgagctatgccatgtgcactaacacgttcgtgctgaagaaggaggtatccgagacgcagcatgggaccatcctcatcaaggtcgaatataagggggaggatgtgccgtgcaagatacccttcagcacggaggacggacagggtaaggcgcataacggccgcctgataaccgccaaccccgtggtgaccaagaaggaagaacccgtgaacatcgaggctgagccgcccttcggtgagagtaacatcgtgattggcatcggggacaacgcgcttaagatcaattggtacaagaagggttcctctatcggaaagatgtttgaggcgaccgcccggggagcccgccggatggcgatcctgggcgacacggcatgggacttcgggagtgtcggcggggtactcaactctctcggcaagatggtgcatcagatctttggcagtgcctacaccgccctgttcagcggcgtctcctgggtgatgaagataggtatcggagtgctccttacctggattggcctgaatagcaagaacacttccatgtcgttctcatgcatagccatagggatcatcacgctctatctgggcgccgtagtccaggccgatatggggtgtgtgatcaactggaagggcaaagaactaaagtgcggctctgggatcttcgtcaccaacgaggtgcatacttggacggagcagtacaaattccaggcggactcccccaagaggctggccactgccatcgccggcgcatgggagaatggcgtgtgcggcattcgcagcactacccggatggagaatctgctgtggaagcagatcgcgaacgagctcaactacatcctgtgggagaacaacataaaactgaccgtcgttgtgggggatatcatcggcgtcctggaacaaggcaagcgtactttaacccctcagcccatggaattgaagtactcatggaaaacctgggggaaggccaagattgtgaccgccgaaacccaaaactcctcattcataatcgacgggcctaacacccccgagtgccccagcgtatcccgggcctggaatgtatgggaggtggaagactacggttttggcgtgttcaccacaaacatttggctgaagttacgcgaggtctacacccagctgtgcgaccatcggctcatgtcagccgccgtgaaagacgagagagctgtgcacgcagacatgggctactggatcgagagccagaagaacgggtcctggaagctggagaaggctagtctcatagaggtcaagacgtgtacctggccgaagtcgcacacactctggagcaacggcgttctagagtccgacatgattattcctaagagcctggcggggcccatctcccaacacaaccaccggccaggttaccacacacagacggccgggccgtggcatctcggaaagctggagctggatttcaactattgcgagggtaccaccgtggtaatcacggagaactgtggtactagggggcccagcttacggaccaccaccgtgtccgggaaactgatccacgagtggtgctgccgatcctgcacgctgcccccgctccggtacatgggcgaagatgggtgctggtacgggatggagatccggcccatatccgagaaggaggagaatatggtgaagtccctggtctccgccggcagcgggaaggtagacaacttcacagtcggcgtgctgtgcttagctattctattcgaagaggtgatgcgtgggaagttcggcaagaagcacatgatagccggtgtgttcttcaccttcgttctgttgctgtccggccagatcacctggcgcgacatggctcacacgcttatcatgatcggctcgaatgcctccgaccgtatggggatgggtgtgacctacttagccctaatagccacctttaagatacagcccttcctggctctcgggttcttcctgcgcaagctgacaagccgggagaacctcctgctgggagtgggcctcgcgatggcgacgaccctgcagcttcccgaggacattgagcagatggcgaacgggatcgcattgggcctgatggcgctgaaacttatcacccagttcgagacctaccagctgtggacggctctgatctcgctgacctgctccaataccatcttcaccctgacggtcgcctggcgtaccgccaccctgatcctggcaggagtgagtctgctcccggtctgccaatcatcgtccatgcggaagacagattggctccccatggcggtcgctgccatgggcgtgccgcccttaccgcttttcattttcggtctcaaagacacactgaagcggcgcagctggcccctgaacgagggcgtcatggcagtggggcttgtgtccatcctggccagctcgctgctcaggaatgacgtccccatggcggggcctctggtggccggagggctgctcatagcctgctacgtgatcaccgggacctccgcggatctgacagtcgagaaggccgcggacattacgtgggaggaggaggcggaacagaccggggtgtcccacaacctgatgatcacggtggacgacgacggcaccatgcgcataaaggacgacgaaacggagaacatactcacggtcctcctgaagacagcactcctgatcgttagcgggatcttcccgtactccatccccgccaccctgctcgtttggcacacctggcagaaacagacgcagcggagcggggtcctgtgggacgtgcccagcccgcccgagactcaaaaggccgagctagaggagggcgtgtatcgcatcaagcagcaagggatatttggtaagacccaggtgggcgtgggcgtgcaaaaggaaggcgttttccacactatgtggcacgtgacgcgcggggcagtgttaacctacaatggcaagcgccttgagcccaattgggccagcgtcaagaaggatctgatctcgtacgggggcggttggcggctcagcgcccagtggcagaagggcgaggaggtccaggttatcgccgttgagcccggcaagaaccccaaaaacttccagacaatgcctggcactttccagacgacgaccggcgagataggggcgatagcccttgacttcaagcccgggacatcaggctcacccattatcaatcgcgaggggaaggtcgtcggcttgtacggtaatggggtggtaaccaagaatgggggatatgtgagcgggatcgcccagaccaatgccgagcctgacgggccgaccccagagttggaagaggaaatgttcaagaagcggaacctcactattatggaccttcatcctggctccgggaagacgcgcaagtatctgccggcgatcgtccgggaagcgatcaagcgtcggctcagaaccctcatcttggctcccactcgggtggtggccgccgagatggaggaggcccttaaaggcctacccatccgctatcagaccaccgctaccaagtcggagcacacggggcgggaaatcgtcgacttaatgtgccacgcgactttcacgatgcgccttctcagtcccgtgcgggtgcccaactacaacctcatcatcatggatgaggctcacttcaccgacccggccagtatcgccgcgcgcggctacatctcaactcgggtcggcatgggggaggccgccgcgatcttcatgacagcgacgccgcccggcaccgccgacgccttcccgcagagcaacgcacctatccaggatgaggagcgcgacattcccgagcgctcctggaatagcgggaacgaatggataaccgacttcgctggcaagaccgtgtggttcgtgccctccattaaggcggggaacgacatcgcaaactgcctccggaaaaacggcaagaaggttattcagctgagccgcaagactttcgacaccgagtaccaaaagacaaagttaaacgattgggacttcgtggtgaccacagacatctccgaaatgggcgccaacttcaaggcggaccgtgtcattgacccgcgccgctgccttaagcctgtcatccttaccgacgggcccgagcgcgtcatcctagccggccccatgccagtcacagcggcgagcgccgcccaacgccgcgggcgggttggtcgcaatccccagaaggagaacgaccagtacatcttcacgggccagcccctcaataacgacgaagaccatgcccactggacggaagcgaagatgctgctggacaatatcaacacgcccgagggcatcatcccggccctgtttgagccggagcgggaaaagtctgcagcgatcgacggagagtaccgcctgaagggggagagccggaagaccttcgtggagctgatgcgccggggcgacctccccgtgtggctggctcacaaggttgcctctgagggaatcaaatacactgacagaaagtggtgtttcgacggccaacggaacaatcaaatcttggaggagaatatggacgtcgaaatctggaccaaggagggggaaaagaagaaattgagacccaggtggctggacgccaggacgtacagcgacccgctggcgctcaaggagttcaaggagttcgccgcgggtcgcaagtcaatcgcacttgacctcgtcaccgagatcggcagggtgcccagccacctagctcaccgtacccggaatgcgctggacaacttagtcatgctccacacttccgaacatgggggccgcgcctatagacacgcggttgaggaactgccagaaacgatggagaccctgctactgctgggactgatgatcctgttgacaggcggagctatgctgttcctgatcagcgggaaaggaatcgggaagaccagcatcggcctgatctgcgtgatcgcctccagcgggatgctatggatggccgaaatcccactgcaatggatcgcctccgcgatcgtcctggagttctttatgatggtcctactgatccccgagccagagaaacagagaacgccccaagacaatcagctcgcatatgttgtaatcggcatcctcacattagccgcaatcattgccgcaaacgagatgggcctgctcgagaccacaaagcgcgacctggggatgagcaaagagccgggggttgtgtcccccacgagctaccttgacgttgacctccaccctgcgtccgcatggactttatacgccgtcgcgacaaccgtgataacgccaatgctgcgccacaccatcgaaaacagcaccgccaacgtctccctcgcggccatcgccaatcaggccgtggtcctcatggggctggacaagggctggccaatcagtaaaatggacttgggggttcccctacttgcgctcggctgctatagtcaggtgaaccccctgaccctaactgcagccgtgctcctgctaatcacgcactacgccattatcggcccggggttgcaggcgaaggctacccgggaggcccagaagagaacagccgcgggcataatgaagaatccgacggtcgacggaatcatgaccatcgacctggaccccgtgatctacgacagcaagttcgaaaagcagctaggccaggtgatgttgctggtattgtgcgcggtccagctcctactgatgaggacctcctgggccctctgcgaagccctgacactggccacaggacccatcacaactttatgggaggggagccccggcaagttctggaacaccacaatagcggtgtccatggccaatatattcaggggctcctacctggccggggcagggttggccttctccatcatgaagtcagtcggaaccggcaagcgggggacgggctctcagggtgagaccctcggcgaaaagtggaaaaagaaactgaaccagctgagccgcaaggactttgacttatacaagaaatcaggaatcaccgaagtcgatcgcaccgaagcaaaggaaggcctgaagcgcggggagatcacccaccacgccgtctcaagagggagcgcaaaactgcagtggtttgtcgagcgcaatatggtgatcccggaggggcgggtgattgaccttgggtgcggccgcggcggctggtcttactactgcgccggcctcaagaaggtgaccgaagtgcggggttatacaaagggcggacccggccatgaagaacctgtgcccatgagcacgtacggatggaatatcgtaaagctgatgagtggtaaggatgtcttttacctcccgcccgaaaagtgcgacaccttgctgtgcgacatcggggagagctcccccagccctaccgtggaagagtcccgaacgattcgcgtcctgaagatggtggagccgtggctcaagaacaaccagttctgtatcaaggtactgaacccttacatgcccacggtgatcgagcatctagaacggctccaacgcaagcatgggggcatgctggtgcggaaccccctaagccgcaactccacccacgagatgtactggattagtaacgggaccggcaacatcgtggcctctgtgaacatggtgtctcggctccttctgaatagatttacaatgacccaccgtcgcccgaccatcgagaaagacgtggacctcggcgcagggacacggcacgtaaacgccgagccagagacccccaacatggacgtgataggtgagcgcatcaagcggatcaaggaggagcacaactccacgtggcactacgacgatgagaacccgtataagacctgggcctatcacggctcatacgaggttaaggcaacgggctccgccagcagcatgaccaacggggtcgtaaaactgctgacgaagccctgggatgtcgtgcccatggtgacccagatggctatgacagataccacgcctttcggccagcagcgcgtcttcaaggagaaggtggacacccggaccccgcgcagcatgccgggcacccggcgcgttatggggatcacggccgagtggctttggcggaccctgggcaggaacaagaagcccaggctgtgcacaagggaggagttcactaaaaaggtccgtactaacgccgccatgggcgcggtgtttaccgaggagaaccagtgggacagcgccaaagccgcagtggaggacgaagacttctggaaactcgtcgaccgggaacgcgagttgcacaaacttggcaagtgcgggtcctgtgtttacaacatgatggggaaacgggagaagaaattaggagagttcggtaaagccaaaggcagccgcgcgatctggtacatgtggctgggggcccggtacctggagttcgaggctttgggcttcctgaacgaagaccactggttctctagggaaaactcgtactccggggtggagggcgagggcctgcacaagctcgggtacatcctgcgcgatatcagcaagatacccggcggggcaatgtacgcggatgacacggctggctgggacactcgcatcacagaggacgacctgcataacgaggagaaaatcacccagcagatggaccctgagcaccgacaactggccaatgcgatctttaaactgacctatcagaacaaagtcgtgaaggttcagcgtcccacccctaccggcacggtcatggacataatcagccggaaggaccagagggggagcggccaggtggggacctacggcttaaataccttcacaaacatggaggcgcagctcatccggcaaatggaaggggaaggcgtgctgtctaaggcagacctggagaacccacacctcccggagaaaaagatcacgcagtggctcgagaccaagggggtcgaaaggttaaagcggatggcgatatccggggacgactgcgtggtgaagccaatcgatgaccgctttgctaacgccttgctggcgctgaacgacatgggaaaggtccggaaggacatcccccagtggcaaccctccaagggatggcatgactggcagcaggtccccttctgcagccaccacttccatgagctcatcatgaaggacggtcgcaaacttgtggttccctgccgaccccaggacgagctgatagggcgcgcccgaatcagtcagggtgcgggctggagtctcaaggagaccgcctgcctgggcaaggcttacgcccaaatgtggtctctgatgtacttccaccgtcgcgacctccggctggcgagcaacgctatctgctccgccgtgcccgtgcattgggtcccgaccagccgaactacatggtccatacacgcgcatcatcagtggatgaccaccgaagacatgttaactgtatggaacagggtgtggattgaggacaacccctggatggaggacaagacccccgttaccacctgggagaacgtgccctacctcgggaaacgcgaggaccagtggtgcgggagcttgatcggcctcacgagccgggccacctgggcgcagaacatcccgaccgcaatccagcaggtcagaagtctcatcggtaacgaggagttcctggactacatgccatcgatgaagcggttccgaaaggaggaggagtccgagggcgcgatctggtag

SEQ ID NO: 25877 - RNA, 9873 nt, synthetic construct
  misc_feature 1..9873: note = derived and/or modified CDS sequence (opt11) from DENV-3__KF973483__SS-prME
  source 1..9873: mol_type = other RNA
accagcctctgcctcatgatgattctgcccgccgccttagcgttccacctcaccagtcgggacggggagccccggatgatcgtggggaaaaacgagcggggcaagagcctgttattcaaaacagcctccgggatcaacatgtgcaccctcatcgcaatggacctgggcgagatgtgcgatgacaccgtgacatacaagtgcccccacatcaccgaggtggagcccgaggacatcgactgttggtgtaacctcactagcacctgggtgacatacgggacctgcaatcaggccggcgagcaccgacgcgacaaacggtccgtggcgcttgcaccgcacgtggggatggggctggacacccgcacccagacctggatgagcgcggagggcgcctggagacaggtggagaaggtcgaaacgtgggccctgcgccacccggggttcaccatcctcgccctgttcctggcccactacattgggacctctctcactcagaaagttgtcattttcatcctactgatgctcgttacgcctagcatgaccatgcgttgcgtgggggtgggcaaccgcgacttcgtggagggcctgtccggtgccacctgggtggacgtggtcctggagcacggcgggtgcgtgactacgatggccaagaacaagcccaccctcgacatagagcttcagaagaccgaggcgacccagctggcgacgctacggaagctgtgcatcgaagggaagatcacgaacatcaccacggacagccgctgccccacgcagggcgaggccaccctgcccgaggagcaggatcaaaactacgtctgcaagcacacttacgtcgaccgggggtggggcaatggctgtggcctttttgggaagggctccctggtgacatgcgccaagtttcagtgcctggagcccatcgaaggcaaggtggtccagtatgagaaccttaaatatacggtgatcatcaccgtacacacgggggaccagcaccaggtcggcaacgagacccagggggtcacggcggagatcacgccccaggccagcaccaccgaggcgatccttcccgagtacggcaccctggggctggagtgctccccgcgcacgggcttagactttaacgagatgatcctgctgaccatgaagaacaaggcctggatggtccaccggcaatggttcttcgacctgccgctgccctggaccagtggcgccaccactgaaacccccacctggaatcgaaaggagctgctggtcaccttcaagaacgcccacgccaaaaagcaggaggtagtcgtacttgggagccaggagggcgcaatgcacacggccctcactggggccacagagatccaaaactccggtgggacctccatcttcgccgggcacctgaagtgccggctgaagatggacaaacttgagctgaagggcatgagctacgcaatgtgtaccaacaccttcgtgctgaagaaggaggtttcagaaacccagcatgggaccatcctcattaaggtggagtataaaggcgaagacgccccgtgcaagatccccttttctaccgaggacgggcagggaaaggctcacaatggccgactgatcaccgccaaccctgtggtcaccaagaaggaggagcccgtgaacatagaggccgagccgcccttcggggaaagcaatatagtgatcggcatcggggacaacgcgctgaagatcaactggtacaagaaaggaagctctatagggaagatgtttgaggccaccgcccggggcgcccgccggatggccattctgggagatacagcgtgggacttcggttccgtaggcggtgtgcttaacagcctgggcaagatggtgcaccagatatttgggagtgcctacaccgccctgtttagcggcgtaagctgggtgatgaagatcggcataggggtgctcctgacctggatcggcctgaatagtcgcaatacctccatgagcttcagttgcattgccatcggtatcattacgctctacctcggcgcggtcgtgcaggcggacatggggtgcgtgatcaactggaaggggaaagagttaaagtgcggctccgggatctttgtcaccaacgaggtgcacacgtggaccgagcaatacaaattccaggccgattccccaaagcgcctagccacggccatcgtgggggcctgggagaacggggtctgcggaatccggagcactacacgcatggagaatctgctatggaagcagatcgcgaacgagcttaactatattttatgggagaacaacataaagctgaccgtggtggtcggggacataatcggcgtgctcgagcagggtaagcggactctgacgccccagccaatggagttaaagtattcatggaagacctgggggaaggcgaaaattgtgaccgccgagacgcagaacagttccttcatcatcgacggccctaacacccccgaatgccccagcgtcagccgcgcctggaacgtgtgggaggtggaggattacgggtttggcgtattcactaccaatatctggttgaagctgcgggagacctacacgcaactgtgcgaccaccgcctcatgagcgccgccgtaaaagacgagcgggccgtgcatgccgacatgggctactggatcgaaagccaaaagaacggtagttggaaactggagaaggccagcctgatcgaggtcaagacctgcacctggccgaagtcccataccatttggagcaacggcgtgctcgaatccgacatgatcatccccaagagtctggctgggcctatctcccagcacaaccatcggccgggctaccacacgcagaccgcggggccctggcacctggggaagttagaattagactttaactactgcgagggcaccaccgtggtgatcacggagaactgtggtacgcggggccccagcttgcgcactaccacggtatccgggaaacttatccatgagtggtgctgccggagctgcaccctgcccccgctgagatacatgggggaggacggatgctggtacggcatggagatccggcccatctcggaaaaagaggagaacatggtcaagtccctcgtgtccgccggcagcgggaaggtggacaacttcaccatgggcgtgctgtgtctagcaattttattcgaggaggtcatgcgaggcaaattcggcaagaagcacatgattgctggggtgtttctgacctttgtcttactcctgtcaggccagatcacgtggcgggacatggcgcacaccctgatcatgattggcagcaacgcctccgacagaatggggatgggcgtcacctacctcgcccttatcgccaccttcaagattcagcccttcctggccctcgggttcttcctgcggaagctaacgagccgcgagaatctcctgctcggggtaggcctcgcgatggctaccaccctgcagctgccggaggacattgaacagatggccaacggtattgccctcggtctaatggcgctaaagctcataacgcagtttgagacgtaccagttgtggacggccttaatcagcctgacttgttcgaacaccatcttcaccttaaccgtggcctggcggaccgccacccttatcctggctggggtcagccttcttcccgtgtgccagtccagttcgatgcgcaagacggactggctccccatggccgtcgccgccatgggcgtgccgcccctcccgctgtttatcttcagcttaaaggacaccctgaagcgccggtcctggcccctgaacgagggggtgatggccgttggcctcgtgagcatacttgcctccagcctcttacgcaacgacgtacccatggcgggccccctggtcgctgggggcctgctgatagcttgctacgtgattaccgggacctccgccgaccttacggtggagaaggcggcggatatcacctgggaggaggaagccgagcagaccggcgtaagccacaacctgatgatcacagtggacgacgacgggaccatgagaatcaaggacgacgagaccgagaacatcctcaccgtgctgctgaaaaccgccctcctgatagtaagcggcatcttcccttacagcatccccgccaccctgttagtgtggcacacttggcagaagcaaacccaaagatctggcgtgctgtgggacgtcccctcaccacccgagacccaaaaagccgagctggaggagggggtgtatcggatcaagcagcagggcatcttcgggaaaacccaggttggtgtcggggtgcagaaggaaggcgttttccacacgatgtggcatgttacccgcggcgcggtgctcacgtataacgggaagcggttagagccgaactgggcgtccgtgaagaaggatctgatcagttatggcggaggctggcgcctctccgcccaatggcaaaaaggggaggaggtacaggttattgccgtggagcctggcaaaaatccaaagaacttccagaccatgccgggcacattccagactaccactggggagatcggcgcgatcgccctggacttcaagcccgggacaagcggcagccccatcatcaaccgggaggggaaggtcgtaggcctgtacggaaacggggtggtcaccaagaacggagggtatgtgtccggcatcgcccagaccaacgccgagccggacggccccacccccgagctcgaggaggagatgttcaagaagcgcaacttaacgatcatggacctgcaccccggaagcggcaagactcggaaatatctgccagccatcgtgcgcgaggcgatcaagcgtcgcctcagaaccctgatcctggcccccaccagggtcgtcgcagccgagatggaggaagccctaaaaggtctacccatccggtaccaaacgaccgcgaccaagtccgagcacaccggacgcgagatcgtagacctgatgtgccacgccaccttcactatgcggctcctgtcccccgtccgtgtaccgaattacaacctcatcataatggatgaggcccacttcacggatcccgcctccatcgcggcgcgagggtatatcagcacccgcgtgggcatgggcgaggcagccgcgattttcatgacggcgacgccacctgggaccgcagacgccttcccgcagagcaatgcccccatccaggacgaagaacgagacatccccgagcggtcgtggaatagtggaaacgagtggatcaccgacttcgccgggaagacggtgtggttcgtgccgtccatcaaggcgggcaacgatatcgcgaactgcctccgcaagaatgggaagaaggttattcagctgtcccggaagaccttcgacacggagtaccaaaagacgaaattaaacgactgggactttgtcgtaaccaccgacattagcgagatgggcgccaacttcaaagccgatcgcgtgatcgacccgcggcgctgcctcaagcccgttattctcactgacggacccgaacgagtgatcctagccggtcccatgccggttaccgcggcctccgccgcgcagagacgcggccgcgtggggcggaaccctcagaaggagaatgaccagtacatattcaccgggcagcccctcaacaacgacgaggaccacgcccactggacggaggcgaagatgctgttggataacatcaacacacctgagggcatcatcccggccctcttcgaaccggagcgcgagaagtccgccgccatcgatggcgagtaccggctgaagggcgagtctcgcaagacttttgtggagctgatgcggcgcggggacctgcctgtgtggttagcgcataaggtcgccagcgagggcatcaagtataccgaccggaagtggtgcttcgacggacaacgcaataaccagatactcgaggagaacatggacgtcgaaatttggacgaaagagggcgaaaagaaaaagctccggcctcggtggcttgacgcacgcacctattccgacccactagccctcaaggagttcaaggagttcgcagccgggagaaagtcaatcgccctggacttggtcaccgaaatcgggcgcgtgccatcccacctagctcacagaacccgcaatgccctggacaatctggtgatgttgcacacgtctgagcatggagggcgggcgtaccgccacgccgtcgaagaactgcccgagacgatggaaaccctgctcctgctaggactcatgatcctgctgaccgggggcgccatgctgttcctgattagtggcaaggggattggcaaaacctccatcggactgatctgcgtcatcgcctcctccggcatgctctggatggccgaaatccctctacagtggatagccagcgcgatcgtgctggagttcttcatgatggttctcctgataccggaacccgagaagcagcggacgccccaagacaaccagctggcctacgtggtgatcggtatcctcaccctggccgccatcatagcggcgaacgagatgggtctgctcgagaccacgaagcgcgaccttggcatgtccaaagagccgggggtcgtgtcccccacctcgtatctggacgtggatctccaccccgccagcgcctggaccctgtacgccgtcgcgaccacggtgatcactcccatgctgcgtcacacgatcgaaaactccaccgcaaacgttagcctggccgccattgccaaccaagcggtcgtgttgatgggacttgataaggggtggccaatctccaagatggacctaggcgtgcccctgttagcgctcggttgttacagccaagtcaaccctctgacgctgaccgcagccgtcctcctgctaatcacccactatgcgatcatcggccctggccttcaggcgaaagccacccgcgaggcccagaagcggacggcggccggaatcatgaaaaacccgacggtggacggcataatgaccattgacttagacccggtcatctacgattccaagttcgaaaagcagctgggccaggttatgctcctagtcctgtgcgcggtccagctccttctgatgcgcaccagctgggcgctctgcgaggccctaactctggccaccggccccatcaccaccctctgggagggatccccggggaagttctggaacacgaccatcgccgtgagcatggccaacatctttcggggctcctacctggccggggcgggcctggccttcagcatcatgaaatccgtgggtaccggcaagcgcggcaccgggagccagggcgagacccttggcgaaaaatggaaaaagaagctgaaccagctgagcaggaaggactttgatctctacaagaagtcaggaattacggaggtcgaccgcacggaggctaaggaggggcttaagaggggagagatcacccaccacgccgtatcacgcggttccgcgaaacttcagtggttcgtcgagcgtaacatggtcatcccggagggccgagtgatcgatcttggctgcggtcggggcggttggagctactattgcgctggcctgaagaaggtgactgaggtccgcggatacacgaagggcggccctgggcacgaggagccagtgcccatgtcaacctacgggtggaacatcgtgaagctaatgagcggaaaagacgtcttctatttaccgcccgagaagtgcgataccctgctgtgcgacatcggcgagtcgagcccatcgcccacagtggaggagagccgcactatccgtgtgctgaagatggtcgagccgtggctcaagaacaaccagttctgcatcaaggtactgaacccttacatgcccacagtgatagagcacctggagcgcctccagcggaagcacggagggatgctggtccgcaacccactttcgcggaatagcacccacgagatgtattggatctccaacggcactgggaacattgtggccagcgtcaacatggtctctcgcctgctattgaatagattcacgatgacccaccgacgtcccacaatcgagaaggacgtagacctcggcgcgggcacccgccacgtaaacgccgagccagagacgcccaacatggacgtcatcggggagcggatcaagaggatcaaggaggagcacaacagcacttggcactacgatgacgaaaacccgtacaaaacctgggcttaccacggctcttacgaggtgaaggcgaccgggtcagcgagctcgatgattaacggcgttgtcaagctgctgacgaagccctgggacgtggtcccaatggtgacccagatggcgatgaccgacactacgcccttcgggcagcagcgggtatttaaggagaaagtcgacacccgcactccgcggtcaatgcccggcacccgccgggtgatgggcatcacggccgagtggctctggcgcacgctggggcggaataagaagccccgcctctgcacccgggaggagttcaccaagaaggtgcggacgaacgcagctatgggtgcggttttcactgaagagaaccagtgggacagcgcaaaagccgccgtcgaggacgaggacttctggaagctcgttgaccgcgagcgggagctgcacaagctgggaaaatgcggaagctgcgtctataatatgatggggaagagggaaaagaaactgggcgagttcggaaaggcaaaggggagccgggcaatctggtatatgtggctgggcgcccgctatttagagttcgaagccctcgggtttctgaacgaagaccactggttcagccgcgagaactcatactcaggcgtagagggggagggcctgcataaacttggttacatcctgcgcgacatctccaagattcccgggggcgccatgtacgccgacgataccgcggggtgggatacgcggatcaccgaggacgaccttcacaacgaggagaagatcacccagcagatggacccggagcaccgtcagctcgccaacgccatcttcaagctgacctatcagaacaaggtggtcaaggtgcagagacccaccccaaccggcacggtaatggacattatctcacgcaaggaccagcggggcagcggacaggtcggtacatatgggctgaacacctttaccaatatggaggcccagctaatccgccaaatggaaggtgagggggtgctcagcaaggccgatttagagaatccccacctcccggaaaagaagatcacgcagtggctcgagaccaagggcgtggagcggctgaagcgcatggcgatttccggagatgactgcgtggtgaagccgatcgacgaccggttcgccaacgccctcctggcactgaacgacatggggaaggtgcgaaaggatatcccacagtggcaacccagtaagggctggcacgactggcaacaagttccgttctgctcccaccacttccacgagttgatcatgaaggacgggcggaagttggtggtgccctgccgcccgcaggatgagctgattgggcgggcccgcatcagccagggggcggggtggtccctaaaggagaccgcctgtttgggcaaggcttacgcccagatgtggagccttatgtactttcaccgacgggacctccgcctagcctccaacgccatttgcagcgcggtccccgtgcactgggtgccgacctccaggacgacctggagcattcatgctcaccaccagtggatgacaaccgaagatatgctgacggtctggaatcgcgtctggatagaagacaacccgtggatggaggacaagacccctgtgaccacctgggagaacgtcccctaccttgggaagcgggaagaccagtggtgcggcagcctgatcgggttaacgtcccgcgcgacctgggcgcaaaacatcccgaccgcaatccaacaggtgcggagcctaatcggcaacgaggagttcctggactacatgccctctatgaagcgctttcgtaaggaggaggagagtgagggggctatctggtga

SEQ ID NO: 25878 - RNA, 9873 nt, synthetic construct
  misc_feature 1..9873: note = derived and/or modified CDS sequence (opt11) from DENV-3__KF973485__SS-prME
  source 1..9873: mol_type = other RNA
accagcctctgtctcatgatgatcctgcccgccgccctggcgttccacctcaccagccgggacggcgagccccggatgatagtcgggaagaatgagcggggcaagagcctgttattcaagaccgcctccgggatcaacatgtgcaccctcatcgcaatggacttaggcgaaatgtgcgacgacaccgtaacctacaagtgccctcacatcaccgaggtagagcccgaagatatcgactgctggtgcaacctgacaagcacctgggtgacatacgggacgtgcaaccaggcaggggaacaccggcgcgacaagcgcagcgtggcgctggcaccccacgtgggcatggggctggataccaggactcagacctggatgagcgccgagggcgcctggagacaggttgagaaggtggagacttgggccctgcgccacccagggttcacgatcctcgcgctgttcctggcacactacatcggcacctccctcacccaaaaagtggtgatcttcatcctgctcatgttggtcacgcccagcatgacgatgcgctgcgtcggcgtgggcaaccgcgacttcgtcgaggggctttccggggccacctgggttgatgtggtcctggagcacggtgggtgcgtaaccacgatggcaaagaacaaaccaacattggacattgaactgcagaagaccgaggcaacccagctggcgacgcttcggaagctgtgcatcgaggggaagatcaccaacatcacaaccgacagccgctgcccgacgcagggcgaggccacactgccggaggagcaagaccagaactacgtctgcaagcacacatacgttgaccgggggtggggcaacgggtgcggcctcttcgggaaaggttccctggtgacctgtgccaagtttcaatgcttggagcccatagaaggcaaggtggtccagtacgagaacctgaagtacactgtcatcatcaccgtgcacaccggggatcagcaccaggtcggcaacgagacacaaggggtgacggccgaaatcacgccccaagcaagcaccactgaagcaatcttacccgaatacgggaccttagggctcgagtgctccccgcgaactggcctggacttcaacgagatgatcctactgaccatgaagaataaggcctggatggtccaccggcaatggttcttcgacctgcccctgccatggaccagcggcgctaccacggagacccccacctggaacaagaaggagctcctggtgaccttcaagaacgctcacgctaagaagcaggaggtggtcgtgttaggtagtcaggagggcgcgatgcacacggctctcaccggagccaccgagatccagaacagtggcgggacgtccattttcgcgggccacctgaagtgcagactgaaaatggacaaactggagctgaagggcatgagctacgccatgtgcacaaataccttcgtgctgaagaaggaggtctcagagactcaacacgggactatcttaatcaaggtggaatacaagggcgaggatgtgccgtgcaagatacccttctcgacggaggatggacagggcaaggcgcacaacggccgcctgatcactgccaaccccgtcgtgacgaagaaagaggagcccgtgaacatcgaggccgagccgcccttcggggagagcaacatcgtcatcggaatcggggacaacgccttgaagatcaactggtacaagaagggctccagcatagggaagatgttcgaggcgaccgcccgcggcgcccggcgaatggctatcctgggtgacacggcctgggacttcggttccgtgggcggggtgctcaacagcctgggcaagatggtccaccagattttcgggtccgcttacaccgccctgtttagcggagtgagctgggttatgaaaatcggcattggagtcttgctgacctggataggcctcaacagcaagaatacctcgatgagcttcagttgtatcgccatcggcataatcacgctctatctcggtgcggtggttcaggccgacatggggtgcgtcatcaactggaagggcaaggagctgaagtgcggaagcggcattttcgtcacaaacgaggtgcatacctggactgagcagtacaaatttcaggcagattcccccaagcggctcgcaacagccatcgccggtgcctgggagaacggggtctgcggcatccgcagcacgacacgcatggagaacctgctctggaagcagatagcgaatgaactcaactacatactgtgggagaacaatatcaaactgaccgttgtggtgggggacatcatcggggtgctcgaacagggcaaacggacgctgacgccgcaacccatggagttaaaatactcttggaagacctggggcaaggccaaaatcgtgaccgccgaaacacagaacagctcctttataatcgacggccccaatacacccgagtgcccgagcgtttcccgcgcctggaatgtgtgggaagtggaggattacgggttcggcgtcttcaccaccaacatttggctgaagctgcgggaagtgcacacccaattatgcgatcaccggctgatgagcgcggccgttaaggacgagcgggcagtccacgccgacatgggctactggatcgagagccagaagaacggaagctggaagctggagaaggccagcctgatcgaggtgaagacatgtacctggccgaagtctcacaccctttggtctaacggcgtgctcgagtcggacatgatcatcccaaaaagcctggcggggcccatctcccagcacaatcaccgcccgggctaccacacccagacggccgggccatggcacctaggcaaactggagttagactttaattactgcgagggcaccaccgtcgtgatcaccgagaactgcgggactagaggccccagcctacggacaactaccgtgtccggtaaactgatccacgagtggtgctgccggagctgcactctgcccccgctgagatatatgggagaggacggctgttggtacggaatggaaattcgacccatctctgagaaggaggagaacatggtcaagagcttagtgtccgccggctcggggaaggtggacaacttcaccatgggtgtcctatgtctcgccatcctgttcgaggaagtgatgcgcgggaagtttggcaagaagcatatgattgccggagttttcttcaccttcgtcctgctcttgtccggccagatcacctggcgggatatggcgcacacgttgatcatgataggcagcaatgcctccgaccgcatggggatgggcgtgacctacctagccctgatcgccaccttcaagatccagccctttcttgcgctcggattcttcctgcgcaagctcaccagccgcgagaacctcttgctgggtgtgggtttagcgatggccacgaccctgcagttacctgaggacatcgagcagatggctaacgggatcgcactcggcctaatggcgctgaagctcatcactcagttcgagacttaccagctgtggacggccctgatcagcctgacctgttccaacaccatcttcaccctgacggtcgcctggcggaccgcaacactgatcctagccggagtgagcttactgcctgtctgccagtccagctccatgcgcaagaccgattggctccccatggcagtggccgcaatgggggttccgcccttgccgctattcatattcggattgaaggacacgctgaagcgacggtcctggccactgaacgagggcgtcatggctgtgggcctcgtatccatcctggctagctccctgctccgcaacgacgtccctatggcggggcccctggtggccggcgggctgctcatcgcctgctacgtcataactggcacaagcgcggaccttacggtcgaaaaggccgcggacataacgtgggaggaggaggccgagcagacgggtgtttcccacaacctgatgatcaccgtagatgacgacggcaccatgaggatcaaggacgacgagaccgagaatatcctcacggtcctgctaaagaccgccctcctgatcgtcagcggcatcttcccgtattcaattcccgccaccctgctcgtgtggcacacctggcaaaagcagacgcagcgctctggggtgctgtgggacgtacccagcccgcccgaaacccagaaggccgaacttgaggagggcgtgtacagaatcaagcagcaagggatcttcggcaagacccaggtcggggtgggagtgcaaaaggagggcgtttttcataccatgtggcacgtgacgcgtggtgcggtgctaacctacaatggtaagcggctggagccaaattgggcaagcgtcaagaaagacctgatctcctacgggggcggatggcgccttagcgcccagtggaagaagggcgaggaggtccaggtgatcgccgtcgagcccggcaaaaaccccaagaatttccaaaccatgcccgggacattccagacgaccaccggcgagatcggggcgatcgctctggactttaagcccggcacctccgggtcccccataatcaacagggaggggaaggtggtgggcctgtatgggaacggcgtcgtgacgaagaacgggggctacgtgtctggcatcgctcagaccaatgccgaaccggacgggcccacccccgagcttgaggaggagatgtttaagaaacgcaacctaaccatcatggacttgcaccccggcagtggaaagactagaaagtacctaccggccatcgtccgcgaggctatcaaacggcgccttcggacgctgattctggcccccacccgcgtggtggcggccgagatggaggaggccctcaagggcctgcccatccgttaccaaacaacggcaaccaaaagcgagcacaccggtcgcgagatcgtcgacctaatgtgtcacgccacctttacgatgcggctcctgtctcccgtgcgcgtgccgaactacaacttaatcatcatggacgaggcccacttcaccgaccccgcatccatagctgcgcggggctatatttccaccagggtgggcatgggtgaggccgccgctatattcatgaccgcgacgccgcccggcacggcggacgctttcccgcagagcaacgcccccatccaagatgaagaacgggatatccccgagagatcgtggaatagcgggaacgagtggatcaccgatttcgccgggaagaccgtctggtttgttccctctatcaaggcggggaacgacattgcgaactgcctcaggaagaacggcaagaaggtcatccagctgagccgtaaaacgttcgataccgagtaccagaagaccaagctgaatgactgggacttcgtcgtgaccacagacatctcggagatgggcgccaactttaaggccgaccgcgtcattgacccgcgtcgctgccttaaacccgtgatcctgaccgacggcccagagcgggtgatcctggccggccccatgccggtcaccgtggccagcgccgcccagcgccggggtcgcgtgggccggaacccccagaaagagaacgatcagtacatattcaccgggcagcccttgaacaatgatgaagaccatgcccattggaccgaggccaagatgcttctggacaacatcaacacacccgaaggcatcataccagccctattcgaacccgaacgcgagaagtccgccgccatcgacggcgagtaccggctgaaaggggagagccgcaagaccttcgtcgaactgatgcggcgcggcgacctcccagtgtggctcgcgcacaaggtagcgtccgaggggatcaagtacactgatcgaaagtggtgcttcgacggacagaggaacaatcaaatactggaggagaacatggacgtggagatctggaccaaggagggggaaaagaagaaacttcggcctcgctggctggatgcccggacgtatagcgacccgctggcactcaaggaatttaaggagttcgccgccgggcgcaaaagcattgctctggatctcgtgaccgagataggccgggtccccagccatctcgcacaccgcaccaggaacgctctggacaacctggtgatgctccacacctccgagcacgggggccgggcctaccgccatgcggtggaggagctgcccgagacgatggagaccctgctcctccttgggctcatgattttgctgaccggtggcgcgatgctattccttatctcagggaagggtatcgggaaaacttctatcggcctgatctgtgtcatagcctcctccgggatgctatggatggccgagatcccgctgcaatggatcgcttccgccatcgtgctggagttctttatgatggtgctactgatccctgaacctgaaaagcagcgaacgccccaggacaaccagcttgcgtacgtcgtgatcgggatcctcacactggccgcaattatcgcggccaacgagatgggcctgctcgagaccaccaagcgtgacctgggaatgtctaaggagccgggcgtggtctcccccacgagctacctggacgtggacctccaccccgcgtctgcctggaccctgtacgccgtggccaccaccgtgatcacgcccatgctgcggcacacaatcgagaacagcacagcgaacgtgagtctcgcagccatcgccaaccaggccgtcgtccttatggggcttgacaaaggctggccgatcagcaagatggatctcggggtgccgctgttggcgctaggctgctactctcaagtgaacccactgaccctgacggcggccgtcctcctgctgatcacccactacgccatcatagggcccgggctccaagcgaaggctaccagggaggcccagaaacggacagctgccggcatcatgaagaacccaacggtggacgggatcatgaccatcgatcttgaccccgtgatctacgactctaagttcgaaaagcagctgggccaggtcatgttattggttctgtgcgtggtccagcttctgctgatgcgcacttcatgggcactctgtgaggcgttgaccctggcaacgggccctatcactaccctttgggaagggagccctggcaagttctggaacactaccatcgccgtgtccatggccaacatcttccgagggtcttacctggcgggcgccggtctggccttcagtattatgaagtctgtgggcaccggcaagcgcgggaccgggagccagggggagaccctaggcgagaagtggaaaaagaagctgaaccaattgagccgcaaagacttcgacctatacaagaaaagtgggattaccgaggtggaccgcacggaagccaaggagggccttaagcggggtgagatcacgcaccacgccgtgagccgggggagcgcgaaacttcagtggttcgtggagcggaacatggtcatcccggagggccgcgtgatcgaccttggctgtggccgcgggggctggagttactactgtgcgggcctgaagaaagtgaccgaggtccgcgggtacaccaagggcgggcccggtcatgaggagccggttcccatgtcgacgtacgggtggaatatcgtcaagctgatgtccggcaaggacgtcttctaccttccgcctgagaagtgcgacaccctactgtgcgatatcggcgagagctcacccagccccaccgtggaggagtccagaacgatcagagtactgaaaatggtggagccgtggctcaaaaataaccagttctgtataaaggtgttgaacccctacatgccgacggtgatagaacacctggaacgcttacagcggaagcacggagggatgctggtccgcaatccgttatcccggaactccacccacgagatgtactggatcagcaacgggaccggcaatatagtagcctccgtgaatatggtcagccgcctcctgctcaaccggttcaccatgacgcaccgccgtccgaccatagagaaagacgtggacctcggcgcagggacccgccacgtgaacgcagagcccgagaccccaaacatggaggtcatcggcgagcggatcaaacgcatcaaggaggagcacaactccacgtggcactatgacgatgagaacccgtataaaacctgggcgtaccacgggagctacgaggttaaggctaccggttccgcgagttccatgatcaacggggtagtgaagctccttaccaagccgtgggacatggtacccatggtcacgcagatggccatgaccgataccacccccttcggccagcagcgggtgttcaaggagaaggtggacacgcgcactccgcggagcatgcccggcacccgccgagtcatggggatcaccgccgagtggctctggaggactctgggtcgtaacaagaagccccgcctgtgcacccgcgaggagttcaccaagaaggtgcgcacaaacgcggcaatgggggccgtgttcacggaggagaaccagtgggacagcgcgaaggccgctgtcgaagacgaagacttctggaaactcgtagatcgcgaacgggagctgcacaaactgggcaagtgcgggagttgcgtctataacatgatgggcaagcgcgagaagaaactcggcgagttcggaaaggccaagggcagccgggccatctggtatatgtggctgggtgcacgctacctggagttcgaggcgcttgggttcttgaacgaggatcactggttctcccgggagaacagctactcgggggtcgagggtgaaggcctgcacaaactaggctacatcctgcgcgacataagcaagatcccgggaggggccatgtacgccgacgataccgctggatgggacacccgaatcaccgaggatgacctgcacaatgaggagaagataacgcagcagatggacccggagcaccgccaactagccgacgcgatcttcaagctgacctaccaaaacaaggttgtgaaggtccagaggcccactccaaccgggaccgttatggacatcatttcccgaaaggaccagcgggggagcggccaggtgggcacgtacggcctgaacacgttcaccaatatggaggcccagctcattcgccagatggagggggagggcgtcctttccaaggccgacctggagaacccacacctcccggagaagaagatcacccagtggctggagaccaagggcgtcgagcggctgaaacgcatggccataagcggggacgactgcgtggtcaagcccatcgacgatagattcgccaacgcgctcttggctctgaatgatatgggaaaggtccgcaaagacatcccccagtggcaaccctccaaaggatggcacgactggcaacaggtgccgttctgcagccatcacttccatgaactcatcatgaaagacggccggaagctggtagtaccctgccgcccacaggacgagctgatcgggcgggcccgtatctcccagggtgcgggctggagcctcaaggagacggcctgcctgggaaaggcgtacgcccagatgtggtccctcatgtacttccacagacgcgacctccgcctggccagcaacgccatatgctcagcggttcccgtccattgggtgcctaccagcaggaccacgtggtccatccacgcccaccaccagtggatgactaccgaggacatgctgaccgtgtggaaccgcgtctggatcgaagacaacccgtggatggaggacaaaacgcccgtgaccacttgggagaacgtgccttacctcggcaagcgggaggaccagtggtgcgggagcctgatcgggctgaccagcagagccacttgggcccagaacattccgaccgccattcagcaggtccggtccctaattgggaacgaggagttcttggactatatgcccagtatgaagcgcttcaggaaggaggaggaaagcgaaggcgcgatatggtga

SEQ ID NO: 25879 - RNA, 9873 nt, synthetic construct
  misc_feature 1..9873: note = derived and/or modified CDS sequence (opt11) from DENV-3__KF973486__SS-prME
  source 1..9873: mol_type = other RNA
accagcctgtgcctcatgatgatcttaccggccgccctggcgttccatttaaccagccgtgacggagaaccccgtatgatcgtggggaagaacgagcgtggcaagagccttctgttcaaaactgccagcggcatcaacatgtgcaccctcatcgccatggacctgggagagatgtgtgacgacaccgtgacctacaaatgtccccacatcacagaggttgagcccgaggacatcgactgctggtgcaacctgacgagcacctgggtcacctacggcacgtgtaaccaagcaggcgagcaccggcgagacaaaagatctgtggccctcgcgccccacgtaggcatggggctggacacccgcacccaaacctggatgagcgccgagggcgcatggcgccaggtggagaaggtcgagacgtgggctctgcgccacccgggtttcaccatattagcgctgttcctggcccactatatcggtacctccctcacccagaaagtggtgatcttcatcctgctgatgctcgttacgcccagcatgaccatgagatgcgtgggcgtgggaaaccgcgacttcgtcgagggcctgtccggggccacctgggtggacgtggtcctcgaacacggcgggtgcgtgaccaccatggccaagaacaagcccaccctcgatatcgaactgcagaagaccgaagccactcagctggcgacgctccggaagctgtgcatcgagggcaagatcaccaacatcaccaccgacagccgctgcccgactcagggcgaggccaccctgccggaagaacaggaccagaactacgtctgcaagcacacctacgtcgaccggggatggggcaacggatgcggcctcttcgggaaaggctcgctggtgacctgcgccaaattccagtgcctggagccgatagaaggtaaggtcgtacaatatgagaacctcaagtacacggtgatcatcaccgtgcacaccggggaccagcaccaagtcggcaacgagacccagggtgtaacggctgagatcacgccccaggcctcaaccaccgaagctatactgcccgagtacgggaccctgggcctcgaatgctccccccgcacgggcctggacttcaacgaaatgatcctgctcaccatgaagaacaaggcctggatggtccaccggcagtggttcttcgacctgcccctgccctggaccagcggagccaccacggagacccccacctggaatcgcaaggagctcctggtgaccttcaagaacgcacacgctaagaagcaagaggtcgtcgtgctagggtctcaggagggcgcgatgcacacagcattaaccggggccaccgagatacagaattctggcgggacctccatcttcgccggccacctgaagtgccggctgaagatggacaagctagaactgaaggggatgagctacgcgatgtgcacgaacaccttcgttctgaagaaagaggtctccgaaacccagcatggtaccatcctgatcaaagtcgagtacaaaggcgaggacgtgccgtgcaagatccccttcagcacggaggatggccagggcaaggcccacaacggccgcctgattacggccaaccccgtggtcaccaagaaggaggagcccgtgaacatcgaggctgagccgcccttcggtgagagcaacatcgtcatcggcatcggtgacaacgccctaaagatcaattggtacaagaagggctcctccatcgggaaaatgttcgaggctaccgcccggggcgcccgacggatggccatcctgggcgacacggcctgggacttcgggagtgtgggcggggtactcaacagcctgggcaagatggtgcaccaaatctttgggagtgcatatacagcactgttcagcggcgtgtcctgggtgatgaagatcggcatcggggttttactgacctggataggcctgaacagcaagaacacctccatgagcttctcctgtatcgccatagggatcatcacgctctacctgggcgccgtggtgcaggccgacatggggtgcgtaatcaactggaagggcaaggagctaaagtgtggcagcgggattttcgtgaccaacgaggtgcatacctggaccgaacagtacaagttccaggctgacagccccaagaggctcgccacggcgatcgcgggcgcgtgggagaatggggtctgcggcatccgcagcaccacccggatggagaaccttctgtggaagcagatcgcgaacgagttaaactacatcctgtgggagaacaacattaagctaaccgtggtggtcggggacatcattggcgtactcgagcagggaaagcgcacattaactcctcagcccatggagctgaaatattcctggaagacctggggtaaggccaaaatcgtgaccgctgagactcagaacagctccttcatcatcgacggccccaacacccccgagtgccccagtgtatcccgggcctggaacgtctgggaggtcgaagactacgggtttggcgtcttcaccacgaacatctggctcaagctgcgcgaggtgtacacgcagctctgcgaccaccggctcatgtccgcggccgtgaaggacgagcgcgctgtccacgcggatatgggatactggatcgaaagccaaaagaacgggtcctggaagctagaaaaggcaagcctgatcgaggtgaagacatgcacctggccgaaatcccacaccctctggagcaatggcgttctcgaatccgacatgatcatccccaagtctctggcggggcccatctcccagcacaaccaccggccgggctatcacacccagaccgccggaccctggcacctcgggaagctggagctggacttcaactactgtgagggcaccaccgtcgtgataaccgagaactgcgggacccgcggcccatcactccgcaccaccaccgttagcgggaaactgatccacgagtggtgctgccgctcctgcacgctgcccccactccggtatatgggcgaggacgggtgctggtacggcatggagatccgccccatctctgaaaaagaggagaatatggtgaagagcctggtgtccgcggggtccgggaaagtggacaatttcaccatgggggtcttgtgcctcgcgatcctgttcgaggaggtgatgcgcgggaaattcggcaagaagcatatgatcgccggggtgtttttcaccttcgtgctgttactctccggccagattacatggcgcgacatggcgcacacgttgatcatgatcggcagcaatgcttccgatcggatggggatgggcgtgacgtacctcgccctgatcgccaccttcaagatccagccatttctggccctcgggttcttcctccgcaaactgaccagccgggagaacctgctgctgggtgttggtctcgcgatggcaacgaccttgcagctgcccgaggatatagaacagatggccaacgggatcgccctcggtctgatggcgctgaaactcatcacgcagttcgagacctaccagctgtggacggcgctgataagcctgacctgctccaacaccatcttcaccctgacggtcgcctggcgcaccgccacgctgattctcgcgggggtaagcctgctgccggtatgccagtccagctccatgaggaaaaccgactggctccccatggccgtggcagccatgggcgtgccgcctctaccgttgtttatcttcgggctaaaggacactctgaagcgccgcagttggcccctgaacgagggggtcatggccgttggcctcgtatccatcctggcctcctccctgcttcggaacgacgtccccatggcggggcccctggtcgccggcggattgctcatagcttgctacgtgatcaccggcacctccgccgacctgacagtcgagaaggccgctgacatcacttgggaggaagaggccgagcagaccggggtttcccacaacctgatgataaccgtggacgacgacggcaccatgcgcatcaaggacgacgagacggagaacatcctcactgtcctgctaaagaccgcgctcctgatcgtgagcggcatctttccgtactccatccccgccaccctgctcgtgtggcacacctggcaaaagcagacgcagcggtcgggggtcctgtgggacgtgcccagcccgcccgagacacagaaggccgagttagaggagggcgtgtaccgcatcaaacagcaggggatcttcggcaagacccaggtcggggtgggggtgcagaaggagggcgtcttccacaccatgtggcacgtgacgcgcggggctgtgctcacctacaacggcaagcggctggagcccaattgggcttcggtcaagaaggacttgatctcctacgggggcgggtggaggctcagcgctcagtggcagaaaggcgaggaggtccaggtgatcgccgtcgagcccggcaagaaccctaagaacttccaaacgatgccagggaccttccaaacgaccaccggagaaatcggtgcgatagcactggacttcaagccgggcacgtccggcagcccaatcatcaaccgcgaggggaaagtggtgggcctctacggaaacggcgtcgtgacgaagaacggcgggtacgtgagcggcatcgcccagaccaacgctgagccggatgggcccacccccgagctcgaggaggagatgttcaagaaacggaacctaaccatcatggacctgcaccctggctcaggcaagacgcgcaagtacctgccggccatcgtccgtgaggcgatcaaaaggcggctccgcaccctgatcttagcccccacccgggtggtggcagccgagatggaggaggccctcaagggcctgccgatccgctaccagaccactgcgaccaagagcgagcacaccgggcgggagattgtcgatttaatgtgccacgccaccttcaccatgcggctcttatcccccgtgagagttccgaactacaatttaatcatcatggatgaagcacactttacggaccctgccagcatcgccgcgcgcggctacatctccacccgagtcggcatgggcgaggcagccgcgatcttcatgaccgcgacgccgcccggaaccgccgacgcctttccgcagagcaacgcccccatccaggacgaggagcgcgacatccccgagcgctcctggaacagcgggaacgaatggatcaccgacttcgccggcaagaccgtgtggtttgtcccatccatcaaggcggggaacgacatcgcgaactgtctccggaagaacggcaagaaggtcatccagctgagccgcaagacgttcgacactgagtaccagaagaccaagctcaacgactgggacttcgtggtaaccacggacatctccgagatgggggccaactttaaggccgatcgggttatcgacccgcgtcggtgcctcaaacccgtgatcctgaccgacggacccgagcgcgtgattctggccgggcccatgcctgtgacggccgcttccgccgcccaacggcgtggccgagttggccgcaacccccagaaagagaacgaccagtacatcttcaccgggcagcccctcaataacgatgaggaccacgcgcactggaccgaggcgaagatgctgctggacaatatcaacactcccgagggcatcatcccggccctcttcgagcccgaacgtgagaaaagtgccgccatcgacggcgagtaccgcctgaagggtgaaagccgaaagaccttcgtcgaactgatgcgccggggagacctccccgtgtggctagcgcacaaggtggcctctgaggggataaagtacaccgaccgcaagtggtgcttcgatggtcaaaggaacaaccagatcctggaagaaaatatggacgtcgagatctggaccaaggagggcgagaagaagaagctccgcccacggtggctggacgcccgcacctacagcgacccgctggcgctcaaggagttcaaggaattcgctgcggggcgtaagtcaatcgctctggacctggtgaccgagatcggccgggtgcccagccacctcgcccaccgcacacgaaacgcactggacaacctggtcatgctccacacctccgagcacgggggccgcgcctaccgtcacgcggtggaagagctgcccgagacgatggagaccctgcttctgctggggctcatgatacttctgacgggcggcgccatgttgtttctgatcagcgggaagggcatcgggaagacaagcatcggcctgatctgcgtaatagcgtcctccgggatgctgtggatggccgagatcccgcttcaatggatcgcatccgcgattgtcctcgagttcttcatgatggtgctcctgatccccgagcccgagaagcagcgcacaccccaggataatcagctggcctatgtggttatcggcatcctcaccctggccgcgataattgccgctaacgagatgggcctgctcgagaccaccaagcgggacctggggatgagcaaagagccaggcgtggtgtcccccacgagctacctggacgtcgacctccaccccgcgtccgcgtggaccctgtacgcagtggcgactacagtgatcactcccatgcttcgacacactatcgaaaacagcacggccaacgtgtccctcgccgccatcgctaatcaggcggtggtcctaatggggctggataaaggctggccgattagcaaaatggatctcggggcgcccctactggccctcggctgctactcccaggtcaacccactgaccctcacggccgccgtgctactgctgatcacccactatgcgatcatcggccccgggctccaggccaaggcgacccgggaggcccaaaagaggaccgctgcgggcataatgaagaacccaacggtcgacgggattatgaccatcgacttagaccccgtcatttacgactcgaagttcgagaagcagctgggccaggtgatgctcctggtgttgtgcgccgtccagctcctgctgatgcggaccagttgggccctctgcgaggccctgacactggcgactggccccatcacgaccctctgggaggggagcccaggcaagttctggaacacgacgatcgccgtgtccatggcgaatatctttaggggaagttatctggcgggcgccggcctggcattctcaatcatgaagtccgtgggcacgggtaagcgggggacaggctcccagggggaaaccctgggcgagaagtggaagaaaaagctgaatcagctgagccgcaaggacttcgacctctacaagaagtccgggatcacagaggtcgaccggacggaggcgaaggaaggcctgaagcgcggcgagatcacccaccacgccgtaagccgggggagcgccaaactgcagtggtttgtggagcgcaacatggtcatcccggagggcagggtaatcgacctcgggtgcggccgtgggggctggtcatactactgcgccggcctgaagaaggtgaccgaggtccgggggtacaccaagggcgggcccggccacgaggaaccggtacctatgagcacgtacggatggaacatcgtgaagctgatgtctggcaaggacgtcttctatctcccgcccgagaagtgcgacaccctcctgtgcgacatcggcgagtcatcccccagccccaccgtggaggagagcagaactatccgcgtgctgaagatggtcgaaccgtggctcaagaacaaccagttctgcatcaaggtgctgaacccttacatgcccactgtgatcgagcacctggagcggttacagcgaaagcacgggggcatgctggtcaggaaccccctgagccgcaactccacgcacgagatgtactggatcagcaacgggaccggcaacatagtggcctccgtgaacatggtcagccggcttctgctcaaccgcttcaccatgacgcaccggcgcccgaccatcgagaaggacgtggacctcggagcggggacccggcatgtgaatgccgagcccgagacacccaacatggacgttatcggcgagcgaatcaagcggataaaggaggaacacaatagcacgtggcactatgacgacgagaacccgtataagacttgggcctaccacgggagttacgaggtgaaagctaccggctccgcttcttccatgatcaacggggtggtaaagctgctgaccaagccctgggacgtggtacccatggtaacgcaaatggccatgacggacaccacccccttcggccagcagcgtgtgttcaaggaaaaggtcgacacccggaccccccggagcatgcccggcaccagacgcgtcatggggatcactgccgagtggctttggcggacgttaggtcgcaacaagaagcctcggctatgcacccgcgaggagttcaccaaaaaggtgcgtaccaacgccgcgatgggtgccgtctttacggaggaaaaccagtgggacagcgccaaggccgccgtggaggacgaggacttctggaagctcgtggatcgggagcgcgagctgcacaagctgggtaagtgcggcagctgcgtctacaacatgatgggcaagcgggagaagaagctcggcgagttcgggaaagcaaagggcagccgcgccatctggtacatgtggctgggggcccggtacctagagttcgaggcgctcggcttcttaaacgaggatcactggttctcacgcgaaaactcttactccggggtggaaggggagggcctgcacaagctcgggtacattctccgggacattagcaagatcccaggcggcgcgatgtacgctgacgacacagccggctgggacacccgcatcaccgaggacgacttacacaatgaagagaaaatcacgcaacaaatggacccggaacacagacagctcgccaacgccatcttcaagctgacctaccagaataaggtggttaaggtgcagcggccaacgcccaccggcaccgtgatggacatcatctcccggaaggaccagcgggggagcggccaggtcgggacgtacggcctgaacaccttcaccaatatggaagcccaactgatccggcagatggagggcgagggcgtactgtccaaagctgacctggagaacccccacctcccggagaagaagatcacccagtggttggaaacgaagggagtggagagattaaaacggatggccatcagcggggacgactgcgtcgtgaagcccattgacgaccgcttcgcgaacgcgctcctggcattaaatgacatgggcaaggtgcggaaggacatcccccagtggcagccatccaaggggtggcacgactggcagcaggtccccttctgcagccaccacttccatgagctcatcatgaaggacggcaggaagctggtggtgccctgccgaccccaggacgagctgatcgggcgcgctcggattagccagggcgctgggtggagcctgaaggagacagcctgcctggggaaggcctacgcgcagatgtggtccctgatgtactttcaccgccgcgacctgaggctggccagcaacgccatctgctccgccgtcccagtgcactgggtaccgaccagcaggaccacgtggtcgatacacgcacaccaccagtggatgaccaccgaggacatgctgaccgtctggaaccgggtgtggatcgaggacaacccttggatggaggacaagactcccgtaactacctgggagaacgtcccctatttaggcaaacgagaagaccagtggtgcgggagcctgatcggcctgaccagtcgggcgacatgggcccagaacatcccgaccgccatccaacaggtcaggtctttaatcgggaacgaagagttcctagactacatgccatcaatgaagcggttccgcaaggaggaggagtccgagggcgccatctggtga

SEQ ID NO: 25880 - RNA, 9873 nt, synthetic construct
  misc_feature 1..9873: note = derived and/or modified CDS sequence (opt11) from DENV-3__FJ898458__SS-prME
  source 1..9873: mol_type = other RNA
accagcctatgcctcatgatgatactgcccgccgccctggcgtttcacctgaccagccgcgacggggagccgcggatgatcgtggggaagaacgagagggggaaaaccctgctgttcaaaaccgccagcgggatcaacatgtgcaccttaatagccatggacctcggcgagatgtgcgatgacaccgtcacttacaagtgcccccacatcaccgaggtggagcccgaggacatcgattgctggtgcaacctgaccagcacctgggtgacctacgggacttgcaaccaagccggcgagcaccgacgcgacaagcggagcgtggccctcgcgccccacgttggcatggggctggatacccgcacccagacctggatgtccgccgagggtgcctggcgccaggtcgagaaggttgagacctgggcgctgcgccatccggggttcaccatcctcgcgctgttcctggcccactacatcggtaccagcctcacgcagaaggtggtcatcttcatcctgctgatgctcgtcaccccctccatgaccatgcggtgcgtgggcgtgggcaaccgcgacttcgtcgagggcctgagcggggccacctgggtggacgtggtcctggagcacggcgggtgcgtcacgaccatggccaagaacaagcccaccctcgacattgagcttcagaaaaccgaggccacgcagcttgcgaccctccggaaactgtgcatcgagggcaagatcaccaacatcaccacggattcccgctgccccacccagggcgaggccgttctgccggaggagcaggaccagaactacgtctgcaagcatacgtacgtggaccgggggtggggcaacggttgtggactctttggaaaaggctcattagtgacctgcgcgaagttccagtgcttggagcccatcgagggcaaggtcgtgcagtacgagaacctcaaatacacggtgatcatcaccgtccacaccggggaccagcaccaggttggcaacgagacccagggcgtcactgccgagatcacgccccaggccagcaccacggaggcgatcctgcccgagtatggcaccctggggctcgagtgcagcccgcgcacgggcctagacttcaatgagatgatcttactcaccatgaagaacaaggcctggatggtccatcggcagtggttcttcgacctgcccctgccctggacctcgggcgccactacggagacccctacttggaaccgcaaagagctcctggttaccttcaagaacgcccacgctaaaaagcaggaggtcgttgtgctgggcagccaggagggcgcgatgcatacggccctcaccggggccaccgagatccagaacagtggcgggaccagcatcttcgccggccacctgaagtgccggctgaagatggacaagctcgagctaaagggcatgtcctacgccatgtgcacgaacacattcgtcctcaagaaggaggtgagcgaaacccagcacgggaccatactcatcaaggtggagtacaagggcgaggacgtcccgtgcaagatccccttttccacagaggatggtcacggcaaggcgcataacggcaggctgatcaccgccaaccccgtggtgacaaagaaggaggagcccgtcaacatcgaggccgagccgccattcggggaatctaacatcgtgatcggcatcggggacaacgcccttaagatcaactggtacaagaagggcagctccatcgggaaaatgttcgaggcgaccgcccggggcgcccgtcggatggccatcctgggcgacacggcctgggatttcgggagcgtgggcggggtgctcaactccctgggcaaaatggtgcaccagatcttcgggagcgcgtacaccgccctgttttccggcgtgtcttgggtcatgaagatcggcatcggtgtactcctgacctggatcgggctgaactccaagaacacctcaatgtccttctcttgcatcgccatcgggatcatcacgctctacctgggcgccgtggtccaagccgatatgggctgcgtgatcaactggaagggtaaggaactgaagtgcggctccgggattttcgtgaccaatgaggtccacacctggaccgagcagtacaaattccaggcggacagccccaagaggctcgccacggccatcgccggcgcctgggagaacggggtgtgcggcatccgctccacgacccgtatggagaacctgctatggaagcagatcgcgaacgagctcaactacatcctctgggagaacaacatcaaactgaccgtggtcgtgggggacatcatcggcgttctcgagcagggcaagcgcacgctgacgccccaaccaatggagttgaagtacagctggaagacctgggggaaggccaagatcgtcactgccgagacgcagaactccagctttatcatcgacggccccaacacccccgagtgcccatccgcctcgcgggcgtggaatgtgtgggaggtggaggactacgggttcggcgtctttaccaccaacatttggctgaagcttcgcgaggtgtacacccagctgtgcgaccatcggctcatgtccgccgccgtgaaggacgagcgcgcggtccacgccgacatgggctactggatcgagagccaaaagaatgggagctggaaattagagaaggcgtccctcatcgaggtcaaaacgtgcacatggcccaagtcccacaccctctggtccaacggcgtgctggaaagcgatatgatcatccccaagtccctggcggggcccatcagccagcacaaccaccggccgggataccacacccagacggccggaccctggcacctcggcaagctggaactggactttaactactgcgagggcacgaccgtcgtgatcaccgagaactgcgggacgcgcggcccctcccttcgtacaacgaccgtatccggcaagttgatccacgagtggtgctgccgctcctgcactctgcccccgcttcggtacatgggcgaggacgggtgctggtacggtatggagatccgccccatcagcgagaaggaggagaacatggtcaagtctctggtatcggccggctccgggaaggttgacaacttcaccatgggcgtcctgtgccttgccatcctgttcgaggaggtgatgcgcgggaagttcggcaagaagcacatgattgcgggggtgttcttcaccttcgtcctgctcctgagcggccagatcacctggcgcgacatggcccatacgcttatcatgataggctccaacgccagcgatcggatggggatgggcgttacctacctcgccctgatagccaccttcaaaatccagcccttcctggcgctcgggtttttcctgcgcaagctgacgtcccgggagaatctcctgctgggcgtcggcctggccatggcaacgaccctgcagctgcctgaggacatcgagcagatggccaacggcatcgcgttaggcctgatggccctgaaactcatcacacaattcgagacctaccagctgtggacggccctgatcagcctgacctgctctaacactatcttcactctgacggtggcatggcgcactgccaccctgatactcgcgggggtgagcctgctcccggtctgccagtcatcgagcatgcggaagaccgattggctccccatgacggtggctgctatgggcgtgccgcccctcccgctgttcatcttctccctcaaggacacactgaagcgccgcagttggcccttgaacgagggtgtgatggccgtgggcctcgtgtccattctggctagctccctgctcagaaacgacgtccccatggcggggcccctggtggccgggggcctgcttatcgcctgctacgtgatcaccgggacttccgcggacctaacggtcgagaaggccgcggacatcacctgggaggaggaggcggagcagaccggagtgagtcacaacctaatgataacggtggacgacgacggtaccatgcgcattaaggacgacgagacagagaacatcctgaccgtcctgctgaagacggccctcctgatcgtgagcggcatcttcccgtactccatcccggccaccctgctcgtgtggcacacgtggcagaagcagacgcagcggagcggcgtcctgtgggacgtccccagcccgcccgagacccagaaggccgagctggaggagggggtgtaccgcatcaagcagcagggcatcttcgggaagacccaggtcggcgtgggcgtgcagaaggagggcgtattccacacgatgtggcacgtgaccaggggcgcggtgctcacctacaatgggaagcggctggaacctaactgggcgagcgtgaagaaggacctgatcagttacggcgggggctggcggctcagcgcccagtggaagaagggagaggaggtgcaggtgatcgccgtcgagcccggcaagaaccctaagaactttcaaaccatgcccggcacgttccagaccaccaccggggagataggcgctatcgcactggacttcaagcccgggactagtggctcgcccatcattaaccgcgaaggcaaggtggtgggtctctacggcaatggcgtcgttaccaagaacggcgggtacgtgagcggcatcgcccaaacgaacgccgagccggacgggcccactcccgagctggaggaggagatgttcaagaagcgcaacctaacgataatggaccttcaccccgggtccgggaagacccgcaagtacctgccggccatcgtccgggaggcgatcaagcgacgactacgcaccctgatcctggctcctacccgggtggtggccgctgagatggaggaagccctcaaagggctgcccataaggtaccagacgaccgcgactaaaagcgagcacaccggccgggagatcgtcgacctaatgtgccacgccacgttcacgatgcgcctcctgtccccggtgcgggtgccgaactacaacctgataatcatggatgaggcccacttcaccgaccccgccagcatcgccgcgcgcgggtacatctccacccgggtcggcatgggcgaggccgccgccatattcatgacggcgacgcctcccgggaccgccgacgccttccctcagagcaatgcacccatccaggacgaggagcgcgacatcccggaacgctcctggaacagcggaaacgaatggatcaccgacttcgccgggaagacggtgtggttcgtcccctccattaaggcgggcaacgacatcgccaactgcctccggaagaacgggaagaaggtcatccagctgtcccgcaagaccttcgacaccgaataccagaagaccaagctcaacgactgggacttcgtggtgacgaccgacatctccgagatgggcgcaaactttaaggcagaccgggtcatcgacccgcgccggtgcttaaagcccgtgatcctaacggacggcccggagcgcgtgatcctggccgggcccatgccggtcaccgcggccagcgccgcccagcggagaggccgggtgggacgcaacccccagaaggagaacgaccagtacatcttcaccggccagccgctcaataacgacgaggaccacgcccattggacggaggcgaaaatgctgctggataatatcaacacccccgagggcatcatccccgccctcttcgagcccgagcgggagaagagtgccgccatcgacggcgagtaccgcctgaaaggcgagagccggaagactttcgtggagctcatgcgtaggggggacctcccagtctggctggcgcacaaggtggcctccgagggaataaagtacaccgaccgcaagtggtgcttcgacgggcagcggaacaaccaaatcctggaggagaacatggacgtcgagatctggacgaaggagggcgagaagaagaagctccgcccccggtggctggacgcccgcacctacagcgaccctctggccctaaaggagttcaaggacttcgccgccggccgcaagtccatcgccctggatctggtgaccgaaatcgggcgggtacccagccacctcgcccacaggacccgaaatgccctcgacaacctggtaatgctccacacgagtgaacacggcgggcgtgcctaccggcacgcggtggaggaacttccggagaccatggaaacattactcctgctgggcctcatgatcctgctgacagggggcgccatgctgttcctgatcagcggcaagggtatcggcaagacgagcatcgggctgatctgtgtgatagccagcagcgggatgctctggatggccgagatccctctgcagtggatcgcttccgcgatagtcctggagttcttcatgatggtgctcctgatccccgagcccgagaagcagagaacgccccaggacaatcagctggcctacgtcgtcatcgggatactcaccttggctgccatcatcgccgcgaacgagatgggcctgctcgagaccacgaaacgggacctgggaatgagcaaagagccgggggtagtgtccccgacgagctacctggacgtcgacctccaccccgcctctgcctggacactgtacgctgtggcgaccacggtgatcacccccatgctgcgccacaccatcgagaatagcaccgccaatgttagcctcgccgccatagcaaaccaggcggtggtactgatgggcctggacaaggggtggccgatcagcaagatggacctaggcgtccctctgctggccctcgggtgctacagccaagtgaaccccctgacgctaaccgccgccgtgttgttactgatcacccactacgcaatcatcggacccggcctccaggccaaggccacccgggaggcccagaagcgcactgccgccgggatcatgaagaatccgactgtcgacggcatcatgaccatagacctggatcccgtgatttatgacagcaagttcgaaaagcagctgggccaggtgatgctcctggtcctgtgcgcggtacaactgctcctaatgcggacctcctgggccctctgtgaggccttaacgctggctacaggccccatcaccaccctctgggagggcagccccgggaagttctggaacacgaccattgcggtgagtatggcaaacatcttccgcggcagctacctggctggggccggcctggccttctctattatgaagtccgtcgggaccggcaagcggggcacggggtcccagggcgagaccctcggggagaaatggaaaaagaagctgaaccagctgagccgcaaagaattcgacttatacaagaagtccggtatcacggaagtggaccggaccgaggcgaaggaaggcctgaagcgcggcgagatcacacaccacgcagtttcccgcggcagcgcaaaactgcagtggttcgtcgaacgcaacatggtgataccggaggggcgagtgatcgacctgggctgcgggcggggcgggtggtcctactactgcgcgggcttaaagaaggtaaccgaggtgcggggctacaccaagggcgggcctgggcatgaagagcctgtacccatgagcacctacggatggaacatcgtgaagctgatgtccgggaaggatgtgttctacctcccgcccgagaagtgcgataccctgctgtgcgacatcggcgagagctcccccagccccacggtggaggagtcccgcacgatccgcgtcctgaagatggtggaaccgtggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcaccggtaacatcgtggcttccgtcaacatggtgtcccggctcctgctaaaccgcttcacgatgactcaccggcgcccgactatcgagaaggacgtggacctcggcgcgggcaccaggcacgtcaacgccgagcctgaaacgcccaacatggacgtgatcggggagcgcatcaagcggatcaaggaggagcacaactccacctggcactacgacgatgagaacccctacaagacctgggcctaccacggcagctacgaagtgaaggccacggggtccgccagctccatgatcaacggcgtcgtgaagctgctgacgaagccctgggacgtcgtacccatggttacccagatggcgatgaccgacaccacaccattcggtcagcagagggtcttcaaggagaaggtggacacccggaccccgagaagcatgcccggcacccggcgcgtaatgggcatcactgccgagtggctttggcgaaccctggggcgtaacaagaagccccggctgtgcacccgcgaggagttcacgaagaaggtccgaacgaacgccgctatgggcgcggtgttcaccgaggagaaccagtgggacagcgccaaggccgccgtggaggacgaggacttctggaagctcgtcgacagggaacgcgaactgcacaagctggggaagtgcggctcctgcgtgtacaacatgatggggaagcgtgagaagaagctcggcgagttcggcaaagccaaggggagccgtgcgatctggtacatgtggctaggcgcccggtacctggagttcgaggccctcgggtttctgaacgaggaccactggttctcccgcgagaacagctattccggcgtggagggggagggcctgcacaagctcggctacatcctgcgggacatcagtaagatacccggaggcgccatgtacgccgacgacaccgccgggtgggacacccgcattacggaggatgatctgcacaacgaggagaaaattacccagcagatggaccccgagcaccgtcagctcgccaacgccatcttcaagctgacctaccaaaacaaggtcgtcaaggtgcaacggcccacccctaccgggactgtgatggatatcatctcccggaaggaccagagaggctcagggcaagtgggtacctatgggctgaacaccttcaccaacatggaggcccagctcatcaggcagatggagggcgaaggagtgctgtccaaggctgacctggagaacccccacctcccggagaagaagatcacgcagtggctggagaccaaaggcgtcgagcgcctgaaacggatggcgatcagcggcgacgactgcgtggtgaagccaattgacgaccgcttcgccaacgctctcctggccctgaacgacatggggaaggttcggaaggacatcccccagtggcagccctccaagggctggcatgactggcagcaggtcccgttctgcagccaccatttccacgagctcatcatgaaggacgggcgcaagctggtggtcccctgccggccccaggacgagctgatcggccgcgcccggatctcccagggggcgggctggtcgctgcgcgagaccgcctgcctgggcaaggcctacgcccaaatgtggtccctgatgtacttccaccgccgggacctccgcctggcgagcaacgccatttgttccgcggtgcccgtgcactgggtccctacctcacggacgacctggtccatccacgcccaccaccagtggatgaccaccgaggacatgctgacagtgtggaaccgcgtgtggatcgaggacaacccctggatggaggataagacgcccgttaccacctgggagaacgtgccctacctcgggaagagagaggaccagtggtgcggcagcctgatcgggctgacaagccgcgccacatgggcgcagaatatcccgaccgccattcagcaagttcggtccctcatcggcaacgaggagttcctggactacatgcccagcatgaagcgcttccggaaggaggaggagtccgaaggcgccatctggtga

SEQ ID NO: 25881 - RNA, 9873 nt, synthetic construct
  misc_feature 1..9873: note = derived and/or modified CDS sequence (opt11) from DENV-3__KJ189256__SS-prME
  source 1..9873: mol_type = other RNA
acaagcctgtgcctcatgatgatactgcccgccgccctggcattccacctcaccagccgggacggggagccccggatgatcgtgggtaagaacgagcggggcaagtctctcctgttcaagaccgcctccgggatcaacatgtgcaccctcatcgccatggacctgggggagatgtgtgacgacactgtaacttacaaatgcccccacattaccgaggtggagcccgaggacatagactgttggtgcaacctgaccagcacctgggtgacctacgggacatgcaaccaggccggcgagcatcggcgcgacaagcggtccgtggccctcgcgcctcacgtggggatggggttagacactcgcacccagacctggatgagcgccgagggggcctggcgccaagtggaaaaggtggagacctgggcgctgcgccacccgggtttcaccatcctcgcgctgttcctggcccactacattggcacctccctgactcagaaagtcgtgatcttcattctgttgatgctcgtaacgccctcgatgaccatgcggtgcgtcggggtgggcaaccgcgacttcgtcgaaggtctgtcgggtgccacctgggtcgacgttgtcctagagcatggagggtgcgtgactacgatggccaagaacaagccgaccctagatatcgagttgcagaagaccgaggccactcagctagcgactttacggaagctgtgcatcgagggaaagatcaccaacataacgacagacagccgctgccctacgcagggcgaggccgtgctgccagaggaacaggaccagaactatgtctgcaaacacacctatgtggaccggggctggggtaacggatgtgggctctttgggaaaggctccctggtgacctgtgccaaattccagtgcctcgagcccattgagggcaaggttgtgcagtacgagaacctcaagtacaccgtcatcataacagtccacaccggggatcagcatcaagttggcaacgagacccagggcgtcaccgctgaaatcacgcctcaggccagcaccaccgaggcgatcttacccgagtacggcaccctggggcttgagtgttccccgcgcaccggactggacttcaacgagatgatcctgcttaccatgaagaacaaggcttggatggtccatcgccagtggttcttcgacctgcccctgccctggaccagcggcgccaccaccgagacgcccacatggaaccgaaaggagctcctggtgacattcaagaacgcccacgccaagaagcaggaggtcgtggtcctggggtcccaggagggcgcgatgcacaccgcactcacgggggccaccgaaatacagaacagcggcgggacctccattttcgccggacacctcaagtgccggctgaagatggacaagctcgagctgaagggcatgtcgtacgccatgtgcaccaacacgttcgtcctgaagaaagaggtgtccgagacccagcacgggaccatcctcatcaaggtggagtataagggcgaggacgtgccgtgcaagatccccttcagtaccgaggacgggcacggcaaagcgcacaacggccggctgatcacggccaaccccgtggttaccaagaaggaggagcccgtcaacatcgaggccgagccgcccttcggggagagcaacatcgtgatcggcatcggggacaatgctctaaagataaactggtacaagaaaggctcctccatcgggaaaatgttcgaggcgaccgccagaggggccaggcgcatggccatcctgggggacaccgcctgggacttcggttccgtaggcggggtcctgaacagcttgggcaagatggtgcaccaaatatttgggtccgcgtatacggctctgtttagcggagtgtcctgggtcatgaagataggaatcggagtgctactgacatggatcggcctgaacagcaagaacacctccatgagcttctcctgcatcgccatcgggattatcaccttatatctgggcgccgtggtccaggccgacatggggtgcgtaataaactggaagggcaaggagctgaagtgcggaagcggaatcttcgttactaacgaggtccatacctggaccgagcagtacaagttccaggcggactcccctaagagactcgccaccgccatcgccggcgcctgggagaatggggtgtgcggcatccgcagcacgacccggatggagaacctgctttggaagcaaatcgcgaatgagctcaattacatcctgtgggagaacaatatcaagctgaccgtggtagtgggggacatcatcggcgtgctcgagcagggcaagcgcaccctgacgccccagccgatggagctgaagtactcctggaagacctgggggaaggccaagatcgttaccgccgagacccagaactcgtcctttatcatcgacggccctaacacgcccgagtgccccagcgcctccagagcgtggaacgtgtgggaagtggaggactatgggtttggcgtcttcaccacgaacatctggctcaagctgcgcgaggtgtacacccaactgtgcgaccacaggttaatgtcagcggccgtgaaggatgaacgcgccgttcatgccgacatgggctactggatcgagagccaaaagaacgggtcctggaagctggagaaggcgagcctgatcgaggtgaagacctgtacgtggcctaagtcgcatacgttatggagcaacggcgtgctggagtccgacatgatcatcccgaaatcacttgcggggccaatatcccagcacaatcacagaccgggctaccacacccagaccgccgggccctggcacctgggaaagctggagctggacttcaattattgcgagggcacgacggtcgtaatcactgagaactgtggaacccgcggcccctcactccggacgacgaccgtgtccgggaagctaatccatgagtggtgctgccgctcatgcacgctgcctccgctccggtatatgggcgaagacgggtgctggtacgggatggaaattcgccccatctccgaaaaggaggagaacatggtcaagagcctggtgtccgccggcagcgggaaggtggacaactttaccatgggcgtcctgtgcttggccatcctgttcgaggaggtaatgcgcgggaagttcggcaagaagcacatgattgcgggggtgttcttcacgttcgtcctgctcctgtccggtcagatcacatggcgcgacatggcccataccctgatcatgatcggcagcaacgcctccgatcgtatggggatgggcgttacgtatctcgctctgatcgccacgttcaagatacagcccttcctggcgctcggattctttttacgcaaacttacctcccgggagaacctcctgttaggcgtgggcttggcaatggccaccacgctccagttacccgaggacatcgaacagatggccaacggaatagcactcggactgatggccctgaagctcataacccagttcgagacataccaactgtggaccgccttgatcagtctcacttgttccaacaccatcttcaccctgacggtcgcatggcgcacggcaacactgattctggcgggagttagcctgctgccggtctgtcagagcagctccatgagaaagaccgactggctccccatggctgtggccgccatgggcgtgccgccactaccgctgtttatcttctccctcaaggacaccctgaagcgccgctcgtggcccctgaacgagggggtcatggccgttggcctcgtgagcatcctggcgtcctcccttttaagaaacgacgtacccatggccggcccgctggtggcagggggcctgctcatagcctgctacgtaatcacagggacctcggccgacctgacagtcgagaaggcggccgacatcacctgggaggaagaggctgagcagacaggcgtgagccataacctgatgatcaccgttgacgatgacggcactatgcgcattaaggacgacgaaacggagaacatcctcactgtcttactaaagactgccttgctgatcgtgtccggcatcttcccatacagcattcccgccaccctgctcgtgtggcacacctggcagaaacagacacagcggtccggcgtcctgtgggatgtgcccagcccgccagaaactcagaaggcggagttagaggagggcgtgtaccgcatcaagcagcagggcatctttgggaagacccaggtcggggttggggtccagaaggagggcgtcttccacacgatgtggcatgtgacccggggcgccgttttgacttacaacgggaaacgcctggagcccaactgggcatctgtcaagaaggatcttatcagctatggcgggggctggcggctctcagcccagtggcagaagggggaggaggttcaagttatcgcggtcgagcctggcaagaaccccaagaactttcagaccatgccgggtaccttccagaccacgaccggggaaatcggcgctatcgccctggacttcaagcccggaaccagcggcagccccataatcaaccgcgagggcaaggtggtggggttgtacggcaacggggtcgtgaccaagaacggcgggtacgtgtccggcatcgcccagacgaacgccgagcccgacggccccacccccgagctggaggaggagatgttcaagaagcggaacttaaccatcatggacctgcatcccggaagcggcaagaccagaaagtacctgccggcgatcgttcgggaggctatcaaacgccggctcaggacgctgatccttgcccccacccgggtggtggcagccgagatggaggaagccctcaaggggctgcccattcgctaccaaaccacggccacgaagtccgagcacactggaagggaaatcgtagacctgatgtgtcatgccaccttcaccatgcgcctgctgagccccgtgagagttccgaactacaacctaatcattatggacgaggcccactttactgaccccgcctccatcgcggcccgcggatatatcagcacccgggtcgggatgggcgaggctgccgcgatttttatgaccgccacgccgcccgggacggccgacgcgttcccgcagtccaacgcccccatacaagatgaggagcgcgacatccccgagagaagctggaactccggcaacgagtggatcaccgacttcgcggggaaaaccgtttggttcgttcccagcatcaaggccggcaacgacatcgccaactgtctacgtaagaacgggaagaaagtgatccagctgtccaggaaaacctttgacacggagtatcagaagaccaagctgaacgactgggactttgtggtgacaaccgacatcagcgagatgggagccaactttaaggcagaccgggtcatcgacccgcgccggtgcctcaaacccgtgatcctgacggatggccccgaacgcgtgattctggcggggcccatgccggtcacagccgcctccgcagcccagcgccgcggccgggtgggccgcaacccccagaaggaaaacgaccagtacattttcaccggccaacccctcaacaacgatgaagaccacgcgcactggaccgaggcaaagatgctgctggacaacatcaatacccccgaggggatcatcccggctctctttgaacccgagcgggagaagtccgccgcgatcgatggcgagtaccgcctgaagggcgaatcccggaagacgttcgtggagctgatgcgccgcggggacctccctgtctggctggcccacaaggtcgcgagcgagggcatcaagtacaccgaccgcaagtggtgcttcgacgggcagcggaacaatcagatcctggaggagaacatggacgtcgagatttggaccaaagagggcgaaaagaagaagctccgcccgagatggctggacgcccgaacatactccgacccgcttgcgctcaaggagttcaaggacttcgcagctggtaggaaaagcatcgccctggacctggtgacggagatcgggcgggtgccctcccacctcgcccaccgcacccgaaacgcgctggacaacctggtcatgctccacaccagcgagcacggcgggcgcgcgtaccggcacgccgtcgaggagctaccagagaccatggagacactgctcctgctgggcctcatgatcctcctgaccggcggtgcaatgctgttcctgatcagcggcaaagggatcggcaaaacctccattgggctgatctgcgtgattgccagctcaggaatgctttggatggccgagatacctttacaatggatcgcatccgcaatcgtcctggagttcttcatgatggtgctactgatccccgagcccgagaagcagcgcacgccccaggacaaccagctggcttacgtggtcatcgggatcctcaccctggccgctatcatagcggccaacgagatgggcctactggaaaccaccaagcgggaccttggcatgagtaaggagccgggagtcgtcagccccacctcctacctggatgtcgacctacacccagccagcgcctggacgttatacgcggtggccaccaccgtgatcacacccatgctgcgccacacgatcgaaaacagcaccgcgaacgtcagcctcgccgccatcgcgaaccaggccgtggtcctgatgggcctggacaagggatggcctatctctaagatggacctcggcgtaccactgttggcactcggctgctacagccaggtgaaccccctgaccctgaccgccgccgtgctcctgctgattacgcactacgcgatcatcggcccgggcctacaggccaaggccacccgggaggctcagaagcgcaccgccgcgggcatcatgaagaaccccaccgttgacggcatcatgacgatcgacctcgaccccgtgatatacgactccaaattcgaaaagcagctgggccaggtaatgctcctggtcttgtgcgccgtccagttactgctgatgcggaccagctgggctctctgtgaggccctgacgctagcaacaggccccatcacgacactctgggagggttcccccggaaagttctggaataccacaatcgcagtgagcatggccaacatcttccgcggttcatacctggcaggggccggcctggcgttcagcatcatgaagtccgtaggcacgggtaagcggggcaccgggagccagggcgagaccctcggggagaaatggaagaagaagctgaaccagttgagccgcaaggagttcgacctctacaagaagtccggcatcaccgaggttgaccgcacagaagccaaagaggggctaaagaggggcgaaatcacgcatcacgccgtaagccggggctccgccaagctccagtggttcgtagagcggaacatggtgataccggaggggcgggtgatcgacttaggctgcgggcgcggcggttggtcttactactgtgctggcctgaagaaagtcactgaggtgcggggctacacgaagggcggtcccgggcacgaggagcccgtacccatgtcaacctacggctggaatattgtcaaactgatgtccggaaaggacgtgttctacctcccgcccgagaagtgtgacacactgctgtgcgacatcggcgagtccagcccgtcccccaccgtagaggagtcccgcaccatccgtgtcctgaagatggtggagccgtggctcaagaacaaccaattctgcatcaaggtgttaaacccctacatgccgaccgtgatcgagcacctggagcgtctccaacgcaagcacggagggatgttggtgcggaaccccctatcccgcaacagcacgcacgagatgtactggatttctaacggtaccgggaacatcgtggcaagcgtcaacatggtatcccggctcctgttgaaccgcttcaccatgacccaccggagaccgaccattgagaaggacgtcgacttgggcgcgggcacccggcacgtcaacgctgagcccgagacacccaatatggacgtgatcggggagcgcatcaagcggatcaaggaggagcataacagcacatggcactacgacgacgaaaacccgtacaagacgtgggcctaccacggttcctacgaggtgaaggcgaccggtagcgcgtccagcatgatcaacggcgtggtgaagctgctgaccaagccctgggacgtcgttcccatggttactcagatggccatgaccgacaccaccccattcgggcagcagcgcgttttcaaggagaaggtggacaccaggacgccgcgcagcatgcccggcacccggcgcgtgatgggcatcaccgccgagtggctctggcggaccctggggcgtaataagaagccacggctgtgcacgcgggaggagttcacgaagaaggtacgcaccaatgctgcgatgggagccgtgttcaccgaggaaaaccagtgggactctgccaaggcagcggtggaggacgaggacttctggaaacttgtcgaccgggagcgcgagctgcacaagctgggcaagtgcggcagctgcgtgtacaacatgatgggaaagcgggagaagaagctcggcgagttcggcaaggcgaaggggtcccgagccatctggtacatgtggctgggcgcgcggtacctggagtttgaggccctagggttcctgaacgaggaccattggttcagccgcgaaaattcctacagcggtgtggagggggagggtctccataaacttggctacatcctgcgggacatctccaagatacccgggggcgccatgtacgcggatgacacggccgggtgggacacccgcatcactgaggacgacctgcacaacgaggagaagatcacccaacagatggacccggaacacagacagctcgccaacgccatcttcaagctcacgtaccagaacaaggtcgttaaggtgcagcgccccaccccaaccggcaccgtcatggacataatcagccgaaaggaccagcgcggatccggccaagtaggcacctacgggctgaatacgttcaccaacatggaggcccaactcatccggcagatggagggcgagggggtgctgagcaaagcggacctggagaacccccacctcccggaaaagaagatcacccaatggctggagaccaaaggcgtcgagcgcctgaagcggatggccatctccggcgacgactgcgtagtaaaacccatcgacgaccgtttcgccaacgccctcctagccctgaacgacatggggaaggtacggaaggacatccctcagtggcagcccagcaagggctggcatgactggcagcaggtacctttctgcagccaccactttcacgagctcatcatgaaggacgggcgcaagctggtcgtcccctgtcggccacaggacgagctgatcggacgcgcgcgcatatcacagggggccggctggtccctacgcgagacggcctgcctgggtaaagcctacgcacaaatgtggagcctgatgtacttccacaggcgcgacctccgtctggcctccaacgccatctgcagcgccgtgcccgtgcactgggtaccgacctcccggaccacctggagtatccacgcccaccaccagtggatgacgaccgaggacatgctgacagtgtggaaccgcgtgtggatcgaagacaacccctggatggaggacaagacccccgtcactacttgggagaatgtgccctatctcgggaaacgggaggaccagtggtgcggcagcttaatcgggctgacctcccgcgcgacctgggcccagaacataccgacggccatccagcaggtccggtcgctcatcggcaacgaggagttcctggactacatgccctccatgaagcgcttccgaaaggaggaggagtcggagggggccatctggtaa

SEQ ID NO: 25882 - RNA, 9873 nt, synthetic construct
  misc_feature 1..9873: note = derived and/or modified CDS sequence (opt11) from DENV-3__KJ189257__SS-prME
  source 1..9873: mol_type = other RNA
accagcctgtgcctcatgatgatcctgcccgccgccctggcgtttcacctaaccagccgggacggggagccgcggatgatcgtgggcaaaaacgagcggggcaagagcctgctgttcaagacggccagtggcatcaacatgtgcacacttatagccatggacctgggcgaaatgtgcgatgacaccgtgacctacaagtgtccgcacatcacggaggtcgaacccgaggatatcgactgttggtgcaatctgacatcgacgtgggtgacctacgggacgtgcaaccaggccggcgagcaccggcgcgacaagagatccgtggctctcgcgccgcatgtgggcatggggctggacacccgcacccagacttggatgagcgccgagggcgcctggcgccaggttgagaaggtggagacgtgggccctgcgccacccggggttcaccatactcgcgctattcctggcacattacatcgggacctccctcacccagaaggttgtgatcttcatcctgctgatgctcgtcacgcccagcatgacaatgcggtgcgtgggggtgggcaacagagatttcgtagaaggcctgagtggggccacttgggtggacgtggtcctggagcacggcggttgcgtgaccacgatggccaagaacaagcccaccctagacatcgagctgcagaagaccgaggccacccagctggcgacgctccggaagctgtgtatcgaaggcaagattaccaacatcaccaccgacagtagatgccccacccagggggaggccgtgttgccggaggagcaggaccagaactacgtatgcaagcatacctatgtggaccgggggtggggcaacggatgcgggctcttcgggaagggcagtctggtgacctgcgccaagttccagtgcctcgagcccatcgagggcaaggtcgtgcagtacgagaacctcaagtacaccgtaatcatcacggtgcacaccggagaccagcaccaggtgggcaatgagacccagggggtcaccgccgagatcacgccccaagccagcaccaccgaggccattttgcccgaatatggcacattaggactcgaatgctccccacgcaccggcctggacttcaacgagatgatcttgctcactatgaagaacaaagcctggatggtgcaccggcaatggttctttgacctgcccctgccctggacaagcggcgccaccactgagacgcccacgtggaacaggaaggagctcctggtgaccttcaagaacgcccacgcgaagaaacaggaggtcgtggtgctggggtcccaggaaggcgcgatgcacaccgccctcacgggggcgaccgagatccagaacagcggcgggacctccatcttcgccggccacctgaagtgccggctgaagatggacaaactcgagctgaagggcatgagctacgccatgtgtaccaataccttcgtcttgaagaaggaggtgtccgagacgcagcacgggaccatcctcatcaaggtggagtacaagggcgaagatgtcccgtgcaagataccatttagcaccgaggacggacacggcaaggcgcataacggccgcctgatcacagccaaccccgtagtgaccaagaaagaggagcccgtcaatatcgaggccgagccgcccttcggggagtcaaacatcgtaataggcataggggataacgccctgaagatcaactggtacaaaaagggctccagcatcgggaagatgttcgaagcgaccgcccgaggcgcccgccggatggccattctgggcgacaccgcttgggatttcgggagcgtaggcggggtcctcaacagccttggcaagatggtacaccagattttcgggagtgcgtacacggccctattcagcggcgtttcctgggtcatgaaaatcggcattggggtgctcctgacttggataggcttaaacagcaagaacacctccatgagcttctcgtgcattgccatcggcatcatcaccctctacctgggcgctgtggtccaggccgacatgggctgtgtgatcaactggaagggcaaggagctgaagtgcggcagcggaatcttcgtgacaaacgaagtccatacctggaccgagcagtacaagttccaggcagactcccccaagcgcctggccacggccatcgccggcgcgtgggagaacggggtatgcggcattcgcagcacgacccgaatggagaacctgctgtggaagcagatcgccaacgagcttaactacatcctgtgggaaaataacatcaagttaaccgtcgtcgtcggggacatcattggcgtgttggaacaaggcaagcgcactctgacgcctcagccgatggagttgaaatactcctggaagacctgggggaaggccaagatagtcacagctgaaactcagaatagctccttcatcattgacggccccaacacgcctgagtgccccagcgcaagccgggcgtggaacgtgtgggaggtggaggactacgggttcggagtcttcaccaccaacatatggctaaagctccgcgaggtgtacacccagctgtgcgaccacaggcttatgagcgccgcggtcaaggatgagcgtgccgtccatgcagacatgggctactggatcgaatcgcagaagaacgggtcctggaaactggaaaaagctagcttaatcgaagttaagacctgcacgtggccgaaatcccacaccctctggagcaacggcgtgctggaatccgacatgatcatccccaagagcctggccgggcccatctcccaacacaaccaccggccgggctaccacacccagaccgccgggccctggcacctcggcaagctggagctggacttcaactattgcgagggcaccactgtagtgatcaccgagaactgcggcacccgcggcccaagcctcagaacgaccaccgtgtccgggaagttaatccatgaatggtgctgccgcagctgtaccctgcccccgctccggtacatgggcgaggacgggtgctggtacggcatggaaatcagacccatatccgagaaggaggagaacatggtcaagagcctggtctccgccggctcggggaaggtggacaacttcacgatgggcgtcctgtgcctcgcgatcctgttcgaggaggtcatgcgggggaagttcggcaagaagcacatgatcgcgggggtgttcttcaccttcgtcttgctactgtccgggcagatcacctggcgcgacatggcccacaccctgatcatgatcggcagcaatacgagcgaccggatggggatgggcgtgacctatctcgccctgatcgccactttcaagatacagcccttcctagcattagggttcttcttgaggaagctgacctcacgggagaacttgctcctgggcgtgggcctcgcgatggccacgaccctacagctgcccgaggacatcgagcagatggccaatgggatagccctcggccttatggcgctgaaacttatcacccagtttgagacctatcagctgtggacggcccttatctcactgacctgttccaacacgatcttcaccctgacggtcgcctggcgcaccgccaccctgatccttgctggggtgtctctgctaccggtctgccagtccagctccatgcggaagaccgattggctccccatggcggtcgccgctatgggcgtgccacccctcccgctgttcatctttagcctcaaggacacgcttaagcgcaggtcgtggcccctgaatgagggggtcatggcggtcggcctcgtgagcatcctggcgtccagcctgctccggaacgacgtcccgatggcgggccccctggttgcgggtgggctgctcatagcctgctacgtgatcacgggtacctccgctgacctgacggtcgagaaagccgcggacatcacgtgggaagaggaggccgagcagaccggcgtgagccacaacttaatgatcaccgttgacgacgacggaaccatgcgcatcaaggacgacgagaccgagaacatccttacggtcctgttaaaaaccgccctcctgatcgtctccggaatctttccgtactccatacccgccaccttgctggtctggcacacatggcagaagcagacgcagcggtccggtgtcctgtgggacgttcccagcccgcccgaaacgcagaaggccgagctggaggagggggtgtaccgcatcaagcagcaaggtatcttcgggaagacgcaggtcggggtgggggtgcaaaaagaaggcgtcttccataccatgtggcacgtgacgcggggcgcggtgctcacctacaacgggaagcggctggagcccaactgggcatccgtcaagaaggacctgatcagctatggcgggggctggcggctatccgcccagtggcaaaaaggagaggaggtccaggtgatcgccgtcgagcccggcaaaaaccccaagaacttccagaccatgcccggcactttccagacgactaccggggagatcggggctatcgccctggactttaagcccgggaccagcggcagccccatcatcaaccgcgagggcaaggtggtggggctgtatggaaacggagtcgttactaagaacggggggtacgtgtccggcattgcgcagaccaacgccgagccggatggccccacccccgagttggaggaggagatgttcaagaagcgtaacctcaccattatggacctgcaccccgggagcggcaagacgcgcaaatacctgccggccatcgtccgggaggcgatcaaacgccggttgcgaaccctgatcctggcccctactcgggtggtggccgccgagatggaggaggccctcaagggtctgcccatccgataccaaaccactgcaaccaagtccgagcacaccggacgggagatagtcgatctgatgtgccatgccaccttcacgatgcgccttctgagtcccgtgcgggtgccaaattataatctgatcatcatggacgaggcccacttcaccgacccggcgtccatcgccgcccgcgggtacatctcgacccgagtcggtatgggtgaagccgctgccatctttatgactgcgacgccgcccgggaccgccgacgccttcccgcagtcaaacgcccccatccaggacgaggagcgcgacatccccgagcgatcgtggaactccggcaacgagtggataaccgactttgcggggaaaaccgtgtggttcgtgccctccatcaaggcgggcaatgatatcgcgaactgcctccggaagaacgggaagaaggtcatccagctgtctcgcaagacgttcgacaccgagtaccagaagaccaagctgaacgactgggacttcgtggtgacaacggacatcagcgagatgggtgccaactttaaagccgaccgggttatcgacccgaggcgatgcctcaagcccgtgatcctgaccgacggccccgagcgcgtgatcctggccggccccatgccggtcaccgccgcctcagccgcacagcgacggggccgggtcgggcgcaacccccagaaggagaacgaccaatacatatttaccggccagcccctcaacaacgacgaggaccacgcccactggaccgaggcgaagatgctgctggacaacatcaacacgcccgagggtatcataccggcccttttcgagccagagcgggagaagtccgccgccatcgacggtgagtaccgcctgaagggagaaagccgaaagaccttcgtcgagctgatgcgccgcggggatctccccgtctggctggcacataaagtggcctcggagggtattaagtacaccgaccgcaagtggtgctttgacggtcagagaaacaaccagatcctggaggagaacatggacgtcgaaatctggaccaaggagggcgagaagaagaagctccgcccccggtggctggacgcacgcacgtactccgacccgctggccctgaaggagttcaaggacttcgccgcgggccgcaagtcgatcgccctggacctggtgaccgagatcggtcgggtgccgtcccacttagctcaccgcactcggaacgccctagataacctagtcatgctccacaccagcgagcacggcgggcgggcatacaggcacgccgtggaggagctgcccgagacgatggagacactactccttctgggtctcatgattctgctgaccgggggcgccatgctgttcctgatcagcggcaaggggattgggaagacatcaatcggactaatctgcgtcatcgccagctccggcatgctctggatggctgagatcccgctgcagtggatcgccagcgcaatcgtcctggagttcttcatgatggttctcctgatccccgagcccgagaagcagcgcacgccccaggataatcagctggcctacgtggttatcgggatcctcaccctggccgccatcatcgccgcgaatgagatgggcctgctagagaccaccaagagagacctaggaatgtcaaaggagccaggggtcgtgagccccacgtcttacctggacgtggatctccaccccgccagcgcctggacactgtacgccgtggcgaccaccgtgatcacgccaatgctgagacacacgatcgaaaactccaccgccaatgtcagcctcgccgccatcgccaaccaggcggtggtcctgatgggcctggacaaagggtggccgatatcaaagatggacctcggcgtcccgctgctggccctcggatgttacagccaggtaaaccccttgaccctgacggctgcggtgtttcttctgattacccattacgcgataatcggccccggcctgcaggcaaaggccacccgggaggcccaaaagcgcacagccgccggcatcatgaaaaacccaacggtcgacggcatcatgaccatcgacttggatcctgtgatctacgactccaagttcgagaagcaactgggccaggtaatgctgctggtcctatgcgcggtgcagctcctcctgatgcgtaccagctgggccctgtgcgaggccctcacactggccacgggccctatcaccaccctgtgggaggggtcccctgggaaattttggaacaccacgatcgcggtgagcatggccaacatcttccgcggctcctacctcgcgggtgccggcctggccttcagtatcatgaagtccgtcgggaccggaaagcggggcaccgggagccagggcgaaactctgggggagaagtggaagaaaaaactaaatcaactatcgagaaaggagttcgacctgtacaagaagtccgggataaccgaggtggaccggacggaggctaaggaggggttgaagcgtggagagatcacccaccacgccgtgagccggggatcggccaagctgcagtggttcgtcgagcgaaacatggtgatcccggagggccgcgtgattgacttgggatgcgggagaggcggatggagctactactgcgccggcctcaagaaggtcaccgaagtgcgcggatacaccaagggcggtcccgggcacgaggagccggtgccaatgtccacgtacggctggaatatcgtcaagctgatgagtgggaaagacgtcttttacctgccacccgagaagtgcgacacgctcctgtgcgacatcggcgagagtagcccctcacccaccgtggaggagagccgaaccatccgagtcctgaagatggtggagccatggctgaagaacaaccagttctgcatcaaggttctcaacccctacatgcccacggtcattgagcacctggagcggctgcagcgcaagcacggcgggatgctcgtgcggaaccccctgtcccgcaacagtacccatgaaatgtactggatctccaacggcaccggaaacatcgtggccagcgtcaacatggtgtcccggctgctcctgaatcgcttcaccatgacgcaccgtcgcccgaccatcgagaaggacgtggacctgggcgccggtacccggcacgtcaacgccgagcccgagacgcccaacatggatgtgatcggggaacgcatcaagaggatcaaggaggagcacaacagtacgtggcactatgatgacgagaacccgtacaagacgtgggcgtaccacgggtcctacgaggtgaaggccaccgggagcgcctcctcgatgataaacggcgtcgtaaagcttctgaccaaaccctgggacgtcgttccaatggtgacacaaatggcgatgaccgacaccacccccttcgggcagcagcgcgtcttcaaggagaaggtggacacgaggacccctcgcagcatgcccggcacccggcgcgtaatgggcatcaccgccgagtggctgtggcggactttggggaggaataagaagccccggctgtgtacgcgtgaggaatttaccaagaaggtccgcaccaacgccgccatgggcgcggtatttacagaggagaaccagtgggactccgccaaggccgccgtggaagacgaggacttctggaaactggtcgaccgggagcgcgagctccacaagctggggaaatgcggcagctgcgtgtacaatatgatggggaaaagggagaagaagctgggcgagttcggcaaggccaaggggagccgcgctatatggtacatgtggctcggcgcccggtacctggagttcgaggctttggggtttctcaacgaggaccattggttcagtcgcgaaaactcctacagcggagtggagggggagggcctgcacaagctgggttatattttaagggatatctccaaaatccccggcggcgccatgtacgccgacgacaccgcgggctgggatacacgcatcaccgaggacgacctgcacaacgaggaaaagatcacgcagcagatggaccccgagcaccggcagctggccaacgccatctttaagctcacctatcaaaacaaggtcgtaaaggtgcaacgcccaactcccaccggcactgtcatggacatcattagcagaaaagatcaacgtggcagtggccaggtgggcacatatgggttaaataccttcactaacatggaggcacagctgatccggcaaatggaaggcgagggagtgctctctaaggctgacctggagaaccctcacctccccgaaaagaagatcacccagtggttggagacgaagggcgtcgagagactgaagcggatggccatctccggcgacgactgcgtggtcaagcctatagatgatcgcttcgccaacgccctcctcgccctgaacgacatggggaaggtccggaaggacataccgcagtggcagcccagcaagggctggcacgactggcaacaggtcccgttctgttcccaccacttccacgagctgatcatgaaggacggtaggaagctcgtagtcccctgccgtccacaggacgaactgatcggccgcgcccggatcagccagggcgcgggatggagcctgcgcgagactgcctgcctcggcaaggcctacgcccagatgtggagtctgatgtactttcaccgccgggatttacgccttgcatccaacgccatctgctctgccgtgcccgtgcactgggtaccgacctcacgtaccacctggtcaatccacgcccaccaccagtggatgaccaccgaggacatgctgaccgtctggaaccgggtgtggatcgaggacaacccctggatggaggacaagacgccggtcacaacctgggagaacgtgccctacctggggaagcgggaggaccagtggtgcggcagcctcatagggctgaccagtcgcgctacgtgggcgcagaacattccgaccgcaatccagcaggtccggagtttgatcggaaacgaggagttcctcgactacatgccttccatgaagagattccggaaggaggaggagagcgagggggccatctggtga

SEQ ID NO: 25883 - RNA, 9873 nt, synthetic construct
  misc_feature 1..9873: note = derived and/or modified CDS sequence (opt11) from DENV-3__KJ189262__SS-prME
  source 1..9873: mol_type = other RNA
accagcctctgtctaatgatgatacttcctgccgcactggcgttccacctcacctccagggatggcgaaccccgaatgatagtgggtaaaaacgaacgcggaaaatcccttctatttaaaacagcctccggaataaacatgtgtacccttatcgccatggatctgggcgaaatgtgtgatgataccgtgacctacaaatgcccgcacatcaccgaagtggaacccgaagacatcgattgctggtgcaatctaacctccacatgggtgacatacgggacctgcaaccaagccggggaacaccgccgcgacaaaaggtccgtagccctggcccctcacgtcgggatggggctcgacaccagaactcaaacgtggatgagtgctgaaggggcgtggcgacaagtagaaaaagtcgaaacatgggcactaagacacccgggctttacgatcttagccctattcctggcacactatattggaacctcacttacccaaaaagtagtaatatttattctgcttatgctagtaaccccttcaatgacaatgagatgcgttggagttggaaaccgagacttcgtagaagggctgagcggggcgacttgggtggatgtcgtcttagaacacggcggctgcgtgacgacgatggccaaaaataaaccgacactggacatcgaactccagaaaacggaagccactcaattggcgacgctgcggaaactatgcatcgaaggtaagatcacaaatattacaactgacagtcgatgcccgacccaaggggaagccgtcctgcccgaggaacaagaccaaaactacgtttgcaagcacacctacgtagatcggggatggggcaacggatgcggactcttcggaaagggatcactggttacttgtgccaaattccaatgcctagaacccatagaagggaaggtagtgcaatatgagaacctcaaatatactgtgataataacggtacatacgggcgaccaacaccaggtgggaaacgagacgcagggcgtcacagcagagataacaccacaagcatcgaccacggaagcaatcctccccgagtacgggacgctaggcctagagtgctccccaagaacgggactagacttcaacgagatgatattactaactatgaaaaataaggcatggatggtacatagacagtggttcttcgacctgccactaccatggacaagcggggcaacaacagaaactcctacatggaaccggaaagagctcttagtaaccttcaaaaatgcacacgccaagaaacaagaagtcgtagtactaggctcgcaagagggtgccatgcacactgcgctaacgggggctaccgagatacaaaacagcggtggaacctccatattcgccgggcacctaaagtgccgactgaaaatggataaactcgaactgaaaggaatgtcttacgcaatgtgcacaaatacatttgttctaaagaaagaggtctccgaaacgcagcatggaacgatactgatcaaggtagaatacaaaggtgaagatgtcccctgcaagatacccttctcaacagaggacggacacggtaaagcgcataacggtagattgataacagccaatccggtagtaactaagaaagaggagcccgtaaatatagaagcagaaccaccattcggcgaatcaaatattgtgatcggcatcggcgataacgccttgaaaatcaactggtacaagaaaggaagttccataggaaagatgttcgaggccacggcccgaggtgcaaggagaatggccatcctgggcgatacagcgtgggactttgggagtgtcggaggcgtattaaatagcctaggcaaaatggtacatcaaatattcggatccgcatataccgcattatttagtggcgtgagctgggtcatgaaaatcgggatcggagtcctgctcacatggatcggactaaactccaagaacaccagcatgagcttctcttgcatcgcaatagggatcatcactctatatctgggtgcggtcgtccaagcagacatggggtgcgtaataaactggaaagggaaagaactaaaatgcgggagcggcatcttcgtcacaaatgaggttcatacatggacggaacaatacaagttccaagcggactccccgaaacgactggccaccgccattgcaggggcgtgggaaaatggtgtttgcggtatcagaagcacgactagaatggaaaacctactatggaaacaaatagccaatgaactcaattacatactgtgggaaaacaatataaagctcacagtggtcgttggcgatattatcggagtcctcgaacaaggcaaaagaaccctgaccccgcagcctatggaacttaaatactcctggaaaacgtggggtaaggcgaagatcgtaacggcagaaacccaaaacagctcgttcatcatagacggcccaaacacccctgaatgtcccagcgcgagcagggcgtggaacgtgtgggaggtggaagactacggcttcggcgttttcacaacaaatatctggttgaaacttcgggaagtatacacccaactatgcgaccaccgtcttatgtcagccgctgtgaaggacgagcgagccgtacacgctgacatgggctattggatcgaatcacagaaaaacggctcgtggaaactagagaaagccagccttatcgaagtcaaaacttgcacctggcccaaatcgcatactctctggtctaacggggtgctggagtcagacatgatcataccgaaatcactcgccggtccgataagccaacacaaccatcggcccggctaccacacacagacagccgggccgtggcacttgggaaaattggaactcgatttcaattattgtgaggggaccaccgtcgtaatcactgagaactgcgggacgcgtggaccaagcctgcgaacgactactgtcagcggcaaactaatccacgaatggtgctgccggtcatgcacccttcccccactcaggtatatgggagaagacggatgctggtacggcatggagatcagacccattagcgaaaaagaagaaaatatggtcaaaagtctcgtaagcgcaggcagtgggaaagtggacaacttcaccatgggagttctatgtctggctatattattcgaggaggtaatgagaggaaagtttggaaagaaacatatgatagcaggggtgttctttacgtttgtgctactcttaagcggtcaaataacctggcgggatatggcacacactcttatcatgatcggcagcaatgccagtgaccgtatgggtatgggagttacatacctagcacttatagcaacatttaaaatacaaccatttctagcgcttgggtttttcctcaggaagttgacgagccgggagaatcttcttctgggcgtggggctggcaatggcgaccactctccaactaccagaggacatagaacagatggcaaacggcattgcgctaggtctcatggccctaaagctaataacacaattcgaaacataccaactctggacagcactcatcagcctgacatgcagcaacaccatcttcaccttaacggtagcctggagaacagccacactgatattagctggagtgtcactactgccggtatgtcagtcgtcgtcgatgcgtaagacagactggctccccatggctgtcgctgcaatgggcgtcccaccgctgcccctgtttattttctcgctaaaggacactctaaaaagacgatcgtggccgttgaacgagggagtaatggcggtggggctcgtcagcatccttgcatcaagcctacttcgcaatgatgtccccatggcagggccattggtcgccggaggcctcttaatagcctgctatgtcataacgggcacctcagctgaccttacagtcgaaaaggcggccgacataacgtgggaggaagaagcagaacaaacaggtgtgtcgcacaacctgatgatcaccgtcgacgacgacggcacgatgcgaatcaaagatgacgagaccgagaacatattgacagtgctactaaagacagcacttctcatagtgagcggcattttcccctacagtatacccgccacgctcttagtatggcacacatggcagaaacaaacgcagcgaagcggagtcctgtgggacgtaccgtcgcctccagaaactcaaaaagcagagttggaagaaggtgtataccgcattaagcaacaaggcatattcgggaagacacaagtaggcgtcggagtgcaaaaagaaggagtatttcacaccatgtggcatgtaacccgcggagcagtcctcacctacaacgggaaacgtctcgaacccaactgggcgagcgtcaagaaagatttaatttcgtacggaggaggatggagactaagcgcacaatggcagaaaggtgaagaggtgcaagtaatagccattgagccaggcaagaatcccaagaacttccagaccatgcccggtacgtttcagaccacaacgggggaaatcggggcaattgcattagatttcaaacctggcacatcagggagcccaataataaacagagaaggcaaggtagtaggcctatacggaaacggcgtcgttacaaagaatggcgggtacgttagcggaatagcccaaacgaacgctgagcccgacggtcccacaccggaactggaggaagaaatgttcaagaaacgcaacctaacgatcatggacctacaccccggaagcggtaaaactaggaaatatttaccagcgatcgtccgcgaggcgataaaacgaagattgcgaaccttgatcctggcaccaacccgcgtggtggctgcagaaatggaagaggcgctaaagggactgccaatacgctaccagacaaccgcgacaaaaagtgagcataccggaagggaaatcgtagacctcatgtgccacgcaactttcactatgcggctgttaagtccggtcagagtgcccaactacaacttaattataatggacgaagcgcatttcaccgacccagcaagcatcgccgcacgagggtacatctcaaccagggtaggaatgggggaagcagcagctatatttatgactgccacgccccctgggactgcggacgccttcccccaaagcaacgcgccaatccaggacgaggaaagggacataccggagcggtcctggaacagcggaaacgaatggataacggacttcgccggcaagaccgtctggttcgtacctagcatcaaagcagggaatgacatcgcaaactgtcttcggaagaacggtaagaaagtcattcagctcagtcgcaagactttcgacacggaataccagaaaacgaagctgaacgactgggacttcgtggtcactaccgacatatcggaaatgggcgcaaatttcaaggccgacagggtaatagatccgcgacgctgcctaaaaccggttattctaaccgacggaccggaacgcgtaatactagcgggaccgatgccggttacagcagcctccgctgcgcaacggagagggagagtcgggcgaaaccctcaaaaggaaaacgaccaatatatcttcaccgggcagcccttaaataacgacgaggaccacgcccattggacagaagccaaaatgctactcgacaacataaacacaccagaagggataatcccggcgctctttgagccagagagagaaaagtcagcggcgatagacggcgagtaccggctcaaaggagagtcccggaaaaccttcgtcgagctcatgagacgcggagacctgccagtatggctcgcgcataaagtagccagcgaagggatcaagtatacagacagaaagtggtgcttcgacgggcaacgtaacaaccagattctcgaggaaaatatggatgtggaaatctggaccaaggaaggagagaagaagaaactgagaccccgctggctcgacgcccgaacctacagcgacccgctcgcattaaaagagttcaaggattttgcagcaggacgtaaaagtatagccctagacctcgtcaccgagattggaagagtcccctcccacctcgctcatcgcactcgcaatgccctagacaacttagtcatgctccacacatctgagcatggcgggcgggcgtaccgacatgctgtagaggaactaccggaaaccatggaaacacttttactgctcggcctgatgatactattaacaggtggagcgatgctattcttgataagcggaaaggggatcgggaaaacatcaatcggcctcatatgcgttattgcatcttccggaatgctgtggatggccgaaatcccactgcaatggatagcctccgccatagtgctagagttcttcatgatggtacttctcatccccgagccagaaaaacagaggacaccacaagataaccagctcgcgtatgtagtcataggcatactcacgttagcggcaataatcgcagcaaacgaaatgggccttctcgagaccacaaaaagggacttagggatgtctaaagagccaggggtcgtatccccaacctcctacctagacgttgacttgcatcccgcgagcgcatggacgctctatgcagtagcgacgacagtcataacaccgatgctccggcataccatcgagaactcgaccgcaaacgtatcactcgctgcgatcgcgaatcaagcagtcgtgcttatggggctcgacaagggttggccgatatcaaaaatggacttgggtgtccccttactggcgctaggatgttacagccaagtcaaccccctcacgctaacggcagccgtcctgctactaataacccattacgcgatcattggccctggcctccaagctaaggccacacgcgaggcgcagaagagaaccgcggctggtataatgaagaacccaaccgttgacggcattatgaccatcgacctcgaccctgtcatatacgattccaaattcgaaaagcaacttggccaggtgatgctattagtactatgcgccgtccagctcctactcatgaggacaagctgggccttgtgcgaggcgctaaccctagccaccggaccgataactaccctatgggaagggtctccagggaaattctggaatactaccatcgcagtgtccatggcaaacatattccgaggctcctaccttgccggtgccggactagcattttcgatcatgaaatcagtcgggaccggaaaacgcggcacggggagtcagggcgagacattgggggaaaagtggaaaaagaaactcaatcagctaagcaggaaggagttcgacttgtacaagaaatcgggaattacagaagtcgaccgcacagaagccaaagaaggcctaaaacgcggagagatcacgcaccatgccgtcagtcgaggatcggccaaactgcagtggttcgtggagcgaaacatggttatccccgagggcagagtaatagatctcgggtgcgggaggggcggctggagctactactgcgcaggtttaaagaaagtcacagaagtcagaggatacacgaaaggcggccctggccacgaagaacccgtccccatgtccacttacggttggaatatcgtcaaactaatgtcgggcaaagacgtcttctacctacccccagaaaagtgtgacacgctgctttgtgacataggcgagtccagcccatcaccaacagtcgaagaatcacggaccatcagagtactaaagatggtggagccctggctcaaaaacaaccaattctgcatcaaggtattaaacccatacatgcctaccgtaatagagcacctggagcgtttacaaagaaaacacggcgggatgctggtacgaaaccccctatcacgtaacagcacccacgaaatgtactggatctccaacggtacaggaaacattgtagcttccgtgaacatggtgtcccgcctcttgctgaatcgcttcactatgacacatcgccgccccacaattgagaaagacgtcgacctaggggcaggaacacggcacgtcaacgccgagcccgagacccctaacatggacgtgataggagaacgaatcaaacggatcaaggaagaacacaactcaacatggcactatgacgacgaaaacccgtataaaacatgggcataccacggcagctatgaggtcaaggccacgggctccgcctccagtatgatcaacggggtggtgaagctcctgacgaaaccatgggacgtggtaccaatggtaacccaaatggcaatgaccgacacgaccccgttcggacaacaacgcgtatttaaggaaaaagtcgacacacggacacccaggtccatgccaggcacaaggagagtaatggggatcaccgcggaatggctatggcggaccctaggaagaaacaaaaagccaagactatgtacgagggaggagttcacgaagaaagtaagaactaacgccgccatgggcgcagtattcacggaggagaaccaatgggacagcgcgaaggcggcagtggaagacgaagacttctggaagctagtagacagagaacgagagctacacaaattaggaaaatgcggaagctgtgtatacaacatgatggggaaaagagaaaagaaactgggcgagttcggaaaagccaagggcagtagggcaatctggtatatgtggctcggagcaagatatctagagttcgaagcactaggattcctaaatgaggatcactggttctcgcgtgaaaactcatactctggagtcgagggagagggtctacacaaattaggctacatactgcgcgacataagcaagatccctggaggcgccatgtacgctgacgacacggcagggtgggatacacgaataacggaagacgatctgcataacgaggaaaagataactcagcaaatggaccccgagcacagacagctcgccaacgccatcttcaagctaacgtatcagaacaaagtagtgaaagtgcaacggccaacgcccacagggacagtgatggacattatctcacgcaaagaccaacgagggtcaggccaagtggggacctacgggctcaatacattcacgaatatggaggcccaactcatccgccagatggagggcgagggagtcctctcaaaggcagaccttgaaaacccccatctaccggagaaaaagataacccagtggctagagacaaaaggtgtcgaacgactcaagaggatggcgatatcgggagacgactgtgtcgtcaaaccgatcgacgatagatttgcaaacgctctcctagctctcaatgacatggggaaggtacgcaaggatatcccccaatggcagccatctaaggggtggcatgactggcaacaagtcccattctgctcccaccacttccacgaactaatcatgaaggacggacggaagctggttgtgccgtgccggccccaagatgagctaattggtcgcgctaggatctcacaaggcgcaggctggagccttcgggaaaccgcttgcctggggaaggcttacgctcaaatgtggagcctaatgtacttccatagacgcgatctacggctggcaagcaacgcgatctgctcagccgttccggtacactgggtgccgaccagccgcacaacatggtccatccatgctcaccatcaatggatgacgacggaggacatgctcactgtatggaacagggtatggatcgaggacaacccctggatggaagacaaaacaccagtcacaacttgggagaacgttccgtacctcggaaagagagaagatcaatggtgtggcagcttaattggattaacaagccgagccacgtgggcgcaaaatataccaacagctatccagcaagtacgaagccttatcgggaatgaagagttcttggactacatgccttcgatgaaaagattccgaaaagaagaagagagcgaaggcgccatatggtag

SEQ ID NO: 25884 - RNA, 9873 nt, synthetic construct
  misc_feature 1..9873: note = derived and/or modified CDS sequence (opt11) from DENV-3__KJ189263__SS-prME
  source 1..9873: mol_type = other RNA
acctctttatgtctcatgatgatactgcccgccgcgctggccttccacctaaccagccgggatggagagccccgaatgatagtggggaagaacgagcgcggcaagagcttactgtttaagacggcatccggcatcaacatgtgcaccctcatcgcgatggatctgggcgaaatgtgcgacgacaccgtgacctacaagtgcccccacattacggaggtggagccggaggacattgactgctggtgcaacctgacctcaacctgggtgacctacgggacgtgcaaccaggctggcgagcaccggcgggacaagcggtccgtggccctagcgcctcacgtgggcatggggctggacacgcgcacccaaacctggatgagcgctgagggtgcttggcggcaggtcgagaaggtggaaacgtgggccctgcgccacccgggcttcaccattctcgcgctgttcctggcccactacattggcaccagcctcactcaaaaggtcgtgatctttattcttctgatgctcgtgacgccaagcatgacaatgcggtgcgtgggggtaggcaaccgcgactttgtggagggtctgtccggtgcgacctgggtggacgtggtcctggagcacggaggttgcgtgaccaccatggctaagaacaagcccaccctcgacatagagctgcaaaagaccgaggccacccagttagcgacgttgcggaagctctgtatcgagggcaagatcaccaacatcaccaccgatagccgctgccccacacagggggaggctgtgctgcctgaggagcaagaccaaaattacgtctgcaagcacacctacgtggaccgagggtggggcaacgggtgcggcctcttcgggaagggctccctggtaacctgcgctaaattccagtgcctggagcctatcgagggcaaggtcgtacaatatgagaacctcaagtacaccgtgattatcaccgtgcacaccggggaccagcaccaggtcggcaatgagacacagggggtcaccgccgagatcacaccccaagccagcacaaccgaggcgacgctgcctgagtacggcactctggggctcgagtgctccccgcgcacaggcctggacttcaacgagatgatcctgctcaccatgaagaacaaagcctggatggttcacagacagtggttcttcgacttgccactgccctggacaagcggggccaccacggaaacccctacctggaaccgcaaggagctcctggtgaccttcaaaaacgcccacgccaaaaagcaggaggtcgttgtgttgggatcccaagaaggcgctatgcacactgccctcaccggggccaccgagatccaaaacagcggcgggacctccatcttcgccggccacctgaagtgcaggctcaagatggataagctcgagctgaagggcatgagctatgccatgtgcaccaacaccttcgtgctgaagaaggaggtgtccgagacccagcatgggaccgttctcatcaaggttgagtacaagggcgaggacgtgccctgcaagattcccttctcgaccgaagacgggcacgggaaggcgcataatggccgcctgattaccgctaaccccgtggtcacaaagaaagaggagccagtgaatatcgaagccgagccgcccttcggggagagcaacatcgtgatcggcatcggggacaacgccttgaagatcaactggtataagaagggctccagcatcgggaagatgttcgaggcgaccgcccggggtgcccggcggatggccatactgggcgacacggcatgggacttcgggtccgtgggcggagtgctaaatagccttggcaagatggtgcatcagatcttcgggtccgcgtacacagccctgttcagcggagtttcctgggtgatgaagattggcatcggggtcctcctgacctggatcggtctgaactcgaagaatacctccatgagcttctcctgcattgccattgggatcattacgttatacctgggtgccgtcgtacaagccgacatgggctgcgtaatcaactggaagggcaaggagttgaagtgcggtagcgggatcttcgtcaccaacgaggttcacacctggacagaacagtataagttccaggccgatagccccaagcgcctcgccacggccatcgccggggcctgggagaatggggtgtgtggcattcgcagcaccacccggatggagaatttgctgtggaagcagatcgctaacgagctcaactacatcctgtgggagaacaacatcaagctcaccgtcgtggtgggggacatcataggcgttctcgagcaaggcaagcgcacgcttaccccccaaccgatggagctgaagtactcctggaagacttggggcaaggcgaagatcgtaaccgctgagacgcagaatagctccttcatcatcgacggccccaacacccccgaatgtcccagcgcctcccgggcttggaacgtgtgggaggtcgaggactacgggtttggtgtcttcaccaccaacatctggctccgcctgcgggaagtgtatacccagctgtgcgaccaccgcctcatgagcgcggccgtcaaagacgagcgggcggtacacgccgacatgggttactggatcgagtctcagaaaaacgggtcctggaaattagagaaggcgagcctgatcgaagttaagacttgcacctggccgaaatcccacaccttatggagcaacggcgtcctggaatccgacatgatcatccccaaatcgctggccgggcccatctcccagcataaccacaggccgggctaccacacccagacggccggaccatggcacctcggcaagctagaactagacttcaactactgcgaaggcacaaccgtggtcatcaccgagaactgtggtacgcggggccccagtttgcgcaccaccaccgtctccgggaagctgattcacgagtggtgctgtcggtcctgcacgctgccgcccctccgctacatgggcgaggacggatgctggtacggcatggagatccgccccatatccgagaaggaagagaatatggtcaaaagtcttgtgtctgccggtagcggaaaggtcgacaacttcaccatgggggtattgtgcctcgccatcctgttcgaggaggtgatgcgcgggaagttcggcaagaagcacatgatagcaggggtcttcttcacgttcgtgttgctcctgtccggccaaatcacctggcgcgacatggcccacacactgatcatgatcggcagcaacgcatccgaccgcatgggaatgggcgtgacctatctcgccctaatcgccacctttaagatacagcccttcctggcgctcgggtttttcctgcggaagttaaccagcagggagaatctcctgctgggggtcggcttagccatggccacgaccctgcagttaccggaagacatcgagcagatggccaacgggatcgccctcggcctgatggctctgaagctcatcacccagtttgagatctatcaactgtggacagccctgatcagtcttacgtgctccaacaccatcttcaccctgaccgtggcctggcggacggcaaccctgatactcgcaggggtcagcctgctgccggtgtgccagtccagctccatgcgcaagaccgactggctccccatggccgtagccgccatgggggtgcctcctctcccgctgtttatcttcagcctcaaagataccctaaaacgccggtcctggcccctgaacgagggggttatggccgtgggcttagtgtctatcctagcgtccagcctgctgcgcaacgacgtgcccatggccggccccctggtggccggggggctgctcatcgcctgctacgtcatcaccgggacctctgccgacctgaccgtagagaaagcggcagacatcacctgggaggaagaggctgagcaaacgggcgtgtctcacaaccttatgatcactgtcgacgacgacgggaccatgaggatcaaagacgacgagactgagaacattctcaccgtgctgctgaagacggcgctcctgatagtttccgggattttcccgtacagcataccggctaccttgcttgtctggcacacctggcagaagcagactcagcgcagcggtgtgctatgggacgtccccagtccgcccgagacgcagaaggccgagctggaggagggggtctaccggatcaagcaacagggcatctttgggaagactcaggtaggtgtgggggtccagaaggagggcgtgttccataccatgtggcacgtcacacgcggcgccgtactcacttacaacggtaagcggttggagcccaactgggcatccgtgaagaaggaccttataagctatggcgggggctggcgcctctccacccagtggcagaagggggaggaggtgcaggtcattgccgtggaacccggcaagaatccaaagaacttccaaaccatgcccggcaccttccagacgaccaccggggagatcggcgcgatagcgttggactttaagcccgggacctccggcagccccatcatcaaccgggaagggaaagtggtcggcctgtacggcaacggcgtcgtgactaagaatggcggctacgtctccggtatcgcccagacgaacgccgagccggacggccctacccccgagctagaggaggagatgttcaagaaacgcaacctcacgatcatggacctgcaccccgggagcggtaagacgcggaagtatctgccggcgatagttcgcgaagccattaagcggcgtttgagaaccttaatcttagcacccacccgcgtggtagccgccgagatggaggaggccctaaaaggtctacccatccggtaccagacaacagcgaccaaatccgagcacactggccgcgagatcgtggatctgatgtgtcacgcaaccttcacgatgcggctcctgtcccccgtgagggtaccgaactataatctgatcattatggacgaggcccacttcaccgaccccgcctccatcgccgcgcggggctacatcagtacccgcgttggcatgggcgaggcggccgccatcttcatgacggcgaccccgcccgggaccgccgacgccttcccgcaatctaacgctcccatccaggacgaggagcgcgatatacccgagaggagctggaactccggtaacgagtggatcactgatttcgccggaaagaccgtgtggtttgtgcccagcatcaaggcgggtaacgacatcgccaactgcctccgcaagaacggcaagaaggtaatccagttgtcgcggaagacgttcgataccgagtatcagaagacgaagctgaacgactgggatttcgtggtcaccacggacatcagcgagatgggcgccaacttcaaggccgatcgcgtaatcgacccgcggaggtgcctcaagccggtgatactgaccgacggccccgagcgggtaatccttgccgggccaatgccggttacggcggcctctgccgcccagcgccggggtcgcgtggggcggaacccccagaaggagaacgatcagtacatcttcaccggacagccgctgaacaatgatgaagaccacgcccactggaccgaggcgaagatgctgctggacaacatcaacacgccggaggggattatcccggctctcttcgagcccgagcgcgaaaagagtgccgctatcgacggagaataccggttaaagggcgagtcccgcaaaacctttgtcgagctgatgcggcgcggggacctcccggtgtggttggcacacaaggtcgccagcgagggcatcaagtataccgaccggaaatggtgcttcgatgggcaacgcaacaaccagatccttgaggagaacatggacgtggagatctggactaaagagggcgagaaaaaaaagctcaggcccaggtggctcgacgcccgcacctactccgacccgttagccctcaaggagtttaaggacttcgcggcgggccgcaagagcattgccctcgacctggtaaccgaaatcgggcgcgtcccctcccacctcgcccaccggacccgcaatgccctggacaacctggtcatgctccataccagcgagcacggcgggcgggcctaccgtcacgcggttgaggagctgcccgaaacgatggagaccctccttctgctaggtctcatgatcctgctgaccgggggcgccatgttattcctcatcagcggtaaggggatcggcaagacatccatcggcctgatctgtgttattgctagctccggcatgctctggatggctgagatcccgctacagtggattgcctcggcgatcgtgttagaattcttcatgatggtactcctgatccccgagccggagaagcaacggacgccccaggataaccaactggcctacgtcgtgatcggtatcctcaccctggccgccatcatcgccgcgaatgagatgggacttctggagactaccaagcgcgacttgggcatgtctaaagagcctggtgtagtctccccaacgtcctatctagacgtggacctccaccccgcctcggcctggaccctgtacgccgtggcgaccaccgttataacgcctatgctgcgccacaccatcgagaactccaccgccaacgtgagcctcgccgccatcgccaaccaggcggtggtcctgatgggcctggacaagggctggccgatctccaagatggacctcggagtgcccctgcttgctctcgggtgttactctcaggtaaaccccctaacgctgactgccgccgtcttactgctgataacccactacgccatcataggcccaggactccaggcgaaagcgacccgcgaggcacagaaacggaccgccgccgggatcatgaagaacccgacggtggacggcataatgaccatagatttagaccctgtgatatacgactccaagttcgagaagcagctgggtcaggtcatgctcctggtgctttgcgctgtgcagctcctcctgatgcgtaccagctgggcgctctgtgaggccctgacgctggccacggggcctataactacgctctgggaaggctccccgggcaagttttggaacaccacaatcgcggtcagcatggccaatatcttccggggctcctatttggccggcgccggcctggcgttcagcatcatgaagtctgtgggaacaggcaagcgcggcaccgggtctcagggcgagactctcggggagaagtggaagaaaaagctgaaccagctgagccgaaaggagttcgacctctataagaagtccgggatcactgaggtggaccgaactgaggcgaaggagggtctgaagcggggcgagatcactcaccatgccgtctcgcgcgggtctgccaagctgcagtggttcgtggagagaaacatggtgatcccggaggggagagtcatcgatttgggatgcggccggggtgggtggagctactactgcgccggcttaaagaaggtgaccgaggtgcggggctacacaaagggcgggcccgggcacgaggagcccgtccccatgtcaacgtacggctggaatatcgtaaagctgatgagcgggaaggacgtgttctatctccctcccgaaaagtgcgacaccctcttatgcgacatcggcgagagttcaccctcccccaccgttgaagagagccgcaccattcgggtgcttaagatggtcgagccatggctcaagaacaaccagttctgcattaaggtcttgaacccgtatatgcctacggtgatcgagcatcttgaacgcctccaacgcaagcacgggggtatgctggtcagaaaccccctgtcccggaactcaacccacgagatgtactggatttcaaacggcaccggcaacatcgttgcctctgtgaacatggtatcccgcctacttctgaaccggtttaccatgactcaccgccggccgacgatcgagaaggacgtcgatctcggggcgggcacccgccacgtgaacgccgagcccgagacgccgaacatggacgtaataggggagcggataaagcgcattaaggaggagcacaactcaacgtggcactacgacgatgagaacccgtacaagacctgggcgtaccacggctcctatgaggtaaaggccaccgggagcgcgtccagcatgatcaacggggtagtcaagcttctgaccaagccctgggacgtggttcctatggtgacgcagatggcgatgactgataccactccgttcgggcagcaacgggtatttaaggagaaagtggacacgcgtaccccgcggagcatgcccggcacccgccgggtcatgggaatcaccgccgaatggctatggcgcacgctcgggaggaacaagaaaccccgcctgtgcacacgcgaggagttcacgaagaaggtccgtaccaacgcagccatgggggctgtgttcacggaggaaaaccaatgggactccgcgaaggccgccgtcgaggacgaggacttctggaagctcgtggaccgggagcgcgagctgcacaagctggggaagtgtggaagctgcgtgtacaacatgatggggaagcgcgaaaagaagctcggcgagtttggcaaggcaaagggatcacgggcgatctggtatatgtggctaggcgcccgatacctggagttcgaggccctaggattcctaaacgaggaccactggtttagccgggagaactcctactcgggtgtggagggggagggcctgcacaagctcggctacatcctgcgagacatctccaaaatcccggggggcgcaatgtatgccgacgacaccgccgggtgggacacccgaatcaccgaggacgaccttcataacgaggagaagatcacacagcagatggacccggagcaccgccaactcgcaaatgccatcttcaagctgacctatcaaaataaagtggtgaaggtccagcggcccaccccgaccgggaccgtgatggatatcatctctcgcaaagaccagcggggctccggccaggtgggcacatacgggcttaacaccttcaccaatatggaggcccaattaatcagacaaatggagggcgagggggttttaagcaaagccgatctggagaatccccacttgccagagaagaagatcacacagtggctcgagacgaagggcgtcgagcggctaaagcgcatggctatctccggagacgattgcgtggtcaagcccatagacgaccgcttcgccaacgccctgcttgccctgaacgacatggggaaggttcgcaaggacataccgcagtggcagccttcaaagggctggcatgactggcagcaagtcccgttctgctcgcaccacttccacgaactcatcatgaaggatgggcgcaagctggtagtaccctgccgcccccaggacgagctgatagggcgggcacgcatcagccaaggcgcgggctggtccctcagagagaccgcctgcctaggcaaggcctacgcccagatgtggagcttgatgtacttccatcggcgcgatttgcggctggcgtccaacgccatttgcagcgcggtacccgtccactgggtgccgacgtcccgaaccacgtggagtatccacgcccaccaccagtggatgaccaccgaagacatgttaaccgtgtggaaccgggtctggatcgaagacaacccctggatggaggacaaaacgcccgtgacgacatgggagaacgtgccgtacctcgggaagcgcgaagaccagtggtgcgggagcctgatcgggctgacgagccgggccacgtgggcccagaacatcccgaccgccatccagcaggtccgcagcctcataggcaacgaagaattcttagactacatgccctccatgaaacggttccgcaaagaggaggagagcgaaggggccatctggtaa

SEQ ID NO: 25885 - RNA, 9873 nt, synthetic construct
  misc_feature 1..9873: note = derived and/or modified CDS sequence (opt11) from DENV-3__KJ189265__SS-prME
  source 1..9873: mol_type = other RNA
acaagcctgtgtctcatgatgatacttccggcggccctagcgttccacctcactagccgggacggggaaccacgcatgattgtggggaaaaatgagcggggcaagagcttactgtttaagaccgcatccgggatcaacatgtgcaccctcatagctatggatctaggcgagatgtgcgacgacaccgtaacctacaaatgcccccacattacggaggtggaacccgaggacatagattgctggtgcaacctgacatccacctgggttacttacggtacatgcaatcaggcaggcgagcaccgacgcgacaaacgctcggtcgccctagctccccacgtgggcatggggctggatactcggacccagacctggatgagcgccgagggtgcctggagacaggtggagaaggtggagacgtgggccctgcgccatccggggttcaccatcctcgcgttgttcctggcccactatatcggcacttccctcacccaaaaggtggtgatattcatacttctgatgctcgtcactccgagcatgaccatgcggtgcgtgggcgtaggcaacagggacttcgtggagggcttatcgggtgccacctgggtagacgtagtcctggaacatggcggctgcgtgaccacgatggccaagaataaacccaccctcgacatcgagctgcagaagaccgaagccacacaactggcgacgttacggaagttgtgcatcgagggaaagatcaccaatattaccaccgacagccgctgccccacccaaggcgaggctgtgttaccggaggaacaggaccagaactacgtctgcaaacacacgtacgtggaccgggggtggggcaacgggtgcggtctcttcggtaagggcagtctggtgacatgtgccaagtttcagtgcctcgagccaattgagggcaaggtagtgcagtacgagaacttgaagtacaccgtgatcatcaccgtgcacacgggagaccaacaccaagtcggcaacgagacgcagggggttacggccgagatcacgccccaggcctcgactacggaggcgattttgcccgagtacggcaccctggggctcgagtgctccccacgtacgggcctggatttcaacgaaatgatcctgctcacgatgaagaacaaagcctggatggtacatcggcagtggttcttcgaccttccgctcccctggacgtcaggcgcaaccaccgagacgcccacctggaaccgcaaggagctattagtgaccttcaagaacgcgcacgccaagaaacaggaggtcgtggtgctgggctcccaggagggcgcgatgcacaccgccttaacgggggcaaccgaaattcagaatagcggcggaacctccattttcgccgggcacctgaagtgccgactgaaaatggacaagctcgagctgaagggtatgtcttacgccatgtgtaccaacacctttgtcctgaagaaagaagttagtgagacccagcacggtaccatcctcattaaggtcgagtataagggcgaggacgtgccttgcaagatcccgttctctacagaggacgggcacggcaaagcgcacaacggccgccttatcacggccaaccctgtagttaccaagaaggaggagccggtcaatatagaggccgagccgcctttcggggagagcaacatcgtgatcggaatcggcgacaacgccctgaagatcaactggtacaagaagggcagctcaatagggaaaatgttcgaggctacagcccggggcgctcgccggatggctatcctgggcgacacggcctgggatttcgggtccgtagggggtgttctcaatagcctcggcaagatggtgcaccagatcttcgggtccgcgtatacggctttatttagcggcgtgtcctgggtcatgaagatcggcatcggcgtgctcctgacctggattggtctgaatagcaaaaacacctccatgagcttctcctgcatcgcgatcgggatcatcactctctacctcggggccgtagtccaagccgacatgggatgcgtgatcaactggaaaggcaaggagctgaagtgcggcagcggcatctttgtgacgaatgaggtccacacttggaccgagcagtataagtttcaagcggacagtccaaagcgcctcgccacagccatcgccggcgcctgggaaaacggggtgtgcggcatccgctcaacaacccggatggagaacctgctgtggaagcagatcgcgaacgagctcaactacatcctgtgggagaacaatataaaactgacggtggtcgtgggggacattataggcgtgttagagcatgggaagcgcacactgacgccgcagccgatggagctgaagtattcctggaaaacctgggggaaggccaagattgtcaccgcagagacacagaatagctcattcatcattgacggccccaatacacccgagtgccccagcgcctcccgggcttggaatgtgtgggaggtggaggactacggtttcggggtcttcaccaccaacatctggctcaagttacgtgaagtatacacccagttatgcgatcaccgactaatgagcgcggccgtaaaggatgaacgcgccgtccatgccgacatgggctactggatcgagagccaaaagaatgggtcctggaagctagagaaggctagcctgatcgaggtgaagacctgcacgtggccaaagtcccacacgttgtggagcaatggcgtgctggagtccgacatgatcattccaaagagcctggccggccccatatcccagcacaaccatcggcccggctatcacacccagactgccgggccctggcatctcggaaagttggagttagacttcaactactgcgagggcacgaccgtcgtaatcaccgagaactgcggaacccgcggccccagcctcagaaccaccaccgtgtccgggaagctgattcacgagtggtgctgccgaagctgcacgttgcctccactcaggtacatgggcgaggacgggtgctggtacggaatggaaatccgcccaatctccgaaaaggaggagaacatggtgaaaagcctggtgtccgccggcagcggaaaggtggacaactttacgatgggcgttttgtgcctcgccatcctgttcgaagaagtgatgcgcggaaaatttggcaagaaacacatgatcgcgggggttttctttaccttcgtgctgctcctgtccggtcaaataacttggcgcgacatggcccacactctgatcatgatcggtagcaacacctccgacagaatgggaatgggggtgacctacctcgccctcatcgctaccttcaaaatccagcccttcctggccttagggttcttcctgcgcaagctgaccagccgagagaacctactgttgggcgttggtctcgctatggccacgaccttgcagttacccgaggacatcgaacaaatggccaacgggatagccttgggacttatggcgctgaagctgataacgcaattcgaaacgtaccagctgtggacggccctgatcagcctgacctgcagtaacaccatattcaccctgacggtcgcctggcgtactgccactttaatattggctggtgtgtcactgctgccggtctgccagtccagctccatgcggaagacggactggttacccatggcggtggccgccatgggcgtgcctcccctcccgctattcatcttcagcctgaaggacaccctgaagcggcgctcctggcccttgaacgaaggggtaatggccgttggcctcgtctccattttagcgtccagcctgcttcggaatgacgtccccatggcgggcccactggttgcagggggcctgctcatcgcgtgttacgtgatcaccgggacgtccgccgacctgacggttgagaaagccgcgaacatcacttgggaagaggaggccgagcagacaggggtgagccacaacctgatgatcaccgtagatgacgatgggaccatgcgcatcaaggacgacgagaccgagaatatcctaacggtcttactgaagactgccctcctgatcgtgtccgggatattcccatattcaatccccgctaccctgctcgtgtggcacacatggcagaagcagacgcagcgatctggtgtcctgtgggacgtacccagcccgcctgagacccagaaagccgagctcgaagagggcgtgtatcgcatcaagcaacagggcatctttgggaagacccaggtcggcgtgggggtgcaaaaggagggcgtcttccacaccatgtggcatgtcacgcggggcgcggttcttacctacaacgggaagaggctggagcccaactgggcctccgtcaagaaagacctgataagctacggaggagggtggaggctctccgcccagtggcagaaaggggaggaagtccaggttatcgcggttgagcctggcaaaaaccccaagaatttccagaccatgcccggcaccttccagacaactacaggggagatcggcgctatcgcgctggatttcaaacccggcaccagcggctcacccatcattaatcgcgaaggcaaggtcgtggggctgtatggcaacggggtcgtgacgaagaacggcgggtatgtgtccggcatcgctcagactaacgccgagccggatggccccacgcccgagctggaagaggagatgtttaagaagcggaacctcacgatcatggacctacaccccgggagcggcaaaacgcggaaatacctgccggctatcgtccgggaggcgatcaagcggcgccttcgcactctgatcctcgcccctacccgggttgtggcggccgagatggaggaggcgctcaaggggctgcctatccgctaccagaccacggcgaccaaatccgagcacacaggccgggagattgtcgacctcatgtgccatgcaaccttcaccatgaggctcctgagccccgtgcgggtgccgaattacaacctcataataatggacgaggcccacttcaccgaccccgcctcgatcgccgcgcgcgggtacatatcgaccagagtcggtatgggcgaggcagccgctatttttatgacggccacgccgcccgggaccgccgatgccttcccgcagtccaacgcccccatccaggacgaggaacgcgacatccccgagcgctcatggaacagtggcaacgaatggatcacggattttgccggcaagacagtgtggtttgtgcccagtatcaaggctgggaatgacatagccaactgcctccggaagaacgggaagaaagtcatccagctgtcgcgaaagacgttcgacacagagtaccagaagacaaagctgaacgattgggatttcgtggttaccaccgacatatctgagatgggcgccaacttcaaagccgacagagtcatcgacccgcgacgctgtttgaagccggtaatcctgacagatggcccagaacgcgtgatcctggccggccccatgccggtcactgcggccagtgccgcacagcgccgcggccgggtggggcgaaacccccagaaggagaacgaccagtacatcttcaccggccagccgctcaataatgacgaggatcatgctcactggaccgaagcgaagatgttactggacaacatcaacacgcctgaggggatcatcccggccctctttgaaccggagcgggagaagtccgcagccatagacggggagtaccgcctgaaaggcgagtcccggaaaacctttgtggagctgatgcgacgcggggatcttcctgtctggctcgcgcataaagtagcatcagagggcatcaaatacaccgaccgcaagtggtgcttcgacgggcagaggaacaaccagatccttgaagagaacatggacgtagagatctggaccaaggagggggagaagaaaaagttgcgcccccgatggctggacgcccgcacgtactctgacccgctggcgctcaaggagttcaaagatttcgccgcgggccgcaaaagcattgccctagacctggtcaccgaaatcggacgtgttccatcccacctcgctcaccgcacccggaacgctcttgataatctcgtaatgctccacaccagtgagcacggcgggcgcgcctaccgtcacgcagtggaggaactgcctgaaacgatggaaaccctgctcctactgggactaatgatcctgcttaccggaggcgccatgctgttcctcataagcggcaaagggatcggcaagacctccatcggtttgatctgtgtaatagcatcatccggaatgctctggatggccgagatccctctgcagtggatcgccagcgcgatcgtcctggagttctttatgatggtgctcctgatcccggagccggaaaagcagcgcacgccccaggacaaccagctggcctatgtggtcatcgggatcctcacacttgctgcgatcatcgcagctaatgagatgggattactcgagaccactaagcgggacttagggatgtccaaggagccgggcgtggttagccccacgtcctacttggacgttgacctccacccagccagcgcgtggaccctctacgccgtggcgaccactgtgatcacgcccatgctgcgccatacaatcgaaaattccaccgcgaatgtgagcctcgccgcaatcgccaaccaggcagtggtgctgatgggcctggacaagggctggccgatatccaagatggacctcggagtccccctgcttgcactcgggtgctatagtcaggtgaaccccctgacccttacggccgcggtgctactactgatcactcactacgctataatcggccccgggctccaggcgaaggccacacgggaggcccaaaagcgcacagccgccgggatcatgaagaacccaacggtcgacgggatcatgaccattgacctggaccccgtgatctacgattctaagtttgaaaagcagcttggtcaggtgatgttattggtcctgtgcgctgtacagctcctgctgatgagaaccagctgggccctctgtgaagcactgacccttgccacgggccctataaccacgctctgggaaggctcccccggaaaattctggaataccacgatcgcggtgagcatggccaacatttttcgcggctcgtatttagccggggcgggcctggcgttcagcatcatgaagtccgttggaaccggcaagcggggcacagggagccagggcgagacgctcggggagaagtggaagaagaagctaaatcaactatcgcggaaggagttcgacctctacaagaagtccggcattacggaggtggatcggacggaggcaaaggaggggctgaagcgcggggagataacccatcatgcagtgtctcgagggtccgcaaagctgcagtggttcgtcgagcgcaatatggtcatcccggaagggagagtgatagacctcggctgtgggcgcggagggtggagctactactgcgcaggcctgaagaaagtcactgaggtgcggggctataccaagggcgggcccgggcacgaggagccggtacccatgtctacgtacggctggaacatcgtcaagctcatgagcgggaaggatgtcttctacttaccgcccgagaagtgcgacactctgctgtgtgacattggcgaatcgagccccagccccaccgtggaggagtcacgtaccatcagagtactgaagatggtggagccgtggctcaagaacaatcagttttgcatcaaggtgctgaatccctacatgccaacggtcatcgagcatttagagcggctacagcgcaagcacggcgggatgctggtacgcaaccctctgagccgcaacagcactcacgagatgtactggatatccaacggtacaggcaacatcgtagccagcgtcaacatggtgtcccgtctcctgctgaaccgcttcaccatgacgcaccggcgcccgactatcgaaaaagatgtagatctcggcgcaggcacccggcatgtcaacgcggagccggaaacccccaacatggacgtcataggcgagaggatcaagagaataaaggaggagcacaacagcacgtggcactacgacgacgagaacccgtataagacctgggcctaccacggctcttacgaggtgaaggcgaccggttctgcgtccagcatgatcaacggggtcgtgaaattgctgaccaagccctgggacgtcgtgccgatggtgactcagatggcgatgactgacaccaccccctttgggcagcagcgcgttttcaaggagaaggtggacacgcggaccccgcgcagcatgcctggcacccggcgcgtgatgggcatcaccgcagagtggctctggcgcacactgggtcgaaataaaaagccccgactctgcacacgggaggagttcactaagaaggtccgcaccaatgcagctatgggcgcggtgttcacggaggaaaaccaatgggactccgcgaaggccgctgtggaggacgaggacttttggaagctcgtcgacagagagcgcgagctgcacaagctgggaaagtgcggttcatgtgtgtacaacatgatgggtaaacgggagaagaagctcggcgagttcggaaaggctaaagggtccagagcaatctggtatatgtggctgggcgcacggtacctggagtttgaggccctcgggttcctcaacgaggaccactggtttagccgcgagaacagctacagcggcgtcgagggggaggggctgcacaagctgggctacatactgcgggacatctccaagatccccggcggcgccatgtacgccgacgacaccgcggggtgggacacgcgtatcaccgaagacgacctgcacaacgaggagaagatcacgcagcagatggacccggagcacaggcagctcgccaacgccatctttaagctgacctaccagaacaaggtcgtgaaggtgcaaagacctaccccgacgggcactgtcatggacatcattagcaggaaagatcagcgcggctccggccaggtcggcacgtatgggctgaacaccttcaccaacatggaagcccaactcatccggcaaatggagggcgagggggtgttgagcaaggccgatctggagaatccccaccttcctgagaaaaagatcacccagtggctggaaacaaagggcgtcgagcgtctgaaacggatggcgatctctggggatgactgcgttgtgaagcccatcgacgaccgctttgccaacgcactgctcgccctcaacgacatgggcaaggtccggaaagacattccgcagtggcagccctcgaagggctggcacgactggcagcaagtgccgttctgctcgcatcacttccatgagctcatcatgaaggacggccgaaagctggtcgttccctgccgtccccaggacgagctgattggccgcgcccggatcagccagggggcgggctggtccctccgcgagaccgcctgtctgggcaaggcctacgcacaaatgtggagtctgatgtacttccatcgccgggacctccgtcttgcgtcgaacgccatatgttccgccgtgcccgtccactgggttccgaccagccgtacgacatggagcatacacgcccaccaccaatggatgacaaccgaggatatgctgaccgtgtggaatcgtgtctggatcgaagacaacccctggatggaagataagacccctgttaccacatgggagaacgtaccctacctcgggaagagagaggaccaatggtgcggtagcctgatcggtctgacctcccgcgccacgtgggcgcaaaacatcccaacagccattcagcaagtccgtagtctcatcggaaacgaggaatttctggactacatgccctccatgaagcgcttccggaaggaggaggagagcgagggagccatctggtga

SEQ ID NO: 25886 - RNA, 9873 nt, synthetic construct
  misc_feature 1..9873: note = derived and/or modified CDS sequence (opt11) from DENV-3__KJ189266__SS-prME
  source 1..9873: mol_type = other RNA
accagcctgtgtctcatgatgatcctgcccgccgcactcgcgtttcacctcacttcccgggacggcgaaccccggatgatcgtgggaaagaacgaacggggcaagagcttactgttcaagacagccagcggcatcaacatgtgcaccctgatcgcaatggacttgggagagatgtgcgacgatactgtaacctacaaatgcccgcacatcaccgaggtagagcccgaggacatagactgctggtgcaacctgacgagcacctgggtgacctacgggacctgcaaccaggccggggaacatcgccgcgacaagaggtcggttgccctcgcgccccatgtgggcatgggtctggatacccgtacccagacctggatgagcgccgagggtgcctggcgccaggtggagaaagtcgagacgtgggctctgcgccacccgggcttcaccatcctagcgctcttcctcgcccattacatcggcacatcgctcacccagaaggtcgtgatcttcatcctgcttatgctcgtcacaccctcgatgaccatgcggtgcgtgggggtggggaatcgcgattttgtcgaaggcttatccggggccacctgggtagacgtggttctcgagcacggcgggtgcgtcaccacgatggccaagaacaagcccaccctcgacatcgagctgcagaagaccgaggccacgcagctagcaacgctcagaaagctgtgcatcgagggcaagatcacgaacatcaccaccgacagccgctgccccacgcagggcgaggctgttctgccagaggagcaggaccagaactacgtctgcaagcacacctacgtcgaccggggctgggggaacgggtgtggactgttcgggaagggctccctggtgacttgcgccaagttccagtgcctggagcccatagaaggcaaggtcgtccagtacgagaacctcaaatatacggtgattatcacggtccacaccggggaccagcaccaggtggggaacgagacccagggggtcaccgccgagattacgccccaggccagtaccaccgaggcgatcctgcccgagtacggcaccctggggctcgagtgctctccgcgcaccgggctggacttcaacgagatgatcttgctcacgatgaagaacaaggcctggatggtgcaccgacaatggttcttcgacttacccctgccctggacttcaggcgccaccaccgaaacgcccacatggaaccgcaaggagctcctggtgactttcaagaacgcccacgccaagaagcaggaggtcgtcgtgctggggtcccaggagggcgcgatgcacacggccttgacgggggccaccgagatccagaacagcggagggacctccatcttcgccggccacctcaagtgccgtctgaagatggacaaactcgagctgaagggcatgagctacgccatgtgtaccaatacgttcgttctgaagaaggaggtgtccgagacccagcatgggaccatcctcatcaaggtcgagtacaagggcgaagacgtcccgtgtaagatccccttcagcaccgaggacgggcacgggaaagcgcataacggccgtctgatcacggctaaccccgtcgtgaccaaaaaggaggagcccgtcaacatcgaggccgagccgccattcggggagagcaacatcgtgatcggcatcggggacaacgccctgaaaattaactggtacaagaagggcagtagcatcgggaagatgttcgaggcaaccgcccggggcgcgcgccggatggctatcctgggtgacaccgcgtgggacttcgggagcgtaggcggagtcctcaatagcctggggaaaatggtgcaccagatcttcgggtccgcgtatacggctctgttcagcggcgtctcatgggtcatgaaaatcggcatcggggtgctcctgacctggatcgggctgaacagcaagaacacctccatgagcttctcctgcatcgccattgggatcatcacgctctacctgggcgccgtggtccaggccgatatggggtgcgtgatcaactggaaagggaaggagctgaagtgtggtagcggcatctttgtgacgaatgaagtccatacctggaccgagcagtacaaattccaggcggactcccccaagcgcctcgccaccgccatcgcgggcgcctgggaaaacggggtgtgcgggatacgcagcacaaccaggatggagaacctgctgtggaagcagattgccaacgagctcaactacatcctgtgggagaacaacatcaaactgaccgtggtagtgggggacatcatcggcgtgctggagcagggcaagcgcactctgacgccccagccgatggagctgaagtactcctggaagacctggggcaaggccaaaatcgtcaccgccgagacccagaatagctccttcatcatcgacggacccaacacgcccgaatgccctagcgcttcgcgtgcgtggaacgtttgggaagtggaggactatggattcggcgtctttacaacgaatatctggctcaagctgcgcgaagtgtacacccagctgtgcgaccaccggctcatgagcgcagctgtgaaggatgagcgcgccgtccatgcagatatggggtactggatagagagccagaagaacgggtcctggaagctggagaaggcgtcactgatcgaggtgaagacctgcacgtggccgaagtcccatacactgtggtcaaacggcgtgctggagtccgacatgatcatccccaaatcgctggccggaccaatctcacagcataaccaccggccgggataccatacccaaactgctgggccctggcatctcggcaaactagagcttgacttcaactactgcgagggcacgaccgtcgtgataaccgagaactgcgggacacgcggccccagtctccggacgaccaccgtgtccggcaaactgattcacgagtggtgttgtcgctcatgcaccctgccaccactccggtacatgggtgaggacgggtgctggtacggcatggagatccgccccatctccgaaaaggaggagaatatggtcaagtccctggtgtctgccggcagcgggaaggtcgacaacttcaccatgggcgtcctttgtctcgccatcctgttcgaagaggtgatgcgaggtaagtttggcaagaagcacatgatcgcgggggtgttcttcacctttgtcttactcctttccggccagatcacctggcgcgatatggcccacaccctgatcatgatcgggtccaacgcctcggaccgtatggggatgggcgtcacgtacctcgccctgatcgccaccttcaaaatccaacccttcctggcgctagggttcttcctgcgtaagctgaccagccgggagaacctcctgctgggcgttggcttagccatggccaccacgctgcagctgcccgaggacatcgaacagatggccaatgggatcgcgctaggcctaatggctctgaagctcatcacacagttcgaaacctaccagctgtggaccgccctgatctcactcacgtgctccaacaccatcttcaccctgaccgtcgcctggcgcacggccactcttatcctagcgggggtgagcttgctgccggtgtgccagtcctcctccatgcggaaaaccgactggttgcccatggcagtggccgccatgggtgtgcctcccctccctctgttcatcttcagcctcaaggacactctgaagcgccgctcttggcccctgaatgagggggtaatggccgtggggctcgtgagcattctggcgtccagcctgcttcggaacgacgtacctatggcgggtcccctggtggctggggggctgctcatcgcctgctacgtgatcacggggacctccgccgacctgaccgtcgagaaggcggcggacatcacgtgggaggaggaggcagagcagacaggcgtgagccacaatctgatgatcaccgtggacgacgacgggaccatgcgcatcaaggacgacgagaccgagaacatcctcacagtcctgttgaaaacggccctcctgatcgtttcgggcatctttccgtacagcattccggcgaccctgctcgtgtggcacacctggcagaagcagacccagcgttccggcgtcctgtgggacgtgccgagcccgcccgagacgcagaaggcggaactggaggagggggtgtaccgcatcaagcaacaggggatcttcggaaagactcaggtcggagtgggggtgcagaaggaaggcgtgttccacaccatgtggcatgtgacccggggcgcggtactcacctacaacgggaagcgcctggagcccaactgggcctcagtcaagaaggatttaatctcttacggcgggggctggcggttgtccgcccagtggcagaaaggggaggaagtccaggtgatcgcgatagagcccggcaagaaccccaagaacttccaagcgatgccgggcacctttcagaccaccacgggggaaatcggcgcgatagccctggactttaagcccgggacctctggcagccccatcataaaccgcgagggcaaggtcgtggggctgtacggcaacggggtggtaaccaagaacggcgggtacgttagcggaatcgcccagaccaacgctgaaccggacggtcctacgcccgagctcgaggaggaaatgttcaagaaacgtaacctcacgatcatggacctgcaccccgggtccggcaagacccgcaagtacctgccggccatcgtccgggaagccatcaagcgccggctacgcaccctgatcttggcccccacgcgggtcgtggccgcggagatggaggaggcactcaagggcctgcccatcagataccaaacaaccgctaccaagagcgagcatactggccgagagatcgtggacctgatgtgccacgccactttcaccatgcgcctcctgagcccagtccgggtgccgaactacaacctgatcatcatggacgaggcccacttcaccgacccggcgtccatagccgcccgcgggtacatcagcacgcgggtgggtatgggcgaggccgctgccatcttcatgaccgccacgccgcccgggaccgctgacgccttcccgcagtctaatgcacctatccaggacgaggagcgcgatatccccgagcgctcctggaactcgggcaacgagtggatcaccgacttcgccggcaagacggtttggttcgtaccctcaatcaaagccggcaacgacattgcaaactgcctacggaagaacgggaagaaggtgatccaattgtccagaaagacctttgacaccgaataccagaagacgaagctgaacgattgggacttcgtcgtgactaccgacatctcagagatgggtgccaatttcaaggcggaccgggtgatcgacccacgccggtgcttaaagcctgtcatcctgaccgatggacccgagcgcgtgattctggccgggcccatgccggtgacggccgcctccgccgcacagagacgcggccgggtagggcgcaacccccagaaggagaacgaccagtacattttcaccggccaacctctcaacaacgacgaggaccacgcccactggaccgaggccaaaatgttactggacaacattaacacacccgaagggatcatcccggcccttttcgaacctgagcgggaaaagagtgcggccatcgacggcgagtaccgcctgaagggcgaatcccggaagacattcgtggagctgatgcgacgcggggaccttcccgtgtggctggcccacaaggtggccagcgagggcatcaagtacacggaccgcaagtggtgttttgacggacagcggaacaatcaaatactggaggaaaacatggacgtggaaatctggaccaaggagggcgagaaaaagaagctccgcccccggtggctagacgccagaacctacagcgacccgctggcgctcaaggagttcaaagacttcgccgccggccgcaagtctatagccctggacctggtgaccgaaatcggacgggttccctcccaccttgcccataggacgcggaacgcgctggacaacctggtcatgctacacaccagcgagcacggcgggcgcgcctaccggcatgccgtcgaggagctgcccgagaccatggagaccctgctcctgctgggccttatgattctactgacgggcggggccatgctattcctgatcagtgggaaggggatcggcaagacgtccatcgggctgatctgcgtgatcgcgagctccggcatgctctggatggccgagatcccgcttcagtggatcgcctccgccatcgtcctggaattcttcatgatggtcctccttatccccgagcccgagaagcagcgaacaccccaggacaaccaactggcttacgtggtaatcggtatcctcaccctggcagcgatcatagccgccaacgagatgggcctgctcgagacgaccaagcgtgacctgggtatgtccaaggagccgggggtcgtgagccccacctcgtacctggatgtggacttgcaccctgccagcgcctggaccctgtatgccgtcgccacgactgtgatcacccccatgctgcgccacacgatcgagaactctaccgccaacgtgagccttgccgcgatcgccaaccaggccgtcgtgctcatgggcctggacaaggggtggccgatctccaagatggacctcggcgtgccactgctggccctagggtgctacagccaggtcaaccccctgactctgaccgctgcggtgctcctgctgatcacccactacgccatcatcggccccggcctccaagccaaggccacgcgggaggcccagaagcgcaccgccgcggggatcatgaagaatccgaccgtagacggcatcatgaccatcgacctggaccccgtcatctacgacagcaagttcgagaagcagctgggccaggtgatgctccttgtgctgtgcgccgtccagctcctgttaatgcggacgagctgggccctctgcgaggcgctgaccctggcaaccggcccgatcaccacgctctgggagggctcccctggaaagttctggaacaccacaatcgctgtgtcaatggctaatatattccgcggctcctacctagctggggcaggcctcgccttcagcatcatgaagtccgtgggcaccggcaagcgaggtacggggtcacagggagaaaccctcggggagaagtggaagaagaagctgaatcagctgagcagaaaggagttcgacctctacaagaagtccggcattaccgaggtcgacaggaccgaggcgaaggaagggctgaagagaggcgagattacccaccacgccgtgagccggggctccgccaagctgcagtggtttgttgagcgcaacatggttatcccagaggggcgggtgatcgacctcgggtgcgggcgcggcgggtggagctactactgcgcgggcctgaaaaaggtgacggaggtacgcggctataccaagggcggccccgggcacgaggagcctgtccccatgtccacctacggctggaacatcgtgaagctgatgagcggtaaggacgtcttttatcttccgcccgagaagtgcgacaccctgctgtgcgacatcggcgagtccagccccagccctacggtggaggagagccgcaccatccgcgttctgaaaatggtcgagccgtggctcaaaaacaaccagttctgtattaaggttctgaacccctacatgcccaccgtgatcgaacacctggaacgactccaacgaaagcacggcgggatgctggtccggaaccccctgtcccgtaacagcacccacgagatgtactggatctccaacggcacgggcaacatagtggcctccgtgaacatggtcagccggttactgctgaaccgcttcacaatgacccacagacgcccgaccatcgaaaaagacgtggacctcggcgccggcacgcggcatgtgaatgccgagcccgagacccccaacatggacgtcatcggggaacgcattaagcggataaaggaggaacacaattcgacatggcactacgacgatgagaacccgtacaagacatgggcttaccacggctcctacgaggtaaaggcgacgggaagcgcctccagtatgatcaacggcgtggttaagctgctgaccaaaccctgggacgtggtccccatggtgacgcagatggccatgaccgatacgaccccctttgggcagcagcgcgtgttcaaggagaaggtcgacacccggacccctcgcagtatgcctggcacgcggagagttatgggaatcaccgccgagtggctctggcggacgcttggtcgcaataagaaaccgcggctgtgcacaagagaggagttcacgaaaaaggtgcggaccaatgccgccatgggcgcagtcttcaccgaggagaatcaatgggactcagctaaggcagcagttgaggacgaggacttttggaagttagtggatcgggagcgcgagctgcacaagttagggaagtgcggcagctgcgtctacaacatgatggggaagagggagaagaagctcggagaattcggcaaggcaaaggggtcccgcgccatctggtacatgtggctgggcgcccggtacctagagtttgaggcgctcgggttcctgaacgaagaccactggttcagccgggagaattcctatagcggcgtggagggggagggcctgcacaagctcggatacatcctgcgggacatctccaagattcccggaggcgcgatgtacgccgacgacaccgccgggtgggacactcgcatcaccgaggacgacctgcacaacgaggaaaagatcacccagcagatggatccggagcaccggcagctagcgaatgccatcttcaagctgacctatcagaacaaggtggtcaaggttcaacgcccaacgcccaccggcaccgtcatggacataatcagccggaaggatcagcgcggatccgggcaggtcggcacttacgggttaaataccttcacgaatatggaggcgcagctcatccggcagatggaaggcgagggggtgctgagcaaggccgacctagagaacccacacctcccggagaagaagataacccagtggctggaaaccaagggcgtggagcgcctgaagcggatggcaatatccggcgacgactgcgtcgtgaaacccatcgacgaccgcttcgcaaatgccctcctggctctgaatgacatggggaaggtgagaaaggacattccccagtggcagcccagcaaaggctggcacgactggcagcaggtcccgttctgctcccatcacttccacgagctcattatgaaagacgggcgcaagctggtggtgccctgtcggccccaggacgagctgatcgggcgcgctcgtatcagccagggggccggctggtccctcagagagaccgcctgccttggtaaggcgtacgctcagatgtggagcctgatgtacttccaccgcagggaccttcgcctggcctccaacgctatctgcagcgccgtccccgtgcactgggtgcccacctcccgcaccacctggagcatccacgcgcaccaccagtggatgaccacggaggacatgttgaccgtctggaaccgcgtgtggatcgaggacaacccctggatggaggacaagacccccgtgaccacttgggagaacgtcccctacctcgggaagcgtgaagaccagtggtgcggcagcctgatcgggctgacctcccgcgcgacctgggctcaaaacatcccgactgccatccaacaagtccggagcctcatcggtaatgaggagttcttggattacatgccttcgatgaagcgcttccggaaggaggaggagagcgagggggctatctggtga

SEQ ID NO: 25887 - RNA, 9873 nt, synthetic construct
  misc_feature 1..9873: note = derived and/or modified CDS sequence (opt11) from DENV-3__KJ189268__SS-prME
  source 1..9873: mol_type = other RNA
accagcctctgcctcatgatgatcctgcccgccgccttggcgttccacctcaccagcagagacggggagccccggatgatcgtggggaagaacgaaaggggcaagagcctgctgttcaagaccgcctccgggatcaacatgtgcaccctcatcgctatggatctgggcgagatgtgcgacgataccgtgacctacaagtgcccccacatcaccgaggtggagcccgaagacatcgattgctggtgcaacctgaccagcacctgggttacctacggtacctgcaaccaggcaggcgagcaccggcgcgataagcggtccgtggccctcgcgccccacgtgggcatggggctggacacccgcactcagacatggatgagcgccgagggcgcctggcgccaggtggagaaggtcgaaacatgggccttacgccacccgggctttaccattctcgcgctgttcctggcccactatatcggcacctccctcactcagaaggtggtaatattcatcctgctgatgctcgtcacgccaagcatgaccatgagatgcgtgggggtgggcaaccgcgacttcgtcgagggcctgtccggggccacctgggtggacgtggtcctcgagcacggcggatgcgtgaccacgatggccaagaacaagcccaccctcgacatcgagctacagaagaccgaggccacccagttggcgacactccggaaactgtgcattgagggcaagatcaccaacatcaccaccgacagccgctgccccacgcagggcgaggccgtgctgccggaagagcaggaccagaattacgtctgtaagcacacctacgtggaccgggggtggggcaacgggtgcgggctcttcgggaagggctccctagtcacctgcgccaagtttcagtgccttgagcccatcgagggcaaggtcgtgcagtatgagaacttgaaatacaccgtgatcatcacggttcatacgggcgaccagcaccaggtgggcaacgaaacacagggagtcaccgccgagatcactccacaggccagcaccaccgaagcgactctgcccgaatacggcaccttaggcctcgagtgttccccgcgcacggggctggactttaacgaaatgatcctgctcaccatgaagaacaaggcctggatggtgcaccggcagtggttcttcgacctgcccctgccctggaccagtggcgccactacggagacccccacctggaaccgcaaggagcttctggttaccttcaaaaacgcccacgccaagaagcaggaggtcgtggtgctggggtcccaagaaggcgcgatgcatactgccctcacaggggccaccgagatccaaaacagcggcgggacctccatcttcgccggccaccttaagtgtcggttaaagatggataagctcgagctgaaaggcatgagctacgcgatgtgcacgaacaccttcgtcctgaaaaaagaggtgtccgagacccagcacgggaccatcctcataaaggtggagtataagggcgaggacgcgccgtgcaagatccccttcagcacggaggacggtcacggcaaggcccacaacggccgcttaatcaccgccaaccccgtcgtcactaagaaggaggagcccgtgaacatcgaggccgagccacccttcggggagagcaacatcgtgatcgggatcggggacaacgcgctgaagatcaactggtacaagaaggggtcctcgatcgggaaaatgttcgaggccacagcccggggcgcccgccgtatggccatcctgggcgacacggcgtgggacttcggatccgtgggaggggtactcaacagcttaggcaagatggtccaccagatcttcgggtccgcctacaccgccctgttcagcggcgtgtcctgggtgatgaagatcggcatcggggtcctcctgacctggatcggcctcaacagcaagaacacctccatgagcttctcctgcatcgcaatcgggatcatcacgctctacctgggcgccgttgtgcaggcggacatggggtgcgtcatcaattggaagggcaaggagctgaagtgcggaagcgggatcttcgtgaccaacgaggtgcacacctggaccgagcaatacaagttccaggccgactcccccaagcgcttagccacggccatcgccggcgcgtgggaaaacggggtctgcggcatccgcagcaccacccggatggagaacctgctgtggaaacagatcgccaacgagctcaactacatcctgtgggagaataacataaagctgaccgtggtggtcggtgacatcatcggcgtgctcgagcagggtaagcgcactctgacgccccagccgatggagctgaagtactcctggaagacatgggggaaggccaaaatcgtgaccgcggagacgcagaactcttccttcattatcgatggcccgaacacccccgagtgccctagcgcgtctcgggcttggaatgtctgggaggtggaggattatgggttcggagtgttcaccaccaacatctggcttcgcctgcgggaggtctacacgcagctgtgcgaccatcgcctcatgagcgccgccgtaaaggacgagcgggctgtgcacgcggacatgggctactggatcgagagccagaagaacgggtcctggaagctcgaaaaggcctcactaatcgaggtcaagacgtgcacgtggcccaagtcccacaccctttggagcaacggcgtgctggagtccgacatgatcatccccaagagcctggccgggcccatatcccagcacaatcacagaccgggctatcacacccagacggctgggccctggcacttagggaagctggagctggacttcaactactgcgagggcaccaccgtggtaatcacggaaaactgcgggacgcggggccccagcctccgcacgaccaccgtgtctgggaaactgatccatgagtggtgctgccgctcctgtacgctgcccccgctccgctacatgggcgaggacgggtgctggtacggcatggagatccgtcccatctccgagaaggaggagaacatggtcaagagcctggtctccgccggttctggtaaggtggacaacttcaccatgggtgtgctttgcctcgcaatcctgttcgaggaggttatgcgcgggaagttcggcaagaagcatatgatcgccggggtgttcttcaccttcgtactgctactgtccgggcagatcacctggcgggacatggcccacaccctgatcatgatcggcagcaacgcctccgatcgcatgggcatgggcgtgacatacctcgccctgatcgcgaccttcaagatccaacccttcctggccctcgggttcttcctgcgtaagttgacctcacgcgagaacctcctgctgggcgtaggcttggccatggccacgaccctgcagctgcccgaggacatcgagcagatggccaatgggatcgccctcggcctgatggctctgaaattgatcacccaattcgagacgtaccagctgtggacagctttgatcagcctgacctgctccaacaccatcttcaccctgacggtggcctggcggacagcgaccctgatactcgccggcgtcagcctgctgccggtgtgccagtccagctctatgcgcaagaccgactggctccccatggccgtcgccgccatgggagtgccgcccctcccgctgttcattttctctctcaaggatacgctgaaacgccggtcctggcccctaaatgagggggtgatggcggtcggcctagtgagcatcctggcctccagccttctgaggaacgacgtgcccatggccggccccttagtcgccgggggcctgctcatcgcctgttacgtgatcacaggaacctccgccgacctaaccgtggagaaggccgccgacattacttgggaggaggaagccgagcagaccggcgtcagccacaaccttatgatcaccgtagacgacgacgggaccatgcggatcaaggacgacgagaccgagaacatcctcactgtgctgctgaagaccgccctcttgatcgtctccggcatcttcccgtatagcatccccgcgaccctactcgtgtggcacacctggcagaaacagacgcaacgctccggtgtactgtgggacgtccccagcccgcccgagacgcagaaggccgagctggaggagggggtgtaccggatcaagcagcagggcattttcgggaagacccaggtgggcgtcggggtgcagaaggagggcgtgttccacaccatgtggcatgtaacgcgcggcgcggtgctcacctacaatgggaagcggctggaacccaactgggcctcggtcaagaaggatctgatcagctacggcgggggctggcgcctctccacccagtggcagaagggggaagaggtccaggtaatcgcggtggaacccggcaaaaaccccaagaacttccagacaatgcccggcacgtttcagaccaccaccggggagatcggcgccatcgccctcgacttcaagccaggtacgagcggctcaccgatcatcaaccgggagggcaaggtcgtggggctatacggcaatggggtggtcaccaagaacggcgggtacgtgagcggcatcgcccaaaccaacgccgagccggacggtcccacgcccgagttggaggaggagatgttcaagaagcgcaacctcacgataatggatctgcaccccggcagcggcaagacccggaagtacctgccggcgatcgtgcgagaggcgatcaaacggcgcctccggaccctgatcttggcccccaccagagtcgtggccgccgagatggaggaggcgctcaaggggctgcccatccggtaccaaacgacggcaaccaagtccgagcacaccggccgcgagatcgttgacctgatgtgccacgccacgttcaccatgcggctcctgagccccgtccgcgtgcccaactacaacctgatcataatggacgaggcccacttcaccgaccccgcctccatcgcggcccgggggtacatcagcacccgcgtgggcatgggcgaggccgccgcgatctttatgacggccacgccgcccgggaccgccgacgccttcccgcagtccaacgcccccatccaggacgaggagcgcgacattcccgagcggagctggaactccggcaacgagtggattaccgacttcgcggggaagacggtctggttcgtgcctagcatcaaggccggcaacgacatcgccaactgcctccgcaagaacgggaagaaggtgatccagctgtcgcggaagaccttcgacaccgaataccagaagaccaagctgaacgactgggacttcgtcgtgacgaccgacatcagcgagatgggcgccaatttcaaggccgaccgcgtgatcgacccgcggcgctgcttgaaacccgtcattctgaccgacggccccgagcgggtaatcctggcagggcccatgccggtgaccgccgcgtccgccgcccagcgccggggcagagtcgggaggaacccccagaaagagaacgaccagtacatcttcaccggacagcccctcaacaacgatgaggaccacgcgcactggacggaggccaagatgctgctggacaatatcaacacccccgaggggatcatcccggccctcttcgagcccgaacgagagaaatccgctgcaatcgatggcgagtaccggctgaagggcgagtcccgcaaaaccttcgtggagctgatgcggcgcggggacctccccgtctggctggcccacaaggtcgccagcgagggcatcaaatacaccgaccgaaaatggtgcttcgacgggcagcgcaacaaccagattctggaggagaacatggacgtggagatctggacgaaggagggcgagaagaagaagctcaggcctcgctggctagacgcgcgcacatactccgacccgctggccctcaaggaattcaaggatttcgcggccggccgcaagagcatcgccctggacctggtcactgagatcgggcgcgtgccctcccacttagctcatcggaccaaaaacgccctggacaacctggtgatgctccatacgtcggaacacggcgggcgcgcgtaccggcacgccgtggaggagctgcccgaaaccatggagaccctgctcctgttaggcctcatgatcctgctgaccgggggcgccatgctgttcttgatcagcggcaagggaatcggcaagacgagcatcgggctgatctgcgtgatagccagctccggcatgttgtggatggcagagatcccgctgcaatggatcgcgagcgccatcgtgctggagttcttcatgatggtcctactgatccccgagccagagaaacaacgtacgccacaggacaaccagttagcttacgtggtgatcgggatcctcaccctggctgccactatcgcggccaacgagatgggcctgctagagacgaccaagcgggacctgggtatgtctaaggagccgggggtcgtgagcccaacctcttacctggacgtggacctccaccccgccagcgcctggaccctttacgcggtcgccacgacggtgataaccccgatgctgcgccacaccatcgagaattccacggccaacgtgagcctcgccgccatagctaaccaggccgtggttctaatgggcctggacaagggttggccgatctccaagatggacctcggagtgcccctgctggccctcgggtgctactcgcaggtaaaccctctgacccttaccgccgccgtactcctgctgatcacccattacgcgattatcggaccgggcctccaggccaaggccacgagggaggcccagaaacgaacagccgcgggcatcatgaagaacccgaccgtggacggcatcatgaccattgatctggaccccgtcatctacgattccaagttcgagaagcaactgggccaggtgatgctcctcgtgctgtgcgccgtccagctcctgttaatgcgtacgagctgggctctctgcgaagcccttacactggcgacagggcccatcaccacgctctgggagggctcccctgggaagttttggaacaccaccatcgccgtgagcatggccaacatattccgcggctcttacctggccggggccggcctggcgttcagcatcatgaagtctgtggggaccggcaagcggggcaccgggagccagggcgagacgctcggggagaagtggaagaaaaagctaaaccaactgagccgcaaggagttcgacctctacaagaagtctggtatcaccgaggtcgaccggacagaggccaaagagggactgaagcgcggagagatcacccaccacgccgtgagccgtggctccgccaaacttcagtggttcgtggagcgcaacatggttataccggaagggcgcgtcatcgacctcggatgcgggagaggcggttggagctattactgcgccggcctgaagaaggtgactgaggtccggggctacaccaagggcgggcccgggcacgaggagcccgtgcccatgtccacctacggctggaacatcgtgaagctgatgtcggggaaagacgtcttctacctaccgcccgagaagtgcgacacgctgctgtgcgacattggcgagtccagcccgtcccccacggtggaagagagtcgcactatcagagtgctgaagatggtagagccatggctcaagaacaaccagttctgcatcaaggtgctgaacccctatatgcccaccgtgattgagcatctggagcggctccagcgtaagcacggtgggatgctggtccggaaccccctgtcccgcaacagcacgcacgagatgtactggatctccaacggcacggggaacatcgtggcgagcgtgaacatggtctctcggctcctgctgaaccgcttcaccatgacccaccgtcgcccgacgatcgagaaggacgtcgacctcggcgccggaacgcggcacgtgaacgccgagcccgagacccccaacatggatgtaatcggggagcgaataaaacgcattaaggaggagcacaacagcacctggcactacgacgacgagaacccgtacaagacctgggcctaccacggctcatacgaggtgaaggccactgggagcgcatcaagcatgattaatggtgtggtcaagctgctgaccaaaccctgggacgtggtcccaatggtgacccagatggccatgacagacacgacccccttcgggcagcagcgcgtgttcaaggagaaggtcgacacccggaccccgcgtagcatgcccggcacgcggcgcgtgatgggcatcaccgccgagtggctctggcggaccctggggcgcaacaagaagccccggttgtgcacccgagaggagttcacgaagaaggtgcgcaccaacgcagcgatgggcgccgtcttcaccgaggagaaccagtgggactccgccaaggccgccgtggaggacgaggacttctggaagctcgtcgaccgggagcgcgagctgcacaagctggggaagtgcggcagctgcgtctacaacatgatggggaagcgggaaaagaagctcggcgagttcggcaaggcgaaggggtcccgcgccatctggtatatgtggctgggcgccaggtaccttgaattcgaggccctcggcttccttaacgaggaccactggttcagccgcgagaactcctacagcggcgtggagggggaggggctgcacaagctcgggtacatcctgcgggacatctccaagatccccgggggcgccatgtacgctgacgacaccgccgggtgggacacgcgcatcaccgaggacgacctgcacaacgaggagaagatcacccaacagatggacccggagcaccggcagctcgccaacgctatcttcaagctgacctaccaaaacaaggtggtcaaggtgcagcgccccacccccacgggcaccgtgatggacatcatcagccggaaggaccagcgaggctccgggcaggtcggcacctacgggctgaacaccttcacgaacatggaggcccagctcatacggcagatggagggcgaaggggtactgagcaaggcggacctggagaacccccacctcccggagaagaagatcacccagtggctggagaccaagggcgtggagcgcttgaagcggatggccatctccggcgacgactgcgtcgtgaagccaatcgacgaccgcttcgccaacgccctcctggccctgaacgacatggggaaggtccggaaggacatcccccagtggcagcccagcaagggctggcacgactggcagcaggtccctttctgttcccaccacttccacgaactcatcatgaaggacggtcgcaagctggtggtgccctgccggccccaggatgagctgatcggcagagcgcggatcagccagggagccggctggtccctccgtgagaccgcctgcctgggcaaggcatacgcgcagatgtggtctctgatgtacttccaccgccgggacctccgcttggcaagcaacgccatctgcagcgccgtccccgtgcactgggtgccgacgtccaggaccacctggagcattcatgcccaccatcagtggatgaccacggaggacatgctgaccgtatggaaccgcgtatggattgaggacaacccctggatggaggacaagacccccgtgaccacgtgggaggacgtcccatacctggggaagcgggaggaccagtggtgcggctctctgatcgggctgacctcccgcgcgacctgggcccaaaatatcccgacagcaatccagcaggtacggagcctcattggcaacgaggagttcctggactacatgccctccatgaagcgcttccggaaggaggaggagtcagagggggccatctggtga

SEQ ID NO: 25888 - RNA, 9873 nt, synthetic construct
  misc_feature 1..9873: note = derived and/or modified CDS sequence (opt11) from DENV-3__KJ189271__SS-prME
  source 1..9873: mol_type = other RNA
acgtcactgtgcctcatgatgatcctgcccgccgccctggcgttccatctcaccagccgggacggggagccgcgcatgatcgtagggaagaacgagcggggcaagagcctgttattcaagaccgcctccgggataaacatgtgcaccttgatcgccatggacttaggggagatgtgcgacgacaccgtgacctataagtgcccccatatcacggaagtggaacccgaggacattgactgttggtgcaacctcaccagcacctgggtgacctacgggacctgcaaccaggccggcgaacatcgacgagacaaacggtccgtggctctcgcgccccatgtgggtatggggctggatacccgcacccagacctggatgagcgccgagggcgcctggcgccaggtagagaaggtcgagacctgggcccttcgccatccggggttcacaatcctcgcgctgttcctagcgcattatatcggcacctcccttactcaaaaggttgtgatcttcatcctgctgatgctcgtcacccccagcatgactatgcgatgcgtgggggtgggaaaccgcgacttcgttgaggggctctccggagccacctgggtggacgtggtcctggagcacggcgggtgcgtgaccacaatggccaaaaacaagcccaccctcgatatcgagctccaaaagacggaggccacccagctggcgacgctccggaagttatgcatcgaaggcaaaatcaccaacatcaccaccgatagccgctgcccgacgcagggcgaagctgtactaccggaggagcaagaccagaactacgtctgcaagcacacatacgtggaccgggggtggggcaacgggtgtggcctcttcgggaagggctccttagtaacctgcgcaaagttccagtgcctggagccaatcgagggcaaggtcgtgcaatacgagaacctcaagtacaccgtgatcataaccgtgcacaccggggaccagcaccaggtgggcaacgagacccagggcgtcaccgccgagatcacgcctcaggccagcaccaccgaggcgaccctgcccgaatacggtaccctgggtctcgagtgctccccgcgaacggggttagacttcaatgagatgatcctgctcaccatgaagaacaaggcatggatggtgcaccggcagtggttctttgatttgccattgccctggactagcggcgcgactactgagacccctacctggaaccgaaaggaactgctagtgaccttcaagaacgcccacgccaagaagcaagaagtcgtggtgctggggagtcaggagggcgcgatgcacacggcccttaccggggccaccgagatacagaacagcggcgggacttcgatcttcgccggccacctaaagtgtcggctgaaaatggacaagctcgaactgaaaggcatgtcctacgcaatgtgcacgaacaccttcgtcctgaagaaggaggtgtccgaaacacagcacgggactattcttatcaaggtcgagtacaagggcgaggacgcgccttgtaagattcccttcagcacagaggacgggcacggcaaggcccacaacggaaggctgatcaccgcgaaccctgtggtgaccaaaaaggaggagcccgtgaatatagaggctgaaccgcccttcggggagagcaatatcgtcataggcattggggacaacgcgctgaagatcaactggtacaagaagggctccagcatagggaagatgttcgaggccaccgcacggggagcccgccggatggccatcctgggcgacacggcgtgggacttcgggtcggtaggaggggtgctcaattctctggggaaaatggtccatcagatcttcgggtccgcctacacagccctattctcaggagtgtcctgggtgatgaagatcggaatcggggtcctcctgacctggatcggcctgaacagcaagaatacctccatgtcattctcctgcatcgcgatcggcattatcacgctctacttaggcgccgtggtacaggcggatatggggtgcgtgatcaactggaagggcaaagagctgaagtgcggcagcggtatcttcgtgaccaacgaggtgcacacctggacggagcagtacaagttccaggccgactcccccaagcgactcgccacagccatcgcaggcgcctgggagaacggtgtctgcggcatccgatcaaccacacggatggagaacttactttggaaacaaatcgccaacgagttaaactatattctgtgggagaataacatcaaactgaccgtcgtggtcggcgatatcatcggagtgttggagcaaggaaagcgcacgctgacgcctcagccgatggaactgaagtactcctggaagacctggggtaaagcaaaaatagttaccgccgagacgcagaacagctctttcataatcgacggtcccaatacgcccgagtgccccagcgcgtcccgcgcctggaacgtctgggaggtagaagactacgggttcggggtgttcaccaccaacatctggctccgcctgcgagaggtctacacccaactgtgcgatcaccgcttaatgagcgccgctgtgaaggacgagcgggccgtgcatgcggatatgggatactggatagagagccaaaagaacgggtcctggaagctggagaaggcgagcctgatcgaggtcaagacgtgtacctggccgaagtcccacaccttgtggtctaacggagtgctggagtccgacatgatcatccccaaatcactggccgggcccatctcccagcacaaccaccgccctgggtaccacacccagactgccgggccgtggcacctcggcaagctggagctggacttcaactactgcgagggcaccaccgtggtaatcaccgaaaattgcgggacgaggggccctagcctccggaccaccacagtgtctgggaagctgatccacgagtggtgttgcaggagctgcactctcccgccactccgctacatgggcgaggacggctgctggtacggcatggaaatccgccccatctccgagaaggaggagaacatggtcaagagccttgtcagcgccggctctgggaaagtagacaacttcacaatgggcgtcctgtgcttagcgatcctcttcgaggaggtgatgcgcgggaagctgggcaagaaacatatgatcgcaggggtgttcttcaccttcgtgttactgctttccggccaaattacctggcgggacatggcccacacgctcatcatgatcggctcgaacgcgtccgaccggatggggatgggcgtgacgtacctggcactgatcgccaccttcaaaatccagcccttcctcgccctggggtttttcctgcggaagctcacctctcgtgaaaacttgttacttggcgtgggcttagccatggccacaaccttgcagctccccgaagacatcgagcagatggcgaacgggatcgccctgggcctgatggccctcaaactgattacccagttcgaaacttaccaattgtggacagcgctcatctcgttaacttgctccaatactatcttcacgttaacggtcgcctggaggaccgcgaccctcattctggccggcgtcagcctgctcccggtctgccagtccagctcaatgcgcaaaaccgattggcttcccatggccgtcgccgccatgggcgtgccgcctctgccgctgttcatcttcagccttaaagatacgcttaagcgccggtcctggccgttaaacgaaggggtgatggcggttggtctggtaagcatcttggcctcctcactcctgcgtaatgacgtacccatggccggcccgctggttgccgggggcctcctgatcgcctgctatgtgatcaccggcacctccgcggaccttaccgtggaaaaggcggccgacatcacatgggaggaggaggctgagcagaccggcgtcagccataacctcatgattaccgtggacgacgacggcaccatgcggataaaggacgacgagaccgaaaacatcctgacggtgttactcaagaccgccctgttaatcgtttccggcatcttcccatactccatccctgcaaccctgcttgtgtggcacacctggcagaagcagacccagcggtccggcgtactatgggacgtcccttccccgcccgaaacccagaaggccgagctcgaggagggggtgtaccggatcaagcagcagggcatattcgggaagactcaagtgggcgtcggggtgcagaaggagggcgtgttccacaccatgtggcatgttacgagaggcgctgtgctgacctacaacgggaagcgtctggaacccaactgggctagcgtcaagaaggacctcatctcctacggcgggggctggagactgtccacgcagtggcagaagggcgaagaggtccaggtcatcgcggtggagcccgggaagaaccccaagaacttccagaccatgcccggcacttttcagactaccacgggtgagatcggcgccatagccctggacttcaagccgggaactagcggcagccccattatcaaccgggaggggaaggtcgtggggttatacggcaacggggtggtcaccaagaacggcgggtacgtgtccggcattgctcagaccaacgccgagccggacggccccaccccggagctcgaggaggagatgttcaagaaacgcaacctgacgatcatggatctgcaccccgggtccggtaagactcggaagtacctccctgcgatcgtgcgggaggccatcaagcggcgcctgcggaccctgatcttggcccccacccgcgtagtggccgccgaaatggaggaggcgctgaaaggactgcctattcggtaccagaccaccgccacaaagtccgagcacacggggcgggagattgttgacctcatgtgccacgccacgtttaccatgcggcttctcagccccgtccgcgtcccgaattacaacctcataatcatggatgaggcccacttcaccgaccctgcctccatcgcggcgcgcgggtatatcagcacaagagtgggcatgggcgaggccgcggcgatcttcatgacggccacgccgcccgggaccgccgacgccttcccgcaatccaatgcacctatccaggacgaggagcgtgacatccccgaacggagctggaacagcggcaacgagtggatcacggacttcgcggggaagacggtgtggttcgttcccagcatcaaggcgggcaacgacatcgccaactgcctacgcaaaaacgggaagaaagtgatccagctgagtagaaagaccttcgataccgagtatcagaaaactaaactcaacgactgggacttcgtcgtgacgaccgacatcagcgagatgggcgccaatttcaaggccgaccgcgtgatcgatccgcggcgctgcctgaagcccgtcatcctgactgatggccccgagcgggtgatcctcgcggggcccatgccggtgacagccgcctccgcagcccagcgccggggccgagtcgggcggaacccccagaaggagaacgaccagtacatcttcaccggccagcccctgaacaacgatgaagaccacgcccactggaccgaggccaagatgctgctcgacaacatcaacactcccgaggggatcatcccggcactgtttgagccagagcgcgagaagtcagccgcgatcgacggagagtaccggttaaaaggcgaatccagaaagaccttcgtggagctcatgcggcgtggggacctgcccgtgtggctggcccacaaggtcgccagcgaggggatcaagtacacagatagaaagtggtgctttgacggtcaacgcaacaaccagatcctcgaggagaacatggacgtggagatttggacgaaagaaggcgagaagaagaagctgcggccccgctggttggacgccaggacctactccgacccgctagccttgaaagagttcaaggatttcgccgctggccgcaagagcatcgccctcgacctggtcaccgagatcgggcgagtgccctcccacctggcgcaccggacgcgcaacgccctggacaacctcgtcatgctgcacactagcgagcacggcgggcgggcctaccgacacgccgtcgaggagttaccagagaccatggagaccctgttgctgctcggtcttatgatcttactgacaggaggcgccatgctgttcctgatcagcggtaaggggatcggcaagacgagcattgggctcatctgcgttatcgccagtagtgggatgctctggatggccgaaatcccgctgcagtggatcgcgagcgccatagtactcgagtttttcatgatggtcctgctgatcccagaaccagaaaagcagcggaccccacaggacaaccagttagcctatgtggtgatcgggatcctgaccctggccgccatcatcgctgctaacgagatgggcctcctggaaaccacgaagcgcgacctgggcatgtccaaggagccaggggtcgtgagccccacctcctacctcgacgtggacctgcatccagccagcgcttggactctgtacgcggtcgccaccacggtaataacccccatgctccggcataccattgaaaattccaccgcgaacgtgagcctcgccgccatcgcgaatcaggctgtcgtgctgatgggcctcgacaaaggatggccgatctccaagatggacttgggcgtgccgctgcttgccctcgggtgctacagtcaggtcaaccccttgacgctcacagccgccgtgctgctgctcatcacgcactacgcgatcatcggcccaggcttgcaggccaaggctacccgcgaggcccagaagcggacggccgcgggcatcatgaagaacccgaccgtggacggtatcatgacaatcgacctggaccccgtcatctacgactccaagttcgaaaagcagctcggccaagtgatgctgctcgtattatgcgccgtgcagctgctattgatgcgcaccagctgggccctatgcgaggctctgacgctcgcgaccggccccatcaccaccctgtgggaggggtcccccggcaagttttggaacactaccatcgctgtaagcatggccaacatcttccggggctcctacctggccggggcaggcctcgcatttagcatcatgaagtcagtgggtaccggcaagaggggcactgggagccagggcgagaccctgggggagaagtggaagaagaagttgaaccagctctcgagaaaggagtttgatctgtacaagaaaagcggcatcacggaggttgaccgcaccgaggcaaaagagggactaaagcggggcgaaatcacccaccacgctgtgagccgcggctctgccaaactccagtggttcgtggagcggaatatggtcatcccggaggggcgagtgatcgacctgggctgcgggaggggcggctggagctactattgtgccggcctgaagaaagtaaccgaggtccgcggctacacgaaaggcgggcccgggcacgaggagcccgtacccatgtcaacctacggctggaacatagtgaagctcatgtctgggaaggatgtcttctacctgccgcccgagaagtgcgacaccctgctgtgcgacatcggcgaatccagcccctcccccactgtggaggaaagccggacgatacgggtgctaaagatggtggagccgtggctgaagaataaccagttttgtataaaggtgctgaacccctacatgcccaccgttatcgagcacctcgagcgcctgcagcggaagcacggtgggatgcttgtccgcaaccccctctcccgtaacagcacccacgagatgtactggatctcaaacggaacagggaacatcgtggccagcgtgaacatggtatcccgcctgctgctcaaccggttcacgatgacacaccgccggccaaccatcgaaaaggacgtggacctgggcgccggcaccaggcacgtgaacgccgagccggagacgcccaatatggacgtcatcggcgaacggatcaagcgcattaaagaggagcacaacagcacctggcactatgacgatgaaaacccgtataagacctgggcctatcatgggtcgtacgaggtgaaggccacggggagcgcgtccagcatgattaacggcgtggtcaaacttctgacgaaaccctgggacgtggtccccatggtgacccagatggccatgacggacaccacccccttcgggcagcagcgggtgtttaaggagaaggtcgacacccgcacaccccggtcgatgcccggcactcgtcgggttatgggtatcacagccgagtggctgtggcgcactctgggacggaacaagaagccacgtctatgcaccagagaggagttcaccaagaaggttcggactaacgccgctatgggcgccgtcttcaccgaagaaaaccaatgggactccgccaaggccgccgtggaggacgaggacttctggaagctggtcgaccgcgagcgggagctgcacaaactcgggaagtgtggcagctgcgtctacaacatgatgggaaagcgcgagaagaagctgggagagttcggcaaggcgaaaggctcccgggctatctggtacatgtggctgggcgcccgttatctcgagttcgaggcgctggggttcctaaatgaggaccactggttctctagggaaaactcctatagcggcgtggaaggggagggactccataagctggggtacatactacgtgacatctccaagatcccaggaggggccatgtacgcggacgacacggccgggtgggacacccggatcacagaggacgacctccacaacgaggagaagattacccagcagatggacccggaacacagacagctggccaacgccattttcaagctcacataccagaacaaggtagtgaaggtccagcggcctacccccaccggcaccgtcatggacatcatctcccgaaaggaccagcgggggtctggtcaggtcggtacatacgggctcaacacgttcaccaacatggaggcccagctgatcagacagatggagggcgaaggggtgctgtcgaaggcggatcttgagaatccacacctcccggagaagaagatcacgcagtggctggagaccaagggggtggagcggctgaagcgcatggccatctccggcgacgactgtgttgtgaaacccatcgacgaccgatttgccaacgccctgctggccctcaacgatatggggaaggtgcgcaaggacatcccacagtggcagcccagcaagggctggcacgactggcaacaggtcccgttctgctcccatcacttccacgagctgatcatgaaagatgggcggaagctggtggtgccctgccgtccccaggacgagctcattggtcgggcgcgcatctctcagggtgccggctggtccctgcgcgagacggcctgcctgggcaaggcctacgcgcagatgtggagcctcatgtactttcaccgtcgcgacctgcggttggcctcgaacgccatctgcagcgccgtgcccgttcactgggtcccaaccagtcgcactacctggtccatccacgcccaccaccagtggatgacaacagaggacatgctcacggtgtggaaccgggtgtggatcgaggacaacccctggatggaagacaagacccccgtgaccacctgggaggacgtcccctacctggggaaacgcgaggaccagtggtgcggcagccttatcgggttaacttcccgcgcgacctgggcgcaaaacataccgaccgccatccagcaggttcgcagcctgatcggcaacgaggagttccttgactacatgccctccatgaagcggtttcgcaaggaggaggagagtgagggggccatctggtga

SEQ ID NO: 25889 - RNA, 9873 nt, synthetic construct
  misc_feature 1..9873: note = derived and/or modified CDS sequence (opt11) from DENV-3__KJ189272__SS-prME
  source 1..9873: mol_type = other RNA
accagcctctgcctgatgatgatcctgcccgccgcgctggcgttccacctcaccagccgggatggcgaacctcggatgatcgttggtaaaaacgagcgcggcaagtccctgctattcaagaccgctagcgggatcaacatgtgcactctcatcgccatggacctgggcgagatgtgcgacgatacagtgacctataagtgtccctatatcaccgaggtggagcccgaagacatcgactgctggtgcaacctgacaagcacctgggtgacctatgggacctgcaaccaggccggcgagcaccggcgcgacaagcgatccgtagccctcgctccacacgtgggcatggggctggatacccgcacccagacctggatgagcgccgagggcgcctggagacaagtggaaaaggtcgagacgtgggccctgagacacccggggttcaccattctcgccctgtttctggctcactacatcggcacctccctgacccaaaaggttgtgatatttatcctgctgatgctcgtcacgcccagcatgaccatgcggtgcgtgggggtgggcaaccgcgatttcgtcgaaggcttatccggggccacttgggtggacgtagtcttagagcacggcgggtgcgtgaccacgatggccaagaataagcccactctcgatatcgagctgcagaagacggaggccacacaactggcgacgctgcggaagctgtgcatcgaaggcaagattaccaacatcaccaccgacagccgctgccccacgcagggtgaagccgtgctgcccgaggaacaggaccagaactacgtctgtaagcacacctacgtggaccgggggtggggcaacgggtgtgggctcttcggtaagggctctttggtgacctgcgccaagtttcagtgcctcgagcccatcgaaggcaaggtagtgcagtacgagaaccttaaatacacagtgatcatcacagtacataccggtgatcagcaccaagtgggtaacgagacccagggggtcacagccgagattacgccccaggccagtaccaccgaggcgaccctgcccgagtacggcactcttgggctagagtgctcaccgcgcacgggcctagacttcaacgagatgattctgctcaccatgaaaaacaaggcctggatggtacaccggcagtggttctttgacctgcccttaccctggaccagcggcgctaccacggagactcccacctggaaccgcaaggagctcctcgtgaccttcaaaaatgcacacgccaagaagcaggaggtcgtggtgctggggtcccaagagggtgcgatgcacacggccctcacaggagccaccgagattcagaacagcggcgggacctccatctttgccggccatctgaagtgccggctgaagatggacaagctcgagctgaagggtatgtcatacgccatgtgcacgaacaccttcgtcctgaagaaagaggtgagcgagacccagcacgggaccatcctcattaaggtggagtacaaaggcgaggacgcgccgtgcaagatacccttcagcacagaagacggacatgggaaggcccacaacggccgcctgatcaccgccaaccccgtcgttaccaagaaggaggaacccgtgagcatcgaggccgagccgccctttggggagtccaacatcgtcatcggcattggggacaacgcgctgaagataaactggtataagaagggcagttccatcgggaagatgttcgaggctaccgctcggggcgcccgccggatggccattctaggcgacacggcttgggattttgggagcgtgggcggggtgctcaattccctgggcaagatggtgcaccagatcttcgggagcgcctacacggccctgttctccggcgtaagctgggtcatgaagatcggcatcggggtcctgctgacctggatcggcctgaactccaaaaataccagcatgtccttcagctgcatagccatcgggatcataacgctgtacctgggcgccgtggtgcaggccgacatgggttgtgtcatcaactggaaaggcaaggaacttaagtgcggcagtgggattttcgtgaccaacgaagtgcacacctggaccgaacagtacaagtttcaggctgacagcccaaagcgcttagccacggccatcgcaggcgcgtgggaaaacggggtctgcggcatccgcagtaccacccggatggagaacttgctgtggaagcagattgccaacgagctcaactacatcctgtgggagaacaatatcaagctgaccgtggtggtgggcgatatcattggcgtgctcgagcagggcaagcgcacgctgacgccccagcctatggaactgaagtactcctggaagacctggggaaaggccaagatcgtgaccgccgaaacgcaaaactcctcgttcatcatcgacggccccaacacacccgagtgcccgtcggcgagccgggcctggaacgtctgggaggtggaggactacgggttcggcgtgttcaccacgaacatctggctccgcctgcgggaggtgtatacccagctgtgtgaccaccgcttgatgtccgccgcggtaaaggacgagcgggccgtgcacgcggatatgggctactggattgaatcccagaagaacgggagctggaagctggagaaggcctccctgatcgaagtgaagacgtgcacctggccaaagtcccacactttatggtctaacggcgtgctggagagcgatatgatcatccccaagagcttggccgggcccatcagccagcacaaccatcgcccgggctaccacacccagacggccgggccctggcacctcggcaagctggagttggacttcaactactgcgagggcaccaccgtcgtcatcaccgaaaattgtgggacgcggggcccctccctccgcaccaccaccgttagcgggaagctgatccacgaatggtgctgccggtcctgcacactgcccccactcagatacatgggagaggacggctgctggtacggcatggagatccgccccatcagcgagaaggaggagaacatggtgaagtccctcgtgagcgccggctccgggaaggtagacaatttcacaatgggtgtgctgtgcctcgcgatcctgttcgaggaggttatgcgcgggaaattcggcaagaaacacatgatcgccggggtgtttttcacctttgttctactcctgtcgggccaaatcacctggcgggatatggcgcacacgctgataatgatcggcagcaacgccagcgaccgcatggggatgggcgtcacgtacctcgccctgatcgcgaccttcaagatccaacccttcctggcgctcgggttcttcctacgcaagttaaccagccgcgagaatctcctattaggcgtgggcctcgccatggccacaaccctgcagctgcccgaggacatcgaacaaatggctaacgggatcgccctcggcctgatggccctcaaactcataacccagttcgagacgtatcagctgtggacggccctgatctcgctgacctgcagcaacaccatcttcaccctgacagtggcgtggcggacggcaaccctgatcctcgccggggtttcactgctgccggtgtgccagagcagcagcatgcgcaagacagactggctccccatggccgtcgccgccatgggcgtgccacccctcccgttgttcatcttttccctcaaggacacgctgaagcgccggtcatggcccctgaacgaaggggttatggcggtaggcctcgtgtccatcctggctagcagtctgctacgcaacgacgtgcccatggccggtcccctcgtcgccgggggccttctaatcgcctgctacgtgatcaccgggactagcgcggacctgaccgtggagaaggccgcagatataacgtgggaggaggaggcagagcagaccggagtatcccataacttaatgattaccgtggatgacgatggaacgatgcggatcaaggacgacgagaccgagaacatactcacggtgctgctgaagaccgccttactgatcgtctccggcatcttcccgtattccatacccgctaccctgctcgtgtggcacacatggcagaagcagacacagcgcagtggcgtgctatgggatgtacccagcccgcccgaaacccagaaggccgagctggaggagggggtgtaccggataaagcaacagggcatcttcgggaaaacccaggtgggcgtcggcgttcagaaggagggcgtatttcacaccatgtggcacgtcacgcgcggcgccgtgttaacttacaacgggaagcgtctggaacccaactgggcctccgtgaagaaggatctgatctcctacggcgggggctggcgcctctcaacccagtggcaaaagggggaggaagtacaggtgatcgcggtagagcccggcaaaaaccctaagaacttccagacgatgcccggcacgttccagaccacaaccggcgagatcggcgcaatcgcacttgacttcaagcccgggacttcgggctctcccatcatcaaccgggagggaaaagtcgttgggctgtacggaaacggggtcgtaactaaaaacggcgggtacgtgagcggcatcgcgcagaccaacgccgagccggacggccccactcccgagctggaggaggagatgttcaaaaagcgcaatctcacgatcatggacttgcaccccgggtccggcaagacacggaagtacttgccggcgatcgtgcgggaggccattaagcgacgccttcggacgttgatcctggcccccacccgcgtcgtggccgcagagatggaggaggcactgaaggggctgccaatacggtaccagacgaccgccactaagagcgagcataccggccgcgaaatcgtcgacctgatgtgccacgccaccttcacgatgcggctcctgtctcctgtccgcgtgccgaactacaacctgatcatcatggacgaagcccacttcaccgaccccgcctcaatcgcggccagggggtacatctccacccgcgtgggtatgggcgaggccgccgcgatcttcatgacggccacgccgcccggtacggcggacgccttcccgcagagtaatgcccccatccaagacgaggagcgcgacatccccgagcggtcctggaacagcggcaatgagtggataaccgacttcgcggggaagacggtctggttcgtgccctccatcaaagccggcaacgatatcgccaactgcttgcggaagaatgggaagaaggtgatccagctgtctcgaaagaccttcgacaccgagtatcagaagaccaagctgaacgactgggacttcgtcgtgaccacagacatctccgaaatgggcgctaacttcaaggcagaccgcgtgatcgacccgcggcgctgcctgaaaccagtcatcctgaccgatggcccagagcgggttatcctggcggggcccatgccggtgaccgcggccagcgccgcccagcgccggggccgcgtaggtcggaaccctcagaaagagaacgaccagtacatcttcaccggacagcccctcaacaacgacgaggatcacgcgcactggacggaggcgaaaatgctactggacaatattaacacccccgagggtatcatccctgccctctttgaacccgagcgcgagaagtccgccgcgatcgacggggagtacagattgaagggcgagagccgcaagaccttcgtcgagctgatgcggcgtggggacctccccgtctggttagcccacaaggtcgcctccgagggtatcaagtataccgatcggaagtggtgttttgacgggcagcgcaacaaccagatccttgaggaaaacatggacgtggagatttggacgaaggagggcgagaagaagaagctccggccccgctggctggatgcccgaacctacagcgatccgttggccctcaaagaattcaaggacttcgcggccggccggaaatccatcgccctggacctggtcaccgagatcgggcgcgtgcccagccacctcgcccaccggacccgcaacgccctggacaacctggtgatgctacacacgagcgaacacggcgggcgagcgtaccgccatgccgtggaggagttgcccgagacaatggagaccctactcctgctgggcctcatgatcctgctgacagggggcgccatgcttttcctgatctctggcaaggggatcggcaaaacgagcatcgggctgatctgcgtgattgcctcctcggggatgctttggatggccgagatcccactgcagtggatcgcatcagccatcgtgctggagttcttcatgatggtcctactgatacccgaacccgagaagcagcgtacgccccaggacaaccagttagcctacgtggtaatagggatactcaccctggccgctatcattgcggcgaatgaaatgggcctgctcgagactacgaagcgcgacctgggcatgagtaaggaaccgggagtcgtttcccccactagctacttggacgtggacctccaccccgcctctgcctggaccttatacgcggttgccaccaccgtgatcactcccatgctgcggcacaccatcgagaactcgaccgccaacgtttccctcgccgccattgcgaaccaggccgtcgtgctgatgggcctggacaaggggtggcccatctctaagatggacctcggcgtgcccctgctcgccctggggtgctactcccaggtcaacccactcacgctgaccgccgcggtgctcttactgatcacccactacgctatcatcggccccggactccaagccaaagccacccgcgaggcccagaagcggacggccgcggggatcatgaagaacccgacagtcgacggcatcatgactattgacctggacccggtcatatacgatagtaagttcgagaagcagctcggccaggtgatgctcttggtgctgtgcgcggtccagctcttgctaatgcgcacctcctgggccctttgcgaggcactgactctggcgaccggccccatcaccaccttatgggagggcagccccgggaagttctggaacacgaccatcgccgtttccatggccaacatcttcagaggcagctacctggctggggctggcctggcgttctcaatcatgaagtccgtaggcaccggcaagcgcggcaccgggtctcagggcgagacactcggggagaagtggaagaaaaagctgaaccagttgtcccggaaggagttcgacctctacaagaaatccggcatcacggaggtcgaccgcaccgaggccaaggaggggctgaagcggggcgagattacccaccacgccgtgtcccgtggcagcgcaaagttacagtggttcgtggaacggaatatggtcatcccagaaggacgcgtgatcgacctcggctgcgggcggggcggatggtcctactattgcgcgggcctgaaaaaggtaaccgaggtccgcggctacacgaagggcgggcccgggcacgaagagcccgtacccatgagcacctacggctggaacatcgtgaagctgatgtccggcaaggatgtcttttatctcccgccagagaagtgcgacaccctgctgtgcgacatcggtgagagctctccaagcccaaccgtggaggagagtcgtacgatccgggtgctgaagatggtcgaaccgtggctcaagaacaatcagttttgtatcaaggtgctgaacccctacatgcccaccgtgatcgagcacctggagcgcctgcagcggaagcatggcggcatgctagtgaggaaccccctgtcacggaattccacccacgagatgtattggatttcgaacggcaccgggaacatcgtggcgtccgttaacatggtcagccgtctcttgctaaaccggttcacgatgacccaccgacggccgaccatcgagaaggatgtggacctcggagccggaacccgccacgtgaacgccgagcccgagacgcccaacatggatgtcatcggggagcggatcaagcgtatcaaggaggagcacaattccacctggcactacgacgacgagaacccgtacaagacgtgggcataccatggcagctacgaggtgaaggcgaccgggtccgcatccagcatgatcaacggcgtggtcaagctgctgacgaaaccctgggacgtggtccccatggtgacccaaatggccatgaccgacaccacgcctttcgggcagcagcgggtgtttaaggagaaggtcgacaccaggaccccgcggtccatgcccggcacccgccgggtgatgggaatcacggccgagtggctctggaggaccctggggcgaaacaaaaagccgcgactgtgtacccgcgaagagttcaccaagaaagtgcggacgaatgccgccatgggcgcggtcttcaccgaggagaaccagtgggacagcgccaaggcggccgtggaggacgaggacttctggaagttggtggaccgtgagcgagagctgcacaagctgggaaagtgcggctcctgcgtttataacatgatggggaagcgcgagaagaaactgggcgagtttggcaaggcaaaagggagccgagccatctggtacatgtggctaggcgctcgctacctggagttcgaggccctcgggttcctgaacgaagaccactggttctcccgggagaactcgtattccggtgtcgagggggagggtctgcacaaactcggctacatcctgcgcgatatcagcaagattcccggtggcgccatgtatgcagacgacaccgccgggtgggacacccggatcactgaggacgacctgcataacgaggagaagatcacccaacaaatggacccggagcatcgccagttagccaatgccatcttcaagctgacttaccagaataaggtggtcaaggtgcagcggccgaccccaaccggcacggtgatggacatcatctcccgcaaggaccagcggggcagcgggcaggtcggtacctacggactgaacacctttaccaacatggaggcccagcttatccgccagatggagggcgagggggtgttgtccaaggcggacctggagaacccccacctcccggagaagaagatcacgcagtggctggagaccaagggcgtggagcggctgaagcgcatggccatcagcggtgacgattgcgtcgtgaagccaatagacgatcgtttcgcaaacgccctcttagccctgaacgacatggggaaagtgcgcaaggacatcccccagtggcagccctccaaaggctggcacgactggcagcaggtcccgttctgcagccaccacttccacgagctcatcatgaaggacgggaggaagctggtggtgccctgccgcccgcaggacgaactgatcgggcgggcccgcatctcacagggggccgggtggagcctccgcgagaccgcctgcctgggcaaggcctacgcacagatgtggtccctgatgtacttccatcgacgcgatctccggctggctagcaacgccatctgctccgcagtccccgtgcattgggtgccgaccagccgcacgacctggagcatccacgctcaccaccagtggatgaccaccgaggacatgctgacggtctggaaccgagtgtggatcgaggacaacccctggatggaggacaagacgcccgtgaccacctgggaggacgtcccctacctcgggaaacgcgaggaccagtggtgcggttcccttatcgggctgacgagccgggcgacctgggcgcagaacatcccgaccgccatccagcaggtccgctccctcatcggcaacgaggagttcctggactacatgccaagcatgaagcggttccgaaaggaggaagagtccgagggggccatctggtga

SEQ ID NO: 25890 - RNA, 9873 nt, synthetic construct
  misc_feature 1..9873: note = derived and/or modified CDS sequence (opt11) from DENV-3__KJ189273__SS-prME
  source 1..9873: mol_type = other RNA
accagcctttgcttgatgatgatcctgccggccgcactggcgtttcacctcaccagccgagacggggaaccccggatgatcgtggggaaaaacgagcggggcaagagcctgctgttcaagaccgcctccgggatcaacatgtgcaccctcatcgccatggacctgggagagatgtgcgacgatacagtcacctacaagtgcccccatatcacggaagtggagccggaggacatcgactgctggtgcaatctgaccagcacctgggtgacatacgggacttgcaaccaggcgggcgagcaccgaagggacaagcggtccgtggccttagcgccccacgtaggcatggggctggacacccgcacccagacttggatgagcgccgagggcgcgtggcgccaagtggagaaggtggaaacctgggccttgcgccatccggggttcacaatcctcgcgctgttcctggcccactacatcggcacctccctcacgcagaaggtcgtgattttcatcttactaatgttggtcacccccagcatgaccatgcgctgtgtcggagtgggcaatagagactttgtcgagggcctttccggggctacctgggtggacgtcgttttggagcatggcgggtgtgtgaccacgatggccaagaacaagccaaccctcgacatcgaactgcagaagaccgaggccactcagctggccacgctccggaaactgtgcatcgagggcaaaatcaccaatatcaccaccgatagccgatgccccacgcaaggtgaggccgtgctgccggaagagcaagaccagaactacgtatgcaagcacacatacgtggaccgtgggtggggcaacgggtgcggcctcttcgggaagggctccttagtgacctgcgccaagttccagtgcctggagccgatcgaggggaaagtagtgcagtacgagaatctcaaatacaccgtaattatcaccgtccacaccggggaccagcaccaggttggcaacgagacccagggggttaccgctgagatcacgccccaggccagcaccaccgaggtgaccctgcccgaatacggcacactggggttggagtgttccccacgcacgggactggacttcaacgagatgatcctgctgaccatgaagaataaggcgtggatggtgcaccggcagtggttctttgatctgcccctgccctggacctctggcgccacgacggaaacccccacctggaatcgcaaggagctcctggtcacctttaaaaacgcccatgcaaagaaacaggaggtggtggtcctggggtcccaggagggtgccatgcacacggcgctcaccggagccacagagatccagaacagcggcgggacctccatcttcgccggccacctaaaatgccggctaaagatggacaagctcgagctgaagggaatgtcatacgccatgtgcacgaacaccttcgtgctgaaaaaggaggtgtccgaaacccaacacgggacaatcttgattaaggtcgagtacaagggcgaggacgccccgtgcaagatcccctttagcacggaggacggtcacggcaaggcacacaacgggcgcctgataacagcaaaccccgtggtgaccaaaaaggaagagcccgttaacatagaggcggagccacccttcggggagagcaacatcgtgatcggcatcggagacaacgccctgaagataaactggtacaagaaggggtcaagcatagggaagatgtttgaggcgaccgcccggggcgcccgccgaatggcaattctgggcgacaccgcctgggacttcgggtcggtgggcggggtcttgaacagcctgggcaagatggtgcaccagatattcgggtcggcgtacaccgccctgttcagcggggtgtcctgggtcatgaagatcggcattggggtgctcctgacctggatcggcctgaatagcaaaaacacatccatgagcttcagctgcatagcaattgggatcatcaccctctacctgggcgcggtggtgcaagcggacatgggatgtgttataaactggaagggcaaagagctgaaatgcggcagcggcatctttgtgacaaacgaggtccatacgtggactgagcaatacaagttccaagcggattcccccaagcgccttgccacagccatcgccggggcctgggagaatggggtgtgcggcatccgctcgacaacgcggatggagaatctgttgtggaaacagattgcgaacgagctcaactacatcttgtgggagaacaacataaagctgaccgtggtcgtgggggacataatcggcgtcctcgagcaggggaagcgcacgctgacgccccagccgatggagctcaagtactcttggaagacatgggggaaggcaaagatcgtcaccgccgagactcagaactcgtccttcatcatcgatggcccaaacacccccgagtgccccagcgcttcccgcgcgtggaatgtgtgggaagtggaggattacgggttcggcgtcttcaccaccaacatatggctccgccttcgggaagtgtatacccagctgtgcgaccaccgcctcatgagcgccgccgtgaaggacgaacgggccgtccacgccgatatgggctactggatcgagagccaaaagaacgggtcctggaaactagagaaggcgtcgctgatcgaggtgaaaacgtgcacctggcctaagtcccacactctctggagtaatggtgtgttagagtccgacatgattatccccaagagcctggccgggcccatctcccagcacaaccaccgccctggctaccacacacagacggccggtccctggcacctcggcaagcttgagctggacttcaactattgtgagggcacaaccgtcgtgatcaccgagaactgtggtacgcggggccccagtctccgcaccaccaccgtaagcggcaagctgatccacgagtggtgctgccggagctgcactttgccccctctccgctacatgggagaggacgggtgctggtacggtatggagatccggcccattagcgagaaggaggagaacatggtcaagtcgctggtgtccgcaggctcaggcaaggtggacaacttcaccatgggcgtcctgtgcctcgccatcctatttgaggaggtgatgcgggggaagttcggcaagaagcacatgatcgcgggagtgttcttcacctttgtcctgttactgtccggccagatcacctggcgggacatggcccacactctgatcatgattggcagcaacgcctcggaccgaatgggaatgggcgtcacctacctcgctctgatcgcaacattcaaaatccaacccttccttgcgctcgggttcttcctgcgtaagctgaccagccgcgaaaacctcctgctgggcgtggggttggccatggccacgaccctgcaactgcccgaggacatagaacagatggcaaacgggatcgcgcttgggctcatggctctgaagttaatcacccaattcgaaatctaccagctgtggactgccctgatctcgttaacatgttccaacaccatcttcacgctgaccgtcgcctggaggactgccacactgattctcgcaggggtatcactgctgccggtctgccagtccagctccatgcgcaagactgactggctccccatggccgtggccgcaatgggcgtgccgcccttgccgctgttcatcttcagcctcaaggacactctgaaacgccgatcctggccacttaacgagggagtcatggcggtggggctcgtgtccatcctggcctcctctctgctccgaaacgatgtcccaatggccggtccccttgtggcaggcggcctactcatcgcctgctacgtaatcactggcacctctgccgacctaaccgtcgagaaggctgccgacatcacctgggaggaggaggcggagcagacgggtgtgagccacaatctaatgatcacagtagacgatgacggcaccatgcggatcaaagacgacgagacggagaacatcctcaccgtcctgctgaagacggccctccttatcgtgtccggtattttcccctatagcatccccgccaccctactcgtgtggcacacctggcaaaagcagactcagcgctccggagtcctgtgggacgtcccctcgccacccgaaactcagaaggccgaactggaggagggggtgtaccggatcaagcagcaaggcatcttcgggaagacccaggtcggcgtgggggtgcagaaggagggcgtcttccacaccatgtggcatgtcacccgcggcgccgtgctcacgtacaacggaaagagactggaacctaactgggcctctgtaaagaaagacctcatatcttacggcgggggctggcgcctcagcacccagtggcagaaaggcgaggaggtccaggttatcgcggtggagcccggcaagaaccccaagaacttccagaccatgcccggcaccttccagacgaccaccggggaaatcggcgcgatagctctggacttcaagccggggaccagcggatcccccatcatcaaccgggagggcaaggtggttgggctgtacggcaatggggtcgtgacgaaaaacggcgggtacgtgtctggaatcgcgcaaacgaacgcggaaccagacggccctacgcccgagctggaggaggagatgttcaagaagaggaacctcacgatcatggacctgcaccccgggtctggaaagacgcggaagtatcttccagccatagtgcgcgaagcgatcaagcggcgcctccggaccttgatcctcgctcccacgcgggttgttgctgccgagatggaggaagcgctgaagggactgcccattcgataccagaccacagcgaccaagtccgagcacacgggtcgcgaaatcgtcgacctgatgtgccatgccaccttcacgatgaggctcctgtcgcccgtacgggtgccgaactacaacctgatcatcatggatgaggcccactttactgacccagcttccatcgccgcgcgggggtacatcagcacccgcgttggcatgggggaggccgccgccattttcatgaccgcgacacctcccgggaccgcggacgccttcccgcagagtaatgcaccaatccaggacgaggaacgtgatatccccgagaggagctggaattccggcaacgaatggatcaccgacttcgccgggaagacagtctggttcgtgcccagcatcaaggcgggcaacgacatcgccaactgtctccgcaagaacgggaagaaagtcatccagctttcccggaagacgttcgataccgaatatcagaagaccaagctgaacgactgggatttcgtggttaccacggacatcagcgaaatgggcgccaattttaaagcagaccgggttattgacccgcggcgctgtcttaagccagtgattctgaccgacggccccgagagagtcattctggccggccccatgccggtgacggccgcttccgccgcccagcgccggggacgagtagggcggaatccccaaaaggagaatgatcagtatatcttcaccggccagcccctcaacaacgacgaggaccacgcccactggaccgaggcgaagatgctgctggataatattaatacgcccgaggggataatcccggccttatttgagcccgaacgcgaaaaatccgccgccatcgacggagagtaccggctgaaaggcgagagccgtaagacgttcgtggagctgatgcggcgaggggacctccccgtctggctggcgcacaaggtcgccagtgaaggcataaagtacaccgatcggaagtggtgcttcgacgggcagcgcaacaaccagatcctggaggagaacatggacgtcgagatctggaccaaggagggcgagaagaagaagctccggccgcggtggctggacgctagaacgtactccgacccgctggctctaaaggagttcaaggacttcgccgcgggccgcaagtctatcgcgttggatcttgtgaccgaaatcggccgcgtgccctcccaccttgcccatcggactcgcaacgcgctggacaacctggtcatgctccataccagcgagcacggcgggcgggcctaccgtcacgcggtggaggagctaccagagacgatggaaaccctgctcctactgggcctcatgatactcctgacgggcggcgccatgctgtttctaattagcggaaaggggatcgggaaaacgagcattgggttaatctgcgttatcgctagctccggcatgctgtggatggccgaaatccccttacagtggatcgcctccgctatcgttctggagttcttcatgatggtgctcctgatccccgagccggagaagcagcggacgcctcaggacaaccagctggcctacgtggtcattgggatcctcaccctggccgcaatcattgccgcgaacgaaatgggtctgctagagaccaccaaacgtgacctgggcatgtccaaggaacccggggtcgttagcccgacatcctatctggacgttgatttgcaccccgccagcgcttggaccctgtacgccgtagcgactaccgtaataacgcccatgctgcggcacacgatcgagaattccaccgccaacgtcagcctggccgccatcgcaaaccaggccgtggtgctgatgggcctggataaggggtggccgatctccaagatggacctcggcgtccccctactggctctcgggtgctattcacaggtgaatcccctgaccctgacagcagccgtgctactgctgatcacccattacgcaatcattggccccggcctccaggcgaaggcaaccagagaggcccagaagcggacagcggccggtatcatgaaaaacccgacggtggacggcatcatgacgatcgacctggaccccgtgatctacgattccaagttcgagaaacagctgggccaggtgatgttgctggtcttgtgcgcggtgcagctcctgttaatgcgcactagctgggccctctgcgaggccctgaccctggccacgggccccatcactaccctgtgggaaggcagtcccgggaagttttggaacactacgatcgccgtgagtatggccaacatctttcggggctcctaccttgccggggctggattagccttcagcatcatgaaatccgtcggtaccggcaagcgcggaacggggagccagggagagaccctcggtgagaaatggaagaagaagctgaaccagcttagccgaaaggagttcgacctctataaaaagtccggaatcaccgaggtggatcgcactgaggcgaaggaggggctaaagcggggcgagatcacccaccacgccgtctcacgcggctcagccaaactgcagtggttcgttgagcggaacatggtaatcccagaggggcgagtaatcgacctcggctgcggccggggcgggtggagctattattgcgccggcctgaagaaggtcacggaggtgagaggctataccaagggcgggcccgggcacgaggaacccgttcccatgtccacgtacggctggaacatcgtcaagctaatgagcgggaaagacgtcttctacctcccacccgagaagtgtgacacgctgctatgcgacattggcgaatcctccccatcccccaccgtggaggagagcagaaccatcagagtcctgaagatggtagagccgtggctcaagaacaaccagttttgcatcaaggtgttgaacccttacatgcctacggtcatcgaacacctggaacgcctccaacggaagcatggtgggatgctggtgcgtaaccccttatcccggaactccacccacgagatgtactggatctccaacggcaccgggaacatagttgcctcagtcaacatggtttcccgcttgcttctgaacagattcaccatgacgcaccgccggcccaccatcgagaaggacgtggacttaggcgcggggacacgccacgtcaacgccgaacccgagacgccgaacatggatgtcatcggtgagcggataaaacgcatcaaagaggagcacaacagcacgtggcactacgacgacgaaaacccgtataagacgtgggcgtaccacgggtcctacgaggtgaaggcgactgggagcgcctccagcatgatcaacggcgtcgtgaagctgctgacgaagccctgggacgtggtgcccatggtgacgcagatggcaatgaccgacaccaccccattcgggcagcagcgggtcttcaaggaaaaagtggacacgcggaccccgaggagcatgcccggaacccgccgggttatgggcatcaccgccgagtggctatggcgcacactggggcggaacaagaagccccgactatgcacccgcgaggagttcaccaagaaggtccggactaacgccgccatgggagcggtgtttacggaggagaaccagtgggactccgcgaaggccgcggtggaggacgaagacttttggaaactcgttgaccgcgagcgggagctacacaaactggggaagtgcggcagctgtgtgtacaatatgatggggaagcgcgagaagaagctcggcgagttcgggaaagcgaaggggagccgggcaatctggtacatgtggctgggcgcacgctatcttgagttcgaggccctagggttcctcaacgaggaccattggttcagccgggagaactcctactcaggcgtggagggggagggcctgcacaagctcggctacatcctgcgggacatatccaagatccccggtggcgccatgtacgcggacgataccgcggggtgggacacccggataaccgaggacgacctgcacaacgaggagaagatcacccagcaaatggacccggagcacaggcagctcgctaacgccatcttcaagctgacataccagaacaaggtcgtcaaggtgcagcgccccaccccgaccggcactgtcatggacatcatcagccgcaaggaccagcgaggctccggccaggtgggcacctacggcctgaacactttcaccaacatggaggcccagttgatccgccagatggagggcgagggggtgctgagcaaggccgacttggaaaatccccaccttccggaaaagaagatcacccagtggttagaaacgaagggcgtcgagcggctcaagagaatggcgatctccggcgacgactgcgtggtcaagcccatcgacgacaggttcgctaacgcactcctggcgctgaacgatatggggaaggtccgcaaggacattccccagtggcagcccagcaaggggtggcacgactggcagcaggtcccgttttgctcccaccacttccacgagttaatcatgaaagacggacggaagctggtggtgccgtgtcgaccccaagacgagctgattggacgggcacgcataagccagggggcgggctggtcccttcgcgagacggcttgcctgggcaaagcgtacgcccagatgtggagcctcatgtacttccaccggcgcgacctccggctggcgtcaaacgccatctgtagcgccgttccggtgcactgggtcccgacctccagaacgacgtggagcatacacgcccaccaccaatggatgactaccgaggacatgctgaccgtctggaaccgggtgtggatagaggacaatccctggatggaggacaagacgccggttaccacctgggaggacgttccgtacctcgggaagcgcgaggaccagtggtgcggctctctgatcggtctgacctcccgcgccacgtgggcccagaacattccgaccgccattcagcaagtccgaagcctcatcggcaacgaggagtttctggactacatgccctccatgaagcggttccgcaaggaggaggagagcgagggggccatatggtga

SEQ ID NO: 25891 - RNA, 9873 nt, synthetic construct
  misc_feature 1..9873: note = derived and/or modified CDS sequence (opt11) from DENV-3__KJ189274__SS-prME
  source 1..9873: mol_type = other RNA
accagtttgtgccttatgatgatcctccccgccgcccttgcgttccacctcaccagcagagatggggagccccggatgatcgtggggaaaaacgagcggggcaagagcttgctgttcaagaccgcctccgggatcaacatgtgcaccctgatagccatggacctgggggagatgtgcgatgacaccgtgacctacaagtgtccccacatcacggaggtggagcccgaggacatcgactgctggtgcaacctgaccagcacctgggtgacatacgggacgtgcaaccaggccggtgagcacagacgcgacaagcggtccgtggccctcgcgccccacgtgggcatggggctggataccaggacccagacctggatgagcgccgagggggcctggcgccaagtggagaaggttgagacgtgggccctgcgccaccccgggttcaccatcctcgcactcttcctggcccactacatcggcacctccctcacccagaaggtggtgatcttcattctcttaatgctcgtcacgccctcaatgaccatgcggtgtgtgggggtgggcaaccgtgatttcgtcgaagggctgtctggggccacctgggtagacgtggtcctggagcatggagggtgcgtcaccacgatggcgaagaacaagcccaccctcgacatcgagctgcagaagactgaggccacgcagttggcaacgttgcggaagctgtgcatagagggcaagatcacaaacatcaccaccgattcgcgctgccctacgcaaggagaggccgtgctgccggaggaacaggaccaaaactacgtctgcaagcacacttacgtggatcgggggtggggcaacgggtgcggtctcttcgggaagggctccctggtgacctgcgccaagttccagtgcctggagcccatcgagggcaaggtcgtgcagtacgagaacctcaagtacaccgtgatcatcacggtccataccggggaccagcatcaggtgggcaacgagacccagggcgttaccgccgagatcacgccacaagcctcgaccaccgaggcgacccttcccgagtatggaaccctgggtctcgagtgctccccacgcacaggcctggactttaacgagatgatcctgcttaccatgaagaacaaggcctggatggtgcaccggcagtggttctttgacctgccgctgccatggaccagcggcgcgaccacggaaacgcccacttggaaccgcaaggagctcctggtgacctttaaaaacgcccatgccaagaagcaggaggtcgtggtgctgggatcccaggagggagcgatgcacacggctctcaccggggccaccgagatccagaacagcggcgggaccagtatcttcgccgggcacctgaagtgccggttaaagatggacaagctcgagctgaaggggatgagctacgccatgtgcacgaataccttcgtcctgaagaaggaggtgtccgagacccagcacgggacgatactcatcaaggtggagtacaagggcgaggacgcgccgtgcaaaatccccttctcgacggaggacgggcacggcaaggcccacaacggccgcctgatcaccgccaaccccgtcgtgacaaagaaggaggagcccgtgaacatcgaggccgagccgcccttcggggagagcaacatcgtcatcggcatcggagacaacgcgctgaagatcaactggtacaaaaagggctccagcatcgggaaaatgttcgaagcaaccgcccggggcgcccgccgtatggcgatcctaggcgataccgcgtgggatttcgggtccgtaggcggggtgctcaacagcctgggcaagatggtccaccagatcttcgggtcggcctacacggctctgttcagcggcgtgtcctgggtgatgaagatcggcattggggtgctcttgacctggatcggcctgaacagcaagaacacgagcatgagcttctcctgcatcgccatcgggatcatcacgctctacctgggcgccgtggtgcaggcggatatggggtgcgtcatcaactggaagggcaaggaactaaagtgcggctctgggatattcgtcaccaacgaggtgcacacttggacagagcagtataagttccaggccgactcccccaagcgcctcgccacggccatcgccggggcgtgggagaacggggtctgcggcatccgcagcaccacccggatggagaacctgctgtggaagcagatagccaacgagctaaactacattctgtgggagaacaacataaagctgaccgtggtagtcggggacataatcggcgtgctcgagcagggccggcggacgcttacgccgcagccgatggagctgaagtactcctggaagacctgggggaaagccaagatcgtgacagccgagacgcaaaatagctccttcatcattgacggccccaacacccccgaatgccccagcgcgtcccgcgcctggaacgtctgggaggtggaggactacgggttcggcgtttttaccaccaacatctggctccggctcagggaggtctacacccagctgtgcgaccaccggctcatgtcagcagccgtgaaggatgagagggccgtacacgctgacatgggctactggatcgagagccagaagaacggctcctggaagctcgagaaggccagcctgatcgaggtcaagacttgcacctggccaaaatcccacaccctctggagcaacggcgtgctggagtccgatatgattatccccaagtcgctggccgggcccatctctcagcacaaccaccggccgggctaccacacccagacggccgggccctggcacctcggcaagctggagctggacttcaactactgcgagggcactaccgtcgtaatcaccgagaactgcgggacgcgtggccctagcctccggaccaccaccgtgtccgggaaacttatccacgagtggtgctgccgcagctgcacgctgcctccgctccggtatatgggcgaggatgggtgctggtacggcatggagatcagacccatctccgagaaggaggagaacatggtcaagagcttagtatccgccggcagcgggaaggtggacaactttaccatgggcgtgctgtgcctcgcgatcctgttcgaggaggtcatgcgggggaagttcggcaaaaagcacatgatcgccggggtgttcttcacctttgtgctgctcctgtcaggccaaattacctggcgcgacatggcacacacgctgatcatgataggcagcaacgcatccgatcggatggggatgggagtcacttatttggccctgattgcgacattcaagatccagccattcctggccctcgggttcttcctgcgcaagctgaccagcagggagaacctcctgctgggagtgggtctcgcaatggccacgactctgcagctgccagaggacatcgagcagatggcgaacgggatcgccctcggcctgatggccctcaagctcattacccagttcgagatctaccagctgtggaccgccctgatcagcctcacgtgcagtaataccatcttcaccctgacggtcgcctggcggacggcgaccctaatccttgctggggtgtccctgctgccggtatgccagtcaagttccatgcgcaagaccgactggctccccatggcagtcgccgccatgggcgtgccacccctcccgctgttcatcttcagcctcaaggacaccctgaagaggcgctcctggccactgaatgagggggttatggcggtcggcctcgtgagcatcctggcctccagcctgctccggaacgacgtgccgatggccggccccctggtggccgggggcctcctcatagcctgctacgtgatcacggggacctctgcggacctcactgtggagaaggccgccgacatcacttgggaggaggaagccgagcaaacgggcgtcagccacaatctgatgatcactgtggacgatgacgggaccatgcgcatcaaggacgacgagacagagaacatactcaccgtgcttctgaagacggccctcctgatagtctccggcatcttcccttacagcattccagcgaccctcctcgtgtggcacacctggcagaagcagacacagaggtccggcgtgctgtgggatgtcccgagcccgcccgagacgcagaaagccgagctggaggagggggtgtaccgcatcaaacagcagggcatcttcggaaaaacccaggtgggcgtcggggtgcagaaagagggcgtgttccataccatgtggcacgtcacccggggcgcagtgctcacttacaacggtaaacgcctggagccgaactgggcatccgtcaagaaagacctgatctcctacggcgggggctggcggctctccacccagtggcagaagggggaggaggtccaagtgatcgcggtggaacccggcaagaaccccaagaacttccagaccatgcctggcacctttcagacgacgaccggtgagatcggcgccatagccctggacttcaagcccgggaccagcggcagccccataatcaaccgcgagggcaaggtcgtggggctgtacgggaacggggtggtcacgaaaaacggcgggtacgtgtccggcatcgcccagaccaacgccgagccggacggccccacccccgagctggaggaggagatgttcaagaagcggaacctcaccataatggacctccaccccggcagcggcaagacgcgcaagtacctgccggccatcgtgcgggaggccatcaagcgccggctccgcaccttaatcctggcccctaccagggtcgtggccgccgagatggaggaggcgctcaaggggctgcccatccgctaccagaccacagccaccaagtccgagcacaccggccgggagatcgtggatttaatgtgtcacgccacctttacgatgcgcttgctgtcgcccgtccgggtgccgaactacaacttgatcatcatggacgaggcacactttaccgatcccgcctccatcgcggctagagggtacatcagcacccgagtgggcatgggcgaggccgccgcgatcttcatgaccgcaacgccgcccgggaccgccgacgcctttccgcagtccaacgcccccatccaggacgaggaacgggacataccggagcgcagctggaactccggcaacgagtggatcaccgacttcgccgggaagaccgtctggttcgtgcccagcatcaaggccggcaacgacatcgccaactgcctccggaagaacgggaagaaggtgattcagctgtcaagaaagacgttcgacaccgaataccagaagaccaagctaaacgactgggacttcgtcgtgaccacggacatcagtgagatgggcgccaacttcaaggccgaccgggttatcgatccgcgccggtgcctcaagcccgtgatcctgaccgacggccccgagcgcgtcatactggcggggcccatgcctgtgaccgccgccagcgcggcccagcgacgcggccgggtcgggcgcaatccccagaaggagaacgaccagtacatcttcaccggccaacccctaaacaacgacgaggatcacgcgcactggaccgaggccaagatgctgctggataacatcaacacgcccgaggggatcattccggccctcttcgagcccgagcgggagaagtccgccgcgatagacggcgagtaccgcctgaagggcgagtcccggaagacattcgtggagctcatgcgccgcggggacctccccgtgtggctggcccacaaggtcgccagcgagggcataaagtacaccgaccgcaagtggtgcttcgacgggcagcgaaacaaccagatcctggaggagaacatggacgtcgagatctggaccaaggagggcgagaagaagaaactccgcccccgatggctggacgctcggacgtactccgacccgctagccttaaaggagttcaaggacttcgcggcgggtcgcaagagcatcgccctggacctggtcaccgagatcgggcgggtgccctcccacctcgcccaccgcacccggaacgctctggacaacctggtgatgctccacaccagcgagcacggcgggcgagcgtatcggcacgccgtcgaggaactgcccgagacgatggagactctgctcctgcttggcctcatgatactgctgaccggtggcgcgatgctgttcctcatcagcggcaaggggatcggcaagacctccatcgggctgatctgcgtgatcgccagttccgggatgctctggatggccgagatcccgctgcagtggatcgctagcgccatcgtgctggagttcttcatgatggtcctcctgatcccggagcccgaaaagcagcgcacgccccaagacaaccagctggcctacgtggttatcgggatcctcactcttgccgcaatcatcgcggccaacgagatgggcctgctcgagaccaccaagcgggacctgggtatgtccaaggaaccgggggtcgtgagccccacgtcctacttagatgtggatctccacccggctagcgcctggaccctgtacgcggtcgccacgaccgtgataacgcccatgctgcgccacaccatcgaaaattcgaccgccaacgtaagcctcgccgccatcgcgaaccaggccgtcgttctgatgggcctggacaagggctggcccatctccaagatggacctcggcgtgcccctgctcgccctcgggtgctactctcaggtcaaccccctgaccctgacggccgcggtgctcctgcttatcacccactacgcgataatcggccctggattacaggccaaggccacccgggaggcccagaagcgcacagccgcgggcatcatgaagaaccccacggtggacggcatcatgaccatcgacctggatcccgtaatctacgattccaagttcgagaagcagctgggccaagtgatgctcctggtgctgtgcgcggtccagctcctgttgatgcggaccagctgggccctgtgcgaggccctgaccctggcgacgggacccatcaccacactctgggagggctcccccgggaagttctggaacacgacgatcgctgtgagcatggccaacatcttccgcggctcctacctggccggggccggcctggcgttcagcatcatgaagtcagtcgggaccggcaagcggggcaccgggtctcagggcgaaaccctcggggagaagtggaagaagaagctgaaccagctcagcaggaaggagttcgatctctacaagaaatccggcatcaccgaggtagaccggacggaggccaaggaggggctgaagcgcggcgagatcacccaccacgccgtgagccggggctccgccaaactgcaatggttcgtggagcgcaacatggtcatcccggagggacgggtgatcgacctcggttgcgggcgcggcggttggagctactactgcgcgggcctgaaaaaggtgaccgaagtccgcggctacactaagggcggacccggccacgaggaacccgtgcccatgtccacctacggctggaacatcgtgaagctcatgtctggaaaggacgtcttctacctcccgcccgagaagtgcgacaccctactgtgcgacatcggcgagtccagcccctcccccaccgtagaggagagccggaccatccgcgtgttgaagatggtcgagccgtggctcaaaaacaatcagttctgcataaaggtgctaaacccctacatgcccacggtgatcgaacatcttgagcggctccagcgcaagcacggcggtatgctggtacggaaccccctgtcccgcaacagcacccacgagatgtactggatctccaacggcacagggaacatcgtggcaagcgtaaatatggtctcccggcttttattaaacagatttaccatgacgcacaggcgcccgacaatcgaaaaggatgtggacctcggcgccgggacccgtcacgtgaacgccgagcctgagacccccaacatggacgtcatcggggagcgcataaagcggatccgcgaggagcacaactcaacgtggcactacgacgacgagaacccgtataagacatgggcctaccacggctcctacgaggtgaaggccacagggagcgcgtccagcatgatcaacggcgttgtcaagttgctgaccaagccctgggacgttgtcccgatggtgacgcagatggccatgaccgacaccacgccattcgggcagcaacgggtgtttaaggagaaagtcgacacgcgcaccccgcggagcatgcccggcacgcgccgggtaatgggcatcaccgccgagtggctctggcgcacgctgggtcgcaacaagaagccccggctgtgcacccgagaggagttcaccaagaaggtgaggaccaacgccgctatgggcgccgtcttcacggaggagaaccagtgggactccgccaaggccgccgtggaagacgaggatttttggaagctcgtggaccgcgagcgggagctgcacaagctcggaaagtgcggcagctgcgtctacaacatgatggggaagcgcgagaagaagttgggcgagttcggcaaggcgaaaggatcccgggccatctggtacatgtggctgggcgccagatacctggagttcgaggcccttggcttcctgaacgaggaccactggttcagccgggaaaactcctacagcggcgtggagggggagggcctgcacaagctcggctacatcctgagggacatcagtaagatacccggcggcgccatgtacgcggacgacaccgccgggtgggacaccagaatcaccgaggatgatctgcacaacgaggagaagatcacgcagcagatggacccggagcatcgccagctcgccaacgcaatcttcaagctgacctatcagaacaaggtagtcaaggtgcagcggcccacccctaccggcacagtgatggacatcatcagccgcaaggaccaaagaggctccggacaggtcggcacgtacgggctgaatacttttacaaacatggaagctcaactcatccgacagatggagggggagggggtcctgagcaaggcggacctggagaacccccatctccccgagaagaagatcacccagtggctggagacgaagggcgtggaacggctgaagcgcatggccattagtggagacgactgcgtcgtgaagcccatcgacgacagattcgccaacgcgctcctggccctgaatgacatgggaaaggtgcgtaaggacatcccccaatggcagccatcaaagggatggcacgactggcagcaggtaccgttctgctcccaccacttccatgagctcataatgaaggacgggcggaagctggttgtgccctgccggccccaggacgagctgatcggacgcgcgcggatcagccagggggccggttggtccctccgtgagaccgcttgcttgggcaaggcctacgcgcagatgtggagcctaatgtacttccacagacgcgaccttcggctggcctccaatgccatctgcagcgccgtccctgtgcactgggtgccgacctccaggaccacgtggagcattcacgcgcaccaccaatggatgaccaccgaggacatgctgaccgtctggaaccgggtttggatcgaggacaacccctggatggaggataaaacgcctgtgacaacctgggaggacgtgccctacctcggtaagcgggaggaccagtggtgtggcagcctgatcgggctgacgtcccgggcgacatgggcccagaacatcccgaccgccatccagcaggtcaggagcctcataggcaacgaggagttcctggactatatgccctccatgaagcgcttccgaaaggaggaggagagtgagggggccatctggtga

SEQ ID NO: 25892 - RNA, 9873 nt, synthetic construct
  misc_feature 1..9873: note = derived and/or modified CDS sequence (opt11) from DENV-3__KJ189275__SS-prME
  source 1..9873: mol_type = other RNA
accagcctctgcctcatgatgatcctgccggcagccctggccttccacctcaccagccgagacggagagccacggatgatagtggggaagaacgagcggggcaaaagcctgctgttcaagaccgcatccgggatcaacatgtgcacccttatcgccatggacctgggcgagatgtgcgacgacaccgtgacctacaagtgcccccacatcaccgaggtggagccggaagacatcgattgctggtgcaatctgaccagtacttgggtgacttacggaacctgcaatcaggccggcgagcaccggcgagacaagcggtccgtagccctggctccccacgtgggcatggggctggacaccaggacacagacctggatgagcgcggaaggagcctggcgccaggtggagaaggtcgagacgtgggccctgcgccacccggggttcactatcctcgcgttgttcctggcgcactacatcggcacttcactcacgcagaaggtggtgatcttcatactgctgatgctcgtcacgcccagcatgacaatgcggtgcgtgggggtgggcaatcgcgattttgtcgagggcctgtctggggccacctgggtggacgtggtcctggagcacggcggctgcgtaaccacgatggcgaagaacaagcccaccctcgacatcgagctgcaaaagaccgaggccacccagctggcgacactgcggaagctgtgcatcgaggggaagataaccaacatcaccacagacagccgctgtcccacgcagggcgaggctgtgttaccggaggagcaggaccagaactacgtctgcaagcacacgtacgtggaccgggggtggggcaacggttgcggcctcttcgggaaaggctccctcgtgacctgcgctaagtttcagtgcctggagccgatcgagggcaaagtcgtgcagtacgagaacctcaagtacaccgtgatcatcacggtccacacgggagatcagcatcaggtgggcaacgagacccagggggtcaccgcggagatcacccctcaggccagcaccaccgaggcgaccctgcccgagtacggcaccctgggcctcgagtgctctccgcgcacgggtctggacttcaacgaaatgatccttctcaccatgaagaacaaagcctggatggtgcatcggcagtggttcttcgacctaccccttccctggacttctggcgccaccacggaaacacccacctggaaccgcaaggaactgctggtgacctttaagaacgcacacgccaagaagcaggaggtcgtggtgctggggtcccaagagggcgcaatgcacacggccttgaccggggccactgagatccagaacagtggcgggacctccatattcgccggccacctgaagtgccggctgaagatggacaagctcgaacttaagggcatgagctacgccatgtgcacaaacacctttgtcctgaagaaggaggtgtccgagacccagcacggaacgatcctcatcaaagtggagtataagggcgaggacgcgccatgcaaaatcccctttagcacggaggatgggcacgggaaggctcataacggccgcctgatcaccgccaaccccgtcgtgaccaagaaggaggagccagtgaacatagaggccgagccgcccttcggggaatcgaacatcgtcatcggtatcggggacaacgcactgaagatcaactggtacaagaagggctccagcatcgggaagatgttcgaggccaccgcccggggcgcccgccggatggcgatcttaggcgacacggcttgggatttcgggtccgttggcggggtgctcaacagcctgggcaagatggtccatcagatcttcgggtcagcctacaccgccctgttcagtggcgtatcctgggttatgaagatcggcatcggggttctcctgacctggataggtctgaacagcaagaacacctccatgtcgttctcctgcatcgcaatcgggatcattacgttgtacctcggcgccgttgtgcaggcggacatgggatgtgtcatcaattggaaaggcaaagagctaaaatgcggcagcgggatcttcgttaccaacgaggtccatacctggaccgagcagtataagttccaggccgattcacccaagagattagccacggccatcgccggcgcgtgggagaacggggtctgtggcatccgcagcaccacgcggatggagaacctgctgtggaaacagatcgccaatgagctcaactacatcctgtgggagaacaacatcaagctgaccgtagtggtgggggatatcatcggtgtgttggagcaagggcgacggacactgacgccccagcctatggagctgaagtactcctggaagacctgggggaaggccaaaatcgtgaccgcggagacgcaaaacagctccttcatcattgatggcccaaacacgcccgagtgtcccagcgcgtcccgcgcctggaacgtctgggaggtcgaggactatgggttcggcgtgttcactaccaacatctggctcagactgcgcgaggtctacacacaactgtgcgaccaccggctcatgagcgccgccgtgaaggacgaacgcgccgtgcacgcggacatgggatattggatcgagagtcagaagaacgggtcctggaagctggagaaggcaagcctcatcgaggttaagacgtgcacgtggccgaagtcccacaccctctggtcaaatggtgtgctagagtccgacatgattatccccaagtcactggccgggccaatctcccagcacaaccaccggccgggctaccacacccagacggctgggccctggcacctcggcaagctggagctggacttcaattattgcgagggcacaaccgtagtcatcaccgagaattgcgggacgcgaggcccctcgttgcggaccaccaccgtgtccgggaagctgatacacgagtggtgttgtcgcagctgcacgctgcccccactccggtacatgggcgaggacgggtgctggtacggaatggagatccgaccgatctcagagaaggaggagaacatggttaagagcctggtctccgccggcagcgggaaggtggataacttcactatgggcgtgctgtgcctcgctatcctgttcgaggaggtcatgcgggggaaatttgggaagaaacacatgatcgcgggtgtgttcttcaccttcgtgctgctcctgtccggacagatcacatggcgcgacatggcccacacgctgatcatgattggcagcaacgcctccgaccggatggggatgggcgtcacctacctcgccctaatcgcgaccttcaagattcagcccttcctggccttaggtttctttctgcggaagctgaccagccgggagaatctcctgctgggcgtgggcctcgccatggccacgacactgcagctgcccgaggatatcgagcaaatggctaacgggatcgccctaggattaatggccctgaagctcatcacccagttcgagacttaccagctgtggacggccctgataagcctgacctgctcaaacaccatcttcactctgaccgtggcctggcggacagcgaccctgatactcgccggggtaagcctgctgccggtgtgccaatcgtcttccatgcgcaaaacagactggttacccatggctgtagccgccatgggcgtgccgcctctcccgctgttcattttcagcttgaaggatacgctgaagcggcgctcctggcccctgaacgagggggtgatggctgtcgggctagtgagcatcctggcctcctctctcctccggaacgacgtccctatggccggacccctggtcgccgggggccttctcatcgcctgctacgtgatcaccgggacctccgcggacctgaccgtggagaaggccgccgacataacgtgggaggaagaggccgagcagaccggagtcagccacaacctgatgatcaccgtggacgacgacgggaccatgcgcatcaaggacgacgagacagagaatatcctcactgtgctgctgaaaaccgccctcctgatcgtctccggtatcttcccgtatagcatccccgcgaccctgctcgtgtggcatacctggcagaagcagacgcagcggtccggcgtgctgtgggacgtccccagcccccccgagactcagaaggccgagctggaagagggggtttaccgcatcaagcagcagggcatcttcggtaagacccaggtgggtgtcggggtgcagaaggagggagtgtttcataccatgtggcacgtcacacggggtgccgtgctcacctacaatgggaagcgcttagagcccaattgggcctccgtaaagaaggacctgatctcgtacggcgggggctggcgtctctctacccaatggcagaagggggaggaggtccaggtgatcgcggtggagcccggcaagaaccccaaaaacttccagaccatgcccggcacattccagaccaccaccggggaaataggcgccatcgccctggacttcaagcccgggacgagcggcagccccatcatcaaccgcgaaggcaaggtggtcgggctgtacggcaacggggtggtcacaaagaacggcggttacgtctccggcatcgcccagacaaacgccgagccggacggacccacccccgagctggaggaggagatgttcaagaaacggaacctcacgatcatggacctgcaccccgggagtggcaagacccgcaagtacctgccggctattgtccgggaggcaatcaagagacggctccgcaccctgatcctggcccccacgcgggtcgtggccgccgagatggaagaggcgctcaaggggctgccgatccgctatcagacgacagccacgaagtcggagcacaccggccgggagattgtggacctgatgtgccacgccacgtttaccatgcgcctcctgagccccgtccgggttccgaactacaacctgatcatcatggacgaggcccacttcaccgaccccgcctccatcgcagcccgcgggtatatcagcacccgcgtgggcatgggcgaggccgccgcgatattcatgacggcgacgccgcccgggacagccgacgccttccctcagtccaacgcccccatccaagatgaggagcgggacatccccgagcgcagctggaactccggcaatgagtggattaccgacttcgcggggaaaacggtctggttcgtgcccagcatcaaggcaggcaacgacatcgccaattgcttacggaagaacgggaagaaagtgattcagctgtcccgcaagaccttcgacaccgagtaccagaagacaaagctgaacgactgggacttcgtcgtaacgaccgacatcagcgagatgggcgccaacttcaaagccgacagagtgatagatccgcgccggtgcctcaagcctgtcatactgaccgacggccccgaacgcgtgatcttagctggtcccatgccggtgaccgcagcatccgccgcgcagcggcgcggccgagtagggcgcaacccgcagaaggagaacgaccagtacatcttcaccggccagcccctcaacaacgacgaggaccacgcgcactggacggaggccaagatgctgctggataacattaacacccctgaagggatcattccagccctctttgagcccgagcgggagaagtctgccgcgatcgatggcgagtaccgcctgaagggagagagccggaagactttcgtggagctgatgcgccgcggggacctccccgtctggctggcccataaggtggctagcgagggcatcaagtacaccgaccgaaagtggtgttttgatggacagcggaacaatcagattctcgaggagaacatggacgtggagatctggacgaaggagggcgaaaagaagaagttacgaccccgctggctggacgcccggacctactccgacccgctggccctcaaggagttcaaggacttcgccgccggccgcaagagcatagcactggacctggttaccgagattggccgggtgcccagtcacctcgcacacaggacccggaatgctctagacaacctggtaatgctccatacgagcgagcacggaggccgcgcataccgccacgccgtcgaagagctgccggagaccatggaaaccctgctcctgctcggcctaatgatcttactgaccgggggcgcaatgctgttcctgatctcgggcaaggggatcgggaagacgtctatcggcctgatctgcgtgatcgccagctctggcatgctgtggatggcggaaatcccgctgcagtggattgcgagcgctatcgtgttggagttcttcatgatggtcctcctgatccccgagcccgagaagcaacgcacgccccaggataaccagctggcatacgtggtgatcgggatcctcaccctggccgccataatcgcggctaatgagatgggtctgctcgaaaccacgaagcgggacctgggaatgtccaaggaaccgggcgttgtgagccccacgtcctacctggacgtggacctccatcccgccagcgcatggaccctgtacgcggtcgccacgactgtgatcacccctatgctgcgccacacaattgagaactccaccgccaacgtatcactcgccgccatcgcaaaccaggccgtcgtgctaatgggcctggataaagggtggccgatctccaagatggacctcggcgtgccgctattagccctcgggtgttacagccaggtcaatcccctgacactgaccgccgccgtgctcctgctgatcacccactatgcgatcataggcccgggcctccaggcgaaagccaccagggaggcccagaagcgcacggcagctgggataatgaagaacccgactgtggatggaatcatgaccatcgacttggaccccgtcatctacgactccaaatttgagaagcaactgggccaggtcatgctcctggtgctgtgcgcggtccagctcctgctgatgcggacgtcatgggccctatgcgaagccctgacgctggcaaccggccccatcaccaccctctgggagggctcccccgggaagttctggaacacgaccatagccgtgagcatggcgaacatcttccgcgggtcctacctggccggggccgggctggcgttctctatcatgaagtccgtggggaccggcaagcgtggcacagggagccagggcgagacactcggggaaaagtggaagaaaaagctgaaccagctgagccgcaaggagtttgacctctacaagaagtccggcatcacggaggtagatcggacggaggcgaaggagggcctgaaacgaggcgagatcacccaccatgcggtgagccgtggctccgccaagctgcaatggtttgtggagcgaaacatggttatccctgaggggcgggtgatcgacctcggatgtggacgcggaggttggtcatactactgcgcaggcctgaagaaagtgaccgaggtcaggggctacacaaaaggcgggcctgggcacgaggaacccgtgcccatgtccacgtacggctggaacatcgtgaagttgatgtccgggaaagacgtcttctaccttccgccggagaagtgcgacaccctgctgtgcgacatcggcgagtccagcccctcccccaccgtggaggagagccggacgatccgcgtgctgaagatggtcgagccgtggctcaagaacaaccagttctgcatcaaggtactgaacccctacatgcccaccgtcatagagcacctggagcgtctccagcgcaagcacggcgggatgctggtaaggaaccccctgtcccggaatagcacccatgagatgtactggatttctaacggcaccggaaacatcgtggcgagcgtgaacatggtctcccggctcctgctgaatcgcttcacaatgacccaccggaggccgacgatcgagaaggacgtcgacctcggtgccgggacccgtcacgtgaacgccgagccggagactccgaacatggacgtcataggggagcgcattaagcggatccgcgaggagcataacagcacctggcactacgacgacgagaacccgtacaagacctgggcctaccacggctcctatgaggtgaaggccacagggagcgcgtccagtatgattaacggcgtggtcaaactcttaacgaaaccatgggacgtggtacccatggtgacacagatggccatgaccgacaccacgcccttcgggcagcaacgggtgttcaaagagaaggtcgacacccgcaccccgcggagcatgcccggcacccggcgggtcatgggcatcacggcggagtggctctggcgcaccctcgggcgcaacaagaagccccggctgtgcacccgcgaggagttcaccaagaaggtgcggaccaatgccgctatgggcgcagtcttcaccgaagaaaaccagtgggactcagccaaggccgccgtggaggacgaggacttctggaagttagtcgaccgcgaacgggagctgcataagctggggaagtgcggcagctgcgtatataacatgatggggaagcgcgagaagaagctcggcgagttcggcaaggcgaaggggtccagggccatatggtacatgtggctgggcgcacgatacctggagtttgaagccctcggcttcctcaacgaggaccactggttcagccgggaaaactcctacagcggcgtggagggagagggactgcataagctcggatacatcctgcgcgacatctctaagatcccaggcggcgccatgtacgcggacgacacggccgggtgggacaccaggatcacggaggacgacctgcacaacgaagagaagattacccagcagatggacccggagcatcgccagctcgcaaacgccatattcaagctgacctaccagaacaaagtggttaaggtgcagcgtcccacccccaccggcaccgtgatggacatcatcagccgcaaggaccaacggggatccgggcaggtggggacctacgggctgaacaccttcaccaacatggaggctcaactcatccgccagatggagggagagggggtactgagcaaggcggatctggagaacccacacctcccggagaaaaagattacgcagtggctggaaacaaagggagtggagcggctgaaacgcatggccatctccggcgacgactgtgtcgtgaagcccatcgatgaccggttcgccaatgccctcctggccctcaacgacatggggaaggtgcgcaaggatataccacagtggcagcctagcaaaggatggcacgactggcaacaggtcccgttttgctcccaccattttcatgagcttatcatgaaggacgggcgtaagctggtggtaccctgccgccctcaggacgagctgatcggccgcgcgcggatcagccagggggcaggctggagcctcagggagacggcctgcctgggcaaggcctatgcacagatgtggagcctgatgtacttccaccggcgcgacctccggctggcctccaacgccatttgcagcgccgtccctgtacactgggtgcccacctcccgcaccacctggagcatacacgcccaccaccaatggatgaccaccgaggatatgctcaccgtctggaaccgtgtgtggatcgaggataacccctggatggaagataaaacccccgtgaccacttgggaggatgtcccctacctcggcaagcgcgaggaccagtggtgcgggagcctaatcgggctgacatccagagcgacctgggcccagaacattccgacagccatccaacaggtccgcagcctgatcggcaacgaagaatttctggactatatgcccagtatgaagcggttcagaaaggaggaggagagcgagggggcgatctggtga

SEQ ID NO: 25893 - RNA, 9873 nt, synthetic construct
  misc_feature 1..9873: note = derived and/or modified CDS sequence (opt11) from DENV-3__KJ189276__SS-prME
  source 1..9873: mol_type = other RNA
accagcctctgcctaatgatgatcctacccgcggccttggcgttccatctgaccagccgggacggggagccccggatgatagtgggaaagaacgagcgcggcaagagcctgctattcaagacggctagcgggataaacatgtgcaccctcatcgcaatggacttgggagagatgtgtgacgacaccgtgacctacaagtgcccccacatcactgaggtggagcccgaggacatcgactgttggtgtaacctgaccagcacctgggtaacctacgggacgtgcaaccaggccggcgagcaccgtcgcgacaagcgttccgtcgcgttagcgcctcatgtgggaatggggctggacacccgcacccagacgtggatgagcgcagagggcgcatggcgacaagtagagaaggtcgagacgtgggcactgcgccaccccggtttcacgatcctcgcgctgttcctagcccactacatcggcacctccctcacccagaaggtcgtgatcttcatactgctgatgctggtgacgccatcaatgaccatgcgctgcgtgggcgtgggcaaccgcgacttcgtcgagggcctgtccggggccacatgggtggacgtggtcctggaacacggcgggtgcgtgaccacgatggctaagaacaagccgaccctagacatcgagctgcagaagaccgaggctacccaactggcgaccctccggaagctttgcatcgagggaaaaatcactaatatcaccacggacagccgctgccccactcaaggcgaggccgtgttaccggaggagcaagaccagaactatgtctgcaagcacacatacgtagaccgggggtggggcaacgggtgtggtctctttgggaagggctccctggtgacctgcgccaagttccagtgcctagagcccatcgaggggaaggtcgttcaatacgagaacctcaagtacaccgtcataatcacggtccacaccggggaccagcaccaggtcggaaacgagacgcagggggtcaccgccgagatcacgccgcaggcctcaaccaccgaggccaccctgcccgagtacggcaccctggggctccaatgctccccacgcacgggcctggacttcaacgagatgatcctgttgaccatgaagaacaaggcctggatggtgcaccggcaatggttcttcgacctgcccctcccatggacttcgggcgcgacgtccgagacgccaacgtggaatagaaaggagttactagtgactttcaagaacgcccacgccaagaagcaggaggtcgtggtgctggggtcacaggagggcgcgatgcacaccgccctcacgggggccaccgagatccagaactccggcggtacctcaatcttcgccggccacctgaaatgccggctgaaaatggacaagttagagttaaaaggcatgagttatgccatgtgcaccaacacattcgtcctgaagaaggaggttagcgaaacccagcacggcacgattctcattaaagtggagtataagggcgaggacgcgccgtgcaagataccctttagcaccgaggatggtcacggcaaagcgcacaatggccgactgatcacggcgaaccccgtcgtgaccaagaaggaggagcccgttaacatcgaggccgagccgcccttcggggagtccaacatcgtcattggcatcggcgacaacgcgctgaagatcaactggtataagaagggcagctccatcgggaaaatgttcgaggccactgcccgtggagctcgccggatggccatccttggtgataccgcctgggacttcgggagcgtgggcggggtgttgaactcactgggcaaaatggtccaccagattttcggtagtgcatatactgctcttttctccggcgtaagctgggtgatgaagatcggcattggagtactgctgacctggatcggccttaactccaaaaacaccagtatgtccttcagctgcatcgccatcggaatcatcaccctctacctaggggccgttgtccaagccgacatggggtgcgtcattaactggaaaggcaaggagttgaagtgcggatccgggatcttcgtaacgaacgaggtgcacacctggaccgagcagtacaagttccaggcggacagcccgaagcgcctcgccaccgctatcgctggggcgtgggaaaacggggtctgcgggatccgctccacgacccggatggagaatctactctggaaacaaatcgccaacgagctcaactacatcctctgggagaataatatcaaactgaccgtggtcgtcggggacatcataggcgtactcgaacagggcaagagaaccctcaccccccagccgatggagctgaagtacagctggaagacctgggggaaggcgaagatcgtcactgccgaaacgcaaaacagtagcttcataatcgacggccccaacacacccgagtgcccgtccgcgtcacgcgcatggaacgtctgggaggtggaagactacggatttggcgtttttacaacaaacatctggctccgcctacgggaagtctacacccagctttgcgaccaccgcttgatgagcgcagccgtgaaggacgagcgggccgtgcatgccgatatgggctattggatcgagagtcagaagaacgggagctggaagctggagaaggcctccctgatcgaagtcaagacctgcacctggcccaagtcccacaccttatggtccaacggcgtgctagagagcgatatgatcatcccgaagtccctggccggacccatcagccagcacaaccacaggccgggctatcacacccagacggcagggccctggcacctcgggaaactggagctggacttcaactactgcgagggcacgaccgtggttatcaccgagaactgcgggacccggggcccgtcgctccggacgacaaccgtaagcgggaagctaatccacgagtggtgttgccggtcctgcaccctgcccccgctcagatacatgggtgaggatggttgctggtacggaatggagatccgccctatcagcgaaaaggaggagaacatggtgaagtccctggtcagcgccggctctgggaaggtggacaatttcacgatgggcgtactgtgcctcgcgatcctgttcgaggaggtcatgcgcgggaaatttggcaagaaacatatgatcgccggtgtattcttcactttcgtgcttctcctcagcggtcaaataacctggagagacatggcgcacaccctgatcatgatcggctccaacgccagcgatcgcatggggatgggcgtaacgtacctcgcactcatcgcgaccttcaagattcagcccttcctagccctcggtttcttcctgcggaagctgacttcacgcgagaacctcctgctgggcgttgggctcgctatggccaccacgctgcagctacccgaggatatcgagcagatggccaacgggatcgccctcggcctcatggcgctgaagctcatcacccagttcgaaacatatcagctgtggaccgccctgatctccctcacgtgctctaataccatcttcaccctgaccgtggcctggcgaactgcgaccttaatcctcgccggggtctccctgctcccggtgtgccagagttccagtatgagaaagaccgactggctccccatggccgtcgccgctatgggtgtgccgcccctcccgctgttcatcttctctctcaaggacaccttgaagcgccggagctggcccctgaacgagggggttatggcggtcggcctcgtatccatcttagcgtcgtccctcttgcgcaatgacgtgcccatggccgggcccttggtcgccgggggcctgcttatcgcctgctatgttatcaccgggaccagtgcggatttaaccgtggagaaggccgccgacatcacctgggaggaggaagcggagcagaccggcgtctctcacaatctgatgatcaccgtggacgacgacggtacaatgcgaatcaaggacgacgagactgagaacattctcaccgtgttgctgaagactgccctcctgatcgtctccggaatcttcccgtactctatccccgcgaccctgttagtgtggcatacatggcagaaacaaacccaacgctctggcgtgctgtgggacgtccccagcccgccggagacgcagaaggccgagctggaggagggggtttatcgaatcaagcaacaaggcatctttggtaagacccaggtgggcgtcggggtgcaaaaggagggggtgttccacaccatgtggcatgttacccgcggtgccgtgctcacctacaacgggaagaggctagagcccaactgggcgagtgtaaagaaggatctgatctcctatggagggggctggcgcctcagcacccagtggcagaagggtgaggaagtccaggtaatcgcagtggagcccggcaaaaacccaaaaaattttcagacaatgcccggaactttccagacgaccaccggggagataggcgccatcgccctggacttcaagcccgggacgtccggctcccccataattaatcgggagggcaaggtcgtggggctgtacggcaacggagtggtaacgaagaacggggggtacgtgagcggcatcgcccagacaaatgccgagccggatggccccacccccgagctcgaggaagagatgttcaagaagcgtaacttgaccatcatggacctacaccccgggagcggtaagactcgaaagtacttgccggcaatagtgagggaggccatcaagaggcgcctccggaccctaatactggccccgacccgtgtcgtggccgctgagatggaagaggcgctcaaggggctgcccatccgctaccagaccacagcaactaagagcgagcatacaggccgcgagatcgtggatctgatgtgccacgccaccttcacgatgcggctgctatcccccgtccgcgtgccgaactacaacctgatcatcatggacgaagcccatttcaccgatcccgccagcatcgcggcccgggggtacatctcaacccgcgtggggatgggcgaggcagccgcgattttcatgaccgccacgcccccggggaccgcagacgccttcccccagagcaacgcccccatccaggacgaggagcgcgacatacccgagcggtcctggaacagcggcaacgagtggataacggacttcgcggggaagaccgtatggttcgtgccatctatcaaagctggcaatgacattgctaactgtctccgcaagaatggcaagaaggtcatccagctgagccggaagacgtttgacacggagtatcaaaagaccaagttaaacgattgggactttgtcgtgacgactgacatcagtgaaatgggcgccaacttcaaggccgatcgtgtgattgacccgcggcgttgcctcaagcctgtcatcctgaccgatggccccgagcgtgtgatcctggcggggcccatgccggtgaccgcagccagcgccgcccagcgccgaggtcgtgtcgggcggaacccgcagaaagagaacgaccagtatatcttcactggccaacccctcaacaatgacgaggaccatgcacactggaccgaggccaagatgctgctggacaacatcaacactcccgagggcatcatcccagccctcttcgagcccgagcgggagaagtctgctgcgatcgacggcgagtaccggctaaagggtgaaagccgcaaaacgttcgtcgagttaatgcgaagaggcgacctccccgtgtggctcgcccacaaagtcgcctccgagggcatcaagtacaccgatcggaagtggtgcttcgacgggcaacgcaataaccagatcctggaggagaacatggacgtggagatctggacgaaggaaggcgagaagaaaaagctccggccccgctggttggacgcccgcacgtacagcgacccgctggccctcaaagagttcaaggatttcgcggccggcagaaagtccatcgctctggacctagtcaccgagatagggcgcgtgcccagccacctcgcccaccggacccgcaacgccctggacaatctggtgatgctccatacaagcgagcacggcgggcgggcttaccgccacgcggtcgaagagctgcccgagacaatggagactctgctacttcttggcctaatgatccttctgactgggggcgcaatgctattcctaatctccggcaaggggatcggcaagacgagcatcgggctgatctgtgtgatcgcctccagcggcatgctctggatggccgagatcccgttacagtggatcgccagcgccatcgtgctggagttcttcatgatggtcctcttgatacccgagcctgagaaacagcggacgccacaggacaatcagctggcctacgtggtaatcgggatccttacattggcagcgatcattgcggccaacgagatgggcctgctggagacaaccaagcgcgacctggggatgagcaaagagccgggagtcgtttcccccacgagctacctggatgtggacttgcatccagcctccgcctggaccctgtacgcggtcgccacaaccgtgatcacccccatgctgcggcacaccatcgagaacagcaccgccaacgtgtccctcgctgcaatcgcgaaccaggccgtcgttttaatgggcctagacaaggggtggccgataagcaagatggacctcggcgtgcccctgctggccttggggtgctactctcaggtcaaccctctgactctgacggccgctgtcttactgttaatcacccactacgcgataatcggcccgggactccaggccaaggccacccgcgaggcacagaagcgtacagccgcggggatcatgaaaaacccgaccgtggacggaatcatgaccatagacctggaccccgtcatctatgacagcaagtttgagaagcagttaggtcaggtgatgctcctggtgctgtgtgccgtccagctccttctgatgcgcacaagttgggcattgtgcgaggcactgacgttagcgacgggaccaatcactaccctctgggagggtagccccgggaagttctggaacacaacgatcgccgtgagtatggccaacatcttccggggtagctaccttgccggggccggattggcgttctccatcatgaaaagtgtgggtaccggcaagcgcggcaccgggagtcagggtgagaccctcggggagaagtggaagaaaaagctgaaccagctgtccagaaaagagttcgacctctacaagaagtccggtatcactgaagtcgaccgcaccgaggcaaaagagggactgaaacggggcgagatcacccaccacgccgtgtccaggggtagcgccaagctacaatggttcgtggaacggaacatggtcattcccgaggggcgcgtgatcgatttaggctgcgggcggggagggtggagctactactgcgctggactgaagaaggttacagaggtccgcggctacaccaaaggtgggcccgggcacgaggagccagtgcctatgagcacgtacggctggaacatcgtgaagctgatgtccggcaaggacgtgttctacctcccgcccgagaaatgtgataccctgctgtgcgacatcggcgagtctagccccagccctaccgtggaggagtcccgcacgatccgcgttctgaaaatggtcgagccttggctcaagaacaaccagttctgcatcaaggtgctcaacccctatatgcccacagtcatcgagcacctggagcgcctccagcgaaagcatggcgggatgctggttaggaaccccctgtcacggaactccacccacgagatgtactggatctccaacggcaccgggaacatcgttgcgtccgttaatatggttagccgcctcctgctgaacaggttcaccatgacgcaccgcagaccgaccatcgagaaggacgtggacctcggcgccggcacccgccacgtgaatgccgagcccgagacccccaacatggacgtgattggggagcggatcaagcgcatcaaggaagagcacaattccacttggcactacgatgacgagaacccgtataagacctgggcctaccacggcagctatgaggtaaaagccaccgggtccgcgagctcgatgatcaatggggtggtcaaactactgaccaagccctgggacgtggtccctatggtgactcagatggccatgaccgatacaacgccctttggccagcagcgggtgttcaaggaaaaggtcgacacgcgcaccccgcggtccatgcctggcacacggcgggtgatgggcattaccgcagagtggctgtggagaacgctgggacggaacaagaagccccgcctgtgcacacgcgaggagttcaccaagaaggttcgaaccaacgccgcgatgggtgccgtcttcactgaggagaaccagtggaacagcgcaaaggccgcggtggaggacgaggacttttggaagttggttgaccgcgagcgggagctgcacaagctgggcaagtgcggctcctgcgtctataacatgatgggtaagcgcgagaagaagttgggagagttcggtaaagcgaaggggagcagggccatctggtacatgtggctcggcgcacgctatctggagttcgaggcccttggttttctgaatgaggaccactggttctcgcgggagaacagctactccggcgtggagggggagggcctgcacaagctcggttacattctgcgcgacatcagcaagatccccggaggcgccatgtacgcggacgacacggcagggtgggacactcgcatcactgaggacgacttacataacgaggagaagatcacgcagcagatggacccggagcaccgccggctggctaacgccatcttcaagcttacctaccagaacaaggtggtcaaggtgcagcgccccacaccaactggcaccgtgatggacatcatctcccggaaagaccagcgcggcagcgggcaggtgggcacttacggtttgaacaccttcaccaacatggaggcccagctaatccggcagatggaaggagagggggtgctgtccaaagcggacctggagaacccccacctcccagagaagaagataactcaatggctggagacgaagggcgtggagcgcctgaagcggatggccatcagcggggacgactgcgtcgtgaagcccatcgatgaccgcttcgcaaacgccttgctggccctgaacgacatgggtaaggtgcgtaaggacatcccccagtggcagccctccaagggctggcacgactggcaacaggttccgttctgcagtcaccacttccacgagctcatcatgaaggacggtcgcaagctagtggtgccctgccggccacaggacgagctgatcggcagggcgcgcatctcccagggagccggctggtctttgcgggagaccgcctgcctgggcaaggcctacgcgcagatgtggtccctgatgtatttccaccggcgagacctccgcctggcctcaaacgctatctgttccgccgtccccgtacactgggtgccgaccagtcggaccacgtggagcattcacgcccaccaccagtggatgaccaccgaggacatgctgacagtctggaaccgcgtgtggatcgaggataatccctggatggaggacaagacgcccgtgaccacctgggaggacgtaccatacctcgggaagcgggaggaccagtggtgtgggtccctgattgggctgaccagccgcgcgacgtgggcccagaacatcccgacggccatccagcaggtccggtctctaatcgggaacgaggagttcctggattacatgcccagcatgaagagatttcggaaggaggaagagtccgagggagccatctggtga

SEQ ID NO: 25894 - RNA, 9873 nt, synthetic construct
  misc_feature 1..9873: note = derived and/or modified CDS sequence (opt11) from DENV-3__KJ189277__SS-prME
  source 1..9873: mol_type = other RNA
accagcctttgtctcatgatgatcctccccgccgcccttgccttccacctcacgagccgagacggggagcctcggatgatagtgggcaagaacgaacgaggcaaaagtttactttttaaaacggccagcgggataaacatgtgcaccctaattgctatggacctgggggagatgtgcgacgatacggtaacctacaaatgcccacacatcacggaggtggagcccgaagacatcgactgctggtgcaacttgacctctacgtgggtcacgtatggtacatgtaaccaagccggtgaacaccgtcgcgacaagcgctccgtggcccttgcccctcatgtcggcatggggctggacacccgcacgcaaacctggatgagcgctgaaggggcgtggaggcaagttgaaaaagtcgaaacatgggccctacggcaccccgggttcaccattttggcactgttcctagcacactacataggaacatcccttacacaaaaggtggtcatctttatcctattaatgctggtaacgcccagcatgacaatgcggtgcgtgggggtgggtaaccgcgacttcgtcgagggtctgtccggggccacctgggttgacgtagtcctggagcacgggggttgtgttacgacgatggccaagaacaagcccacgctcgacatcgagttacaaaagacagaggccactcaactggcgacgctacgtaagctgtgcatagagggtaagattaccaacattacgacagattctaggtgtccgacccaaggagaggccgtcctgccagaggaacaagaccagaactacgtctgcaagcacacctatgtagatcgggggtggggcaacggttgcggccttttcggaaagggcagcctggtgacctgcgcaaaattccagtgcctggaacccatagagggcaaagtcgtgcagtacgagaacttgaagtacacagtcatcattactgttcacacgggtgaccagcatcaggtaggcaatgaaacccaaggggtcacagcagagatcacgccccaggcttcgaccaccgaagcaactctgcccgaatacggcaccctggggctacagtgctctccacgcacgggacttgactttaacgaaatgattcttctcactatgaagaacaaagcatggatggtacaccggcaatggtttttcgacctgcccctgccctggacttcgggcgccacctccgagacgccgacctggaaccgcaaagagctgttggtcacgtttaagaacgcccacgccaagaagcaggaggtcgtcgtactggggagccaagagggtgccatgcacacggcccttacgggcgccaccgagatccagaacagcggcgggaccagcatattcgcggggcacttgaaatgccgcctgaagatggacaagctggagctcaagggcatgtcctacgcgatgtgcaccaacactttcgtgctgaaaaaggaagtgagtgaaacccagcacgggaccattctgatcaaggtagagtacaagggcgaagacgctccctgcaagatccctttcagtacagaagacgggcacggtaaagcccacaacggaaggttaatcaccgccaaccctgtcgtaaccaagaaagaagaacccgtcaatatcgaggccgaaccgccatttggggagtccaatatcgttatagggataggcgataacgcattgaaaatcaattggtacaaaaagggctcctctataggcaagatgttcgaggccaccgcccgcggcgcgcgccgtatggccatcctcggcgacaccgcttgggactttgggtcggtgggcggtgtgttaaacagtctgggtaaaatggtgcaccagatattcggcagcgcgtacactgccctttttagcggcgtgtcctgggtgatgaaaataggcatcggtgtccttctaacttggattgggctgaactccaagaatacgtcaatgagtttctcctgtatcgcgataggcataattaccttatacctgggcgccgttgtgcaggcggatatggggtgcgtcatcaactggaaaggtaaagagctgaagtgtggcagtggaatctttgtgacaaatgaggtccacacctggaccgagcaatacaagttccaagcagacagccccaagcgcctcgcaaccgcaatagccggcgcgtgggagaatggcgtgtgcgggatacgctccacgaccaggatggagaacttactgtggaagcagatcgccaatgaactcaactatatactttgggaaaacaacatcaaactaacagtggtggtgggggacatcattggcgtgctcgagcagggcaagcgaactcttacgccgcagccaatggagctaaagtattcgtggaagacatggggcaaagcgaaaatcgtaactgcagagactcagaactccagcttcataattgatggcccaaatacgcccgagtgtccctcagcctcacgcgcctggaatgtttgggaggtagaagattatggtttcggggtatttaccaccaatatttggctccgcctccgcgaggcctacacacagctgtgcgatcaccgcctcatgtccgccgcagtcaaagatgagagggcggttcatgctgacatgggctactggatcgagagtcagaaaaacggaagttggaaacttgaaaaggcctccctcatagaggttaagacatgcacctggccaaagtcccacaccttgtggtccaacggcgtgctggaaagtgacatgattatcccgaagtccctcgccggccccatcagccagcacaatcatcgtccgggttaccacactcagaccgcgggcccatggcacctaggcaagctggagctggacttcaattactgtgagggcacaacagttgtcatcaccgaaaactgcgggacccggggtccatcccttcgcactaccaccgtaagcggcaagctcattcacgaatggtgctgtcggtcgtgcaccctacccccgttgaggtacatgggggaagatgggtgctggtatggcatggagattcgaccaattagtgagaaggaagagaacatggttaagagtctcgtctccgcgggctcagggaaggtggacaacttcacgatgggcgtgttgtgcctcgccatcctgttcgaggaggtgatgcgcggtaaatttggaaagaagcacatgatcgccggtgtattctttacattcgtacttctcttaagcggccagatcacctggagagatatggcccacacactgatcatgattggatccaatgcgagcgatcgcatgggcatgggcgtaacttaccttgcacttatcgcgaccttcaagatacaaccctttctagcattagggttctttctgaggaagttgacctcaagagagaacctcttgctgggagttggcctggccatggctaccaccctccagttaccggaggacatcgagcaaatggccaacgggatagccctcgggctaatggccctcaaacttataacgcagttcgagacctatcagctatggaccgcgcttatttcactcacgtgcagtaataccatcttcacactgactgtggcgtggagaacagccaccctcatacttgccggggtttccctcctgcctgtctgtcagagctcctccatgaggaaaactgattggctgcccatggccgtggcggcgatgggagtgccacccctcccgctctttatcttctccttaaaggataccctgaagcgacggagctggcccctgaacgagggggtaatggctgtgggcctggtgtccattttagctagctccctgctgcgcaacgacgtgcccatggctggccctttggtggccggtggcctgctcatcgcttgttacgtgataacggggaccagcgctgacctaacggtcgagaaagcagccgacataacctgggaggaggaggccgaacagaccggcgtctcccacaacttgatgatcacagtcgacgatgacggcactatgcgtataaaagacgacgagaccgaaaatatactgaccgtgctcctgaagacggccctcctgattgtatcaggcatatttccatactccatccctgcaacgctgctcgtctggcacacatggcagaaacagacgcagcgtagtggcgttctctgggacgtcccaagcccgcccgagactcagaaggctgagcttgaggaaggagtctaccggattaaacagcaagggatatttggaaagacccaggtaggcgtgggggtccaaaaggagggcgtgttccataccatgtggcacgtgacacgcggcgccgtcctcacgtataacggcaaacggcttgagcccaactgggcgagcgtgaagaaggacctgatctcgtacggcggtggctggcgtcttagcacccaatggcagaagggggaagaggtccaggtcatagcggtggagcctggcaaaaaccccaagaatttccagacaatgccgggcaccttccaaacaacaacaggtgagattggagccattgcgttggatttcaagcccggtacgagcggctctcccatcatcaaccgcgaaggcaaggtggtcgggttgtatggcaacggtgtagtgacgaagaacggcgggtatgtcagcgggatcgcccaaacaaacgcggagccagacggtcctacgcccgaactggaggaagagatgttcaagaaacggaaccttactatcatggacttacaccctgggagcggcaagacacgtaagtacttacctgccatcgttagagaggcgataaagcgcagactccggaccctgattctagcgcccaccagagtcgtagccgcagagatggaagaggcgctcaaggggttaccgatccgataccagaccaccgcgaccaaaagcgagcacaccggccgcgagattgttgacctcatgtgccacgcaacattcacgatgcggctcctgtcccccgtgcgcgtcccgaactacaatcttataataatggacgaggcccattttactgaccccgcttctattgccgcccgggggtacatatccacccgcgtaggaatgggcgaggcggcggcgatttttatgaccgcgactcccccgggcacagcggacgcctttccgcaatcaaatgcgccaatccaggacgaggagcgagacatacccgagagatcctggaacagcggtaatgagtggataaccgatttcgcaggcaaaacagtatggttcgtcccctccatcaaggcgggaaacgatatcgccaactgcctacgcaagaacgggaagaaggtgattcaactttcacggaaaacgtttgacacagagtatcagaaaaccaaactaaacgactgggacttcgttgtgacgacggacatctccgaaatgggcgcgaacttcaaagcggacagggttatcgacccgcggcggtgcctcaagcctgtgattcttacggatggcccggagcgggtaattctggctgggcctatgcctgttaccgcagcctcagctgcccagcgcagggggcgcgtcggccgaaacccgcaaaaggagaacgatcagtatatctttacagggcagcccctcaacaacgacgaagaccacgcccactggaccgaggccaagatgctgctggataacatcaacactccagaaggcattatcccagctctgtttgaacctgagagggagaagtctgctgcaatagatggcgaataccggctgaaaggagagagcagaaagacgttcgtcgagcttatgcggcgtggagatttgcccgtatggttggcgcacaaagtggcatccgaggggattaagtacaccgaccgtaagtggtgcttcgatgggcagcgcaataatcagatcttagaggaaaatatggacgtcgagatatggactaaggagggagaaaagaagaagttgaggcctcggtggctggatgcgcgaacgtattcggaccccctggccctcaaagagttcaaagactttgcggccggcaggaagtcgatcgctctggacctggtgaccgaaattgggcgcgtcccaagccacctcgcccacaggaccagaaacgcgctggataacttagtgatgttgcacacctcggagcacggcggtagagcgtaccgtcacgccgtggaggagttgcccgagacgatggagaccctgcttcttctgggcttgatgattctcctgaccggcggcgccatgctgttcctgatatcggggaagggaatcggaaagacctcgatagggttaatatgcgtaattgcctccagcggcatgttatggatggcggagattccgctgcaatggatcgcctctgcgattgtcctggaatttttcatgatggtgctgctgattccggagcctgaaaaacaacgtacgccccaggacaaccagctggcctatgtggttatcggtatcctcacgctggcggcgataattgcagccaatgaaatgggcttacttgagactaccaagcgagaccttggcatgagcaaggaaccaggagtggtgtcccccacgtcatacctggacgtggacctccacccagcctccgcgtggaccctgtacgccgtggccaccaccgtcatcacgcccatgctaaggcacactatcgaaaacagcaccgccaacgtatccttggcggcgatcgcgaaccaggccgtcgtcctgatgggtctagacaaggggtggccgatcagcaaaatggatttgggcgtgcccttactggccctaggttgctattcacaggtgaaccccctgacactcacagccgccgtactcctactcattactcattacgccatcattggcccaggactacaggctaaggctaccagggaagcccagaagcggaccgccgcaggcattatgaaaaatcccacggtggacggtatcatgaccatcgatttagaccccgtgatttacgacagcaagtttgaaaagcaattagggcaggtcatgctcctggtgctgtgcgcagtccaactactgctgatgcgcacatcatgggccctctgtgaggctctgactctggctacgggcccgatcacgaccctgtgggagggcagccccgggaaattttggaataccacgatcgccgtctccatggccaacatctttcgtggcagctacctggccggcgcagggctggccttctccattatgaaatccgtgggcaccggcaagcgaggcaccggctcccagggagagaccctgggcgagaagtggaagaagaaactgaaccagctgtcacggaaggaatttgatctatataagaagtcagggataacggaagtggaccgaacggaagccaaggaagggttaaaacggggtgaaattactcaccacgctgtcagtcgcggaagcgccaagctgcagtggttcgtagagcggaatatggtgataccggaagggagagtcatcgacctcggatgcggaagagggggttggtcctactactgtgccgggcttaagaaagtgacagaggtacggggttataccaaaggagggcccggacacgaggaacccgtccccatgagcacctacggttggaacatcgtcaagctgatgtccggcaaggatgtgttttacctcccacccgagaagtgcgacacattattgtgcgatattggcgaaagttcgccgagccccaccgtcgaagaatcgaggaccatccgggtactgaagatggtggaaccctggctcaagaacaaccagttttgtataaaagtactcaacccctacatgcccacggtaatcgaacatctggagcggctgcagcggaagcacggaggtatgctagtccgcaaccctctatccagaaattctactcacgagatgtactggatttccaacggcaccgggaacatcgttgccagtgtgaacatggtgtcccgcctccttttaaatcgattcacgatgacgcaccgccgtcctaccattgaaaaggatgtggacctcggcgctggcacacgacatgtgaacgccgaacccgagacccctaacatggatgtaatcggggagagaataaagcgcattaaggaggaacacaactcgacatggcattacgatgacgagaacccatacaagacctgggcttatcacggcagctatgaggtcaaggcaaccggatctgcaagctctatgatcaatggagttgtcaagttgctgaccaagccctgggacgtcgtccccatggttacgcagatggcgatgaccgacaccaccccattcgggcagcaacgggtgttcaaagagaaggtagacacgcgcactccgcgctccatgcccggcacccgccgggtcatgggcatcaccgccgagtggttgtggcgcacgctgggcagaaataagaaaccccgcctgtgtacccgcgaggagttcactaaaaaggtacggacgaacgcggccatgggagccgtgtttacggaggagaaccagtggaacagcgccaaggcggccgtcgaggatgaagacttctggaaattggtggatcgggagcgagagctacataagctgggcaagtgcggctcctgcgtatataacatgatgggaaagcgtgagaagaagctcggcgagtttggcaaagcgaaaggctcacgggccatctggtatatgtggttgggcgctcggtacttagagttcgaggcgctgggctttttgaatgaggatcattggttctccagggaaaactcatactccggcgtagaaggtgaaggcctgcacaaactaggctacatactgcgcgacatctcgaagatacccggaggcgcaatgtatgccgacgacaccgccggctgggacacacggataaccgaggacgacctacataacgaggaaaagataacgcagcagatggacccggaacaccgtcgcctagctaacgcaatattcaagttgacctatcagaataaggttgtgaaagtccagcgccctacccccactggcacagttatggacatcatatcgaggaaggaccagcgcggctctggccaagtaggaacatatggattgaacacattcacgaacatggaggcccagcttatccgccagatggagggcgagggggtactgtctaaggctgatctggagaatccgcacctacccgagaagaaaatcacccaatggctagaaactaagggcgtggagcgtctgaaaagaatggcaataagcggcgacgactgcgttgtcaagccgatcgacgaccggttcgccaacgctctcctagcactaaacgatatggggaaagtgcgcaaggacataccccaatggcaaccatctaaaggctggcacgactggcagcaagtcccgttctgcagccaccacttccacgaactcattatgaaggacgggcggaagctggtcgtgccctgtcgaccgcaagacgaactgatcggtcgcgcgagaatctcacagggcgccggctggagcttgcgggagaccgcctgcttggggaaggcttatgcccagatgtggagtctgatgtacttccatcgccgggatctgcgcctagccagcaacgccatatgtagcgcggtgcccgtccattgggtgcctacttcccggaccacctggtctatccacgcgcatcaccagtggatgacgaccgaagatatgcttacggtttggaaccgagtctggatcgaggacaatccctggatggaagacaaaacgcccgtcacgacttgggaagatgtcccatacctcggaaagcgcgaggatcaatggtgcggatccctgatcggcctgacctcacgagcgacatgggcgcagaacattcctaccgccatccaacaggtccggagtttgatcgggaacgaagagttcctggattacatgccgtcaatgaagaggttccggaaggaggaggagtctgagggagcgatttggtga

SEQ ID NO: 25895 - RNA, 9873 nt, synthetic construct
  misc_feature 1..9873: note = derived and/or modified CDS sequence (opt11) from DENV-3__KJ189278__SS-prME
  source 1..9873: mol_type = other RNA
accagcctctgtcttatgatgatcctccccgccgcccttgcgttccacctcaccagccgggatggggagccccggatgatcgtggggaagaacgagcgaggcaagagcctactattcaagaccgcctccggtaccaacatgtgcaccctcattgccatggacctgggcgagatgtgcgacgacaccgtgacctacaagtgcccccacattaccgaggtggaacctgaggacatcgactgctggtgcaacctgaccagcacttgggtcacatatgggacctgcaatcaagccggcgagcaccggcgcgacaagcggtccgtggccctcgcgccccacgtgggcatggggctggacacccgcacccaaacatggatgagcgcagagggcgcctggcgccaggtagaaaaggtagaaacctgggccctgcgtcacccggggtttaccatcctcgcgctgtttctggcccactatataggaacgagcctcacgcagaaggtggtgatcttcatcctgctgatgttggtaacccccagcatgaccatgcggtgcgtaggggtcggaaaccgcgacttcgtagaaggtctgtccggggccacctgggtggacgtagtcctggagcacggcggatgcgtcacgaccatggcaaagaacaagcctacgctcgacattgaattgcagaagaccgaggccacgcagcttgcgacgttgaggaagctgtgtatcgaggggaagatcaccaacatcaccacggacagccgctgccccactcaaggcgaagccgtccttccggaggagcaggaccagaactacgtttgcaaacatacctacgtggaccgtgggtggggcaacgggtgcggcctcttcggtaagggctctttagttacctgcgcgaagtttcagtgcctggagcccatcgagggcaaagtcgtgcaatacgaaaacctcaagtacacggtgatcatcaccgtccacaccggagatcaacaccaggtgggcaatgagacccagggggtcacggccgagatcacgccccaggcctctaccaccgaagcgaccctgccggaatatgggacgctgggactcgagtgctccccgagaaccggcctagacttcaacgagatgatcctgctcaccatgaagaacaaggcctggatggtgcaccgccagtggttctttgacctgcccctgccttggacttcgggcgctacgacagagaccccaacctggaaccgcaaagagctcctggtcactttcaaaaacgcccacgccaaaaagcaggaggtcgtggtcctgggatcccaggagggggcgatgcacaccgctctaactggggccaccgagatccagaacagtggcgggacgagtatctttgccggccacctgaaatgccgtctgaagatggacaagctcgagctgaaggggatgagctacgcgatgtgcaccaacactttcgtcctgaagaaggaggtatccgagacccaacacgggacgatactcatcaaagtggaatacaaaggagaagacgcgccatgtaagatccccttctccaccgaggacgggcacggcaaggcccataacggtagactgatcacagccaaccccgtcgtgaccaaaaaggaggagcccgttaacatagaggccgagccgcccttcggcgaaagcaatatcgtcatcgggatcggggacaacgccctgaagataaactggtacaagaaaggctccagtatcgggaagatgttcgaagcgaccgcccggggagcccggcggatggccatcctgggcgacaccgcgtgggacttcggttccgtgggcggggttctcaactccctgggcaagatggtccaccagatcttcgggtccgcctacaccgcgctgttctctggcgtgtcctgggtgatgaagattggcattggggtcctcttgacctggatcggccttaactccaagaacacgtccatgagcttttcctgtatcgccatcgggatcatcaccctatacctgggcgccgtggtacaagcggacatggggtgcgtgatcaactggaagggcaaggagctaaagtgtggcagtggcatcttcgtcaccaacgaggtgcatacctggacggagcaatataaattccaagccgactcgcctaagcggctcgccaccgccatcgccggcgcgtgggagaacggggtctgtggcatccgcagtaccacgagaatggagaatctgttatggaagcagatcgctaacgagctcaattacatcctgtgggagaacaacgtgaaactgacggtggtcgtgggggacattatcggcgtgctcgagcagggcaagcgcaccctaacgccgcagccgatggagctgaagtactcctggaagacctgggggaaagccaagatagtcacagccgagacccagaattcgtccttcatcatcgacggccccaataccccagagtgccccagcgcgtcccgggcctggaatgtatgggaggttgaggactacgggttcggtgtcttcacaaccaacatatggcttcgcctgcgggaagtgtacacgcagctctgcgaccaccgcctaatgagcgcggccgtgaaagatgagcgggccgtacacgcggatatgggctactggatcgagagccagaaaaacgggtcctggaagctggagaaggcgagcctgatcgaggtgaagacatgcacctggcccaagtcccacaccctctggagcaacggcgtgctggagtccgacatgatcatccccaagtcgttagctgggcccatttcgcaacacaaccaccgcccgggctaccatacgcagaccgccgggccctggcatctcggtaagctggagcttgactttaattactgcgagggaaccaccgttgtgatcacggagaactgcgggaccaggggtcccagcctccgcaccaccacggtttcggggaagttaatccacgagtggtgctgccggagctgcaccctgcccccgctccgctacatgggcgaggatggctgctggtacggcatggagatccgccccatctccgagaaggaagagaatatggtaaagagcctggtgtctgccggatccgggaaggtggacaacttcacgatgggcgtcctgtgcctcgcgatcctgttcgaggaagtgatgcgtgggaagttcggcaagaagcacatgatcgcgggggtgtttttcaccttcgtgctgctcttgtccggccagataacgtggcgtgacatggcccacaccctgatcatgatcggttcgaacgcctctgaccgtatgggtatgggtgtgacctacctcgctctgatcgccaccttcaaaatccagccgttcctggccctcgggtttttcctgagaaagctgaccagccgcgagaacctcctgctgggcgtgggcctcgcgatggccaccaccctgcagctgcccgaggacatagaacagatggcgaacggcatcgccctcggactgatggccctgaagctcatcacccagtttgagacgtaccagctgtggaccgcactgataagcctgacctgttccaacaccatcttcacgctgaccgtcgcttggcggacggcgactctaatcttggccggcgtaagcctgctgccggtctgtcagtcctcttcaatgcgcaaaacggattggttgcccatggccgtggcagccatgggcgtgccgcccctcccgctgttcatctttagcctcaaggacactttaaagcgcagatcctggccgctgaacgagggggtgatggcggtgggcctggtgtccatcctcgcctcctctctgcttcggaacgacgtcccgatggccggccccctggtggcgggtggcttactaattgcatgctacgtaatcactgggacctcagctgacctaacggttgagaaagcagccgatatcacctgggaagaggaggctgagcagaccggtgtgagccacaacctgatgataaccgtagacgatgacgggaccatgcggatcaaggacgacgagactgaaaacatcctcacagtcctgctgaagaccgccctgcttatagtttccggtatattcccgtactctattcctgcgacgctgctagtatggcacacgtggcagaagcagacgcagcgctcgggcgtcttatgggacgtgccctcaccgcccgagacacagaaggccgagctggaggagggggtgtatcggatcaagcagcagggcatcttcggcaagacccaggtcggggtgggggtgcagaaggagggcgtgttccacacgatgtggcacgtcacccgcggcgccgtgctcacatacaacgggaagcggctagagcccaactgggcatctgtcaagaaggacctcatctcctacggcgggggctggcgcctctctacccagtggcagaagggggaagaggtccaggtgattgcggtcgaacccggtaagaacccgaagaatttccagacaatgcccggcaccttccagacaaccacgggggagatcggcgccatcgccttggacttcaagccagggacctccgggagcccaattatcaaccgggagggcaaggtggtcggcctctacggcaacggggtagtgaccaagaacggcgggtacgtgtccggcatcgctcagaccaatgcagagccggacggaccgacgcccgagctggaagaggaaatgttcaagaaacgcaacctcaccatcatggacttgcaccccgggtccggcaagacccggaagtacctcccagcgatcgttcgcgaggcaatcaaaaggcgcctccgaacccttatcctggcccccacgagagttgtggccgccgagatggaagaggccttgaaggggctgcccatccggtatcagaccacagcaaccaagtccgagcacaccggccgcgagatcgtcgatctgatgtgccatgcgacctttaccatgagactcctgagccctgtgagggtgccgaattacaacttaataatcatggatgaggcgcacttcacggaccccgcctcaatcgctgcccgaggatacatctctacgagagtcggaatgggcgaggccgcagcgatcttcatgaccgccacgccgcccgggacggccgacgcctttccgcaatccaacgcccccatccaggatgaggagcgcgacatccccgagcgtagctggaactccggcaacgagtggataacagacttcgcggggaagaccgtgtggttcgtgcccagcatcaaggccggcaacgacatcgccaactgcctccgcaagaacggtaagaaggtcatccagctgtcccggaagaccttcgacaccgagtaccagaagacaaagctgaatgactgggacttcgtggtcacaacagacatctcagagatgggtgctaacttcaaagcagaccgtgtcatcgatccgcggcggtgcctcaagcccgtgatcctgaccgacggcccggagcgggtgatactcgctgggcctatgccggtcaccgccgcttccgccgcccagcgccggggacgcgtggggcggaacccccaaaaggaaaacgaccaatacatcttcacgggccagccattgaacaacgacgaggaccacgcgcactggaccgaggccaaaatgctgctggacaacatcaacacacctgaagggataatacctgccctcttcgagccagagcgcgagaagtccgcagctatcgacggcgagtaccgacttaagggcgagtcccgcaagaccttcgtggagctgatgcggcgcggggacctccccgtctggctggcccacaaagtggcgagcgaaggcatcaagtacacggaccggaagtggtgcttcgacgggcaacggaacaaccagatcctcgaagagaacatggacgtcgaaatttggaccaaggagggcgagaagaagaagctccggccccgttggcttgatgccagaacctacagcgacccgctggccttgaaagagttcaaggatttcgcggccggccgcaagtcgatagccctggacttggtgacggagatcggacgcgtgccctcccacctagcccaccggacgcgcaacgcactggacaacctggttatgctacacaccagtgaacacgggggtcgggcgtaccgccatgccgtggaagagctgcctgaaaccatggagaccctgttgctgttgggcctcatgatcctgcttacgggcggagccatgctgttcctgattagcgggaaggggatcggtaaaacctcgatcgggctcatttgcgtcatcgccagctccggcatgctctggatggccgagattccgctgcagtggatcgcgagcgcgatagtcctggagttcttcatgatggtgctcctgattcccgagccggagaagcagcgcacgcctcaggacaaccaactggcctacgtggtcatcgggattctcaccctggcagccatcatcgcggcgaacgagatgggcctgctcgagacgacgaagcgcgacctgggcatgagcaaggagccaggggtggtcagccccacatcgtatcttgacgtcgacctacacccggctagcgcctggacactgtatgcggtggctactaccgtcataaccccgatgctgcgtcacaccattgagaactccactgctaacgtcagcctcgccgccatagctaatcaggctgtggtgctgatgggcctggacaaggggtggcccatctccaaaatggatctcggtgttcccctgctggccctcgggtgctacagccaggtgaaccccctgaccttaaccgccgccgtgctcctgttaataacccactacgcgatcatcggccccggcctccaggcgaaggccacgagagaagcccagaagcgtaccgccgcggggataatgaagaaccctaccgtcgacggcatcatgactatcgacctggaccccgtgatctacgacagcaagttcgagaagcagctgggccaggttatgctattggtactgtgcgccgtgcagctgctgttgatgcgcacctcatgggccctctgcgaggcgctgacccttgcgaccggcccgatcaccacgctatgggaaggctcccccgggaagttttggaacaccaccatagccgtaagcatggccaacatcttcaggggctcctacctggccggggccggcctggcgtttagcatcatgaagtccgttggcaccggcaagcgcggcacggggagccagggcgagacgcttggggagaagtggaagaagaagctgaaccagctgtctaggaaggagtttgacttgtacaagaagtcaggcatcaccgaggttgatcgcaccgaagctaaggaaggtctgaaacggggcgagatcacccaccacgccgtgagccgcggctccgccaaactgcagtggttcgtcgagcgaaacatggtgatcccggagggtcgcgtgatcgacctcggctgcggaaggggcgggtggagctattactgcgccggcctgaagaaggtaacggaagtccgggggtacaccaagggcgggcccgggcacgaggaaccggtgcccatgtccacctacggttggaatatagtcaaactgatgagcgggaaggacgtgttctacctgccgcccgagaagtgcgatacccttctgtgcgatatcggagagtccagccccagtcccacggtggaggagagccgcaccatccgggtcctgaagatggtggagccgtggctaaaaaacaaccagttctgcattaaagtcctgaacccctacatgcccaccgtcatcgagcacctggagcgcctccagaggaagcatggcggaatgctggtgcgcaaccccctgtctcggaatagcacgcacgagatgtattggatctccaacggcaccgggaacatagtggcaagcgtcaatatggtgtcccgcttactccttaaccggttcaccatgacacaccgccggccgaccatcgagaaggacgtggacctcggcgccggcacgcgacacgtcaacgccgaacccgaaacccccaatatggacgtgatcggtgagcgaatcaagcgtatcaaggaggagcacaacagcacctggcactacgacgatgagaatccgtacaaaacctgggcctaccacggctcctacgaggtgaaggccacgggaagcgcgtctagtatgatcaacggggtagtgaagctgctgaccaagccctgggacgtcgtgcccatggtgacacagatggcaatgactgacacgaccccgtttggtcagcagcgtgtcttcaaggagaaggtggacacgcgaacgccgcgaagcatgcccggtacgcgccgggtgatgggaatcaccgcagaatggttgtggcgcacactggggcgtaataaaaagccgcggctgtgcacccgcgaggagtttacgaagaaggtccggaccaacgccgcgatgggcgccgtgttcaccgaggaaaaccagtgggacagtgccaaagctgccgtcgaggacgaggacttttggaagctagtcgaccgcgagcgggagctgcacaagttaggaaaatgcggtagctgcgtctacaacatgatggggaagcgggaaaagaagctcggcgaatttggtaaggcgaaggggtcgcgagccatctggtacatgtggctgggcgctcgctaccttgagtttgaggcactgggattcctcaacgaggatcattggtttagccgggaaaactcctattctggcgtggagggggagggtctgcacaagctgggctacatcctgagggacatctctaaaatacccggcggcgccatgtacgcggacgacaccgcggggtgggacacgcggatcaccgaagatgatctgcacaacgaggagaagatcacccagcagatggacccggagcaccggcagttggccaacgcgatctttaagctgacataccaaaacaaagtcgtcaaggtgcaacggcctacccccacgggcaccgtcatggatattatcagccgcaaagaccaacgtggatccgggcaggtgggcacgtacgggctgaacactttcacgaacatggaggcccaactcatccgccaaatggaaggggagggggtgctgagcaaggccgacttagaaaacccccatctcccagagaagaagatcacccagtggctcgagactaagggcgtcgaacggctgaagcgcatggcgatctccggcgacgactgcgttgtgaaacccatcgacgaccgtttcgccaatgccctcttagccctgaacgacatggggaaggtccgcaaggatatcccccagtggcagccaagcaagggctggcacgactggcagcaggtcccgttctgttcccatcacttccacgaactcatcatgaaggacgggaggaagctcgtggtcccgtgtcgcccgcaagacgagttaatcggacgggcgcgcatctcccagggggccggttggtcgctccgcgagaccgcctgcctgggcaaagcatacgcgcagatgtggagcctgatgtacttccatcggcgcgacctccggctggcctccaacgcaatctgcagcgccgtgcccgttcactgggtgcctacgtcccgcaccacctggagcatccacgcccaccaccaatggatgaccacggaggacatgcttacagtgtggaaccgggtgtggatcgaggataacccctggatggaggataaaacccctgtcaccacatgggaggacgtaccctacctcggcaagcgcgaggaccaatggtgcggctctctgatcggactgacgtccagagccacctgggcccagaacatcccgactgccatacagcaggtccgcagtctcatcgggaatgaggagttcctcgactacatgccctctatgaagcgcttccgcaaggaggaggagagcgagggggctatctggtga

SEQ ID NO: 25896 - RNA, 9873 nt, synthetic construct
  misc_feature 1..9873: note = derived and/or modified CDS sequence (opt11) from DENV-3__KJ189279__SS-prME
  source 1..9873: mol_type = other RNA
acatcactctgtttaatgatgatcctacccgccgcgctagcattccatctcacctcccgcgatggcgaaccacgaatgatcgtcggtaaaaatgaaagaggaaaaagtctgctgttcaaaacagcttccggaataaacatgtgcacattgatagcaatggatctgggagaaatgtgtgacgacacagttacctataaatgtccgcacataaccgaagtggaacccgaggacattgattgctggtgcaatttaacgtccacatgggtgacatacggcacctgtaaccaagcaggagagcacaggcgggataaacgcagcgtggctctagcaccccatgttggaatgggcctggatacaagaacacaaacatggatgagcgccgagggggcctggaggcaagtggaaaaagtagagacctgggcactccggcaccccggctttaccatcctcgccctattcctcgcgcactacatcgggacgagtctaacccaaaaggtcgtcatcttcatcctacttatgctcgtcacgccatccatgactatgaggtgcgtaggtgtgggtaacagggacttcgtcgaaggcctatcaggcgcaacctgggtagatgtcgtcctcgaacacgggggatgcgtcacaacaatggcgaaaaataaaccgactctggatatcgaactgcaaaagacagaagcaacacaattggcaaccctacgaaagctatgtatcgaggggaaaataacgaacataacgacagactcaaggtgccccacacagggcgaagcagtgctccccgaagaacaagaccagaactacgtctgtaaacacacgtacgtcgaccgaggatggggcaacggatgtgggctattcgggaaggggtccctagttacatgcgccaaattccaatgcttggaaccaatcgaaggcaaagtcgttcaatacgaaaacctcaaatacacagtgataataaccgtacatacgggagatcagcaccaagtaggaaatgaaacccaaggcgtgacagcagagataacaccacaagcctccactaccgaagtgaccctcccagagtacgggaccttagggctggaatgctcaccccgcactggcctggacttcaacgaaatgatcctactcacaatgaaaaacaaagcgtggatggtgcaccgacaatggttcttcgatcttccactaccgtggacctctggcgcgaccactgagacaccaacatggaaccgcaaagaattacttgtgacgttcaagaacgcacacgccaagaaacaagaagtagtagtccttggttctcaggaaggggcaatgcataccgctctaacgggcgcaaccgagatacaaaatagcggcggcacatcgatattcgcagggcacctaaaatgtcgcttgaaaatggacaaactcgagttaaagggcatgtcttacgcgatgtgcacgaacacgttcgtgcttaagaaagaagtaagtgaaacacaacacggtaccatattaattaaagtggagtataaaggtgaagatgcgccgtgcaagataccattttcaacagaggacggccacggaaaggctcataacgggagactaatcacggcaaacccagtggtaactaaaaaggaagaacccgtgaacatagaagcggaaccgcccttcggagaaagcaacattgtaataggcatcggcgacaacgcactgaaaataaactggtacaagaagggctccagcatagggaaaatgttcgaagccaccgcgcgaggcgcgcgtcggatggccatcctaggcgacacagcctgggactttggaagcgtaggtggagtactaaacagtctggggaaaatggtccaccaaatcttcggaagcgcatacacggccctattctcaggagtgagctgggtgatgaaaatcggcataggagtcctgctcacatggatcggactaaactccaaaaacacaagcatgtctttttcatgcatagctataggcatcatcaccttgtatctgggagccgtcgtgcaagcagacatggggtgcgtcattaactggaaagggaaagagctaaaatgcggcagtggcatctttgttacgaatgaggtccacacctggacggagcaatacaaattccaggcggacagcccaaaaagactagcaacggcaatcgccggcgcatgggagaacggggtttgcggaatcagatcaaccacaagaatggaaaacctactctggaagcagatagcgaacgagttaaactacatactctgggaaaacaatataaaactaacagtggtcgttggagacataataggtgtgctagagcaaggcaaaaggacactaacgccacagccgatggagcttaaatatagctggaagacctggggaaaggccaagatagtcaccgccgagacccaaaacagcagcttcatcatcgacggaccgaacacgcctgagtgccccagcgcaagcagagcttggaacgtgtgggaagtagaggactatgggttcggcgtgttcacaacgaacatctggttacgactacgagaagtctacacccagctctgcgatcacagactaatgtcagccgcgataaaagacgaacgggcagtccatgctgatatgggctactggatagaatcgcagaaaaacggcagctggaaacttgaaaaggcctcgttaatcgaagtcaaaacgtgcacatggccaaagtcacacaccctctggtctaacggggtgttagaatcagacatgattatacccaagagcctagcaggacccatatcacagcataaccacagacccggttaccatactcagaccgcaggaccctggcacctcggcaaactcgagctagacttcaactattgcgaagggactacagttgtaataaccgaaaactgcgggacccgagggccgagcctacgaacgacaacggtcagtggcaaactcatccacgaatggtgctgccgcagctgtactctaccgcccttgcgctatatgggagaagacggttgctggtacgggatggagatccgcccgattagcgaaaaagaagagaacatggtaaaatcgctcgtaagtgctggcagcggaaaagtcgataatttcacaatgggagtcctatgcctagcaatcctattcgaagaggtaatgcgcggaaagttcggcaagaaacatatgatagcaggcgtcttcttcacatttgtcttactcctcagcgggcaaataacatggcgcgacatggcgcatacgctgatcatgatcggatctaacgccagcgaccggatgggtatgggcgtcacttacctagcacttatcgcgaccttcaagatacagccctttcttgcgcttggatttttcctacggaaacttacgtcacgcgaaaacctactgctgggagttggtctggctatggccacgaccctccagctgccagaagatattgaacagatggccaacggcatagcgctggggttaatggccctgaaattgatcacccaattcgagacgtatcagctatggacagccttgatatcgctcacctgtagtaacacgattttcaccctcacagtagcatggcggaccgccacgctaatcctagccggcgtcagccttctgcccgtgtgccaaagcagttcaatgcggaagaccgactggcttccaatggccgtcgccgctatgggtgtacctccattgcctctcttcatcttttcactaaaagataccctaaaacgccggagctggcccctcaacgaaggggttatggccgtagggctagtctctatattggcatcctcactactccgaaacgacgtaccgatggcaggtcccctagttgctggcggactcctcattgcgtgctatgtcataaccggcaccagtgctgacctcaccgtggaaaaagctgcggatatcacctgggaagaagaggccgaacaaaccggcgtttcgcacaacttgatgatcactgtcgacgatgacggaaccatgcggataaaggacgacgagacggagaacatcctgacggtactactaaagacagcactactgattgtctctgggatctttccctacagcattcccgccactctacttgtctggcatacatggcagaagcagacacaacgcagcggggtcctatgggacgtaccaagtccaccggaaacacaaaaggccgaactcgaagaaggagtctaccgaataaaacagcagggcatcttcggaaaaacgcaggtaggtgtcggggtgcagaaagagggtgtctttcacacaatgtggcacgtcacgcgcggggctgtcctgacatataacggaaaacgactagaacccaattgggcgagtgtaaagaaggatttgatttcctacggaggtgggtggaggctttcgacacaatggcaaaagggagaggaggtccaagtaatcgcagttgagcctggcaagaatccgaaaaatttccaaaccatgcccggaacgtttcaaaccacaacgggcgagatcggggccatagcgctcgactttaaaccaggaacctcaggatcaccaatcatcaacagggaaggaaaagtagtaggattatatggcaacggagtcgtgaccaagaacgggggatacgtcagcggaatagcacagaccaacgcggaaccggatggacccacccccgaactggaagaggaaatgtttaagaaaaggaacctcaccatcatggaccttcaccctggcagtggaaagacccgtaagtacttgcccgcaatcgtacgtgaagcgataaaacgccgcctgagaaccttgatcctagcgccgacccgcgtcgttgcagccgagatggaagaagctctgaaggggcttccgatccggtaccaaacgactgcaacgaaatcggaacacacaggcagagagatcgtagacttaatgtgtcacgcaacattcaccatgagactactatcccccgttcgcgttcccaactacaacctaattattatggatgaagcccacttcacagaccccgcgtctatagcagcgagaggctacatcagtaccagagtgggtatgggagaggccgcagctatattcatgaccgcgacaccacccggcacagcagatgcattcccacagtcaaacgcaccgattcaggatgaggaacgagacatccccgagcgaagctggaatagcggcaatgaatggatcaccgatttcgcaggtaaaaccgtgtggtttgtaccatcgataaaagcgggaaatgacatcgcaaactgtctcaggaaaaacggaaagaaagtgatacaactttcgcgcaagaccttcgacacggaataccagaaaacgaaactaaacgactgggatttcgttgtcaccaccgacatctcggaaatgggcgccaacttcaaagcagatcgagttatcgacccacgccgctgcctcaaacccgtcatcctcacggacggaccggagagagtgatactagcaggacccatgcctgtaaccgcagccagcgccgcccaacgaagaggtcgtgtaggacggaatccacaaaaagaaaacgaccaatacatattcaccggccagccgctcaataacgacgaggaccacgcccactggactgaagcaaagatgttacttgataacataaacacgccagaaggcattattccggcattatttgaaccggagcgagagaaaagcgcagccattgacggagaatacaggttaaaaggagaaagtagaaaaaccttcgttgaactcatgaggcgtggggacctgccagtatggctcgcacataaggtagcgtccgaaggcattaagtacacggatcgcaagtggtgtttcgatggccagcgcaacaatcaaatactcgaggagaacatggacgtcgaaatatggaccaaagaaggcgagaagaagaaactacgcccccgctggctagacgcacgcacatactccgacccgctagccctaaaggagttcaaagacttcgccgcaggcagaaaatcaatagccctagacctagtaaccgaaataggcagagtacctagccatctggcacaccgcacaagaaacgcactcgacaatctagtcatgctacacacgtccgaacacggtggacgagcatacagacacgccgtggaagaactccccgagactatggagaccctgttattgcttgggctgatgatactcctaacaggcggagctatgctctttctaatctccggaaaaggcatcggtaagaccagcattgggttgatatgcgtcatcgccagcagcggcatgctttggatggcagaaattccactccaatggattgcatccgcgatagtgctagagttcttcatgatggtactactaatcccagaaccagaaaagcagcgtacgccccaagacaaccaactcgcatatgtagtcatagggatattgaccctagccgccataatcgccgcgaatgaaatgggtctcctagaaaccaccaagcgcgacctcgggatgagcaaggaaccgggagtagtaagtcccacaagctatctggacgtcgatctgcatcctgccagcgcctggacgctctacgctgtcgcaaccaccgtaatcactccaatgctgcggcacacgatcgaaaactcaacggcaaacgtatcgttagcggctatagctaatcaagcagtcgtactcatgggcctggataaaggctggccgatctcaaagatggacctcggcgtgcctctactggcactgggttgttactcacaagtgaaccctctgaccctgacagccgctgtgctcttactcataacgcattacgcgataattgggccaggccttcaagcgaaggctaccagggaagcacagaaaagaacagcagccggtattatgaaaaatccgaccgtcgacggcataatgactatagatttggaccctgtcatttatgactcaaaatttgaaaaacagctcggccaagttatgctattggtactctgcgcggtgcaactcttgctgatgagaacaagctgggcgctgtgcgaagccctgacactagcgacgggccccatcactacattatgggaaggcagtccagggaaattctggaacactacgatcgcggtttcaatggctaacattttccgcggttcctatttggcgggcgctggtttggcatttagcattatgaagtcggtaggaactggaaagcgtggcaccggaagccagggggagaccctgggcgaaaaatggaagaagaaactcaaccaactctcgaggaaagagttcgacttatataagaagtccgggataaccgaggtggaccggacggaggccaaggaaggcctgaagcgaggagaaatcacacaccacgcagtctcccgcgggtcggcgaagctacaatggtttgtagaacggaacatggtaatacctgagggtagagtcatcgacctaggatgcgggagagggggttggtcgtactattgtgccggattgaagaaggtaacagaggtccgtggctacaccaaagggggcccaggtcacgaggaaccagtccccatgagcacctacggctggaacatagtcaagctaatgtctggtaaggatgttttctacctcccaccagaaaagtgtgacaccctcctctgcgacatcggcgagagcagcccatcaccaaccgtagaggaatcacggaccattcgcgtcctcaagatggtggaaccgtggctgaaaaacaatcaattctgcatcaaggtcttaaacccctatatgcccacagtaatcgaacacctagaaaggctgcaacgaaaacatggaggaatgctggtgcgcaaccctctatcgaggaacagcacgcatgagatgtattggataagcaacggaaccggaaacatcgttgcgtcagtaaacatggtatcccggctccttctcaacagattcaccatgacacacaggaggccaaccatcgaaaaagacgtagacctcggggcgggcacacgacacgtcaatgcagaaccagaaactcctaacatggatgtaatcggagaacgaattaagcgaataaaagaggaacacaacagtacgtggcactacgacgacgaaaatccgtataaaacctgggcatatcacggatcatacgaggtgaaagccaccggaagcgcaagttctatgataaacggagtggtgaagctcttgaccaaaccatgggacgtagtcccaatggttacacagatggcaatgacagacacaacgccattcgggcagcaacgagttttcaaagagaaagttgacacccgcacaccccggagcatgccaggcactcgtcgtgttatgggaataaccgcagaatggctatggcgaacacttggacggaacaagaaaccccgtctttgtacacgcgaagagttcacgaagaaagtgcgaaccaacgccgctatgggggctgtattcacagaagaaaatcagtgggacagcgcaaaagcggccgttgaagacgaagacttctggaagctagtcgatcgagaacgcgaactgcataaactcggcaaatgcggctcatgcgtgtataatatgatgggcaaacgtgagaaaaagttaggagaatttggtaaggcaaaaggatcaagagcgatatggtatatgtggcttggcgctagatacctggaatttgaagcgcttgggtttttgaacgaagaccactggttctcgagagaaaacagctacagcggcgttgaaggcgaagggcttcacaagctcggatatatcttgcgagacataagtaaaatcccgggcggcgcgatgtacgccgacgatactgcaggttgggacactcgcattactgaggacgacctccacaacgaggaaaagataactcaacaaatggacccagagcaccgccagctagccaacgcaatcttcaagctaacctaccagaacaaggtcgtgaaagtgcaacgccccacgcccacaggtactgtcatggacataatatcccgaaaagatcaacggggctcggggcaagtaggcacctacggactcaacacttttaccaacatggaagcacaactcataagacagatggaaggagaaggagtgctgtccaaggccgacctcgaaaatccccatctaccggagaagaaaataacccaatggctcgaaacgaagggagtcgaaagactgaaacgcatggcaatttccggagacgactgcgtagttaaacccatcgatgaccggttcgcgaacgccctgctagcgctaaacgacatgggtaaagtccggaaggacattcctcagtggcaaccgagcaaaggatggcatgactggcaacaagttcccttttgcagccatcattttcacgaactcataatgaaggacggcagaaaacttgtggtaccgtgcagaccacaagacgaactgatcggccgagcgaggatcagccaaggggccggatggagcctcagggaaacagcctgcctcggaaaagcatacgcccaaatgtggagcttgatgtacttccaccggagggatttaagactcgcaagcaacgccatatgtagtgcagtgcccgttcactgggtacccacaagccgcaccacctggtcaatacacgcgcaccaccaatggatgaccacagaagacatgctgacagtctggaatcgagtctggatagaagacaacccctggatggaagacaaaacgccggtgacaacctgggaagacgtaccatatctaggcaaaagagaggatcagtggtgcggctccttaatcggcctcacatcccgagcaacctgggcgcagaacataccaacggcgatccagcaagttaggtccttaatagggaacgaggagttcctcgactacatgccaagcatgaaaagatttagaaaagaagaggaaagtgaaggggccatctggtga

SEQ ID NO: 25897 - RNA, 9873 nt, synthetic construct
  misc_feature 1..9873: note = derived and/or modified CDS sequence (opt11) from DENV-3__KJ189280__SS-prME
  source 1..9873: mol_type = other RNA
accagcctctgcctaatgatgattctgcccgcggccctggcattccacctcacatcaagggatggggagccccggatgatcgtggggaagaacgagcgcggcaagagcctgctgttcaagacggcctccgggattaacatgtgcactttgatcgcgatggatttaggcgagatgtgcgacgacaccgtaacgtataaatgcccacacatcacggaggtggagcccgaggacatcgactgctggtgcaacctgaccagcacctgggtgacttacgggacctgtaaccaggccggcgagcaccggcgagacaagcggtcagtagctttagcgccccacgtgggtatgggactggacaccaggacccagacgtggatgagcgccgagggcgcttggcgccaagtggagaaggtcgagacgtgggctctgcgccacccggggttcaccatcttggcgctgttcctcgcccactacatcggcacctcgctcacccagaaggtggtcatcttcatattgctaatgctcgtcacgcccagcatgaccatgcggtgcgtgggtgtggggaatcgcgacttcgtcgaaggcctgtctggggccacttgggtggatgtggtcttggagcacggcggatgcgttaccacgatggcgaagaacaagcctaccctcgacatagagctgcagaaaaccgaggccacccagttagccaccctccggaagctgtgcatagagggcaagatcaccaacataaccaccgacagtcgttgccccacgcagggcgaggccgtgctgccggaggaacaggaccagaactacgtctgcaagcatacctacgtggaccgtgggtggggcaatgggtgtggcctctttgggaagggcagtctggtgacgtgcgccaaattccagtgcttggaacccatcgaggggaaggtagtacagtacgagaacctcaagtacaccgtgatcatcacggtccacaccggcgaccagcaccaggttggcaacgagacccagggggtgaccgccgagattaccccccaagccagcaccaccgaggcgaccctcccggagtatggcaccctgggtctcgagtgctccccgcgcacggggctggacttcaacgaaatgatcctgctcacaatgaagaacaaggcctggatggtgcatcggcagtggttcttcgatctccccctgccctggaccagcggcgccaccacggagacccccacctggaaccgcaaagagctcttagtgacgttcaaaaacgcccacgcgaagaagcaggaagtcgtggtgctagggtcccaggagggcgcgatgcacactgctctcacgggggccaccgagatccagaacagcggcggcacatccatcttcgccgggcacctgaagtgcagactgaagatggataagctcgagctgaagggcatgagctacgccatgtgcactaacactttcgtcttgaagaaggaggtatccgagacccagcacggcacgatcctcatcaaggtggagtacaagggcgaagatgcgccgtgcaagatccccttcagcacagaggatggccacggcaaggcccacaacggccgccttataaccgccaatccggtagtgaccaagaaggaggagcccgtcaatatagaggccgagccgccgttcggagagagcaacatcgtcatcggcataggcgacaacgcgctgaagatcaattggtataagaagggctcctccatcgggaagatgttcgaggccaccgcacggggtgcccgtcgtatggccatcctgggcgacacggcatgggacttcggaagtgtggggggggtgctcaatagcctgggcaagatggtccaccagatcttcgggtccgcgtacaccgccctgttctcgggggtatcctgggtgatgaaaatcggcattggggtactcctgacctggatcggcctgaatagcaagaacacctccatgagcttctcctgcatcgccatcgggatcatcacgctctacctgggcgccgtggtgcaggcggacatggggtgcgtcataaactggaagggcaaggaactgaagtgcggctcggggatcttcgtgaccaacgaggtgcacacctggaccgagcagtacaagttccaggccgactcccccaagcgtctggccacggccatcgcgggcgcatgggagaacggggtctgcggcatccgatctaccactcgtatggagaacctgctgtggaaacaaatagccaacgagctcaactacatcctgtgggagaataacatcaagctgaccgtcgtggtcggggacataatcggtgtgctcgagcagggcaagcgcacgctgacgccccagccgatggagctgaaatactcttggaaaacctgggggaaagccaagatcgtgaccgcagagacgcagaacagcagcttcatcatcgacggccccaacacacccgagtgtccaagcgcgtcccgagcctggaacgtatgggaggtggaggactacggtttcggcgtgttcacaaccaacatctggctccgcctgcgggaggtctacactcaactctgcgaccaccgactcatgagcgccgcagtgaaggacgagcgggccgtccacgcggatatgggttactggatcgagagccagaagaatgggtcctggaaactggagaaggcctcactgatcgaagtcaagacgtgcacctggccgaagtcacataccctctggtcgaacggcgtgctggagtccgacatgatcatccccaaaagcttggccgggcctatctcccagcacaaccaccgcccgggctaccacacacagactgcggggccctggcacctcggcaaactggaactggacttcaattattgcgagggaaccacggtcgtcatcaccgagaactgcgggacgcggggaccctcgctccgaaccaccaccgtgtccgggaaactgatccacgagtggtgttgccggagctgcacgttaccgccgcttcgctacatgggcgaagacggatgctggtatggcatggagattcgccccatctctgagaaggaggagaacatggtcaagtctttagtctccgccggctccgggaaggtggacaacttcaccatgggcgtgctttgcttggcgatcctgttcgaggaggtcatgcgcgggaaattcggcaaaaagcacatgatcgccggggtttttttcactttcgtgctgttactgagcggacagataacctggagagacatggcccacacgctgatcatgattggcagcaatgccagtgatcgcatgggcatgggcgtcacctacttggcactgatcgcgaccttcaagatccagccctttctggccctcggattcttcctccggaagctgacaagccgcgaaaacctcttattgggcgtaggcctagccatggcaaccaccctgcagttgccagaagacattgagcagatggcaaatggcatcgccctcggcctgatggctctgaagctcatcacccagttcgaaacctaccagctgtggactgccctgatctcgctgacctgctccaataccatatttactctgacggtggcctggcgtactgcgaccctgatacttgccggggtctcactgctgccggtttgccagtcttcgtcgatgcgcaaaaccgattggctacccatggccgtagcagccatgggcgtgcccccactcccccttttcatcttcagcctcaaagatacgctgaagcgcagatcctggcccctgaacgagggcgttatggcggtcggcctcgtgagcatcctggcctcaagtctcctccggaacgatgtgcccatggccggacccctggtcgccgggggcctgctcatcgcctgctacgtgatcaccggtacctccgctgacctgacggtggagaaagccgcagacatcacatgggaggaggaggccgagcagaccggcgtcagccacaacttgatgatcactgtggacgacgacggtactatgcggatcaaggacgacgagaccgagaatatcctcacggtcctgctgaaaaccgcactcctgatcgtctcgggcatcttcccctacagcatcccagcaacgctgcttgtgtggcacacctggcagaagcagactcagcggtccggcgtgctgtgggacgtcccgtctccgccggagacacaaaaggccgaactggaggagggggtgtatagaatcaagcagcaaggcatcttcgggaagacccaggtgggcgtaggggtgcagaaggagggcgtgttccatacgatgtggcacgtcacgcggggagccgtgctcacctataatgggaagagactggagcccaattgggcgtccgtgaagaaagacttgatcagctacggcgggggctggcgcctctccacacagtggcagaagggggaggaggtccaggtgatcgccgtggagccaggcaagaatcccaagaactttcagaccatgcccggcacgttccagaccacaacaggcgagatcggcgccatagccctggactttaaacccggcacgagcggtagcccaatcatcaaccgggagggtaaagttgtggggctgtacggcaacggggtagtcaccaagaacggcggttacgtatcgggtatcgcccagacgaacgccgaaccggacggccccaccccagagctggaggaagagatgttcaagaagaggaacctcacgatcatggacctgcacccaggctcgggcaagacccgtaagtacctgccggcgatagtgcgcgaggccatcaagcggcgcctccggacgttgatcctggccccgacccgcgtcgtggccgccgaaatggaggaggcgttgaaggggctgccgatccggtaccagacgactgcaaccaagtccgagcacaccggtagggaaatcgtggacttaatgtgccatgccacgttcaccatgcgactcttatcccccgtccgcgtgccgaactacaacttaatcatcatggacgaggcccacttcaccgaccctgcatctatcgcagcccgggggtatataagcacacgcgtggggatgggcgaggccgccgcgattttcatgacagccacgccgccagggacggccgacgcattcccgcaatccaatgcccccatccaggatgaagagcgcgacatccccgaacggagctggaactcaggcaatgaatggataaccgacttcgcggggaagacggtctggttcgtgccttcaatcaaggccggcaacgacattgccaattgcctccgcaaaaacgggaagaaggtgattcagctgtcccggaagactttcgacactgagtaccagaaaaccaagttaaatgactgggacttcgtcgtgacgactgatatcagcgagatgggcgcaaacttcaaggccgatcgcgtcatcgacccgcggcgttgcctcaagcccgtcatcctgaccgacggaccagaaagagtgatcctcgcaggtcccatgccggtcactgccgcctccgccgcccagcgccgggggcgagtcgggcggaacccccagaaggagaacgaccagtacatcttcaccggccagccccttaataatgacgaggaccacgcccactggacggaggccaagatgctgctggataacatcaacacccccgaggggataatcccagccctcttcgagccggagagggagaagtccgccgccatcgatggcgaatacagactgaagggtgaaagtcgcaagacctttgtggagctgatgcgaagaggggacctcccagtctggttagcccataaggtcagctccgagggcatcaagtacactgaccggaagtggtgctttgacggtcagcggaacaatcagatcctggaggagaacatggacgtggagatctggacaaaggagggcgagaagaaaaaactcagacctaggtggctggacgcccgcacgtacagtgatccgctggctttgaaggagttcaaggacttcgccgcgggccggaaatcaatcgccctggacctggtcaccgaaatagggcgcgtgccaagtcatctggcccatcgcacccgcaatgccctggacaacctggtaatgttgcacacgagcgaacacggggggcgggcctaccgtcacgcggtcgaggagttgcccgaaaccatggagacccttctactgctcggccttatgatattgctcacagggggcgcgatgttgttccttatctccggcaaggggataggaaagacgtcaatcgggctgatttgtgtgatcgcctccagcggaatgctatggatggccgaaatcccgttacagtggatcgcctcggcgattgtgttagagttcttcatgatggtcctattaatacccgagcccgagaaacagcggacgccccaggacaaccagctggcctatgtggtgatcggtatcctcactctggccgccatcatcgccgcgaacgagatgggcctgctcgagaccacgaagcgcgacctgggaatgagcaaggagccgggcgtcgtgtctcctaccagttatttagacgtggacctccaccccgcttccgcctggaccctgtacgccgtcgcaactacggtgatcacgcctatgttacggcacaccatcgagaactcgaccgccaacgtatcgctcgccgccatcgcaaaccaagcggtcgtgctgatgggtctggacaaggggtggccgatcagcaagatggacctaggcgtgcccctgttggcgctagggtgttattcccaggtcaatcccctgacgctgaccgccgccgtgctgctgttgatcacgcactatgcaatcatcggcccaggcctccaggcgaaagccacccgcgaagcccagaagcggacggctgccgggattatgaaaaacccgaccgtggacggcatcatgaccatcgacctggaccccgttatctacgacagcaagttcgaaaaacaactgggccaggtgatgctcctggtgctgtgtgcggtccagctcctgctgatgcgcacctcctgggccctttgcgaagcgctgacgctggccacaggccccatcacaactctttgggagggctccccagggaagttttggaacaccacgatcgcggtgtccatggccaacatattccggggcagctatctggccggtgccggactcgcattctcgatcatgaagtccgtggggaccggtaagcgcggcaccgggagccaaggcgagaccctcggggagaagtggaaaaagaagctgaaccagctgtcccggaaggagttcgacctctacaagaagagtggcatcacggaggtcgaccgcaccgaagccaaggagggactcaaacgaggtgagattacccaccacgccgtgtcacgcggcagcgcaaagctgcagtggtttgtggagagaaacatggtgatcccggaggggcgggtgatcgacctcggctgcgggcggggcggctggtcgtactactgtgccgggctaaagaaggtgaccgaggtccgcggctacacgaagggcggtcccgggcacgaggaacccgtgcccatgtcgacctacggatggaatattgtgaagctgatgagtgggaaggacgttttttacctcccgcccgagaagtgcgatacactactgtgtgacatcggcgagagctcccccagccctaccgtcgaggagtcccgtacaattcgggttctcaaaatggtcgagccgtggctcaagaacaaccagttctgcatcaaggtgttaaacccctacatgccaaccgtgatcgaacacttagaacgcctccagcggaagcacggtggaatgctggtccgcaaccccctatccaggaactccacacatgagatgtactggatctccaacggcaccgggaacatcgtagcctcagtgaacatggtcagccgcctcctgttgaataggttcacgatgacccacagacggccaaccatagagaaggacgtcgatcttggcgctggcacccgccatgtgaacgccgaaccagagacgcccaatatggacgtaatcggggagcggatcaagcgcatcaaggaggagcacaactccacgtggcactacgacgacgagaacccgtacaagacctgggcctaccacggttcctatgaggtgaaagcgaccgggtccgccagcagcatgatcaacggggtggtcaagctgctcaccaagccctgggacgtggtacccatggtcacgcagatggcaatgaccgacaccacgccctttgggcagcagcgggtgttcaaggagaaggtcgacactcgtacccctcggtccatgcctggtacccgacgggttatggggatcacagctgaatggctctggcggaccctgggccggaacaagaagccccgcctgtgcacccgcgaggagttcaccaaaaaagtgaggacgaacgccgcgatgggtgcggtcttcaccgaagaaaaccaatgggactcagccaaagcggccgtggaggacgaggacttctggaaactcgtcgatcgcgagcgggagcttcacaagcttgggaagtgcggctcctgcgtttacaatatgatggggaagcgcgagaagaagctcggtgagttcggcaaagccaaggggagccgggcaatctggtacatgtggttgggcgctcgctacttagaattcgaagccctcgggttcctcaacgaggaccactggttctcccgtgagaactcgtactccggagtggagggggagggcttgcataagctcgggtatatactgcgcgacatttcgaagatccccgggggagccatgtacgccgacgacaccgctgggtgggacacacgtatcactgaggatgacctgcacaatgaagaaaagattacacaacagatggaccccgaacaccggcaactcgccaacgccatattcaaactcacctatcagaacaaggtggtcaaggtacagagacccacccccaccggcaccgtcatggacatcatctcgcgcaaggaccaacgtggcagtgggcaggtgggcacctatggattaaacacctttaccaacatggaagctcagctaataaggcaaatggagggggagggggttctgagcaaggcagatcttgagaacccgcacctcccggagaagaagatcacccagtggctggagaccaagggagtggagaggttaaagcgcatggcgatcagcggtgacgactgcgtcgttaagcccatagacgaccggttcgcgaatgccctcctggctctgaacgacatggggaaggtgcgcaaggatatcccgcagtggcagccctccaaaggctggcatgactggcagcaggtgccgttctgcagtcaccactttcacgagctcataatgaaggacgggcggaaactggtggttccctgccgcccccaggacgagctaatagggcgagctcgcatttcccagggggcggggtggagcctacgcgaaacagcctgcctcggcaaggcctacgcccagatgtggtccctgatgtacttccaccggcgcgatctacgcttagcgtcgaatgccatttgctccgcagtgccagtgcactgggtgccgaccagccgcacgacctggtcaatccacgcccatcaccagtggatgacgaccgaggatatgctgacggtctggaaccgagtgtggatcgaggacaacccctggatggaagataagacccccgtgaccacctgggaagacgtcccctacctcgggaaaagggaggaccagtggtgcggctcccttattgggcttactagccgagccacctgggcgcagaatataccgactgccatccagcaggtccgctcccttataggcaacgaagagttcttggactacatgcccagcatgaagaggttccggaaagaggaggagtccgagggggccatctggtga

SEQ ID NO: 25898 - RNA, 9873 nt, synthetic construct
  misc_feature 1..9873: note = derived and/or modified CDS sequence (opt11) from DENV-3__KJ189281__SS-prME
  source 1..9873: mol_type = other RNA
accagcctctgcctcatgatgatcctgccggctgccttggcgttccacctcacctcccgggacggggagccccggatgatcgtggggaagaacgagcggggcaagtccctgctgttcaagaccgccagtgggatcaacatgtgcacgctgattgccatggacctgggggagatgtgcgacgacacggtgacctacaagtgcccccacatcaccgaggtggagcccgaggacatagactgctggtgcaacctgaccagcacctgggtgacctatgggacctgcaaccaagccggcgagcatcggcgcgacaagcggtccgtggctctcgcgccccacgtgggcatgggactagacacgcgcacccaaacgtggatgagcgctgagggcgcttggcgccaggtggagaaggtggagacgtgggccctgcgccacccggggttcaccatcctagccttgtttttggcccactacatcggcacctccctcacccagaaggtggtgatcttcatcctgcttatgctcgtgacgcccagcatgaccatgcggtgcgtgggggtggggaaccgagacttcgtcgagggcctgtccggggccacctgggttgacgttgtactggagcacggcgggtgcgtcacgacgatggctaagaataagcccaccctcgacatcgagctgcagaagaccgaggctacccagctggcgacgctccggaagctgtgtatcgagggcaagatcactaacataaccaccgacagccgctgtcccacccagggcgaggccgtcctgcctgaggagcaggaccagaactatgtctgcaagcacacgtacgtggaccgggggtggggcaatgggtgcggactcttcgggaagggatccctggtgacctgcgccaagttccagtgcctggagcccatcgaagggaaggtcgtgcagtacgagaacctcaagtacaccgtaatcatcacggtccacaccggggaccagcaccaggtgggcaacgaaacccagggggtcaccgccgagatcacgccccaggccagcacaaccgaggcgacgttgcccgagtacgggaccctggggctagagtgctcccccaggactggcctggacttcaacgagatgatactgctcaccatgaagaataaggcctggatggtgcaccggcagtggttcttcgacctgcccctgccctggaccagcggcgccaccacggagacccccacctggaaccgcaaggagctcctggtcaccttcaagaatgcccacgccaagaagcaggaggtcgtggtgctggggtctcaggagggcgcgatgcacacggccctcaccggcgccaccgagatccagaacagcggcgggacctccatcttcgccggacacttaaagtgccggctgaagatggacaagctcgagctgaagggaatgagctacgccatgtgtacgaatacattcgtcctgaagaaggaagtgtcagagacccagcacgggaccatcctcatcaaggtggaatacaaaggcgaggacgcgccgtgtaagatccccttcagcacggaggacgggcacggcaaggcccacaacggccgactgatcaccgccaacccggtcgtgaccaaaaaggaggagcccgtgaacattgaggcggagccacccttcggggagtcgaacatcgtcatcggcattggggacaacgcgctgaagatcaactggtacaagaagggctcgagcatcgggaagatgtttgaggccactgcccggggcgcccgccggatggcaatcctgggcgacactgcgtgggacttcggatccgtaggaggggtcctcaacagcctcggcaagatggtccaccagatcttcgggtcagcatacaccgccctgttcagtggcgtgtcctgggtgatgaagatcggcatcggggttctcctcacctggataggcctgaacagcaaaaacaccagcatgagcttctcctgcatcgccatcggaatcatcacgctctacctgggcgccgtggtgcaggcggacatggggtgcgtaattaactggaagggcaaggagctgaagtgcggcagcgggatcttcgtgactaacgaagtgcacacctggactgaacagtacaagttccaggccgactcccccaagcgcctcgccaccgccatcgccggcgcgtgggaaaacggagtctgcggcatccggagcaccacacggatggagaacctgctgtggaagcaaatcgccaacgagctcaactacatcctgtgggagaacaatatcaagctgacggtggtagtcggggacatcatcggtgtgctcgagcagggcaagcgcacgctgacgccccaaccgatggagctgaagtactcctggaaaacctggggcaaggcaaagatcgtaacggccgagacgcagaactcatccttcatcatcgacgggcccaacacccccgagtgcccgtcggcgtcccgtgcctggaacgtctgggaggtggaggactacgggtttggcgtattcacgaccaacatctggctacgcctgcgggaggtctacacgcagctatgcgaccaccgcctgatgagcgccgccgtgaaggacgagagagccgtgcacgcggacatgggctactggatcgagagccagaagaacgggtcctggaaactggagaaggcctcgctcatcgaagtcaaaacatgcacctggccgaagtcccacaccctctggagcaacggcgtgctggagtccgacatgatcatccccaagtcgcttgccggccccatatcccagcacaaccaccgcccgggctatcacacccagaccgccgggccctggcacttgggaaaacttgagctggacttcaactactgcgagggcaccactgtggtcatcaccgagaattgcgggacgcggggcccctctctccgcacgaccaccgtgtccgggaagctaatccacgagtggtgctgccggagctgcacgctgcccccgctacgctacatgggcgaggacggttgctggtacggcatggagatccggcccatctccgagaaggaggagaacatggtcaagagcctggtctctgcaggcagcgggaaggtggataacttcaccatgggcgtcttatgcctcgcgatcctcttcgaggaggtcatgcgcgggaagttcggcaagaagcacatgattgctggtgtgttcttcaccttcgtgctgctcctgtccggccagatcacctggcgggacatggcccacacgctgatcatgatcggcagcaacgcctccgaccgcatggggatgggcgtcacctacctcgccctgatcgctaccttcaagatccagcccttcctggtgctcgggttcttcttgagaaagctgaccagccgcgagaacctcctgctgggcgtgggcctcgccatggccacgaccctgcagcttcccgaggacatagagcaaatggccaacgggatcgctctaggcctgatggccctgaagctcataacccagtttgagacctaccagctgtggaccgccctaatcagcctgacatgcagtaacaccatcttcaccctgacggttgcctggcggaccgccaccctgatcctcgcgggggtgagcttactcccggtctgccagtcctcttccatgcgcaagaccgactggctccccatggccgtggccgccatgggcgtgccacccctaccgctgttcatattcagcctcaaagacacgttgaagcgccggtcatggccccttaacgagggggtaatggccgtgggcctcgtgagcatcctggcatccagcctgcttcgcaacgacgtccccatggccggccccctggtggccgggggcctgctcatcgcctgctacgtcatcaccgggacctccgccgacctgaccgtcgagaaggcggccgacataacgtgggaagaggaggccgaacagaccggcgtgagccacaaccttatgatcaccgtggacgacgatggcaccatgcggatcaaggacgatgagactgagaacatcctcacggtcctgctgaagaccgccctcctgatcgtgtccggcatcttcccgtacagcattcccgccaccctgctcgtgtggcacacctggcagaagcagacgcagcgctccggcgtcttatgggacgtgccctcaccacccgagacccaaaaggcggagctggaggagggggtgtaccggatcaagcagcaaggcatcttcgggaagacccaggtaggcgtgggagtgcagaaggagggcgtctttcacaccatgtggcacgtaactcgcggcgccgtgctaacgtacaacgggaagcgcctggagcccaactgggcctcagtcaagaaggacctgatcagctatggcgggggctggcgcctatccacccagtggcagaagggcgaggaggtccaggtgatcgcggtcgagcccggcaaaaaccccaagaacttccagaccatgcccggcacgttccagactaccaccggagagatcggggccatcgcgctggacttcaagcccgggacgagcggcagccctatcatcaaccgtgagggcaaggtggtggggctgtatggcaacggagtcgtgacaaagaatggcggctacgtgtccggcatcgcccagaccaacgccgagccggatggccccacccctgagctggaagaggagatgtttaagaagcgcaacctcacgatcatggacctgcaccccgggagcggcaagacccggaagtaccttccggccatcgtccgcgaggcgattaagcggcgcctccggactctgatcctcgcccccacccgcgtggtagccgccgagatggaggaggccctcaaggggctgcccatcagataccagacgaccgcgacgaagtccgagcacactggcagggagatcgtcgacctgatgtgccacgccacgtttaccatgcggctcctgagccccgtgcgcgtgccgaactacaatctgatcatcatggatgaggcccacttcaccgaccccgcctccatagccgcgcggggttacatcagcacccgcgtgggcatgggcgaggccgccgccatcttcatgacggccacgccgcccggcaccgccgacgcctttccgcagtccaacgcccccatccaggatgaggagcgcgacatccccgagcggagctggaactccggcaacgagtggatcaccgacttcgctgggaagaccgtgtggttcgtgcccagcatcaaggcgggcaacgacatcgccaactgcctccgcaagaacgggaagaaggtcatccagctgagccggaagaccttcgataccgagtaccagaagacgaagctgaatgactgggatttcgtggtgacgaccgatatcagcgaaatgggggccaacttcaaggccgatcgcgtcatagacccccggcgctgtctcaagccggttatcctgaccgacgggcccgagcgggtaattctggccgggcccatgccggtcaccgcggccagtgccgcccagcgcagaggccgcgtcgggcgaaacccccagaaggaaaacgaccagtacatcttcaccgggcagcccctcaacaacgacgaggaccatgcccactggacggaggccaagatgctgctggacaacatcaatacccctgagggtatcatcccggcactcttcgagcccgaacgcgagaagtccgccgcgatcgatggcgagtaccgactgaagggcgagtcccgcaagaccttcgtcgagttgatgcggcgcggggacctccccgtctggctggcccacaaggtggccagcgaaggcatcaagtacaccgaccggaaatggtgcttcgatgggcagcgcaacaaccagatcctggaggagaacatggacgtcgagatctggacgaaagagggcgagaaaaagaagctcagaccccgttggctggatgcccgcacctactccgatccactggccctcaaggagtttaaggacttcgccgcgggccgcaagagcattgccctggacctggtgaccgagatcgggcgcgtaccgtcccacctcgctcaccggacccgcaacgcacttgacaacttagttatgctccataccagcgagcatggcgggcgggcctaccgccacgcggtggaggagctgcccgagacgatggagacactgctcttacttggcctcatgattctgctgaccgggggcgccatgctgttcctgatcagcggtaagggtatcggcaagacgtccatcggcctgatttgcgtgatcgccagctccggcatgctctggatggccgagatcccgctgcagtggatcgccagcgcgatcgttctggagtttttcatgatggtgctcttaatccccgagcccgagaagcagcggacgccccaggacaaccagctggcctacgtggtcatcgggatcctcaccctggccgccatcatcgccgcgaatgagatgggcctgctcgagaccaccaagcgtgacctgggcatgtccaaagagccgggggtggtgagcccgacctcctatctggacgtcgacctccaccccgccagcgcctggaccctgtacgctgtcgcgaccacggtgatcacacccatgctgagacacaccatcgagaactccaccgccaacgtcagcctcgccgccatcgccaaccaggctgtggtgttgatgggcctcgataagggttggcccatctccaagatggatctcggcgtccccctcttggctctcggttgctactcacaggtgaaccccctgacgctgaccgccgccgttctcctgctgatcacgcactacgcaatcatcggccccggcctccaggcgaaggccacccgcgaggcccagaagcgaacggcggccggcatcatgaagaacccgaccgtcgacggcatcatgacgatcgacctggaccccgtgatctacgactccaagttcgagaagcagctaggccaggtgatgctcctggtcctgtgcgcggtgcaactcctgcttatgcgcaccagctgggccctctgcgaggccctgactctggccaccggccccatcaccaccctctgggagggctcccccgggaagttctggaacacgaccattgctgtgagcatggccaacatcttccggggctcctacctggccggggccggccttgccttctcgattatgaagtcggtcggaaccggcaaacgcggcaccgggagtcagggcgagaccctcggggaaaagtggaagaagaaactgaaccagctgtcccggaaggagttcgacctctacaagaagtccggcatcacggaggtcgacaggaccgaagcgaaggaggggctgaagcggggcgaaatcacgcaccacgccgtgagccgagggtccgccaagctgcagtggttcgtcgagagaaacatggtgattccggaggggcgcgtgatcgacctcggctgcgggcggggcgggtggagctactactgtgccggcctgaaaaaggtcaccgaggtgagaggctacacgaagggcgggcccgggcacgaggagcccgtacctatgagcacctacggatggaatatcgtcaaacttatgagcgggaaggacgtgttctacttgccgcccgagaagtgcgataccctgctctgcgacatcggcgagagcagtccctcgcccactgtggaagagagccgcacgatccgggttctgaagatggtggaaccgtggctcaaaaacaatcagttctgcatcaaagtgctgaacccctacatgcctaccgtcatcgaacacctggagaggctccagcggaagcacggcgggatgctggtgcgcaaccccctctcccggaacagcacccacgagatgtactggatctccaacggcactggcaacatcgtggccagcgtaaacatggtgtcccgcttactgctgaaccgtttcacgatgactcatcgccggccgaccatcgagaaggacgtcgacctcggcgcgggcacacgccacgtcaatgccgagcccgagactccaaacatggatgtcatcggtgagagaatcaagcgcatcaaggaggagcacaactcaacctggcactacgacgacgagaacccgtacaagacctgggcttaccacgggtcctacgaagtgaaggccaccggtagcgcctcttctatgataaacggcgtcgtgaagctgctgacgaaaccctgggacgttgtgcccatggtgacccagatggcgatgaccgacaccactcccttcgggcagcagcgggtctttaaggaaaaggtggacaccaggaccccgagaagcatgcccggcacccgccgggtgatgggcatcactgccgagtggctgtggcgcaccctggggcggaacaaaaagccccgcctgtgtacccgcgaggagttcaccaagaaggtccggactaatgccgccatgggcgcggtgttcaccgaggagaaccagtgggactcggccaaggctgccgtggaggacgaggacttctggaaacttgtcgatcgcgagcgggaactacacaagctggggaagtgcggcagctgcgtgtacaacatgatggggaagcgcgaaaagaagctcggtgagttcggcaaagcaaaggggtcccgggcgatatggtacatgtggctgggcgcccgctatctggagttcgaggctctcggcttcctgaacgaggaccactggttctcgcgggagaactcctactcaggcgtagaaggggagggcctgcacaagctcggctacatactgcgcgacatctccaagatccccgggggcgccatgtacgccgacgataccgcggggtgggacaccagaatcacggaggacgacctgcacaacgaggagaagataacccagcagatggacccggaacatcgacagctcgccaacgccatcttcaagctgacataccagaataaagtcgttaaggtgcaacggcccacccccaccggcacggtgatggacatcatcagccgcaaggatcagcggggttccggccaggtaggcacctacgggcttaacaccttcaccaacatggaggcccaactcattagacagatggagggcgagggggtgctgagcaaggcggacctggagaacccccacctcccggagaagaagatcacgcaatggctggagaccaagggcgtcgagcggctgaagcgcatggcgatctccggcgacgactgcgtggtgaagcccatcgacgaccggttcgccaatgccctcctggccctgaacgacatgggcaaggtccgcaaggacatcccccagtggcaaccatcgaaaggctggcacgactggcagcaggtcccgttctgctcccatcacttccacgagctcatcatgaaagacgggcgcaagctggtagtcccctgccgcccacaagacgagctcatcggccgggcccgcatctcccagggggcgggctggtccctccgcgagacagcctgcctgggcaaggcctacgcccagatgtggagcctgatgtacttccaccgtcgcgacctgcggctggcgtccaacgccatctgcagcgccgtgcccgtgcactgggtcccgacctcccgtacgacctggtccatccatgcccaccaccaatggatgaccacagaggacatgctgacagtgtggaatcgggtctggatcgaggacaacccctggatggaagacaagacccccgtcaccacctgggaggacgtgccctaccttgggaagcgcgaggaccagtggtgcggaagccttatcgggctgacgtcccgggccacctgggcgcaaaatatcccgactgccatccaacaggtccgcagcctcatcggcaacgaggagttcctggactacatgccctcaatgaagcgcttccgcaaggaagaggaaagcgagggggccatctggtga

SEQ ID NO: 25899 - RNA, 9873 nt, synthetic construct
  misc_feature 1..9873: note = derived and/or modified CDS sequence (opt11) from DENV-3__KJ189282__SS-prME
  source 1..9873: mol_type = other RNA
acctccctctgcctcatgatgatcctgcccgctgctctcgcttttcacctcacaagccgggacggggagccgaggatgatcgtggggaagaacgagcggggcaagagcctgctgttcaagaccgcctcgggaataaacatgtgcacattgatcgccatggacctgggggagatgtgcgacgacaccgtgacctacaagtgtccccacatcactgaggtggagcccgaggatatcgactgctggtgcaacctaacaagcacatgggtgacatatgggacctgcaaccaggccggcgaacaccggcgcgacaagcggtccgtggcactcgcgcctcacgtgggcatgggactcgacactcgcacccagacctggatgagcgccgagggcgcatggcgccaggtggagaaggtggagacgtgggccctgaggcatccggggttcaccatcctcgcgctttttttggcgcactacatcgggacctctctaacccagaaggtggtgatcttcatcctgttgatgctcgtgacgccaagtatgacgatgcggtgcgtgggggtgggaaaccgggacttcgtcgagggcctgtctggggccacatgggtcgatgtggtcctggagcacggcggatgcgtgaccacgatggccaagaacaagcccaccctagatatcgagctgcagaaaaccgaggcaacccagctggcgacgctccgcaagctgtgcatcgaggggaagattaccaatattaccaccgacagccgctgccccacgcaaggcgaggcggtcctgcccgaggagcaagaccagaactacgtctgcaagcacacctatgtggacagggggtggggcaacgggtgcggactcttcgggaagggctccctggtaacctgcgccaagtttcagtgcttggagcccattgaaggcaaggtcgtgcagtacgagaacctcaagtacaccgtgatcatcacggtccacacgggggaccaacaccaagtgggaaacgagacccagggcgtaaccgccgaaataacgccccaagccagcacgaccgaagcgacactgcccgagtacggcaccctggggctcgagtgctcgccgcgaacggggctggacttcaatgagatgatcctgctcaccatgaagaacaaggcctggatggttcaccgacagtggttcttcgacctgcccctgccatggaccagtggcgccactacggaaacccccacctggaaccgcaaggagctcctggtcaccttcaagaacgcgcacgccaagaaacaagaggtcgtggtgttgggttcccaggagggggcgatgcacaccgccctcaccggggccacggagatccagaacagcggcgggacctccatcttcgccggacacctgaagtgtcggctgaagatggacaagctcgagctgaagggcatgagctacgccatgtgcacgaacacttttgtcctgaaaaaggaggtgtctgagacccagcacgggaccatcctcataaaggtggagtataagggcgaggacgcgccatgcaagatccccttcagtacggaggacgggcatggcaaggctcacaacggccgccttatcaccgccaaccccgttgtgaccaagaaggaggagcctgtaaatatcgaggccgagccacccttcggggagagcaacatcgtcatcgggatcggggataacgcactgaagatcaactggtataagaaaggctccagcatcgggaagatgttcgaggccaccgcccggggcgcacggcggatggccatactcggcgacacggcgtgggacttcgggtccgtgggtggggtgctcaacagcctgggcaagatggtccaccaaattttcggttccgcatatactgccctcttcagcggcgtttcctgggtgatgaagatcgggattggggtcctgctgacctggatcggcctgaacagcaagaacacctccatgagcttctcctgcatcgccatcggaatcatcacgttgtacctgggtgccgtggtgcaagcggacatggggtgcgtcatcaattggaagggcaaggagctcaagtgcggctccgggatcttcgtgaccaacgaggtgcacacctggaccgagcagtacaaattccaggccgacagccccaagcgcctcgcaacggccatcgccggcgcgtgggagaatggggtctgtggcatccgcagcaccacccggatggaaaacctgctgtggaagcagatcgccaacgagctgaactacatcctgtgggagaacaacataaaactcaccgtggtggtcggtgacatcatcggcatactcgagcagggaaagcgcacgttgacgccccagccgatggagctgaagtacagctggaagacctgggggaaggcaaagatagtgaccgccgagacgcagaacagctctttcataattgacggccccaacacacccgagtgcccaagcgcgagtcgcgcctggaacgtatgggaagtcgaggactacggcttcggcgtcttcaccaccaacatctggctccgcttacgggaggcctacacccagctctgtgaccaccgcctcatgagcgccgccgtgaaggacgagcgggcggtccacgccgacatgggctactggatcgaatcacagaagaacgggtcctggaagttagagaaggccagcctcatcgaggtaaagacctgcacctggccgaagtcccacaccctctggagcaacggcgtgctggagtccgacatgatcatacccaagagcctggcagggcccatctcccagcacaatcatcgcccgggctaccacacccagacggcaggcccatggcacctcggtaagctggaactggacttcaattattgcgaaggcaccaccgtcgtaatcaccgaaaactgcgggacgcgtggcccctcgctccgcaccaccaccgtctccggaaagttaattcacgagtggtgctgccggtcctgcaccctgcccccgctcaggtacatgggcgaggacgggtgttggtacggcatggagatacggcccatctccgagaaggaggagaacatggtcaaaagcctggtaagcgcgggcagcgggaaggtggacaactttaccatgggcgtgctttgccttgcaatcctgttcgaagaggtgatgcgggggaagttcggcaagaaacacatgatcgccggtgtgttctttactttcgtcctgctcctatctggacagattacatggcgggacatggcccatacccttataatgatcggcagcaatgcctccgatcgcatgggtatgggcgtgacctacctcgcactgatcgccaccttcaagatccagcccttcctggccctcggattcttcctgcggaagctgaccagccgcgagaatctgttgctgggcgtgggcctcgccatggcgacgaccctgcagctgcccgaggacatcgagcagatggccaatggcatcgctctcggactgatggctctgaagctcatcacccagttcgagacttaccagttgtggacggccctgatcagcctgacctgctccaacactatcttcaccttgacggtcgcgtggcggaccgccaccctgatcctcgccggggtgagcctgctgccagtgtgccagtccagctccatgcgcaagaccgattggttacccatggccgtcgccgcgatgggcgtgccgcccctcccactgttcatctttagcctcaaggacacgctgaagcgccggtcctggcccctcaacgaaggggtcatggcggtgggcctcgtgagcattctagcctcctcactgctccgcaacgacgttcccatggccggtcccttagtggcggggggcctgctgatcgcgtgctacgtgattaccgggacctccgccgacctgaccgttgagaaggctgccgacatcacgtgggaggaagaagccgagcagaccggcgtgagccacaacctgatgatcaccgtcgacgacgacgggaccatgcggataaaggacgacgagaccgagaacatcttgacggtccttctgaagactgcgctactgatcgtgtccggcatattcccatactcgatccccgctaccctgctcgtgtggcacacctggcaaaaacagacgcagcgctccggcgtcctgtgggacgtgccaagcccgcccgagacccaaaaggccgagttggaggagggggtgtaccggatcaagcagcaaggcatcttcggcaagacccaggttggcgtgggggtgcagaaggagggcgtattccataccatgtggcatgtgacgcgtggcgctgttctcacctacaacgggaagagactggagccgaactgggcgtccgtcaagaaggacctcatctcgtacggcgggggctggcggctctccacccaatggcagaaaggggaggaggtccaagtgatcgccgtggagcccgggaagaaccccaagaacttccagaccatgcccggcacgttccagaccacgacaggggagatcggcgccatcgccctggacttcaagccggggacgagcggcagccccatcatcaatcgggagggcaaggtggtgggtctgtacggcaatggcgtcgtgaccaagaatggcgggtacgtgtccgggatcgcccagaccaatgcggagccggacgggcccacccccgaattggaggaggagatgtttaagaagaggaacctcacgatcatggacctgcacccggggagcggcaagacccgtaagtacctgccggccatcgtccgcgaagccatcaaacggcgcctccggactctgatcctggcccccacccgcgtggtggcagcggagatggaggaggccctcaaggggctgcccatccgttaccagactactgccaccaagtccgagcacacgggccgcgagatcgtcgacctgatgtgccatgccaccttcaccatgagactgttgagccccgtgcgcgtgccgaactacaacctgattatcatggacgaggcccactttaccgaccccgcgtccatcgccgcccgcgggtacatctctacccgtgtcggcatgggcgaggccgcggccatcttcatgacggccacgccgcccggcaccgccgacgctttcccgcagtccaacgctcccatccaggatgaggagcgcgatatccctgagcgaagctggaactccggtaacgaatggatcaccgacttcgccgggaagacggtgtggttcgtgcccagcatcaaggccggcaacgacatcgccaactgcctccgaaagaacggtaagaaggtcattcaactgtcccggaagaccttcgataccgagtatcagaagaccaagctgaacgactgggatttcgtggtgacgacagacattagcgagatgggcgctaatttcaaggcggaccgagtaatcgaccctcggcgctgcctcaagcccgtgatcctgaccgatggccccgagagggtgatcctggctgggcccatgccggtgaccgccgcctccgcggctcagcgccggggcagagtcgggcggaacccgcagaaggaaaatgaccagtacatcttcaccggtcagcccctcaacaatgacgaggaccacgcccattggacggaagccaagatgctactggataacatcaacacgcccgaagggatcatcccggccctctttgagcccgagcgcgagaagtccgcagccatagacggcgaataccgcctgaagggcgagtcccggaagacgttcgtggaactgatgcggaggggggatctccccgtctggctggctcacaaggtggccagcgagggcataaagtacaccgaccgtaagtggtgttttgacggtcaacgcaataaccagattctggaagaaaacatggatgtggagatctggaccaaggagggcgagaaaaagaagcttcgccctcgctggctggacgcccgcacctactccgacccgctggcactgaaggagttcaaggattttgccgccggcagaaagagcatcgccctggacctggtcacggagatcgggcgcgtaccttcgcacctcgcccacaggacaagaaacgcgctggacaacttggtcatgttgcacacgagcgagcacggcggtcgggcctatcgccacgccgtggaagagttgcccgagaccatggagaccctgctgctgctgggcctcatgatcctgttaaccgggggggccatgctgtttttgattagcggcaaagggatcggcaagacgtcgatcgggctgatctgcgtgatagccagctccgggatgctttggatggcggagatcccactgcaatggatcgccagcgccatcgtactggaatttttcatgatggtactcctgatccccgaacccgagaagcagcggacgccccaggacaatcaactggcctacgtggtcattgggatcctcacactggccgcgatcatagccgcgaatgagatgggcctgcttgagacgacgaagcgcgacctgggcatgtccaaggagccgggggtggtgagccccacctcctacctggacgtcgacctccacccagccagcgcgtggaccctgtacgccgtggccaccacggtgatcacccccatgctgcggcacactatagaaaactccacggccaacgtctccctcgccgcaatcgccaaccaggccgtggtgctgatgggcctggacaagggctggccgatctccaaaatggaccttggcgtccccctgttggccctgggttgctactcccaggtgaaccccctgacgctcacggccgcggtgctcctgctgatcacccactacgccatcataggccccggattacaggccaaggccacccgcgaggcccaaaagcggacggcagccggcatcatgaagaacccgaccgtcgacgggatcatgacgatcgacctggaccccgtgatttacgactccaagttcgagaagcagctgggccaggttatgctcttagtcctgtgcgccgtccagctcctactgatgcggaccagctgggccctctgcgaggcgctgacgctggccaccggcccaattaccaccctctgggagggctcccccgggaagttctggaacacgaccatagctgtgagcatggccaacatcttccgtggctcctatctcgcaggggccggcctggccttcagcattatgaagtccgtcgggaccggcaaaaggggcaccggcagccagggcgagaccctcggtgagaaatggaagaagaagctgaatcagctgagcagaaaggagttcgatctctataagaaatcgggcattacggaggtggaccgcaccgaggcaaaagaagggctgaagcggggcgagatcacccaccacgcggtgagccggggcagcgccaagctgcagtggttcgttgaacggaacatggtgattccggaggggcgcgtgatcgacctgggatgcggccggggggggtggagctactactgcgcgggcctgaagaaggttaccgaggtgcgcggctatacgaagggcggccccgggcacgaggagcccgtccccatgtccacttacggctggaacatcgtcaagctgatgagcggaaaggacgttttctacctccctcccgagaagtgcgacaccctgctgtgcgacattggcgagtcaagcccctcccccaccgtcgaggagagccgcactatccgggtcctgaagatggtggagccctggctcaagaataaccagttctgcatcaaggtcctgaacccctacatgcccaccgtcatcgaacacttagagaggctccagcggaagcacggcgggatgttagtgagaaatcccctgtcccggaacagcacccacgaaatgtactggatcagcaatggcacagggaacatcgtggccagcgtcaacatggtgtctcgcctcctgttgaaccggttcacgatgacacaccgccggcctactatcgagaaggatgtggatctcggagcgggcacgagacacgtcaatgccgagcccgagacccccaacatggacgtgatcggggagcgcatcaaacgtatcaaggaagaacacaacagtacctggcactacgatgacgagaatccgtacaagacctgggcataccacggctcctacgaggtgaaggcgaccgggagcgcctccagcatgatcaacggcgtcgtgaagctgctgacaaagccctgggatgtggtccccatggtaacccaaatggcgatgaccgacacaacgccgttcggtcagcagcgggtcttcaaggagaaggtggacacccgcaccccgcggagcatggccggtacgcgtcgggtgatggggatcacggccgaatggctctggaggaccctggggcgaaacaaaaaaccacgcctgtgcactcgcgaggagttcaccaagaaggtgcgtacgaacgccgcaatgggtgccgtcttcaccgaagagaaccagtgggactccgccaaggcagcagttgaggacgaggacttttggaagctcgtagaccgcgagcgggagctgcacaagctgggaaagtgcggcagctgcgtgtataacatgatggggaagcgcgagaagaagctcggggagttcggcaaggccaaagggtcccgggccatctggtacatgtggctgggcgcccgctacctggagttcgaagcactggggttccttaacgaggaccactggttctcacgggagaactcctattccggcgtggaaggcgaaggcctgcacaagctgggctacattctgcgcgatatctccaagatcccaggcggcgccatgtacgccgacgacaccgccggttgggacacccggatcacggaggacgacctgcacaacgaggagaagatcacccaacaaatggatcccgaacaccgccagttagccaacgcgattttcaagctgacctaccagaataaagtcgtgaaagtgcagcggccaacccccacgggcacggtgatggacatcatcagccgcaaagatcagcggggctccggccaggtgggcacctacgggctgaacaccttcaccaacatggaggcccagttaattcgccagatggaaggcgaaggagtgctgagcaaggccgacctggagaatccccatttacccgagaaaaaaatcacgcaatggctggagaccaagggcgtggagcggctgaaacgcatggccatatccggcgacgactgcgtggtcaagccgatcgacgaccgcttcgccaacgccctcttggccctgaacgacatgggaaaggtccgtaaggacatccctcagtggcagccctcaaagggctggcacgactggcagcaggtgcccttctgctcccaccacttccacgagctcatcatgaaggacggacggaagctggtcgtcccgtgtcgcccccaagacgagctgatcggccgcgcccgcatcagccagggggccgggtggtccctccgcgagaccgcgtgcctgggcaaagcatacgcccagatgtggagccttatgtacttccatcgacgcgaccttcggctggcctccaacgctatctgcagcgctgtgccagttcactgggtccccacctctcgaacgacctggagcatccatgcccaccaccagtggatgaccacggaggacatgctgaccgtgtggaatcgggtgtggatcgaagacaacccatggatggaggataagaccccagtgaccacctgggaggacgtgccctacctcgggaagcgcgaggaccagtggtgtggcagcctgatcgggctgacgtcccgcgccacctgggcgcaaaacatccccaccgccatccagcaggtccgcagcctcatcggcaacgaggagttcctggactacatgccgtcaatgaagcgattccgcaaggaggaggagagcgagggggcgatctggtga

SEQ ID NO: 25900 - RNA, 9873 nt, synthetic construct
  misc_feature 1..9873: note = derived and/or modified CDS sequence (opt11) from DENV-3__KJ189283__SS-prME
  source 1..9873: mol_type = other RNA
accagcctgtgtctcatgatgatcctacctgctgccctggccttccacctaacgtcgcgggatggagaaccgcgaatgatagtcggtaaaaatgaacgaggcaaatccctactcttcaagaccgccagcgggatcaacatgtgcaccttaatagccatggacctcggcgaaatgtgtgatgacacggtcacatataaatgcccccacatcacggaagtcgaaccggaagacatcgactgttggtgcaacctaaccagtacttgggtgacgtacgggacatgcaaccaagccggtgagcaccggcgcgacaaacgatcagtggccctggcccctcacgtaggcatgggactggatacccggacccaaacctggatgagcgcggaaggggcgtggcggcaagtggaaaaagtagaaacgtgggctttgcggcaccctgggttcacgatcctggcactgtttcttgctcattacatcggaaccagcttaacgcaaaaagtagtgatattcatcctactaatgctggtgacaccgtcaatgacgatgcgttgtgtcggagtgggaaacagggacttcgtcgaagggctaagtggcgcaacatgggtcgacgtggtcctcgagcacgggggctgtgtaaccactatggccaagaacaaaccgacactcgacatagaactgcagaaaactgaagcaacacagcttgctaccctccgaaaactctgtatcgaaggcaagataacaaatatcaccacagactccagatgtccgacacaaggcgaggctgtactaccagaagaacaagatcaaaattacgtgtgcaaacacacctacgtggacagaggatggggaaacggctgcggactcttcggcaagggatccctcgtgacctgtgcaaaatttcaatgcctggaaccaatcgaagggaaagtagtacaatacgaaaacctcaaatacacggttatcatcacagtccatacgggagatcaacaccaagtaggaaatgaaacacaaggggttaccgcggagataaccccacaagcaagcaccacggaagccaccctaccggaatacggaaccctaggactagaatgctccccgagaacaggcttagacttcaacgaaatgatactgttgaccatgaaaaataaagcctggatggtacaccgacagtggttcttcgacttgccactaccatggacaagcggagcgacaaccgagaccccgacctggaacagaaaggaattgcttgttaccttcaagaatgcacacgccaagaagcaagaggtggtagtccttgggtcccaggagggcgctatgcacacggcactaaccggtgcgacagaaatccagaactctggcggaaccagcatctttgcaggccatctgaaatgccgattgaagatggacaagctggagctcaagggcatgagctatgccatgtgtacgaatactttcgtcctcaagaaagaagtaagtgagacacagcatggtacgatccttataaaggtggagtataagggcgaagacgcgccttgcaagataccctttagtacggaagacgggcatggaaaggcacacaacggcagactcataacagcaaatccggtcgtcacaaagaaggaagaacccgtaaacatcgaagcggaacctccgttcggagagagcaatatcgtgatagggatcggcgataacgccctaaaaataaactggtataagaaaggctccagcataggaaaaatgttcgaagccactgcgcgcggcgcaaggcgaatggccatcctgggcgataccgcgtgggactttggcagtgtgggcggggtcctaaacagcctcgggaagatggtacatcaaatatttggttctgcgtacaccgcgctattcagcggcgtgtcatgggtcatgaagatagggatcggtgtactgctaacctggatcggactcaactctaagaatacaagcatgtccttcagctgcattgccatcgggataatcacgctatatctaggagcagtcgttcaggctgatatgggctgcgtaatcaactggaaggggaaagaactcaagtgcggatccggaatattcgtcacaaacgaagtgcacacgtggaccgaacagtacaagtttcaagcagactccccgaaaagactcgcgactgctatagcgggagcatgggaaaatggggtctgcgggatacgttccacgaccaggatggagaacctactatggaaacagatcgctaatgaattaaactatatcctctgggagaataacataaaattaaccgtcgtagtaggagacataataggcgtcctagaacaaggaaaacgtacgctaacaccacaaccgatggaattaaaatatagctggaaaacgtggggaaaggcaaaaatcgtcaccgctgaaactcagaacagcagcttcataatagacggccccaacacgcccgaatgtccaagtgcatcgagagcctggaacgtctgggaggtcgaggattacggcttcggtgtattcactacaaacatctggctgagactccgcgaagtgtatacccaactctgcgaccaccgactcatgtcggcagcagtaaaggatgaacgagcggtacacgcagacatgggatactggatcgaaagccaaaagaacggcagctggaaactagaaaaggcgagtctgattgaagtgaagacgtgcacgtggcccaaatcacacacgctatggtccaatggggtactcgagagcgacatgataatcccgaaatccttggcaggaccgatatcccaacacaaccaccgacccggatatcacacccagacagccggcccgtggcacctcgggaagctggaactagatttcaactattgtgagggaacaaccgtagtaatcacggaaaactgcgggacccgaggtccaagcctgaggacgacaaccgtaagtggcaaactcatacacgaatggtgttgcagatcgtgcacgctacccccgctacggtacatgggggaagatggatgttggtatggtatggaaatacgacctatttctgaaaaagaagagaacatggtcaagtcactcgtatctgcggggtcagggaaagtggacaacttcacgatgggcgtgttatgcctcgcgatccttttcgaggaagtgatgagagggaaatttgggaagaaacatatgatagcgggtgtattcttcacattcgtactgctactatcgggccagataacatggagggatatggcccatacactcataatgataggatcaaatgcatcggaccggatgggcatgggagtgacctaccttgcactaatagcgacctttaaaatccaaccgttcctggcgcttggcttctttctaaggaaactgacgagtagagaaaacctcctattgggcgttggactggcaatggccacgacactccaattgcccgaagacatagaacagatggcaaatggaatagctctcggactgatggcgctcaaacttataacgcaattcgaaacgtaccagctatggaccgcattaataagtctaacgtgcagtaaaacaatcttcaccttaactgtggcctggcgcacggccaccctcatcttggcaggagtaagtctcctgccagtgtgtcaatcctccagtatgcggaaaacggactggctacccatggccgtcgccgcgatgggtgtcccacccctccctctgttcatattcagtcttaaggacacattaaaaagaagatcatggccactgaacgagggggtaatggcagtcgggcttgtatcgatactggcaagctcactacttaggaacgatgtacccatggcagggcccctagtggctggcggactcctaatagcctgctacgtcatcacaggaacatccgcggatctcactgtcgagaaggctgctgatataacatgggaagaagaggccgaacagaccggtgtgtcacacaatctcatgataacagtcgacgacgacggaaccatgcgcatcaaggacgacgaaaccgaaaacatactcacggtcctgctaaaaacagccctccttatagtttcaggaatcttcccctactcaatacccgcaaccctcctagtatggcacacctggcagaaacagacgcagcgaagtggggtgctttgggacgtaccgtcacccccggaaacccaaaaggccgagctagaagagggcgtctatcggataaagcaacaaggtatattcggaaaaactcaagttggcgtcggtgtgcaaaaagaaggtgttttccacacaatgtggcacgtcacaaggggcgcggtgctaacgtataacgggaaacggctagagcccaactgggctagcgtaaagaaagacctaatcagctacggaggcgggtggagactctccacccagtggcagaaaggtgaagaggtccaagtcatagccgtggaacccggcaaaaaccccaaaaatttccaaacaatgccaggaacctttcagaccactaccggggagattggtgcgatagcacttgattttaaacccggcacaagcggttccccaataataaaccgagagggcaaagttgtcggattgtacggtaacggagtggttacgaaaaacggcggttatgtatcgggcattgcacaaaccaacgcagaacctgacggtccaacacccgaactagaagaggaaatgttcaagaaacgaaacctcaccatcatggacctccaccccgggagtggcaaaacacgcaaatacctgccggcaatcgtcagggaggcaatcaagcgaagactccgcaccttgatattggcacccacccgagttgtagccgcagagatggaagaagccctcaaaggactaccaatacgctaccaaacgactgctaccaagagtgagcataccggacgagagatcgttgatctaatgtgccacgccacgttcacaatgagactccttagcccagtgcgcgttcccaattataacctaatcataatggatgaagcgcatttcacggatccagcaagcatcgcggcaagagggtatatctcgacccgagttgggatgggagaggcggcagccatttttatgacagcgacacccccaggtactgcagatgccttcccacagagcaacgcacccatacaggacgaggaacgcgatatcccggaaaggagctggaactcgggaaatgagtggataacggatttcgcgggtaaaactgtgtggttcgtgccgtccattaaagcaggaaacgacatcgcaaactgcttacggaaaaacgggaaaaaggtaattcaactatccagaaaaacatttgataccgaataccagaaaaccaagctgaacgactgggactttgtggtcacgacagacatatccgaaatgggtgcgaatttcaaggccgatagagtcatcgacccccgccgatgcctcaagccagtaatcctcactgacggtcccgaacgcgtaatcctagcaggacctatgccggtgacggccgcgagcgcggcacagcgtcgtggtcgagtaggtcgtaacccacaaaaagaaaacgaccaatacatcttcaccggacaaccgctaaacaacgacgaggaccatgcccactggacggaagcaaaaatgctactcgacaatataaacactccggagggaattataccagccctgttcgaaccagagagggaaaagagcgccgccatagacggagaataccgccttaagggcgaaagcaggaagacattcgtagaactgatgagaaggggtgacttaccagtctggttggcgcacaaagtagcatccgaaggaatcaagtacaccgatcgaaaatggtgtttcgacggacagcgcaataatcaaattctagaggaaaacatggacgtggagatatggacaaaagaaggagaaaagaagaaactgaggcctcgatggctggatgcccgaacgtacagcgacccgctggcactaaaagagtttaaagatttcgcagcaggacgtaaatcgatcgcgctagatttggtgaccgaaatcgggcgagttccgagccacctagctcaccgaacacgcaacgccctggataacttggtaatgctccacacaagtgagcatggcggccgagcatacaggcacgcggtcgaagaattgccagagactatggaaactcttctcttactggggcttatgattctcctaacaggtggagccatgctattcctgataagcggcaaaggcatcggtaaaacaagcataggactaatctgcgtaatagcgagctcagggatgctatggatggcagaaatcccgctacagtggattgcatccgctattgtgttggagtttttcatgatggttctactcatcccagagcccgagaagcaaagaacccctcaggacaaccaactcgcctatgtcgtcatcggaatacttaccctggcggcgatcatagctgccaacgaaatgggcctactggagacgaccaaacgagacctcggaatgagcaaggagccaggggtcgtctccccaacctcttacctggacgtcgacttgcatcccgcgtcggcctggacactatacgccgtagcaacaacagtgatcacgcccatgctccgccataccatcgaaaactcaacagccaacgtgagcttggccgcaatcgcgaaccaggccgtagttctcatgggactcgacaaaggatggccgatctccaagatggacctaggcgtaccactactggccctcggatgttactcacaggttaacccgctcacattaaccgcagcggttctactgctcataacccactacgctatcataggcccaggactccaggctaaagcgacccgcgaagcgcaaaaacgcacagcagccggaatcatgaagaacccgacggtcgacggaatcatgacaatagatcttgaccccgttatctacgactccaagttcgagaaacaactgggccaggttatgttactcgttttgtgcgcagtccaactgctactgatgcgaacaagctgggctctgtgcgaggcgctaaccctagcaacaggcccaatcaccactctatgggaagggagcccaggtaaattctggaatacaaccatcgcagtgagcatggcaaacatcttccgaggatcatacctggcgggggcagggctggctttcagcatcatgaaaagcgtaggaaccggcaaacgaggaaccgggtcgcaaggagaaacactaggtgagaaatggaaaaagaaactaaaccagctatcgcgtaaagagttcgacctgtataagaaaagcggaataacagaagtcgaccgaacggaagccaaggagggcctgaaaagaggggaaatcactcaccatgccgtcagccgtggcagcgcaaaactccaatggttcgttgaacggaacatggtaatcccagaaggacgagtcatagacctaggctgcggccgtggtggctggtcatactattgtgcggggctcaagaaagtcacggaggtaagaggttacacaaaagggggccccggtcacgaagaacccgtaccaatgtcgacctacggttggaacatagtgaaactcatgagcgggaaagacgtcttctacttgcccccagaaaagtgcgataccctcctttgtgatataggggagtccagccccagtccaacggtagaggagtcaagaaccatcagagtactgaagatggtcgaaccttggttgaaaaacaaccaattctgcatcaaagtcctaaacccctacatgcccactgtaatagagcacctcgagcgccttcagcgcaaacacggtggaatgctggttaggaaccctctctcgagaaacagtacccacgagatgtactggataagcaatggaacgggcaacatcgtggccagcgtaaatatggtcagccgcctactgctaaacaggttcaccatgacacacagaaggccaacgatcgagaaagacgtcgatttaggcgcaggcacacgccacgtaaacgcagagcctgaaacgcccaacatggacgtaatcggagaacgaataaagcgcataaaggaagaacacaacagtacttggcattacgacgatgagaatccatacaagacgtgggcgtaccatggatcatacgaagtaaaggcgaccggctcagcctcgagtatgatcaatggcgtcgtaaaacttcttacgaagccatgggacgtagttccaatggtgacccaaatggccatgacagataccacgccgtttgggcagcaacgcgttttcaaagaaaaggtggatacaagaacaccccggagtatgccgggaacccgccgggtgatgggtatcaccgcagaatggctctggcgcaccctcggtcgcaacaagaaaccacggctctgcacgcgcgaagagttcaccaagaaagtccgcaccaacgccgctatgggagccgtgttcacggaagaaaaccagtgggacagcgccaaagcagcggttgaggacgaggacttctggaagttggtggaccgagaacgcgaattacacaagctgggcaaatgcggctcctgcgtctataacatgatggggaaaagagagaagaagctcggcgagttcggcaaggcaaaaggaagccgagccatatggtatatgtggctcggcgcgaggtaccttgagttcgaggctctcggcttcctaaacgaagaccactggttttcgcgcgagaactcctactcgggagtagagggcgagggcctacacaaacttggctacatcctaagggacatcagtaaaatccctggcggcgcaatgtacgccgatgacaccgccggatgggacacccgaatcaccgaggacgacctacacaatgaggaaaagatcacccaacaaatggaccccgaacatagacagctggccaacgctatcttcaaactgacgtatcaaaataaagtagtcaaagtacagcggccgacccccacaggcacagtcatggatataatctcaaggaaggatcagcggggaagcggccaagtcgggacctacggcctcaacaccttcacaaacatggaggcccaactaatccggcaaatggaaggcgaaggcgtactaagcaaagcggacctcgaaaacccgcatttgcccgagaaaaagataacacagtggctggagaccaaaggagtggagcggcttaagaggatggccattagcggcgacgactgtgtcgtcaagcccatagacgaccgattcgcgaacgctctcctagccctcaatgatatgggtaaggtaagaaaagacattccacagtggcagccttcaaaaggatggcatgattggcaacaagttccattctgctcccaccattttcatgagctgatcatgaaagatggccgcaagctggtggttccctgtcgcccccaggacgagcttattgggcgagcacggatatcccaaggcgcaggctggagcctccgcgaaacagcctgcctaggcaaggcctatgcgcagatgtggtcactcatgtacttccaccgccgcgacctacgcctagccagtaacgcaatatgtagcgcggtacccgtgcattgggtcccgacgtcgagaaccacctggtctatccacgcacatcaccaatggatgacaactgaagatatgctaacagtatggaatagagtatggattgaagacaacccgtggatggaagataaaacaccagtaacaacctgggaggacgtcccttacttaggcaaacgtgaggaccaatggtgcggatcccttatcgggttaacctcacgtgcaacctgggcacaaaacatactaacagccatccagcaagtaagatcgttgatcggaaacgaagagttcttggactatatgccgagcatgaagagatttcgaaaggaagaggaaagcgaaggcgcaatctggtga

SEQ ID NO: 25901 - RNA, 9873 nt, synthetic construct
  misc_feature 1..9873: note = derived and/or modified CDS sequence (opt11) from DENV-3__KJ189284__SS-prME
  source 1..9873: mol_type = other RNA
acttcgctctgtctaatgatgatcctgcctgccgcccttgccttccacctcacctccagggacggggagccccggatgatcgtggggaagaatgagcggggaaagagcctgctgttcaagaccgcctccgggatcaacatgtgcaccctcatagccatggacctgggggagatgtgcgacgacacagtgacctacaagtgcccccacatcaccgaggtagagcccgaggatatcgattgctggtgcaacctgaccagcacctgggtgacctacggtacctgcaaccaggccggtgagcatcggcgcgacaagcggagtgtggccctcgcgccccacgtgggcatggggctggatacccgcacccagacctggatgtcagccgagggcgcctggcgccaggtggagaaggtggaaacgtgggccctgcgccacccggggtttaccatcctcgcgctgttcctggcccattacattggtacctccctcacccagaaggtggtgatattcatccttctaatgctcgtcacgcccagcatgaccatgcggtgcgtgggggtgggcaaccgcgacttcgtcgagggcctgtccggggccacctgggtggatgtggtcctggagcacggagggtgcgtgaccacgatggccaagaacaagcccaccctcgacatcgagctgcagaagaccgaggccacgcagctggcgacactccggaagctgtgcatcgagggcaagatcaccaacatcacgaccgacagccgctgccccacgcagggcgaggcggtcctgccggaggagcaggatcagaactacgtctgtaagcacacctacgtggaccgggggtggggcaacgggtgcggcctcttcgggaagggctccctggtaacctgtgccaagttccagtgcctggagcccatcgagggcaaggtggttcagtacgagaacctcaagtacaccgtgatcatcacagtccatacgggggaccagcaccaagtgggcaacgagacccagggggtcaccgccgagatcacgccccaggccagcaccaccgaggtgaccctgccagagtacggcacccttgggctcgagtgttccccacgcacgggcctggacttcaatgagatgatcttgctaaccatgaagaacaaggcgtggatggtgcaccggcagtggttcttcgacctgcccctgccctggaccagcggggctaccacggagacccccacctggaaccgcaaggagctcctggtaaccttcaagaacgcccacgcaaagaagcaagaggtggttgtcctcgggtcccaagagggcgccatgcacacggcgcttaccggggctaccgagatccagaacagcggcgggacctccatcttcgctgggcacctgaagtgccggctgaagatggataagttagagcttaagggcatgagctacgccatgtgcacgaacaccttcgtgctgaagaaggaggtctccgagacccagcacgggacgatcctcatcaaggtcgagtacaagggcgaggacgccccgtgcaaaatcccatttagcacggaggacgggcacggcaaggcgcacaacgggcgcctgatcaccgccaaccccgtggtgacaaagaaggaggagcccgtcaacatcgaggccgagccgccctttggggagtcgaatattgttataggcattggggacaacgccctgaagatcaactggtataagaagggctccagtatcgggaagatgttcgaggcgaccgcaagaggggcccgccggatggccatactgggtgacacggcctgggacttcgggagcgtgggcggggtcctcaattcactggggaaaatggtacaccagattttcgggtccgcctacaccgccctgttcagcggcgtgtcctgggtaatgaagatcggcatcggggtgcttctgacgtggatcggcctgaacagcaagaacacctccatgagtttctcttgcatcgcaatcgggatcatcaccctctacctgggcgcagtggtccaggcagacatggggtgcgtgatcaactggaagggcaaggagctgaagtgcggctcagggatctttgtgaccaacgaggttcatacctggaccgagcagtacaagttccaggcggactcccccaagcgcctcgccacggccatcgcgggcgcctgggagaacggggtgtgcggcatccggagcaccacccggatggagaacctgctgtggaagcagatcgcgaacgagctcaattatatcctgtgggaaaacaacatcaagctgaccgtggtcgtgggggacatcatcggcgtgttagagcagggcaagcgcacgctgacgccccagccgatggagctgaagtactcctggaagacgtgggggaaggccaagatcgtcaccgccgaaacacagaacagctccttcataatcgacggccccaacacccccgagtgccccagcgcctcccgggcgtggaacgtgtgggaggtggaggactacgggtttggcgtattcactaccaacatctggctccgcctacgggaggtgtatacccagctgtgtgatcaccgcctcatgagcgccgcggtgaaggacgagcgggccgtccacgccgacatgggctactggatcgaaagccagaaaaacgggtcctggaagctggagaaggcgtcactgatcgaggtgaagacgtgcacgtggccgaagtcccacaccctttggtcaaacggcgtgttagagtccgacatgatcatcccgaagagtctggccgggcccatctcccagcacaaccaccgcccgggctaccacacccagacggccgggccctggcaccttggcaagctggagctggacttcaactactgtgagggcaccaccgtagtgatcacagagaactgcggaacgcggggacccagcctccggaccaccaccgtgtccgggaagctgatccacgagtggtgctgccgcagctgcacactgcccccgctccgctacatgggcgaggacgggtgttggtacggaatggagatccggcccatctccgagaaggaggaaaacatggtcaagagcctggtgtccgccggcagcgggaaagtggataattttaccatgggcgtcctgtgcttagccattctgttcgaagaggtgatgcgagggaagttcggcaaaaagcacatgatcgcgggggtgttcttcaccttcgtcctgctactatccggccagatcacatggcgggacatggcacacacgctgatcatgatcggcagcaacgcctccgaccgcatgggcatgggcgtgacctacctcgccctaatcgccaccttcaagatccagcccttcttggcgctcgggttcttcctgcgaaagttgacctctcgcgagaatctcctgctgggcgtgggcctggccatggccacgaccctgcagctccccgaggacatcgagcagatggccaacgggatcgcgttaggcctgatggccctgaagctgatcacgcagttcgagacctatcagctttggacggccctgatcagcctaacctgctccaacaccatatttaccctgacggtcgcttggcggaccgccacccttatcctcgcgggagtgagcctcctgccggtctgccagtccagctccatgcgcaaaaccgactggctccccatggccgtggccgccatgggcgtgccgcccctaccgctgttcatcttcagcctcaaggacacgttgaagcgccggtcctggcccctgaacgagggagtcatggccgttggcctcgtgagcatcctggcgagtagcctcctccgtaacgacgtcccaatggccggccccctggtggcagggggcctgctcatcgcctgctacgtcatcaccgggacctccgctgatctgaccgtcgagaaggccgcggacatcacgtgggaggaggaggccgagcagaccggagtgagccataacctgatgatcaccgtggacgacgacggtacgatgcggatcaaggacgacgagaccgagaacatcctcactgtcctgctgaagaccgccctgctgatcgtgagcggcatcttcccgtactcaatccccgccaccctcctcgtgtggcacacctggcagaagcagacgcagcgctccggcgtcctgtgggacgtgccgagcccgcccgagacccagaaggctgagctggaggagggggtttaccggatcaagcagcagggcatcttcggtaaaacccaggtcggggtaggggtgcagaaggagggcgtctttcacaccatgtggcatgtgactcgcggcgccgtgctcacatacaacgggaagcggcttgagcctaactgggcctccgtcaaaaaggacttaatcagctatggcgggggctggcgcctctccacccagtggcagaagggggaggaggtccaggtgatcgctgtcgagcccggcaagaaccccaagaattttcagaccatgcccggcacattccaaaccaccaccggagagatcggcgcgatagctttagacttcaagccggggacgtctggcagccccatcatcaaccgggaggggaaagtggtgggcctgtacggcaacggagtcgtgaccaagaacggcgggtacgtgagtggcatagcccagaccaacgcagagccggacgggcccacccccgagctggaggaggagatgttcaagaagcgcaacctcactataatggacctgcacccggggagcggcaaaacacggaagtacctgccggcaatagtccgagaggcgataaaacggcgccttcggacgctgatcctggcacctacccgcgttgtggccgccgagatggaggaggccctcaagggcctgcccatccggtaccagacgaccgcgaccaagagtgagcataccggccgcgagatcgtcgacctgatgtgccatgccactttcaccatgcgactcctgagccccgtgagagtgccgaactacaacctgatcatcatggacgaggcccatttcactgaccccgcctccatcgccgcgcggggatatataagcacccgcgtaggcatgggcgaggccgccgccatcttcatgacggccacgccacccggtactgccgacgccttcccgcagtccaatgcccccatccaggacgaggagcgcgacatccccgagcggagctggaactccggcaacgaatggatcaccgacttcgccgggaagacggtgtggttcgtgcccagcatcaaggcgggcaacgacatcgccaactgtctcaggaagaacgggaaaaaggtcatccagctgtccaggaagaccttcgacaccgagtaccagaagaccaagctgaacgattgggacttcgtggtcaccaccgatatcagcgagatgggcgccaacttcaaggccgaccgcgtcatcgacccgcggcgctgtttaaaacccgtgatcctgaccgacgggcccgagcgggtgatcctggccggtcccatgccggtcaccgcggcctccgccgcccagcgccggggccgcgtgggtaggaacccccagaaggagaacgaccaatacatcttcacaggccagccgctcaataacgacgaggatcacgcccattggacggaggcgaagatgctgctggacaacatcaacacccccgaggggatcatcccggccctcttcgaacccgagcgcgagaagtccgccgccatcgacggcgagtaccggcttaagggcgagtcccgtaagaccttcgtggagcttatgcggcgcggggaccttcccgtctggctggcccacaaagtagctagcgagggcatcaagtacaccgaccggaagtggtgcttcgacgggcagaggaacaaccagatcctcgaagagaacatggacgtcgaaatctggacgaaggaaggcgagaagaagaagctccggccccgttggctggacgcccgcacctactccgacccgctggccctcaaggagttcaaggatttcgcagcaggccgcaaatcgatcgcgctggacctggtgaccgagatcgggcgcgtcccgtcccacctcgcccaccggaccagaaatgccctggacaacttggtgatgttacacacgagcgagcacggcgggcgggcctaccgccacgccgtcgaggaactgcccgagaccatggagaccctgctcctgctgggcctcatgatactgctgaccgggggcgccatgcttttcctgatcagcggcaaggggatcggtaaaacgtccatcggactgatctgcgtgatcgccagctccggcatgctctggatggccgagatcccgctgcagtggatcgccagcgcgatcgtcctggagttcttcatgatggtgctgctgatccccgagcccgagaaacagcggacgccccaggacaaccagctggcttacgtggtcatcgggatcctcaccctggccgccatcatcgcagcgaacgagatggggctgctcgaaaccacaaagcgcgacctgggaatgtccaaagagccgggggtggttagccccacctcctacctagacgtcgatctccaccccgcctcagcatggacattatacgccgtggcgaccacggtgatcacacctatgctgcgacacaccatcgaaaattcaaccgcgaatgtcagcctcgcggcaatcgccaaccaggcggtggtgctgatgggcctggacaaggggtggccgatctccaagatggacctcggcgtccccctgctggctttagggtgctacagccaggtgaaccccctgacgctgaccgccgcggtgctcctgctgattacacactacgccataatcggccccggccttcaggcgaaggccacccgcgaggcccagaagcggacggccgcggggatcatgaagaaccccaccgtcgacggcatcatgaccatcgacctggaccccgtgatctacgactccaagtttgagaagcagctgggccaggtaatgctactggtcctgtgcgcggtgcagctcctgctgatgcgaacctcctgggccctttgcgaggccctgacgctggccaccgggcccatcaccaccctctgggagggctcccccgggaaattctggaacacgaccattgccgtgtccatggcaaacatcttccgcgggtcctacctggcgggggccggcctggccttctcgatcatgaagtcggtggggaccgggaagcgtggcaccgggagccagggggagaccctcggggagaagtggaagaagaagctgaaccagctgagcaggaaggagttcgacctatacaagaagtccggcatcacggaagtggaccgcaccgaggcgaaggaggggctgaagcggggcgagatcactcaccacgccgtgagccgcggttccgccaagctgcagtggttcgtcgagagaaacatggtaatcccggagggaagggtgatcgacctcggctgcggacgaggagggtggagctactactgcgcaggcctgaagaaggtcaccgaggtgcgcggctacacgaagggcggccccgggcacgaggagcccgtgcccatgtccacctacggctggaacatcgtcaagctgatgagcgggaaggacgtcttctacctcccgcccgagaaatgcgacaccctgctttgcgacataggcgagtctagcccctcccccactgtggaggagagccgcacgatccgggttctgaagatggtggaaccgtggctcaagaacaaccagttctgcatcaaggtcctgaacccctacatgccgaccgtcattgagcacctagaacgcctccagcgcaagcacggcgggatgctggtgagaaaccccctgtccaggaacagcacccacgagatgtactggatcagtaacggcaccgggaacatcgttgccagcgtcaacatggtgtcccgcctcctgttgaaccggttcacgatgacacaccgacggccgacaatcgagaaggatgtggacctaggcgcgggcacccgccacgtcaacgccgagcccgagacgcccaatatggacgtgattggggagcggattaagcgcatcaaggaggagcacaacagcacctggcactacgacgacgagaacccgtacaagacctgggcctaccatggctcctacgaggtgaaggccaccgggtcagcctccagcatgatcaacggcgtcgtaaaactcctgactaagccctgggatgtcgtgcccatggtgacccagatggcgatgaccgataccacgccgttcgggcagcagcgggtattcaaagagaaggtggacacccgtaccccgcggagcatgcccggtacccgcagggtgatgggcataacggccgagtggctctggcgcaccctggggcggaataagaagccacgcctgtgcacacgcgaggagttcaccaagaaggtccggacgaacgccgccatgggagcggtatttactgaggagaaccagtgggactccgccaaggccgccgtggaggacgaggacttctggaagctcgtcgaccgcgagcgagaactgcacaaactggggaagtgcggcagctgcgtgtacaacatgatggggaagcgcgagaagaagctaggcgagttcgggaaggccaagggatcccgggcaatatggtacatgtggctgggcgcccgctatctggagttcgaggccctggggtttcttaacgaggaccactggttcagcagagagaacagctactcaggcgtggagggggaaggccttcacaagttgggctacatcttgcgcgacatctccaagatccccgggggcgccatgtacgccgacgataccgcggggtgggatacgcggatcacggaggacgacctgcataacgaggagaagatcacccagcaaatggaccccgagcaccgccagctcgccaacgccatcttcaagctgacttaccaaaacaaggtcgtgaaggtgcagcggcccaccccgaccggcacggttatggacatcatcagccgcaaggaccagcggggctctggacaggtgggcacctacgggctgaacaccttcaccaacatggaggcccagctcatccgacagatggaaggcgagggggttctgagcaaggccgacctggagaacccccacctcccggagaagaagatcacacaatggctggagacaaagggcgtcgagcggctgaagcgcatggcgatctccggggacgattgcgtggtgaagccaatcgatgaccggttcgccaatgccctcctggccctgaacgacatggggaaggttcgtaaagacatcccccagtggcagccaagcaagggctggcacgattggcagcaggtcccgttctgctcccaccacttccacgagctcatcatgaaggatggtcggaagctggtggtcccctgccgcccccaagacgagctgatcggccgggcccgcatcagccagggggcgggctggtcgttacgcgagaccgcctgcctgggcaaagcctacgcccagatgtggagcctgatgtactttcatcggagggacctcaggctggcgtccaacgccatctgcagcgctgtgcccgtgcattgggtcccgacatcccgcacgacctggagcatccacgcccaccaccagtggatgactaccgaggacatgctgacggtgtggaaccgggtatggatagaggacaacccctggatggaggacaagacccccgtcacgacctgggaggacgtgccctacctcgggaagcgcgaggaccagtggtgcggcagcttaatcgggctgacgtcccgagccacctgggcgcagaacatccctaccgccatccagcaagtccggagcctcatcggcaacgaggagttcctggactacatgccctcgatgaagcggttccgcaaagaggaagagagcgagggggccatctggtga

SEQ ID NO: 25902 - RNA, 9873 nt, synthetic construct
  misc_feature 1..9873: note = derived and/or modified CDS sequence (opt11) from DENV-3__KJ189286__SS-prME
  source 1..9873: mol_type = other RNA
acttccttctgcctgatgatgatacttcccgcggccttggccttccatcttacatcaagagacggtgagccgcggatgatcgtggggaagaacgaacgcggtaagagcctcttgttcaagaccgcaagcggcatcaacatgtgcaccctgatcgccatggacctgggcgaaatgtgcgacgacacggtgacctataagtgcccccatattaccgaggtagaacccgaggacatagattgctggtgcaatctgacctctacctgggtgacgtacgggacctgtaaccaagcaggcgaacaccggcgcgacaagcggtccgttgccctggcgccccatgtgggcatggggctcgacacccgcacccagacctggatgagcgccgagggcgcctggcgccaagtggagaaggtggagacgtgggccctgcgccacccggggttcacaattctggccttgtttctcgcccactacatcggcacctctctcacgcaaaaggtggtcatcttcatcctcctgatgctggtcacgcccagcatgaccatgcgctgcgtaggcgtgggcaaccgcgacttcgtcgagggcttgtccggtgccacttgggtggacgtggttttagagcatggcggctgcgttaccacaatggccaagaataagccgaccctagacatagagctccagaagactgaggccacccagctggctacgctaaggaagctctgcatcgaaggtaagatcaccaacatcacaactgacagccgctgccccacgcagggagaggccgtgctgccggaggagcaggaccagaactacgtctgcaagcatacatacgtcgatagggggtggggcaacgggtgcggtctgttcgggaagggctccctcgtgacctgcgccaagttccagtgcctcgagccaatcgagggcaaggtcgtgcaatacgaaaaccttaagtataccgtgatcatcacggtccacacaggggaccagcatcaggtgggcaatgagacccagggagtcaccgcagaaatcacgccccaggccagcacaaccgaagcgaccctcccagaatacggaaccctgggtctggagtgctccccacgtacagggctggatttcaacgagatgatcctactgaccatgaagaataaagcctggatggtgcacaggcagtggttcttcgacctccccctgccatggacctcgggcgctaccaccgagacccccacctggaaccgcaaggagctgctcgttaccttcaagaacgcccacgccaagaagcaagaggtcgtagtgctagggtcccaagagggagcgatgcacacagccctgaccggggccaccgagatccagaacagtggcggcacctccatcttcgctggtcatctcaaatgccggctgaagatggataagttagagctcaagggcatgagttacgccatgtgcacgaataccttcgtcctgaagaaggaggtgtccgaaacccagcacggaaccattctgatcaaggtggaatacaagggcgaggacgcgccctgcaagatccccttctccacagaggacgggcacgggaaagcccacaacggacgcctcattaccgcgaaccccgtcgtaactaagaaggaggaacccgtgaatatagaagccgaaccgcccttcggggagtcaaacatcgtcatcggcatcggggataacgctctgaagatcaactggtacaagaaaggcagcagtatcgggaaaatgttcgaagcgaccgcccggggcgcccgccggatggccatccttggtgacacggcttgggacttcgggagtgtgggcggagtcctgaactcactcggcaagatggtccatcaaattttcggatccgcctacaccgccctgttctcaggcgtgtcctgggtgatgaagataggaatcggggtcctgcttacctggatcggcctgaatagcaagaacacctccatgtcgttctcctgcattgccatagggatcatcacgctttacctcggagcagtggtacaggcggacatggggtgcgtcatcaactggaaaggcaaggagctgaagtgcggcagcgggatcttcgtgaccaacgaggtgcacacctggaccgagcagtataagttccaggccgattcgcccaagcgtctagcgactgccatagccggcgcgtgggagaatggggtctgcggcatccgcagcaccacccggatggagaacctcctatggaagcagatcgccaacgagctaaattacattttatgggagaacaacatcaagctgacagtggtagtgggggacataatcggtgtgctggagcagggaaagcgcaccctcacgccccagcccatggagttaaagtactcctggaagacctgggggaaggccaagatcgtgacggccgagacgcagaacagctcctttataatcgacggcccaaacacccccgagtgccccagcgcgtcccgggcatggaacgtctgggaggtggaggactacgggttcggtgtgtttaccactaacatctggttgcgcctccgggaggtctacacccagctgtgcgaccaccgcctgatgtcggccgcggtgaaggacgagcgggccgtgcacgcggacatgggctactggattgagagccagaagaacgggtcctggaagctcgagaaagcctctctgattgaagtcaagacctgcacttggccgaaatcccacaccttgtggagcaacggcgtgctggagtccgatatgatcattcccaagagcttagccggaccaatcagtcagcacaaccatcgacctggataccatacccagaccgccgggccctggcacctggggaagttggagttggacttcaattactgcgagggcactaccgtggtcatcactgagaactgcgggacgcggggcccgagcctgcgcaccaccacagtgtcagggaagctcatccacgagtggtgttgccggagctgcacgctgccccccctgcgctacatgggcgaggacgggtgctggtacggcatggagatccgccccatctcagagaaggaggagaacatggtgaagtcccttgtgagcgccggctcggggaaggtagacaattttaccatgggcgtgctgtgcctggcgatcctctttgaggaggtcatgagaggcaagttcggcaagaagcacatgatcgccggtgtgtttttcaccttcgtgctgttactgtccgggcagattacttggcgggatatggcacacacgctgattatgatcggctcaaatgcctccgaccgtatgggaatgggcgtcacatacttggccttaatcgcgacattcaagatacaaccctttctggccctggggttcttcttacggaagctgacctcacgtgaaaatctgttgctgggtgtggggctcgccatggccacaaccctacagctgcccgaggacatcgagcagatggcgaacgggatcgcactgggtctcatggcactgaagctgatcacccagttcgagacctaccaactctggacggctctgatcagcctgacctgctccaacacaatcttcaccctcacggtggcctggcggaccgcgaccttaattttagccggagtcagtctcctgccggtgtgtcagtcaagctccatgagaaagaccgactggctgcccatggcggtcgcagcgatgggcgtgccgcccctccccttattcatcttcaacctgaaggatacgctcaagcgccggagctggcccctcaacgagggggtgatggcggtcggcctggtgtccatcctcgccagctccctactgcgcaacgatgtgcccatggccggtcccctcgttgcgggaggcctgctgatcgcatgctacgtcatcaccgggaccagcgcggacctcaccgtggaaaaagccgccgacatcacgtgggaggaggaggccgagcagactggcgtctcccataacctgatgattaccgtagacgacgacgggaccatgcggattaaggacgacgagaccgagaacattctgacggtgcttctgaagactgcgctgctcattgtaagcggcatcttcccctactccatacccgcaacccttctggtatggcacacctggcagaagcagacgcagaggagcggagtgctctgggacgtaccctcacctccggagacgcagaaggccgagctggaggaaggcgtgtaccggatcaagcaacagggtatcttcggaaagacccaggtgggcgtcggtgtgcagaaggagggtgtatttcacaccatgtggcacgtcacacgcggcgccgtgctgacctacaacgggaaacggctcgaacccaactgggcgagcgtgaagaaggacctgatctcctatggtgggggctggcgcctgtccacccagtggcagaaaggggaggaggtccaggtgatagcggtggagcccggcaaaaaccccaagaacttccagacgatgcccggcacgtttcagacgaccaccggtgagatcggcgccattgccttagacttcaagccggggacttcaggatcgcccatcataaaccgggaaggcaaggtcgtggggctgtacggcaacggggtggttaccaaaaacggcggctacgtgagcggcatcgcccagaccaacgccgagccggacggccccacccccgaactggaggaggagatgttcaagaagcgcaacctgacgatcatggacctccaccctgggtccggtaagacgagaaagtacctgccggcgatcgtgagggaagccattaaaagacgcctgcggaccttgatcctggctccaacccgcgtcgtggccgctgagatggaggaggcgctgaaagggctccccattcgttatcagacgaccgccaccaagtcggagcacactggtcgcgagatcgtagacctgatgtgccatgccacgttcacaatgaggctgctctccccagttcgggtgccgaactacaacctaataatcatggacgaagcacacttcaccgatccagccagcatagcggcccgggggtacatctctactcgcgtaggtatgggcgaggccgccgcgatcttcatgacggccacgccgcccgggaccgccgacgccttcccacagtcgaacgcccccatccaagacgaggagcgcgacatccccgagcggtcctggaacagcggcaacgagtggatcactgacttcgcagggaagacggtctggttcgtgccctccattaaagccgggaacgacatcgccaactgcctgcggaagaacggcaagaaggtgatccagctcagcaggaagaccttcgacacagagtatcaaaagaccaagctgaacgactgggacttcgtcgttacgaccgacatctccgaaatgggcgccaatttcaaagcggaccgcgtaatcgacccgcgccgctgcttgaaacccgtaatcctcaccgacgggcccgagcgggtgatcctggcggggcccatgccggtgacagcagccagcgccgcccagcgccggggcagagttgggcggaacccgcagaaggagaacgaccagtacattttcaccggccagcccctgaacaatgacgaagaccacgcacactggactgaggccaagatgctcctggataacataaatacgcccgaagggataatcccggccctgttcgagcccgaacgcgagaagtctgcggctatcgacggggagtaccggctcaagggcgaaagccgcaagacttttgtggaattaatgcggcgcggggacctgcccgtgtggctcgcccacaaggtcgcttccgagggcatcaagtacaccgacagaaagtggtgctttgacgggcagagaaacaaccagatcctggaggaaaacatggatgtggagatctggacgaaggagggcgaaaagaagaaactcaggccgcgctggctcgacgctcgtacctacagcgaccctctggccctgaaggagttcaaggactttgcggccggcaggaagtccatcgccctcgacttggtcaccgagatcgggcgcgtgcccagccatttagcccaccggacccgtaacgccctcgacaacctggtgatgctgcacacgtctgagcacggcgggcgcgcttaccgacacgccgtcgaggaattgccggagaccatggagaccctgctgctcctgggcctgatgatcctcctcaccgggggagctatgctgttcctcatcagcgggaaggggatcggcaagacgtcaattgggttaatctgcgtcatcgcatccagtggtatgttatggatggcggaaatccccctacagtggatcgcatccgctatcgtgctggagttcttcatgatggtcctgctcatccccgagccagagaaacaaagaacgccccaggacaaccagttagcctacgtggtgatcgggatcctgaccctcgccgccatcatagcggccaacgagatgggcctgttggagaccactaagcgcgacttgggcatgagcaaggagccgggcgtggtgtccccaaccagctacttggacgttgacctgcatccagcttccgcgtggacactctacgctgtcgccactactgtaatcactcctatgcttcgccacactatcgagaacagcaccgctaacgtttccctggccgcaatcgcgaaccaagccgtcgtgctcatgggcctagacaaagggtggcctatctcgaaaatggacctgggcgtgcccttgctggccctggggtgttattcccaggtcaaccccctcacgcttacagccgccgtgctgctcctcatcacgcactacgcgataatcggccccggcttacaggccaaggcgacccgcgaagcccagaagcggacggccgcagggatcatgaagaacccaaccgtggacggcatcatgactatcgacctcgaccccgtcatctacgacagcaaattcgagaagcagctgggccaggtaatgttactcgtgctgtgcgccgtccagctgctcttgatgcgcacctcctgggccctatgcgaggccttgaccttagctaccggtcccatcacgaccctgtgggagggctcacccgggaagttctggaatacgaccatcgcagtgtccatggccaacatcttccgtggtagctacttagccggcgccggcctggcgttctccatcatgaagtctgtggggacaggcaagcgcggcaccgggtcccagggtgaaaccctgggggagaagtggaagaagaaactcaaccaactgagccggaaagaattcgacctatacaagaaatcgggcatcactgaggtcgaccgcaccgaggccaaggaggggttaaagcggggtgaaatcacccatcacgccgtgtcccgcggctccgccaagctgcagtggttcgtggagcggaacatggtcatcccggaggggcgagtgatcgacctgggatgcggacggggggggtggagttactactgcgccggtctgaagaaggtgaccgaggtccgcggctacactaagggcgggcccgggcacgaagagcccgtgcccatgagcacctacggctggaacatcgtgaaactaatgtccgggaaggacgtcttctatctgccgcccgagaagtgtgacaccctcctgtgcgatatcggagagtcatcccccagccccaccgtggaggagtccagaacgatccgggtgctgaagatggtagagccgtggctgaagaacaaccagttctgcatcaaggtgctcaatccctacatgcccaccgtgattgagcaccttgagcgcctgcagcggaaacacgggggtatgctcgtccggaaccccctgagccgtaacagtacccacgagatgtactggatcagcaacggcacagggaacatcgtggcgtcggtgaacatggtctctagactgttgttaaaccggtttacgatgactcaccgacggccaaccattgagaaggatgtagatctgggggcgggcacccgacacgtgaatgccgagcccgaaacgcccaatatggacgtcatcggggagcgtatcaagcgcatcaaggaggagcacaactccacctggcactacgatgacgagaatccgtataaaacctgggcctaccacggctcgtacgaggtgaaggccacagggtctgcgagctccatgatcaacggcgtggtcaagctcctgacgaagccctgggatgtcgtccccatggtcacccagatggctatgaccgacaccacgccctttgggcagcagcgtgtattcaaggagaaggtcgacacgcggacaccgcggtctatgccgggcacccgccgggtaatgggcatcacggccgagtggctgtggcgcacgcttggacggaataagaagccccgcctgtgcactcgggaagaattcaccaagaaggttcggaccaacgccgcgatgggcgcggtcttcaccgaggagaatcagtgggactcggcgaaggccgcggtcgaggatgaggatttctggaagttagtggacagggagcgcgagctccacaaactagggaagtgcgggtcctgcgtctataacatgatggggaagcgcgagaaaaaactgggcgaattcggcaaggcgaaggggagccgggccatatggtacatgtggctcggcgcgcgctatctcgagtttgaggccctggggttcttaaacgaggaccactggttctctcgggagaacagctactccggcgttgagggggaaggactgcacaaactgggctacattctccgcgacatcagcaagatacccgggggcgccatgtatgcggatgacaccgcggggtgggacacccggatcacggaggacgacctgcataacgaggagaagataacccagcaaatggacccggaacaccgccagctggccaacgccatcttcaagctcacctaccagaacaaagtggtcaaggtgcagcggcccaccccaaccggcacggttatggacatcatctcccgcaaagaccaacggggttcaggtcaggtcggcacctacgggctgaataccttcaccaatatggaggctcagctgatccgccagatggagggcgagggcgtgctctccaaggccgacctggagaacccccacctccccgaaaagaagatcacgcagtggttagagaccaagggcgtggagcggctaaaacgaatggccatctccggcgacgactgcgtcgtgaagcccatagacgaccggttcgccaacgcgcttcttgccctcaacgacatggggaaggtgcgaaaggacatcccccagtggcagccctcgaagggctggcacgactggcagcaggtcccgttctgcagtcaccacttccacgagctgatcatgaaggacgggcggaagctcgttgtgccctgccgcccccaggacgagctaatcggccgggcccgcatatcccagggggccggctggagcctgcgcgagaccgcttgtctcggcaaggcctacgcgcagatgtggtccctgatgtatttccacaggcgcgatctgcggcttgccagcaatgccatctgttccgccgtccccgttcactgggtgccgacgtcgcgcacgacatggtccattcacgcccaccaccagtggatgaccacggaggatatgctgacggtctggaacagagtgtggattgaggacaacccctggatggaggacaagactcccgtaaccacctgggaagacgtcccctatctcgggaagcgcgaggaccagtggtgcggctccctcattggtctgacgagccgggccacctgggcccagaatatcccgaccgccatccagcaagtccgttccctcatcggcaacgaggagttcctcgactacatgcctagtatgaaacggttccgcaaagaagaagagtctgagggcgcgatctggtag

SEQ ID NO: 25903 - RNA, 9873 nt, synthetic construct
  misc_feature 1..9873: note = derived and/or modified CDS sequence (opt11) from DENV-3__KJ189287__SS-prME
  source 1..9873: mol_type = other RNA
acctctctctgcctcatgatgatactgcccgccgcgctcgcgttccacctcacctcacgggacggggaaccccggatgattgtcgggaagaacgagcgaggcaagagtctactgttcaagaccgcctccgggatcaatatgtgcaccctcatcgccatggatcttggcgagatgtgtgacgacactgtgacctacaagtgcccccatataacagaggtggaacccgaggacatcgactgctggtgcaatttgaccagcacgtgggtgacctacggaacctgcaaccaggccggcgaacaccggcgtgacaagcggtccgtggccctcgcgccccacgtaggcatgggtctggacactcgcacccaaacctggatgtcagccgagggcgcctggcgccaggtggagaaagtagagacgtgggccctgcgccacccggggttcaccattcttgctctgttcctggcccactatatcggcacctccctcacgcagaaggtggtgatcttcatcctgctgatgctagtaaccccaagcatgaccatgcggtgtgtaggggtgggtaaccgcgacttcgtcgaaggtctctccggggccacctgggtggacgtggtccttgagcatggcggttgcgtgaccactatggccaagaacaagcccaccctcgacatcgagcttcagaagaccgaagccacccagctggcgacattacggaaactttgcattgagggcaagatcaccaacataaccaccgactcacgttgccccacgcagggcgaggcggtcctcccggaggaacaagaccagaactatgtgtgcaagcacacctacgtggaccgaggatggggtaacggctgcggcctgttcggcaagggctccctggtaacctgcgcaaagtttcagtgcctggaacccattgaggggaaggtcgttcagtatgagaacctcaagtacaccgtgatcataacagtccacaccggtgaccagcaccaggtcggcaacgagacccagggagtgaccgcagaaatcacgccacaggccagcacgaccgaggccacactgccagagtacggcaccctggggctggagtgttccccgcgcaccggcctggacttcaatgagatgatcctgctcaccatgaagaacaaggcctggatggtgcatcggcaatggttcttcgacctgcccctgccctggacctccggcgctaccacggagactcccacctggaaccgtaaggagctcctggtgaccttcaaaaatgctcacgccaagaagcaggaggtcgttgttctggggtctcaagagggcgcgatgcacacggcactgaccggggccaccgaaatccagaatagcggcgggacctccatcttcgccggtcacctgaagtgccggctcaagatggacaagctcgagttgaaaggcatgtcttatgccatgtgcaccaacaccttcgtcttgaagaaggaggtttccgagacccagcacggaacgatccttatcaaggtggagtataagggggaggacgcgccgtgtaagatccccttctctacggaggatggccacgggaaggcccacaatggccgcctcatcaccgcaaaccccgtcgtgaccaagaaagaggaaccggtgaatatcgaagctgaaccgccttttggagagagcaacatcgtaatcggcatcggggacaacgcgctgaagatcaactggtacaagaagggcagtagcattgggaagatgttcgaggccaccgcccggggcgcgcgtcggatggccattctgggcgacacggcgtgggacttcggctccgtaggcggggtgttaaactctctaggcaagatggtccaccagatcttcgggtccgcttacaccgccctgtttagcggcgtgtcctgggtgatgaagatcggcatcggggttctcctcacctggataggattaaactccaagaatacctctatgagcttctcgtgcatcgccatcgggatcatcactctctatctgggcgccgtagtgcaggctgacatggggtgcgtcattaactggaaggggaaggagctgaagtgcggcagcggtatcttcgtgaccaacgaggttcacacatggaccgaacaatacaaattccaggctgatagccccaagcggctcgccacggccatagccggcgcgtgggagaacggggtctgcggcatccggtcaactacacggatggaaaacttgctgtggaaacaaatcgcaaacgagctaaactacatcctgtgggagaacaatatcaagctgaccgtagtggtcggggacatcatcgggatccttgagcaaggcaagcgcactctgacgccccagccgatggagctgaagtactcatggaagacctgggggaaggccaagatcgtgaccgctgagacgcagaacagctccttcataattgacggccccaacacccccgagtgccccagtgcgtcccgggcctggaatgtgtgggaggtcgaagactacgggtttggcgtgttcacgaccaacatttggctccgcctgcgggaggtgtacactcagctgtgcgaccaccgcctaatgagcgcggccgtcaaggacgagcgagcagtccacgcggatatgggatactggattgaaagccaaaagaacgggagctggaaacttgagaaggccagcctgatcgaggtgaagacgtgtacctggccgaagtcccacaccttatggagtaacggtgtcctggaatccgacatgatcattccaaagagcctggccggccccatctcccagcacaaccatcgcccaggctaccacacccagaccgccgggccgtggcacctcgggaagctggagctagatttcaactactgtgagggcacaaccgtggtgatcacagagaattgcggcacgcggggcccctccctccggaccaccaccgtctccgggaagctgatacacgagtggtgttgtcgctcatgcacactacccccgcttcgctacatgggagaagacgggtgctggtacggtatggaaatccggcccatctccgagaaggaggagaacatggtcaagagcctagtgtccgccggcagcgggaaggtcgataatttcaccatgggcgtgctgtgcctggcgatcctgttcgaggaggtcatgcgcgggaaattcggcaagaagcacatgatcgctggggtcttcttcactttcgtgctacttcttagcggccagatcacttggcggaacatggcccacactcttatcatgatcggcagcaacgcctccgaccgcatggggatgggcgttacctacctcgccctaatcgcgaccttcaagatacagccttttctggtgctgggtttcttcttgagaaaattaaccagccgtgagaacctcctgttaggtgtcggcctagcgatggccacgaccctacagctacccgaagacatcgagcagatggcaaacgggatcgcgctcggccttatggccctgaagctcattacccagtttgagacctaccaattatggacggccctgatttcactgacatgctccaacaccatcttcaccctgacggtggcctggaggaccgctacgttgatcctcgcgggggtcagcctgctgccggtgtgccagtccagctccatgcgcaagaccgactggctccctatggcggtcgccgcaatgggcgtgccacccctccctctattcatctttagcctcaaggacacgctaaagcgccggtcctggccactgaatgaaggtgtgatggccgttggactcgtgtccatactggcgtcctcgctgctccgcaacgacgtgcccatggctggccccttagtcgctgggggcctgctcatcgcgtgctacgttatcaccgggaccagcgccgacctgaccgtggagaaggccgccgacataacctgggaagaggaggccgaacagacgggcgtgtctcacaacttaatgatcaccgtggacgacgacgggacaatgagaatcaaggacgatgagaccgaaaacattctcacggtcctgctgaagacggccctcctgattgtcagtggtatctttccgtactcaatccccgccaccctgctcgtgtggcacacttggcagaaacaaacacagcgctccggcgtgttgtgggacgtccccagcccgccggaaacccagaaggcagagctagaggagggagtgtacagaatcaaacaacaaggcatctttgggaagacccaggtgggcgtcggagtgcagaaggagggcgtattccataccatgtggcacgtcacgcgcggcgcggtgctaacctataatgggaagcggctggagcctaattgggctagcgtgaagaaggaccttattagctacggcgggggctggcgcctctccacccagtggcagaaaggggaggaggtccaagttatcgccgtggaaccggggaaaaacccaaagaacttccagacgatgcccgggacgttccagaccactacgggggaaatcggcgcgatcgccctggacttcaaacccggcacgagcggcagcccgatcataaaccgggagggcaaggtagtagggctgtacggtaacggggtcgtcaccaagaatggagggtatgtgtccggcatcgcccagactaatgcggaaccagacggccccacacccgagctggaggaggagatgttcaaaaagcgcaacctcacgatcatggaccttcaccctggttctggcaagacccgtaagtatttgccggccattgtgagagaggcaatcaagagacgtctccggaccctgatcctggccccgacccgcgtggtggccgctgagatggaggaggccctcaaggggctgcccatccggtaccagacgaccgcgacaaaatccgagcacacggggcgcgaaatagtagatctgatgtgccacgccaccttcacgatgcggctcctgagccccgtccgcgtgccgaactacaacctaatcatcatggacgaggcccatttcaccgaccccgcctccattgccgctcgggggtacatcagcacgcgcgtgggtatgggcgaggccgctgccatcttcatgacggccacgccgccgggtacggctgacgcctttccacagtctaacgcccccatccaggacgaggagcgcgacattcctgagcggagctggaactccggcaacgagtggatcaccgacttcgccggtaaaacggtctggttcgtgcccagtatcaaagcgggcaacgacatcgcgaactgcctccgcaagaacgggaagaaggtaatccagttatcccggaaaacgttcgacaccgagtatcagaagaccaagctgaatgactgggacttcgttgtgactaccgacatcagtgagatgggcgccaacttcaaggccgaccgtgtcatagacccgaggcgctgtctcaagccggtcatcctgaccgacggccccgagcgtgtgatactagccgggcccatgcccgtgaccgctgcttccgcggcccagcgccgtggccgcgtcggcaggaacccccagaaggagaacgaccagtacatcttcactggccagcccttgaacaacgatgaagaccatgcccactggacggaggcaaagatgcttctggacaacatcaacacccccgaggggatcatcccggccctcttcgagcctgagcgcgagaaatccgccgcaattgacggcgagtaccggctgaagggggagtcccgcaagacctttgtggagctgatgcggcgcggggatcttcccgtctggttggctcacaaggtcgccagcgagggcatcaagtacaccgaccggaagtggtgcttcgacgggcagcgcaacaaccagattctagaggagaacatggacgtagagatctggactaaggagggcgagaagaagaagctacggccgcgctggctagatgcacgcacctactcggacccgctggccctcaaggagttcaaagactttgccgcgggccgcaagagcattgcccttgacctggtcaccgagatcggccgtgtgccatcccacctcgcccaccggacccgcaacgcgctggacaacctggtgatgctacacacgagcgagcacggtggccgggcgtaccgccacgcggtcgaggagctgcccgagacaatggagaccctgctattactgggcttgatgatccttttaaccggaggggccatgctgttcctgatctcgggcaaggggatcggaaagacgtccattgggctgatttgcgtgatcgccagcagcggcatgctctggatggccgagatcccgcttcagtggatagcctctgcgatcgtcctggagttcttcatgatggtcctactgatccccgagcccgagaaacagcggacgccccaggacaaccaactggcctatgtcgtcatcgggatcctcaccttagctgccattatcgccgcgaacgagatgggcctgctcgagaccacgaagcgcgacctgggcatgtccaaggagccgggggtcgtgagccccacctcctacctggacgtggatctccaccccgcgagcgcctggaccctgtacgccgtggccaccacggtgatcactcccatgttacgacacaccatcgagaactcgaccgccaacgtcagcttggccgccatcgccaatcaggcggtcgtgctgatgggcctggacaaggggtggcctatcagtaagatggacctcggcgtgcccctgcttgcccttgggtgctactcgcaggtcaaccccctgacgctgaccgccgcagtgctcttgctgatcacccactacgcgatcattggccccggcctccaagcgaaagccacacgcgaggcccagaagcggaccgcagcggggatcatgaaaaacccgaccgtggacggcattatgacaatcgacctcgaccctgttatctacgattccaagttcgagaagcagctgggccaggtcatgctccttgtgctgtgcgcggtacagctcctgctgatgcgcacgagctgggccttgtgcgaagcgttaacgctggctacaggccccatcaccacactctgggagggctctcccggtaagttctggaacacgaccatagcggtgagcatggccaacatcttccggggctcttacctcgccggcgcaggcctcgccttcagcatcatgaagtccgtgggtaccggcaaaagaggaaccggcagccagggcgagacactcggggaaaagtggaagaagaaactaaaccagctctcacggaaagagttcgacctctacaagaagtccggcattacggaggtcgaccgcaccgaggcgaaggagggcttgaaacggggtgagatcacccaccacgcagtcagccgcggctcagccaagctacagtggttcgtggaaaggaacatggtcatcccggaggggagagtgatagacctcgggtgcgggagaggagggtggagctactactgtgccgggctgaagaaggttaccgaggtccgaggctacacgaagggagggcccgggcacgaagaacccgttccgatgtctacctacgggtggaacatagtgaagctaatgagcgggaaggacgtattctatctcccgcctgagaaatgtgacacacttctgtgcgacataggcgagtccagcccatcccccacagtggaggagagcaggaccatccgggtgctgaagatggtcgagccgtggctcaagaacaaccagttttgcataaaggtgctcaacccctacatgccgactgtgattgagcatctggagcgactccagcgaaagcacggagggatgctggtccggaaccccctgtcccggaacagcacccacgagatgtactggatcagtaacggcacagggaacattgtggcctccgtgaacatggtctcccgcctactgctgaaccggttcacgatgacacaccgccggccgaccatcgagaaggatgtcgacctcggcgcagggacacgccacgtaaacgcagagcccgagacgcccaatatggatgtcatcggcgagcggatcaagcgcatcaaggaggaacacaatagcacctggcactacgacgacgagaacccttacaaaacctgggcctatcatggctcctacgaagtgaaggccaccgggagtgcctccagcatgatcaatggcgtggtcaaactgctgacgaaaccttgggacgtggtccccatggtgacccagatggcaatgacagacaccacgccctttgggcagcagagggtcttcaaggagaaggttgacacccgcaccccgcggagcatggctggcacccgccgggtgatggggatcacggccgagtggctctggcgcacccttggtcggaacaaaaagccccgcttatgcacccgcgaggagttcaccaagaaggtgcggacgaacgccgcgatgggcgccgtcttcaccgaggagaatcagtgggacagcgccaaggccgccgtggaggacgaggacttttggaagctcgtcgaccgcgagcgggagctgcacaaactggggaaatgcggctcttgcgtctacaacatgatgggcaagagggagaagaaactcggcgagttcggaaaggcgaagggctcccgggccatctggtacatgtggctcggcgcgcgctacctggagttcgaggccctcggtttcctgaacgaagaccactggttcagccgggagaactcctatagcggagtggagggggagggcctgcacaagctcggctatatcctgcgagacatcagcaagatccccggaggcgccatgtacgcggatgacacagccgggtgggatacccggattaccgaggacgacttgcataacgaggagaagatcactcagcagatggaccccgaacaccgccagttagctaatgcgatcttcaaacttacctaccagaacaaggttgtcaaggtgcagcggccgaccccaacaggcacggtgatggacattatcagcaggaaggaccagcggggctccgggcaggtcggtacctacgggcttaacacctttaccaacatggaggcgcagctcattcgccagatggagggtgagggcgtgctgtccaaggccgaccttgagaacccccacctccccgaaaagaaaattactcaatggctagagaccaagggcgtggagcggctgaagcgcatggccatctccggcgacgactgtgtggtgaagccgatcgacgatcggttcgccaacgccctcctagccctgaatgacatggggaaggtgcgcaaggacatccctcagtggcaaccaagcaaaggctggcatgattggcagcaggtccccttttgttcgcaccacttccatgagctcatcatgaaggacgggcggaagttggttgttccgtgccgaccccaagacgaactgatcggccgggcgcggatcagccagggggccggctggtccttgcgcgagaccgcttgtttaggcaaggcctacgcgcaaatgtggagcctgatgtattttcataggcgcgacctccgactggcctccaacgcaatatgctcggccgtccccgtgcactgggtgcccacctcccgcacaacttggagcatccacgctcaccatcagtggatgaccaccgaggacatgttgacggtctggaaccgggtgtggatcgaggacaacccgtggatggaagacaagacccccgtgactacctgggaggacgtcccctaccttggcaagcgcgaggaccaatggtgcggcagcctgatcgggctgacgagtcgggcgacctgggcccaaaacatccccaccgccattcagcaggtccgcagcctcatcggtaacgaggagtttcttgattacatgcctagtatgaaacgctttcgcaaggaagaggagagcgagggagccatctggtaa

SEQ ID NO: 25904 - RNA, 9873 nt, synthetic construct
  misc_feature 1..9873: note = derived and/or modified CDS sequence (opt11) from DENV-3__KJ189288__SS-prME
  source 1..9873: mol_type = other RNA
acctcgttatgcctcatgatgatactccccgctgccctggctttccatctcacatcccgcgacggcgagccccggatgatcgtcggtaagaatgaacgcggcaagagcctcctgttcaaaactgcctccggtaccaacatgtgcacactcatcgccatggacctgggcgagatgtgcgacgacacggttacctacaagtgcccccatatcaccgaagtggagccggaggacatcgactgttggtgcaacctgaccagcacttgggtgacctacgggacgtgcaaccaagccggggagcaccggagggacaagcgttctgttgcgttagcgccccacgtgggcatggggctggacactcgcacccaaacttggatgagcgcggaaggcgcttggcggcaggtcgagaaggtcgagacctgggctctgcgccacccgggtttcaccatcctcgcgttattcctagctcattacatcggaacctcccttacacagaaggtggtgatcttcatcctgctaatgctcgtcacccccagcatgaccatgaggtgcgtgggagtgggcaaccgggacttcgtcgaaggattgtcaggggcaacatgggtggacgtggtcctggagcatggcgggtgcgtgactaccatggcgaaaaacaagcccaccctggatatcgagctgcagaagaccgaggcaactcagttagcgacactccgaaagctgtgcatcgagggcaagatcaccaatatcaccacggacagcagatgtcccacccagggcgaggctgtcctgccggaggagcaagatcagaactacgtctgcaagcacacctacgtggaccgggggtggggaaatgggtgcggcctcttcgggaagggctccctagtaacatgcgccaaattccagtgcctagagccaatcgagggcaagatggtccagtacgagaatctcaagtacactgtgatcattaccgtgcacaccggtgatcagcaccaggtcgggaacgagacccagggtgtcacggctgagatcacgccccaggcaagcaccaccgaggcaaccctgcccgagtatggcacgttagggctcgagtgctccccgcgaactggcctggactttaacgagatgattctgctgaccatgaaaaacaaggcatggatggtacaccggcagtggttcttcgacctgcctctaccctggacatcaggcgccacgaccgaaactccgacctggaacagaaaggaactcttagtgacgttcaaaaacgcccacgccaagaagcaggaagtggtcgtgttaggaagccaggagggcgcgatgcataccgcactcaccggggccaccgagatccaaaacagcggagggacatcaatcttcgccggtcacctgaagtgcagactcaagatggacaagctcgagttgaagggcatgtcgtatgccatgtgcacaaatacgttcgtgctgaagaaggaggtttccgagacccaacacgggactatcctcatcaaggtggagtataagggtgaggacgctccatgcaagattcccttcagcaccgaggacggacacggtaaggcacacaacggtcgacttataacagccaaccctgtagtcaccaagaaggaggagcccgttaacatcgaggctgaaccgccattcggtgaaagcaacatcgtgatcggcatcggggataacgcgctgaagatcaactggtataagaaggggtcatctatcgggaagatgttcgaggccacagccaggggcgcccgccggatggccatcctgggcgacaccgcttgggacttcgggtccgtcggaggggttctcaacagcctgggtaagatggtgcaccagatattcgggtccgcctacaccgcgttattcagcggcgtctcctgggtgatgaagatcggcataggggtgctcctcacctggatcggcctgaacagcaagaacacgtcgatgagcttctcctgtatagcaatcgggatcatcaccctctacctgggagccgtcgtccaggcggatatggggtgcgtgatcaattggaaaggcaaagagctgaagtgtgggtcagggatctttgtcaccaacgaggtgcacacctggacggaacagtataagtttcaggccgactcccccaagagactcgccaccgccatcgcaggcgcgtgggaaaacggggtctgtggcatccgcagcacaacacgcatggagaacctactttggaagcagatcgccaatgagttaaactacatcctgtgggagaacaacgtcaagctgactgttgtcgtcggtgatatcattggcgtgctcgaacagggcaagcgcaccctgactccccagccgatggagctgaagtacagctggaagacctggggtaaagccaagatcgtgacggccgagacgcagaactcgtcctttatcatcgacggccccaatacacccgagtgccccagcgcgtctcgggcctggaacgtctgggaggtggaagactacgggtttggcgtattcacaaccaacatctggcttcgcctccgggaggcctacacgcagctgtgcgaccaccgcctcatgtccgcggccgtcaaggacgagcgggcagtgcacgccgacatgggctactggatcgagagccagaagaatgggtcctggaagctggagaaggccagcttgatagaggtgaagacctgtacatggccgaagtcccacaccctctggagcaacggcgtccttgagtccgatatgatcatcccgaagagcctcgccgggcccatcagtcagcacaaccaccggccgggctaccatacgcagaccgccgggccctggcatctcggcaagctggaactggacttcaattactgcgagggcaccaccgtagtgatcacggagaactgcggaaccaggggccccagcctccgaaccaccaccgtctccgggaagctaatccatgaatggtgctgccggagctgcaccctgcccccgttacgctacatgggcgaggacgggtgctggtacggtatggaaatcagacccatctccgagaaggaggaaaacatggtcaaatcccttgtgtccgcgggctccggcaaggtcgacaacttcaccatgggtgtgctgtgcctcgccatcctgttcgaagaggtgatgagggggaagttcggcaagaagcatatgatcgccggggtcttcttcaccttcgtgctgctcctgtccggccagattacgtggcgggatatggcccacaccctcatcatgatcggcagcaacgcctcagatcgcatggggatgggtgtcacttatttagcgctgatcgccacattcaagatccagccctttctggccctcggcttcttcctacggaagctgacaagcagggagaacctcctgctgggcgtcggtctggccatggcgaccaccctgcagttacccgaggacatcgagcagatggccaacgggatcgctctcggactgatggcactcaaacttatcacccagttcgagacgtatcagctgtggaccgctctaatcagcctaacatgctcaaataccatcttcacgctgaccgtagcgtggcggaccgccaccctgatcctcgccggggtgagcctgctgccggtctgccaatctagttccatgcgcaagacggactggcttccgatggccgtagctgcgatgggcgtgcccccacttcctctgttcattttctcgctcaaggacaccctgaagcgccggtcctggccccttaacgagggcgtaatggcggtgggccttgtaagcatcctggcctcatcgctgttacgcaacgacgtgcccatggccggcccactggtggccgggggcttgctcatcgcgtgttacgttatcaccgggacctccgccgacctgacggtggagaaggccgccgacatcacctgggaggaggaggccgaacagaccggagttagccacaatctgatgatcacagtcgacgacgacggcactatgaggattaaggacgacgagacggaaaacatcttaaccgtgctgctaaagaccgcgctattaattgtgagtggtatcttcccgtacagcatacccgccaccctgctagtttggcatacctggcagaagcagactcagagatcaggcgtgctgtgggatgtgcccagcccgccagaaacccagaaggccgagctggaggagggggtgtacaggattaagcagcagggcatctttggcaagacccaggtgggcgtgggggtacagaaggagggcgtgttccacacgatgtggcacgtaaccaggggagcggtcctaacctacaacgggaagcggctcgaaccgaactgggcatcggtgaagaaggatctcatcagctacggcggcggctggcgcttgtccacacagtggcagaagggggaggaagtccaggtgatcgccgtggaacccggaaaaaatcccaaaaacttccagacgatgcctggcaccttccagaccacgactggggagatcggcgcaatcgctctggacttcaagcccggaaccagcggaagcccaatcatcaatcgggagggcaaggtggtcgggctatacggaaacggggtggtgaccaaaaacggaggttacgtatccggcatcgcccagaccaacgccgagccggatggccctacgcccgaactcgaggaggaaatgttcaagaagcgcaaccttaccatcatggaccttcaccccgggagcggcaagacccggaagtaccttccggccatcgttcgcgaggccatcaaacggcgcctccgtaccctgattctggcccccactcgggtggttgctgcggaaatggaggaggctcttaaggggctgcccatccggtaccagaccaccgccaccaaaagtgaacacacgggccgggagatcgtcgacctgatgtgccacgcaaccttcacaatgcggctcctgtccccagtgagggtcccgaactataacctcatcattatggatgaagcccacttcaccgaccccgcgagcatcgcagctagggggtacatcagcacgcgagtgggtatgggcgaagccgcggccattttcatgacggccacgccgcccgggactgcagacgccttcccacagtccaacgcgccgatccaagacgaggagcgcgatatccccgaaagaagctggaattccgggaatgaatggatcacggatttcgcaggtaaaacagtctggttcgtccccagcatcaaggccggcaacgacattgccaactgcctacgcaagaacggcaagaaggtaatccagctgtcccgaaaaacattcgacaccgaatatcagaagacgaaattaaacgactgggacttcgtggtgaccaccgacatcagtgagatgggagccaatttcaaggcagaccgcgtgattgacccgcgacgatgcttgaagcccgtgatactgaccgacggcccggagcgggtcattctggccgggcccatgccggttactgccgcctccgccgcgcagcgcagggggcgcgtggggagaaatccccaaaaggaaaacgaccagtacatctttacgggccagcccctcaacaacgacgaagatcacgcccactggacggaagcaaagatgctgctggacaatatcaacacgccagaggggatcataccggccctgttcgaacccgaacgcgagaagagtgcagccatcgacggcgagtaccggctgaagggggagtcccgcaagaccttcgtcgagctgatgcggcgcggggacctccctgtgtggcttgctcacaaagtggccagcgagggcatcaaatacacggaccggaagtggtgtttcgacggacagagaaataaccagatcctcgaagagaacatggatgtcgagatctggacaaaagagggcgaaaagaaaaagctacggccgcgttggctggatgcccgcacctactccgaccctctggcactcaaggagttcaaagacttcgcagcaggccgaaagagcatcgccctggacctcgttacggagatcggtagggtcccctctcacttagcccatcggacgcgcaacgcgctggacaacctggtcatgctccataccagcgagcacggcgggcgggcctatcggcacgcagtagaagagttacccgagaccatggagaccctgctcctgctgggcctcatgatcctgctaaccggcggggccatgctgttcctaattagcgggaaaggaattggcaaaacatccatcgggctcatctgcgtcatcgccagctctgggatgctctggatggcggagattcctttacagtggatcgcctcggccatagttcttgagttctttatgatggtgctcctggtccccgagccggagaagcaacggacaccccaggacaaccagctggcctacgttgtaatcgggatactcacattggctgcgattattgccgccaacgaaatgggtttactcgagacgacaaagcgcgacctggggatgtcgaaggagcctggggtcgtctccccaacctcctacctggacgttgatttgcaccctgcgagtgcgtggacgctgtacgccgtcgccacgactgtgataacccccatgctgcggcacacgatcgagaactcaacggctaacgtcagtttagccgcgatcgccaaccaggccgttgttttaatgggcctggacaaagggtggccgatctccaaaatggacctcggtgtacccctgctggcgcttggatgctatagccaggtcaacccgctgacgctgaccgctgcggtgctccttctcatcacccattacgccataatcggtcccggattgcaagccaaggccacgcgcgaggcccagaagcggacagcggccggtattatgaagaatccaaccgtggacggaataatgaccatcgacttggacccggtcatttatgactccaagttcgagaagcagttgggccaagtgatgctgctagtactgtgtgctgtccagctcctactcatgcgcacgagctgggccttgtgcgaggccctgacgctggccaccggacccatcaccacgctgtgggagggctctccaggtaagttttggaacacgaccatcgccgtgtccatggctaacatctttagaggttcctatttagccggcgcgggcctcgccttcagcatcatgaagtccgtggggaccggtaagcgcggcaccgggagccagggcgaaactctcggggagaagtggaagaagaagctaaaccagctgagccggaaggagttcgacctctataagaagtccggaatcaccgaggtcgaccgcacagaggccaaggaggggctgaagcggggtgagattacgcatcacgcggtcagccgcggctccgccaagttacagtggttcgtggaaagaaacatggtgataccggaggggcgagtcatcgacctcggctgcgggagaggagggtggtcttactactgcgctggcctgaagaaggttacggaggtccgcggatacaccaagggcgggccggggcacgaggagcctgtgcccatgagcacgtacggctggaacatcgtaaagcttatgagcgggaaagacgttttctacttaccacctgagaagtgcgacacgctactatgcgacattggggagtccagcccctcccccacggtagaggagtcgcgcaccatacgggtgcttaagatggttgagccgtggctcaagaacaaccagttctgtataaaggtgctgaacccttacatgcctaccgttatcgagcacctcgagcgcctccagagaaaacacggcgggatgttagtccgcaaccccctgtcccggaatagtacacacgagatgtactggatatccaacggcacagggaacatagtcgccagcgtgaacatggtctctcgcctcctcctcaacaggttcaccatgacgcaccgccggccgaccatcgagaaggacgtagacctcggcgccggtacgcgtcacgtaaacgccgagcctgagacaccaaacatggacgtgatcggggagcgaatcaagcgcataaaggaggagcacaacagcacctggcattacgacgacgaaaacccgtataagacatgggcctaccacggctcctacgaagtcaaggcgacggggagtgcctcctctatgatcaacggcgtggtcaagctgctgacaaagccctgggacgtcgtcccgatggtgacccaaatggccatgaccgatacgacccctttcgggcagcagagggtgttcaaagagaaggtcgatacacgaacaccgcggagtatgcccggaacgcgccgggtaatgggcatcaccgccgagtggctatggcgcacccttgggcgtaataagaaaccccgcctctgcacccgagaagaatttacgaagaaggtgcgaaccaacgccgctatgggggccgtcttcacggaagagaatcagtgggatagtgccaaggcagcggtggaggacgaggacttctggaagctcgtggatcgcgagagagagcttcacaagctaggtaagtgtggcagctgcgtctacaatatgatggggaagcgcgagaagaagctcggcgagttcggcaaagccaaggggtcgcgggccatttggtatatgtggttgggcgcccgctacctggagtttgaggccctcgggttcctcaacgaggaccactggtttagcagagagaactcctacagcggcgtggagggtgaaggcctgcacaagctcggctacatcttacgcgacatatcgaagatccccgggggggcgatgtacgctgacgacaccgccggttgggatacgaggatcactgaagacgatctgcataacgaggagaagatcacacagcagatggaccccgagcaccgccaactcgccaacgccatcttcaagctgacctaccagaataaggtggttaaagttcagcgccccacccccaccggcacggtgatggacatcatcagccgcaaggatcagcggggcagcgggcaggtcggcacctacgggttgaacaccttcacgaacatggaggcacagctcattaggcagatggagggcgagggggtgctgagcaaggcagacctagaaaacccccacctgccggagaagaagatcacccagtggctggaaacgaaaggcgtggaacggctgaagcgcatggccatctccggtgacgactgcgtcgtgaaaccaatcgatgatcggttcgcaaacgccctcctggcgctgaacgacatggggaaggtccgcaaggatatcccccaatggcagccctctaagggctggcacgactggcagcaggtccctttctgcagccaccacttccacgagctgattatgaaggacggacggaagttggtggttccctgccgcccccaggacgagctgatcggccgagccagaatcagccagggggctggctggagtctccgcgagacggcctgcctaggcaaggcgtatgctcagatgtggagcttgatgtacttccaccggcgcgacctccggctggcctccaatgccatctgtagcgctgtccccgttcactgggttccgacgtcccgcaccacctggtcgatccatgcgcatcatcaatggatgaccacagaggacatgctgacggtctggaatcgggtatggatcgaggataacccctggatggaggataaaacacccgtgaccacgtgggaggacgtcccctacttaggtaagcgcgaggaccagtggtgcggcagcctaatcggcctcacgtcccgggcgacatgggcccagaatatcccgacggccatccaacaggtacgttccctcatcggcaacgaagagttcctggactacatgccctccatgaaacggttccgcaaggaggaggaatcggagggtgccatctggtga

SEQ ID NO: 25905 - RNA, 9873 nt, synthetic construct
  misc_feature 1..9873: note = derived and/or modified CDS sequence (opt11) from DENV-3__KJ189289__SS-prME
  source 1..9873: mol_type = other RNA
accagcctgtgccttatgatgatcctccccgccgccctggccttccacttgacgtctcgagatggggaaccccgtatgatcgtggggaagaatgagcgcgggaaatccctcctctttaagactgcctcagggattaatatgtgcactctgatcgccatggacctgggcgagatgtgcgacgacacggtgacctacaagtgcccccacattacagaggtagaaccagaagacatagactgttggtgcaatctcaccagcacctgggtgacctacgggacctgcaaccaggcaggggagcatcggcgcgacaagcggagcgtggccctcgcaccccacgtgggcatgggactggatacccgtactcagacctggatgagtgctgagggcgcctggcgtcaggtggaaaaagtcgagacgtgggccttacgccacccggggttcaccatcctcgcgctgttccttgcccactacattggcacctccctgacccagaaggttgtgatctttatcctgttgatgctcgttacccccagcatgaccatgaggtgcgtgggggtgggcaatcgtgacttcgtcgagggactgtccggagcaacctgggtagacgtggtcttggagcacggagggtgcgtgacgacgatggccaagaacaagcccaccctcgacatcgaactgcagaaaacagaagccacccagctggcgacgcttcggaagctctgcattgaaggcaagataaccaacatcactacagactctagatgtcccacgcagggggaggccgtgctgccggaggagcaggaccagaactatgtttgcaagcacacctatgtggacagggggtggggcaatgggtgtggcctcttcgggaagggatcattagtgacttgtgccaaattccagtgcttagaacccatcgagggtaaagtcgtgcagtacgagaacctcaagtacaccgtgataataacagtccacaccggagaccagcatcaagtgggcaatgagacccagggagtcaccgccgaaataacaccccaagcgtcgaccaccgaggcgaccttaccggagtatggaaccctcggcctagagtgtagcccccgcacgggactggacttcaatgaaatgatcctcctcaccatgaagaacaaggcgtggatggtacacaggcaatggttctttgacctgcccctgccctggacaagcggggccacgacggaaacccccacttggaaccgtaaggagctcctggtgaccttcaagaatgcccacgctaaaaagcaggaggtcgttgtgcttggatcccaggaaggagcaatgcacaccgccttaaccggggctacggagatccaaaattctggcgggacctccatatttgccggccacctgaagtgtcggctgaagatggacaagctcgagcttaagggaatgagctacgccatgtgcacaaacaccttcgtcctaaagaaggaggtatcggagacccagcatggcaccatcctcattaaagtggagtataaaggagaggacgcgccgtgcaaaatcccgtttagcacggaagacgggcatgggaaggcacacaacggccgtttaattaccgcgaaccccgtcgtaacaaagaaggaggaacccgtgaacatcgaggccgaaccaccctttggggaaagcaacatcgtcatcggcatcggtgataacgcgctgaagatcaactggtacaagaagggctcgagcatcgggaaaatgtttgaggccaccgctcggggcgctcgccggatggcaatcctgggggacactgcatgggacttcggcagcgtcggcggagtacttaatagcctgggcaagatggtccaccagatcttcgggtccgcatacaccgccctgttctccggcgtgagttgggtgatgaagatcggcatcggcgttctattgacttggatcgggctgaacagcaagaatacttctatgtccttctcctgcatcgccatcggcatcatcacactctacctgggcgccgttgtacaggcggacatggggtgtgtgataaactggaaagggaaggagctaaaatgtgggagcgggatcttcgtaaccaatgaggtgcatacctggacagaacagtacaaattccaggcagatagccccaagcgtctcgcaaccgcgatcgccggcgcgtgggagaacggggtctgcgggatcaggtctaccaccagaatggaaaacctcctgtggaagcaaatcgccaacgaactcaactacatcctttgggagaacaacataaagttgaccgtggtggtcggggacacgatcggcgtgttagagcagggtaagagaaccctgacgccgcaacctatggagctgaagtactcatggaaaacctgggggaaggctaagatcgttacggccgagacacagaactcttcctttatcatcgacggccccaacacccccgaatgccccagtgcgtcacgggcttggaacgtctgggaggtggaagactacgggtttggcgtgttcaccacaaatatctggctccgcctacgggaagtttacacccaactgtgcgaccaccgcctcatgagcgcggccgtgaaagatgaaagggctgtacacgcggacatgggatactggatcgagagtcagaaaaacgggtcatggaagttggagaaggccagcctgatcgaggtcaagacctgcacctggccgaaatcccatacgttatggagcaacggcgtgttagagtccgacatgatcatccccaagagcctggccgggccgatctcccagcacaaccaccgccctggctatcacacgcagaccgccgggccctggcaccttggcaagctggagctggatttcaattattgtgagggcaccaccgttgtcatcacggagaattgtggaacgcggggaccctctctccgcaccaccacggtctccggcaagctgatccacgagtggtgctgccggagttgcaccctgccgcccctccgatacatgggcgaggacgggtgctggtacggtatggagattcggcccatctccgagaaggaggagaacatggtgaagtcattggtctcagccggaagtgggaaggtggacaactttaccatgggcgttctgtgcctcgccattttgtttgaggaggtcatgcgcgggaagtttggcaagaagcatatgatcgccggggtctttttcaccttcgttttgctcctttcaggccaaatcacgtggcgggacatggcccacaccctcatcatgataggcagcaatgcctccgaccgcatggggatgggggtcacgtacctcgccctgatcgccacctttaagatccaaccattcttggccctagggttcttcctgcgaaagctgacgtctcgggagaaccttctgttaggcgttggcctcgccatggccacgaccctccaactgccggaagacatcgaacagatggctaacggcatagccctcggtctgatggccctgaagctgatcactcaattcgagacataccaactgtggactgctctaatctcgctgacatgctccaacacgatattcaccttgaccgtggcatggcggactgcgactctgattctcgccggggtttcgcttctgccggtgtgccagtccagctccatgcgcaagaccgactggctgccaatggcagtcgccgcaatgggcgtgccgcccctaccgctgttcatattcagcctcaaggataccctgaagagaaggagctggcctttaaatgagggggtgatggcggtcggcctcgtgtccatcctggcttccagcctgcttcgcaacgacgttcccatggccgggccgctcgtcgccggtggcttactcatcgcctgctacgtgattacaggaacgtccgcagatctgacagttgaaaaggccgcagacatcacctgggaggaagaagccgagcaaaccggcgtcagccacaatctcatgatcaccgtggacgatgacggaacgatgcgcatcaaagacgacgagacagagaacatcttgaccgttctgctgaagaccgcattactgatcgtctcgggcattttcccttacagcattcccgccacgctgctcgtctggcatacgtggcagaagcagacccagcgcagtggtgttctatgggacgtccccagccctcctgagacccaaaaggccgagctagaggagggggtataccgcatcaaacagcagggcatctttgggaaaacccaggtgggcgtcggagtgcagaaagagggcgtattccacacgatgtggcacgtcacccgcggcgcagtgctcacttataacggtaaacgcctggagccaaattgggcgtccgttaagaaagacttaatcagctacggcggcggctggcgcctgagtacccagtggcaaaagggagaagaagtacaagtgatcgctgtggagccaggcaagaaccccaagaatttccagacgatgccggggaccttccagaccaccacgggcgagatcggagccatcgcccttgactttaaacccggaacgagcggcagcccaatcatcaaccgggaagggaaggtcgtggggctctacggtaacggggtcgtcaccaagaacggcggatacgtaagtggcatagcgcagaccaatgcagaacccgatggccccactcccgaactggaagaggagatgttcaaaaagcgaaacctcacaatcatggatctacaccctgggtcgggcaaaacccgaaaatacctgccggcgatcgtgcgagaggccatcaagcgacgcctcaggactctgatactggcgccgacgcgcgtagtggccgcggaaatggaagaagcgctcaaggggctcccgatacggtaccaaactacagcaaccaagtccgagcatacgggcagggagatcgtggacctgatgtgccacgcgaccttcaccatgcggctcctgagccccgtgcgtgtgccgaactacaacctgatcatcatggacgaggcccacttcaccgaccctgcctccatcgcggcgcgaggatatatctctactcgcgtagggatgggcgaggccgccgcgatcttcatgacggccacgccacccggcaccgccgacgccttcccgcaaagcaatgcccccatccaggacgaggaacgcgacatccccgagagaagttggaactccggtaacgaatggatcacggacttcgcggggaagacagtctggtttgtccccagcattaaggctgggaacgacatcgccaactgcctccggaagaacgggaagaaagttatccagctatcccggaaaacctttgacaccgagtaccagaaaacgaagctgaacgactgggacttcgtcgtgaccaccgacataagcgaaatgggcgccaacttcaaggcggaccgcgtgatcgacccacgacgctgcctcaagcccgtcattctaaccgatgggcccgagagggtgattcttgcggggcccatgccggtgaccgctgcatcggcggcccagcgccggggccgcgtcggacggaacccccagaaggagaacgaccaatacatattcacgggccagcctctcaacaacgacgaagaccacgcgcactggacagaggccaagatgctgctagacaacattaacacccccgagggtatcataccggctctattcgagcccgagcgcgaaaaatccgccgctatcgacggcgagtaccgccttaagggcgaatcccgcaagacctttgtggagctgatgagacgcggagatctcccagtgtggctggcccacaaagtggcctcggaaggaataaagtacaccgatcgtaagtggtgttttgacggccagaggaacaaccagatcttggaggagaacatggatgtggagatctggaccaaggaaggcgagaagaagaagctccgcccccgctggttagacgcccgcacttacagtgacccgctggcactgaaggagtttaaggactttgcagcgggccgcaagtctatcgcactggacctagtgaccgaaatcgggcgcgttccctcacatttggctcatcggacgcgcaacgcgctggacaacctggtgatgctacatacgagtgaacacggcggaagggcgtaccgacatgccgtcgaggagctgccggagaccatggagaccctgctcctgctgggtctcatgatcttactgaccggaggcgccatgctgttcctgatttccggcaagggtatcggtaagacctccatcggcctgatctgcgtgatagccagcagcggaatgctctggatggccgagataccgctgcaatggatagcgtcagccattgttctggagttcttcatgatggtcctcctgatccccgagcccgaaaagcaaaggacaccacaggataatcagctggcgtacgtcgtgatcgggatactcaccctggccgccataatcgccgctaacgagatgggcctgctcgagacgaccaaacgcgatctgggaatgagcaaggaaccgggggtcgtctcatccactagctacctggacgtggacctccaccccgcctcagcctggaccctgtacgcggtcgcgaccaccgtcatcaccccgatgcttaggcacacgatcgagaatagcacggcgaatgtgtctttagccgcgatcgcgaaccaggccgtcgtcttaatgggcctggataaaggttggcctatcagcaagatggacttaggcgtgcctctgcttgccctcgggtgctattcccaagtcaacccgctgactctgactgccgcagtgcttctactaataacccattacgcgattattggccccgggcttcaggcgaaggccactcgtgaggcacagaagcggactgcggcggggatcatgaagaacccaaccgtggacggcattatgaccatcgatctggatccggttatctacgacagcaaattcgagaaacagctgggccaggttatgttgctagtgttatgcgcagttcagctcctgctgatgcgcacgtcttgggccctctgtgaagctctgacccttgcgacgggtccaatcacgacactctgggagggcagccctgggaagttctggaacacgaccatcgctgtgtccatggcaaacatatttcggggcagctacctagccggtgccggtctggctttctccatcatgaagtcggtggggaccggcaagcgcggcaccgggtctcagggggagacgctcggggagaaatggaagaagaagctcaaccagctgtcgcgcaaggagttcgatctctataagaagagtgggatcacagaggtcgaccgcacagaagccaaggagggactgaaacggggagagatcactcaccacgccgtgtcccgcgggagcgctaaactgcagtggttcgtggagcgtaatatggtcatccccgagggtcgcgttatcgacctcggctgtggtcggggcgggtggtcttactactgtgccggcttaaagaaagtgacagaggtccgcggctacacaaaaggcgggccgggacacgaagaacccgtacccatgagcacctacggttggaacatagtgaaactgatgtccggtaaggacgtgttctatctcccgcccgaaaagtgcgataccctgctgtgtgacatcggtgagtcgtcccccagcccgacggtagaagaatcgcgcactatccgcgtgctgaagatggtcgagccctggctaaagaacaatcagttctgcatcaaggtgctgaacccttatatgcccaccgtgatcgagcatcttgagaggctgcagcggaagcacggcgggatgctggtccgcaatcccttaagccggaacagcacacacgagatgtactggatcagcaacggcacggggaacatcgttgccagcgtgaacatggtgagccgcctccttctgaaccgcttcaccatgacccatcgtcggccaaccattgaaaaagacgtggacctcggcgcaggaacccgccacgtgaacgccgagccggagacccccaatatggacgtcataggggagcggatcaagcgcattaaggaggagcacaactccacttggcactatgatgacgagaacccatataagacctgggcctaccacgggtcttatgaggtgaaggccacggggtccgcaagctcaatgataaatggagtcgtgaaacttctgaccaagccgtgggatgtagtccccatggtaacccagatggccatgacggacacgacccccttcgggcaacagagggtgttcaaggagaaggttgacacccggacgccacggagcatgccaggcacgcgccgggttatgggcatcacagccgagtggctctggagaaccctgggccgcaataagaaaccccgcctgtgcacccgagaggagttcactaagaaggtgcggaccaacgcggcgatgggcgcggtcttcaccgaggagaaccagtgggacagcgccaagactgcagtggaggacgaggacttctggaagttggtggaccgcgagcgggaacttcacaagctgggaaagtgcggctcctgcgtgtacaatatgatggggaaacgcgagaagaaactcggcgagttcggcaaagcaaaggggtcccgggctatatggtacatgtggttaggagcccgctacctggagttcgaggctctcggattcctaaacgaggaccactggttctcacgggagaacagctactccggcgtggaaggggaaggtctacataaactcggctacatcctacgcgacatcagtaagattcccgggggagcgatgtacgccgacgataccgcggggtgggacacccgcataaccgaagacgatctccataacgaggaaaagatcacccagcaaatggaccccgagcaccgtcagctcgcgaacgccatcttcaagctgacctaccaaaacaaggtggtcaaagtccagaggccgacgcccaccggtacagtgatggacatcatctcccgcaaggaccagcgggggagcgggcaagtggggacctatgggctgaacaccttcacgaatatggaggcccagctcatccgacaaatggagggggagggggttctatccaaagctgacctcgagaaccctcatctccctgagaagaaaatcacccagtggcttgagaccaagggcgttgaaagacttaagcgcatggcgatcagcggcgatgactgtgtcgttaaaccgatcgatgatcggtttgcaaacgccctcctggccctgaacgacatggggaaggtgcgcaaggacatccctcaatggcagccctccaagggctggcacgattggcaacaggtccccttctgcagccaccacttccacgagcttatcatgaaagacggacggaagctagtagttccgtgccgcccccaggatgagctgataggccgtgcccgcatttcacagggggcgggctggagtctccgcgaaacggcctgcctggggaaggcctatgcacagatgtggtccctcatgtacttccatcggcgcgacctcagactggccagcaacgccatctgctcagccgtccctgtgcattgggttcctactagccgcacaacgtggagcatccacgcccaccaccagtggatgaccacagaggacatgctgaccgtctggaaccgggtgtggattgaagacaacccttggatggaggacaagacaccagtcacgacctgggaggatgttccctaccttggtaagcgcgaggatcagtggtgcgggtcgctaattgggcttacttctagggctacctgggcgcagaatatccccactgccatccaacaggtgcgcagtctcatcggaaacgaagagttcctggactacatgccttcgatgaagcggtttcgcaaggaggaggaatccgagggcgccatctggtga

SEQ ID NO: 25906 - RNA, 9873 nt, synthetic construct
  misc_feature 1..9873: note = derived and/or modified CDS sequence (opt11) from DENV-3__KJ189290__SS-prME
  source 1..9873: mol_type = other RNA
accagcctttgcttaatgatgattctacccgcagccctggccttccacttaacaagccgagacggcgaaccaaggatgattgtggggaaaaatgaacggggcaaatccctgctatttaaaacggcaagcgggatcaacatgtgcaccctcatcgcgatggacctcggcgaaatgtgcgatgacacagtaacatataaatgtccccacataaccgaagtagagcctgaggacatcgactgttggtgtaacctaaccagcacatgggtcacctacggaacctgcaaccaagccggtgaacatagaagagacaaacgatcggtggcactggcaccccacgtaggcatgggtttagatacgcggacacaaacatggatgagcgctgagggcgcctggagacaagtcgaaaaagtggaaacatgggcgctgcgtcaccccgggttcacgatcttagcactattcctagcacactacataggcacgtcactgactcaaaaagtcgtaatattcatcctattaatgcttgtcacgccaagcatgacaatgcgatgtgtgggggtaggtaaccgcgactttgtagaggggctcagcggagccacttgggtagacgtggttctggaacacggagggtgcgttaccaccatggccaaaaacaaaccaaccctagatatagaactccagaaaacagaggccacacaattagcgacgctgcggaaactctgcatcgaagggaaaattaccaacatcacgaccgactcaagatgcccaactcaaggagaagccgttctgccggaagaacaagaccagaactacgtctgtaaacatacgtacgtcgacagaggatggggaaacggctgcggactgtttggcaaggggagcctagtaacctgcgccaagttccaatgtctcgagcccattgagggtaaagtcgtgcaatacgagaacctaaaatacaccgttattatcacggtgcatacgggcgaccaacaccaagtcggaaatgagacacaaggtgtaaccgcggagatcacaccgcaagcctcaacaacggaggcaacactaccagaatacggcacactgggtctagagtgtagcccccgaaccggactagacttcaacgaaatgatactccttacaatgaaaaacaaggcttggatggtccacagacaatggttctttgatctgccgctaccatggacgtcaggcgccaccaccgagacacctacatggaacaggaaagagcttcttgtgaccttcaaaaatgctcatgccaagaaacaagaggttgtcgtactcggatcccaagaaggggcaatgcacaccgcactaacgggcgcaacagaaatccagaactcgggcgggacaagcatcttcgctggccacctcaaatgccgactaaaaatggacaagctagaactaaagggaatgtcgtatgccatgtgcaccaatactttcgtactcaagaaagaagtgagcgagacgcaacatggtaccatccttatcaaggtagaatataaaggtgaagacgcaccatgtaaaataccgttcagcacggaggacggccacggaaaagcacataacggacggctaatcaccgccaacccggtggtaaccaagaaggaagaacccgtaaatatcgaggcagaaccacccttcggcgagtcaaacatagtgataggaatcggagacaatgcacttaaaataaactggtacaagaaaggcagcagcatcggtaaaatgtttgaggccacggcccgcggtgcccggcgcatggctatactcggggacaccgcatgggacttcggaagcgtaggaggggttctaaatagcctaggcaaaatggtacaccaaatcttcggaagcgcctataccgccctattctcgggcgtgtcatgggtcatgaagattgggataggggtactattgacttggattggactcaactccaaaaatacatcgatgtcattttcatgtatagcaatcggaataatcaccttgtatctcggggccgtggtccaggcagacatgggatgcgtaatcaattggaaaggaaaggaattaaaatgcggaagcggaatcttcgtcacaaacgaggtacacacctggacagagcaatacaaattccaagcagacagcccgaagcgactggccaccgcaatagcaggagcgtgggagaacggagtctgcggaatccgatcaaccactagaatggaaaacctcctatggaagcagatagcaaacgagctcaactatatactctgggaaaacaacatcaaactcacagtggtagtcggcgacatcataggcgtcttggaacaagggaaaaggaccctgactccgcagccaatggaactgaagtacagctggaaaacctgggggaaagccaagatcgtcactgcggaaactcaaaactcgagcttcataatagacggacctaacacgcccgaatgcccatctgcctcacgtgcgtggaacgtatgggaagtagaggactacgggtttggagtattcactacgaacatatggcttcggctcagagaggtctacacgcaactctgcgaccatagacttatgagcgcagcagtaaaagatgaacgggctgtacacgccgacatgggatattggatcgaaagccagaaaaacggctcatggaaactcgaaaaggctagcctcatcgaagttaaaacttgcacatggccaaaatcacatacgctctggagcaatggcgtgctggaaagcgacatgataatacccaaaagtctggccggaccgatcagccaacacaaccaccgccccggctaccatactcagaccgcaggaccgtggcacctgggaaaacttgaactggacttcaattactgcgaaggaacaacagtagtcataacggaaaattgcggcacaagaggaccctccctgcgaacaactaccgttagtggtaagctaattcacgagtggtgctgccggagctgcactctgccgccattgcgctacatgggggaagatggctgttggtacgggatggagatacgaccgatcagtgaaaaggaagagaacatggtgaagtcattagtgagtgccgggagcggcaaagtagataactttaccatgggagtactctgtctcgcaatcctatttgaagaagtcatgagaggtaagttcggcaaaaagcatatgatagcaggagtattcttcactttcgtactattactctcagggcagataacctggcgcaacatggcccacaccttaataatgataggtagcaacgcctctgacagaatgggcatgggcgtcacgtaccttgcattaatcgcgacattcaaaatacaaccctttcttgcactcggattcttcctccggaagttaaccagcagagagaacctcctactgggcgtaggtctcgccatggcaaccaccctccagttgcccgaagatatagaacaaatggctaacgggatcgcccttggcttaatggcgctcaaactcatcacgcagttcgagacctaccagctttggactgccctgatcagcctgacctgctcaaacaccatattcacactcacagtggcgtggcgaaccgctacactcatattagcgggggtgtccctcctccccgtctgccaatcatccagcatgcggaaaactgactggctaccgatggcggttgcggctatgggggtcccacccttacccctcttcatcttcagtctcaaggacacgctcaagcgccgcagctggcctctcaacgagggtgtgatggcagtcggattagtttcaatcctcgccagcagcctgctgagaaacgacgtaccgatggcgggacccctagtcgcgggaggcctattgattgcatgctacgtaataaccggaacgtcagcggacctaacagtagaaaaagccgcagacatcacatgggaagaggaagccgaacaaacaggcgtatcacacaacctcatgatcacggtcgatgacgacggaacgatgcggataaaagacgacgagacggaaaacatcctgacagtcctattaaagacagccctcttgatcgtttcagggatattcccttacagcatacccgcaacactgctggtatggcacacctggcagaagcaaacacagcggtcgggcgttctttgggatgtgcccagccctccggagacacaaaaagcggagctagaagaaggagtctaccgaatcaaacaacagggtatatttgggaaaacgcaagtgggagtaggagtccaaaaagagggggtcttccacactatgtggcacgtaaccagaggggcagtactcacatataacggaaagcgactcgagccgaactgggcaagcgtgaagaaagacctcatatcatacggaggaggctggaggctatccacccaatggcagaaaggagaagaagtacaagtcatcgcagtagaacccggcaaaaaccccaaaaatttccagacaatgccagggacgttccagactaccacaggagaaataggagccatcgctctcgacttcaagccgggaacgtcaggaagcccaattatcaacagagaaggaaaagtggtcggactatacgggaacggcgtcgtaaccaaaaacgggggatacgtaagtggaatagctcaaacaaacgccgaaccagacggtcctacaccggaattagaggaagagatgttcaagaaacggaacctaacaatcatggacctgcaccccggtagcgggaagacgcgcaagtacctcccggcgatagttagagaagccataaaaagaagattgcggactctaatactggctccaacaagagtagtagcagctgaaatggaagaagctctaaaggggttgcccattagataccagactaccgcaacaaagagcgaacacacagggagggaaatcgtagacctgatgtgccatgccacgttcacgatgagactgctctccccagtacgtgtacccaactacaacctgatcataatggacgaagcccacttcaccgaccccgccagcatcgctgcaagaggttacatttcaaccagggtcgggatgggggaggcagcggccattttcatgacggctacccctccaggtacagcagatgcgttcccacaatccaacgcgcccatccaagacgaagaacgggacattcccgagcgatcgtggaactccggaaacgaatggataaccgatttcgcggggaaaaccgtatggttcgtaccaagcatcaaggcgggaaacgacatagcaaactgcttgaggaaaaacggcaaaaaggttatccaattgtctaggaaaacatttgataccgaatatcagaaaacaaagctaaacgactgggactttgtagttacgacagatatcagtgaaatgggagccaatttcaaagcggaccgggtaatagatccgcgccgctgtctaaaaccagtgatcctgacagatgggccggaacgtgtcatactagccgggccgatgccggtaacagcggcgagcgcggcacaaaggcgaggacgcgtgggtcgaaatccacaaaaagaaaatgaccaatacatttttacaggccaaccccttaacaacgacgaggaccacgcacactggacagaggccaagatgctgctagacaacatcaataccccggaaggaataatcccagcgctatttgagccggaacgcgaaaagtccgcagcaatagacggagaataccgcctgaaaggagaaagcaggaaaacgttcgtggaacttatgaggcgcggagatttaccagtctggctggctcacaaagtagcaagcgaaggtatcaagtacacagacagaaaatggtgtttcgacggacagagaaataaccaaatcctagaggaaaatatggacgtcgaaatctggaccaaggaaggtgagaagaagaaactcagaccccgctggctagatgcgaggacgtactcagaccctctagcgctcaaagagttcaaggatttcgccgcaggacgcaagtccatcgcgctcgacttggttacggaaatcgggagagtgccgtcacacctcgcgcatcggacacggaacgccttagacaacttagttatgttacacaccagtgaacacgggggtcgcgcataccgccatgcggtagaagaattacctgagacaatggaaacgttgctattgctgggtttgatgatcctcttaacaggaggggccatgctctttcttatatcaggaaagggaatcggaaagaccagtataggcctaatctgcgttatagcatccagcgggatgctctggatggcagaaatcccgctgcaatggatagccagcgccatcgtactagaatttttcatgatggtattacttatccctgagcccgagaaacagcggacgccgcaagacaaccagctagcatacgtagtaataggcatcctaacactagctgccataattgcagcgaacgagatgggcctccttgagacgacaaaaagggatctaggtatgtccaaagaaccaggcgtagttagtccgacgtcgtacctcgacgttgacctgcacccagccagcgcctggactctctacgcagttgcaacgacagtcatcacgcccatgctccgacacactatcgaaaactctaccgctaacgtgagcttggcagcaatcgctaaccaagcggtagtactaatgggtctggataaaggatggcctatctcaaaaatggacttaggggtccccctcctcgcgcttggctgctactcccaagtaaacccgctaaccctcacggccgccgtcctgctcttaataacgcactacgcgatcataggtccaggcctccaagcgaaagcaacgcgcgaagctcagaaacgcaccgccgccgggatcatgaaaaatcctacagtagacggtatcatgaccatagatctggatccggtcatatacgacagcaaattcgaaaaacaactcggacaagtaatgcttctcgttctgtgcgcagtccagctcctattaatgcgaacaagctgggccctgtgcgaggcgctcacgctggcgacgggaccaatcaccacgctttgggaagggtcccccggtaaattctggaacactacgatagcagtgtcgatggcaaacatcttccggggaagctacttggcaggcgccggcctagccttcagcataatgaaaagcgttggtaccggtaaacgaggcaccggctcccagggggagacgctcggagaaaagtggaagaagaaactcaaccagctgagccgaaaagagtttgacctttataagcgctcagggataacagaagtcgaccgtacggaggccaaggaaggactaaaacgcggcgaaataacccatcacgcagtgtcccgaggctccgcaaagctacaatggttcgtcgagcgtaacatggtcatcccagagggccgcgtaatcgatctcggatgcggacgaggaggctggagctactactgtgctggactaaagaaagtgactgaagtaagaggatacactaaaggtggacccggtcatgaagaacccgtaccgatgtcaacgtatggctggaacatcgtaaaactcatgagtggaaaggatgtcttctacctcccgccagagaaatgcgacacgcttctttgcgatattggcgagagttcccccagtccgacagtcgaagagtcaaggactataagggtactgaaaatggtggagccctggctcaagaacaaccaattctgcataaaggtactgaacccctacatgcctacagtcatagaacacctagaacgcctccaacgaaaacacggtgggatgctagtccgcaatcccctatcacgaaacagtactcacgaaatgtattggatatccaatgggaccggcaatattgtggccagtgtcaacatggtatcacgactcttgctaaaccgtttcacaatgacgcaccggcgtccgacgattgagaaagatgtcgacctcggtgcaggtactaggcacgtaaacgccgaacccgagacacccaatatggacgtcataggagagaggatcaaaagaataaaagaggaacataactccacatggcactacgacgaagaaaacccctacaagacgtgggcgtatcacggatcatacgaagtcaaggcgacagggagcgcatcctcgatgatcaatggagtcgttaaattactaacgaagccctgggacgtcgtgcccatggttacccagatggcaatgacagatacgaccccattcgggcagcagagagtgtttaaagagaaagtcgacacaaggacaccacgatcaatgccgggtacaagaagggtaatgggaataaccgcggaatggttatggagaaccctcggtagaaacaagaaacctcggttatgcacgcgggaggagttcactaagaaggtacggacaaacgcggccatgggggccgtgtttaccgaggagaaccagtgggatagcgcgaaagcagcagtcgaggacgaagacttctggaagctagtggacagggaaagagagctacacaaactcggaaaatgtgggtcgtgtgtgtacaacatgatgggcaagcgcgagaagaaattgggtgagttcggtaaggcgaaagggagtcgagccatctggtacatgtggctgggagcccgctacctcgagttcgaggccctaggattcctaaacgaagatcattggtttagccgcgagaactcttactcgggagtcgaaggagagggcttacataaactaggatacatactcagggacatctccaagataccaggcggcgcaatgtatgcagacgacacggccgggtgggatacccggataacggaggatgacctgcacaacgaggagaaaatcacgcaacaaatggaccccgagcataggcaactggcaaatgcaatcttcaaattaacctatcaaaacaaagtcgtcaaagtccagagacccacccccacgggcaccgtaatggacatcataagtagaaaagaccaaagaggatcaggacaagtcggcacatatgggctcaacacattcacaaacatggaggcacaactcataagacagatggagggagaaggcgtcctatcgaaagcggatcttgagaacccccatcttccagagaagaaaattacacagtggctggagaccaaaggcgtcgaacgcctaaaaaggatggcaataagcggggacgactgcgtagtcaaaccaatcgacgatcgcttcgcaaatgcgctcctcgcactgaacgacatggggaaagtacgaaaagatataccgcaatggcagccgtcgaaaggatggcacgactggcaacaagtacccttctgttcgcatcattttcacgagctgataatgaaggacggaaggaaattagtagtcccatgcaggccccaagacgagctgatcggtagagccagaatctcgcaaggcgcaggatggtccctacgagaaaccgcctgcttgggaaaagcctacgcacaaatgtggtccctaatgtatttccacagacgggatcttagactggcatcaaacgctatctgctccgcggtaccggttcactgggtcccgacgtcgcgaacaacatggtctatacacgcacaccaccagtggatgaccaccgaagacatgctgacggtttggaatagagtatggattgaagataacccgtggatggaagacaagacacctgtaaccacctgggaggacgtaccttacctgggcaagcgagaagatcagtggtgcggatctttaatcggcttaacaagccgagcgacatgggcacaaaacatacctacggccatacaacaagtgagaagtctgatcggtaatgaagagttcctagactacatgccgagcatgaaaagattccgaaaggaagaggagagtgaaggagccatctggtaa

SEQ ID NO: 25907 - RNA, 9873 nt, synthetic construct
  misc_feature 1..9873: note = derived and/or modified CDS sequence (opt11) from DENV-3__KJ189291__SS-prME
  source 1..9873: mol_type = other RNA
acatctctctgtctcatgatgattctgccggccgccctggcgttccacttgactagccgggacggggagccgcggatgatcgtggggaaaaacgagcggggaaagtcactgctgttcaagacagcgtccgggatcaacatgtgcaccctcatcgcgatggatctcggagagatgtgcgacgacaccgtgacctacaagtgtccccacatcacagaggtggagccagaggacatcgactgctggtgcaacctcacgagcacctgggtgacctacgggacctgcaaccaggccggcgagcaccggcgtgacaagcggtccgtggccctcgcgccacacgtaggtatggggctggacacccgcacccagacatggatgagcgccgagggcgcatggcgccaggtggagaaggtcgaaacatgggccttacgccatccggggttcaccatcttggcgctgttcttggcccactacatcgggaccagcctcacccagaaagtggtgatatttatactgctgatgctcgtcacgccgagcatgaccatgcggtgtgtgggggtgggcaaccgcgacttcgtcgaaggactctccggggccacctgggtagacgtggtactggaacacggagggtgtgtgaccacgatggccaagaacaagcccaccttagacattgagctgcagaagaccgaggctacacagctggcgacgctcaggaagctgtgcatcgagggcaaaatcaccaacatcacgaccgacagccgatgccctacgcagggcgaggcagtcctgccggaggagcaagaccagaattacgtgtgcaagcacacctatgtggacaggggttggggtaacgggtgcggccttttcgggaagggctccctggttacctgcgccaagttccagtgcctggagcccatcgaaggcaaagtcgtgcagtacgagaaccttaagtacaccgtgatcatcactgtccacaccggggatcagcaccaggtcggcaacgaaacacagggggtcaccgcggagatcacgccccaggccagcacaaccgaggccactctgccggagtacggcaccctggggctcgagtgctccccgcgcacgggcttagacttcaatgagatgatactgctgaccatgaagaacaaggcctggatggtgcaccggcagtggttctttgacctgcccctgccgtggactagcggcgccaccacggagaccccaacctggaaccgcaaggaactcttagtcacgtttaagaacgcccacgccaagaagcaggaggttgtggttctggggtcccaggagggcgcgatgcacacggccttaaccggggcaaccgagattcagaacagcggcgggacctccatctttgccggccacctgaagtgccgcctgaaaatggataagctcgaactgaagggcatgtcttatgccatgtgtacgaacacctttgtcctgaagaaggaggtgagtgagacccagcacgggacgatactgatcaaggttgagtacaagggtgaggacgcgccatgcaaaatccccttcagcacggaggacggccacggcaaggcccacaatggtcgcctgataaccgccaacccagtcgtgaccaagaaggaggagcccgtgaacatcgaggccgagccccccttcggggagagtaatatcgttatcggcatcggcgacaatgcgctgaagatcaactggtacaagaagggctcgagcatagggaaaatgttcgaggcgaccgctcggggcgcccgccggatggccattcttggcgacacggcgtgggacttcgggtccgtcggaggggtactaaatagcctgggcaagatggtccaccagatcttcgggtccgcctacaccgccctgttcagcggcgtgtcctgggtgatgaagatcggcatcggggtcctcctgacctggatcggcctgaactctaagaacacctccatgtcgttctcatgcatcgctatagggatcatcacgttgtaccttggcgccgtagtgcaggcggacatggggtgcgttattaactggaagggcaaagagctgaagtgcggctcaggtatattcgtgacgaacgaagtacacacctggacggagcagtacaagtttcaggccgattccccaaagcgcctcgccacggccatagccggagcgtgggagaatggggtctgcggcatacgcagtacaacccggatggagaacctgctgtggaagcagatcgcaaacgagctcaactacatcttatgggagaacaacattaagctgacggtggttgtcggggatatcatcggcgtgctagagcagggcaagcggacgctgacgccccagccgatggaactgaagtacagttggaagacctgggggaaggccaagatcgtgaccgccgagacgcagaatagctcctttattatcgatggacccaacacccctgaatgcccaagcgcgtcccgagcctggaacgtctgggaggtggaggactatgggttcggtgtgttcaccaccaacatctggctccgcttacgggaggtctatactcagctttgcgaccacaggctgatgagcgccgccgtaaaggacgagagggctgtacacgcagacatgggctactggatcgagagccagaagaacgggtcctggaagctggagaaggccagcctgatagaggtcaaaacgtgcacctggccgaagtcccacaccttgtggagcaacggcgtgctggagtccgacatgatcatccccaagtcactggccggacccatctcccaacataaccaccgccctggataccacacccagacggcaggtccttggcaccttggcaagttggagctggatttcaattactgcgagggcactaccgtggtcattaccgagaattgcgggacccgcggcccctctctccgcaccaccaccgtgtccgggaagctcatacacgagtggtgctgccgcagctgtacgttaccccctctccgctacatgggcgaagacgggtgctggtacggtatggaaatccggcccatcagtgagaaggaggagaacatggtgaagagcctggtctcagccggcagcgggaaggtggacaacttcaccatgggggtgctgtgtctggcgatcctgttcgaggaggtcatgcgcgggaagttcgggaagaagcacatgatagccggggtgttcttcaccttcgtgctgctactgtccggccaaatcacctggcggaacatggcccacacgctgatcatgatcggcagcaacgcttccgaccggatgggtatgggtgtcacctacctcgccctgatcgcgacattcaaaatccagcccttcctggccctcgggttcttcctacggaagctgaccagccgcgagaacctcctgctgggcgtgggcctcgccatggccactacgctccagctgcccgaggacatcgaacaaatggctaacgggatcgccctaggtctcatggccctgaagttgataacccagttcgagacctaccagctgtggaccgcgttgatcagcctgacctgctcaaatacgatcttcaccctgacggttgcctggcggaccgcgacccttatcctcgctggggtctcgctgctgccggtctgtcagtccagctcgatgcggaagaccgactggctccccatggccgtggctgccatgggcgtgccgccgctgccgctgttcatcttctctctcaaggacacactcaagcgccggtcctggcccctgaacgagggtgtgatggccgtcggcttggtgtcaatcctggcctccagcctgttgcgcaacgacgttccgatggccggccccctggtggcagggggcctgttaatcgcctgctacgtgatcacagggacctccgcggacctgaccgtggagaaggcagccgacattacctgggaggaggaagcagaacaaaccggcgtcagccataatctgatgattacagtggacgacgatggcaccatgaggattaaggacgatgagaccgaaaacatcctcacggtgctgctgaagaccgccctccttatcgtctccggcatcttcccgtacagcatccctgcgaccttgctcgtgtggcacacctggcagaaacagacccaacggtccggcgtgctgtgggatgtcccctccccgcccgagacccagaaagccgaactggaggagggggtgtaccgaatcaagcagcaaggcatcttcggtaagacgcaggtgggcgtcggtgtacaaaaggagggcgtcttccacacaatgtggcacgtcacgaggggcgccgtgctcacctacaacgggaagcggctggagcccaattgggcctccgtgaagaaggatctgatcagctacggcgggggatggcgcctgtccacccagtggcagaagggggaagaggtgcaggtgatcgcggtggagcctggcaagaaccccaaaaacttccagactatgcccggcacgttccagaccaccaccggggaaatcggcgccatcgccctggacttcaagccgggcacaagcgggtcacctatcatcaaccgtgaaggcaaggtcgtgggtttgtacggcaacggcgttgtcacaaagaacggcgggtacgtgtccggaatcgcgcagaccaacgccgagccggatggccccacacccgaactggaggaagagatgttcaagaagcgcaacctcacgatcatggacctgcaccccggtagcggcaagacgagaaaatacctgccggctatagtgagggaggccataaagcgccgtctccgtacgctgatcctggcgcccacccgcgtcgtcgcagccgaaatggaggaagcgcttaagggcctgcccatccggtaccaaacgaccgccactaaatcggagcacaccggccgcgagatcgtggacctcatgtgccacgccacgtttaccatgcggctcctgtcgcccgtccgcgtgccgaactataacctgatcatcatggacgaggcccacttcaccgaccccgccagcatcgcagcccggggatacatctcgacccgcgtgggcatgggcgaggccgccgcgatttttatgacggccacgccgcccgggaccgccgacgccttcccgcagtccaacgccccgatccaggacgaagagcgcgacatccccgaaaggagctggaactccggcaacgagtggatcactgacttcgcggggaaaacggtgtggttcgtgccctcgatcaaggccggcaacgacatcgccaactgcctccgtaagaatgggaagaaggtgattcagctgagtcggaagacattcgacaccgagtaccagaagacgaagctcaatgactgggatttcgtcgtgacgaccgacatctccgagatgggcgccaacttcaaggccgaccgcgtgatcgacccgcggcgatgcctcaagccagtcatactgacggacggccccgagcgggtgattctggcggggccaatgccggtgaccgcggcctccgctgcgcaacgccggggtcgtgtcgggcggaacccgcagaaggagaacgaccagtacatctttactggccagcccctcaataacgacgaggaccacgctcattggacggaggccaagatgctgctggacaacatcaatacccccgaggggatcatcccagccctgttcgagcccgagcgcgagaaatcggccgcaatcgacggcgaatacaggttgaagggagagtctcgcaagacctttgtcgaactgatgcggcgcggggacctacctgtgtggctcgcccacaaggtcgccagcgagggcatcaaatacactgaccggaagtggtgcttcgacgggcagaggaacaaccagatcctggaggaaaacatggacgtggagatttggacaaaggagggcgagaagaagaagctccggccccgctggctggatgcccgcacctacagcgacccgctggccctcaaggagtttaaggacttcgcggccggccgaaagagcatcgctctggacctggtcactgagatcgggcgcgtgccctcccatctcgcgcaccggactagaaacgccctggacaatctggtgatgcttcacacgagcgagcacggcggtcgagcatatcggcacgccgttgaggagctcccggagaccatggagaccctgctcctgctgggcctcatgatcctgctcaccgggggcgccatgcttttcctaatcagcggcaagggaatcggcaagacgtccatcgggttaatctgcgtcattgccagctccggcatgctctggatggccgagatcccgctgcagtggatcgcaagcgcaatcgtgttggagtttttcatgatggtcttactgatcccagagcccgagaagcagcggacgcctcaggacaaccagctggcctatgtggtgatcgggatcctcaccctggccgccatcatagcggccaacgaaatgggactgctcgagaccactaagcgcgacctgggcatgtccaaggagccgggcgtcgtgtctcccacctcctatttagacgtcgacctccacccagccagcgcgtggaccctctacgcggtcgccaccacagtgatcaccccgatgctgcgacacaccatcgagaacagtacggctaacgtcagcctcgccgcaatcgcgaaccaagccgtggtgctgatgggcctggacaaggggtggccgatctctaaaatggacctcggcgtgccattacttgccctcggatgttacagccaggtcaatccgttgacgcttaccgccgccgtgctactgctgatcacccactacgctatcatcggacccggcctccaagccaaggccacgcgcgaggcccagaagcggacggcggcagggataatgaagaatccgaccgtggacggtattatgaccattgacctggaccctgtgatttacgactccaaattcgaaaagcagttgggccaagtgatgctcctggtgctgtgcgccgtccagttattactgatgcgcacctcgtgggccctatgcgaggccctgacgttggcgaccggcccgatcactacgctttgggaaggatcccccgggaaattctggaatacgactatcgccgtgagtatggccaacatcttccggggctcttacctggcgggcgccggcctggcgttcagcattatgaagtcggttggcacaggcaagaggggtaccgggagccagggcgagacactcggcgagaaatggaagaagaaactcaaccaactatctcggaaggagttcgacttatataagcgctccggcataacggaagtcgacaggaccgaggccaaggaggggttaaagcgcggggagatcacccaccacgccgtgagccggggttccgccaagctccagtggttcgtggagcgaaacatggtcatccctgaagggcgggtgatcgacctcggatgcgggagaggcgggtggagctactattgcgccggcctgaagaaggtaaccgaggtccgcggctacacgaagggcgggcccggccacgaagagcccgtgcccatgagcacgtacggctggaacattgtgaagcttatgagcgggaaggacgttttctacctacctcccgaaaaatgtgacaccctgctatgtgacatcggcgagtccagcccctccccgaccgtagaggagagccgaaccatccgcgtactgaagatggtcgagccgtggctcaagaacaaccaattctgcatcaaggtactgaacccctacatgcccaccgtgatagaacatctggagcggctccagcgcaagcacggcgggatgctggtcagaaaccctctgtcccgcaacagcacccacgagatgtattggatctccaatggcaccgggaacatcgtggcgagcgttaatatggtctcccggttattgctgaatcgcttcactatgacacaccggcggcccaccatcgagaaggacgtggacctcggcgccggcacccgacacgtgaatgccgagcccgagacgcccaatatggacgttatcggggaacgcatcaagcggataaaagaggaacataattcaacgtggcactacgacgaagagaacccctacaaaacgtgggcctaccacggctcctacgaggtcaaggcgaccggctcggcgagtagcatgatcaacggagttgtcaaacttttgacaaagccctgggacgtggtccccatggtgacccaaatggccatgaccgatacgacgccgttcgggcagcagcgcgtattcaaggaaaaggtcgacacccggacccctcgcagtatgcccggtaccaggcgagttatgggcatcacagccgagtggctctggcggaccttagggcgcaacaaaaagccccgcctgtgcacccgggaggagttcaccaaaaaagtacgcacgaatgccgctatgggggccgtcttcaccgaggagaaccagtgggattccgccaaagccgccgtggaggacgaggacttctggaaactcgtcgaccgggagcgcgaattgcacaagctggggaagtgcgggagctgtgtctacaatatgatggggaagcgggagaagaagctcggcgagttcggcaaggcaaaaggatcccgcgccatatggtatatgtggctgggggcccggtacctggagtttgaggccctcgggttcctgaacgaggaccattggttcagccgcgagaactcctattctggggttgagggggagggtcttcacaagctcggctacatcctgcgagacatctccaagatccccgggggcgccatgtacgcggacgacaccgccgggtgggacacccgcatcacggaagacgacctgcacaacgaagagaagatcacccagcaaatggacccggagcaccggcagttagcaaatgccatcttcaaactgacataccagaacaaggtcgtcaaggtgcaacgccctacccccaccggcacggtgatggacatcataagcagaaaagatcaacgcggctcggggcaagtcggcacgtacgggctgaacacgttcacaaacatggaggcccagctcatcagacagatggagggcgaaggggtgctgagcaaggcggacctggagaacccccatctcccggagaagaagatcacgcaatggcttgagaccaagggcgtggagagactgaagcggatggccatctcaggcgacgattgcgtggtgaagcccatcgacgataggttcgccaatgccctcctggccctgaacgatatgggcaaggtgcggaaggacatcccacagtggcaaccgagcaaggggtggcacgactggcagcaggtcccgttctgctcccaccatttccacgagctcatcatgaaggacggcagaaagctggtggtgccctgccggccccaggacgagctgatcggccgcgcgcggattagtcagggggcaggctggtccctccgcgaaaccgcatgcctgggcaaggcctacgcacagatgtggaccttaatgtacttccaccgccgggacttgaggctcgccagcaacgccatctgctcagccgtcccggtccactgggttccaacgtctcggaccacttggtccatccatgcgcaccaccaatggatgaccacggaagatatgctaacggtctggaaccgcgtctggatagaagacaacccatggatggaggacaaaactcccgtaaccacgtgggaagacgtcccctatctcgggaagagggaggatcaatggtgcggcagcctaatcggcctgaccagccgtgcgacctgggcccagaacatcccgaccgccatccaacaagtcagatcgctgatagggaacgaggagtttctggactatatgccctcaatgaagcgcttccggaaggaggaggagtccgagggggccatctggtga

SEQ ID NO: 25908 - RNA, 9873 nt, synthetic construct
  misc_feature 1..9873: note = derived and/or modified CDS sequence (opt11) from DENV-3__KJ189292__SS-prME
  source 1..9873: mol_type = other RNA
accagcctatgcctaatgatgatactacccgcggccctagcgttccatctaacgtccagggacggagaaccccgcatgatcgtcgggaaaaacgaacgcggaaaaagtctactgtttaaaacagcgagtggaatcaatatgtgcacactaatcgctatggatctaggcgaaatgtgcgacgatacagtaacttacaaatgcccacacataaccgaagccgaaccagaagacatcgattgttggtgcaacctcacaagcacatgggttacatacggcacatgtaaccaagccggcgaacaccggagagacaaaaggagcgtcgcactcgcaccacatgtcggaatgggtcttgacactcgaacccagacctggatgagcgccgaaggggcatggcgacaagtggaaaaagtggaaacctgggcattgagacacccgggtttcaccatcctcgcgctattcttggcgcattacataggcacatccctgacacaaaaagtggttatcttcatcctactaatgctagtaacgccctccatgacgatgaggtgcgtaggggttgggaaccgtgacttcgtggaggggctaagtggggccacgtgggtagacgttgtgctagaacacggagggtgcgtcaccaccatggcgaaaaataaacccacgttagacatcgaactacagaaaacagaagccacacaactggcgaccttgagaaaactatgcatcgagggtaaaatcactaatattactaccgacagccgttgtccaacacagggcgaggcagttctgcccgaagaacaagaccaaaattatgtgtgcaaacatacatatgtggatagaggctggggcaacggctgcggactgttcggtaaaggatcgctcgtcacgtgcgctaagttccaatgtctggaaccaatagagggaaaagtcgtccaatacgagaacttaaaatacacagtaatcataacagtacatacaggagatcaacaccaagtaggaaacgagactcagggcgtaaccgcagaaattacaccgcaggctagcacgacagaggcaactctccccgagtacggaaccctcgggctagaatgttccccaaggacagggctagactttaacgagatgatcctactcacaatgaagaataaggcgtggatggttcacaggcaatggtttttcgacctaccgcttccgtggacgagcggggcgacaacggagaccccaacatggaaccgaaaagaacttctagtaaccttcaaaaacgcccacgccaagaaacaggaagtggttgttctaggatcccaagagggggccatgcacactgcgctaaccggcgccacagagatccaaaacagcggagggacgagcatattcgcaggacacctaaagtgtagactcaaaatggataaattagaactcaagggaatgagctacgccatgtgtacaaatactttcgtattaaagaaagaggtatccgaaacacagcacggcactattttgatcaaggttgaatacaaaggggaggatgcaccttgcaaaattcccttctccacagaagacggccacggtaaggcccacaacgggagattaatcacggcgaaccctgtggtaacaaagaaagaagaaccggttaatatagaggccgagccacccttcggagaatcgaatataatgattgggatcggagacaacgctctaaaaataaactggtacaaaaagggctcatccataggaaaaatgtttgaggctaccgccaggggcgctcgcagaatggccattctgggagacacagcatgggacttcggatcagtcggaggagtgctgaacagtctgggaaaaatggttcatcagatattcggaagcgcatacactgcgctattcagtggggtgtcctgggttatgaaaattggtatcggagtattgctgacctggatcggactaaactccaagaacacctctatgtcattctcctgcattgcgataggaattatcacactatacctcggagcggtagtacaggccgatatgggctgtatcataaactggaaggggaaagagctaaaatgcggaagcggaattttcgtaacaaacgaagttcacacctggacagagcaatacaagttccaagcggactctccaaagaggctggccacagcaatcgccggagcttgggagaacggggtctgcgggatcaggtcgacgacacgaatggaaaatctgctatggaagcagatagcaaacgagctaaattatattttatgggaaaacaacataaaactaacggttgtagtcggtgacatcatcggcgttctagaacaaggtaaaaggactctgactccacagccgatggagttaaagtattcatggaaaacctggggtaaagcgaagatagtcacagcggaaacacaaaattcatccttcattatcgacgggccgaacacgccagagtgcccgtcggcctcgcgtgcgtggaacgtctgggaagtagaggactacgggtttggcgtattcacgacaaatatatggctaaggctaagagaagtttatacacaactatgcgaccatcgcctcatgagcgcagcagtcaaagacgaacgcgccgtgcatgcagatatgggatactggatagagagccagaaaaatggctcgtggaaactggagaaagctagcctcatcgaagtcaaaacctgtacatggcctaagtcgcatacgctttggagcaacggggtgctagagtcggacatgatcatcccaaaatcgctagccgggccgataagtcaacacaaccatcgcccagggtaccacacgcagaccgccggaccgtggcaccttggaaaacttgaacttgatttcaactactgcgaggggactaccgtcgtcataactgagaactgcggtacgcgtgggccgagcttaaggactaccaccgtgtcaggcaaactcatacacgaatggtgctgtcgttcgtgcaccctaccacccttgcggtatatgggcgaagacggctgctggtacgggatggagatacgaccgatatcagagaaagaagaaaacatggtcaagtcgctagtctccgccggctccggcaaggtcgacaattttacgatgggtgtcctatgtctagcgatcctatttgaggaggttatgcggggaaagttcggaaagaaacacatgatcgcgggcgtctttttcaccttcgttctgctcctatccggacagataacatggcgcgatatggcacacaccctcataatgataggatcgaacgcctctgaccggatgggaatgggcgtgacatacctcgccctcatcgccacttttaagatacagcctttcctagccctggggttcttcctaaggaaattgacgagccgggagaacctactcctaggtgtagggctagcaatggctactacacttcaactaccagaagatatagaacagatggcaaacggaatagcgctcggcctcatggcattgaaactgataacacaatttgagacataccaactatggactgcgctgataagtctaacatgctccaacacgatatttaccttaacggtcgcctggaggacagcaactttgatactagccggtgtcagtctactaccagtctgccaaagctcaagcatgcgtaaaacagattggctaccgatggcggttgcggccatgggggtaccaccgctgcccctgtttatcttcagcctaaaggatacgttaaaaagacgaagttggcccttgaacgagggcgtcatggcggtagggctcgtatccatcctagcctcctcgcttctaaggaacgacgtcccaatggcggggccactcgtcgccggcggccttctaatcgcatgttacgtaataacggggacctctgcagacctcaccgtagaaaaggcggccgacatcacgtgggaagaagaggccgaacagacgggggtttcccacaatctaatgataactgtagacgacgacgggaccatgcgcataaaggacgacgaaactgaaaacatactcacagttcttctgaaaacggccctcttgatcgtatctggaatatttccgtatagtatccccgcgacgctacttgtatggcacacgtggcagaaacaaacgcaaagaagcggagtgctctgggacgtccccagcccacccgaaacacagaaagcggagttagaagaaggggtgtaccggataaaacaacagggtatctttggaaagacccaagtgggggtaggagtacaaaaagagggcgtattccacacgatgtggcacgtcactcgcggtgcagtactaacgtataacgggaaaaggttagaacccaactgggcatccgtaaagaaagatctaatatcatacggcgggggatggagacttagtactcaatggcaaaaaggcgaggaggtacaggttatcgcggtcgaaccggggaaaaacccaaagaacttccaaacaataccgggcaccttccagaccacaactggggagataggcgccatagctctggatttcaagcccgggaccagcggcagcccaattattaatagggagggaaaagtcgtaggactttatggtaacggagtcgttactaagaatgggggatacgttagcgggatagcgcaaactaatgccgagcctgacggctcaactcccgagcttgaagaggagatgttcaagaagcgaaacctcacgatcatggacctccacccaggatccggaaaaacccgaaaatacttgcccgcgatagtgcgcgaagcgataaaacgacggctaaggacactcatactggcgccaacaagagtagtggcggcggaaatggaggaagcattaaagggacttcccataagatatcagacgacagccactaagtcagaacacaccggccgagaaatcgtcgatcttatgtgccacgccaccttcacaatgcgtctactatcgcccgtcagggtcccaaactacaacttaatcatcatggacgaagcccacttcacggaccccgcaagcatagcggcacgaggttatataagcacgcgggttgggatgggggaagccgctgccatatttatgaccgcaacaccaccaggaacagccgatgcattcccacaatcgaacgcgccgattcaggacgaggagcgcgacatacccgaacgcagctggaactcaggaaatgaatggataaccgattttgcagggaaaaccgtctggtttgtaccgtcaatcaaagccgggaacgatatagcaaactgcctacgcaagaacggcaaaaaggtgatacaactgagccgaaaaacattcgacacggagtaccagaaaacaaaactcaatgactgggacttcgtagttacgacagacataagtgagatgggagccaattttaaagctgacagggtcatagacccacggcgctgcctgaaaccggtcatcctgacggatgggcccgagagagtcatactcgcaggaccaatgccagtgacggttgcgtcggcagcgcagcgacgcgggcgggtgggacgtaacccgcagaaagagaacgaccagtacatctttacaggtcaacccctgaacaatgatgaggatcacgctcactggacggaagcaaagatgttgcttgacaacatcaatacaccagaaggcatcatcccggcgctatttgaaccagagagagagaagagtgccgccattgatggagagtaccgcctcaaaggggaaagcagaaaaacgttcgtggaactgatgcgaagaggcgacctccccgtctggctagctcataaagtagctagcgagggcattaaatatacagaccgaaagtggtgctttgacggacaaagaaacaaccaaatcctcgaggagaacatggacgtcgagatatggaccaaagagggcgagaagaagaaattgagacccaggtggctcgatgccaggacatacagcgacccgctagccctaaaagagttcaaggattttgcggcagggcgcaaatccatcgcattggacctagtgactgaaattggccgggtaccgagccacctagctcatcggacacggaacgcacttgataatctggtcatgttacacacgtcggagcacggcgggagagcataccgccacgcagttgaagaactgcccgaaacgatggaaacactattactgctgggcctgatgatcctattaactggaggcgcgatgctctttctgataagtggaaaaggtatcggaaagacgagcatcggactgatatgcgtaatcgcaagcagtggaatgttatggatggccgaaattccgctgcaatggatagcatcagcaatcgtgctggagttcttcatgatggtactactaatcccggagcccgaaaagcagcgaacaccccaggacaatcagctggcctacgttgtcatcgggattctcaccttggcagctataatcgcagccaacgaaatgggcctcctcgaaaccacaaaacgagacctcgggatgagcaaagagccgggtgtcgtcagcccaacctcttacttggacgtagatttgcaccccgcaagcgcatggaccctatatgcggtcgcgaccaccgtaatcacacccatgctcaggcacacaatagagaacagcacggccaacgtttcacttgcggccatcgccaaccaggcagtggtcttaatgggcttagacaagggttggccgataagcaaaatggacctaggggtgcctctattggcgttgggctgctactcacaagtcaaccccttgacgctcacagccgccgtcctcctgctcatcactcactacgctatcataggacccggtctccaggccaaagccacgagggaagcccaaaagcggacagcagccggaataatgaagaacccaacagtagacggaatcatgaccatagacctagatcccgtaatttacgattcaaaattcgagaagcagcttggccaggtgatgctcctggtactctgtgcagtacaactactgctaatgcgaacctcatgggccctgtgcgaggcgctcacactcgccaccggaccgataacgaccctgtgggaggggagccccggtaaattctggaacactaccatagccgtatcgatggcaaacatattccgggggagttacctagcaggggccggactagcattctctataatgaaaagcgtcgggactgggaaaagaggcactggcagccaaggtgagacgttgggggaaaagtggaagaagaaactgaaccagctcagtcggaaagagttcgacctttacaagaagtcaggcataaccgaggtagacaggacagaagctaaagagggtctcaagagaggtgagattacccaccacgcagtatcacgagggagcgctaagctgcagtggtttgtggaacggaatatggtcatacctgaggggagagtaatcgacctggggtgcggcagagggggatggtcatactattgtgcaggactcaagaaagtgacggaagtacgggggtacaccaagggcgggccaggacacgaagaacccgtgcctatgagcacatacggatggaatatcgtaaagttaatgagcggcaaagacgtcttctatctccctccagaaaaatgcgacacgctactttgcgatattggggaaagttcgccttcacccacggttgaagaatccaggactataagagtgttaaaaatggtggaaccatggctcaaaaacaaccagttctgcattaaagtcctgaacccttacatgccaacggtaatagagcacctcgagaggctacaacggaaacacggcggaatgctcgtcagaaatcccctatcccgtaatagtacacatgaaatgtactggatctcaaacgggacagggaacatagtggctagcgttaacatggtgagccgattgctcttaaaccgattcacgatgacacaccgtcggcccacaatcgaaaaggacgtcgacctcggggctgggaccaggcatgtcaacgcggagcctgaaacaccaaacatggacgttatcggcgaacggataaagaggatcaaggaagaacacaacagtacgtggcactacgacgatgaaaacccatacaagacatgggcctatcacggaagctacgaagttaaggctacaggatcagccagctctatgataaacggagtcgtaaaactactcacgaagccttgggacgtcgtcccgatggtaacgcaaatggcgatgaccgacacgacgccattcgggcagcaacgggtgtttaaggagaaagtagatacacgcacaccgcggtcaatgcctggaaccaggcgagtcatgggcatcacagccgagtggctctggcgaaccctaggaagaaacaagaaacctcgcctctgcacacgagaggagttcaccaagaaagtccgtactaacgcagcgatgggcgccgtattcacggaagaaaaccaatgggactcggcgaaggcagcggtggaagacgaggacttctggaagctagtcgaccgggaacgggaattacataaactcggcaaatgtggctcatgcgtgtacaacatgatggggaagcgagagaagaaactaggagagttcggcaaagcaaaaggttcccgggccatatggtacatgtggctcggagctcgatacctcgagttcgaggctctcggctttctaaacgaggaccactggttctcaagagagaactcgtacagtggcgtagaaggtgaaggcctacacaagttaggctacatacttcgcgacatatcgaagatacccggcggggcgatgtacgccgacgacaccgccggctgggacacaaggataaccgaagatgatctgcacaacgaagagaaaataacgcaacaaatggacccagaacatcgacaattggcaaacgcaatattcaaactaacctaccaaaataaagtggtcaaagtgcaacggcccacacccacaggcacagtaatggacataattagtcgaaaagaccaaagggggtcgggacaagtaggaacatacggactgaataccttcaccaacatggaagtacaactcatacgccagatggaaggcgagggcgtcctgagcaaggctgacctggagaacccccatctcccggagaagaaaataacacagtggctggagaccaagggagtagagagattgaagcgaatggccatttccggcgacgattgcgtagtaaaaccgatagacgacagattcgcaaacgctctgctggccctcaacgacatgggaaaaatccgcaaagacatcccgcaatggcagccatcaaagggctggcacgactggcagcaagtacccttctgttcacatcacttccacgaactaataatgaaagacggccggaagttagtggtaccatgcaggccccaagacgaactgatcgggagggcccggataagccaaggcgcgggctggtcgctccgggaaacggcctgtctcggcaaggcctacgcgcagatgtggtccctcatgtacttccacagaagagacctgcggctcgcctccaacgccatctgttcagccgtcccagtccactgggtgccaacctctcgaacaacttggtccatacacgcccaccaccagtggatgaccacggaagatatgctaaccgtctggaacagggtctggatcgaagataacccctggatggaggacaaaacgccagtcacaacctgggaagacgtcccgtacctcggcaaacgggaagatcagtggtgcgggagtttgataggactgacgtcccgcgccacgtgggcacagaacatccctacggcaatccaacaagtcagaagcctcatagggaacgaggagttccttgactacatgccctccatgaaacggttccgaaaggaagaagaaagcgaaggagcgatctggtag

SEQ ID NO: 25909 - RNA, 9873 nt, synthetic construct
  misc_feature 1..9873: note = derived and/or modified CDS sequence (opt11) from DENV-3__KJ189293__SS-prME
  source 1..9873: mol_type = other RNA
accagcctctgcctcatgatgatactgcccgcggccctggcgtttcacctcaccagtcgtgacggtgagcctcggatgatagtggggaagaacgagcgtggcaagagcctgctgttcaagaccgcctccgggataaacatgtgcaccctcattgcgatggacctgggcgagatgtgcgacgacaccgttacctacaagtgcccccacatcaccgaggtggagcccgaggatatcgactgctggtgcaaccttaccagcacctgggttacatatggtacctgcaaccaggccggggagcaccggcgcgacaaacggtccgtggccttggcgcctcacgtggggatggggctagatacccgcacccagacctggatgagcgccgagggggcctggcgccaggtggagaaggtcgagacgtgggcactgaggcacccggggtttaccatcctcgcgttgttcctggcccattacatcggcacctccctcacgcagaaggtggtgatctttattctgctgatgttggtcacacccagcatgaccatgcggtgcgtgggcgtgggaaaccgcgactttgtagagggcctgtccggggcgacctgggtggatgtggtacttgagcacggagggtgtgtgaccacgatggctaagaacaagccaaccttagacatcgaactgcaaaagaccgaggctacccagctggcgacgctccgaaaactgtgtattgagggcaaaatcaccaacataaccaccgacagccgctgccccacgcagggcgaggcagtgctgcccgaggagcaggaccagaattatgtctgcaagcacacctacgtggatcggggctgggggaatgggtgcggcttatttggaaagggctcgctagtgacgtgcgcgaaatttcagtgcttagaacccatagagggcaaggtcgtgcaatacgagaacctcaagtacaccgtaatcatcacggtccacaccggggaccagcaccaggtcggcaacgagacccagggggttaccgccgagatcacgcctcaggccagtactactgaggcgaccctgcctgagtacggcacgctgggtctcgaatgctccccacgcaccgggcttgactttaacgagatgattctgctcaccatgaagaataaggcctggatggtgcaccggcagtggttcttcgacctgcctctgccctggacctctggggccacaacggagacacctacatggaaccgcaaggaactcttggtgacctttaagaacgctcatgctaagaaacaagaggtcgtggtgctcgggtcccaggaaggtgcgatgcatacagccctgactggggccaccgagattcagaacagcggtgggacctccatcttcgctggtcatctaaaatgccggctgaaaatggacaagctcgagctcaagggcatgagctacgccatgtgtactaacaccttcgtcctgaagaaggaagttagcgagacacagcatggaaccattctcatcaaggtggaatacaaaggcgaggacgcgccctgcaagatccccttcagtacggaggacgggcatggcaaggcgcacaacggccgcctgattactgccaaccccgtcgttaccaaaaaggaggagcccgttaacatcgaggccgagccgccgttcggggaaagcaacatcgtcatcggcatcggggataacgcactgaagatcaactggtacaaaaagggctcgagcatcgggaaaatgttcgaagccaccgctcggggcgcccggcggatggctattctgggtgacactgcttgggacttcgggtcggtgggcggagtgctgaactcgcttggcaagatggtacaccagatcttcgggagtgcttacacggctctgtttagtggcgtgtcctgggtgatgaagatcggcataggggtcctcctaacttggataggcctgaatagcaagaacacctccatgagcttttcctgcatcgccatcggtatcatcacgctttacctgggcgccgtggtgcaagcagacatggggtgcgtcattaactggaaagggaaggaattgaaatgcggcagcgggatcttcgtgaccaacgaggtgcacacatggaccgagcaatacaagttccaagccgactccccgaagcgcctcgctacggccatcgccggcgcgtgggagaacggggtctgtggcatccgcagcaccactcggatggagaacctgctgtggaaacagatcgccaatgagctcaactacatcctgtgggagaacaacatcaagctgaccgtggtggtcggagacatcatcggcgtactcgagcaaggcaagcgcacgctaactccacagccgatggagctaaagtacagttggaagacgtggggtaaggccaagatcgtcacagccgagacgcagaacagttctttcatcattgacggccccaacaccccagaatgccccagcgcctcccgggcatggaacgtctgggaggtggaggactacgggttcggcgtgttcaccaccaacatctggctccgcctgcgggaggtctacacacaactctgcgaccaccgcctcatgagcgccgctgtaaaggacgaaagagccgtgcacgcggacatgggctattggatcgagagtcagaagaatgggagctggaagctggaaaaggcatccctgatcgaggtcaagacgtgcacttggccgaagtcccacaccttatggagcaatggggtactggaaagtgacatgattatcccgaagagcctggcaggccccatatcccagcataaccaccgcccggggtaccacacccagacggccgggccctggcacttgggcaagctggaactggacttcaactactgcgagggcaccaccgtggtaatcaccgagaattgcggcacgcggggacccagcctgcgaaccaccacagtgtccgggaagctgatccacgagtggtgctgccggagctgcacgctgccgccgctccgctacatgggcgaggacgggtgctggtatggcatggagatccggcccatctccgagaaggaggagaacatggtgaagtcattagtttcggccggaagcgggaaggtggacaactttacgatgggcgtgctatgcctcgcgatcctgtttgaggaggtaatgcgcgggaaatttggcaagaagcacatgatcgcgggcgtttttttcaccttcgtgctgttactgtccggccaaatcacctggcgggatatggcccatacgctgataatgatcggctcgaatgcatccgaccgcatgggaatgggcgtcacctacctcgctctgatagcgaccttcaagatccagcccttcctggcgctagggttcttcctgagaaagctaacctcacgcgagaacctcctgctgggcgtgggcctcgccatggccacgaccctgcagctgccggaggacattgagcagatggcgaacgggatcgccttaggcctgatggccctgaagctcattacccagttcgagacctaccagctgtggaccgccctgataagcctgacctgctccaacactatcttcaccctgactgtcgcctggcgaaccgccaccctaattctcgctggggtaagcctgttgccggtgtgccagtctagctccatgagaaagaccgattggctccccatggccgtcgcggccatgggcgttccgcccctccccctgttcatcttctcgttaaaggacacgctgaaacgccgttcctggcccctcaacgagggggtgatggcggtcggcctcgtgtctatcctagcctcctcactcctccgcaacgatgtgcccatggccgggcccctggtggcagggggcctgttgatcgcctgttacgttatcaccgggacgtcggcggacttgaccgtggagaaggccgccgatataacgtgggaggaagaggccgaacagaccggcgtcagccataacctgatgatcaccgtcgacgacgacgggaccatgcggataaaggacgatgagaccgagaatatcctcaccgtgctgctcaaaaccgccttgctgatagtctccggcatcttcccgtattctatccccgcaactctgctcgtgtggcacacctggcagaaacagacgcaacggtccggcgtgttatgggacgtgcccagcccgcccgagacccagaaggccgagctggaggagggggtgtaccggataaagcagcagggcatcttcggaaagacccaggtgggcgttggggtccaaaaggagggggtgttccacaccatgtggcatgtcacgcgcggggccgtgttgacatacaatgggaagcggctggaacctaactgggcttccgtgaagaaggacctgatcagctacggcggtggttggcgcctctccacccagtggcagaagggggaagaggtccaagtgatcgcagtggagcccggcaagaaccctaagaacttccaaaccatgccgggcacattccagacaaccaccggggagatcggcgccatcgcccttgacttcaagcccggtacgagcggcagccccattatcaatcgggagggcaaggtcgtgggactgtacggcaatggtgtggtgacgaaaaacggcggttacgtgtccgggatcgcccagaccaacgccgagcccgacgggcccacacctgagcttgaggaggagatgttcaagaagcggaacctcactatcatggaccttcacccagggtcaggcaagacccgcaagtacctgcccgcgatcgttcgcgaggcaatcaaacggagactccggaccctgatcctggccccgacccgcgtcgtggccgcggagatggaggaagcgcttaagggtcttccaatacgctaccagacgaccgccaccaagtccgaacacaccgggcgcgaaatcgtggacctgatgtgccacgccacgttcaccatgcggctcttgagccccgttagagttccgaactataacctgatcataatggacgaggcccacttcaccgatcccgcctccatcgcggcaagagggtacatcagcacccgcgttggcatgggcgaggccgccgcgatctttatgacggcgacacctcccgggaccgccgacgccttcccgcaatccaacgccccaatccaggacgaggaacgcgacataccagaacgtagctggaattccggtaatgaatggatcaccgactttgcggggaagacggtctggttcgtgcccagcatcaaggccggcaacgacatcgccaattgcctcagaaagaacgggaagaaggtgatccagctgtcccggaagaccttcgacaccgagtaccagaagaccaagttaaacgattgggacttcgtggtgacgaccgacatatctgaaatgggggccaactttaaggccgaccgcgtgatcgaccctaggagatgcttaaaaccggtgatcctgaccgacggccccgaacgggttatccttgccgggcccatgccggtgactgccgcatctgcggcccagcgcagaggccgcgtcgggagaaacccccagaaggagaacgaccagtacatcttcaccgggcaacccttaaacaacgatgaggaccatgcgcactggacggaggccaagatgttgctggacaacattaacacccccgaagggattatcccggctcttttcgagcccgagagagagaagagcgcggcgatcgacggagagtaccgcctgaagggcgagtcccgcaagacctttgtagagcttatgcggagaggggacctccccgtgtggctagctcataaggtcgccagcgagggcatcaagtacaccgaccggaagtggtgcttcgacgggcagcgcaacaaccagatcctggaggagaacatggacgtagagatatggaccaaggagggggaaaagaagaagctccgccccaggtggctagacgcccgcacctactcagacccgttggccctcaaggagttcaaggacttcgcagccggccgcaagagcatagccctagacttagtgaccgagatcgggcgcgtgccctcccacctcgcccacagaacccggaacgccctggacaatctggtgatgctccacacgagcgaacacggcggtcgggcatatcgccacgctgtcgaggagttacccgagaccatggagaccctgctcttactgggcttaatgatcctgctgacggggggtgccatgctgttcctgatcagcggaaaggggattgggaaaacgtccatcgggctcatctgcgtgatcgccagctccggcatgctctggatggccgaaatcccgctgcagtggatcgcaagcgctatcgtgctggagttcttcatgatggtcctcctgatccccgagccggagaaacagcggacgccccaggacaatcaactggcctacgtcgtgatcggtatcctcacgttagccgccatcatcgcggccaatgaaatgggcctgctcgagaccacgaagcgcgacctgggcatgtccaaggaaccgggggtagtgagccccacttcctacctggacgtagacctccacccggcctcggcgtggactctttacgctgtcgccacgacagtgatcaccccgatgctgcggcacacgatcgagaattccaccgctaacgtgagcctcgccgccatcgcgaaccaagccgtcgtactgatgggcttggacaagggatggccgatctccaagatggacctcggagtgccactgctggctctcgggtgctactcgcaggtcaacccccttacgctgactgcagcggtgctccttctgatcacccactacgcgatcataggtcccggcttgcaggccaaggccactagggaggcccaaaagcgcacggccgcgggcatcatgaagaaccccaccgtggacggcatcatgaccatcgacttggatcccgtgatctatgactccaagttcgaaaagcaacttgggcaggtcatgctcctggtcctgtgcgccgtccagctgctattaatgcgcacgagctgggctctctgcgaggcgctgactttggcgacaggccccatcaccacactctgggagggcagccccgggaagttctggaacacaaccatcgcagtgtcgatggctaacatcttccggggctcctacctggcaggagccggactggcgttcagcatcatgaagtccgtgggcaccggcaagcgcggcaccgggagtcaaggcgagaccttaggagagaagtggaagaagaagctgaaccagctgagccggaaagagttcgacttatataagaaatccggaatcacggaagttgaccgcaccgaggccaaggagggattgaagcggggggagatcacccaccatgcggtgtcgagaggctccgccaagctgcagtggttcgtggagcggaacatggtaatcccggaggggcgcgtgatcgacctcggatgtgggagaggggggtggtcttactactgtgccggcctgaaaaaggtgaccgaggtccgagggtatacgaaaggcgggcccgggcacgaagagcccgttcctatgtccacctatgggtggaacatcgtcaagctcatgagcggaaaagatgtcttttacctcccgcccgaaaaatgcgacaccctgctctgcgacatcggcgagtccagcccctcgcccacagtggaggagagccgcacgatccgggtcctgaagatggtagagccgtggctcaagaacaaccagttttgtatcaaggtactgaacccatacatgcccaccgtgatcgagcacctggagcgcctacaacggaagcacggcgggatgctagtccgcaatcccctgtcccggaacagcacccacgagatgtactggatatccaatgggaccgggaatatcgtcgctagcgtcaatatggtctccagactcctgctgaatcggttcacgatgacgcaccggaggccgaccatcgagaaggacgtggacctcggcgccgggacgcgccacgtgaatgccgagcccgagacgcccaacatggacgtcatcggagagagaatcaagagaatcaaagaggaacacaatagcacctggcattacgacgacgagaacccgtacaagacctgggcctaccacggctcatatgaggtgaaggccaccgggagcgcgagtagcatgatcaatggcgtggtcaaacttctgaccaagccttgggacgtggtccccatggtgacccagatggccatgaccgacaccacgcccttcgggcagcaacgggtgttcaaggagaaagtggacactcgcacgccgcggagcatgccaggaacccgccgggtgatgggcatcacagccgagtggctatggcgcactctgggccggaataagaagcctcgactgtgcacccgcgaggagttcaccaagaaggtgcggacgaacgccgcgatgggcgccgtcttcaccgaggagaatcagtgggactccgctaaggccgccgtggaggacgaggacttctggaagctcgtagaccgagagcgggagctccataagctggggaagtgcgggagctgcgtatacaatatgatggggaaacgcgagaagaagctcggcgaattcggcaaagctaagggcagccgagccatctggtacatgtggctcggcgcccgctacctcgagttcgaagcgctcgggttcctcaatgaggatcactggtttagtcgggagaactcctattccggcgtggaaggcgaggggctgcacaagttgggctacatcctgcgtgacatctccaagatccccgggggagccatgtacgctgatgataccgctgggtgggacacgcggataacggaggacgatcttcataacgaagagaagatcacccagcagatggatcctgagcaccgccagctcgccaacgcaatcttcaaactcacataccagaacaaagtggtcaaggtgcagcggcccaccccaaccggcaccgtaatggacattataagccgcaaagaccagcgaggctcggggcaggtcgggacttacgggctgaatacgttcaccaacatggaggctcagctcatccgccaaatggagggcgagggggtgctgagcaaggctgacctggagaacccccatctcccggagaagaagatcacgcagtggctggaaaccaaaggagtagagagactgaagcgcatggccatttccggcgatgactgcgtcgtcaagcccatcgacgaccgcttcgccaacgctctcctcgccctgaacgacatggggaaggttcgcaaggacataccccagtggcagccatcgaaaggctggcacgattggcagcaggtcccgttctgctcccaccactttcatgagctcattatgaaggacggccggaaactggtggtgccctgtcgaccccaggatgagctgatcggccgggcgcgaatcagccagggggccggctggtccttacgcgaaacagcctgcttaggaaaggcctacgcgcagatgtggagcctgatgtatttccacaggcgtgacctccggctggcctccaatgccatctgcagcgcggtccccgtgcactgggtgccgacctcgcgcacgacctggagcatccacgcccatcaccaatggatgacaaccgaggacatgctgacggtctggaaccgggtgtggattgaggacaatccctggatggaggataagacgcccgtgaccacctgggaggacgtcccctatttagggaagagggaggatcagtggtgcggcagcctgatcggcctgacttccagggccacatgggcccagaacatcccgactgctatccagcaggttcggagccttatcggcaacgaggaattcctggactacatgccatccatgaagcggttccgcaaggaggaggagtctgagggggcaatctggtag

SEQ ID NO: 25910 - RNA, 9873 nt, synthetic construct
  misc_feature 1..9873: note = derived and/or modified CDS sequence (opt11) from DENV-3__KJ189294__SS-prME
  source 1..9873: mol_type = other RNA
acctcgttgtgcctcatgatgatcctgccagccgccctggccttccacctgaccagccgggacggcgagcccagaatgatcgtggggaagaatgagcggggcaagagcctgctgttcaagaccgcctccgggattaacatgtgtaccctgatcgccatggacctgggcgaaatgtgcgacgacaccgtgacctacaagtgccctcatattaccgaggtagaacccgaggacatcgactgctggtgcaacctgaccagcacctgggtgacctatgggacttgtaaccaggccggcgagcaccggcgcgacaaacggtccgtagcccttgcgccccatgtgggcatggggcttgacacccgcacgcagacctggatgtctgccgagggggcctggcggcaggtcgagaaggtcgaaacgtgggccctgcgtcaccccgggtttaccatcttggcgttattcctggcccactacatcggcaccagcctcacccagaaggtcgtcatcttcatcctgttgatgctcgtcacgcccagcatgacaatgcggtgcgtaggagtgggcaaccgcgatttcgtcgagggcctgtccggggccacatgggtggacgtggtcctggagcacggcgggtgtgtcaccacgatggccaagaacaagccgaccttggacatcgagctgcagaaaaccgaagccacacaactcgcgacgctccggaagctgtgcatcgagggcaaaatcaccaacattacgacggacagccgctgccctacgcagggcgaggccgtgctgccggaggagcaggaccagaactacgtctgcaagcatacttacgtggataggggttggggcaacggatgcggcctcttcgggaagggctccctggtgacatgcgccaagttccagtgtctagagcccatcgagggtaaggtggtgcagtacgagaacctcaaatatactgtcatcatcactgtacacaccggggatcagcatcaagtgggcaatgagacccagggagtcaccgccgagatcacgccccaggcctctaccaccgaggcgacgctgcccgagtatggcaccctggggctcgagtgctctccacgaacgggactggattttaatgaaatgatcctgctcaccatgaagaacaaggcctggatggttcaccggcagtggtttttcgacctgcccctgccctggactagcggcgccaccacggagacccccacctggaatcgcaaggagctccttgtaaccttcaagaacgcacacgccaagaagcaggaggtggtggtgcttgggtcccaggagggcgcgatgcacacagctctcaccggggcaaccgagatccagaacagcggcggaaccagcatcttcgccggccatctgaagtgccgactgaagatggacaagctcgagttaaagggtatgagctacgccatgtgtactaacaccttcgtcctgaagaaagaggtgtccgagacgcagcacggtaccatcctaatcaaggtggagtacaagggggaggacgcgccgtgcaaaatccccttcagcacggaggacggtcacggcaaggcgcacaacggccgcctgataacagccaaccccgtagtgacgaagaaggaggagcccgtgaacattgaggccgaaccgcccttcggggaatccaacatcgtcatcgggatcggggacaatgcgctcaagataaactggtacaagaagggctctagtatcggtaaaatgttcgaggctaccgcccggggcgcccgccggatggcgatcttgggcgatacggcgtgggattttgggtccgtgggcggggttttaaacagcctggggaagatggttcaccagatattcgggtccgcctacactgcactgttcagcggcgtgtcctgggttatgaagatcgggatcggcgtcctcttgacctggatcggcctaaacagcaagaacacctctatgagcttctcctgcatagccatcgggataatcacgctctacttaggcgcagtggtgcaggcggacatggggtgtgttataaactggaaaggcaaagaactgaagtgcggctctgggatcttcgtgaccaatgaggtgcatacctggaccgagcagtataagttccaagccgactcacccaagcggctagccacggcaatcgccggggcgtgggagaacggcgtctgcggcatcaggagcaccacgcggatggagaatctgctgtggaagcagatcgcaaacgaactcaactacatcctgtgggagaacaacatcaaactgaccgtggtggttggggacattatcggcatactcgagcagggcaaacgcacgcttacgccccagccgatggaactgaaatactcctggaagacgtgggggaaagccaagatcgtgaccgcagagacgcagaactcatcctttatcattgatggccccaacacccccgagtgccccagcgcatcccgcgcctggaacgtgtgggaggttgaagactacgggtttggcgtcttcaccactaacatctggctacgactcagagaggtgtatacccagctgtgcgaccatcgcctgatgtcggccgccgtgaaggacgagcgggccgtgcacgcggacatgggctattggatcgagagccagaagaacgggtcctggaaacttgagaaggccagcctaatcgaggtcaagacgtgcacgtggccgaagtcccataccctgtggagcaacggcgtccttgagtcggacatgattattcccaagtccctggctggtcccatctcccagcacaaccaccgcccgggctaccacacccagactgccgggccctggcaccttggcaagctggagctcgacttcaattactgcgagggcaccaccgtggtgattaccgagaattgcggaacgaggggccccagcctccgcaccacgaccgtctcggggaaactgatccacgaatggtgctgccggtcctgcacgttgcccccgctccgttacatgggagaggacggatgttggtatggcatggagatccgtcccatctctgagaaggaggagaatatggtcaagtcgctcgtttccgccggcagcggtaaggtcgacaacttcaccatgggcgtgctgtgcttggcgatcctatttgaggaggtgatgcgagggaagtttgggaaaaagcacatgatcgccggagtcttcttcaccttcgtgctgctcctgtccggtcagatcacgtggcgtgacatggcccacaccctgatcatgattggcagcaacgcttccgacaggatgggaatgggcgtcacatacctcgccctgatcgcgaccttcaagatccagcccttcctggccctcgggttttttctgcgtaagcttaccagccgcgagaacctcctgctgggtgtcgggctcgcaatggccacgaccttacagctgccggaggacatcgagcagatggcgaacggcatcgccctcggactcatggccctgaaactcatcacacaattcgaaacgtaccagctgtggacggccctgataagcctgacctgctccaacaccatcttcaccttaacggtggcctggaggacagcgactctgattttggccggggtgagcttgttaccggtctgccaatcctcttctatgcgcaagacggactggctccccatggccgtcgccgccatgggtgtgccgcccttgccgttgttcatcttctccctcaaggacacgctaaagcgccggtcctggcccctgaatgagggggtgatggcggtgggcctcgtaagcatcctggcctccagcctgctccgcaacgatgtgcccatggccggccccctagtagcagggggactgctcatcgcctgctatgtcatcactggcacatccgcggacctgaccgtggagaaggccgccgacatcacgtgggaggaggaggccgaacagactggtgtgagccacaacttaatgatcaccgtagatgatgatggaaccatgcggatcaaggacgatgagacggagaacatcctcactgtactattaaagacagccctcctgatcgtgtccggtatcttcccgtattccattcccgctaccctactcgtctggcacacttggcagaagcagacccagcgctctggcgtcctgtgggacgtgcccagcccgcccgagacacagaaggccgagctagaggagggggtttaccgaatcaagcaacaagggattttcggcaagacccaggtgggcgtaggcgtacaaaaggaaggcgtgttccacactatgtggcacgtcactagaggcgccgtattgacctacaatgggaagcggctggagcccaactgggcctccgtgaagaaggatctgatttcctacggtgggggctggcgtttaagtacccagtggcagaagggggaagaggtacaagtcatcgcggtggagcccggcaaaaaccccaagaacttccagaccatgcccggcacgttccaaaccaccacgggggaaataggcgcgatcgccctggacttcaagcccgggacgtcaggctcacccatcataaaccgggaaggcaaagtggtcgggctgtacggaaacggcgtggtaacgaagaatggcggctatgtgagcggcatcgcccaaaccaatgcagagcctgacggccccacccccgagctggaggaggagatgtttaaaaagcgcaatttaacgatcatggacctccaccccgggagcggcaagacacggaagtacttgccggcgatcgtgcgtgaggccatcaagcggcgcctccggaccctgatactggctccgacacgcgtggtcgccgccgagatggaggaggccctaaaggggctgccaatccggtaccagacgacggcgactaagagcgagcacaccggccgcgagatagtggacctgatgtgccacgcaactttcaccatgcgcctcttaagtcctgtgcgcgtcccgaattacaacctgatcatcatggacgaagcccacttcactgaccccgcgtccatcgccgccaggggatatatcagcacccgtgtgggcatgggcgaggccgccgcaatcttcatgaccgccacaccgcccggtaccgccgacgccttcccgcagtccaacgcacccatccaggacgaggagagagacatccccgagcgaagctggaactcgggaaacgagtggatcaccgacttcgccgggaagactgtgtggttcgtcccctcaataaaggccggcaacgatatcgccaactgcctccgcaagaacggaaagaaggtaatccagctgagccggaagacctttgacactgagtaccagaagacgaagctgaacgactgggacttcgtggtcacgacagacatcagcgagatgggtgccaacttcaaggccgaccgcgttatcgatccgcggagatgcctaaagccagtgatcttgaccgacggccccgagcgggtgatcctggcgggccccatgccggtgaccgccgccagcgcagcccagcgaaggggccgcgtggggcgtaatccccagaaggagaacgaccagtacatcttcaccggccagccgctcaacaacgacgaggaccatgcgcattggacggaggcaaagatgctgctggacaacatcaacacccccgagggtattataccggccctcttcgagcccgagagggagaaatccgccgcgatagatggtgagtatcggttgaagggcgagagccgcaagaccttcgtcgagcttatgcggcgcggcgacctgccagtttggctggcacacaaagtagcgagcgagggtatcaagtacaccgatcggaagtggtgcttcgacgggcagcgaaacaaccagattttggaagagaacatggacgtcgagatttggacgaaagagggcgagaagaagaagctccggccgcggtggttagatgcacgcacctactccgaccccctggccctcaaggagttcaaggacttcgcagcgggccgcaagagcatcgccctggacctggtgaccgaaatcggtcgcgtaccgtctcacctcgcccaccggacacgcaatgccctagacaatctggtgatgctgcacacatcggaacacggcgggcgggcctaccgccacgccgtggaagagctgcccgagacgatggagacactgctcctgctgggcctcatgattttgcttacagggggcgccatgctgttcctcatcagcggcaaggggatcggcaagacgtccatcgggcttatatgcgtcatcgccagctccggcatgctttggatggccgaaataccccttcagtggatagcgagcgccatcgttctcgagttcttcatgatggtgctcctgatccccgaacccgagaagcagcggacgccccaggacaatcagcttgcctacgtcgtgatcggcatactcaccttagccgccataatcgcagccaatgaaatgggcctgctcgagaccacgaagcgcgacctggggatgtccaaggagccgggggtcgtcagcccgacctcgtacttagacgtggacctccaccctgcctcggcctggaccctgtacgcggtggcgaccacggtcatcacccccatgcttcggcacaccatagagaactccaccgccaacgtgtcgctcgccgccatcgcgaatcaggccgtagtgctgatgggcctggacaagggctggccgatctccaaaatggaccttggcgtgcccctgctggccctcggttgctatagccaggtcaatccgctaacgttaaccgccgcggtgttactgctgatcacgcactacgcgatcatcggccccggcctccaggccaaggcgacacgcgaggcccagaagcggacggctgcggggataatgaagaatccgaccgtggatgggatcatgacaatcgacctggaccctgtgatatacgactccaagttcgagaagcagctggggcaggtcatgctgctggtgctgtgcgccgtgcaactcctgctcatgcgaaccagctgggccctctgcgaagccctgacgcttgcgaccggccccatcacgaccctatgggagggctcccccggcaagttctggaacacgaccatcgccgtcagcatggccaacatctttcggggctcctatttggccggggccggcctggcgttcagcatcatgaagtccgtggggaccggcaagcgcggcaccgggagccaaggagagaccctaggggagaagtggaagaagaagctgaaccaattgtcgcgaaaggagtttgatctctacaagaagtctggcatcacggaggtagatcgaaccgaggccaaagaggggctgaaacggggtgagatcacccaccatgcggtcagcaggggctctgccaagctgcaatggttcgtggaacggaacatggttatcccggaagggcgggtgatcgatctagggtgcgggcggggcgggtggagctactactgcgccggcctgaagaaggtgaccgaggtacgaggttacacgaagggcggacccggccacgaggagcccgtccccatgtccacctacggctggaacatagtaaagctgatgagcgggaaggacgtgttctatctcccgcccgagaagtgcgacaccctgctgtgcgacattggtgagtccagcccctcccccaccgtagaggagagtcgcacgatccgggtcctgaagatggttgagccgtggctcaaaaacaatcaattttgcatcaaggtccttaacccctacatgcccaccgtgattgagcacttggaacgcctccagcggaagcatggcgggatgctggtgcgcaatccattgtcacggaatagcacccacgagatgtactggatcagcaatggcactggaaatatagtcgcgagcgtgaacatggtgtcccgcctgctgctgaaccggttcacgatgacccaccgcagacctaccatcgagaaggacgtagacttaggcgccggcacccgacacgtgaatgccgagcccgagacgcccaatatggacgtgatcggggaacggatcaagcgcatcaaggaggagcataacagcacctggcactatgacgacgagaatccttacaagacctgggcctatcacggctcctacgaggtcaaggccactgggagcgcgtcaagcatgatcaacggtgtggtgaagttacttaccaagccctgggacgtcgtgcccatggtcacccagatggccatgaccgacaccacacccttcggacagcaacgagtgtttaaggagaaggtggacacccgaaccccgcggagcatgcccggtacccgtcgggtcatgggcatcacggccgagtggctctggcgtaccctgggaagaaacaaaaagccccgcctgtgcacacgcgaggaatttaccaagaaggtccggacgaacgccgcgatgggcgccgttttcacggaggagaaccagtgggactccgccaaagccgccgtcgaggacgaggatttctggaagcttgtggaccgcgagagggagctccataagctggggaagtgcggcagctgcgtgtacaatatgatggggaagcgggagaaaaagttaggcgagttcggtaaggcgaaggggtcccgggctatctggtacatgtggctgggtgcccgctatctggagttcgaggccctggggttcctgaacgaggatcactggttcagccgggagaactcttacagcggtgtagagggggagggcctgcacaagctcggctacatactgagagatatctccaagatcccgggaggcgctatgtatgcggatgataccgctgggtgggacaccaggatcacggaggacgacctgcacaacgaggagaaaatcacccagcagatggaccctgagcaccgccaactcgccaacgctatcttcaaactgacctaccagaataaggtggtgaaggtacagcggcccacccctaccgggaccgtgatggacatcatttcacgcaaggaccagcggggctctggccaggtaggtacctacgggttaaacaccttcaccaacatggaagctcagctcatccgccagatggagggcgagggggtcctgagcaaggcggacctggaaaacccccacctccctgagaaaaagatcacgcagtggctagagaccaagggtgtggagcggctaaagcgcatggccatctccggcgacgactgcgtggtgaagcccatcgacgaccggttcgcaaatgccctcctggccctgaacgacatggggaaggtgcgcaaagacatcccccagtggcagcccagcaagggctggcacgactggcagcaggtccctttctgctcccaccactttcacgagctcatcatgaaggacggccggaaactggtcgtgccctgtcgcccccaggacgagctgataggtcgggcgcgcattagccagggtgcgggctggtctctcagggagaccgcctgcctgggcaaggcgtatgctcagatgtggagcctgatgtacttccaccggcgcgaccttcggctggcctccaacgcaatctgcagcgcagtgcccgtccactgggtcccgacctcgcgcactacttggagcatccacgcccaccaccaatggatgaccacagaggacatgctaactgtgtggaaccgggtctggatcgaggacaacccctggatggaggataaaacccccgtgaccacctgggaagacgtgccatacctagggaagagagaggaccagtggtgcggcagcctgatcggactcacgtcccgggcgacctgggcccagaacatccccacggctatacagcaggtccgctcgctcatcggtaacgaggagtttctcgactacatgccctcgatgaagcggttcaggaaggaggaagagagcgagggggcgatctggtga

SEQ ID NO: 25911 - RNA, 9873 nt, synthetic construct
  misc_feature 1..9873: note = derived and/or modified CDS sequence (opt11) from DENV-3__KJ189295__SS-prME
  source 1..9873: mol_type = other RNA
acctccctctgtctaatgatgatactgccagccgcactggcgttccacttaactagtcgggatggcgagccacggatgatcgtcggtaagaacgagcgtggcaaaagcctgctgttcaagacagcatccgggattaacatgtgcacccttatcgcgatggacctaggggagatgtgcgacgacactgtaacctacaaatgcccccatatcaccgaggtagaacccgaggacatcgactgctggtgcaatctgacaagcacctgggtgacctacggcacgtgcaaccaagccggcgagcaccgaagggacaagagatccgtagccctcgccccacacgtgggcatggggctagacacccgcacacaaacctggatgagcgccgagggcgcctggcgccaggtggagaaggtcgagacgtgggcactgcgccacccaggcttcactatattagcgctattcctggcccactacattggcaccagtctcacccagaaggttgtgattttcatcctgcttatgctcgtcacgcccagcatgacgatgagatgcgtgggggtgggcaaccgcgacttcgttgaagggctatccggggccacctgggtggacgtggtcctcgaacacgggggttgcgtgaccacgatggccaagaacaaacccacgctcgacattgagctgcagaagaccgaagccacccagctggcgacgttgcggaaactatgcatcgaaggcaaaatcaccaacattaccacggacagccgctgccctacgcagggcgaagctgtcctgccggaagagcaagaccaaaactacgtctgcaaacacacttacgtggatcgaggttggggcaacgggtgtggcctctttggaaagggctccctagtgacctgcgcgaaattccagtgcctggagcccatcgaggggaaagtcgtgcagtacgaaaacctcaaatacaccgtgatcatcacagtgcacaccggagatcagcatcaggtcggaaacgagacacagggggtcacggccgagatcacgccccaggcctcaaccaccgaagcgaccctgcccgagtacggcaccctagggctcgagtgctccccgcgcacgggcctggatttcaacgaaatgatcctgcttaccatgaagaacaaggcgtggatggtgcatcgtcagtggttctttgaccttcccctgccctggaccagcggcgccaccacagaaactcccacctggaatcggaaggagctcttggtgaccttcaagaatgcccatgccaagaaacaggaggtagtggtcctgggctcccaggagggcgcgatgcatacggcgctcacgggggccaccgagatccagaactcaggaggcacctccattttcgcggggcatctgaagtgtcggctaaaaatggacaagctcgaactgaagggcatgagctacgcgatgtgcaccaatacatttgtcctgaagaaggaggttagcgagacgcagcacgggaccatccttataaaagtggagtacaagggcgaggatgcgccgtgtaaaattcccttctctactgaggacggacacggcaaggctcacaacggccgcctgatcaccgctaaccctgtggtaaccaaaaaggaagagccggtgaacattgaagccgagccgcccttcggggaaagcaacatcgttatcggaatcggggacaatgcgttgaagatcaattggtacaaaaagggctccagcatcgggaagatgttcgaggccaccgcccgcggcgcccgtcggatggctatcctcggagacacggcgtgggacttcgggtctgttggcggggtactgaattcactaggtaagatggttcaccagattttcggatccgcgtacaccgccttattctcgggcgtgagctgggtgatgaagataggcataggtgtactcctgacctggatcggcctgaacagcaaaaacacctccatgtctttctcctgcatcgccatcggcatcattacgctgtacctgggtgccgtggtgcaggcggacatggggtgtgttatcaactggaagggaaaggaactgaagtgcggaagcgggattttcgtgacaaatgaagtacacacgtggactgaacagtacaaattccaggccgactctcccaagcgtttggcaacagccatcgccggcgcatgggaaaacggggtgtgcggcatccgcagcaccacccggatggaaaatctcttgtggaagcaaatagcaaacgagctcaactacatactctgggagaacaacatcaagctgaccgtggtggtaggggatatcatcggagtgttggagcagggcaagcgaacactaaccccccagccgatggagctgaagtactcctggaaaacttggggaaaggccaagatcgtgaccgccgaaacgcagaatagttcgttcatcatagatggacccaacacccccgagtgccccagcgcctccagagcgtggaacgtctgggaggtggaggattacggcttcggcgttttcactacgaacatctggctgaggctgcgtgaggtctatacccagctgtgcgaccaccgcctcatgagcgccgccgttaaggatgagcgggccgtgcacgcggatatgggctattggattgaaagccagaaaaacgggtcctggaagttagagaaggccagcctaatcgaggtcaagacgtgcacctggccgaagtcccacacactctggagcaacggcgtcctggagtcggatatgatcatccccaagagcctggccgggcctatttcccagcacaaccatcggccaggctaccatacccagacggctgggccgtggcatctcggaaagctggagctggatttcaactactgcgagggcaccactgtagtcataacagaaaattgcggtacccgcggtccaagcctacgcaccaccacggtttccggtaagctgatacatgagtggtgttgccggagctgcaccctgcccccccttagatacatgggcgaggatggctgctggtacggcatggagatccggccaatatccgagaaagaagagaacatggtcaagagcctggtttcagctggtagcgggaaggttgacaactttaccatgggcgtgctatgcttggcgatcctgtttgaggaggttatgcggggtaagttcgggaagaaacacatgatcgccggggtattctttaccttcgtgctgctcctgtccggccagatcacatggcgtgacatggcccacacgctgattatgatcggcagcaatgcctccgaccgcatggggatgggggtcacctaccttgctttaatcgcgaccttcaaaatccagccgtttctggccctcgggttcttcctgcgaaagctgacttcgagggagaacttactattaggcgtgggcctcgcaatggctacgaccctgcagttgcccgaagatattgaacaaatggcgaacgggatcgccttgggtctgatggccctcaagctaatcacccagtttgagacctaccaactgtggacggccttaataagcctcacatgttctaacaccatcttcaccctcacggtggcctggagaactgcgactttgattctcgccggcgtcagcctgctgccggtgtgtcagtcatcgtcgatgaggaagaccgactggctccccatggcagtcgccgctatgggcgtaccgccactgccgctcttcatcttcagcctcaaagacaccctgaagcgccggtcctggccgctgaatgagggcgtgatggcagtcggccttgtgagtatccttgcatccagccttctccgcaatgacgtgcccatggccggccctctggtagccggcggcctgcttatcgcctgctacgtgataacggggacttccgcggacctgaccgtagagaaagccgccgacatcacatgggaggaggaagccgagcaaaccggggtctcgcacaatctgatgattaccgtcgatgatgacgggaccatgcggatcaaagatgatgagaccgagaatatcctcacggtcctgctgaagacagctttactgattgtcagtggcatcttcccgtactctatccccgcgaccctactcgtgtggcacacctggcagaaacagacgcaacgctccggagttctgtgggatgtcccatcaccgcctgagacccagaaggccgagctggaggagggggtataccggatcaagcagcaaggcatcttcggaaaaacccaggtaggagtgggtgttcaaaaggagggagtgtttcacactatgtggcacgtcacccgcggcgcagttctcacctataatgggaagcggctcgagccaaactgggcctctgtgaagaaggacctaatcagctatggagggggatggaggctctccacccagtggcagaagggggaggaggtacaggtaatcgcggttgaacccggaaagaaccccaagaactttcagactatgccgggcacgtttcagaccaccaccggggagataggcgccatcgccctggacttcaagccaggaacgagcggtagtccaatcatcaatcgagagggcaaggtggtggggctatacggaaacggggttgtcacaaaaaacggcggctacgtgtcaggcatagcccagaccaatgcagaaccggatggccccacacccgagctggaggaggagatgttcaagaaacgcaacttaacgatcatggacctacatccaggatctggtaagacccggaaatacctaccggcgatcgtgcgtgaggccatcaagcggcgcctccggaccctgatcctggcccctacccgcgtcgtagccgccgagatggaagaggcgttgaagggcctgcccattcgataccagacgacggcgactaagtccgagcacaccggcagagagattgtagacctgatgtgccacgccaccttcaccatgcggctcctcagccccgtaagggtgccgaactacaatctgattatcatggacgaagcccacttcaccgacccggcatctatcgcggcccgggggtatatcagcaccagagtgggtatgggggaagccgccgctatttttatgacagccacgccacctggaacggctgacgcttttccgcagtccaatgcccccatccaggatgaagagcgagacatacccgagcgatcatggaactccggcaacgagtggatcacagactttgccgggaaaacggtctggttcgtccctagcataaaagccggaaacgatattgccaactgcctcaggaagaatgggaagaaagtgatccagctgtcgagaaagacattcgataccgaataccagaagaccaagctgaacgactgggacttcgtggtgaccaccgacataagcgagatgggcgccaacttcaaggctgatcgggtcatcgatccgcggcgctgcctaaaacccgtgatcttaaccgacgggcccgaacgggtgatcctggccgggcctatgccagtgacggccgcgtccgccgctcagcgccggggccgcgtcgggcgtaatccccagaaggaaaacgaccagtacatatttaccggccaacccctcaataacgacgaagaccatgcgcactggacggaagctaaaatgttgctagacaacatcaacacccccgagggtataatacctgcactcttcgagcccgagcgcgaaaagagcgccgcgatcgatggcgagtaccggctgaagggggagtctcgcaaaaccttcgtggaattaatgcggcgcggggatctccccgtgtggttggcccacaaggtcgcctccgagggaattaagtatacggaccgcaagtggtgcttcgacgggcaacgcaataaccagatcctcgaggagaatatggatgtggagatctggacgaaggagggcgagaaaaagaagttgcgcccgcgctggctagacgcccgaacgtactccgacccgttggccctcaaggagttcaaggacttcgcggccggccgaaagtcaatcgccctggatctggtcaccgagatcgggcgcgtgccctcacacttggcccatcggacccgcaacgccctggacaaccttgtgatgttacacactagcgagcacgggggccgggcctaccgccacgccgtggaagaactccccgagaccatggagaccctgctcctgctgggactcatgatcctgctaaccggaggcgccatgctgttccttatctcaggaaaagggattgggaagacgtctatcggattgatctgcgttattgcctcatccgggatgctctggatggccgagattcctctgcagtggatcgctagcgccattgtgctggagttctttatgatggttttgctgatccccgaacccgagaagcaaagaacgccgcaggacaaccagctggcttatgttgtgatcgggattctcaccctggccgcgatcatcgccgctaatgagatggggctgctggaaaccacgaagagagacctcggcatgtccaaagagccgggggtggtgagccccacaagttacctcgacgtggaccttcatcccgccagcgcctggaccctgtacgcggtcgctaccacggtaatcacaccgatgctgcgtcacacgatagagaactccactgcgaacgtcagcctcgccgcaatcgcgaatcaggccgtagtactgatgggcctggacaaggggtggccgatttccaagatggaccttggggtgcctctgctggccctcgggtgttacagccaggtcaacccgctgacgctgaccgcagccgtcctccttttaatcacccactacgccattatcggacccggcctccaggcaaaggcgacgcgcgaggcgcagaaacgaactgccgcaggtatcatgaagaacccgacagtggacggtataatgaccattgacctggaccccgtcatctacgattccaagttcgagaaacaattaggccaggtgatgctcctcgtgctatgcgcagtccagttactgctaatgcgaaccagctgggccctctgcgaggccttaacgctggcgaccggccctataaccaccctctgggaggggagccccgggaagttctggaacacgaccatcgcggtaagcatggcaaacatttttcggggttcctacctggcgggtgccggcctagccttcagcatcatgaagtccgtgggaacaggcaaaagaggtactggtagccagggcgagaccctaggcgagaagtggaaaaagaaactcaatcaattgtctagaaaggagttcgacctctacaagaagtccggaataactgaggtcgaccgcacagaggccaaggaggggcttaagcggggagagatcacgcaccacgccgtgagccgcggctccgcgaagctgcaatggttcgtcgagaggaacatggtcatcccggagggaagggtgatcgacctaggctgcgggcggggcgggtggagttattattgcgccggcctgaagaaagtgacagaagtccgcggctatacgaagggtggccccgggcacgaggagcccgttccaatgtcaacctacggatggaacattgtcaagctcatgagcgggaaggacgtcttctacttgccccccgagaaatgtgacaccttattgtgcgacattggagagagtagcccttctccgaccgttgaagagagccgcacgattcgggtgttgaagatggtagagccatggctcaagaataaccagttctgcatcaaggtgttaaacccatatatgcccactgtgatcgagcaccttgagaggctccaacggaagcacgggggcatgctggtacgaaacccactgtcgcggaattcgacacatgagatgtactggatcagtaacggcaccgggaatatagtggcgagcgtgaacatggtctcgcgactcctgctgaatcggttcacaatgacgcacagaaggcccaccatcgagaaagatgtggacctcggggccgggactcgccacgtgaacgccgagccagaaacgcccaacatggacgtcatcggggagcggatcaagcgcatcaaggaagaacacaatagcacctggcactatgacgacgagaacccatacaagacctgggcctaccacggatcctacgaggtgaaggccaccgggtccgcgtcaagcatgatcaacggcgtagtcaaattgcttacgaagccctgggacgtggtgcccatggtgacgcagatggcgatgactgatactacccccttcggccagcagcgggtattcaaggagaaagtcgacacccgcaccccgcgttcgatgcccggaacccgacgggtgatgggaattacggctgaatggttgtggaggaccctgggccggaacaaaaagccccgcctgtgcacccgcgaggagttcactaagaaggtgcggacgaatgccgcgatgggcgccgtcttcaccgaggaaaaccagtgggactccgccaaggctgccgtagaggacgaggacttctggaaactcgtggatcgggagcgggagctgcataagctgggaaagtgtggatcctgcgtgtacaacatgatggggaagcgggaaaagaagctcggcgagttcggcaaggctaaagggtcccgagcgatctggtatatgtggctgggagccagatacctggagttcgaagccctcgggtttctgaacgaggatcattggttcagtcgggagaactcctacagcggcgttgagggcgagggcctgcacaaattgggctatatcctgagagacatctccaagattccgggaggggcaatgtatgcggatgacaccgccgggtgggacaccagaatcacagaggatgaccttcacaacgaggagaagatcacccaacagatggatccggagcacagacagctcgccaacgcaatcttcaagctgacctaccagaataaggtggtcaaagtgcagcgtcctaccccgactgggactgtgatggatatcataagccgtaaagatcagcggggcagcggccaggtcggcacctacgggctgaataccttcaccaacatggaggcccagctcatccgccaaatggagggcgaaggggtcctgctcaaggcggatctcgagaacccccacctccccgaaaagaagatcacgcagtggctggagaccaaaggagtggaacgtctcaagcgcatggccataagcggcgatgattgcgtcgtgaagcccatcgacgaccggtttgccaacgccctactggccctaaacgacatgggaaaggtgcggaaagatatccctcaatggcaaccctccaagggatggcatgactggcaacaagtacctttctgcagtcaccacttccacgaactgatcatgaaggacggccggaagctcgtggtgccctgccgcccccaggacgagctcatcgggcgagctcgcatcagtcagggggccggctggtctctcagggaaacggcctgcttaggcaaggcatacgcccagatgtggtctctcatgtacttccaccggcgcgatctgcggttggcctctaacgccatttgctccgcggttcccgtccactgggtcccaaccagccgtacaacttggagcatccacgcccatcaccaatggatgaccaccgaggacatgctcactgtgtggaaccgggtgtggatagaggacaacccttggatggaggaccgtacgccagtcaccacctgggaggacgttccctacctggggaagagggaggaccagtggtgcggctccctgatcgggcttacgtcgcgagcgacatgggcccagaacatcccaacggccattcaacaggttcggtccctgatcggcaatgaagagttcctggactacatgccatccatgaagcgcttcaggaaggaagaggagtccgagggggcgatctggtga

SEQ ID NO: 25912 - RNA, 9873 nt, synthetic construct
  misc_feature 1..9873: note = derived and/or modified CDS sequence (opt11) from DENV-3__KJ189297__SS-prME
  source 1..9873: mol_type = other RNA
acctccttatgcctcatgatgatcctgcctgcagctctggcgtttcacctcaccagccgggacggcgaaccccggatgatcgtcgggaaaaatgagcggggcaaaagcctgctgttcaagacggcgtccgggatcaacatgtgcaccttgatcgccatggacctcggcgaaatgtgcgacgataccgtgacctacaaatgcccacacatcacagaagtagagccggaggacatcgactgttggtgcaacctcaccagcacctgggtgacctacggtacctgcaaccaggccggggagcaccggcgcgataaacgctccgtagccctagccccacacgtgggcatggggcttgacacccgcacccaaacatggatgtccgctgagggggcctggcgccaagtcgagaaagtcgaaacgtgggctctacgccacccggggtttaccatcctcgcactgttcctcgctcactacatcggcacctccctcacgcagaaagtggtgatcttcatattgctaatgctcgtcacgcctagcatgaccatgcgatgcgtcggggtggggaaccgcgatttcgtggagggtctatccggggccacctgggtggacgtggtattagagcatggcggatgcgtgaccacgatggccaaaaataagccaactcttgacatcgaactacaaaagaccgaggccacgcagcttgcgactttacgcaagttgtgcatagagggtaagatcaccaacatcactactgacagccggtgccccacgcagggtgaagcggttctgccggaggagcaggatcagaattacgtctgtaagcacacgtacgtggatcgtgggtggggcaacggatgtggtctattcgggaagggttcactggtgacatgcgccaagttccaatgcctcgagcccatcgagggcaaggtcgtgcagtacgaaaacctcaagtatactgttatcatcacagtccacaccggggatcaacatcaggtggggaacgagacacagggggtcaccgccgagataacgccccaggcctctaccaccgaggcgaccctcccggaatacggcacactgggactcgagtgctccccgagaaccggccttgacttcaacgagatgatccttctcaccatgaagaataaggcctggatggtgcatagacagtggttcttcgaccttccactgccctggaccagcggtgccaccacggagacccccacctggaatcggaaggagctgctcgtaaccttcaagaatgctcacgccaagaagcaggaggttgtggttctggggtcccaggaaggcgcaatgcatacggccctcactggggctactgagattcagaacagcggtgggacgtccatcttcgcgggccacctgaagtgccggctcaagatggacaagctcgagctgaagggcatgagctatgccatgtgcacgaataccttcgtgctgaagaaggaggtgtcggagactcagcatggtaccatcctcattaaggtggaatacaagggagaggacgctccgtgcaaaatccctttcagtacggaggatgggcacggtaaagctcataacggtcgactgattactgcaaaccccgtcgtgactaagaaggaggagcccgtgaatatcgaggccgagccgcccttcggggagtcaaacatcgtgatcggcatcggggacaacgcactgaagatcaactggtacaagaagggctcctctattgggaagatgttcgaggccaccgcccggggcgcccgccgaatggcaatcttaggcgacacagcgtgggacttcgggtcagtgggcggggtgctcaacagcttgggtaaaatggtgcatcagattttcgggtccgcctacactgccttgtttagtggcgtgtcctgggtgatgaagatcgggatcggggtgctcctcacctggatcggcctgaactcgaagaacacgtccatgagcttctcctgtattgcaatcgggataatcacgctctacctgggcgccgtggtgcaggctgacatgggttgcgtcatcaattggaaaggcaaagagctgaagtgcgggagcggaatattcgtaactaacgaggtgcacacgtggacggaacagtacaagttccaggccgacagtccaaagcgactcgctacggccatcgctggcgcgtgggagaacggggtatgcggcatacgcagcaccacccggatggagaacctgctgtggaagcagatcgccaatgagctgaactacatcctgtgggagaataatatcaaattaactgtggtagtcggtgacatcattggagttttagagcagggcaagcgtacgctgacgccccagccgatggaactgaagtactcttggaagacttggggaaaagccaaaatcgtgaccgccgagacgcagaacagctccttcatcattgatggcccgaacacacccgagtgccccagcgcctcccgggcctggaacgtctgggaggttgaggactacgggttcggtgtgttcacgaccaatatatggctcaggctgcgggaggtttacacccagttatgcgaccataggctcatgagcgcagctgttaaggacgaacgtgccgtccatgcggacatgggctactggattgagagccagaagaacggttcctggaagttggagaaagcgagcctgatagaggtcaagacatgcacctggccaaaatcccacacactctggagcaacggagtactggagagtgacatgatcatccctaagtcactggcagggcctatctcgcagcacaaccaccgtccgggctaccacacccagactgcgggtccctggcacttaggcaaattggagttggacttcaactactgcgaaggaaccaccgtagtcatcaccgagaactgcgggacgcggggcccgagcttgcggacaacaacggtctccggaaagctgattcatgagtggtgctgcagaagctgcacgctgcccccgctccgctacatgggcgaggacggctgctggtacggcatggaaatccggccgatttccgagaaggaagagaacatggtcaagagcctggtatccgccggcagtgggaaggtagacaacttcaccatgggcgtactgtgcttagcaatcctgttcgaggaagtaatgcgcgggaagttcgggaagaaacacatgatcgctggggtcttcttcacctttgtattgctcctgtccggccagatcacttggcgggatatggcacacactctgataatgatcggaagcaacgcctccgatcgaatgggcatgggcgtaacctatctcgccctgatcgcgactttcaagatacagcccttcctggccctagggttctttctgcgcaagctgacatcacgcgaaaacctcctcctgggcgtgggccttgccatggctacgaccctgcagcttcctgaggacatcgagcagatggcgaacgggatcgcactcggattgatggccctgaagctgatcacccagttcgagacctaccagttatggacagccctaataagcctgacgtgctccaacaccatcttcaccttgacggtagcttggcgcacagctaccttaatactcgccggagtcagcctgctgccagtctgtcagtcctcgagcatgcgcaaaaccgactggctccccatggctgtcgccgcaatgggtgtgcctcccctcccgctgttcatcttcagcctcaaggatacccttaagcgcagatcctggccgctgaacgagggtgtgatggcggtcggactcgtgagcatcctggcctcctctctgcttcgcaacgacgtgcccatggccggccccttggtagctggtggccttctcatcgcctgctatgtgatcactggcacttcggccgacctgaccgtggagaaggccgcagacatcacgtgggaggaggaagccgagcagacaggcgtctctcacaacctgatgatcactgtggacgacgacgggaccatgcggatcaaggacgacgagaccgagaacattctcacggtgctgctgaagaccgccctcctaatcgtctccggcatcttcccgtacagcattccggcgaccctgctagtatggcacacctggcagaagcagacccaacgatccggcgtgctgtgggacgtcccctccccgccggagacgcagaaggcagaacttgaggagggggtgtaccggataaaacagcagggcatcttcggtaagacccaggtcggagtcggggtacagaaggagggcgtgttccacaccatgtggcacgtgacgcggggagcagttcttacctataacgggaagcggctggagcccaactgggcgtccgtaaagaaagacctgatctcatacggaggaggctggcgtctatccacgcagtggcaaaagggggaggaagtacaggtgatcgcggtggagcccggtaaaaaccccaagaacttccaaactatgccgggcacgttccaaacaaccaccggggagatcggtgccatcgccctggatttcaagcccgggacgagcggctcacccattatcaacagagaaggtaaggtagtgggtctgtacggaaacggcgtggtgaccaagaacggcggatacgtgagcggcatcgcccaaaccaacgcagagcccgacggcccaactccggagctggaggaagagatgttcaagaaacgcaacctcacgatcatggacctgcaccccggtagcggcaaaacgcgaaagtacctgcccgccattgtcagggaagccataaagcgtcgccttcggaccctcatactggccccaacccgcgtcgttgccgccgagatggaggaggcgctcaagggtctgcctattcggtaccagacgaccgcaacaaagtccgagcacacaggccgtgagatcgtggatctaatgtgccatgccacgttcaccatgcggctccttagccccgtccgcgtgcccaattacaacctaataatcatggacgaggcacattttaccgaccccgcttcgatagcagcccggggttacatctctacgcgcgtgggcatgggagaggcggccgcgattttcatgacggccacgccgcctgggaccgccgacgccttcccacaatctaacgcgccaatccaagacgaagaacgcgacatccccgagcggagctggaactccggcaacgagtggatcactgacttcgcgggcaagacagtgtggttcgtcccctcgatcaaggccggcaatgacatcgcaaactgcttacggaagaacgggaagaaggtgatccagttgtcacggaagacttttgacaccgagtaccaaaagaccaaacttaacgactgggatttcgtcgttacgaccgacatctctgaaatgggagccaactttaaagcggaccgggtgatcgaccctcggcgctgcctcaagcccgttatcctgacagacggacccgagcgggtcatcctggcggggccgatgcccgtgaccgccgcctcagcagcccaacgccgcgggagagtaggccggaacccccagaaggagaacgaccagtacatcttcaccggccaaccgctcaataacgatgaggaccacgcgcactggacggaggctaagatgctgctggataacataaacaccccagaaggcatcatcccagccctgttcgagccagagcgcgagaagtccgccgcaatagacggcgaataccgactgaagggagagtcccgcaagacctttgtggagctgatgaggcgtggggacctacccgtgtggttagcccacaaagtcgcaagcgaaggcattaagtataccgacaggaaatggtgtttcgacgggcagcgcaacaaccagattctggaagagaacatggacgtcgagatctggacgaaagagggggaaaagaaaaagctccggccgaggtggttagatgctcgcacctattccgacccgctggccctcaaagagttcaaggacttcgcggccggccgcaagtcgatagcattagacctggtaaccgaaatagggcgtgttccctcccacctcgcccatcgcacgcgcaatgccttagacaatttggttatgttgcacacgagcgagcacggcggccgggcatacaggcacgcagtagaggaactgccagaaactatggagaccctgctcttgctgggcctcatgatcctgctgaccggcggcgcgatgttattcctgataagcggcaaggggatcggcaagacgtccatcggcctgatttgcgtgatcgcctctagtgggatgctctggatggccgagatccctctccagtggatcgcgagcgccatcgtactggaatttttcatgatggtgctcctgatccccgagcccgagaagcagcgcacgccccaggacaaccagctggcctatgtggtgatcggaatcctcaccctggctgctatcatcgcggccaacgagatgggactgctcgagacgaccaagcgtgacctgggcatgtccaaggagccgggtgtcgtgtccccaacttcctacctggatgtggacctccaccccgcctcagcctggacgttgtacgcggtcgccaccactgtgatcacccctatgctacgtcacaccatcgaaaactcaaccgccaacgtttctctcgcagccatcgccaaccaggccgtcgtgctcatgggcctggacaaggggtggcccatctccaagatggacctgggcgtgccccttctggccttggggtgttactcccaggtcaacccactgacattaaccgcagcagtcctcttactgatcacccactacgcgatcataggccccggcctccaggccaaggccacccgcgaagcccagaagcggaccgccgccgggatcatgaagaacccaaccgtggacggcatcatgaccatcgacctggaccccgtcatctacgactccaagtttgaaaagcagctgggccaggttatgcttctggtcctgtgcgccgtccagctcctgctgatgcgcacctcgtgggcgctctgtgaggccctgacactagcaaccggacccatcaccacgctttgggagggctcccccgggaagttctggaacactaccatcgcggtcagcatggctaacatctttcgggggtcctacctggccggggccggcttagcgtttagcataatgaaatccgttgggacaggcaaacgcggtaccgggtctcagggagagaccctcggggagaagtggaagaagaagctcaaccaactgagccgtaaggagttcgacctctacaagaaatccggcatcacggaagtggaccgaaccgaggcgaaagaggggcttaagcggggcgagattacccatcacgccgtgtccagaggctccgcaaagttgcaatggttcgttgagcggaacatggtgatacctgagggacgcgtgattgacctcggctgcgggcggggcgggtggtcgtactactgtgccggtttaaagaaggtgacggaggtccgcgggtacacaaagggcggtcccgggcacgaggagccagtcccaatgagcacctacggctggaacattgtgaaacttatgagcgggaaggatgtattctatctcccacccgaaaagtgcgacaccctgctatgcgacatcggggagtcctctccctctcccactgttgaggagtcacgcaccatccgagtcctgaagatggtcgaaccgtggctcaagaacaaccaattttgcataaaggtgttgaatccctacatgcccaccgtgatcgagcatctggagagactccagcgtaagcacggcgggatgctggtcaggaatcccctttcgcggaacagcacccacgagatgtactggatcagcaacggcacaggaaacattgtggcttcggttaacatggtctcccgcctcctcctgaatcggttcactatgacccatcgcaggccgaccatcgagaaggacgttgatctcggcgctggaacccggcacgtcaacgccgagcctgagacacccaacatggacgtcatcggggagaggatcaagcgcataaaggaggaacataacagcacctggcactacgacgacgagaacccatacaagacctgggcctaccacggctcctacgaggtcaaggcaaccgggagcgcatcgagcatgattaatggagtggtgaagctgctgacgaagccctgggacgtggttcccatggtgacacagatggccatgaccgatacaacgccctttggccagcagcgggtgttcaaggagaaagtcgacacccgcacaccgagatcaatgccgggcacccgccgggtaatggggataacggctgagtggctttggcgcacgctggggcgaaataagaaacctcgcctgtgcacccgcgaggagttcaccaagaaggtgcggactaatgcagcgatgggtgcagttttcactgaagagaaccagtgggatagtgcgaaggccgcagtagaagacgaagacttttggaagctggtagaccgcgagcgggagcttcataagctgggcaagtgcgggagctgcgtttacaacatgatggggaaacgcgaaaagaagctcggtgagttcggtaaggcgaaggggagccgggccatctggtacatgtggctgggcgcgcgctacctggagttcgaggcccttgggttcttgaacgaggaccactggttcagtcgcgagaatagctacagcggtgtcgaaggggaaggactgcataagctcggttatatcctacgcgatatcagccaaatacccgggggcgctatgtacgctgacgataccgctgggtgggacaccagaattacggaggacgatctacacaacgaggagaagatcacgcagcagatggatccggagcatcgccagctcgcgaacgccatcttcaagctcacctaccaaaataaggtggtgaaagtgcaacggccaacccccactggcaccgtgatggacataatcagccgcaaggatcagcgtggctccgggcaagtcggcacctatgggctgaatacgtttaccaatatggaggcgcagctcatccgccagatggagggcgagggggtgctgagcaaggcggacctagagaacccacacctcccagagaagaaaatcacgcagtggctagagaccaaaggagtggagcggctgaagcggatggccatctcaggcgacgactgcgtggtcaagcctatcgacgacaggttcgccaacgccctcctggccctgaacgacatggggaaggtccgcaaagacatccctcaatggcagccctcgaaggggtggcacgactggcagcaggtccctttttgctcccatcactttcatgagctgatcatgaaggacgggcgcaagttagtggtgccctgtcggccgcaagacgaattgatcggccgtgcacgcatcagccagggggcaggatggtccttacgcgagacggcctgcctgggcaaggcttacgcgcagatgtggagcctgatgtatttccaccggcgagacctcagactggcaagtaacgctatatgtagcgccgttcccgtgcactgggttccgacctcccgcacgacctggtccatacacgcgcaccaccaatggatgaccaccgaggacatgctgacagtctggaatcgggtatggatcgaggataacccctggatggaggataaaacccccgtgaccacatgggaggatgtgccctacttagggaaacgcgaggaccagtggtgcggcagcctgatcggactcacgtcccgggctacctgggcgcagaatattccgactgccatacagcaagtccgcagcctcattgggaacgaggagttcttggactatatgccttccatgaagcggtttcgaaaagaggaagaaagcgagggtgcaatttggtga

SEQ ID NO: 25913 - RNA, 9873 nt, synthetic construct
  misc_feature 1..9873: note = derived and/or modified CDS sequence (opt11) from DENV-3__KJ189298__SS-prME
  source 1..9873: mol_type = other RNA
acgagtctctgcctgatgatgatcttacccgcagcactagcgttccatctcacatcacgggacggagaacctcgtatgatagtaggcaaaaacgagcgggggaaaagcctgttgttcaaaacagcttctggaattaacatgtgcaccctaatcgcgatggacctgggcgagatgtgcgatgacacggtaacgtataaatgtccacatatcacagaggtcgagccagaagacattgattgctggtgcaacctgacctcaacatgggtaacctacgggacatgtaatcaagccggagagcaccgcagggacaaacggtccgttgcgttagccccacatgtcggaatgggccttgacacccgtacgcaaacttggatgagtgccgaaggcgcctggcgccaggttgagaaagtagaaacatgggcattgcgtcatcccggcttcacaattttggccctattcctggcgcattacatcggcacatcactgactcaaaaagtagtgattttcatcctgctaatgctcgttacaccgagcatgaccatgcgctgtgttggggttgggaaccgagacttcgtcgaaggcctgagcggagccacgtgggtagacgtagttctggaacatggcgggtgcgttaccacaatggcgaaaaacaaacccacccttgacattgaactccagaaaactgaggccactcagctggccacattacgcaaactatgcatagaaggaaaaattacaaacataaccacggatagtcgatgccccacccaaggggaggccgtgctccccgaagaacaagatcaaaattacgtgtgcaaacacacgtacgtagataggggctgggggaacgggtgtgggctgttcggcaaaggctcactcgtgacatgcgccaaattccaatgtcttgaacccatagagggcaaagtcgtacagtacgaaaacttaaaatacactgtcatcatcacagtccataccggtgaccagcatcaggtcggaaacgagacccaaggggttacggccgaaataacaccccaggcttcaaccactgaagccaccttaccggaatacggaacgctaggattggaatgtagcccacgcacaggactggattttaacgaaatgatcctcctcacaatgaaaaacaaagcctggatggtccacaggcagtggttctttgacctaccgcttccctggacaagcggagctaccaccgagacaccaacctggaaccgcaaagaactactggtcaccttcaaaaatgcacacgcgaagaaacaagaggtggtagtactcggcagccaggaaggggctatgcacacagcccttaccggggcgaccgaaattcaaaactcaggcggtacaagtatattcgcagggcacctgaaatgccgccttaaaatggacaaactcgagctgaaaggtatgagctacgcgatgtgcaccaacacgttcgtgctcaagaaagaagtgtcggagacacagcacggcacgatactcataaaggtagaatacaaaggggaagacgcaccttgcaaaatcccattctcgacagaggacggccacggtaaagcacataacggaaggctgattacggcaaacccagtcgttactaagaaagaggaacccgtcaatatcgaggctgaacccccgttcggggaaagcaatattgttatcggcatcggcgacaacgctctcaagatcaactggtacaagaaaggaagtagtatcggcaaaatgttcgaggcaacagctcgcggcgcccgaagaatggctatactaggagatacagcatgggattttggctcggtcggaggcgtcctcaatagccttggtaagatggtgcaccaaattttcggcagcgcatataccgccctgttctcgggtgtcagttgggttatgaaaatcggcataggcgtcttacttacatggatcggcctcaactctaaaaacacaagcatgagcttctcctgcatagccatcggaatcatcacactctacctcggtgccgttgtacaggcggacatgggctgcgtcatcaactggaagggtaaagagctcaagtgtgggagcgggatatttgtaaccaacgaagttcacacttggaccgagcaatacaaattccaggcagattcaccaaaaagattggcaactgccatagctggagcctgggagaacggggtatgcggcatcaggagcaccacgagaatggagaacctcttatggaagcagatagcgaacgagctcaattacatattatgggaaaacaacatcaagctcactgtcgtggttggtgacataataggagtactggagcaaggcaagcgcacactgactccgcaaccaatggagcttaaatacagctggaagacatggggaaaagcaaaaatagtgactgcagaaacacaaaatagctcattcataatcgacggacccaacaccccggaatgccccagtgcctcgcgagcatggaacgtatgggaagtcgaagactacggtttcggtgtgttcacgacaaacatctggttgcggcttagggaagtttacacccagctatgcgaccaccgcctaatgagtgcggcggtaaaagatgaaagagcagtacacgcagacatgggatactggatagagtcgcaaaagaacggcagctggaagctcgagaaagcgtccctgatcgaagtgaagacatgtacatggcctaaatcgcacacgctttggagtaacggcgtcctagagagtgacatgatcatcccaaaatccttagccggaccaatctcccaacacaaccaccgtccaggctatcacactcagaccgccgggccttggcacctaggaaagctcgaactagattttaactactgtgagggtacgacggtggtcattacagaaaattgcgggacacggggaccatctctccggaccaccaccgtgtccggaaaactcatccacgagtggtgctgcaggagctgcacattgccgcctctcagatacatgggggaggacggctgctggtacggaatggaaattcgccccatatccgagaaagaagaaaatatggtcaagagcctagtctcagccggcagcggaaaggtggataactttacgatgggagtactctgtctggcaatattattcgaagaagtaatgcggggaaagttcggcaaaaagcacatgatagcgggagtatttttcacattcgtgttactcctgagcgggcaaatcacctggagaaacatggcacataccctcataatgataggctcgaacgccagcgaccgaatgggaatgggagtgacttacctggcactaattgccacatttaagatacaaccattcctagctcttggcttcttcttgcgtaaactgacctcccgggaaaatctcttactaggagtcggcctcgctatggcgaccaccctacaacttccagaggacatagagcaaatggccaacggcatagccctagggttgatggcactgaaactaatcacccaatttgaaacataccagctttggacagcacttatatctttaacatgcagcaataccatcttcacactaacggtagcctggagaaccgctactctaatcttagcaggcgtgagcctacttcctgtctgccagagctcgtctatgcgaaaaaccgactggctcccaatggccgtggcagccatgggtgtcccgccactaccactgtttattttctcactaaaagacaccctgaagagaagatcatggcctctgaacgaaggcgtcatggcagtaggcctagtgtccattctggccagctccctcctacggaatgatgtaccgatggcaggccctttagtagctgggggattactcatcgcatgctatgtaataaccggcaccagcgccgacctaacggtggagaaggcagccgatatcacgtgggaagaggaagcagagcaaaccggcgtatcccacaacctaatgatcacagtcgatgacgacggaaccatgcgaataaaggacgatgaaaccgaaaacatcctgacagtcctcttgaagaccgccttactcatagtaagcggcatcttcccgtactccataccagccacactcctagtatggcacacctggcagaagcagacccaaagatcaggggtactctgggacgttccatcaccacccgaaacacaaaaagcggagctcgaagagggagtctacaggatcaaacaacaggggattttcggaaagacgcaagtaggagtcggagtacagaaagaaggggtattccacacaatgtggcacgtaaccagaggcgccgtcctcacatacaacggtaagcggctcgaacccaactgggcctcggtcaagaaggacttgatatcttatggcggcggctggaggcttagcacacaatggcaaaagggtgaagaggtacaggtcatagccgtagagccgggcaagaacccaaagaatttccaaacgatgcccgggacctttcagacgaccacaggcgaaataggagccatagccttagattttaagccggggacaagcgggagcccaattataaaccgagagggcaaagtagtcgggttatacggtaacggagtggttacgaagaacggcggctacgttagcggaatcgcgcaaactaacgcagaaccggatggacccacgcctgagcttgaggaagagatgttcaaaaagcgaaaccttacaatcatggacctacacccaggttcaggaaagacgaggaaatacctcccagcaattgtacgggaggcaataaagcgaagattacgcacgctgatcctggcaccgacgagagtggtcgcagccgaaatggaagaagcactgaagggcctcccgatacggtatcaaaccacagcaactaaaagcgagcacaccggcagggaaatagtcgacctcatgtgccacgcaacattcaccatgcgactcctaagtccagtgagagtccctaactacaatcttatcatcatggacgaagcccatttcacagacccagcgagcattgccgcgcgaggatatatttctacgcgggtcggcatgggagaagcggctgcaatctttatgaccgccaccccgccagggactgcagacgccttcccgcagagtaacgcacccattcaggacgaagaacgcgacataccagaacggagctggaactcaggtaacgagtggatcactgactttgcagggaaaacagtgtggtttgtcccgagcatcaaagcaggtaatgacatagccaactgcctacggaagaacggcaagaaagtaatacaactaagtaggaagacctttgacactgaataccaaaagactaaattgaacgactgggactttgtggtcacgacagacatcagcgagatgggagccaattttaaggccgacagagtcatcgatccccgcagatgtctcaaaccagttatcttaaccgatggcccagagcgagtaatcttagccgggccaatgccagtcacggcagcaagcgctgcccaacgacgggggagagtaggaaggaacccccagaaagaaaatgaccagtacattttcacagggcagcccttgaacaatgacgaagaccacgcacactggacagaggcaaagatgctactagacaacataaacacaccagaaggaataattccagctcttttcgagccagaaagggagaaaagcgcagcaatcgatggcgaatataggctcaaaggcgagagtcggaaaacattcgtcgagctcatgcgccgcggcgacctaccggtgtggctagcacacaaggtagcgagcgaaggtatcaaatacacagatcgaaaatggtgcttcgacggccagagaaacaatcaaatcttggaagaaaacatggacgtggaaatctggactaaggaaggcgagaagaagaaactgcggcctcgatggcttgatgctcgaacctactcggaccctttagcgctcaaagagttcaaagatttcgcagccggccgaaaatcaattgcgctagacctagtcacagagataggacgtgtccctagccacttggcacatagaaccagaaacgccttggacaatctggttatgctgcatacatccgagcacggtggccgagcatacagacacgccgtagaggagctccccgaaactatggagaccctacttctcctgggcctaatgatactgttgacgggtggcgccatgttatttttaattagcggaaaaggcataggaaaaactagcatcggcctcatatgcgtaatagcatccagtggaatgctttggatggcggaaataccactgcaatggattgcatcagccatagtccttgagttctttatgatggtattactgattccggaaccagaaaaacagagaactccccaagataaccagctcgcatacgtggtcattggtatcctcacactagccgccataatagcggccaacgagatgggattattggaaacaactaaacgagacctaggcatgtcgaaggaaccaggagtcgtgagccctacttcgtacctcgacgtcgaccttcatccagcatcagcatggacgctctatgcagtcgcaaccaccgtaatcaccccaatgttacgacacacaatagaaaactccaccgcaaatgtcagtctcgccgcgatcgcaaaccaagcggtagtgttaatgggcctcgataaagggtggccaattagcaagatggatctcggggtgccgctcttagcactagggtgctacagccaggtaaaccccctgacgctcacagccgccgtacttctcctgatcacccactatgcaataataggcccgggactacaggctaaggcaacaagggaggcccaaaagagaacggctgcaggtatcatgaagaaccccacagtggacgggataatgacaatcgatttagacccagtgatctacgacagcaagttcgagaaacagctgggtcaggtaatgctcctagttttatgcgccgtacaactcctgttgatgcgcacaagctgggccctgtgtgaggcgctcacgttagcgaccggacctataaccacgttgtgggaaggtagcccagggaagttctggaacactaccatcgcggtctcaatggcaaacatatttcgaggaagttatttagcgggagccggtctggccttcagcatcatgaaaagcgtggggacaggtaaacgaggcaccggttcccagggagaaacgctaggagaaaagtggaaaaagaaactcaaccaattaagtagaaaggagttcgacctatataagaaaagcggtatcaccgaggttgaccgaaccgaagcgaaagaaggccttaagagaggagaaataacccatcatgcagtcagccgtgggtcggcaaaactccagtggttcgtagagagaaacatggttataccagaaggtcgcgtaatagacctagggtgtggtcgaggcgggtggagctattattgtgccggcctaaagaaggtaacggaggtccgagggtacaccaaagggggaccaggccacgaggaaccagtcccaatgagcacgtatggctggaacatagtaaaactaatgtcagggaaagatgtcttctacttgccgcctgaaaagtgcgacaccttactttgtgacatcggagaaagcagccccagccccaccgtcgaggaatcacgcaccatacgagtactaaagatggtcgaaccctggctaaagaacaaccaattttgcataaaggttttgaacccttatatgccgacggtgatagagcatctggagcgcctgcaacgaaaacacggcggcatgctagtgcgcaacccactatcccgcaattcaacacacgaaatgtactggataagcaacggaaccggaaacattgtggccagtgtcaacatggtatcaaggctgctgttaaaccggttcacaatgacacaccggcgcccgactatagagaaggacgtggacctaggagcgggaacgcgacacgtaaacgcagagccggagacgcctaacatggacgttataggagagcgaataaagcgtatcaaggaggagcacaattccacctggcactacgacgaagaaaacccatacaagacttgggcataccacggaagctatgaagtgaaagcaactgggtcagcttcaagcatgattaacggagtcgtgaaactgctgactaaaccatgggatgtcgtacccatggttactcagatggcgatgactgacacaaccccgttcggacagcaacgagtgttcaaagaaaaggttgacacgagaacgccgcgaagtatgccaggcacgcgccgggtaatgggaatcacagccgaatggctatggcgaaccctaggaaggaacaaaaagccacgcctctgcacaagagaggagttcactaagaaagtacgcacaaacgcagcgatgggagccgtcttcacagaggaaaaccagtgggacagcgcaaaggcggcagtagaagatgaggacttttggaagctggttgaccgcgagcgtgagcttcacaagctcggcaagtgcgggtcctgcgtctacaatatgatggggaaaagagagaagaaactcggagagttcgggaaagcgaaggggagcagggctatttggtacatgtggttgggagctcgttacctagagttcgaggcgcttggtttcttgaatgaggatcattggttcagtcgcgaaaactcgtactcaggcgttgagggggaaggtcttcataaactaggctatattctaagggacataagcaaaatcccaggaggggcgatgtacgcggacgacaccgccgggtgggacacacgcatcactgaagacgacctacacaacgaggagaaaattacacaacaaatggacccggaacatcggcaacttgcaaacgcaatcttcaagctcacgtaccagaacaaggtcgtaaaagtgcaacggcccacgcctaccggcacagtaatggacattatcagcagaaaggaccagcggggaagcggacaggtgggtacttacggactaaataccttcacaaacatggaagcgcaattgattagacagatggagggcgaaggggtactatcaaaagcagacctggaaaatccgcaccttcctgagaagaaaataacccagtggctagaaacaaaaggagtagaacgcttgaagcgtatggcaatatcgggcgatgactgcgtggtaaagccaatcgacgaccggttcgctaacgcgttgctagcactcaacgatatgggcaaagtacgcaaagatatcccccaatggcaaccgagcaaggggtggcacgactggcaacaagtacccttctgttcgcaccacttccacgaactaataatgaaagacggcagaaaactggtggtaccgtgcagaccacaggatgaactaataggacgagccagaatatctcaaggcgcaggatggagcctaagggaaacagcgtgcctgggaaaagcgtacgcacaaatgtggagtctcatgtactttcaccgccgcgacttaaggttggcctcaaacgccatttgctcagccgttccagtgcattgggtcccaacgtctagaactacctggagcatccacgcgcatcaccaatggatgaccaccgaggacatgctcaccgtttggaaccgagtatggattgaggacaacccatggatggaagacaagacgcccgttacgacctgggaagacgttccctaccttggcaaaagagaagaccagtggtgtggatccttaataggcctaacaagccgagccacatgggcccaaaacataccaaccgctatccaacaggtgaggtcgctcatagggaacgaggagttcttggactacatgccctcaatgaagcggttccgaaaagaagaagagtctgaaggcgcaatctggtag

SEQ ID NO: 25914 - RNA, 9873 nt, synthetic construct
  misc_feature 1..9873: note = derived and/or modified CDS sequence (opt11) from DENV-3__KJ189301__SS-prME
  source 1..9873: mol_type = other RNA
accagcctctgtctcatgatgatcctgcccgccgctcttgcgttccacctcaccagccgtgacggggaaccccggatgattgtggggaaaaacgaacggggcaagagcttattattcaagaccgcctcaggtaccaacatgtgcaccctcatcgctatggaccttggcgaaatgtgcgacgacaccgttacctacaagtgcccccacattacagaagtggaaccggaggacatcgactgctggtgcaacttaaccagcacctgggtgacctacgggacatgcaatcaggcgggggagcatcggcgcgacaagcgatccgtggctctcgcgccccatgtgggcatgggtctggatactaggacccagacctggatgagcgccgagggcgcgtggagacaggtcgagaaggtggaaacctgggccctccgccaccccggtttcaccatcttagcactgttcctggcgcactacattggcacgtccctcacgcagaaagtggtcatcttcatcttgctgatgctcgtcacccccagcatgaccatgcggtgcgtgggggtagggaatcgcgacttcgtcgagggcctgtccggtgctacctgggtggacgtggtcctggagcatggagggtgcgtgacaacaatggcaaagaacaaacccaccttggacatcgagctgcagaagaccgaggccacgcagctggcgaccctccggaaactctgcatcgagggcaagatcaccaacatcacaaccgactcaaggtgcccaacccagggcgaggccgtgctgcccgaggaacaggaccagaactatgtgtgcaagcatacctacgttgacagaggatggggcaatgggtgcggcctcttcggtaagggctcgctagtgacttgtgccaagttccagtgcctggaacccatcgagggcaaggtcgtgcagtacgaaaacctcaaatataccgtcatcatcacggtccacacgggggaccagcaccaggtgggcaatgaaacccagggcgtgacggccgagataacaccccaggcaagcaccaccgaggcgaccctgcccgagtacggcacgctgggcctcgagtgttctccgcgcaccgggttggatttcaatgagatgattctgctcaccatgaaaaacaaagcctggatggtgcaccggcagtggtttttcgacctgcccctgccctggacctcaggggccaccaccgagacccccacctggaaccgcaaggagctattggtgacgttcaaaaacgcccacgcaaagaagcaggaggtcgtcgtgctggggtcacaggagggcgctatgcacactgccctcaccggggccactgagatccaaaactcgggcgggacctcgatttttgctggccatctaaagtgccgactgaaaatggacaagctcgagctgaagggcatgtcatacgccatgtgcaccaacacatttgtcctgaagaaggaagtgtcggaaacgcagcacgggacgatactcatcaaggtggaatacaagggcgaggacgcgccatgcaaaatccccttctcaacggaagacggacatggcaaggcgcacaacgggcgcctcatcaccgccaaccccgtcgtcaccaagaaggaggagcccgttaacatcgaggcggagccgcccttcggcgagagcaacatcgtcataggtatcggtgacaacgcgctgaagatcaactggtacaaaaagggctcgagcattggcaagatgttcgaggccacggcccggggcgcccgccggatggctatcttaggcgacaccgcctgggacttcgggtccgtagggggcgtgctaaacagcctgggcaagatggtccaccaaatattcgggagtgcctacaccgcattattcagcggcgtatcctgggtgatgaagatcggcatcggggtcctcctgacctggatcggcctgaatagcaagaacacgtccatgtcattttcctgcatagccatcggcatcattaccctatacctgggcgctgtagtgcaggctgacatggggtgcgtcattaactggaagggcaaggagctgaagtgcggcagtggcatctttgtgaccaacgaagtacacacctggacggaacagtacaagttccaggccgattcccccaagcgtctcgccaccgccatcgccggggcttgggagaatggggtgtgcggcatcagaagcaccacgcgtatggagaatttgctgtggaagcaaatcgccaacgagctcaactacatcctatgggaaaacaatgtaaaacttaccgtggtcgtgggggacatcatcggcgtactcgagagaggcaagagaaccctaacgccccaaccgatggagctcaaatacagttggaagacctgggggaaggccaagatcgtcacggccgagacccagaacagctccttcatcatagacgggcccaacacgcccgagtgtccaagcgcgtccagagcgtggaatgtgtgggaggtggaggactacgggttcggcgttttcaccaccaacatctggctccgtctgcgtgaagcatacacgcagctgtgcgatcatcggttgatgagcgccgctgttaaggacgagcgcgcggttcacgccgacatgggctattggatcgagagccagaagaacggtagctggaagctcgagaaggccagcctaattgaggtcaagacttgtacctggcccaagtcccacaccctctggagcaacggcgtgctggagtccgacatgatcattcccaagtctcttgccgggcccatctctcagcacaatcaccggccgggctaccacacgcagaccgctggcccttggcacttgggcaagctagagctggacttcaactactgcgagggaaccacagtggtgattacggagaactgcgggacgcgcggacccagcctccggacaacaacggttagtgggaagctgattcatgaatggtgctgccgcagctgtactctgcccccgctccgttacatgggggaggatggatgctggtacggtatggagatcagacctatttcagagaaggaggaaaacatggtcaaatcactggtcagtgctggcagcggaaaagtggacaacttcaccatgggcgtgctgtgcctcgcgattctgttcgaggaggtcatgcgggggaagttcggcaaaaagcacatgatcgccggggtgtttttcaccttcgttctcctcctgtccgggcagatcacgtggcgagatatggcccacaccctaattatgatcgggtctaacgcctccgaccggatggggatgggcgtcacctacctagcgctgattgcgacgttcaagatccagcccttccttgcactcggtttcttcctgcggaaactgacgagccgcgagaacctactgctgggcgtggggctcgccatggccaccactctgcaactgcccgaagacatcgagcagatggccaacggtattgccctcggcctgatggccctgaagctcattacccagttcgaaacgtaccagctgtggaccgcgctgattagccttacctgttccaacacgatcttcaccctgaccgttgcttggcgcaccgccactttgatcctcgccggcgtcagcctgctgccggtatgccagtcaagctccatgcgcaagacggactggctcccaatggccgtcgccgcgatgggcgtaccgccacttccattattcatcttcagtctcaaggacaccctcaagcggcgatcctggccactgaacgaaggggtgatggccgttggcctcgtcagcatcctggcctccagcctgctcagaaacgatgtgcccatggccgggcccctggtagccgggggactgctcatagcctgctacgtgatcaccgggacctcagcagacctgacggtggaaaaagccgccgacatcacctgggaggaggaggcagagcagaccggcgtcagccacaatctaatgatcaccgtagacgacgacgggaccatgcgcatcaaagatgacgagactgagaatatcctcaccgtgctgctgaagaccgctctcctgattgtctccggcatcttcccgtacagcatacccgccaccctgctcgtgtggcatacgtggcaaaagcagacccagcgaagcggcgtgctgtgggatgtccctagcccgcccgagacccagaaagctgagctggaggagggggtgtatcgcatcaagcagcaggggattttcgggaagacccaggtgggcgtcggggtgcagaaggagggcgtcttccacacgatgtggcacgtgacccggggagctgtgctcacgtataatgggaagagattagagcccaattgggctagcgtgaagaaggacttaatcagctacggcggtggctggcggctcagtacccagtggcagaagggggaggaggtccaggtgatcgccgtggagcctggcaagaaccccaaaaactttcagacgatgccaggaacctttcagaccaccacgggggagatcggcgccatcgccctggacttcaaacccggaacaagcggtagccccattatcaacagggaggggaaggtcgtgggtctgtacggcaacggggtggtcaccaagaacggtgggtacgtgagcggcatcgcccagactaacgcggagcccgacggccccacgccggagctggaggaggagatgttcaagaagcggaacctcaccatcatggacttgcatccgggtagcggcaagacccgcaagtacctgccggccatcgtgagagaagccatcaagcgccggctgcgcaccctaatcttggcccccacgcgggtcgtggccgcggagatggaggaggctctcaaggggctgccgattcgataccagacgaccgctaccaagagcgagcacacgggccgggagatcgtggacctgatgtgccatgccaccttcaccatgcgactcctgtcacccgtccgggtgccgaattataacttaatcatcatggacgaggcccacttcacagatcccgcgtccatagccgcgagaggctacatcagcacgcgcgtgggcatgggcgaggccgcggccatcttcatgaccgctacgccgcccgggaccgcggacgctttcccgcagtccaatgcgcccatccaggatgaggagcgggacattccagagcgcagctggaactccggcaacgagtggattacagacttcgcgggcaagaccgtctggttcgtgccgagcatcaaggccggcaatgacatcgctaattgtctccggaagaacggtaagaaggtgattcagttgtctcgcaagacatttgacaccgagtaccagaagacgaagctgaacgactgggacttcgtcgtgaccacggacattagcgagatgggcgcaaacttcaaggcggaccgggtgatcgacccgcgccggtgcctcaagcccgtcatcctgaccgacggccccgagcgcgtgatcctagccgggcctatgccagtcacggccgcctccgccgcgcagcgtcgcggtcgagtcggtaggaatccccagaaagagaacgaccagtacatcttcacaggccagccccttaataacgacgaggaccacgcccactggaccgaggccaagatgctgctggacaacatcaacacacccgaggggatcatcccggccctcttcgagcccgagcgggagaagtcagcggccatagacggggagtaccgcttaaagggcgagtcgcgtaagacgtttgtcgagctgatgcgccgtggagatctccccgtttggctggcccacaaggtcgcgagcgagggcatcaagtatacggatcggaaatggtgcttcgacgggcaacggaacaaccaaatcctcgaggagaacatggacgtggagatatggactaaggagggcgagaagaagaaactccgcccccgctggctggacgcgaggacttactccgatccgcttgccctcaaggagttcaaggatttcgccgctggccgcaagagcatcgccctggaccttgtgaccgagataggacgggtgcccagtcacctcgcgcaccgtacccggaacgcgctagacaacctggtgatgctccacaccagcgagcacggcgggcgcgcctaccggcacgccgtcgaggagctgcccgaaaccatggagaccctgctcttgctgggccttatgatcctcctgaccggcggggccatgctgttcctaatcagcggtaaggggatcgggaagacctccataggcctcatctgtgtcatcgcgtcctcaggcatgctctggatggcggaaatcccactgcaatggatcgccagcgccatcgtgctggagttcttcatgatggtcctcctggtgccagagcctgagaagcagaggacgccccaggacaaccagctcgcctatgtagtcatcgggatcctgaccctcgccgcgatcatcgctgccaacgaaatgggactgctcgagacgacaaagcgggatctgggcatgagcaaggagccgggagtggtaagccctacctcctacctggacgtcgacctacaccccgcaagcgcgtggaccctttacgccgtggccacgacagtaatcacccctatgctgcgccacaccatcgagaactccaccgccaacgtcagcctcgccgcgatcgctaatcaggcagtggtactgatgggattagataaggggtggccgatcagtaagatggacctcggtgtcccccttctggccctcgggtgctacagccaggtaaacccattgaccctgaccgccgccgtgctcctgctgatcacccactatgccatcatcggccccggcttgcaggcgaaggcaacaagggaggcacagaagcgcacggcagccgggatcatgaagaacccaaccgtcgacggcataatgaccatcgacttagatcccgtgatctacgattccaagttcgagaaacagctgggccaggtcatgctcctggtcctgtgcgccgtgcagctcctgctaatgaggacttcatgggccttgtgcgaagcgttgacccttgccacaggtcccatcacgacgctctgggaaggctcccccgggaaattctggaacacgaccatagccgtgagcatggcaaacatcttccggggctcctatctggccggggcgggcctggcattcagcatcatgaagtccgtcgggaccggcaagcggggcaccggcagccaaggcgagacgttaggggaaaagtggaagaaaaagctgaaccagctgagccgcaaggagttcgacctctataagaaatcaggcatcacggaggtggaccggaccgaggccaaggaggggttgaagcgcggcgagatcacgcaccacgccgtgagccggggttccgcgaagttacagtggtttgttgagcgcaacatggtgataccggaggggcgagtaatcgacctcggatgcggtcgcggcgggtggagctactactgcgcgggcctgaagaaggtaacggaggtacgcggctacaccaaaggcgggcctgggcacgaggagcctgtgcccatgtccacgtacggctggaatatcgtcaagctgatgtccgggaaggacgttttctacttgcctccagagaagtgcgacaccctgctatgcgacatcggcgagtccagcccctcccccacggtagaagagagccggaccatccgcgtcctgaaaatggtagaaccctggctcaaaaataaccaattctgtatcaaggtgctcaacccctacatgccgacggtcatagagcacctggagcggctccaacgcaaacatggcgggatgctggtgcggaaccctctgtcccgcaactctacccacgagatgtactggatctccaacggcacagggaacatcgtggcgagcgtcaacatggtgtctcggctcctgctgaaccgctttaccatgacccaccggcgcccgaccatcgagaaggacgtggatttaggtgccggcacacggcacgtcaatgccgagccggagacacccaacatggacgtgatcggggagcgcataaaaaggatcaaggaagaacacaacagcacctggcattacgacgacgagaacccgtacaaaacctgggcttatcacggctcatacgaggtgaaggccaccgggagcgcctcgagcatgatcaacggcgtcgttaagctcctgaccaagccctgggacgtcgtacctatggtgacccagatggccatgaccgacacgacccccttcgggcagcagcgcgtgttcaaggagaaggtggacacgcggaccccgcgctctatgcctggcacgcggcgggtcatgggaatcacagccgagtggctctggcggaccctgggtcgcaacaagaagccccgcctgtgtacccgggaagagttcacgaagaaagttcgcaccaacgcggccatgggcgccgtgttcactgaggagaatcagtgggacagcgctaaggccgctgtcgaggacgaggatttctggaagctcgtcgaccgggaacgcgagttgcacaagctggggaagtgcggcagctgtgtgtataacatgatggggaagcgggagaagaagctcggcgagttcggcaaagccaaggggtcccgcgccatctggtacatgtggctgggagccaggtacctggagttcgaggccctcggcttcctgaacgaagaccattggttcagccgcgaaaacagctacagcggcgtggagggggaggggctgcacaagctcggctacatcctgcgcgacatttccaagatccccgggggtgcgatgtacgccgatgacaccgcaggatgggacacgcgcatcaccgaggacgacctgcataacgaggaaaagattacccaacagatggacccggagcaccggcaactcgccaacgctatcttcaaacttacgtaccagaacaaggtcgtgaaggtgcagcgccctactcccacgggcactgtcatggacataatcagtcggaaggaccagcgcggttccggccaggtgggcacctacggccttaacacctttacgaacatggaagcgcagctcatccggcaaatggaaggcgagggggttctgagcaaggctgacctggagaacccccacctaccagagaagaaaatcacccagtggctggagaccaagggcgtggaaaggctgaagcgtatggccatctccggcgacgattgtgtggtgaaacccatcgacgatcgcttcgctaacgcgctcctggccttgaacgacatgggtaaggtacggaaagacatcccccagtggcagccctctaaggggtggcacgattggcaacaggtgccgttttgctcccaccatttccacgagttgatcatgaaggacgggcgcaagctggtggtcccctgccggccccaggacgagctgataggccgggccagaatcagccaaggggccggctggtccctccgggaaacagcctgtttgggcaaggcgtacgcccagatgtggagcctgatgtactttcaccgtcgtgatctccgactggcttccaatgcgatctgcagcgctgtcccggtgcattgggtcccgacatcccggactacctggagcatccacgcacaccatcagtggatgactactgaggatatgctgaccgtctggaaccgcgtgtggatcgaggacaacccctggatggaggacaagaccccagttaccacgtgggaggacgtgccatacctgggcaagcgggaggatcagtggtgcggtagcctgatcggcctgacctccagggccacgtgggcacagaacatcccgacggccatacagcaggtccggagcctgatcggcaatgaggagttcctggactacatgccctcgatgaagcgcttccggaaagaggaagagagcgagggggcaatctggtag

SEQ ID NO: 25915 - RNA, 9873 nt, synthetic construct
  misc_feature 1..9873: note = derived and/or modified CDS sequence (opt11) from DENV-3__KF955456__SS-prME
  source 1..9873: mol_type = other RNA
acctcgctttgcttaatgatgattctgccggcagcgctggcctttcacctcaccagccgggacggggagccccggatgattgtgggcaaaaacgagcgcggcaagagcctgctgttcaagacagccagcgggatcaacatgtgtaccctcatcgccatggatctgggcgagatgtgcgacgacaccgtaacctacaagtgcccacacatcgccgaagtggagccggaggatatcgactgctggtgcaacctgaccagcacctgggtgacctacgggacctgcaatcaggcaggggagcatcggagggacaagcggtccgtggcccttgcgccccacgttggcatggggctcgacacgaggacccagacctggatgtctgccgagggagcctggcgccaggtagagaaagtggagacatgggccttgcgtcacccggggttcacgatcctcgccctgtttttggcccactacatcggcacctccttaacccagaaggtagtgatcttcgtcctgctgatgctcgtgaccccctccatgacgatgcggtgcgtgggggtcggcaaccgcgacttcgtcgagggcctgtccggggccacatgggtggacgtagtgctagaacacggcgggtgcgtgaccacaatggccaagaacaagcccacgctcgacatcgagctgcagaagaccgaagcgacgcagctggccaccctccggaagttgtgcatcgagggcaagatcacgaacatcactaccgacagcagatgtcccacccagggcgaggcggtcttgccggaggagcaagaccagaattacgtgtgcaagcacacgtacgttgaccgtggctggggcaacgggtgtgggctcttcggcaagggctccctggtgacctgcgccaagtttcagtgcctcgagcccatcgagggcaaagtcgtgcagtacgagaacctcaaatacacggtcatcatcaccgtgcacacgggggaccagcatcaggttggaaatgagacacagggtgtcactgccgagatcacaccccaagcgagcacgaccgaagccatcttacccgagtacggcactctgggtctcgagtgctccccgcgcacgggactggacttcaatgagatgatcttgctcacgatgaaaaacaaagcgtggatggtgcaccggcagtggttctttgatttacccctgccctggacgtcgggcgccaccactgagactccaacgtggaaccgcaaggagttgctagtgaccttcaagaacgcccacgcgaagaaacaggaggtggtggtactggggtcccaagagggagccatgcataccgccctcaccggggctacggaaatccagaacagcggtgggaccagcatcttcgccggccacctgaaatgtcggttgaagatggacaagcttgaactgaaggggatgagctacgccatgtgtactaacaccttcgtgctaaagaaggaggtgagtgaaacacagcatgggaccatcctcatcaaggtcgagtacaagggggaagacgccccgtgcaagatacctttctccaccgaggacggacaggggaaggctcacaacggccgcctgattaccgccaacccagtggtgacgaagaaggaggagcccgtcaatatcgaggcggagccgcccttcggcgagtctaatatcgtgataggtatcggagacaacgctctgaagatcaactggtataagaagggctcatcaatcgggaagatgttcgaagccaccgcgcggggcgcccgccggatggcaatcctgggcgatacggcctgggacttcggctccgtgggcggtgtcctcaactcactgggcaagatggtgcaccagatcttcgggtccgcctacaccgcgctgttcagcggcgtgtcctgggtaatgaagatcggcatcggcgtgctgctgacttggatcggcctgaacagcaagaacacctccatgagcttttcctgcatcgccatcggcatcattactctctacctgggcgctgtcgtccaagccgataccgggtgcgtgatcaactggaagggcaaggagctgaaatgtggttctgggattttcgtgacgaatgaggtccacacctggaccgagcagtacaagttccaggccgactcacctaaacgcctcgcaaccgccatagcgggcgcctgggagaatggcgtgtgtggcatcagaagcacgacccggatggagaacctcctatggaagcaggtggccaacgagctaaattacatcctgtgggagaacaacatcaagttgaccgtcgtggtgggggacatcatcggcgtccttgaacagggcaagcgcaccttaacgccacaacccatggaactgaagtactcctggaagacctgggggaaggccaagattgtaaccgctgagacgcagaacagctccttcatcatcgacggccccaacacgcccgagtgcccctccgcctcccgggcctggaacgtttgggaggttgaggactatggtttcggagtgttcacaaccaacatctggctcaagcttcgcgaggtgtacacccaactgtgtgaccaccggttgatgagcgccgctgtcaaagacgagcgcgccgtgcacgccgatatgggatactggatcgagagccaaaagaacgggtcctggaagctggagaaagcgagtctgatcgaggtcaagacatgcacttggccgaagtcccatacgctgtggagcaacggcgtccttgagtccgacatgatcatccccaagagcctggccgggcccatctcccagcacaattaccggccgggctatcacacgcagaccgccgggccctggcacctcggcaagctggagctggacttcaactattgcgagggcactaccgtggtgatcaccgagaactgcgggacgcgcggcccgtcactccggaccactaccgtctccgggaagctgatccacgagtggtgttgtcgtagctgcaccctgccccctctccgatacatgggcgaggatgggtgctggtatggaatggaaatccggcctatctccgagaaggaggagaacatggtgaagagccttgtgtccgcgggctctgggaaagtcgataacttcactatgggcgtgttgtgcctcgcgatcctgttcgaggaagtgatgcgggggaagtttggcaagaagcacatgatagcgggtgtattcttcaccttcgtcctgttgctgagcggccaaattacgtggcgagacatggcccacacccttgtgatgatcggcagcaacgcatccgatcggatggggatgggggtcacttacctggcgctgatcgccaccttcaaaatccagccgttcctggccctagggtttttcctacgcaaactgacctctcgggagaaccttctgctaggcgtgggcttggccatggcgaccacgctgcagctgccggaagatatagagcagatggccaacggcatcgccctaggcctaatggccctgaagctcataacccaattcgaaacctaccaactgtggaccgcgctgattagcctcacgtgctccaacacaatcttcacgctgaccgtcgcgtggcgcacggcaaccctgatactcgccggggtgagccttctgccggtgtgccagagtagctccatgcggaagtcggactggctccccatgaccgtcgcagccatgggtgtgccgcccctccccctgttcatattctccttaaaggacaccctgaagcgccggagctggcccctgaacgagggagtgatggctgtcggcctcgtctccatcctggctagctcgctgctcagaaacgatgtgcccatggccggccccctggtcgccggtggcctcctcatcgcctgctacgtgatcacgggaacaagcgctgatctgacggttgaaaaggccgcagacgtaacctgggaggaggaggcggagcagacgggggtgtcccacaacctgatgatcaccgtggacgacgacgggaccatgcgcatcaaagacgacgagaccgaaaacatcctcacggtcctgctgaagacggccctcctcatagtgagcggcatctttccttactccatccccgctacccttttagtgtggcacacctggcagaagcagacccgccgcagcggcgttctgtgggacgtaccttccccgcccgagacgcaaaaggccgagctggaggagggagtgtacagaataaagcagcagggcatattcggcaagacccaagttggcgtgggggtccaaaaggaaggcgttttccataccatgtggcacgttaccagaggggcagtgctcacatacaacgggaagcgcctcgagcccaattgggccagtgtaaagaaggacctgatctcctatggtgggggctggcgtctcagcgcgcagtggcagaagggggaggaggtacaggtgatcgccgtcgaacccggcaaaaacccaaagaacttccaaaccatgcccggcaccttccaaaccacaactggcgaaatcggcgccattgccctggacttcaagcccgggaccagtggctcccccataatcaaccgcgaaggcaaggtggtggggctgtacggcaacggggtcgtgaccaagaacggcgggtacgtgagcggcatcgcacagaccaatgccgagccggacgggcccacccccgagctggaggaggagatgttcaagaagcgtaatttaaccatcatggacctgcatcccgggtccgggaagacccgaaagtacctgccggctatcgtccgcgaggccatcaagcggcgcctcagaacgctgatcctggcccccacccgcgttgtggcagccgagatggaggaagccctgaaggggctgcccatacggtaccagaccaccgccaccaagagcgagcataccggcagggaaattgtcgacctgatgtgccacgctaccttcaccatgcggctcttatctcccgtccgcgtgccgaactacaacctgatcatcatggacgaagcccactttacggatcccgcgagcatcgcggcccgggggtacatctccaccagggtcggcatgggtgaggccgcggccatcttcatgaccgccacgccgcccgggacggcagacgccttcccgcagagcaacgcccccatccaggatgaggagcgcgatatccctgagaggtcctggaacagtggcaacgagtggatcacggatttcgccgggaagactgtgtggttcgtgccctctatcaaggccggtaacgacatcgctaactgcttacgcaagaacgggaagaaggtaatccaactgtcacgaaagaccttcgatacggagtaccagaagaccaagctcaacgattgggacttcgtggtaaccaccgacatcagcgagatgggggccaacttcaaggcagacagggtcatcgacccgcggcggtgcttaaagcccgtgatcctgacggacggtcccgaacgggtgatcctggccggacctatgccagttaccgccgccagcgccgctcagcgccggggccgcgtggggcgaaacccccagaaagagaacgatcagtacatcttcacaggccaaccacttaacaacgacgaggaccacgcccattggaccgaagccaagatgctgctggacaatattaacacccccgaagggatcatcccagcccttttcgagcctgagcgcgagaagtcagcggccatcgatggcgagtaccggctaaagggcgagagcaggaagacgttcgtcgagctgatgagacgcggcgacctcccggtgtggctggcccacaaggtggcctccgaggggattaaatataccgaccgtaagtggtgcttcgacgggcagcgcaacaaccaaattctcgaagagaacatggacgtcgagatctggaccaaggagggcgagaagaagaagctccggccccgctggctcgacgcccgtacatacagcgacccactcgcgctaaaggagttcaaggacttcgcggccggccggaagtcgatcgccctggacctagtgacggagatcgggcgcgtgcccagccacctcgcccatagaacccggaacgcactagacaacctggtcatgcttcataccagcgagcacggtgggaaggcttatagacacgccgtggaggaactgcccgaaacaatggagacgctgctcctgttgggcctcatgatcctgcttaccgggggcgcgatgctgttcctaatctcagggaaggggatcggcaagacgagcatcgggctgatctgcgtcatcgcctccagcggcatgttatggatggcggagattccgctgcaatggatcgcctccgccatcgtcctggaattcttcatgatggtgctcttgatccccgagcccgagaagcagcgcacgccccaggataaccagctggcctacgtggtgatcgggatcctcacactggccgcgatcatcgccgctaacgagatgggcctgctagaaaccaccaagagagacctgggaatgagcaaggaaccgggggtggtaagtcccaccagctacctggatgtcgacctacaccccgcctccgcctggacactgtacgcggtggccacgaccgtcatcacccccatgttacgccatacgatcgagaacagcacggccaatgtctccctggccgcgatcgccaaccaggctgttgtgctgatgggcctggataaggggtggccgatcagcaagatggatctcggcgtcccccttctggccttaggctgctactctcaggtcaaccccttaaccctgaccgccgcggtgctccttctaatcactcactacgcgatcattggccccggcctccaggccaaggctacccgggaggcgcagaagcgcaccgcagccgggatcatgaagaacccgacggtcgacgggattatgacgatcgacctggaccccgtaatctacgacagcaagttcgagaaacagctggggcaggtgatgctgctagtcctgtgtgccatccagctcctgctgatgcggacatcctgggccctctgcgaagcgctgaccctggcgactggacccatcacgaccttatgggagggcagccccgggaagttctggaacaccactatcgccgtgtccatggccaacatattccgaggctcttacttggccggggcgggcctggctttctccattatgaagtccgtggggacgggaaagcgcggcaccgggagccagggcgaaaccctcggggagaagtggaagaagaagctaaaccaattatcccgcaaagaattcgacctctacaagaagtccggcatcaccgaagtagaccggaccgaggccaaggaagggcttaagcgcggcgagatcacgcaccacgcagtgtcccggggcagcgccaagctgcagtggttcgtggaacgcaacatggtcatcccggaggggcgggtgatagacctcggctgcggaaggggcggctggtcatactactgcgcgggcctgaagaaggttactgaggtccggggctacaccaagggcgggcctgggcacgaggagcccgtgccaatgagcacctacgggtggaacatcgttaagctgatgtccgggaaagacgtcttctatctcccgcccgagaagtgcgacaccctgctgtgcgacattggtgagagctccccgagccccaccgtggaagagtcacggaccatccgggtcctcaagatggtcgagccgtggctgaagaacaaccagttttgcataaaagtgctgaatccctatatgcccaccgtgatcgagcatctcgagcggctccagcgcaagtatggtggtatgctggtccggaacccactgtctcgcaactccacgcacgaaatgtactggatcagcaacggcaccgggaacatcgtggcttcagtcaacatggtcagccggttactgcttaaccgcttcaccatgacccaccggcgcccgaccatcgagaaggacgtggatctcggcgccggtacccggcacgtgaacgccgagcccgagacccccaacatggacgtcatcggtgagcgcatcaaacggataaaggaggagcacaactccacctggcattatgacgacgagaacccgtacaagacatgggcataccacggcagctacgaggtgaaggcaaccggatccgcaagcagcatgatcaacggcgtcgtgaaactgctgaccaagccctgggatgtggtccccatggtgacacagatggcaatgacggacaccaccccgttcggccagcagcgggtgttcaaggagaaagtcgacacccggacgccccgctccatgcccggcacccggcgcgtcatgggcatcaccgccgagtggctctggcggacacttgggcgcaacaaaaagccccggctctgcacgcgggaggaattcactaagaaggtgcggaccaacgcggccatgggcgctgtcttcaccgaggagaatcagtgggacagcgccaaggccgcagtggaggatgaggacttttggaaattagtggaccgggagcgcgagctgcacaagctggggaagtgcggctcctgtgtatacaacatgatgggcaagcgggagaagaaactcggcgagttcggcaaggctaaggggagccgcgccatttggtacatgtggctgggcgcccggtacctggagttcgaggcgctcgggttcctgaacgaggaccactggttctcccgcgagaacagctatagtggcgtagagggtgagggcctgcataagcttggctacatccttcgggacattagcaagatccccggaggcgcgatgtacgctgatgatacggcaggctgggacacccgcattactgaggacgacctccacaatgaggagaagatcacccagcagatggacccggagcatcggcaattggccaatgcgatcttcaagctgacgtatcagaacaaggtcgtcaaagtgcagcgcccgactcccaccggcaccgtgatggacataatctcccggaaagaccaaagaggcagcgggcaagtcggaacctacgggctcaacacgtttaccaacatggaagcgcagttgatccgtcagatggaaggggagggtgtgctgaccaaggccgatctcgagaatccccacctctccgagaaaaagataacacaatggctggagacgaaaggcgtggagcgcttaaagcgaatggcaataagcggcgacgattgcgttgtgaagccgatagacgaccgcttcgccaacgccctcctggcgctgaacgacatggggaaggtgcggaaagacatcccccagtggcagccgtccaaaggctggcacgactggcaacaggtccccttctgcagtcaccacttccacgagctcatcatgaaggacgggcgcaagctggtggtgccgtgccggccccaagacgagttgatcggccgcgcgcggatctcccagggggccggatggtcgctccgggagaccgcctgccttggcaaggcgtacgcacagatgtggtccctgatgtacttccaccgccgagacctgcgcctggcgagcaacgccatttgctccgccgttcccgtgcactgggtgcccaccagccggaccacctggagcattcatgcgcaccaccagtggatgaccaccgaggacatgctgacggtttggaaccgcgtgtggatagaagacaacccgtggatggaagacaaaacgcccgtgaccacctgggagaacgtcccgtaccttggaaagcgcgaggaccagtggtgtggcagcctgataggccttaccagccgcgccacgtgggcgcagaacatccccaccgccatccagcaggtccggtccctcatcggaaacgaagagtttctggactacatgccaagcatgaagcgcttcagaaaggaggaggaatctgagggggccatttggtga

SEQ ID NO: 25916 - RNA, 9873 nt, synthetic construct
  misc_feature 1..9873: note = derived and/or modified CDS sequence (opt11) from DENV-3__KF955465__SS-prME
  source 1..9873: mol_type = other RNA
acgtcgctgtgcatcatgatgatcctccccgcggcgctggcgttccatctcacaagccgggacggggaaccgaggatgatcgtggggaaaaacgagcggggcaagagccttttgttcaagacggcttcggggataaacatgtgcaccctcatcgctatggatctcggcgagatgtgcgacgacaccgtcacttacaagtgcccgcacatcacggaggtagagcccgaggacatcgactgctggtgtaacctgacctccacctgggtgacctacggcacgtgcaaccaggccggcgagcataggcgcgataaacggtccgtggccctggcaccccatgtgggtatggggctcgacacgcgcacgcaaacttggatgagcgccgagggagcctggagacaggtggagaaggtggaaacgtgggccctgaggcatcccgggttcaccattcttgccctcttcttagcccactatatcggaacgagcctgacgcagaaggtggtcatatttatcttactgatgcttgtgacgccgagcatgaccatgcggtgcgtgggggtaggaaaccgcgacttcgtggaaggcctctccggggccacttgggtggacgtcgtcttggagcatgggggatgcgtcaccacgatggcaaagaataagcccaccctggacatcgaactccaaaagaccgaggctacccagctggcgaccttgcggaagctctgtatcgagggaaaaatcaccaacatcaccaccgacagccgatgcccaacgcaaggcgaggctgtgctcccggaggagcaagatcagaattacgtctgcaaacatacctacgtggaccgggggtggggcaacggttgcggcctgttcggcaagggctccctcgtgacgtgcgccaagtttcaatgcctggaacccatcgagggcaaagtggttcaatacgaaaatctgaagtacaccgtgataatcacggttcataccggggatcagcaccaagtgggcaacgagacccagggggtcactgctgagatcactccacaggcctcaacgacagaggcgatcctgccggaatacggaacccttgggctggaatgctccccgcgcacgggcctcgacttcaacgagatggttctgctgacgatgaagaacaaggcatggatggtgcaccggcaatggttcttcgacctcccgctaccatggacatcgggcgctactaccgagacacccacatggaatcgcaaagagctgctggtcactttcaaaaatgctcacgcaaagaaacaagaggtggtggtcctgggctcccaggaaggcgcgatgcataccgccctgacaggagccacagagatccagaactcaggcggcacatccatatttgccggccacttgaagtgcaggctgaagatggataagctggagttaaagggcatgagctacgctatgtgtacgaacacgttcgtgctcaagaaggaagtgtctgagacccagcacgggacaatcctgatcaaggtagagtacaaaggggaggacgtgccgtgcaagattccattcagcaccgaagacgggcagggcaaggcgcacaacgggcgcctcatcacggctaaccccgttgtcaccaagaaggaggagcctgtgaacatcgaggcagagccgccatttggggagagcaacatcgtgataggcatcggggacaacgccctgaagatcaactggtataagaagggcagcagcatcggcaagatgttcgaggcgaccgcccggggtgcccgccggatggctatactaggggatacggcctgggacttcgggtccgtaggaggggtgctgaacagcctcggtaagatggtgcaccagatcttcggatctgcctatacggctctgttctctggcgtctcctgggtgatgaagatcggcattggggttctgcttacgtggatcggcctgaactctaagaacacttccatgtctttctcctgcattgtcatcgggataatcaccctttacctcggagccgtggtgcaagccgacatggggtgcgtcatcaactggaaaggcaaggagctgaagtgcggcagcgggatcttcgtgacgaacgaggtgcacacctggacagaacaatacaagttccaagctgactctcccaagcgcctggcgaccgcgatcgccggcgcttgggaaaacggggtctgtgggattcgtagcaccacccggatggaaaacttgctgtggaagcagattgccaacgagctgaactatattctctgggagaacaacatcaagctgaccgtggtagtcggagacatcattggcgtgctggagcagggcaagcgcaccctgacgccccagcccatggagttaaagtactcctggaagacctgggggaaggcgaagatcgtgactgccgaaacccaaaactcctccttcattatcgacggaccgaacacgccggagtgtcccagcgcctctcgggcttggaacgtctgggaggtcgaggactacggcttcggcgtgtttaccaccaacatctggctgaagttgcgcgaggtttacacccagctgtgcgaccaccggctgatgagcgcggcagtcaaagatgagcgagctgtgcacgccgatatgggctattggatcgagagccagaaaaacgggtcctggaaactcgagaaggcctcgctgatagaggtcaaaacctgcacgtggcccaagtcccatactctgtggtctaacggtgtgttagagagtgacatgataatcccaaagagcctggctgggcccatctcccagcataactaccgcccgggctaccacacccagaccgcagggccctggcatctaggcaagctcgagctggattttaactactgcgaggggacaactgtagttatcaccgagaattgcggcacccgggggccctcgttacggacaactaccgtctctggcaagctcatccacgagtggtgctgccgcagctgcaccctaccacccctgaggtacatgggcgaggacggctgttggtacggcatggagattcgccccatttctgagaaggaggaaaatatggtcaagagtttagtctccgccggctccgggaaggtggataatttcacgatgggcgtcctgtgtctagccatactctttgaggaggtcatgcgggggaagttcggcaaaaagcacatgatagcaggcgtgttcttcaccttcgtgctgctcctctccgggcagatcacctggagggatatggcgcacaccctgatcatgatcggaagcaacgcatccgaccggatgggcatgggcgttacatacctggccctcatcgctacgttcaaaatccagcctttcctggcactggggtttttcctccgcaagctgacaagcagggagaacctgctactaggcgtagggctcgcgatggccaccacgctacagctgcctgaagacatagagcagatggccaacgggatagcactgggcttaatggcgctcaagctgataacccaattcgagacctatcagctatggaccgccttaatctcactgacttgctccaacaccatcttcaccttaaccgtcgcatggcgcactgccactctcatccttgccggggtatcactcctaccggtgtgccagtccagttccatgcggaagaccgactggttgcccatgaccgtggccgccatgggcgtgcctcctttgccactcttcatcttcagtctgaaggacaccctgaagcgccgaagttggcccttgaacgagggggtaatggccgtcggcctcgttagcatcctcgccagcagcctgctgcggaacgacgtgcccatggccggccccttagttgccgggggcctgctgatcgcctgctacgtcatcaccggcactagcgccgacttaaccgtggagaaggccgcagatgtcacctgggaggaagaggcggagcagactggtgtgtcgcacaacttgatgatcaccgttgatgacgacgggacgatgcgtatcaaagatgacgaaacggagaacatcctgaccgtgctacttaagacagcgctgttgatcgtgtccggaatctttccgtacagcatccccgccaccctgttagtatggcacacctggcagaagcagacgcagcggtccggcgtgctctgggacgtaccaagcccgcccgagacccagaaggccgagctcgaggaaggcgtgtaccggattaagcagcagggaattttcgggaagacgcaggtcggcgtgggggttcagaaggaaggcgtcttccacaccatgtggcatgtaacgcggggtgccgtcttgacctacaacggcaaacggctggaacccaattgggcgtccgtcaagaaggacctgatcagctacggtggaggctggaggctgtctgcccagtggcagaagggggaggaggttcaagttattgccgttgagccagggaagaaccccaagaacttccaaaccatgcccggcacctttcagaccacaaccggggagatcggcgcgatcgcgctcgacttcaagcccgggacgagcggcagcccaatcatcaatcgcgagggcaaagtggttgggctgtatggcaacggggtcgttacgaaaaatggtgggtacgtgtccgggatagcccagaccaatgccgaaccggacggccctacacccgaactagaggaagagatgttcaagaagcggaacctgaccataatggacctccaccccgggtctgggaagacccgcaagtacctgccggccatcgttcgggaggccattaaacggcggctcagaaccttaatcctggcccccaccagggtggtggcggccgagatggaggaagccctgaaggggctccccatccgctatcagaccacggccacaaagtccgagcacaccggccgcgaaatagtcgacctgatgtgccacgcaaccttcacgatgcgcctgctctcgcccgtaagggttccgaactacaaccttatcatcatggacgaggctcatttcaccgatcccgcctccatcgccgcccgcgggtacatctccacccgggtcgggatgggcgaggcggccgccattttcatgactgcgacgcctccggggaccgcggacgcattcccacagtccaacgcccctatacaggacgaggaacgcgacattcccgagcgcagctggaactcaggcaatgagtggatcaccgacttcgccgggaaaacagtgtggttcgttcccagcatcaaggcgggcaacgacatcgccaattgtctgcggaaaaacggtaagaaggtcatccaactctcaaggaaaacgttcgacaccgaataccagaagacaaaactgaacgattgggacttcgtcgtgaccactgatattagcgaaatgggcgcgaactttaaggccgaccgggttattgaccccaggcgatgcctgaagcctgtgatcctcaccgacggcccggagcgtgtgatactggcagggccaatgccggtcaccgccgcgtccgccgcccaacggcggggtcgggtaggtcgcaatccccaaaaggagaacgaccagtatatattcaccggacagccactgaacaacgacgaggaccacgcccactggaccgaggcaaagatgttgctggacaatatcaacacgcccgaggggatcatccccgccctgttcgaaccggaacgggagaagtccgccgcgattgacggcgaatacagattaaaaggcgagtcccggaaaaccttcgtcgagctgatgcgccgcggggacctgcccgtttggcttgcccacaaggtggcgagcgaggggatcaagtacaccgacaggaagtggtgcttcgacggccagaggaacaaccagatcctggaggagaacatggacgtcgagatttggactaaggagggcgagaagaagaaactaaggcccagatggctggacgcgcgcacctactctgacccgctagcgctgaaagagttcaaggatttcgctgcgggcagaaagagcatcgccctcgacctagttacggagatagggagagtaccctcgcacctggcacaccgcaccagaaacgctctagacaacctggttatgctgcacaccagcgaacacggcggaaaagcgtatcgccacgccgtggaagaattacccgagacgatggagaccctgctcttgctgggactgatgatcctcttgaccggtggggcgatgctattcctgatcagtgggaaggggatagggaaaaccagtatcgggttgatctgcgtcattgctagctccggtatgctctggatggccgagatcccgcttcagtggatcgccagcgcaatcgtcctggagttcttcatgatggtgctgcttatcccggagcccgagaagcaacgcacgccccaggataaccagctggcgtacgtggtcattgggatcctgaccctcgccgccattatagcagccaacgagatgggactactagaaaccacgaaaagagatctcggcatgtccaaggagccgggggtggtgtccccaacgtcttatcttgacgtagacctgcaccccgcgagcgcgtggactctctatgccgtggcgaccaccgtgatcacgcccatgctacgacacaccatcgagaactctaccgcgaacgtatcactggccgcgatcgccaaccaggcagtagtgctcatgggtctggacaagggctggccgatcagtaagatggatctgggcgtgccgctcctcgcgctggggtgctacagccaggtgaatcccctcaccctgacagccgccgtgctgctactcattacccattacgccattatcgggcctggcctgcaagccaaagcaacgcgagaggctcagaagcgtacggcagccggaatcatgaaaaacccgactgtggacggaataatgacaattgacctcgaccccgttatctatgattccaagtttgagaagcagctgggccaggttatgctcctggtcctgtgtgccgtacaactgctcctcatgcgcactagctgggcgctgtgcgaggccctcacgctggccacgggacccatcaccaccctatgggaggggagccccgggaagttctggaacactacgatcgccgtaagcatggccaacattttccgggggtcctacttagccggcgccgggctagccttctcaatcatgaagagtgtcggtacaggaaagaggggcacagggagccaaggcgagacactgggggagaagtggaagaaaaagctcaaccagctaagccggaaggaatttgacctgtataaaaagagcgggattaccgaagttgaccgcacggaggccaaagaagggctcaaacgaggcgagatcacccaccatgcggtctcacgcggctccgccaagctacagtggttcgttgagcggaatatggtgatcccggaaggtagggtaatcgacctaggctgcggtcggggcgggtggtcgtactactgcgccggcctcaagaaagtcaccgaggtgcgaggctatacaaagggcggtcccggtcacgaggaacccgtgccaatgagcacgtacggctggaacatcgtcaagctcatgtcgggtaaagacgtcttttacctgccgccggagaagtgcgacaccttgctgtgcgatatcggagaatccagccccagccccaccgtggaagagagccggacaatccgggtcttgaaaatggtggagccgtggctgaaaaacaaccagttctgcatcaaggtgctcaatccgtacatgcccacggtcatcgagcacctggagcgcctgcagcggaagcacggtgggatgctcgtcagaaatcccctgtcccgaaacagcacccatgagatgtactggatctccaacggcaccgggaatatagtggccagcgtcaacatggtgtcccggcttctcctgaaccgcttcaccatgacgcatcgccggccgaccatcgagaaggacgtggacctcggcgctggcacacgccatgtcaacgccgagccagagacccccaacatggatgtgataggggagcgcattaagcgcatcaaggaggagcacaactccacgtggcattacgacgatgagaacccttataagacctgggcctaccatgggtcctacgaggtcaaggctactgggagcgcctccagcatgattaacggagtggtcaagctcctgacgaagccctgggacgttgttcccatggtgacgcagatggcaatgaccgacactacccccttcggtcagcagcgggtgttcaaggaaaaggtggacacaaggacgccgcggagcatgccgggaacgcgccgtgtgatgggcatcaccgcggagtggctgtggcgcactctcgggcgcaataagaagccccgcctttgcacccgtgaggagtttaccaagaaggtccgcactaacgccgcaatgggcgcagtgttcacggaggagaaccaatgggattcggcaaaggccgctgttgaagacgaggatttctggatcctggtcgatcgcgaacgggagcttcataaacttgggaagtgcggcagctgtgtctacaacatgatgggcaagcgcgaaaagaagctcggcgagttcggcaaggctaaggggtccagggcgatctggtacatgtggctcggcgcgcgctatctggaatttgaggctctcggcttcctgaacgaagaccactggtttagccgggaaaacagttatagcggggtggagggtgagggtctccacaagctgggttacatcctgcgcgacatctccaaaatccccggtggagccatgtacgccgacgacaccgccggatgggacacccggatcaccgaagacgacctgcacaatgaggagaaaatcacgcagcagatggatcccgagcaccgccagctggcgaacgccatattcaagctcacctatcagaacaaggtagtgaaggtgcagcggcccacacccacaggcaccgtcatggacatcatcagcagaaaggaccagcgggggtccggccaggtcggcacgtacggcctgaacaccttcactaacatggaggcgcaactgatccgacaaatggagggcgaaggcgtgctatcgaaagccgacctggaaaacccacacctccccgagaagaagataactcaatggctagagacgaagggcgtcgaacgattaaaacgcatggcgataagcggcgacgactgcgtggtgaagcccatcgacgatcggttcgcgaatgccctgctcgcactgaacgatatgggaaaagtccgtaaggatatcccccagtggcagcctagcaagggctggcatgactggcagcaggtcccgttctgttcacaccacttccacgagctgatcatgaaagacggtcggaaattagtggtaccctgtcgcccccaggatgagctgatcggtcgggcccgcatttctcaaggggccggctggagccttcgtgagaccgcttgcctgggcaaggcctacgcgcagatgtggtcgctgatgtactttcaccgcagagacctgcgtctcgcctccaacgcaatctgcagcgccgtgcccgtacactgggtgccgacctcccgaaccacgtggagcatccacgctcaccaccagtggatgaccaccgaagacatgctgaccgtatggaatagagtttggatagaggacaacccatggatggaagacaaaacgcccgtcactacatgggagaacgtgccctacctggggaagcgcgaggatcagtggtgtggctctctcatcggtttaacctcgcgggccacgtgggctcagaacatccctactgccatccaacaagtacggagcctgatcggcaatgaagagttcctcgactacatgccctcaatgaagcgattccgcaaggaggaggaatctgagggggctatatggtaa

SEQ ID NO: 25917 - RNA, 9873 nt, synthetic construct
  misc_feature 1..9873: note = derived and/or modified CDS sequence (opt11) from DENV-3__KF955466__SS-prME
  source 1..9873: mol_type = other RNA
accagcctatgcctcatgatgatcctgccagcggcactggccttccacctaacctcacgggacggtgagccccgaatgatcgtggggaaaaacgagcgcgggaaaagcctgttgttcaagacggcctccggtatcaacatgtgcaccttgattgccatggacctgggcgagatgtgcgatgacaccgtgacgtacaagtgcccgcacataacggaggtggagcccgaggacatagactgctggtgtaacctgaccagcacctgggtgacatacggcacgtgcaaccaagccggcgagcaccggcgcgacaaacggtccgtggctctggcgccccacgtagggatggggctggacacccgaacgcagacctggatgtcggctgagggcgcctggagacaggtcgagaaagtcgagacttgggcactgcgacaccccgggttcaccatcctcgcgctgttcctagcccactacatcggaacgtccctcacccaaaaagtggtgatcttcatcctgctcatgctcgtcacgccaagcatgaccatgcggtgcgtcggggtgggcaaccgggacttcgttgagggcctgtccggggccacttgggtggacgtggtgctggagcacggggggtgtgtgaccacgatggctaagaacaagcccactctcgatatcgagctgcaaaagaccgaggccacccagctggcgacgctacggaagctatgcatcgagggcaagatcaccaacataaccaccgatagccgctgccccacccaaggcgaggccgtcctgccggaggagcaggatcagaattatgtctgcaagcacacctacgtggaccggggttggggcaacgggtgcggcttattcgggaaaggatccctggtaacatgcgccaagtttcaatgtttagagcccatagaggggaaggtcgtacagtatgagaacctcaaatacaccgtgatcatcactgtccacaccggtgaccagcaccaagtgggtaacgagacgcagggggtcactgccgagatcacgccccaggccagcacgactgaggctatcctgcccgaatatgggaccctggggctcgagtgctctccgcgcaccggcctggacttcaacgaaatgatcctgctcacgatgaagaacaaggcctggatggtgcaccgccagtggttcttcgacttgcccctgccctggacgagcggcgccaccaccgagacgccaacatggaaccgcaaagagctgctcgtgacctttaagaatgcacacgccaagaagcaggaggtcgttgtactggggtcccaagagggcgcaatgcacacggctctcacgggtgcaaccgaaatccagaacagcggcgggacctcgatcttcgccggtcacctgaagtgccgactgaagatggataagctcgaactaaagggcatgagctatgccatgtgcacgaacacttttgtcctgaagaaggaagtgagtgagacgcagcacggcacaatcctcatcaaggtggagtacaagggcgaagacgtcccgtgcaagatccccttcagcacggaggatgggcaggggaaggcgcataacggcagactcatcacggccaaccccgtggtcaccaagaaggaggagcccgtgaatatcgaggccgagccacccttcggggagtcgaacatagtgatcggcataggggacaatgccctaaagatcaattggtataagaaaggctccagcatcgggaagatgttcgaggccaccgccaggggcgcccgccggatggcaatcctgggcgacaccgcctgggacttcgggtccgtggggggtgtcctcaacagccttggcaagatggtgcaccagatcttcggctcagcgtacacggccctgttcagcggcgtgtcctgggtcatgaagatcggcatcggggtgctcttaacctggatcggtctgaactcgaaaaacacctccatgtcgttcagctgtattgtgatcgggatcatcaccctctatctcggcgccgtcgtgcaggcagacatgggatgcgtcattaactggaagggaaaggagctgaagtgtggctccgggatcttcgtcactaacgaggtgcacacctggaccgagcagtacaagtttcaggccgactcccccaagcgcctcgcgaccgccattgccggcgcctgggaaaatggtgtatgcggcatccgtagcaccacacggatggaaaacctgctgtggaagcaaatcgccaatgagctcaactatatcctgtgggaaaacaacatcaagctgacggtggtggtcggggacatcatcggcgtcctcgagcaaggaaaacggaccctgacaccccagcctatggaactcaagtactcctggaagacctgggggaaggcgaagattgtgaccgccgagacccagaacagctcttttatcattgatggccccaacacgcccgagtgcccaagcgcctcccgggcctggaacgtttgggaggtcgaagattacgggttcggggtgtttaccaccaacatctggctgaagctgagagaggtgtacacccagttatgcgaccatcggctcatgagcgcggccgtcaaggatgagcgcgctgtgcacgccgatatgggctactggatcgagagccaaaagaacgggtcctggaagctggaaaaagctagcctgatcgaggtgaaaacctgcacgtggccgaagtcccataccctctggtctaatggcgtcctggagtccgacatgatcattcccaagagcttggcggggcccatttcccagcacaactaccggccaggctaccatacccagaccgccgggccctggcacctcggtaagttagagctggactttaactactgcgagggcacgaccgtggtcataacagagaactgtgggacccgcggaccgagcctccggactaccacggtctccgggaagctgatccacgaatggtgctgcagaagctgtaccctgcccccgctccggtacatgggcgaagatgggtgctggtacggcatggaaatccgccctatctccgagaaagaggagaacatggtcaagagcctggtgtccgccggaagtgggaaggtggataacttcacgatgggcgtgctttgcctcgcaatcctgttcgaggaagtgatgagagggaagttcggaaaaaagcacatgatcgccggggtgttcttcaccttcgtgctgctcctgtccgggcagatcacctggcgcgatatggcgcatactttaatcatgatcggctccaacgcctccgatcggatggggatgggtgtgacgtacctcgcactgattgccaccttcaagatacaaccgttcctggccctcggcttcttcctgagaaagctgacttctcgggagaacctcttgctgggcgtcggcctcgcgatggccaccacgcttcagctgcccgaggacatcgagcaaatggccaacgggatcgccctcggcttgatggccctaaaactcatcacccagttcgagacctatcagctgtggacggccctgatttcactcacgtgttccaacaccatcttcaccctgaccgttgcctggcggacggcaaccctgatcctcgccggggtctccctgctgccggtctgccagtcctcttcaatgcggaaaaccgattggttgcccatgaccgtggcagccatgggcgtgcctcccctcccgctcttcatattttctctcaaggacacgctgaaacgccgatcctggcccctgaacgagggggtgatggcggtaggcctcgtcagcatcctcgcctctagcttactccggaacgatgtgcccatggcgggcccgctggtggccggcggcctgctcatcgcctgctacgtcatcacgggcacctcggccgacttaaccgtggagaaagccgcagacgtgacgtgggaggaggaggcggaacaaaccggggtcagccacaacctgatgatcaccgtggacgacgacggtaccatgcgtatcaaggacgacgagaccgagaatatcctcaccgtgttactgaagaccgccctcctcatcgtcagtggcatattcccatacagcatccccgccacgctgctcgtgtggcacacctggcagaagcagacgcagcgttccggcgtgctttgggacgtaccctctccacccgagacccagaaagccgagctggaagagggggtgtaccgcatcaagcaacaaggcattttcgggaagacccaggttggcgtaggggtgcaaaaagagggcgtgttccataccatgtggcatgtcacgcggggcgccgtgctcacctacaacgggaagcgcctagagcccaactgggcgtccgtgaagaaagacctgatcagctacggcgggggctggcggctctccgctcaatggcagaaaggggaagaggtgcaagtgatcgccgtggagcccggaaaaaaccctaagaattttcagactatgcccggcacgttccagacaaccactggggagattggtgccatcgcgctggacttcaaacccgggacatctggctcgcccatcattaaccgcgaagggaaggtcgtggggctgtatgggaacggggtggttactaagaacggtgggtacgtgtccggcatcgcgcagaccaacgccgagccggatggaccgacccccgagttggaggaggaaatgtttaagaagcgtaatctcacgattatggacctgcaccccggtagcggaaaaacgcgcaagtacctgccggccatcgtacgggaggccatcaagcgccggctccgcacgctgatcctggcgcccacccgggtcgtggccgccgagatggaggaggccctcaaggggctccccatccggtaccagaccaccgccacaaagagtgagcacaccggccgcgagatcgtggacttaatgtgccacgcgacctttacgatgcgcttacttagccccgttcgggtgccgaactataacctgatcatcatggacgaggcccacttcaccgaccccgcgtccatcgccgcccgcgggtacatcagcaccagagtgggcatgggagaggcggccgccatcttcatgaccgctacgccgcccgggaccgcggacgccttcccccagagcaacgcccccatacaggacgaggagcgcgacatacccgagcgctcatggaactccgggaacgagtggatcaccgacttcgccgggaaaacggtctggttcgtacccagcatcaaggccgggaacgacatagcgaattgcctccggaagaacgggaagaaggtgatccaactgtcccgcaagacgttcgataccgaataccagaagaccaagctgaacgactgggacttcgtagtgaccacagacatcagcgagatgggcgccaacttcaaggcagaccgggtaatcgatcctcgtcggtgcctcaagcccgtcatcttgaccgacggccccgagcgcgtcattctggccggcccgatgccggtgaccgcagcttccgccgctcagcggcgcggccgggtagggcgtaacccccagaaggagaacgaccaatatatcttcaccggccagcccctcaacaacgacgaggaccacgcccattggactgaggcaaagatgctgctggacaacatcaacacgcccgaggggatcataccggctctcttcgagccggaacgggagaagagcgcagccatcgacggggagtaccgcctgaagggcgagtcccggaagaccttcgtggaactgatgcgcagaggggacttacccgtctggctagcccacaaggtggcaagcgagggaataaagtataccgatcgcaagtggtgcttcgacgggcaacgcaacaaccagatcctcgaggagaatatggacgtggagatctggactaaggagggcgaaaagaagaagctacggcctcggtggctggacgcacgcacgtactcggaccccctcgcccttaaggaattcaaggacttcgccgctggccgcaaaagcatcgcgttggacctggtcaccgagatcggccgggtgccctcgcacctagcacaccgcacccgtaacgccctggacaacctggtgatgctccacacctcagagcacggcgggaaggcataccgccacgccgtagaggaactgccagagacgatggagacgctcctcctgctaggccttatgatcctgctgaccggaggtgcgatgttgttcctgataagcggcaaggggataggcaagacctccatagggctcatttgtgtgatcgccagctcaggcatgctgtggatggccgagatcccactgcagtggattgcttcagccattgtcctggagttcttcatgatggtgctccttatcccggagccggagaagcagcggacgccccaggataatcagttggcgtatgtggttatcgggatcttaaccctggctgccataatagccgccaatgagatgggactgctcgaaaccaccaagcgcgatctgggcatgtccaaggagccgggggtcgtaagccccacgtcctatctggatgtggacctccaccccgccagcgcctggaccctgtacgctgtagctaccacggtgatcacgcccatgctgcggcacacgatcgagaactccacagcgaatgtgagccttgccgctatcgccaaccaggccgtagttctgatgggcctggacaaagggtggccgatatcaaagatggacttgggcgtgcccctgctagcactcgggtgctatagccaggtcaacccccttactctaacggccgccgtattgctgctgatcacccactacgccatcatcgggccaggcctccaggctaaggcgactcgcgaggcccagaaacgcacagccgccgggatcatgaagaacccaactgttgacggaatcatgaccatcgacctggatcccgtgatctacgactcgaaattcgaaaagcagctgggccaagtgatgttactcgtcctctgcgccgtccaactcctgctgatgcgcaccagctgggcgctctgcgaggcgctgacactggcgacgggacccatcactactttgtgggagggatcacccgggaagttctggaacaccacgatcgccgtctccatggcaaatatctttcggggctcctacctcgccggggccggcctggcatttagcatcatgaagtccgtggggacaggcaagcgcggtaccggcagccagggcgagacactcggggagaagtggaagaagaagctgaaccaactgagccggaaggagtttgacctctacaaaaagtccggcattaccgaggtcgaccgcacggaagcaaaagagggactgaagcgaggcgaaatcacccaccacgctgtgagccgcggctccgccaagcttcagtggttcgtagagcgaaacatggtcatccctgagggacgcgtgatagatctcggctgcgggcgggggggctggagctactactgcgccggtttaaagaaggttaccgaagtccgcggatacactaagggcggtcccgggcacgaggagcccgtgcccatgagtacgtacggctggaacatcgtgaaactgatgtcagggaaagacgtcttctacctcccgcccgagaagtgcgataccctactgtgcgacattggagagtccagtccctcccccaccgtggaggagagccggaccatccgcgtgctgaagatggtggagccatggctcaaaaacaaccagttctgcataaaggtgctgaacccctacatgcccactgttatcgagcatctggaaaggctccagagaaagcacggcgggatgctagtccgaaaccccctgtctcggaactcgacccatgagatgtactggatctccaacggcaccgggaacatcgtggccagcgttaacatggtctccaggctcctgctgaaccggttcactatgacgcaccgccggccgaccatcgagaaagacgtcgacctcggcgccggcacacgccatgtgaacgcggagccggagacacccaacatggacgttattggggagcggatcaagaggattaaagaggagcacaacagcacgtggcactacgacgacgagaacccgtacaagacctgggcataccacggctcctacgaagtgaaggcgaccggaagcgcctcctctatgatcaatggcgttgtgaaactcttgaccaaaccctgggacgtagtcccgatggtgacgcaaatggcaatgaccgacaccacccccttcgggcagcagcgggtcttcaaggagaaggtcgacacgcgcactccgaggagcatgccgggcaccagaagggtgatgggcattacggcggagtggctctggcgcactctgggtcggaataagaagccccgactttgcacacgtgaagagttcaccaaaaaggtgcgcaccaacgccgccatgggcgccgtcttcacggaggagaaccagtgggacagtgcgaaggccgccgtggaagacgaggacttctggatgctcgtggaccgcgagcgcgagctgcacaaactgggcaagtgtggaagctgcgtctataacatgatgggaaagcgcgagaagaagctcggcgagttcggcaaggccaagggatcccgagccatatggtacatgtggctaggcgcgcgatacctggagttcgaggcgctcggcttcctaaacgaggaccactggttcagcagagaaaactcctactcaggcgtagagggggaggggctgcacaaattgggttacatcctgcgggatatttccaagatccctggtggggcgatgtacgccgacgacactgccgggtgggatactcggatcaccgaagacgatctgcataacgaggaaaagatcacgcaacagatggaccccgaacatcgccagctggctaacgccattttcaaactgacgtaccagaacaaggtggttaaagtgcagaggcccacccccactggcaccgtgatggacatcatctcccgcaaggaccagcgtggctccgggcaggtcggcacgtacgggctgaataccttcaccaatatggaggcccagctcatcaggcagatggagggtgaaggggtactgagcaaggcagatttagaaaacccccacctcccggagaaaaagattacacagtggctggagactaagggcgtagagcggctgaagcgcatggccatctccggcgacgactgcgtcgtgaagccgattgatgaccggttcgcgaacgccctcctggccctaaacgacatgggcaaggtccggaaggacatcccccagtggcagccgtccaaaggatggcacgactggcagcaagtccctttctgctcccaccactttcacgagctcataatgaaggacgggcgaaagttggtggtgccctgccgcccccaggacgagctgatcggccgtgcgcgcatcagccagggggccggctggagcctccgggagaccgcgtgcttaggcaaagcttacgcccagatgtggagtctgatgtacttccatcgtcgcgatctcagactggcctccaacgccatctgcagcgcagtccccgtgcattgggttccgacatcccgcaccacgtggagcatccacgcccaccaccagtggatgaccaccgaggatatgctgaccgtctggaatcgggtgtggatagaggataatccatggatggaggataaaacgcccgtaaccacctgggagaacgtcccctacctcggtaagcgcgaggaccagtggtgcggtagcctgatcgggttgacctcccgggccacatgggcccagaatattccgaccgcgattcagcaggtccgcagcttaatcggcaacgaggagttcctggactacatgccctccatgaagcggttccgcaaggaggaggagagcgagggggccatctggtga

SEQ ID NO: 25918 - RNA, 9873 nt, synthetic construct
  misc_feature 1..9873: note = derived and/or modified CDS sequence (opt11) from DENV-3__KF955468__SS-prME
  source 1..9873: mol_type = other RNA
accagcctgtgcctcatgatgatcctgcccgcggccctcgcgttccacctcacctcccgggacggcgagccacggatgatcgtggggaagaacgaacgcggcaagagcctgctgttcaagacggcctccggaatcaacatgtgcaccctcattgccatggacctgggcgagatgtgtgacgacacagtgacatacaagtgccctcacattaccgaagtggagcccgaagacatcgactgctggtgcaacctgaccagcacctgggtgacctacgggacgtgcaaccaggccggcgagcaccggcgcgacaagcggtccgtggccctcgcgccacacgttggtatggggctggacacccggacccagacctggatgagcgccgagggcgcctggcggcaggtagagaaagtcgagacgtgggccttacgccacccgggattcaccatccttgcgcttttcctggcacattacatcggcacttccctcacacagaaggttgtgatcttcatactgctgatgctcgttactcccagcatgaccatgaggtgcgtgggcgtgggcaatcgcgacttcgtcgagggcctgtccggcgccacctgggtggatgtggtcctggagcacggcgggtgcgtgaccacgatggccaagaacaagcccacgctcgacatcgaactgcagaagaccgaagccacccagttagcgacgctgcggaagctgtgcattgagggcaagatcaccaacatcaccaccgacagccgctgccctacgcagggcgaggcggtgctgccggaggagcaggaccagaactacgtctgcaagcatacctacgtggatcgggggtggggtaacggttgcggcctcttcgggaagggctccttagtgacctgcgccaagttccagtgcctggagcccatcgagggcaaggtcgtgcagtacgagaacctgaagtataccgttataatcacggtccacaccggggaccaacaccaggtgggcaacgagacccaaggggtcaccgccgagatcacgccccaggctagcaccaccgaagcgatcctgcctgagtacggcaccctggggctcgagtgctccccgcggacgggcctggacttcaacgaaatgatcctgctcacgatgaagaataaggcctggatggtgcaccggcagtggttcttcgacctgcccctgccctggacctcgggcgccaccaccgaaacgccaacctggaaccgcaaggagctccttgtgaccttcaagaacgcccacgccaagaagcaggaggtcgttgtgctggggtctcaggagggcgctatgcacaccgccctcaccggggccactgagatccagaactccggagggacatccatcttcgccggacacctgaaatgccggctgaagatggacaagctcgagttaaagggcatgagctacgccatgtgcaccaacacgttcgtgctgaaaaaagaggtgtccgagacccagcacgggaccatcctcatcaaggtcgaatacaagggagaggacgttccgtgcaagatccccttcagcaccgaagacggacagggcaaagcccataacggccgcctgatcaccgccaaccctgtggtgaccaagaaggaggaacccgtcaacatcgaggccgagccgccctttggggagtcaaatatcgtgataggcatcggggacaatgccctgaagatcaattggtacaagaagggttcctccatcggcaagatgttcgaagcgacggccagaggcgccagacgaatggccatactgggagacaccgcctgggacttcgggtccgtgggtggggtcctcaatagtctgggcaagatggtgcaccagatcttcgggtccgcttacacggcactgtttagcggcgtgtcctgggtgatgaagattggcatcggcgtgctcctgacatggatcggcctgaacagcaagaacacctccatgagcttctcctgtatcgtgatcgggatcatcaccctctacctgggcgccgtggtgcaggccgacatggggtgcgtaatcaactggaaggggaaagagcttaagtgcggcagcggaattttcgtcactaacgaagtgcacacctggaccgagcagtacaaattccaggccgactcccccaagcgcctcgcgaccgccatcgccggcgcctgggagaacggggtgtgcggcatccgaagcacgacccggatggagaatctgctgtggaaacagatcgccaacgagctcaactacattctgtgggagaacaacatcaagctgacagtcgtggtgggggatatcattggcgtcctcgagcaggggaaacgcaccctgacaccgcaaccgatggagctgaagtactcctggaaaacctggggtaaggcgaagatagtgaccgcagaaacccaaaacagctccttcatcatcgacggccccaacacgcccgagtgcccctccgcctcccgagcctggaacgtgtgggaggtcgaagactacgggttcggcgtgttcacgaccaatatctggctcaagctacgggaggtatatacccagctgtgcgaccaccgtctcatgtccgcggcggtcaaggacgagagagccgtccacgccgacatgggctactggatcgaaagccaaaagaatgggtcctggaagttagagaaggccagcctaatcgaggtcaagacctgcacgtggccgaagtcccataccctttggagcaacggcgtcttggagtccgacatgataatcccaaagagcctggcggggcccatctcccagcacaactatcggccgggctaccacacccagaccgccggaccctggcacctcggcaagctagagctggacttcaattactgtgagggcacgaccgtggtgatcaccgagaattgcgggactcgtggccccagcttgcggacgaccaccgtctccggcaagctaatccacgagtggtgctgccgtagctgtaccttaccaccgctccggtacatgggagaggacgggtgctggtacggcatggagatccgccccatcagcgagaaggaggagaatatggtaaagtcactggtgtccgcgggctccggaaaggtcgacaacttcacgatgggcgtactgtgcctcgccatcctgttcgaggaggtgatgagagggaagttcggcaagaagcacatgatcgcgggcgtcttcttcacctttgtactgctcctgtccggacaaatcacctggcgcgatatggcgcacaccctgatcatgatcggcagcaacgcctcagacagaatggggatgggcgtgacgtacctcgccttgatcgccacgtttaagattcagcccttcctggccctcgggtttttcctgcgcaagctgacgagccgggagaacctcctgctgggagtcggcctcgcgatggctaccactctgcagctgcccgaggacatcgagcagatggccaacgggattgccctaggcctgatggcgctgaagttaataacccagttcgagacctaccagttatggaccgccctgatcagcctcacgtgctccaacacgatcctgacgctcacggtcgcctggcgcaccgcaaccctcatcctggccggggtcagcctgctccctgtgtgccagtcctcttccatgcgaaagaccgactggctgcccatgaccgtggcggccatgggcgtgccgcccctgcccctgttcatcttcagcctgaaagacacgctgaagaggagatcgtggcccctcaacgagggggtgatggcagtagggctggtcagtatcctggcatcctccctcctgcggaacgacgtgcccatggccggccccctggtggccggtggtctcctgatcgcctgctacgtcataaccgggacctcagcagacctgactgtggagaaggccgccgacgtgacgtgggaagaggaggcggagcagaccggggtcagccacaacctcatgattaccgtggacgatgacgggaccatgcgcatcaaggacgacgagaccgagaacatcctaacggtgctgctcaaaaccgccctgcttatcgtttccggcatcttcccgtacagcatccctgccaccctcctggtgtggcacacctggcagaagcaaacccaacggtccggcgtgctgtgggacgtcccatccccgcccgaaacccagaaagccgagttagaagagggggtgtaccgcatcaagcagcagggcatcttcgggaagacccaggtgggcgtcggggtgcaaaaggagggcgtgttccacaccatgtggcacgtcacgcgtggcgccgtgctgacatataatgggaagcgcctggagcccaactgggcatccgtgaagaaggatctcatcagctacggcgggggctggcggcttagtgcccagtggcagaagggggaggaggtccaggttatcgcagtggagcccggcaagaaccccaagaacttccagactatgcccggcaccttccagacgaccaccggggagatcggcgctatcgcgctggacttcaagccagggacttccggcagccccatcatcaaccgcgaaggccgggtagtgggcctgtatggcaacggggttgtcaccaagaacggcggctacgtgtccggtatcgcccaaactaacgccgagccggacggccccacccccgagctcgaagaggaaatgtttaagaagcgcaacctgaccatcatggacctacaccccggatcgggtaagacgcggaagtacctcccggccatcgtgcgcgaggctatcaagcggagattgcggacactgatccttgcgccaacccgcgtggtggctgccgagatggaggaggccctgaaggggctgcccatccggtaccagaccacggccaccaagagtgagcacaccgggcgcgaaatcgtagacctcatgtgccacgcgaccttcacaatgcggttactgagccccgtccgcgtgccgaactacaacctcatcatcatggacgaggcccatttcaccgaccccgccagcatagccgcaagggggtacattagcacccgcgtgggcatgggcgaggcggccgcaatcttcatgaccgccacgccgcccgggaccgcggacgccttcccgcaatccaacgcccctatccaggatgaggagagggatatccccgaacggagctggaactccggcaacgagtggatcaccgactttgccggcaagaccgtctggttcgtgccgtctatcaaagcgggcaacgatatcgcgaactgcctgcgcaagaacgggaagaaggttatccagctgtcccggaagacgttcgatacagagtaccagaaaaccaaactcaacgactgggactttgtcgtgaccacagacattagcgagatgggtgccaacttcaaggccgacagagtgatcgacccgcgccgctgcctgaaacccgtcatcctgacagacggccccgagcgggtgattctcgcagggcccatgcctgtgaccgccgcgtccgccgcccaacgccggggccgcgtggggcggaacccccagaaggagaacgaccagtacatcttcacgggccagcccttgaacaacgacgaggaccacgctcactggaccgaggccaagatgctgttagacaacatcaacacgcccgagggtatcataccggcgctgttcgagcccgagcgcgagaagagtgcagcgatcgatggggagtacaggctgaagggagagtccagaaaaacattcgtggagctcatgcggcgcggcgacttaccagtatggctggcgcacaaagtggcaagcgagggcataaagtacaccgaccgtaagtggtgctttgacggtcagaggaacaaccagatcctcgaggagaacatggacgtggaaatctggaccaaggagggcgagaagaagaagcttcggccccgctggttggatgcccgcacgtactctgacccactagccctgaaggagttcaaggacttcgccgccggccgcaaaagcatcgcgttggacctcgtgaccgagatcgggcgcgtgccctcccacctggctcaccggacccgcaacgccctcgacaacctcgtgatgctgcacaccagcgagcacggcgggaaggcctaccggcacgccgtcgaggaactgcccgagacgatggagactctcctgctgctcggcctgatgatcctgctcacagggggcgcgatgctgttcttaataagcggaaaagggatcggcaagaccagtatcgggttgatctgcgtgattgcatcctccggcatgctatggatggccgaaatcccgcttcaatggatcgccagcgcaatcgttctcgagttcttcatgatggtcctgctgatccccgagcccgagaagcagcgcacgccccaggacaatcaactagcatacgtggtgatcgggatcctgaccctggccgccatcatcgccgcaaacgagatgggcctactcgagactaccaaacgggacctgggcatgtccaaggaaccgggggtcgtgagtcccacgtcgtacctcgatgtagacttacaccctgcgtctgcctggaccctgtacgccgttgccaccaccgtgatcacacccatgcttaggcacacaattgagaactccacggcgaacgtaagcctggccgccatcgccaaccaagccgtcgtgctgatgggcctcgacaaggggtggccgatcagtaagatggacctcggcgtgcctctgctcgcgctggggtgttacagccaagtaaaccccctgaccctcactgctgccgtgctgctgctcattacccactacgccatcatcggccccgggctgcaggccaaggcgacccgggaggcccagaagcgaaccgccgccgggatcatgaagaacccgacggtggatggtatcatgaccatcgatctggacccagtcatatacgactccaagttcgagaagcaactcggccaggtgatgttgctcgtgctctgcgccgtccagctgcttctcatgcggaccagctgggcgctttgcgaagcccttaccctcgccacaggccccatcaccaccctgtgggagggctccccggggaagttctggaataccacgatcgccgtgagtatggcgaacatcttccgcggctcctacctggccggagccggcctcgcgttcagcatcatgaagtccgtcgggaccggcaagagagggaccgggagccaaggcgagacactgggggagaagtggaagaaaaagctgaaccagctcagccgcaaagagttcgacctgtacaagaagagcggcatcaccgaggtggaccggactgaggccaaggaggggctaaagcgcggcgaaatcacccaccacgctgtgtcccggggctccgccaagctccagtggttcgtcgagagaaatatggtcataccggaggggcgggtgatagacctgggctgcgggcgcggcggatggagctactactgcgccgggttgaaaaaggtgaccgaggtccggggctatacgaagggcgggcccgggcacgaggagcccgtgcccatgtccacgtacggctggaacatcgtgaagttaatgtctggcaaggacgtcttctaccttccgcccgagaagtgcgacaccctgctgtgcgacattggcgagtccagtccctcccccacagtggaggagtctcgcaccatccgcgtactcaaaatggttgaaccgtggctgaaaaataaccagttttgcatcaaggtgctgaatccctacatgcccacggtgatcgaacacctcgagagattgcagcgcaagcacggcgggatgttggttcggaacccgctctctcggaacagcacccatgagatgtactggatctccaacggcaccgggaacatcgtggccagcgtgaacatggtttccaggttgctgctcaaccgcttcaccatgacgcaccggcgccctaccatcgagaaggatgtggacttaggcgccgggacccggcacgtgaacgcggagcccgaaacccccaacatggatgtgatcggggagcgcataaaacggatcaaggaggaacacaactccacttggcactatgacgacgagaatccgtacaagacctgggcctaccacggcagttatgaggtgaaggctacaggtagcgcctcctctatgatcaacggggtcgtgaaactgctcaccaagccctgggacgtggttcccatggtgacccagatggcgatgaccgacacaaccccctttggtcagcaacgggtgttcaaggagaaggtcgacacgcggaccccccgcagcatgcccggtacacggagggtgatgggcatcaccgcggagtggctgtggagaacgctggggcgcaacaagaaaccacggctatgcacccgcgaggagttcaccaagaaggtgagaacaaacgccgccatgggcgccgtcttcacggaggagaaccagtgggactccgcgaaggcggccgtggaggacgaggacttctggaccctggtggaccgcgagcgagagctgcacaagctcgggaagtgcggcagctgcgtctacaacatgatgggtaagcgggagaagaagctgggcgagtttggcaaggccaaagggtcccgcgctatttggtacatgtggctgggcgcgcggtacctcgagttcgaagccctgggtttcctgaacgaggaccactggttcagccgcgaaaattcgtacagcggcgtggaaggggagggccttcacaagctgggctatatactgcgggacatctcgaagatccccgggggcgccatgtacgcagacgacaccgccgggtgggacacccgcatcacggaggacgacctccacaacgaggagaaaatcactcagcaaatggacccggagcacagacaactggcgaacgccatcttcaaactgacttaccagaacaaggtcgttaaggtgcagcgccccacccccacgggcaccgtgatggacataatcagccggaaggatcagcgcggttccggccaggtcggcacctacggtcttaacaccttcaccaacatggaggcccagctgatccggcagatggagggcgagggggtgctgagcaaagcagacctcgagaacccccacctcccggagaagaagattacgcagtggctggaaaccaaaggagtggagagactcaagagaatggcaatctccggcgacgactgtgtcgtgaagcccatcgacgatcgcttcgcgaacgccctcctggcgctcaacgacatggggaaggtgcgaaaagacattccacagtggcagcccagcaagggttggcacgactggcagcaagtcccgttctgctcccatcacttccacgagctgatcatgaaggatgggcgcaagctggtggtgccctgccggccccaggacgagctcataggccgcgctcggataagccagggggccggctggtccctgcgcgaaactgcgtgcctaggaaaagcctacgcccagatgtggagccttatgtactttcaccgccgggatttgcgcctggcctccaacgcgatctgttccgccgtccccgtgcactgggtgcctacgtcccggacgacctggagcatccacgcccaccaccagtggatgaccaccgaggacatgctaacggtctggaatcgggtgtggatcgaggacaacccctggatggaggataagaccccggtgaccacctgggaaaacgttccctacctggggaagcgggaggaccagtggtgcggcagcctgattgggctcacgtcccgcgccacgtgggcccagaacatcccaactgcgatccagcaggtccggagcctgattggcaacgaggagttcctggactacatgccctccatgaagcgcttccgaaaagaggaggagagcgagggggctatctggtga

SEQ ID NO: 25919 - RNA, 9873 nt, synthetic construct
  misc_feature 1..9873: note = derived and/or modified CDS sequence (opt11) from DENV-3__FJ744726__SS-prME
  source 1..9873: mol_type = other RNA
accagcctatgcctcatgatgatgctgcccgccacccttgccttccacctcacgagccgggacggcgagccgagaatgatcgtagccaagaacgagcggggcaagtcactgcttttcaagaccgcctccggcatcaacatgtgcaccctcatagcgatggacctgggggagatgtgcgacgacaccgtgacctataagtgccccttgatcgccgaagtggagcccgaggacattgactgctggtgcaacctgaccagcacctgggtgacctacggcacgtgcaaccaagccggggagcaccggagagataaacgcagcgtggcgttggcgccccacgtgggcatgggcctggacacccggacccagacctggatgagcgccgagggggcctggcgccaggtggaaaaggtcgagacgtgggcgctccgccacccaggtttcaccatcctggccctgttcctcgcccactacatagggacctccctgactcaaaaggtggtgatcttcatcctcctcatgctggtaactccctcgatgaccatgcggtgtgtgggcgtggggaaccgggacttcgttgagggcctttccggagccacctgggtggacgtggtcctcgagcacgggggctgcgtgaccacaatggccaagaacaaacccaccctggatatcgagctacagaagaccgaggcgacccaactagccacgctgcggaagctgtgcatcgaggggaagatcacaaacatcaccaccgacagccgctgcccaacgcagggcgaggccatcctcccggaggagcaggaccagaactatgtgtgcaagcacacctatgtcgacaggggctgggggaacggctgcgggctgttcggcaaggggtccctggtgacgtgtgccaagttccaatgtctcgagcccatagagggcaaggtggtccagcatgagaacctgaaatacaccgtaattataacggttcataccggggaccagcaccaggtcgggaatgacacccagggcgttaccgtagagattacgccccaggccagcaccgtggaggcgatcctgcccgagtacgggaccctcggcctggagtgctcaccgcgcaccgggttggacttcaatgagatgattctcctgaccatgaaaaacaaggcttggatggttcatcggcagtggttcttcgatctccccctcccctggacgtctggcgccaccaccgagacccccacgtggaaccgcaaggagctgctggtcaccttcaagaacgcccacgccaagaagcaggaagtggtggtgctcggctcccaggagggagcgatgcacaccgccctgaccggcgccacggaaatccagaactcgggcggcaccagtatcttcgccgggcacctgaagtgccggcttaagatggacaagctggagctgaagggcatgagctacgcgatgtgtctcaacaccttcgtgctgaagaaggaagtgtccgagactcaacacgggaccattctgatcaaggtcgagtataagggggaggacgcgccgtgcaagatccctttctctactgaagacggccaagggaaagctcataatggccgcctgatcaccgccaaccccgtggtgacgaaaaaagaggagcccgttaacatcgaggccgagccgcccttcggcgagagcaacatcgtgatcgggattggcgacaaagcgctcaagatcaactggtacaagaaagggagcagcatcgggaagatgttcgaggcgacggcccgcggggcccgcagaatggccatcctgggcgacaccgcgtgggatttcggctccgtcggcggtgtcctgaacagtctggggaagatggtgcaccagatcttcgggtccgcgtacaccgcccttttcagcggagtgtcctggatcatgaagatcggcatcggcgtcctgctcacctggatcggacttaatagcaagaacacgtccatgtccttctcctgcattgtcatcggcatcatcaccctgtacttgggggccgtcgtccaggccgacatgggatgcgtgatcaactggaaggggaaggagcttaagtgcggcagcggaattttcgtcaccaacgaggtccacacctggactgaacagtacaaattccaggcggactccccgaagcgcttggccaccgccatcgccggggcctgggagaacggcgtatgcgggatcaggagcaccacccggatggagaacttactgtggaagcagatcgccaacgaactgaattatatcctctgggaaaacaacatcaagctgacggtggtcgtgggtgacatcatcggggttctagagcagggcaagcgcaccctcacgccccagcccatggagctgaagtactcgtggaagacttggggcaaagccaagatcgtcacggccgagactcagaacagcagcttcatcatcgacgggcccaacacccccgagtgccccagcgcctcccgggcgtggaacgtgtgggaggtggaggattacggcttcggggtgtttacaacgaacatctggcttaagctccgcgaggtgtacacccagagctgcgaccaccggctgatgagcgcggcaatcaaggacgagagggcagtgcacgctgacatgggctactggatcgaatcccagaaaaacggctcatggaagctggagaaggcgtccttcatcgaggtcaaaacatgcacctggcccaagtcccacacgctctggtccaacggcgtgttagagtctgacatgatcatccccaagtccctggcaggccccatctcacagcacaaccaccgaccgggctaccacacccagacagcgggcccctggcacctcggtaagctagagctggatttcaattactgcgagggcaccaccgtggtcatcacggagaactgcggcactcgcgggccctccctccggaccaccacggtaagcgggaagctgattcacgagtggtgctgcaggtcctgcaccctccccccgctccgctacatgggagaggacggctgctggtacgggatggagatccgccccataaacgagaaagaggagaacatggtcaagagcctggtctccgcaggctcgggcaagatggacaacttcaccatggggatattgtgccttgccatcctgttcgaggaggtgatgcggggtaagtttgggaagaagcacatgatcgcgggcgtgcttttcaccttcgtcctcttactgtctggtcagatcacctggagggacatggctcacacccttatcatgataggcagcaacgcctccgaccggatgggcatgggggtgacctatctggccctgatcgccaccttcaagatccagccctttctggcgctgggtttcttcctgcgcaagctcacgagccgggagaatttgctactcggggtggggctcgccatggcaactaccctgcagctgccagaggacatcgaacagatggccaacggtatcgcgttagggttaatgactctcaagctgatcacgcagttcgagacttaccagctatggaccgccctcgtcagcctgacctgttcaaacacgatattcaccctgaccgtcgcctggcgcaccgccacgctcatcctcgccggcgtgtcattactcccgttatgccagtcctcttccatgcggaagaccgactggctgcccatgactgtcgctgccatgggggtgccgcccctgccgctgtttatcttcagcctgaaggacacccccaagcgccgctcctggccgctcaacgagggagtcatggccgtggggctggtgagcatcctggcctcctcgctcctgcggaacgacgtccctatggccggccccttggtggcgggcggtttgctaatcgcctgctacgtgattaccggcacctccgccgacctgaccgtcgagaaggccgccgacgtgacgtgggaggaggaagccgaacagacgggcgtgagccataatctcatgatcacagtcgacgacgacgggaccatgaggatcaaggacgacgagacggagaacatcctgaccgtgctgctcaagactgccttactgatagttagcgggatcttcccctacagcatccccgctacgctcctggtctggcacacctggcaaaagcagacccaacgatccggcgtgctgtgggacgtgcccagcccaccagagacacagaaggccgagctcgaggaaggcgtctaccgcattaagcagcaagggatctttggcaaaacccaggtaggggtgggcgtccagaaggagggtgtttttcataccatgtggcacgtgacccggggcgccgtgctgacccacaatggcaaacgcctggagcccaactgggcctccgtcaagaaagacctcataagctacgggggcgggtggcggctgtccgcacagtggcaaaagggcgaggaggtgcaggtgatcgccgtggagcccggcaagaacccgaagaacttccagaccatgccaggcatattccaaaccacaacgggcgagatcggggccatcgcgctagacttcaagcccgggaccagcgggtcgccgattatcaaccgcgaaggcaaggtagtcggcctgtacgggaacggcgtggtgaccaagaacgggggctatgtttccggcatagcccagaccaacgccgaacccgacggccccacgcccgagctcgaggaggagatgttcaagaagcggaacttaaccatcatggacttacacccgggcagcgggaagaccagaaagtacctgccggcgatcgtgcgggaggccatcaagcgccggctgcgcaccctgatcctcgcacccaccagagtggtcgctgctgagatggaggaggccttgaaaggcctgcccatccgctatcagaccaccgcgatcaagtccgagcacaccgggcgggagatcgtggatctcatgtgccacgctacgtttaccatgcgcctactgagtccggtgcgggtccccaactacaatctcatcatcatggacgaggcccatttcaccgaccccgcgtccatcgcagcccgcggctacatcagcacacgggtggggatgggcgaggcggccgccatcttcatgacggccacgccgcccggaacggcggaggctttcccccagagcaacgcgccaattcaggacgaggagaaggacatccctgagcggtcgtggaattccgggaacgaatggatcaccgactttgtgggcaagacggtctggttcgtgcctagcatcaaggcagggaatgacatagcaaactgcctgaggaagaacggaaagaaagtgatccagctgtcccggaagaccttcgacaccgagtaccagaagacccgccttaacgattgggatttcgtcgtgacgacagacatcagcgagatgggggccaactttaaggcagaccgggtgattgatcccagaagatgcctgaagcccgtcatcctgaccgacggccccgagcgtgtgatcctcgcgggcccgatgcccgtgaccgcagcctccgcggcgcagcggcgcgggcgggtcgggaggaacccccagaaggagaacgaccaatacatcttcacgggtcagcccctgaacaacgacgaggaccacgcgcattggaccgaggccaagatgctgctcgacaacatcaacaccccggagggcataatccctgccctgttcgagcccgagcgggagaaatccgcagcaatcgacggtgagtatcgcctgaagggcgagtcccggaagactttcgtggagctcatgcgccggggcgacctgcccgtgtggctggctcacaaggtcgccagcgaaggaatcaaatacaccgacagaaagtggtgcttcgacggtgagcggaacaaccagatactcgaggagaacatggacgtggagatctggacaaaggagggcgagcgcaagaagctgcgcccccgctggttggacgcgcgcacttactccgaccccctggcactgaaggagttcaaggacttcgccgccgggcgcaaaagcattgccctggaccttgtcaccgagatcggacgtgtgcccagtcaccttgcccaccggacacgcaacgccctggacaacctcgtgatgctgcacacgagcgagcacgggggacgggcctatcgccacgccgtagaggagctgccggagaccatggaaaccctcttgctgctcgggctgatgatactgctcaccggcggggccatgctgttcctgatcagcggcaagggcatcgggaagacgtctatcggcctcatctgtgtgattgtttcatccgggatgctgtggatggcggacgtccctctgcaatggatcgccagcgccatagtgctcgagttcttcatgatggtgctgctgatccccgagcccgagaagcagaggacgccccaggacaaccaacttgcatacgtcgtgattggaattttaaccctggccgcgatcgtgaccgccaacgagatgggcttactggagacgacgaagcgcgacctgggcatgtcaaaggagccgggagtcgtgagccccacctcctacctagacgtggacctgcaccccgccagcgcctggaccctgtacgccgtcgcaacaaccgtgatcaccccgatgctccggcacacaatcgagaactccacggccaacgtaagcctggccgccatcgcgaaccaggccgtcgtgctgatggggttagacaaggggtggcccatctccaagatggacttgggggtgccccttctcgccctgggctgttactctcaggtcaaccccctgactctcaccgctgccgtgctgctgctcgtgacccactatgcgatcatagggccgggcctccaggccaaggccacccgtgaagcacagaagcggacagccgcgggcataatgaagaaccccaccgtcgatgggatcatgaccatcgacctggaccccgtgatctacgactccaagttcgagaagcagctcggtcaggtgatgttactggtcctctgcgccgtgcagctgctgctcatgcgcacgtcttgggccctgtgcgaggccctgaccctcgcgaccgggcccatcaccacgctgtgggagggctccccgggcaagttctggaacaccaccatagcggtgagtatggccaacatctttcggggatcctacctggccggcgcggggcttgcgtttagcatcatgaagagcgtcggcacggggaagagaggtacaggcagtcagggggagaccctgggcgagaagtggaagaagaagctgaaccagctaagccggaaggagttcgacctgtacaagaagtcagggattaccgaggtggatcgcaccgaggccaaggaagggctgaagcgcggggagaccacgcatcacgccgtaagccgcggctccgcaaagctccagtggttcgtcgaacgcaacatggtgatccctgagggccgcgtgattgacctggggtgcggccgcgggggctggagctactactgcgccgggctgaagaaggtcacagaggtgcgcggctacaccaagggggggcccggccacgaggagccagtgccgatgtccacctacggatggaacatcgttaagctaatgtctggcaaggacgtgttttacctgccgcccgagaaatgcgacacgctgctgtgcgacatcggggagtccagcccgtccccgaccgtggaagagagccgcactatccgggtcctcaagatggtggaaccctggctgaagaacaatcaattctgcatcaaagtgctgaatccctacatgcccaccgtcatcgagcacctcgagcgcctacaaaggaagcacggcggaatgctggtgcgcaacccgctctcccggaacagcacgcacgagatgtactggatatccaacgggaccggcaacatcgtgtcgtccgtcaacatggtgtcaaggctgctgctcaatcggttcactatgacacaccgcagacccacgattgagaaggacgtggacctgggggcgggaaccaggcacgtaaacgccgagccggagacaccaaacatggacgtgattggcgagcggatcaagcgtatcaaagaggagcactccagcacctggcactacgatgacgagaacccctacaagacgtgggcctaccacgggtcctacgaggtcaaagccaccggcagtgctagctccatgatcaatggggtggtgaagctgctcaccaagccttgggacgtcgtgcccatggtaacgcagatggcgatgacggacaccacaccgtttggccaacagagagtattcaaggagaaagtcgacactcgcacgccccggcccatgccagggaccagaaaggttatggagatcaccgccgagtggctatggcggacccttggccgcaacaagcggccgcgcctctgcacgcgcgaggagttcactaagaaggtccggaccaacgccgcaatgggcgccgtgttcacagaggagaatcagtgggacagcgcgagggccgccgtggaagatgaagagttctggaagctggtcgaccgggagagagaactgcacaagctcgggaagtgcggcagttgcgtgtacaacatgatgggaaagcgggagaagaagctgggcgagttcggaaaggccaagggcagccgcgcaatttggtacatgtggctgggcgctcggtacctcgaattcgaggcccttgggttcttaaacgaggaccattggttttcccgggagaacagctactccggcgttgagggggagggcttgcacaagctgggatacatcctgcgggacatcagcaagatccccggtggagcaatgtatgccgacgatacggcgggctgggacacccgcatcaccgaggacgacctccacaacgaggagaagatcacccagcagatggaccccgagcatcggcagcttgctaacgccatcttcaagctgacgtaccaaaacaaagtcgtgaaggtgcagcgccccaccccgaagggcaccgtcatggacatcatctcccggaaggaccaacgggggtccggccaggtgggcacctacgggctaaacacctttacgaatatggaggcccagctggtgcggcagatggagggcgagggcgttctgtccaaggtagacctagagaatccgcatctgctagagaagaagatcacccagtggctagagaccaagggcgtcgagcgccttcgaagaatggccatcagcggggacgactgcgtagtgaagcccatcgacgaccggttcgcgaacgcgctgctcgccctgaacgacatgggaaaagttcgaaaggacatcccccagtggcagccttccaaaggctggcatgactggcagcaggttccgttctgcagccaccatttccacgaactgatcatgaaggacgggcgaaagctcgtggtgccctgccgaccacaagacgaattaattggccgcgcccggatctcccagggggccggctggagcctgaaggagaccgcgtgtctaggaaaggcctacgcacaaatgtggtccctaatgtactttcaccggcgggatttacgcctcgccagcaacgccatatgttccgcggtcccggttcattgggtgcccacgagccggaccacctggagcatccacgcacaccaccagtggatgaccactgaggacatgctgactgtctggaatcgcgtgtggatcgaggacaacccatggatggaggacaagaccccagtgaccacgtgggaggacgtcccgtacctgggcaagcgggaagaccagtggtgtggatccctcatcggtctgaccagccgcgccacctgggcccagaacatcttaaccgcgatccagcaggtccggtccctcatcggagacgaggagttcctcgactacatgccttcgatgaagcgcttcagaaaggaggaagagagcgagggggccatatggtaa

SEQ ID NO: 25920 - RNA, 9873 nt, synthetic construct
  misc_feature 1..9873: note = derived and/or modified CDS sequence (opt11) from DENV-3__FJ744729__SS-prME
  source 1..9873: mol_type = other RNA
acctcactgtgcctcatgatgatgctcccagccaccctggccttccacctcaccagccgagacggagagccgcggatgatcgtagccaagaacgagcggggcaagagcttactgtttaagaccgcctccggcattaatatgtgtaccctcatcgccatggacctgggcgagatgtgcgacgacaccgtgacctacaagtgccccctaatcgccgaggtggagcccgaggacatcgactgctggtgtaaccttacaagcacttgggtgacctacggcacttgcaaccaggccggggagcaccggcgcgacaagaggtctgtcgcactagcgccccacgtgggcatgggcctggacacacggacccagacctggatgagcgccgagggggcctggcgccaggttgagaaggtggagacgtgggcgttgcgtcacccgggattcaccatcttggccctgttcctcgcacactatatcgggacctccctgacccagaaggtggtgatattcattctgctcatgctggtcaccccaagcatgaccatgcgctgcgtgggggtggggaaccgcgacttcgtcgaaggcctgtccggcgctacctgggtggacgtggttctcgaacacggggggtgcgtaaccacaatggcaaagaataaacccaccctggacatcgagctgcagaagacagaggcgacccagctcgcaacgttacggaaactgtgcatcgaggggaagatcacaaacatcaccaccgatagccgctgtcccacgcagggcgaggccattctcccggaggagcaggaccagaactacgtgtgcaagcatacctatgtcgatagaggttgggggaacggctgtgggctgttcggaaaagggtccctggtgacctgcgccaagttccagtgcctcaagcccatcgagggcaaggtggtccagcacgagaaccttaagtacaccgtaatcatcacggtgcacaccggcgaccagcaccaggtcgggaacgacacccaaggagtgaccgtcgagatcaccccccaggccagcacagtggaggcgattctgcccgagtacgggaccctcggcctggagtgctcaccccgcaccggccttgactttaacgagatgatcctccttaccatgaagaacaaggcctggatggtgcacaggcagtggttcttcgaccttcctctgccctggacgtccggcgccaccaccgaaacccccacgtggaatcggaaagagctgttggtcaccttcaagaacgcccatgccaagaagcaggaggtggtggttctcggctcacaggagggcgcgatgcacactgccctaaccggcgccacggagatccagaacagcgggggcacctccatcttcgctgggcatctgaagtgccgtctcaagatggacaaactggagctgaaaggcatgagctacgccatgtgcctcaacaccttcgtattaaagaaggaggtgagcgagacccaacacggcacgatcctgatcaaagtagagtataagggggaggacgcgccctgcaagatccccttcagcacagaagacggccagggtaaggcccacaacggccgcctgatcaccgccaaccccgtggttaccaagaaggaggaacccgtcaacatcgaggctgagccgcccttcggcgaaagcaacatcgtaatcgggatcggcgacaaggccctcaagatcaactggtacaagaaagggtccagcattgggaagatgttcgaggccacagctcgcggggcaaggcggatggccatcctgggcgacaccgcgtgggacttcggctccgtaggcggggtactgaacagcttggggaagatggtgcatcagatcttcgggtccgcctacacagccctgttcagcggtgtgtcctggatcatgaagatcggaatcggcgtcctgctcacctggatcggtctgaacagcaagaacacgtctatgagcttctcctgcatcgtgatcggcattatcaccctatacctcggggccgtggtgcaggccgatatgggatgcgtaataaactggaaagggaaagagctgaagtgcggctctgggatcttcgtgaccaatgaagtccacacatggacggagcagtacaagttccaggctgactcccccaagcgcctggccaccgccatcgccggggcctgggaaaacggcgtgtgcgggatccgcagcaccacacggatggagaacctcctgtggaagcagatcgcgaacgagctgaactacatattgtgggagaacaacatcaagcttacagtggtcgtgggcgacatcatcggggtcctggagcagggcaagcgcaccctaaccccccagccgatggagctgaagtactcctggaagacgtggggtaaggccaaaatcgttacggcagagacccaaaactcttccttcatcatcgacgggcccaacacccccgagtgccccagcgccagccgggcctggaacgtgtgggaagtggaagactacggcttcggggttttcaccacgaacatctggctgaagctccgtgaggtgtacacccagagctgtgatcaccggctgatgagcgctgccatcaaggacgagcgcgccgtacatgcggacatgggctactggattgaaagccaaaagaacggatcgtggaaactggagaaggcgtccttcatagaagtcaagacatgtacctggcccaagagccacaccctttggagcaacggggtactggagtcggatatgatcatccccaagtccctcgcaggaccgatctcacaacacaaccaccgacccggctaccacacgcagacagcgggcccatggcacctcgggaagctggagctggactttaactactgcgagggcacaaccgttgtcatcacggaaaactgcggcacccgcgggccctccctcaggaccaccactgtgtcgggcaagcttatccacgagtggtgctgccgctcttgcaccctgcccccgctccggtacatgggagaggacggctgctggtatggtatggagatacgtcccatcaacgagaaggaagagaacatggtcaagagcctcgtctccgccggcagcggcaagatggacaacttcaccatggggatcctttgtctcgccatcctgttcgaggaggtgatgcggggcaagttcgggaagaagcacatgatcgcgggcgtgctattcaccttcgtcctcctgctgtccgggcagataacgtggcgcgacatggcccataccctcattatgatcggcagcaacgcctccgaccgtatgggcatgggagttacctacttagctctgatcgccaccttcaagatccagcccttcctcgccctggggttcttcctgcgcaagctcacgagccgggagaacctgttgttgggggtcggcctggccatggccaccaccctacaactccccgaggacatcgagcagatggccaacgggatagcgctcgggctgatgacactgaagctgatcacacagttcgagacctaccagctgtggaccgcgctcgtcagcctgacgtgctccaacacgatcttcaccctgaccgtggcctggcgcacagccacgctcatcctggcgggcgtgagcctgctcccgctgtgccaatcaagctcgatgcggaaaaccgactggttgcccatgactgtcgctgccatgggggtgcctcccttacccctgtttatctttagcctgaaggacacccccaaacgccgatcctggcccctcaatgagggggttatggctgtgggacttgtcagcatcctggcctccagcctcctgcggaacgacgtgcccatggccggcccgctggtggcaggcggtctcctgatcgcctgctatgtaatcacggggacctccgccgacctgaccgtcgagaaagccgccgacgtgacctgggaggaagaggcggaacagacgggggtgagccacaacctcatgatcaccgtcgatgacgacggcaccatgcgcatcaaggacgatgaaaccgagaacatcctcaccgtgttactcaaaacagcactgctgatcgtatccgggatcttcccctacagcattcccgccaccctcctggtgtggcacacttggcagaagcaaacccagcgctccggcgtgttgtgggacgttccctcaccgcccgagacccaaaaggccgaattggaggagggcgtctaccgcattaagcagcagggcatcttcggaaagacccaggttggggtgggcgtccagaaggagggggtgttccacacgatgtggcacgtgacccggggcgccgtactgacccacaacggcaagcggctggaacctaactgggcgtccgtgaagaaggacctcatcagctacgggggcgggtggagactgtccgcccagtggcagaagggcgaggaggtgcaggtcattgccgtggaacccgggaagaatccgaagaacttccaaaccatgcccggcatcttccagaccaccacgggcgagatcggggccatcgcgctggacttcaagccgggcaccagcgggagtccgatcattaaccgcgagggcaaggtggtcggcctatatgggaacggcgtggtgaccaagaacggcggctacgtatccgggatcgcccagaccaacgccgagcccgacggccccacgcccgagctcgaagaggagatgtttaaaaagcggaatctgactatcatggacctgcacccgggcagcgggaaaacccgcaagtacctcccagccatcgtcagggaggccatcaagcgccggctgcgtaccctgatcctcgcacccacgcgggtagtcgcagccgaaatggaagaggccctgaagggcctgcctatccgctaccagaccaccgccatcaagtccgagcacactgggcgggaaatcgttgacctcatgtgccacgcgacgttcaccatgcgtctgctgagcccggttcgggtccctaactacaacctcatcatcatggacgaggcccattttaccgacccggcctccatcgctgcccgcggctacatcagtacccgcgtgggcatgggcgaagcggctgctatcttcatgacggctactccacccggcacagcggaggccttcccccagtccaacgcccccatccaggatgaggagcgcgatatccccgagaggagctggaatagcgggaacgagtggatcaccgacttcgtgggcaagactgtctggttcgtaccatcgatcaaggccgggaatgacattgcaaactgcctgcggaaaaacggcaagaaagtgatccagctgtctcgcaagacattcgacactgagtaccagaagacccggctcaacgactgggatttcgtcgtgacaaccgatatatccgagatgggggcgaacttcaaggccgaccgcgtgatcgacccccggcgctgcctgaagcccgtcatcctgaccgacggccccgagcgggtgatcctcgccggcccgatgcccgtgaccgcagcctccgcggcccaacgccgagggcgagtaggtcggaacccccagaaggagaacgaccagtacatcttcacgggtcaaccccttaacaacgacgaggaccacgcccactggaccgaggccaagatgttgctcgacaacatcaacacccccgagggcatcatacccgcccttttcgaacccgaacgcgagaagagtgcggccatcgacggggagtaccggctgaaaggcgagtctcgcaaaacgtttgtggagctcatgcggcgtggagacctgcccgtgtggctcgcccacaaggtcgccagcgaggggatcaagtacaccgaccggaagtggtgcttcgacggcgagcgcaacaaccaaatcctagaggagaacatggacgtggagatctggactaaggaaggggagcggaagaagctgcgtccgcgctggctcgacgcgcggacctactccgacccgctagcgctgaaggagttcaaggacttcgcagccggtcgcaagagcatcgccctggacctagtcacagaaatcggccgagtaccctcacacctggcacaccgtacccggaacgccctggacaacctcgtgatgttgcacacgtctgaacacgggggccgggcttaccgccacgccgtcgaggagctgccggagacaatggagaccctcctgttgctcgggttaatgatcctgctgaccggcggcgccatgttatttctgataagcggcaaggggatcgggaagaccagtatcgggctcatctgcgtgatcgtgtcctccggtatgctgtggatggcagacgtacccctgcagtggatcgccagcgccatcgtgttagagttttttatgatggtgctgctgatccccgagccggagaaacagcgcaccccgcaggacaaccagctcgcctacgtcgtgatcggcatcctcaccttagccgcgatcgttaccgctaacgagatggggctcctcgagacgaccaagcgtgacctgggcatgtccaaggagcccggtgtcgtgagccccacatcctacctcgatgttgaccttcaccccgccagcgcctggaccttatacgccgtcgcgacgaccgtgatcaccccgatgttgcgacacaccatcgagaactccacggcgaacgtgagcctggccgctatcgcaaaccaggccgtcgtgctgatggggttggacaaagggtggcctatctccaaaatggacctgggcgtccccctgctcgccctcggatgctacagccaggtcaaccccctgaccctgaccgcagccgtgctgctgctcgtgacccactacgcgatcatcgggccgggcctgcaggccaaggccacgcgagaggcccaaaagcgcaccgcggctggcatcatgaagaaccccacggtcgacgggatcatgaccatcgatctggatcccgtgatctacgactccaagttcgagaaacagctgggccaggtgatgctactggtcctctgtgccgtgcagctgctgctcatgcggactagctgggccctctgtgaggcgctaaccctcgccaccgggcccattaccacgctatgggagggctccccgggtaaattttggaataccaccatcgcagtgtctatggcaaacatctttcgcgggagctatctggccggcgccgggctagcgttcagcattatgcggtccgtcgggactggaaaacgcggcacggggagccagggggagaccctgggcgagaagtggaagaagaagctcaaccagctcagccggaaagagtttgatctgtacaaaaagtccgggatcaccgaggtggaccgaaccgaggccaaggagggcctgaagcgcggggagaccacgcaccacgccgtgagccgcggatccgccaagctccagtggttcgtcgagaggaacatggtgatacccgaggggcgagtgatcgacctggggtgcggccgcgggggctggtcctactactgcgcgggactgaagaaagtcaccgaagttcgcggttacactaagggtgggcccggccacgaggagcccgtgcccatgtccacctacgggtggaacatcgtcaagcttatgagcggcaaggacgtattctacctaccgcccgaaaagtgcgacacgctgctgtgcgacatcggggaatccagcccctccccgaccgtggaggaatcacgcaccatccgggtccttaaaatggtggagccatggctgaaaaacaaccaattctgtatcaaggtgttgaacccctatatgcccactgtcatcgagcacctcgagcgcctgcagcggaagcacggcggcatgctggttcgcaaccctctctcccgtaacagcacacacgaaatgtactggatctccaacgggaccggcaatatcgttagctccgtcaacatggtgagccgcctgctgctcaacaggttcactatgacccaccgccgtcccaccatcgagaaggacgtggacctgggggcgggcacccgccacgtaaacgccgagcctgagaccccgaacatggacgtaatcggcgagcggattaagcgaatcaaggaggagcactccagcacctggcactacgacgacgaaaacccctacaaaacgtgggcctatcacgggtcgtacgaggttaaggccaccgggagcgccagctccatgatcaacggagtggttaagttgctcaccaagccctgggatgtcgtacctatggtgacccagatggcgatgacggacactaccccgttcggccagcagcgggtattcaaggagaaggtggatacccgcacgcctcggcccatgcccgggacccgcaaggtgatggagatcacagccgagtggctgtggcggactctaggccgcaataagcgcccgcgactctgcacacgtgaagagttcactaagaaggtccggaccaacgccgccatgggcgccgtgttcactgaggagaaccagtgggatagcgcgcgcgccgccgttgaggatgaggagttctggaagctggtcgaccgagagcgggagctgcacaagctcgggaagtgcggctcctgtgtgtacaacatgatggggaagcgggagaagaagcttggcgagttcgggaaagccaagggcagtcgcgcaatctggtacatgtggttaggagcccggtacctcgagtttgaggccctgggattcctcaacgaggatcactggttctcccgtgagaacagctactccggcgtggagggagagggcctacacaagctggggtatatcctgcgggacatcagcaagatccccggcggcgccatgtacgccgacgacacggcggggtgggacacgcgcatcacggaagacgacctccataacgaggagaagatcactcaacaaatggaccccgagcaccggcagctggccaacgccatcttcaagctgacgtaccagaacaaagtcgtgaaggtgcagcgcccgacaccgaaaggcaccgtaatggacattatttcccggaaggaccagcgcgggagcggacaggtaggcacctacgggctcaacacctttacgaacatggaagcccagcttgtgcggcagatggaaggcgagggggtcctgtccaaggtggacctcgagaacccccacctcctggagaagaagatcacccagtggctcgagaccaagggcgtggagcgcctccggcgcatggccatcagcggtgacgactgcgtcgtgaagcccatcgacgaccggtttgcgaacgcgctgctcgccctgaacgatatgggcaaggtgcgcaaggacatcccccagtggcagccgtccaagggctggcacgactggcagcaggtccccttctgtagccaccatttccacgagcttatcatgaaggacggacgcaagctcgtggtgccctgtcggccccaggacgagctgatcggccgcgcccggatctcccagggtgcgggctggtcgttaaaggagacggcgtgcctcggaaaggcatacgcccagatgtggtccctgatgtacttccaccgccgggatttgcgcctcgcctcgaacgcgatctgctccgcggtcccggtgcattgggtgcccacgtcccggaccacatggtctatccacgcccaccaccagtggatgaccaccgaggacatgctgaccgtttggaaccgcgtgtggatagaagacaatccctggatggaggacaagacccccgtgaccacgtgggaggacgtcccgtaccttggcaagcgggaggatcaatggtgcggctccctcatcgggctcaccagccgcgccacctgggcccaaaacattctcaccgcgatccagcaggtccggtccctcatcggcgacgaggagtttttggactatatgcccagcatgaagcgcttccggaaggaggaggagtccgaaggtgccatctggtga

SEQ ID NO: 25921 - RNA, 9873 nt, synthetic construct
  misc_feature 1..9873: note = derived and/or modified CDS sequence (opt11) from DENV-3__FJ687448__SS-prME
  source 1..9873: mol_type = other RNA
actagcctatgtttgatgatgatgctgcccgccaccctagcctttcacctaacgagccgggacggagagccacggatgatcgtggctaaaaacgaacggggcaagtccctgctgttcaagaccgccagcggtatcaacatgtgcactctcatcgcgatggacctgggggagatgtgcgacgacaccgtgacttacaagtgtcctctgatcgccgaggtggaacctgaggacatcgattgctggtgcaatctcaccagcacgtgggtgacctacggcacgtgcaaccaggccggggagcaccgtcgcgataaacggagcgtcgccttagcgcctcacgtaggcatgggactggacacccggacccagacctggatgagcgccgagggggcatggcgccaagtagagaaggtggagacttgggcgctccgacacccgggcttcacgatcctggccctattcctagcccactacataggcacctccctgacccagaaggtggtgatcttcatactgcttatgctggttacgccctcgatgaccatgcggtgcgtaggtgtcgggaatcgcgacttcgttgagggcctgtctggcgcgacctgggtagatgtggtcctcgagcatgggggctgtgttaccacgatggccaagaacaagccgactctggacatcgagctgcagaagacagaagcgacccagctcgcgactctgcggaagttgtgcatcgaagggaagattaccaacataaccaccgacagccggtgccccacgcagggcgaggccattctaccggaggaacaggaccagaactacgtgtgcaagcacacatacgtcgatcggggctgggggaacggctgcggattgttcggaaaaggctccctggtgacctgcgccaaattccagtgcctcgaacccatcgagggcaaggtggttcagcacgaaaaccttaagtacaccgtgatcatcactgtccacacgggtgaccagcaccaggtggggaacgacacacagggggtgaccgtcgagataacgcctcaggctagtaccgtggaggcgatcttaccggagtacggcaccttgggtctggagtgctccccgcgcacagggctggatttcaacgagatgatcctccttacaatgaagaacaaggcctggatggtgcacaggcagtggttcttcgacctgcccctcccgtggacgagcggcgccaccactgagacccccacatggaaccgcaaggagctgctggtgacctttaagaacgcgcacgccaagaagcaggaggtggtggttctcgggtcccaggagggggcgatgcacaccgcactgacgggagccacggagatccagaacagcgggggaacctctatcttcgccgggcacttaaaatgccgactaaagatggacaaattagaactgaagggcatgtcttacgccatgtgcctcaacaccttcgtactgaagaaggaggtttccgagacccaacatggcacgatactcataaaagtcgagtacaaaggggaagacgccccatgcaagatccccttcagcaccgaggacggccagggaaaggcccacaatggccgcctgataaccgccaacccagtggttaccaagaaagaggagccggtgaacatcgaggccgagcccccatttggcgagtctaacatcgttatcggtatcggggacaaggccctcaagatcaattggtacaagaaggggtcctccatcggtaagatgttcgaggcaactgcccgaggggcgcgccggatggccatcttaggggacaccgcgtgggacttcggctccgttgggggggtcctgaacagcctcgggaagatggtgcaccagatcttcggttccgcttacaccgccctgttttcaggagtgtcctggatcatgaaaattggcatcggcgtgttactcacttggatagggctgaacagcaagaacacgtcaatgtccttctcctgcatcgtgatcggcatcatcaccctgtacttgggggccgtggtccaggccgacatgggctgtgtcatcaactggaagggaaaggagttaaaatgcggcagcggaatattcgttacaaatgaagtccacacctggactgaacagtataagttccaggcggactcccccaagcgtctggccaccgcgatcgccggggcgtgggaaaatggcgtgtgcgggatccgcagcacgacccgtatggagaacttactgtggaagcagatcgcgaacgagctgaactacatcttgtgggaaaataacatcaagcttacggttgtcgtgggcgacataatcggggtgcttgaacaggggaagaggaccctcacgccacaaccgatggagctgaagtactcctggaagacctggggaaaggccaagatcgtcacggccgagacccaaaactcgtccttcattatcgacgggcccaacacccccgagtgccctagcgcctcccgggcgtggaacgtttgggaggtggaagactacggcttcggtgtcttcaccacgaatatctggctgaagctccgcgaggtgtacacacagtcgtgcgaccacaggttaatgagcgccgcaatcaaggacgagcgcgctgtgcacgccgatatgggctactggatagagtcacagaagaacggcagctggaagctggagaaggcgagcttcatcgaggtcaagacctgtacctggcccaagagccacaccctctggtccaacggggtgctggaatcagacatgatcatcccaaaatccttagccggccccatcagccaacacaaccaccggcccgggtaccatacgcagaccgccggcccgtggcacctcggcaagctcgaactggatttcaattactgcgaggggacaactgttgtaatcacagagaactgcggaacccgcgggccctccctcaggaccaccaccgtgtcgggcaagctgatccatgagtggtgctgccgttcctgtaccctgcccccgcttcggtacatgggggaggatggctgctggtacggtatggagatccgacccattaacgaaaaggaggaaaacatggtcaagtcactagtgtccgcaggcagcggcaaaatggacaatttcacgatggggatactgtgcctcgccatcctgttcgaggaggtcatgcgcggcaagttcgggaagaagcacatgatcgcgggcgtgctgttcaccttcgtgttactgctgtccggacaaatcacgtggcgagacatggcgcacaccttaatcatgatcggcagcaacgcctccgaccgaatgggcatgggggtcacttacctcgccctaatcgccaccttcaaaatccaacccttcctcgcgctcggctttttcctgcggaagctcacttcacgggagaaccttttacttggggtaggcctggctatggccaccaccctgcagttacctgaggatatcgagcagatggcgaacggaatagcgctagggttaatgaccctgaaactgatcacgcagttcgaaacctaccagctgtggaccgctttggtcagcctaacttgttcgaacacaatattcaccctcactgtggcctggcgcaccgccactcttattttggctggcgttagcctactccccctgtgccagtccagttccatgcggaagaccgactggctgcccatgaccgtcgcggccatgggggtgccccctctgccgctttttatattcagcctgaaggatacccccaagcgccgatcttggccgctaaacgagggcgttatggccgtagggctggtgagcatcctggctagctcgctcctgcggaacgatgtcccgatggctggcccgctcgtggcgggaggcctcctgatagcctgctacgtgatcaccggcaccagcgccgacctgaccgtcgagaaggccgccgacgtgacctgggaggaggaggcagagcagaccggcgtgagtcacaacttgatgatcacggtcgatgacgatggcaccatgcgcatcaaggacgacgaaaccgagaatattttgaccgtcctgctcaagacggccctgctcatcgtgagtggaatcttcccttatagcatccccgccaccctcctggtctggcacacgtggcaaaagcagacccagcggtccggcgtgctatgggacgtgcccagcccgcccgagactcagaaagcggagctcgaggagggtgtctatcgcatcaagcagcaagggatcttcggcaagacccaggtgggggtgggcgtccagaaggagggggtgttccacacaatgtggcacgtgacccgaggtgccgttctgacgcacaacgggaagcgcctggagcccaactgggcctccgtgaagaaggacctcattagctatggaggtggatggcggctaagcgcccagtggcaaaagggcgaggaggttcaggtcatcgccgttgagcccgggaagaacccgaaaaattttcagacgatgcccggcatcttccagaccaccacgggagagattggggccatcgcgctggacttcaagcccggaacttcgggctctccgatcataaatcgcgaggggaaggtggtgggtctgtacggaaacggcgtagtgaccaagaacggaggctacgtcagcgggatcgcccaaacgaacgccgaacccgacggacccacacccgaactcgaggaggagatgttcaagaaaaggaatctgactattatggatctgcacccaggcagcgggaaaacgcgcaagtacctccccgccatcgtacgtgaggccattaagcgacggctgcgcaccctgatccttgcgccgacgcgggtggtcgccgccgagatggaggaggcccttaagggactgccaatccgctaccagactaccgctatcaagtccgaacataccggacgagaaatagtggatctaatgtgtcacgccacgtttaccatgcgcctcctcagccccgtgcgggtcccgaactacaaccttatcattatggacgaggcacacttcacggaccccgcctccatcgcggcacgcggctacataagcaccagagtggggatgggcgaggcggcggcaatctttatgacggccacgccgcccgggaccgcggaggccttcccccaatccaacgccccaatccaggacgaagagcgcgacattcccgagcgaagctggaactcggggaacgagtggatcaccgacttcgtaggcaagaccgtttggttcgtacccagcatcaaggccgggaatgatatcgctaattgcctacggaaaaatgggaagaaggttattcagctgtcccgcaagaccttcgatacggagtaccagaagacgcggttaaatgattgggatttcgtagtaacgaccgacattagcgaaatgggggcgaatttcaaggccgacagggtgattgacccccggcgctgcctgaagcccgtcattttgacagacggacccgagcgcgtgatcctcgctggcccgatgcccgttaccgccgcctcagcggctcagcgccggggccgagtcggtagaaacccccagaaggaaaacgaccaatacatcttcactgggcagcccctgaacaacgacgaggaccacgcccactggactgaggccaaaatgttactcgataacatcaataccccggagggcatcatccccgcgctgttcgagccggaaagagagaagtccgcggctatcgacggggagtaccgccttaagggcgagtcccgcaagacgttcgtcgagctcatgcggagaggcgacctgcccgtgtggctggcccacaaagtcgcgtctgaggggatcaagtataccgacaggaagtggtgcttcgatggcgaacgcaataatcagattctcgaggagaacatggacgttgagatctggacaaaagagggtgagagaaagaaactccgcccgcggtggcttgacgcccggacctacagtgaccccctcgccctgaaggagttcaaagacttcgccgcaggccgcaagagcatcgccttggacctggttaccgaaatcggccgggtgccatcccacttggcgcatcgtacgcggaatgcgctagacaatctcgtgatgctgcacacgagtgagcacggaggccgcgcataccggcacgcagtcgaggaattgccggagacgatggagaccctcctgttgcttgggctgatgatcttactcacgggtggggccatgctgtttctgataagcggtaagggaatagggaagacctccatcggcctaatttgcgtgatcgtgtcttccgggatgctctggatggcggacgtccccttgcagtggatcgccagcgccatcgtactcgagttcttcatgatggtgttactgatccccgaacccgagaagcagcgcaccccacaagacaaccagctcgcttacgtcgtcataggcatcctgaccctggccgcgatcgtaacagccaacgagatggggctacttgagacgaccaagcgggacttaggcatgtccaaagagcctggtgtggtcagccccacctcctatttggacgtggacctgcaccccgcctcagcctggaccctgtacgccgtcgcaacgaccgtgatcacccctatgctccgccacaccatcgagaacagcacagccaacgtgagcctggccgctattgctaaccaggcagtagtcctgatggggctcgacaaagggtggcccatctcaaagatggacctaggcgtgcctctgttagccctgggctgctacagccaggtcaacccccttacccttaccgccgccgtgctgctgctcgtaacccattacgcgatcatcgggccgggcctgcaggccaaggccacgagggaagcccagaagaggaccgctgcgggcatcatgaagaaccccacggtagatggcattatgaccatcgatctggaccccgtgatctacgattccaagttcgaaaagcagctcggccaagtgatgctgttagtcctctgcgccgtgcagctgttactcatgcggactagctgggccctgtgcgaggcactgacactcgccacagggcccataacgactctgtgggagggctcccccggcaagttctggaacaccaccatagcggtgagcatggcgaacatattccgcggttcctacctggccggcgcggggctcgcgttcagcatcatgaagagcgtaggcacagggaaacggggcaccggcagccagggagagaccttaggagaaaagtggaagaagaagcttaatcagttgagccgcaaagagttcgacctgtataagaagtccgggatcaccgaggtcgaccggaccgaggccaaagagggcttaaagcgcggggagactacccaccacgccgtgagccgaggatccgcaaaattgcagtggtttgtagagcgcaatatggtaatccccgaaggcagagtaattgatctcgggtgcggccgcgggggatggtcgtactactgcgccgggctaaagaaagtgaccgaggtgcgcggatataccaagggcgggccgggccacgaggagcctgtgccgatgtccacctatgggtggaacatcgtcaagctcatgagcgggaaggatgtcttctatctgccacccgagaagtgcgacactttactctgtgacatcggagagtcctcgcccagcccgactgtggaggaaagccggacaatccgtgtcctcaagatggtggagccttggctgaagaataatcaattctgcattaaggtgctgaacccctacatgcccaccgtcatcgagcacctcgagcggctgcagcgcaagcacggcggcatgctagtgcggaacccgctctcccgcaacagcacgcatgagatgtactggatctccaacggaacggggaacatcgtgagcagtgtcaacatggtaagtcggctacttctcaaccgcttcaccatgacccatcgacggcccaccatcgagaaagatgtggacctgggggcgggcaccagacacgtcaatgccgagcccgaaactcctaacatggacgtcatcggcgagcgcataaagcggataaaggaggagcactcaagcacctggcactacgacgacgagaacccttacaagacctgggcctaccacgggtcctatgaggtcaaggccaccggtagtgcgtcgtccatgatcaatggggtggtaaagctgctcaccaaaccctgggacgtcgtccccatggtcacccagatggccatgacggacaccacgccgttcggccagcagcgcgtctttaaagagaaggttgacacccgtacgccccgccccatgccgggtacccggaaggtaatggagatcaccgccgagtggctatggcgcaccctgggccggaataaacgcccgcgcctctgcacccgggaagaattcactaagaaggtccggacaaacgccgccatgggcgccgttttcaccgaagagaaccagtgggatagcgcacgggccgccgtggaagatgaggagttctggaagctggtcgaccgcgagcgggaactgcacaaacttggcaagtgtggctcctgcgtctacaacatgatggggaagcgcgagaagaagttgggcgaatttggcaaggctaagggcagccgggctatctggtacatgtggctgggagccagatacctagagttcgaggccctggggttcctgaacgaggaccactggttctcccgggaaaactcgtactccggtgttgaaggggaaggtctccacaagctggggtatatcctgcgggatatcagcaagatccccggcggtgccatgtatgccgatgacacggcggggtgggacacccgtatcacggaagacgacctccacaacgaggagaagataacccagcagatggacccggagcaccgccagctggccaacgccatattcaagttgacgtaccaaaacaaggtcgtgaaagtccagcgccccacaccaaagggaaccgtaatggacatcatttccagaaaggaccaacggggtagcggccaggtgggcacctacggcttgaacaccttcacgaacatggaagcgcagctggtgcgccagatggagggcgaaggggtcctatctaaggtggacctcgagaacccccacctcctggagaaaaagatcactcagtggctcgaaaccaagggcgtggagcggctacgacggatggccatctccggggacgactgcgtcgtgaaacccattgatgaccgcttcgctaacgccttattagcactgaacgacatggggaaggtgcgaaaggacataccccagtggcagccctcgaagggctggcacgactggcagcaggtccccttctgctcacaccactttcacgagttaatcatgaaggatgggcgcaagctcgtggtgccctgccgtccccaagacgagctaatcggccgggcccggatcagccagggcgccggctggtcgctaaaggagaccgcgtgtctcgggaaggcatacgcccagatgtggtccttgatgtacttccaccgccgcgacctgcggctcgccagcaacgccatctgctcggctgtcccggtacactgggtgcccactagccgcaccacctggtcgatacacgcccaccaccagtggatgaccacggaggatatgttaaccgtctggaatcgggtgtggatagaggacaacccctggatggaggacaagactcccgtgacgacgtgggaggacgtcccgtatttaggcaagcgcgaggaccagtggtgtggctccctcatcgggctgaccagccgcgcgacctgggcgcagaacatactgaccgcgatccagcaagtgcgctcgctcatcggcgatgaagaatttctggactacatgcccagcatgaagcgcttccgcaaggaagaggagtccgagggtgccatctggtaa

SEQ ID NO: 25922 - RNA, 9873 nt, synthetic construct
  misc_feature 1..9873: note = derived and/or modified CDS sequence (opt11) from DENV-3__FJ744732__SS-prME
  source 1..9873: mol_type = other RNA
accagcctgtgcctcatgatgatgctgcccgccaccttggccttccatttgaccagccgagacggcgagccgcggatgatcgtagccaagaacgagcggggcaaaagtctgctgttcaaaacagcttccggcatcaatatgtgcacgctaatcgccatggacctgggggagatgtgcgatgacaccgtaacctacaagtgccccctaatcgccgaggtggagccagaggacattgactgctggtgcaacctcacctctacctgggttacctacggcacgtgcaaccaagccggggagcatcggagagacaaacgatccgtcgcgctggcaccccacgtgggcatgggcctggacactaggacccagacgtggatgagcgccgaaggggcctggcgccaggtggaaaaggtggagacgtgggcgctccgccacccgggctttaccatcctggccctgttcctcgcccactacatcgggacctccctgacacaaaaggtggtgatctttattctactgatgctggtaacgcctagcatgaccatgcggtgcgtgggcgttgggaaccgagacttcgtcgagggcctgtccggcgccacctgggtggatgttgtcctcgagcacgggggttgtgtgacaaccatggccaagaacaagcccaccttagatatcgagctgcagaagaccgaggcgacccaactagccacgctgcggaagctgtgcatcgaggggaaaatcaccaacatcacgaccgacagccgctgtcccacgcagggtgaggccatcctcccggaagaacaggaccagaactacgtgtgcaaacacacctacgtagaccggggctggggaaacggctgcggactgttcggaaagggctccctggtgacatgcgccaagtttcagtgcctcgaaccaatcgaaggcaaggtggtccagcacgagaacctgaagtacaccgtaatcattacggtgcatacgggcgatcagcaccaggtcgggaacgacacccagggcgtgaccgtcgagattactccccaggccagcaccgtggaggcgatcctgcccgagtacggtacattaggcctggagtgctccccgcgaacagggctggacttcaatgagatgatcttactgactatgaaaaacaaggcctggatggtgcaccgtcagtggttcttcgacctacctctcccctggacgagcggtgccaccacggagacccccacgtggaaccgcaaggagctgctagtcacctttaagaacgcccacgccaagaagcaggaggtggtggtccttggctcccaggagggggcgatgcacaccgctttaaccggcgccacggagatccaaaacagcgggggaacctccatcttcgccggacacctgaagtgccggctcaagatggataagctggagctgaaggggatgtcgtacgccatgtgcctcaacaccttcgtgctgaagaaggaggtgtccgagacacagcacggaacgatcctgatcaaggtcgagtacaagggggaggacgcgccatgcaaaatccctttcagcacagaggatggccagggaaaggcgcacaacggccgcctcatcaccgccaatccagttgtcaccaaaaaggaggagcccgtcaacatcgaggccgagccgcccttcggcgagagcaacatcgtgatcggtatcggcgacaaggccctcaagataaactggtacaaaaaggggtccagcatcggcaagatgtttgaagccacggctcgcggggctcgccgcatggctatcctaggcgacaccgcgtgggactttggcagcgtgggtggggtcctgaacagcctcgggaagatggtgcaccaaatcttcggatctgcctatacagccctgttcagcggcgtgtcctggatcatgaagatcggcatcggcgtcctgctcacctggatcggtctgaacagcaagaacacgtccatgagcttctcctgcatcgtaataggtattattaccctgtatctcggggccgtggtccaggccgacatgggttgcgtgatcaactggaaaggcaaggagctgaagtgcggcagcggaatattcgtgaccaacgaagtacacacatggactgaacagtacaaattccaggcggacagccccaagagacttgctaccgccatcgccggggcttgggagaacggcgtgtgcgggatccggagcaccacccgtatggaaaacctcctgtggaagcagatcgcgaacgagctgaactacatcctctgggaaaacaacatcaagctgacggtcgtcgtgggcgatatcatcggcgttttggaacaggggaagcgcacactcacgccccagccgatggagctgaaatactcttggaaaacctggggaaaggccaagatcgtgacggccgagacacagaacagttccttcatcatcgacggccctaacacgcccgagtgccccagcgcctcccgggcgtggaacgtgtgggaagtggaggactacggcttcggggtcttcactacgaatatctggctgaagttgcgcgaagtgtacacccagagctgcgaccacagattgatgagcgccgccataaaggacgagagggccgtgcatgcggacatggggtattggatcgagtcccagaagaacggcagctggaagctggaaaaggcgagctttatcgaagtaaagacctgcacctggcccaagtcacatactctctggtccaacggcgtgctcgaatcagatatgatcatccccaagtccttagccggccccatttcccagcacaaccacaggccgggttaccatacgcagactgctggcccctggcatttagggaagctcgagctggacttcaactactgcgagggcacgactgtggtcatcactgagaactgcggcaccagaggaccctccctccggaccaccacggtgtccggcaagctgatccacgagtggtgctgccgctcgtgcaccttgcctccgctacggtacatgggggaggacggctgctggtacgggatggagatacgccctatcaacgagaaagaggagaacatggtcaagagcttggtatccgccgggtcgggtaagatggataactttaccatggggattctgtgtctcgccatcctgtttgaggaggtgatgcggggcaagttcgggaagaaacatatgatcgcgggcgtgctgttcacctttgttctactgctgagcgggcagataacctggcgagacatggcccacaccctcatcatgatcggcagtaacgcatcagatcggatgggaatgggggttacgtacctggcactaatcgctaccttcaaaatccagcccttccttgcgctggggttctttcttcgcaaactcacgagccgggagaacctcctactcggggtggggctggccatggccaccaccttgcagctacccgaggacatcgagcagatggccaatggcatagcactggggctaatgaccctcaagctgataacgcaattcgaaacctaccagctgtggacagccctcgtcagcctgacctgttccaacacgatcttcaccctgaccgtggcctggcgcaccgccacactcatcctggcaggcgtaagcctgctcccgttgtgtcagtccagctccatgcggaagaccgactggctgcccatgaccgtcgcagccatgggggtgccgcctctgcctctgttcatcttcagcttgaaggacacccccaaacgccgctcctggccactgaacgagggcgtgatggctgtggggctcgtaagtattctggcatcgagcctcctgcggaacgacgtccccatggccggcccgctggtggcgggcgggctcttaatcgcctgctatgtaatcacaggcacctccgccgacttaaccgtcgagaaggccgccgacgtgacctgggaggaggaggccgagcagacgggggtgtcacacaacctcatgataaccgtcgacgatgatggcaccatgaggatcaaggatgacgagaccgaaaacatcctgaccgttctgcttaaaacagccctgcttatagtgtccgggatcttcccctattcaatccccgccacgttgttggtctggcacacctggcagaagcagacccaacggtctggtgtcctgtgggatgtgccaagcccgcccgagacgcagaaggccgagctggaagagggggtgtaccgcatcaaacaacaggggattttcgggaaaacccaggtgggggtgggcgtccagaaggaaggggtcttccacacgatgtggcacgtgacccggggcgctgtcctgacgcataacggaaagcgtctggagccaaactgggcttccgtaaaaaaagatctcataagctacggcggcgggtggcgtttatccgcccagtggcagaagggcgaggaggtgcaggttatagcggtggagcccgggaagaacccgaaaaacttccaaacaatgcccggcatattccagactaccacgggcgagatcggtgcgatcgctctcgactttaagcccggcaccagcgggagcccgatcatcaatcgtgaaggaaaggtggtgggactgtacgggaacggcgtcgtgacgaaaaacgggggctacgtctccgggattgcacagaccaacgccgagccggacggcccaacgcccgagctcgaagaagaaatgttcaagaaacgaaacctgaccatcatggacctccacccgggcagcgggaaaacgcgcaagtacctccccgcgatcgtgcgggaggccatcaaaaggcggctccgcaccctgattctcgctcccacgcgggtggtcgccgccgagatggaagaggctctaaaagggctgcccatccgctaccaaacgaccgccataaagtccgagcacacaggacgagagatagtggacctcatgtgccacgcaacgttcaccatgcgcctgctgagcccagtgcgtgtcccaaactataacctcatcataatggacgaggctcacttcacagacccagccagtatcgctgcacgcggttacatcagcacccgggtgggcatgggcgaggcggccgctatcttcatgacggcaactccccccggcaccgcggaggcctttccgcagtccaatgccccgatccaggacgaagaacgcgacatccccgaacgctcatggaactcagggaacgagtggattactgactttgccggcaaaacggtttggttcgttccctcgataaaggcggggaacgacattgcgaactgcctgcggaagaacggcaagaaggtgatccagctgtcccgcaaaacattcgacaccgagtaccagaagactcggctcaatgactgggacttcgtggtaacgaccgacattagcgagatgggggccaacttcaaggccgaccgggtgatcgacccccgccgctgccttaagcccgtaatcctgacggacggtcccgaacgcgtgatccttgccggcccaatgccagtgacggccgcatcggccgcccagcggcgggggcgcgtgggccggaacccccagaaggagaacgaccagtacatctttactgggcaaccactaaacaacgacgaggaccacgcccattggaccgaggccaaaatgctgttggacaacatcaataccccggagggtatcatcccagcgttatttgagcccgagcgcgaaaagagtgccgcaatagatggggagtacaggctgaagggcgagtcccgcaagaccttcgtcgagctcatgcggcgtggggacctgcccgtgtggctagcccataaagtggcaagcgagggtatcaaatacacagacaggaagtggtgcttcgacggtgagcgcaacaaccagattctcgaggagaacatggacgtggagatatggacgaaggaaggggagcggaaaaaattacgtccaagatggctcgacgcccggacctactccgacccactcgccctgaaggaattcaaggacttcgccgctggtagaaagagcatcgcgctggatctcgtgacagagatcggccgtgtgccctcccacctggcccaccgcacccggaacgccctggacaatctagtcatgctgcatacgtctgaacacgggggtcgggcctaccggcacgccgtcgaggagctgcctgagaccatggagaccctcctgttactcggactgatgattctcctcaccggaggggcgatgctgttcctgatcagcggcaagggcattgggaaaacctccatcggcctcatctgcgtaatcgtgagctccgggatgctgtggatggcggacgtgccgcttcagtggatagccagcgccattgtcttagagttcttcatgatggttctgctgatccccgagcccgagaaacagcgcaccccgcaagacaaccagctcgcctacgtggttatcggcatcctgaccctggccgccatcgtgaccgccaatgagatggggctcttagagacgaccaaacgcgacttaggcatgtccaaagagcccggggtagtcagccccacctcctacctcgacgtagacctgcaccccgcctctgcctggaccctgtacgcggtggccacgactgtgatcacgccgatgctccgccataccatcgagaattccacggccaatgtgtcactggccgcgatcgccaaccaggccgtggtcctgatgggactcgacaaggggtggcccatctccaagatggacctgggagtccccctactcgccctaggctgctacagccaggtgaaccccctgaccctcaccgccgccgtcctactcctcgtgacccactacgctataatcggtccagggctgcaggccaaggccacgcgggaggctcagaaacgcaccgcggccggcatcatgaagaatcccacagttgatgggatcatgactatcgacctcgacccggtcatctatgacagtaagttcgagaagcagctcggccaagtgatgctgctggtgttatgcgccgtccaactgctgctcatgcggacaagctgggccctctgcgaggccctgaccttagcaaccgggcccatcaccaccctgtgggaaggcagtccggggaagttctggaacacaaccatcgccgtaagcatggccaatatattccgcgggtcctacctggcgggcgcggggctcgccttcagcatcatgaaaagtgttggcaccgggaaacggggcactggcagtcagggcgagaccctcggcgagaagtggaagaagaaattaaatcagctcagccgcaaggagttcgatctgtacaaaaagtccgggatcacggaggtcgatcgtaccgaggctaaggaggggttaaaacgcggcgagacgacgcaccacgccgtctcacggggctccgccaaactccagtggttcgtggagcgcaatatggtaataccggagggccgagtgatcgacctgggatgcggccgcggtggctggagctattactgcgcggggctgaagaaggtgaccgaggtccgcggctacacgaagggcggaccgggccacgaagagcccgtgccgatgtccacctacgggtggaatatcgtgaagctcatgagcggaaaggacgtcttctatctgccgcccgaaaagtgcgacacgctgctgtgcgacatcggggagtccagcccctctccgaccgtggaagagagcaggaccattcgcgtgttaaagatggtcgagccctggctaaagaacaaccaattttgcatcaaggtgctaaacccatacatgcccaccgtgatagagcacctcgagcggctgcagcgcaagcacggcggcatgctggtcagaaacccgttgtcccgcaactcgacacacgagatgtactggatctccaacggtaccggcaacatcgtgagctcagtgaacatggtctctcgcttactcctcaacaggttcaccatgactcaccggcgccccacgatcgagaaggatgtggacctgggggccggcacccggcacgtcaacgccgaacctgagacaccgaatatggacgtgatcggagagcgcattaagcgaattaaggaggagcactctagcacctggcattacgacgacgaaaacccctataagacatgggcctatcatgggtcctacgaggtcaaggccaccggcagcgcgtcatccatgataaatggtgttgttaagctgctaaccaagccctgggacgtcgtcccaatggtaacccagatggccatgaccgacaccaccccgtttggccaacagcgcgttttcaaagagaaggtcgacacccggacgcccaggcccatgccggggacccgtaaggtgatggagatcaccgctgagtggctgtggcgcaccctgggccggaacaaacgcccgcgcctctgtacgcgggaagagttcacaaagaaggtgagaaccaacgctgccatgggcgcagtcttcacagaagagaaccagtgggacagcgcccgggcggccgtagaagacgaagagttctggaagcttgtggaccgcgaaagagaactgcacaagttagggaaatgcggctcctgtgtctacaacatgatggggaagcgcgagaaaaagctgggcgagttcgggaaggctaaaggctcccgggccatctggtacatgtggctgggcgcccgttatctcgagttcgaggccttagggtttctgaatgaggaccactggttttcccgggagaacagctacagtggcgtggagggggaaggcttacacaagttggggtacatattgcgcgacatcagcaagatccccggcggcgccatgtacgctgacgacacggccgggtgggacacccggatcaccgaggatgacctccataacgaggagaagattacccagcagatggaccccgagcaccgccagctggccaacgccatcttcaagctgacataccaaaacaaggtggtcaaggtccagcgccccaccccaaagggcaccgtgatggacatcatctcccgcaaggatcagcggggaagcgggcaggtcggaacctacgggctcaacacattcacaaacatggaagcccagctggtgcgccagatggagggcgagggggtgctgagcaaggtcgatctcgaaaacccccacttgctggagaagaagatcacccagtggctcgagaccaagggcgtggagcggctgcgccggatggcgatcagcggggacgactgcgtagtcaagccgatcgatgaccgcttcgccaatgcgctgctagccctgaatgacatgggtaaggtgcggaaggacataccccagtggcagccgtcgaaaggctggcacgactggcaacaggtccccttctgctcgcaccacttccacgagctgatcatgaaggacgggcgaaagctagtcgtgccctgtcgcccgcaggacgagctcatcggccgggcccggatctcccagggggcgggctggagcctgaaggagaccgcctgcctcgggaaggcgtatgctcagatgtggtccctgatgtacttccaccggcgcgaccttcggctcgcctctaacgcgatttgctccgccgtgccggtgcactgggtgcccactagccggacaacctggagcatccacgcccaccaccagtggatgaccacggaagatatgttaaccgtgtggaatcgggtttggatcgaggacaacccctggatggaggacaagacgcctgtcacaacgtgggaggatgtgccgtacctgggcaagcgtgaggaccagtggtgcggttccctcatcgggctgacctcccgggccacctgggcgcaaaacatcctcaccgcgatccagcaggtacgctccctcatcggagacgaagagtttctagactacatgccctcaatgaagcggttccgcaaggaagaagaaagtgagggggctatctggtga

SEQ ID NO: 25923 - RNA, 9873 nt, synthetic construct
  misc_feature 1..9873: note = derived and/or modified CDS sequence (opt11) from DENV-3__FJ810414__SS-prME
  source 1..9873: mol_type = other RNA
accagcctatgcctcatgatgatgctgcccgccaccctggccttccatctcacgtctcgggacggagaaccacggatgatcgtggccaagaatgagcggggcaagagcctgctgttcaagaccgcctcgggcataaacatgtgcacgttaatagccatggacctgggagagatgtgtgacgacaccgtgacctacaagtgccccctgattgccgaagttgagccggaagacatagactgttggtgcaacctcaccagtacatgggtgacctacggaacgtgcaaccaggccggggagcaccggagagacaaacggtccgttgcgctggcgccccacgttggaatggggttagacacacgcacccagacctggatgagcgctgagggggcatggcgacaagtcgaaaaggtcgagacatgggcgctccgccacccgggcttcaccatcctggccctgttcctcgcccactacatcgggacctccctaacccagaaggtggtgatcttcatcctgctcatgctggtgactcctagcatgaccatgcggtgtgtgggcgtggggaaccgtgacttcgtcgaggggctgtcaggcgccacctgggtggacgtcgtcctagagcacgggggctgcgttaccacgatggccaagaacaagcccaccctggacatagagctgcagaagaccgaggcgacccagctcgccacgctgagaaagctgtgcatcgagggtaagataactaacatcaccaccgacagccgctgccccacgcagggcgaagcaattctcccggaggagcaggaccagaactacgtttgcaagcatacttacgtagaccggggctgggggaatggctgcgggctcttcggcaaggggtccctggtgacatgcgccaaattccagtgcctcgagcccatcgagggcaaggtggtacaacacgagaacttgaagtatacagtgataatcaccgtgcacaccggcgatcaacatcaggtcggaaacgacacccaaggcgtgaccgtcgagatcacgccacaggccagcaccgtggaagcgatcctgccggagtacgggacccttggcctcgagtgttccccgcgcacaggcctggacttcaacgaaatgatactcctgaccatgaaaaacaaggcatggatggtgcaccggcagtggttcttcgacttgcccctcccctggacgagcggcgctaccaccgagactcccacgtggaaccgtaaggagctgctggtaaccttcaagaacgcacacgccaagaagcaggaggtggtggttctcggctctcaggaaggagcgatgcacaccgcactgaccggcgccacagagattcaaaacagcgggggcacctcaattttcgccgggcaccttaagtgtagactcaagatggacaagctggagctgaagggcatgtcctacgccatgtgcctaaacaccttcgtgctgaagaaggaggtgtccgagacccagcacggcaccatcctgatcaaggtcgagtacaagggtgaggacgcgccgtgcaaaatacccttcagcaccgaggacggccaggggaaggcccacaacggccggttgatcaccgcaaaccccgtggtaaccaaaaaggaggagcccgtcaacatcgaggccgagccgcccttcggggaaagcaacatcgtgatcgggataggcgacaaggccctgaagatcaattggtacaagaaggggtcgagcatcggcaaaatgttcgaggccacggctcgcggggcccgcagaatggccattctaggcgacactgcgtgggattttggctccgtcggcggggtactgaacagcctcgggaaaatggtgcaccagatcttcggttctgcatataccgccttattcagcggggtgtcgtggatcatgaagatcggcatcggggtcctactcacctggatcggcctgaacagcaagaacacgtccatgagcttctcctgcatcgtgatcggcatcatcaccttatacctcggagcggtggtccaagccgatatgggctgcgtgatcaactggaaggggaaggagctgaaatgcggcagcgggatcttcgtgacaaacgaggtccacacctggacagagcagtacaagttccaggccgactcgcccaagcgcttagctaccgcaatcgctggggcctgggaaaacggcgtgtgcgggatacgctcaaccacacggatggagaaccttctgtggaaacaaatcgcgaacgagctgaactacatactctgggagaacaacatcaagctgacggtagttgtgggcgacataatcggggttttggagcagggcaagcgcaccctcacaccccagcccatggagctgaagtactcatggaagacctggggcaaggccaagatcgtcacggccgagacccagaacagctccttcattatcgacggcccaaacactcccgaatgcccctccgcgtcccgggcgtggaacgtgtgggaggtggaggactacggcttcggggtcttcactacgaacatctggctgaagctccgcgaggtgtacacccagagctgcgaccaccggctgatgtctgccgctatcaaggacgaacgcgccgtgcacgctgacatgggctattggatcgagtctcaaaagaacggaagctggaagctcgagaaggcgtccttcatcgaagtcaagacctgcacctggcccaagagccacaccctctggtccaacggtgtgctggagagcgacatgatcatccccaagtccctggccggccccattagccagcacaaccatcgccctggctaccacacgcagaccgccggcccctggcacctcgggaagctggagctggactttaactactgcgagggtaccaccgtggtcattactgagaattgcgggacgcgcgggccctcactccgaaccaccaccgtgagcgggaaactgattcacgagtggtgctgccgcagttgcactcttcccccgctccggtatatgggggaggacgggtgttggtacggcatggagataaggcccatcaacgagaaggaggagaacatggctaagtccttagtgtctgccggaagcgggaaaatggacaacttcacgatggggatcttgtgcttggctatcctgttcgaggaggtcatgcgggggaagttcgggaagaagcacatgatcgccggcgtcctgttcaccttcgtgctcttgctgtccggtcagatcacgtggcgtgacatggcccataccctgatcatgataggttcaaacgcctccgaccggatgggcatgggggtaacctatctggccctgatcgcgactttcaagatccagcctttcctcgcattaggttttttcctgcgcaagctcacgagccgggagaacctgttgctaggggtgggcttggccatggcaacgacactacaactccccgaggatatcgagcagatggcaaacggaatcgccctggggctgatgaccctgaagctgatcacacagttcgagacataccagctatggaccgcccttgtgagcttaacctgctccaacacaatcttcaccctgacggtcgcctggagaaccgccacgctcatcctggccggcgtgagcctgttgccgctgtgccagtccagctctatgcggaagactgactggctgccgatgaccgtagccgccatgggcgtgccgccgcttccgcttttcatcttcagtctgaaggacacccccaagcgacgctcttggcccctaaatgagggcgtcatggccgttgggttagttagcatactcgcgtcaagcctcttacggaacgacgtacccatggcggggcccttggtggccggcgggctcctgatcgcctgctacgtgattacgggcacctccgccgacctgaccgtggagaaggccgcggacgtcacttgggaagaggaggccgagcagacgggggttagccacaatttaatgatcaccgtcgacgacgacggaaccatgcgcatcaaggacgacgagaccgagaacatcctgacggtcttattaaagacggccctgctgatagtgtccggtatattcccgtactctatccccgcaacgctcctggtatggcacacctggcagaagcagacccagcggtccggggtcctgtgggacgtgccctcaccgcccgagacgcagaaggccgagctcgaagagggcgtgtaccgaatcaaacagcaggggatcttcggcaagacccaggtgggggtgggcgtgcagaaggagggggtattccacaccatgtggcacgtgactcggggcgcggtgctgacacacaacggcaagcgcctggagcccaactgggcctccgtcaaaaaagacctcatcagctacggtggcgggtggaggctgtccgcccagtggcagaagggtgaggaggtccaggtgatcgccgtcgagcccggcaaaaacccaaaaaacttccagaccatgcccggcatcttccagaccacgacaggtgagattggggctattgccctggactttaaacctggcactagcgggagcccgatcatcaaccgagagggtaaagtggtgggcctgtacgggaatggcgtagtgaccaaaaacgggggctacgtgagtgggatcgctcagaccaacgccgaacccgacggccccacgcccgagctcgaggaggagatgtttaagaagcggaacctgaccatcatggatctgcacccgggcagcgggaagaccagaaaatatctccccgctatcgtccgggaggcgattaaacgccggctgcgcaccctaattcttgcccccacacgtgtggtagcagccgagatggaggaggcgctgaagggcctgcccatccgctaccagaccaccgccatcaagtcagaacacaccgggcgggaaatcgttgacctcatgtgccacgctacgtttacgatgcgcctgctgtctccggtgcgggtgcccaattacaacctcataatcatggacgaggcacacttcactgatcccgcctccatcgccgctcgcggctatatctctacccgggtcgggatgggcgaagccgccgccatcttcatgacggcgacgccgcccggaaccgctgaggcattcccccagtccaacgcccccatccaggacgaggagcgcgacatccccgagcgcagctggaactccggcaacgagtggataaccgacttcgtgggcaaaacggtgtggttcgtccctagcatcaaggccggtaacgacatcgcgaactgcttacggaagaacggcaaaaaggtcatacaactgtcccgcaagacgttcgacaccgagtaccagaagactcgtctcaacgactgggacttcgttgtaacgaccgacatctcggagatgggggccaacttcaaggccgaccgggtgattgaccccagacgctgcctgaagcccgtgatactgaccgacggccctgagcgggtcatactcgccggaccgatgcccgtaaccgccgcgtccgccgcccagcgcagagggcgcgtgggccggaatccccagaaggagaacgaccagtacatcttcacggggcaacccctaaacaatgacgaggaccacgcccattggaccgaggcaaaaatgttactggacaacatcaacacgccggagggcatcatccccgccctgttcgagcccgagcgcgagaagtccgccgccatcgacggggagtaccggctgaaaggcgaatcccgaaagacgttcgtcgagctcatgcgtcgcggcgacctgccagtgtggttagcccacaaggttgccagcgaggggatcaagtatacagaccggaagtggtgcttcgacggcgagagaaacaaccagatactcgaggagaacatggacgtggagatttggacgaaggagggggaaaggaagaagctgcggccgcgctggctggatgcccggacatactcagaccccctcgccctgaaggaattcaaggacttcgccgccggccgcaaatccattgcgctagacctggtgaccgagataggtcgagttccctcccacctagcgcatcgcaccagaaacgccctggacaacctcgtcatgctgcacacgagcgagcacgggggccgcgcctaccggcacgcagtggaagaactgccggaaaccatggagaccctgctgctgctcggcctgatgatcttgttgaccggcggggcgatgttattcctgattagcggcaaaggcatcgggaagacgtctatcggccttatctgcgtcatcgtgtcgagcgggatgctgtggatggccgacgtgcccctgcagtggatcgcgagcgccatcgtcctcgagttcttcatgatggtgctgctgatacccgagcccgagaagcagcgcaccccccaggacaatcaactcgcctacgtcgtcattggcatcctaactctggcggccattgtgaccgccaacgagatgggactcctggagacgacgaaacgtgatctgggcatgtccaaggagcccggcgtagtaagccctacctcctacctcgacgtggacctacaccccgccagcgcctggacgttgtatgctgtggccacgaccgtcatcaccccgatgctgcgtcacaccatcgagaactccacggccaacgtaagcctggcagccatcgctaatcaggccgtggtccttatggggctcgataagggttggcccatctcaaaaatggacctgggggtgcccctgctcgccctgggctgctacagccaggtgaaccccctgaccctcacggctgcggtactgctgctcgtgacccactacgcaatcatcggtcccgggctacaggccaaggcgacgagagaggcacagaagcgcactgcagccggcatcatgaaaaaccccacagtggacgggatcatgacaatcgatctggaccccgtcatctacgactccaaatttgagaagcagctcggccaggtaatgctgctggtgctatgcgccgtccagctgctgctcatgcggacgagctgggcactgtgcgaggctctgaccctcgcaaccgggcccattacgacgctgtgggagggctccccgggcaagttctggaacaccaccatcgccgtgagcatggcgaacatcttcagggggtcctacctggccggcgcggggctcgccttcagcatcatgaagtctgtgggaaccggaaagcggggcacgggcagccagggggagaccctgggcgagaagtggaagaagaagctgaaccagctctcacgaaaggagtttgacctgtataagaagtccgggatcaccgaagtcgaccggaccgaggccaaagagggcctcaagagaggggagaccacacaccacgccgtgagcagagggtccgccaaactccagtggtttgtggagcgcaacatggttatccccgaggggcgggtgatcgacctcgggtgtggacgcgggggctggtcgtactattgcgctgggctgaagaaggtgaccgaagttcgcggctacaccaagggtggccccggacatgaggagccggtccctatgtccacctacgggtggaacatagtgaagctcatgagcggcaaggacgtcttctacttgccgcccgagaagtgcgacacgttactgtgtgacataggggagagtagcccctccccgaccgtggaggagagccggaccatccgcgtgctcaaaatggtcgagccctggctgaagaacaaccagttctgcatcaaggtactgaatccctacatgcccaccgtgatcgagcacctggagcggctgcaacgcaagcatggcggtatgctggtgcggaaccctctctcccgcaacagcacccacgaaatgtactggatctccaacggaaccggcaacattgtgtcctccgtgaacatggtcagccggcttctgctcaaccgcttcaccatgacccatcggcgccccaccatagagaaggacgtggacctgggggccgggacccggcatgtgaacgccgagcccgaaaccccgaacatggacgtaatcggcgagcgcatcaagcggatcaaggaggaacactccagcacctggcactacgacgacgagaacccctacaagacgtgggcctaccatggttcctacgaagtgaaggccaccggcagcgcgtcatccatgataaacggggtcgtgaagctgctcaccaagccctgggacgtcgtccccatggtgacccagatggccatgacggacaccaccccgttcggccagcagcgcgtgtttaaggagaaggtcgacacccggacgccccgccccatgcccgggacgcggaaggtgatggagatcaccgcggaatggctgtggcgtaccctgggccggaacaagcgacctcgtctctgtacgcgggaggagttcaccaagaaggtacgtaccaacgccgccatgggcgccgtctttaccgaggagaaccagtgggacagcgcccgcgccgccgtagaggacgaggagttttggaagttagtggacagggagcgggagctgcacaagctcgggaagtgcggctcctgcgtctacaacatgatgggcaagcgagagaagaagcttggcgagttcgggaaggcgaaaggtagccgggccatttggtacatgtggctgggcgcgcggtacctcgagttcgaggccctgggtttcctgaatgaggaccattggttctcccgggagaacagctactccggcgtggagggggagggcctccacaaactggggtatatcctgcgcgacatctcgaagatccctggcggcgctatgtacgcggacgacacggccggttgggatacacggatcaccgaagacgacctccataacgaggagaagatcacccaacagatggatcccgagcaccgacagctggccaacgccattttcaagttgacgtaccaaaataaagtggttaaagtgcagcggccaaccccgaaaggcaccgttatggacattatctcccgcaaggaccagcgggggagcggccaggtcgggacctacggcttaaacactttcacgaacatggaagcccagctggtgcgccaaatggagggggagggggtgctgtcaaaggtcgacctcgagaaccctcaccttctggagaagaagatcacccagtggttggagaccaagggcgtagagcgactgcgtcggatggcgatcagcggggacgactgcgtcgtcaagccaatcgacgatcgcttcgccaatgccctactcgccctgaacgacatggggaaggtgcgaaaggacatcccccagtggcagccgagtaaaggatggcacgactggcagcaggtccctttttgcagccaccatttccacgagctgatcatgaaagacgggcgcaagctcgtcgtgccctgccgcccccaggatgagctgatcggccgggcacgcatctcccagggggcgggctggtcattaaaggagactgcctgcctcgggaaggcctacgcccagatgtggagtttaatgtacttccaccggcgcgacctgcggctcgcctctaacgcgatttgctccgccgtcccggttcactgggtgccaacgtcccgcaccacctggagcatccacgcccaccaccagtggatgacgacggaggacatgctgaccgtgtggaatcgggtctggatcgaagacaacccctggatggaggacaagacgcccgtgaccacgtgggaggacgtgccgtacctgggcaagcgcgaggaccagtggtgcggatccctcatcggactgaccagccgggctacctgggcgcagaacatcctgaccgcgatacagcaggtgagatcgttgattggcgacgaagagttcctggactatatgcccagcatgaagcgcttccggaaggaggaagagtcggagggagccatctggtga

SEQ ID NO: 25924 - RNA, 9873 nt, synthetic construct
  misc_feature 1..9873: note = derived and/or modified CDS sequence (opt11) from DENV-3__FJ744734__SS-prME
  source 1..9873: mol_type = other RNA
accagtctgtgcctcatgatgatgcttcccgccaccctggccttccacctaaccagccgggatggcgagccccggatgatagtggccaagaacgaacgcggcaagagtttgcttttcaagaccgcctctggcatcaacatgtgtacactcatagccatggacctgggagagatgtgcgacgacaccgtgacctacaagtgcccattgatcgccgaagtcgagcctgaggacatagactgctggtgtaacctaacaagcacctgggtgacctacgggacgtgcaaccaggctggtgagcaccggagagataagcggtcagttgcgctggcaccccacgttggcatgggcctggacacacgcacacagacatggatgagcgccgagggtgcttggcgccaggtggagaaggtagagacgtgggcactcaggcaccccggctttaccatcctggccctcttccttgcccactacatcgggacgtccctgacccagaaggtggtgatcttcatcctgctcatgcttgtgacgcccagtatgactatgcggtgtgtgggagtggggaaccgcgacttcgtagagggcttgtccggcgcgacgtgggtagacgtagtcctcgagcatgggggctgcgtaacgacgatggccaagaacaagcccaccctagacatcgagctgcagaagaccgaagcgacccagttagctacgctgaggaagctgtgcatcgaggggaagatcacaaacattaccacagatagccgatgccccacacagggtgaggccatcctcccagaggagcaggatcagaactacgtgtgcaagcatacatacgtagataggggatggggtaacggctgtggactatttggtaagggatccttagtgacctgcgctaagtttcagtgcctcgagccgatcgagggcaaagtggtccagcatgagaacctgaaatacaccgtgatcatcactgtacacaccggggaccagcaccaagtagggaacgacacccagggcgtcaccgtcgagataacgccacaggccagcaccgtggaggctatcctgcccgaatacgggacattgggcctggagtgctcgccgcgcaccgggttggacttcaacgagatgatcctcctgaccatgaaaaacaaggcctggatggtgcaccgacagtggttcttcgatttgcccctcccatggacttcaggcgccaccacagagaccccaacgtggaaccgcaaagaactgctggtcaccttcaagaacgctcacgccaaaaagcaggaagttgtggtcctcggctcccaggagggtgcgatgcacacggctctgactggtgccacggaaatccagaattcagggggcacctcgatcttcgccggccaccttaagtgtaggctgaaaatggataaactggagcttaaaggaatgtcctatgcaatgtgtctgaacaccttcgtgctgaaaaaagaggtctcggaaacgcaacacggcacgatcctgatcaaagtcgagtacaaaggtgaggacgctccttgcaagatcccttttagcaccgaggacggccaagggaaggcccacaacggtcgcctgataacagccaacccagtagtgacgaagaaggaagagccagtaaacatagaggctgaaccgcccttcggggaatccaatatcgtgatcggcatcggcgacaaggcgctcaagatcaattggtacaaaaaggggtccagtataggcaagatgttcgaggccactgcgagaggggcccgccggatggccatcctgggcgacacagcttgggatttcggctccgtcggtggggtcctgaacagcctagggaagatggttcaccaaatcttcgggtccgcctacaccgccctgttcagcggggtgtcttggatcatgaagatcggtataggcgtccttcttacgtggatcggactgaactctaagaacacgtctatgagtttctcttgtatcgtgatcggcataattactctctacctcggggccgttgtgcaggccgacatgggttgcgtgataaactggaaggggaaggagcttaagtgcggtagcggtatattcgtgaccaacgaggtccacacttggactgaacagtacaagttccaagcggactccccgaagcgcctcgcgaccgccattgctggagcctgggagaatggcgtgtgtggtattcgcagcacaacccggatggagaaccttttgtggaaacagatcgcgaacgagctcaattacattttgtgggaaaacaacatcaagttgacggtggtggtcggtgatatcatcggggtgctggagcaggggaagcgcacgttgacgccccagccgatggaactgaaatactcctggaagacctggggtaaggcaaaaatcgtcacggcggagacacagaactcgtccttcatcatcgacgggcccaacacccccgagtgccccagcgcctccagagcctggaacgtgtgggaggtagaggattacggcttcggggtgttcacaacgaacatctggctgaagcttcgcgaagtgtacacccagagctgcgatcatcggctcatgagcgccgccatcaaggacgaacgcgccgttcatgccgatatgggctactggatcgagtcccagaagaacggttcgtggaagctagagaaagcatccttcatagaggtaaagacctgcacctggcccaagagccacaccttgtggtccaatggagtgcttgagagtgacatgattatccccaagtcccttgctggcccaatcagccaacacaaccaccgtccgggctaccacacgcagaccgccgggccctggcacctcgggaaacttgaactagactttaactactgcgagggaaccaccgtggtcataacggagaactgcggcacccgtggaccctccctcaggacgacaacggtcagcggcaagctgatacatgagtggtgctgccgctcctgcactcttcccccgctccggtacatgggggaggacggctgctggtatggtatggagatccggccgattaatgagaaagaggagaacatggtcaagagcctagtcagtgccggcagcggaaaaatggacaatttcaccatgggtatattatgcctcgccatcctcttcgaggaggtgatgcgaggcaagttcgggaagaaacacatgatcgccggcgtattgtttaccttcgtgctcctcctgtccgggcagatcacgtggcgtgacatggcccacaccctcataatgatcggcagcaacgccagcgaccggatgggcatgggcgtgacctacctggccctgatagccaccttcaagatccagcctttcctcgccctaggcttcttcctacgcaagctcacgagccgtgagaatctgctgctcggcgtcggattagcaatggccacgaccctgcagctgccggaggacatcgaacagatggccaacggtattgcgctcggtctaatgaccctcaaactgataacgcaattcgagacataccagctgtggaccgctctcgtctccctcacttgctccaacacgatcttcacgctgaccgtcgcgtggcgcaccgccacgcttatcctagccggagtgagcctgctgcctctatgccaatccagctccatgcggaaaaccgactggctgcccatgaccgtcgcggcaatgggggtgcctcccctgccgttattcatcttcagcctgaaggacacccccaagcgccgttcatggcccctcaacgagggcgtcatggcggtgggtttagtgagcatcctagcctctagtctgctgagaaacgatgtaccgatggccggcccgttggtggcgggcgggctcttgattgcctgctatgttataacgggcacatccgcagatctgaccgtcgagaaggccgcagacgttacctgggaggaagaggccgagcagacgggtgtgtctcacaatttaatgatcactgttgacgacgacggcaccatgcgcatcaaggacgacgagactgagaacatcctgaccgtgctgctcaagacggccctactcatcgtgagtgggatatttccgtactcgattccggccaccttactggtctggcacacctggcagaagcaaacccagcggtccggcgtgctatgggatgtgcccagccctcccgagacacagaaggcagagctcgaggaaggcgtctatcgcatcaagcagcaggggatctttggcaagacccaggtgggagttggtgtccagaaggagggggtgttccacaccatgtggcacgtgacccgaggtgccgtcctaacgcacaacggcaagcgactggagccgaactgggcgtcggtgaagaaggatctcatcagctacggaggcggttggcggctgtcggcgcagtggcagaagggggaggaagtgcaggtcatcgcggttgaacccggaaagaacccgaaaaacttccagactatgccgggaatattccagaccacaatgggcgaaatcggcgccatcgcgctggactttaaacccggcacgagcggtagccccattatcaaccgcgaggggaaggtggtcggcctgtacgggaatggcgtggtaactaagaatgggggctatgtcagtggaattgcacaaaccaacgccgagcccgacgggcccaccccagagttagaggaagaaatgttcaagaagcgaaatctgactatcatggacctgcaccccggcagcggtaagacccgtaagtaccttcccgccatcgtgcgagaagccatcaaacgccggctgcggactctgatcctcgcccccacccgggtggtcgccgctgagatggaggaggcgctaaagggcctccccatccgctaccagaccacagccatcaaatctgagcacaccgggcgggagatagtggacctgatgtgccatgccactttcacgatgcgcctgctgagccccgttcgggtccccaactataacctcatcatcatggacgaggcccactttacggacccagcctccattgccgcccgcggatacatatcaactcgggtcggaatgggcgaggcggccgccattttcatgaccgcgacgccccctggcactgcggaggccttcccccagtccaacgcgcctattcaagacgaggagcgcgatatacctgagcgcagttggaactccggtaacgagtggatcactgattttgtaggcaaaaccgtctggttcgtgcctagcatcaaggccggcaacgacatcgccaactgcctgcggaaaaacggcaaaaaggtgatccagctgtcgcgcaagacgttcgacaccgagtaccagaagacccggctgaatgattgggacttcgttgtgaccaccgacatcagtgagatgggggcgaactttaaggctgatagggtaattgacccccgtcgctgcctgaagcccgtgatcctaaccgacggccccgagcgcgtgatcctggccggcccgatgccggtaaccgccgcctccgcggcccagcgcagggggcgtgtcggccggaacccccaaaaggaaaacgaccagtacatctttaccgggcagcctttgaacaacgacgaggaccacgcccactggaccgaggccaagatgctgttagataatataaacactccggaaggcatcatccccgcactattcgagccggagcgcgagaagtccgcagccatcgacggtgagtatcggttgaagggcgaatctcgcaagaccttcgtcgagctcatgcggcgcggcgatttaccggtctggctggcccacaaggtagcctcagaggggataaagtatacagatcgaaagtggtgcttcgacggggagcggaacaaccagatactcgaggagaacatggacgtggagatctggaccaaagagggtgagcggaagaaattgcgcccgcgttggttagacgcccgtacgtattccgaccccctcgcgctgaaggaattcaaggacttcgcggcgggccgaaagagcatagccctggacctcgtcaccgagatcggcagagttccctcccaccttgcgcatcgcacccggaacgcgctggacaacctcgtgatgctgcacaccagcgagcatggaggccgcgcctaccggcacgccgtcgaagagctgccggagacgatggagaccctccttctgctcgggctcatgattctcctcaccggtggggccatgctgttcttgatcagcggcaagggcatcgggaagacctccatcggcctgatctgcgtgatcgtgagctccggaatgctctggatggcggacgttcccctgcagtggatcgcaagcgccattgtcttggagtttttcatgatggtactcctgatccccgagcccgagaagcagcgcactccgcaggacaatcagctcgcctacgtcgtgatcggcatccttaccctggccgcgatcgtgaccgccaacgagatggggctcctggaaacgacaaagcgggacctggggatgagtaaagagcccggcgtcgtgagcccgacatcctacctcgatgtggacctgcacccagctagcgcgtggaccctatacgccgtcgcaaccacggtgataacaccgatgttacgccatacgatcgagaactccaccgcaaacgtgagccttgccgctatcgcgaaccaggcggtggtactgatgggactcgacaagggctggcctatctctaagatggacctgggagttccactgctcgccctgggctgctacagccaggtcaatccactgactctcactgccgccgtgctattactcgtgacccactatgcaattatcgggccgggcctccaagccaaggcaacccgggaggcgcagaagcgcacggccgcggggatcatgaagaaccccacggtcgacgggataatgaccatcgacctggacccagtaatctacgactccaagttcgagaagcagctcggccaggtgatgctgctagtcctctgtgccgttcagttactgctcatgcggaccagctgggccctgtgcgaggccctgacgttggccacagggcccatcactaccctttgggagggctcacctggcaagttttggaacacaaccatcgcggtgagcatggccaacatatttcgcgggtcatacctggccggcgccgggctcgcattttctatcatgaagtccgtcggcaccgggaaacgggggaccggcagccagggggagacgctgggtgagaaatggaaaaagaagctgaaccagctgtctcgaaaggaattcgacctgtacaagaagtccggtatcaccgaggtggaccggaccgaagctaaggagggcctgaagcgcggggagactacgcaccacgccgtgtcccgggggtccgccaagctccagtggttcgtggagcgcaacatggttatccccgaaggccgcgtgatcgatctggggtgcggtcgcggggggtggagctactactgcgccggcctgaagaaggtgacagaagtcaggggatacacaaagggcggtcctggtcacgaggagcccgtgccgatgtccacttacgggtggaacatcgtcaaactcatgtccggcaaggacgtgttctacctgccaccagagaaatgcgacactctgttgtgtgacatcggggagtcctcgcccagtccgaccgtagaggaaagcagaaccattcgagtcctcaaaatggtcgagccctggctgaaaaacaaccagttctgcatcaaggtgctgaatccctacatgcccaccgtgatcgaacatcttgaacggctgcagcgcaagcatggtggcatgctggttcggaacccactcagtcgcaacagcactcacgaaatgtactggatctccaacgggaccggcaacatcgtgagctccgtaaatatggtgagccggctcctgttaaacaggttcaccatgacgcaccggcgccccaccatcgaaaaagacgtggacctgggggcgggaacccggcacgtgaacgccgagcccgagaccccaaacatggacgtgatcggcgagcgcatcaagcggatcaaggaggagcactccagcacttggcactacgacgacgagaacccctacaagacctgggcctaccacgggtcttacgaggtaaaggccacgggcagcgcctcatcaatgattaacggggtagtgaagctgctcaccaagccctgggacgtagtgcctatggtgacccagatggcgatgaccgacacaacgcctttcggccagcaacgcgttttcaaggagaaggtggacaccagaacgcccaggcctatgcccgggacacggaaggtgatggaaatcaccgctgagtggctttggagaactttaggtaggaacaaacgcccgcgcctatgtacccgggaggagtttacgaagaaggtccgcactaacgccgccatgggtgcagttttcaccgaggaaaaccaatgggacagtgcgagagccgccgtggaagacgaggagttctggaagttagtcgatcgcgagcgggagctgcacaaacttggtaagtgcggctcatgtgtgtacaacatgatggggaagcgcgagaagaagctgggtgagttcgggaaagccaagggcagcagagcgatctggtatatgtggcttggcgcccgctacctcgagttcgaggctttgggcttcctgaacgaggaccactggttctcccgggagaactcttattccggcgtcgagggggagggcctgcacaaactggggtatatcctgcgcgacatcagcaagatacctggcggcgccatgtatgctgacgacactgcggggtgggacacgaggatcaccgaggacgacctccataacgaggagaagatcacccagcagatggaccccgagcatcgccagttggccaatgcaatcttcaagctgacctaccaaaacaaggtcgtgaaagtgcaaaggcccacgccgaagggcaccgtcatggacatcatctcccgcaaggatcagcgggggagcggtcaggtggggacctacggcctcaataccttcaccaacatggaagcccaactagtgcgccagatggaaggggagggggtcctgtccaaggtagatctcgagaatcctcacctcctggaaaagaaaatcactcagtggctcgaaacaaagggagtggaacggctgcgcaggatggccataagcggggacgactgcgtcgtaaagcccatcgatgaccgcttcgccaacgccctgctcgccctgaacgacatgggcaaagttcgcaaagacattccgcagtggcagccgtccaagggctggcacgattggcaacaggttccgttctgcagccaccatttccacgagctgatcatgaaggacgggcgcaaactcgtggtaccttgccgcccccaagatgagctgatcggccgggcccgcatctcccaaggggcgggatggtcactgaaggagaccgcatgcctggggaaggcctacgcccagatgtggtccctgatgtactttcaccggcgcgacctgcgtctagcttcaaacgccatctgctcggcggtcccagtccactgggtgcccacgagtcgcactacctggagtatccacgcccaccatcagtggatgacaaccgaagacatgcttaccgtctggaaccgtgtgtggatcgaggacaacccctggatggaggataagacgcctgtgacaacctgggaggacgtcccgtacttgggaaagcgcgaggatcagtggtgtgggtccctaatcgggctaacgagccgcgcgacctgggctcagaacattctgaccgcgatccagcaggtccgcagcttgatcggcgatgaggaattcctggattacatgcccagcatgaagcggttccgcaaggaggaggagtccgagggcgccatttggtga

SEQ ID NO: 25925 - RNA, 9873 nt, synthetic construct
  misc_feature 1..9873: note = derived and/or modified CDS sequence (opt11) from DENV-3__FJ744737__SS-prME
  source 1..9873: mol_type = other RNA
accagcctgtgtctcatgatgatgctgcccgccaccctggccttccatctcaccagcagggacggcgagccgcggatgatcgtggccaagaacgagcgcggcaagtccctactgttcaagaccgcttctgggatcaacatgtgcaccttaatcgccatggacctgggtgaaatgtgcgacgacaccgtgacctacaaatgccccctgatcgccgaggtggagcccgaggacattgactgctggtgcaacctcacgtccacctgggtgacctacggcacatgcaatcaggccggggagcaccggcgcgacaagaggtccgtcgctctggcgccccacgtgggcatgggcctggacacccgcacgcaaacctggatgagcgctgagggggcctggcggcaggtggagaaggtggagacgtgggcgctccgccaccccgggttcaccatcctggccttgtttctcgcccactacataggtacctccctgacacagaaggtggtgatcttcatccttctcatgctggttacgccatcgatgaccatgcgatgtgtgggcgtgggtaaccgagacttcgtggagggtctgtccggggccacctgggtggatgtagtactcgagcacgggggctgcgtgaccacgatggccaaaaacaagcccacccttgatatagagctgcagaaaactgaagccacgcagctcgctacgctacggaagttatgcatcgaggggaagatcaccaacatcacgaccgatagccgctgccccacgcagggcgaggccattcttccggaggaacaggaccagaactacgtgtgcaagcacacctacgtcgacagaggctgggggaacggctgcgggttgttcggcaaggggtccctcgtgacctgcgccaagttccagtgtctagagcccatcgagggcaaggtggtgcagcacgagaatctgaagtataccgtgatcatcacggtgcacaccggcgaccagcaccaggtcggaaacgacacccagggagtgaccgctgagatcacgccccaggcgagcaccgtcgaggcaatactgcccgagtacggtaccctcgggctggagtgctccccgcgcaccgggctggacttcaacgagatgattctcctgaccatgaagaacaaggcctggatggtccatcgacagtggtttttcgacctgcccttgccctggacgtccggagccaccaccgagactccaacgtggaatcgcaaggagttgcttgtgaccttcaagaacgcccacgcgaagaagcaggaagtcgtggtgctcggcagccaggagggggccatgcacaccgccttgaccggtgccacagagatccagaacagcgggggcacctctatcttcgccgggcatctgaagtgccgactcaagatggacaaactggagctgaaaggtatgagctatgcgatgtgcctaaatacctttgtcctgaagaaggaggtctcagagacccagcatggcacgatcctgataaaggtggaatacaagggggaggatgcaccgtgcaagatccctttcagcacagaggacggccaggggaaggcccacaacggacgcctgatcaccgcgaacccagtcgttaccaagaaggaggagccggtgaatattgaggcggagccgccctttggcgagagcaacatcgtcatcggcatcggcgataaggcccttaagattaactggtacaagaaagggagctcgattggaaaaatgttcgaggccacggcccgcggggcacgccggatggcgatcctgggagacaccgcctgggacttcggttccgttggtggcgtgctgaacagcctcggaaagatggtccaccagatcttcgggagtgcctacaccgccctgttcagcggcgtgagctggataatgaagattggcataggcgtgctactcacctggatcgggctcaacagcaagaatacgtcaatgtcgttctcctgcatcgtcatcggcataatcaccctttacctaggggcagtggttcaggccgacatgggctgcgtcatcaattggaaggggaaggagctgaagtgcggcagcggcatattcgtgaccaacgaggtgcacacttggacggaacagtacaagttccaggccgactcacccaagcgcctggcgacagccatcgccggggcgtgggagaacggcgtctgcgggattcgtagcaccacccggatggagaaccttctgtggaagcagatcgcaaacgagctgaactacatcctctgggaaaataacatcaagctgacagtggtggtcggagacataatcggggttttagagcagggcaagcgcaccctgacaccacagccaatggagctgaagtactcctggaagacctggggaaaggccaaaatcgtcacagccgagacccaaaacagctccttcatcatcgacgggcccaacacccccgagtgtccaagcgcgtcgcgggcctggaatgtctgggaggtggaagattacggctttggggtgttcaccacaaacatctggctgaagctcagagaggtctacacccagagctgcgaccaccggctgatgagtgcggccatcaaggacgagcgagccgttcacgccgacatgggctactggatcgagtcacaaaagaacggcagctggaaattagagaaagcgagtttcatcgaagtgaagacctgcacctggcccaaaagccatacattgtggtccaacggtgtactggagtcggatatgatcatccccaagtccctggccggacccatatcacagcacaatcaccggccgggataccacacgcagaccgccggtccatggcacctcgggaagctagagctggacttcaattattgcgagggcaccactgtggtgatcacggagaactgcggtacgcgcgggccctccctccggaccaccacggtcagcggcaaactgatccatgaatggtgctgccgttcatgcaccctgcctccgctcagatacatgggggaggacggctgctggtacgggatggagattcgacccattaacgagaaggaggaaaacatggtcaagtctctcgtgtccgcgggcagcggaaagatggacaacttcacgatggggatactatgcctcgcgatcctctttgaggaggtcatgcgcggcaagtttgggaagaagcacatgatcgccggtgtgctcttcacattcgtgttgttactgtcagggcagataacgtggcgcgacatggcccacaccctcatcatgatcggtagcaacgcgtctgacagaatgggcatgggagtcacctacctggccctgattgcgaccttcaaaatccagccattcctcgccctaggcttctttctccgcaagctcacgagcagggagaacctgctgctcggggtcgggctggccatggccacgaccctgcagctccccgaggacattgagcagatggcaaacggcatcgccttagggttaatgacgctcaagctgatcacgcagttcgaaacctaccagctgtggaccgctcttgtgagcctgacgtgctccaacacaatcttcacgctgacggtcgcctggcgtacagctactctcatactggctggtgtgtctctgctcccgttgtgccagtcctcctccatgcggaagaccgattggctgcccatgaccgtggcagccatgggtgtgccgcccctgccgttatttatcttcagcctgaaggacacccccaagcgccgcagttggcccctcaatgagggcgttatggccgtcgggcttgtctcgatcttggcctcctccctactgcggaatgatgtgcccatggcggggccgctcgtcgccggcgggttgcttatcgcatgctacgtgatcactggcacgtccgccgacctgaccgtagagaaggccgcggatgtgacatgggaagaggaagccgagcagacgggggtgagccacaacctgatgatcaccgtggatgacgacggcaccatgcgcatcaaggacgacgagaccgagaacatcctgaccgtccttttaaagacggccctgctgattgtgtccgggatcttcccctactcaattcctgccacccttctggtgtggcacacttggcaaaagcagacccagcggtccggcgtcctgtgggacgtgcccagcccgcccgaaacgcagaaggcggagctcgaggagggtgtgtaccgcataaagcagcagggtatcttcggcaaaactcaagtcggggtcggcgtgcagaaggagggggtgttccacaccatgtggcacgtgactcggggcgcggtcctgacgcacaacggtaaacgcttggagccgaactgggcctccgtcaagaaggacctcatctcctacggaggtgggtggcggctttccgcgcagtggcagaagggtgaagaggtccaggtcatcgccgtagagcccgggaagaacccgaagaactttcagaccatgcccggcatcttccagaccacaactggcgagattggggcgatagccctcgacttcaagcccggtaccagcgggagcccgatcatcaaccgcgagggcaaggtagtgggcttgtacgggaatggcgtagtaaccaaaaatggcgggtatgtgtccgggattgcccagaccaacgccgaacccgatggtcccacgcctgaattagaggaggagatgtttaagaagcggaacctcaccatcatggatctgcaccctggcagcggaaagacccgcaagtacctccccgccatcgttagagaggccataaagcgcagactgcgcaccctgattctcgcccccacgcgggtagtggccgctgagatggaggaggctctcaaaggactgccgatacgctaccaaaccaccgcgatcaagtccgaacacaccgggcgtgaaatcgtagacttaatgtgccacgccacttttaccatgcgcttactaagcccggtgcgagtgcccaattataaccttatcatcatggatgaagcacatttcaccgatccggcgagtatcgccgcccgaggctacatcagcacccgggtggggatgggggaggccgccgccatcttcatgacggcgaccccccccggcaccgccgaggccttcccacagtcgaatgcccccattcaggacgaggagagggacatccccgagcgctcatggaacagcgggaacgaatggatcaccgacttcgtgggcaagacggtgtggttcgtccccagcatcaaagccgggaacgacatcgcgaactgcctgcggaagaacgggaagaaagtgatccagctgtcccgcaaaaccttcgacacagagtaccagaagaccagactcaacgactgggacttcgtagtcacaaccgacatcagtgagatgggggccaacttcaaggccgaccgcgtgatcgacccccggcgctgcctgaagccagtgatactgaccgacggccccgagcgcgtcatactagccggcccgatgcccgttacagccgcttccgccgcgcagaggcgggggcgcgtcggacggaacccccagaaggagaacgatcagtacatcttcacggggcagcccctgaacaacgacgaggatcatgcccactggaccgaggccaagatgctgttggacaacataaacaccccggagggcatcataccagcgcttttcgagcccgagagggaaaagtccgccgccattgacggggagtatcggctgaagggtgagtcccgcaagaccttcgtcgagctcatgcgtcgcggcgacctgcccgtgtggctggcccataaggtggcgagcgaggggatcaagtataccgacagaaagtggtgcttcgacggcgagcgcaacaaccagattctcgaggagaacatggacgtggagatatggacgaaggagggtgagagaaagaagctgcgcccgcgctggctggacgcacggacctactccgacccccttgctctaaaagagttcaaggacttcgccgccggccgcaagtctatcgcactcgacctagtgaccgaaattggccgggtgccctcccacctcgcccaccggacccggaatgctctggacaatctcgtgatgctgcacacgtctgagcacgggggccgcgcctaccggcatgctgtggaagagctgccggagaccatggaaaccctgttgctgttggggctgatgatcctgctcaccggcggggcgatgttattccttatcagcggcaaaggcatcgggaagacgtctattggtctcatatgcgtcatcgtaagctccgggatgctatggatggccgatgtgcccctgcaatggatcgcctctgcaatagtcctcgagttcttcatgatggttttgctgatccccgagcccgaaaagcagcgcaccccacaggataaccagctagcgtatgtggtcatcgggatcttgaccctggcggctatagtgaccgccaatgagatgggcttactggagacgacaaaaagggacctggggatgtcgaaggagcccggcgtggtcagcccgacctcctacctcgacgtggacctgcatcccgccagcgcctggaccttatatgcggtggccacgaccgtcatcacccccatgctccgccatactatcgaaaactccaccgctaacgtcagcctggctgctatcgctaaccaggcagtagtcctgatgggtctagacaagggctggcccatttccaagatggatctgggggtgcccctgcttgccctgggctgctacagccaggtgaaccctctgacgctcaccgccgcggtcttgctgctcgtgacccactacgcgatcatcggcccgggcttacaggccaaagccacaagagaggcccagaagcgaaccgcggccggtatcatgaagaatcctactgtggacggtatcatgaccatcgaccttgatcccgtaatatacgactccaaatttgaaaagcaactcggccaggtgatgctcctggtgctctgtgccgttcagctactgttaatgcggacgagttgggcgctctgcgaggccttgaccctcgccaccgggccaattaccacactgtgggagggctccccaggcaagttctggaataccaccatcgcggtcagcatggccaacatcttccgcgggtcttacctggcgggcgcggggctcgccttctctataatgaagtccgttggcacagggaagcggggcacgggctcccaaggggagaccctgggcgagaagtggaaaaagaagctaaaccagctcagccgcaaggaatttgacctgtacaagaaatccggcatcaccgaggtcgatcgtaccgaggcaaaggagggactcaagcgcggggaaaccacgcaccacgcagtgagccggggctcggctaagctgcagtggttcgtggagcgcaatatggttatcccagaaggccgggtgatcgatctggggtgcggccgcggcggatggtcgtactactgcgcgggcctgaagaaggtgaccgaagtccgcggctacaccaagggcgggcccggccacgaggagcccgtgccgatgtccacatatggatggaacatcgttaagcttatgtcgggcaaggacgtattctacctgccgcccgaaaagtgtgataccctgctgtgcgacatcggggagtcctctccctcgccgaccgtggaggagagtcgaaccatccgtgtgctcaagatggtcgaaccctggctgaagaataaccagttctgcatcaaggtgctaaacccctacatgcccactgtgatcgagcacctcgaaagactccagcgcaagcacggtggcatgctggtccggaacccgctcagtcgtaactcaacgcacgagatgtactggatcagcaatggcacgggcaacatcgtgagctccgtgaacatggtcagccgattgctgttaaaccggttcaccatgacccatcggcgccccacgatcgagaaggacgtggacctaggggccggcacccgtcatgttaacgcggagccggagaccccgaacatggacgtcatcggagagagaatcaagaggatcaaagaagagcacagtagtacctggcactacgacgacgagaacccatacaaaacatgggcctaccacggttcctacgaggtgaaggcaaccggcagcgcgagctctatgatcaacggggtcgtgaaactgctcaccaaaccctgggatgtggtccccatggtgacacagatggccatgacagacacgaccccttttgggcagcaacgcgtgttcaaagaaaaagtcgacaccagaacgccccgccccatgccggggacccgtaaggtgatggagatcacagccgagtggctgtggcgcaccctggggcggaacaagcgcccgcgcctctgcacgcgcgaggagttcaccaaaaaagtccgtaccaacgcggctatgggggcggtcttcaccgaggagaaccagtgggatagcgcgagggccgccgttgaagacgaggagttctggaaacttgtggaccgcgagcgggaactgcacaaactcgggaaatgcgggtcctgcgtatacaacatgatggggaagcgcgagaagaaactgggggaattcgggaaggcgaagggcagccgggcaatctggtacatgtggctgggcgcgcgctatttggagttcgaggcgctagggttcttaaatgaagaccattggttctcccgggagaacagctactccggcgtggagggggagggcctgcacaaactggggtatatcctccgcgatatttccaagatccccggaggcgccatgtacgcggacgacacagccggctgggatacccggatcaccgaggacgacctccacaacgaggagaaaatcacccagcagatggaccccgagcacagacagttagcgaacgccatattcaagttgacgtaccagaacaaggtggtcaaggtgcaacgacccaccccgaaaggcaccgtgatggatataatttctcgcaaggaccagcgaggttcaggccaggtcgggacctatggccttaacacctttacgaacatggaggcccagctggtgaggcagatggagggagaaggggtactgtccaaggtcgatctcgagaacccacacctactggagaaaaagatcacccagtggttggagaccaaaggcgttgagcgtctacgccgaatggcgattagcggggacgactgcgtggtcaagcctatcgacgaccgcttcgcgaacgccctactcgccctgaacgacatgggcaaggttcgtaaagacataccgcagtggcaaccatccaaaggctggcacgactggcaacaggtccccttctgttcacaccacttccacgaactgatcatgaaggatgggcgcaagttggtcgtgccctgtcgcccgcaggacgagctgatcggccgggcccggatctcccagggggcaggctggagcctgaaggagaccgcttgcctcggaaaggcttacgcccagatgtggtctctgatgtactttcaccggcgcgaccttcggctcgccagcaacgcgatctgttcggccgtgccggtgcactgggttcccacgagccgcaccacctggtctatccacgcccaccaccagtggatgaccacggaggacatgctgacggtatggaacagagtatggatagaagataacccctggatggaagacaagacccccgtgaccacgtgggaggatgtaccgtacctgggcaaacgcgaggaccagtggtgcggctccctcatcggcctgaccagccgggccacctgggctcagaacatcctgaccgccatacagcaagtccgctctctcataggcgacgaggaattcctggactatatgccctcaatgaagcggttccgcaaggaggaggagagtgagggcgccatctggtag

SEQ ID NO: 25926 - RNA, 9873 nt, synthetic construct
  misc_feature 1..9873: note = derived and/or modified CDS sequence (opt11) from DENV-3__FJ744739__SS-prME
  source 1..9873: mol_type = other RNA
accagcctgtgcctcatgatgatgctgcccgcaacgctggccttccacctcaccagccgggacggggaaccccgcatgatcgtggcgaagaacgagcgcggcaagagcttactgtttaagaccgtttccgggatcaatatgtgcaccctcatcgcgatggacctgggggagatgtgcgacgacactgtaacctacaagtgcccgctgatcgccgaggtggagcccgaggacatcgactgctggtgcaacctcaccagcacctgggtcacctacggcacgtgcaaccaggccggggagcacaggcgcgacaagcggtcagttgccctggcgccccacgtgggcatgggcctggacaccaggacccagacctggatgagcgccgagggcgcctggcgccaggtggagaaggtggagacatgggcgctccggcacccgggcttcaccatcctggcgttatttctagcccactacatcgggacctccctgacccagaaggtagttatcttcattctgctcatgctggtgacgcccagcatgaccatgcggtgtgtgggcgtcgggaaccgcgactttgtggagggcttgtccggcgccacctgggtggacgtcgtgctcgagcacgggggatgcgtgaccacgatggcaaagaacaagcccaccctggacatcgagctgcagaagaccgaggcgacccagctcgcgaccctgcgtaagctatgcatcgaggggaaaataactaatatcaccaccgattctcgctgccccacacagggcgaagccatcctcccggaggagcaggaccaaaactacgtctgcaagcacacctacgtggatagagggtggggaaacggctgcggactcttcggcaaggggtccctggtgacctgcgccaagttccagtgtctcgagcccatcgagggtaaggtcgtgcagcacgaaaacctgaagtacaccgtaatcataacggtccacaccggcgatcagcaccaggtgggtaatgacacccagggggtcaccgtggagatcacgcctcaggcctccacggtggaggccatcctgcccgagtacggaaccctcggcctggagtgttccccgcgcaccgggctggacttcaacgaaatgattctcctgacgatgaagaacaaggcgtggatggtccaccgacagtggttcttcgacctacccttgccctggacgagcggcgccaccactgagacccccacgtggaaccgcaaggagctcctggtgacgttcaagaacgcccacgccaagaagcaagaagtggtcgtgctcggctcacaggagggggccatgcacaccgcactgacgggcgctacggagatccaaaattctgggggaacctccatcttcgccgggcacctgaagtgccggctcaagatggacaaacttgagctgaagggcatgagctatgccatgtgcttgaataccttcgtgctgaagaaggaggtctccgaaacccagcacggcacgatcctgatcaaggtggagtacaagggggaggacgcaccgtgcaagatccccttcagcaccgaggacggccaggggaaggcgcacaatggtcgcttaataaccgccaatcccgtggtcaccaaaaaggaggagcccgtgaacattgaggccgagccgcccttcggcgagtcaaacatcgtgatcgggatcggcgacaaggcactcaagatcaactggtacaagaaagggtctagcatcggaaagatgtttgaggcgacggcccgcggagcccgccggatggccatcctgggcgacaccgcttgggatttcggcagcgtcgggggcgtcctgaactcgctcgggaagatggtgcaccagatctttgggtccgcttacaccgccctcttcagcggcgtctcctggatcatgaagatcgggataggcgtgctgctcacctggatcgggctcaacagcaagaacacgtccatgagcttctcctgcatcgtgataggcattatcacactgtacctcggggccgtagtccaagcggacatgggttgtgtgatcaactggaaggggaaagaacttaagtgcggatcaggcatcttcgtaactaacgaggtgcacacctggacggagcagtacaaattccaggccgactcccccaaaaggctggcgaccgcaatcgccggggcctgggaaaacggcgtgtgcggcatccggagcaccacccgtatggagaacctactgtggaagcagatcgcgaacgagctgaactatatcctctgggagaacaacataaaacttacggtcgtggtgggggacatcatcggcgtcctggagcagggcaagcgtacactcacgccccagcccatggagctgaagtactcctggaagacctggggcaaggcgaagatcgtgacggctgagactcaaaacagctctttcatcatcgacgggccaaacacccccgagtgccccagcgcctcgagagcctggaacgtgtgggaggtcgaggactacggattcggagtgttcaccacgaacatatggctgaagttacgcgaggtttatacgcagagctgcgaccaccggctgatgtccgcggctatcaaggacgagagggccgtccacgccgacatgggttattggatcgagtcccagaagaacggcagctggaagctggagaaggcctccttcatcgaggtgaagacctgcacctggccaaagagccacactctctggtccaacggggtgctggagagcgacatgatcatccccaagtccttagctggacccatcagccaacacaaccaccggccgggctaccacacccagaccgccggcccctggcacctcgggaaactggagctcgacttcaactactgtgagggtaccaccgtcgtgatcacagagaactgtggcacccgcggcccctccctcagaaccaccacagtgagcggcaagctgatccacgagtggtgttgccgctcctgcacactgcccccgctccggtacatgggggaggacggatgctggtacgggatggaaatccgccccatcaacgagaaggaggagaacatggtcaaatccctggtgtccgcaggatcaggcaagatggacaatttcaccatggggatcttatgcctggctatcctattcgaggaggtgatgcggggcaagttcggtaagaagcacatgatcgccggcgtcctgttcaccttcgtgctcctgctatccggacagatcacgtggcgcgacatggcgcatacgctcatcatgatcggcagcaacgcctccgaccgtatgggcatgggggtcacgtacctggcgctgatcgccacgttcaagatccagcccttccttgccctgggcttcttcctgcgcaagctcaccagccgggagaacctcctgctcggggtcggcctggccatggccacaaccctgcagctccccgaagacatcgagcagatggccaatggcatcgctctggggctgatgaccctcaagctcatcacgcagttcgagacctaccaactgtggaccgcgctggtgagcttgacctgctccaacacgatcttcacgctgacggtggcctggcgcaccgccacgctcattctggccggcgtctcgctgctcccgctgtgccagtccagctccatgcggaagaccgactggctgcccatgaccgttgcggcgatgggagtgccgcccctgccgcttttcattttcagcctaaaggacacccccaaaaggcgttcctggcctctcaacgagggcgtgatggccgtggggctggtcagcatcctggcctccagcctactgcggaatgacgtgcccatggccggcccgctagtagcgggcggactcctgattgcgtgttacgtcatcacgggcacctccgcggacctgactgtggagaaggccgccgatgtgacatgggaggaagaggccgagcaaacaggtgtcagccacaacctcatgatcaccgtggacgacgacggtaccatgcgcattaaagacgacgagacagagaacatcctgaccgtgctgctcaagacggcgttactgatcgtctccggcatctttccttacagcatccctgcgaccttactggtgtggcatacctggcagaagcaaacccagcggtccggcgtgctatgggatgtccccagcccgcccgaaacgcagaaagcggagttagaggagggcgtgtacaggatcaagcagcaggggatcttcggaaagacccaggtgggagtcggtgtccagaaggagggagtgttccacaccatgtggcacgtcacccggggcgccgtactgacgcacaacgggaagcgcttagagcccaactgggcctccgtgaagaaggacctcatctcctacggtggagggtggcggctttcagcccaatggcagaagggcgaggaggtccaggtgattgccgtagagcccggaaagaacccgaagaactttcagaccatgccaggcatctttcagaccaccaccggcgagatcggagccatcgctctggatttcaagcccggcacttccgggagcccgatcatcaaccgcgagggtaaagtcgtgggtctgtacggtaacggcgtggtaaccaagaacggagggtacgtgtccggaatcgcacagaccaacgcggagcccgacggacccacccccgagttagaggaggagatgttcaagaaacggaaccttacgattatggatctgcacccgggctctgggaagacccgcaagtatctccccgccatcgtcagagaagccatcaaacgccggctgcggactctgatccttgcccccacgagggtcgtggccgccgagatggaggaagcgctgaagggactgcccatccgctaccagaccaccgccatcaagagcgagcacaccgggcgggagatagtagacctcatgtgccacgccacgttcaccatgcgcctattaagcccggtccgggtgcccaactacaacctcatcatcatggacgaagcgcacttcaccgaccccgccagcatagccgctcgcggctacattagcacacgggtggggatgggcgaggccgcagcgatattcatgacggccacgccgcccggcaccgccgaagcgttcccccagtccaacgcccccattcaggacgaggagcgcgatatcccggagcgcagctggaactccgggaatgagtggataaccgatttcgtcggcaagaccgtgtggtttgtgcccagcatcaaggccggcaacgacatcgcgaactgtctgcggaagaacggcaagaaggttatccagctgtccaggaaaacattcgataccgagtaccagaagacccggctcaatgactgggacttcgtggtcacgaccgatataagcgagatgggggccaactttaaggctgaccgcgtcatcgacccccggcgctgcctcaagcccgtcattcttaccgacggccccgaaagagtgatcctcgccggtccgatgccagtcaccgccgcatccgctgcgcagcgccgagggcgcgtgggccggaatccccagaaggagaacgaccagtatatcttcacggggcagccacttaacaacgatgaggaccatgcccattggaccgaggccaagatgctgctcgacaacatcaacacccctgagggcattatcccagccctgttcgagcccgagcgcgagaagtcggccgcgatcgacggggagtaccggctgaagggcgagtcccgcaagaccttcgtggagctaatgcggcgcggcgacctgccagtctggctggcccacaaagttgcgagcgaggggataaagtacaccgatcggaagtggtgcttcgacggcgagcgaaacaaccagatcctcgaggagaacatggacgttgagatctggactaaggagggggaacggaaaaagctgaggccgaggtggctggatgcccggacctacagtgaccccctcgcgttaaaggagtttaaggatttcgccgccggccgcaagagcatcgccctagacctagtgaccgagatcggccgagtgccctcccacctagcccacagaacccggaacgcgctggacaatctagtcatgcttcacacgagcgagcatggcggccgcgcctatcggcacgccgtggaggagctgccggagaccatggagaccctcttactgctagggctgatgatcttactcacaggcggggcaatgctgttcctgatcagcggcaagggcatcggaaaaacgtccatcggcctcatatgcgtgatcgtaagctccgggatgctgtggatggcggacgtgcccctgcagtggatcgcgtctgccatcgtgctcgagttcttcatgatggtcttgctgatccccgagcccgagaagcagcgcacccctcaggacaaccaactagcctacgtagtgatcgggatcctgacgctggctgcaatcgtcaccgccaacgagatgggactcctggaaacgaccaagcgggacctgggcatgtccaaggagcccggcgtggtaagccccacctcctacctcgacgtagacctgcatcccgcctccgcctggacgctgtacgctgtagctacgaccgttatcactccgatgctccgccacaccatcgaaaacagcacggcgaacgtcagcctagccgcaatagccaaccaggcggtggtgctgatggggctcgacaaggggtggcccatctccaaaatggacctgggcgtccccctgctcgccctgggctgctacagccaggtgaaccccctgacgctcaccgccgccgtgctgctgctcgtcacccactacgccatcatcgggccgggcctgcaggcgaaagccacgcgggaggcccagaagcgcacggccgccggcataatgaagaaccccaccgtagatgggatcatgaccatcgaccttgaccctgtgatctacgattccaagttcgaaaaacaactcggccaggtcatgctgctggttctgtgcgcggtgcagctgcttctcatgcggacgtcatgggccctgtgcgaggccctaaccctcgccaccgggcccatcaccacgttgtgggagggatccccgggcaagttctggaacactaccatcgccgtctctatggcgaacatcttccgagggtcttacttggccggcgccggactcgcctttagcatcatgaagtctgtgggcaccgggaagcggggcacgggcagccagggagagaccctcggcgaaaagtggaagaagaaacttaaccagttgagccgcaaggagttcgacctctataagaaatccgggatcaccgaggtggaccggaccgaggcgaaggagggcctcaagagaggggaaaccacgcaccacgccgtcagccggggctccgccaagctccaatggtttgtggagcgcaacatggtgatcccggagggtcgggtcatcgacttggggtgcggccgcgggggatggagctattactgcgccgggctgaagaaggtgaccgaggtgcgcggctacaccaaaggcgggcccggtcacgaggagcccgtcccgatgtccacctacgggtggaacatcgtcaagctcatgagcggcaaggacgtcttctatctgccgccagagaagtgcgacacgctactgtgtgacatcggagaaagctcgcccagccctaccgtcgaggagagcaggactatccgcgtgttaaagatggtggagccctggctgaagaacaaccagttctgcatcaaggtactgaacccctatatgccaaccgtgatcgagcacctcgagcggctgcagcgcaagcatggcggcatgctggtgcggaacccgctctcccgtaactcaacgcacgagatgtactggattagtaacgggactggcaacatcgtcagctccgtgaacatggtaagccggctgctcctcaaccgcttcaccatgactcaccggcgacccacaatcgagaaagacgtcgacctgggggcagggacccggcacgtgaacgcggagcccgagaccccgaacatggacgtcatcggcgagcgcatcaagcggatcaaggaggagcactcgagcacctggcactacgacgacgagaacccctacaagacctgggcctaccacgggagttatgaggtgaaagctactggcagcgccagctcaatgattaatggcgtggttaagctgctcaccaaaccctgggacgtggtgcccatggtcacccaaatggccatgacggacaccaccccgttcggtcaacaacgggtgttcaaggagaaggtggacacccgaacaccccggcccatgcccgggacacggaaggtcatggagataaccgcggagtggctgtggcgcacactgggccgtaacaaacgcccgcgcctctgtacgcgggaggagtttactaagaaggtgcgcactaacgccgccatgggcgccgtgttcaccgaggagaaccagtgggacagcgcccgggcagcagtcgaagacgaggagttctggaaactggtggaccgggaacgggagctgcataagctcgggaagtgcggcagctgcgtgtacaacatgatgggcaagcgcgagaagaagctgggcgagttcgggaaagcgaagggctcacgagccatttggtacatgtggctgggggcgcgctacctcgagttcgaggccctagggttcctgaatgaagaccactggttctcccgggagaacagctactccggcgtcgaaggggaaggcttacacaagctgggctacattctgcgcgacattagcaagatccccggtggcgcgatgtatgccgacgacacagccggttgggacacccggataaccgaggacgacctgcacaacgaggaaaagatcacccaacagatggaccctgaacatcgccagctcgcgaacgcaatattcaaacttacctaccagaacaaggtggtgaaggtccagcggcccactccgaagggcaccgtgatggacatcatctccaggaaagaccagcgggggagcggccaggtgggcacctacgggctcaacaccttcacgaacatggaggctcagttagtccgccagatggagggcgagggggtcctgtccaaagtggacctcgagaacccccacctcctggagaaaaagatcacccagtggctcgagaccaaaggcgtcgagcgattacgccggatggccatcagcggcgacgactgcgtggtcaagcccatcgacgaccgcttcgccaacgcccttctcgccctgaacgacatgggcaaggtcagaaaggacatcccgcagtggcagccgtccaagggctggcacgactggcagcaggtcccgttctgtagtcaccacttccacgagctgatcatgaaggacgggcgcaagctagtggtcccctgccgtccccaggacgaactgatcggcagggcacgcatatcccagggggccggctggtccctgaaagagaccgcctgcctcgggaaggcttacgcacagatgtggtccctgatgtacttccaccggcgcgacctccggttagctagcaacgccatctgctccgcggtgccggtgcactgggtaccaacgagccgcaccacctggagtatccacgcgcatcaccagtggatgacaacggaggacatgctgacagtatggaaccgggtgtggattgaggacaacccctggatggaggacaagactcccgtcaccacctgggaggacgtgccgtacctgggcaagcgcgaggaccagtggtgcggctcctttatcggtctcactagccgggccacctgggcccagaacatcctgaccgccatccagcaggtccgctcccttatcggagacgaggagttcctcgactacatgcccagcatgaaacggttccgcaaggaggaggagtccgaaggggcgatctggtga

SEQ ID NO: 25927 - RNA, 9873 nt, synthetic construct
  misc_feature 1..9873: note = derived and/or modified CDS sequence (opt11) from DENV-3__FJ744740__SS-prME
  source 1..9873: mol_type = other RNA
accagcctgtgcctcatgatgatgttaccggctacgctggccttccacctcaccagccgggacggggagccgcggatgatcgtggcaaaaaacgagcggggaaaaagcctgctgttcaagaccgcttccggcatcaacatgtgcacgctcatcgccatggacctgggggagatgtgcgatgacaccgttacctacaagtgccccctgatcgcagaggtggagccagaggacatcgactgctggtgcaacctcaccagcacctgggtgacatacggcacgtgcaaccaggccggggagcaccggcgcgacaagcggtcggtcgcgctggccccccacgtgggcatgggcctggacacccgcacccagacctggatgagcgccgagggggcctggcgccaggtcgagaaggtggaaacgtgggcgctccgccacccgggcttcaccatcctggccctgttcctcgcccactatatcgggacctccctgacccagaaggtggtgatcttcatcctgctcatgctggtcacgcccagcatgaccatgaggtgcgtgggcgtggggaatcgcgacttcgtcgagggcctgtccggcgccacctgggtggacgtagtcctcgagcatgggggctgcgtgaccacaatcgccaagaacaagcccaccctggacatcgagcttcagaagacagaggcaacccagctcgcaacgctgagaaagctgtgcatcgagggaaaaatcaccaacatcaccaccgacagcagatgccccacgcagggcgaggcgatactcccggaggaacaggaccagaactatgtctgcaagcacacctacgtcgaccggggctgggggaacggttgcgggctgttcggcaaagggtccctggtgacctgcgccaagttccaatgcctcgaacccatcgagggcaaggtggtccagcacgagaacctgaagtataccgtgatcatcacggtgcacaccggcgaccagcaccaggtcgggaacgacacccagggggtcaccgtcgagatcacgccccaggccagcaccgtggaggctatcttacccgagtacgggaccctcggcctggagtgctccccgcgcacaggccttgacttcaacgagatgattctcctgaccatgaagaacaaggcctggatggtacaccggcagtggttcttcgacctgcccctcccctggacaagcggcgccaccaccgagacccccacgtggaatcgcaaggagctgctggtcaccttcaaaaacgcccacgccaagaagcaggaggtagtggtcctcggctcccaggagggggcgatgcacaccgccctgaccggcgccacggagatccagaacagcgggggcacctccatcttcgccgggcacctgaagtgccggctcaagatggacaagctggagctgaaaggcatgagctacgccatgtgcctcaacaccttcgtgctgaagaaggaggtgtccgagacgcagcacggcaccatactgataaaggtcgaatacaagggggaagacgcgccgtgcaagatcccctttagcaccgaggacggacagggtaaggcccacaacgggcgcctgatcaccgccaaccccgtggtgaccaagaaggaagagcccgtgaacatagaggccgagccgcccttcggcgagagcaacatcgtgatcggggtgggtgacaaggcgctcaagatcaactggtacaagaaggggtccagcatcggtaaaatgttcgaggccacggctcgcggggcccgccggatggccatcctgggggacaccgcgtgggacttcggctccgtcgggggcgtgctgaactccctcgggaagatggtgcaccagatcttcggctccgcctacaccgccctattcagcggcgtctcctggatcatgaagataggcataggcgtgctgctcacctggatcgggctgaacagcaagaacacttccatgtcgttctcctgcattgtaatcggtatcataaccctctacctcggggccgtggttcaggccgatatggggtgcgtgatcaattggaagggaaaagagctgaagtgcggcagcggcatcttcgtcaccaacgaggtgcacacctggacggagcaatacaagttccaggcggattcccccaaacgcctggccaccgccatcgccggggcctgggaaaacggcgtctgcgggatccgcagcaccacccggatggaaaacttgctgtggaagcagatcgcgaacgagctgaactacatcctctgggagaacaacattaagctgacggtcgtggtgggcgacatcatcggggtcctggagcagggcaagcgcaccctcacgccacagcccatggagttaaagtatagttggaagacctggggcaaagccaagatcgtgaccgccgaaacccagaacagctctttcatcatcgacgggcccaacacccccgagtgcccaagcgcatcccgggcgtggaacgtgtgggaggtcgaggactacggctttggggtattcacaacgaacatctggctgaagctccgcgaggtgtacacccagtcttgcgatcaccgtttaatgagcgccgctatcaaggacgagcgcgccgtccatgctgacatgggctactggatcgaatcccaaaagaacgggagctggaagctggagaaagcgagcttcatcgaggtcaaaacatgcacctggcccaagtcacacaccctctggtccaacggggtcctggagagcgacatgatcatccccaagagtctggccggccccatcagccagcacaaccaccggccggggtaccacactcagaccgcgggaccctggcacctcggcaaactggagctggacttcaactactgcgagggcaccacagtcgtgatcacggagaactgcggcacccgcgggccctcactcaggaccaccacggtctccggcaaactgatccacgagtggtgctgccgctcctgcaccctgcccccgttgcggtacatgggggaggacggctgctggtacggaatggagatacgccccatcaacgagaaggaggagaacatggtcaagagcctggtgtcggccggcagcggcaaggtggataacttcacgatggggatcctgtgcctcgcgatcctgttcgaggaggtcatgcggggcaaattcgggaagaagcacatgatcgcgggcgtgctgttcaccttcgtgctcctgttgtcggggcagatcacttggcgcgacatggcccacaccctaatcatgatcggcagcaacgcctccgatcggatgggcatgggggtcacctacctggccttgattgccaccttcaaaatccagcccttcctcgcgctgggcttcttcctccgcaagttaacgagccgggagaacttactgctcggggtgggcctcgccatggcgaccaccctgcagctccccgaggacatcgagcagatggccaacggcatagcgctggggctgatgacactcaagctgattacgcagttcgagacctatcagctgtggaccgcgctcgtgagcctgacctgctccaacacgatcttcaccctgacggtcgcctggcgcaccgccacgctcatccttgccggcgtgagcctgctcccgttatgccagtccagctccatgcgcaaaaccgactggctgcccatgaccgtcgcagccatgggggtgccgccacttcccctgttcatctttagcctgaaggacacccccaagcgccgctcctggcccctcaatgagggcgtgatggccgtcgggctggtcagcatcctggcctccagcctactgcggaatgacgtgcccatggccggcccgctggtcgcgggcgggctcctgatcgcctgctacgtgatcacgggcacctccgccgacctgactgtggagaaggccgccgacgtaacctgggaggaggaggcagagcagacgggggtgagccacaacctcatgattacagtggacgacgacggcaccatgcgcatcaaagacgacgagaccgagaatatcctgaccgtcctgctcaagacggccctgctgatcgtgagtgggatcttcccctacagcatcccggccaccctcctggtgtggcacacctggcagaagcagacccagcggtctggcgtcctgtgggacgttccctctccgcccgagacgcagaaggccgagctcgaggagggagtgtaccgcatcaagcaacaagggatcttcggcaagacgcaggtcggggtgggcgtgcagaaggagggggtcttccacaccatgtggcatgtcacacggggcgccgtactgacgcacaacggcaagcgcctggagcccaactgggcgtccgtcaagaaggacctcatcagctacggaggcgggtggcggctgtccgcccagtggcagaagggcgaggaggtccaggtgatcgccgtcgagcccgggaagaacccgaagaatttccagaccatgcccgggatcttccagaccacgacgggcgagatcggggccatcgcgctggacttcaagcccggcacctcagggagcccgatcatcaaccgcgaggggaaggtggtgggcctgtacggaaacggggtggtgaccaaaaacggcggctacgtgtccgggatcgctcagactaacgccgagcccgacggccccacgcccgagctcgaggaggagatgttcaagaagcgtaacctgaccatcatggacctgcacccgggaagcgggaagacccgcaagtacctacctgccatcgtgcgggaggcaatcaagcgccggctccggaccctgatcctcgcacccacgcgggtagtggccgccgagatggaggaggcgctgaagggcctgcccatccgctaccagaccaccgccatcaagtccgagcacaccgggcgggagatcgtcgacctcatgtgtcacgcgaccttcacgatgcgcctgctgagcccggttcgggtgcccaactacaacctcatcatcatggacgaggcccacttcaccgaccccgcctccatcgccgccaggggctacattagcactcgggtcgggatgggcgaagcggccgccatcttcatgacggccactccgcccggcaccgcggaggccttccctcagtcgaacgcccccatccaggacgaggagcgtgatatccccgagagaagctggaactccgggaacgagtggatcaccgacttcgtgggcaagacggtctggttcgtgcccagcatcaaagccgggaacgacatcgccaactgcctgcggaagaacggcaagaaagtgatccagctgtcgcgtaagaccttcgacacggagtaccagaagacccggctcaatgactgggacttcgtggtcacgaccgacatcagcgagatgggggcgaacttcaaggccgacagggtgatcgacccccggcgatgcctgaagcccgtcatcctcaccgacggccccgaacgggtcatcctcgctggcccgatgcccgtgaccgcggcctccgcggcccagcgccgtggacgcgtgggccgtaaccctcagaaggagaacgaccagtacatcttcacggggcagcccctgaacaatgatgaggaccacgcgcactggaccgaggccaagatgctgctcgacaacatcaacaccccggagggcatcatcccggccctgttcgaacccgaacgcgaaaagtccgcggccatagacggggagtaccggctaaagggcgagagccggaagactttcgtcgagctcatgcggcgaggcgacctgccagtgtggctggcccacaaggtcgccagcgaggggatcaaatacaccgaccggaagtggtgcttcgacggcgagcgcaataaccaaatcctcgaggagaacatggacgtggagatctggacgaaggagggggagcggaagaagttacgcccgagatggctggacgcgcggacctactccgaccccctcgccctgaaggagttcaaggacttcgctgccggccgcaaatcgatcgccctggacctcgtgaccgaaatcggccgggtcccctcgcacctagcgcaccgcacccggaacgccctggacaacctagtgatgcttcacaccagcgagcacgggggcagagcctaccggcacgccgtggaagagctcccggagaccatggagaccctccttctgctcggcctgatgatcctgctcaccggcggggccatgctgttcctgatctctggcaagggcatcgggaagacgtcgatcggtctcatctgcgtcatcgtctcatccgggatgctctggatggcggatgtgcccctgcaatggatcgccagcgcgatcgtcctcgagttcttcatgatggtgctgctgatccccgagcctgagaagcagcgcaccccgcaggacaaccaactcgcctacgtggtcatcggaatactgaccctggccgcgatcgtgaccgccaacgagatgggcctcctggagacgaccaagcgggacctgggcatgtccaaggagcccggcgtagtgagccccacctcctatctcgacgtggacctgcaccccgccagcgcctggaccctgtacgccgtggcgacgactgtgatcaccccgatgctccgccacaccatcgagaactccacggccaacgtgagcctggcagccatcgcaaaccaggccgttgtcctcatgggcctcgacaagggctggcccatctccaagatggacctgggggtgcccttgctcgccctggggtgctacagccaggtgaacccgctgaccttgaccgctgccgtcctgctgctcgtgacccattacgcgatcatagggccgggcctgcaggccaaagccacgcgggaggcccagaaacgcaccgcagcgggcatcatgaagaatcccaccgtggacggcatcatgaccatcgatctggatcccgtcatatacgacagcaagttcgagaaacagctcggccaggtgatgttactggtgttgtgcgccgtccagttgctgctcatgcgcacgagctgggccctgtgcgaagccctgaccctcgccaccgggcccatcaccacgctgtgggagggctccccgggcaagttctggaacaccaccatcgcggtttctatggccaacattttccgcgggtcctacctggccggcgccgggctagctttcagcatcatgaaatccgtcgggaccgggaagcggggcacgggcagccaaggggaaaccctgggcgagaagtggaagaagaagctaaaccagctcagccgaaaggagttcgacctctacaagaagtccgggatcaccgaggtcgaccggaccgaggccaaggagggtctaaagcgcggtgagaccacgcaccacgccgtgtcacggggctccgcgaagctccaatggtttgtggagcgcaacatggtcatccccgagggccgggtgatcgacctggggtgcggccgcggtggatggagctactactgcgccgggctgaaaaaggtgaccgaggtcaggggctacaccaaaggcgggcccggtcacgaggagcccgtgccgatgtccacctacgggtggaacatcgtgaagctcatgagcggtaaggacgtattctacctgccacccgagaagtgcgacacgctgctgtgcgacatcggggaatctagtccatcgccgaccgtggaagagagccggaccatacgcgtgctcaagatggtggagccatggctgaagaacaaccagttctgcatcaaggtgctgaatccctacatgcccaccgtgattgagcacctcgagcggctgcagcgcaagcacggcgggatgctcgtccggaacccgctctcccgaaacagcacgcacgagatgtattggatctccaacgggaccggcaatatagtgagctccgtgaacatggtcagccgtctgctgctcaaccgtttcacgatgacccaccggcgccccacgatcgagaaggacgtcgacctgggggcgggcacccggcacgtaaacgccgagcccgagaccccgaacatggacgtgatcggagagcgcatcaagcggatcaaggaggagcactccagcacctggcactacgacgacgagaacccctacaagacttgggcctaccacgggtcctacgaggtgaaagcaaccggcagcgcaagctccatgatcaacggagtcgtgaagttgctcaccaagccctgggacgtggtccccatggtaacccagatggcaatgactgacaccaccccgttcggccagcagcgcgtgttcaaagaaaaggtcgacacacggacgccccgccccatgcccgggacccggaaggtgatggagataaccgccgagtggctctggcgcactttaggccggaacaagcggccccgcctctgcacgcgggaggagttcaccaagaaggttcgcaccaacgccgccatgggcgccgtcttcaccgaagagaaccagtgggacagtgctcgggccgccgtggaggacgaggagttttggaaattagtggaccgagagcgggagctgcacaaactcgggaagtgcggctcatgcgtttacaacatgatggggaagcgcgagaagaagttaggcgagttcggaaaggccaagggcagccgcgcgatttggtacatgtggctgggcgcccgttacctcgaattcgaagccctgggattcctgaacgaggaccactggttctccagagagaacagctacagcggtgtagagggggaaggcctgcacaaactgggatacatactgcgcgacattagcaagattcccggcggcgccatgtacgccgacgacacggcggggtgggacactcggattaccgaggacgacctccacaatgaggagaaaatcacccagcaaatggaccccgagcaccgccagctggcaaacgccatcttcaaactgacgtaccagaacaaggtggtgaaggtacagcggcccacgccgaaggggaccgtgatggacataatctcccgcaaagaccagcgtgggagcggccaagtcggcacctacggactcaacacgtttacgaatatggaggctcagttggtgcgccagatggagggcgagggggtgctgtccaaagtagacctcgagaacccccacctcctggagaaaaagatcacccagtggctcgagacgaagggcgtagagcgactgcgccggatggcgatcagcggggacgattgtgtggtcaagccaatcgatgatcgcttcgcgaacgccttattagccctgaacgacatgggcaaggtgcgcaaggacatccctcagtggcagccctccaagggctggcacgactggcagcaggtccctttctgctcgcaccactttcacgagctgatcatgaaggacgggaggaagttagtcgtgccctgccgcccacaagacgagctgatcggccgggctcgcatatcccagggggccggctggagcctgaaggagaccgcgtgcctcggcaaggcctacgcccagatgtggtccctgatgtacttccaccggcgcgatctgagattggccagcaacgccatctgctccgcagtgccggtccattgggtgcccacgagccgcacgacatggagcattcacgcccaccaccagtggatgaccacggaggacatgctgaccgtgtggaaccgggtctggatcgaggataacccctggatggaggacaagacccccgtgaccacgtgggaggacgtgccatacctgggcaaacgagaagaccagtggtgcggctccttgatcgggctgaccagccgggccacctgggcccagaatatcctgaccgcgatacagcaggtccgaagtctcatcggagacgaggagttcctggactacatgcccagcatgaagcgtttccgcaaggaggaggagtccgaaggggccatctggtag

SEQ ID NO: 25928 - RNA, 9873 nt, synthetic construct
  misc_feature 1..9873: note = derived and/or modified CDS sequence (opt11) from DENV-3__GQ868593__SS-prME
  source 1..9873: mol_type = other RNA
accagcctttgcctcatgatgatgctgccggctacactggcgttccatcttactagccgggacggcgaaccccggatgatcgtggggaagaacgaacgcggcaagtcgctgctgttcaagaccgcgtcggggatcaacatgtgcaccctcatcgcgatggatctcggagagatgtgtgacgacacagtgacgtacaagtgcccccacattgccgaggtggagcccgaggacatcgattgctggtgtaacctgacatctacgtgggttacctacgggacctgcaaccaagccggcgagcatcggcgcgacaagcggtccgttgccctcgcgccccacgtgggcatggggctggacaccaggactcagacctggatgagcgccgagggcgcctggagacaggtcgagaaggtggaaacctgggcgctgcgccaccccggatttaccatcctcgcgcttttcttggcccactacatcggcacttccctaacccagaaggtggtgatcttcatcctgctgatcctcgtcacccccagcatggccatgcggtgcgtgggggtagggaaccgcgacttcgtcgagggcttgtccggtgccacctgggtggacgtggtcctggagcacggcgggtgcgtgaccaccatggccaagaacaagccgacactggacatcgagctgcagaagaccgaggctacccagctggccaccctccggaagctgtgcatcgagggcaagatcacaaacattacaaccgacagccgctgcccaacccagggcgaagcgatcttgcccgaggagcaagatcagaactacgtgtgcaagcacacgtacgtagaccgcgggtggggcaatgggtgcggcttgttcggtaagggctccctggtgacctgcgctaagttccagtgcctggagagcatcgaaggcaaggtggtccagcacgagaacctcaagtataccgtgatcatcaccgtgcacacgggagatcagcaccaggtcggcaacgagacccagggagtgaccgccgagatcacgccccaggcgtccacagttgaggccatcctccccgagtatggcaccctcgggctcgagtgcagcccacgcactggcttagacttcaatgagatgatcctgctcaccatgaagaacaaggcctggatggtgcaccggcagtggttcttcgatctgccgctgccttggacctccggcgccaccaccgagacccccacctggaaccgcaaggagcttctggtgacgttcaagaacgcccacgcgaagaagcaggaggtagtggttctggggagccaggagggagccatgcacacagccctcaccggagccaccgagatccagaactccggcgggacgagcatctttgccggccacctgaagtgccggttgaagatggataagctcgagctgaaggggatgtcctacgcgatgtgcctgaacaccttcgtcctcaagaaggaggtgagcgaaacccagcacgggaccatcctgatcaaggtggagtacaaaggcgaggacgctccatgtaaaatccccttcagcaccgaggacgggcagggcaaggcccacaacggacgcctgattaccgcaaatcccgtcgtgaccaagaaggaggagcccgtgaatatcgaggcggagcccccgttcggggagtccaacatcgtaatcggcatcggagacaaggcccttaagattaactggtacaagaagggcagctcaatcgggaagatgttcgaagccacagcccggggcgcccgccggatggcgattctcggcgacacggcgtgggacttcgggagcgtgggcggtgtgctgaactccctgggcaagatggtccatcaaatcttcgggagcgcctataccgccttgttctccggcgtgtcttggatcatgaagatcggcatcggggtgctgctaacctggatcggcttgaactccaagaacaccagcatgtcctttagctgtatcgccattgggataatcacgttgtacctgggcgccgtggttcaggccgacatggggtgcgtgattaactggaagggcaaggaactcaagtgcggtagtggtatctttgtcacaaatgaggtgcacacgtggaccgagcagtacaagttccaggccgacagccccaagcgcctggccaccgctatcgcgggcgcctgggagaacggggtgtgcggcatccgctctaccacccggatggaaaacctgctctggaaacagatcgccaatgagctaaactacatcctgtgggagaacaatatcaaattgacagtcgtggtgggggacatcatcggcgtccttgagcagggaaagcgtacgctcacaccccagcccatggagttgaagtatagctggaagacctgggggaaggcgaagatcgtcaccgcggagacgcagaactccagctttatcatagacggaccgaacacccccgagtgcccgagtgccagcagggcctggaacgtgtgggaggtggaggactacgggttcggagtgttcaccaccaacatctggctgaagctgcgcgaggtgtatacgcagctctgcgatcaccggttaatgtccgccgcggtcaaggacgagcgagcggtgcacgccgacatgggctactggatcgagagtcagaagaacgggagctggaaactggaaaaggcctccttgatcgaggtgaagacctgcacctggcccaagtcgcacaccctctggtccaacggcgtcttagagagcgacatgataatcccgaagtccctcgccggaccaatcagccagcacaaccatcggccgggctaccacacccagacggccggcccgtggcacctgggcaaactggagctagacttcaactactgcgagggtacaactgtcgtgatcaccgaaaactgcgggacgcgcggcccgtccctgcggaccaccacggtcagcgggaagctgatccacgagtggtgttgccgctcctgcacgctgccacccctccggtacatgggcgaagatgggtgctggtacggcatggaaatcagacccatcaacgagaaggaagaaaacatggtcaagagtctggcgtccgccgggagcggcaaggtggataacttcaccatgggggtgctctgcctggccatcctgttcgaagaagtcatgcggggtaagttcggcaagaagcatatgatcgccggggtgctcctgaccttcgtcttactcttatccggacaaattacctggcgcgatatggcacatacgttgatcatgatcggatcgaacgcttccgaccgcatggggatgggcgtgacctatctcgccttaatcgccaccttcaaaatccagccgttcctggctctcgggtttttcctgcgaaagctgaccagccgtgaaaacctcctgctaggcgtgggcttagcgatggccacgacccttcagctgcccgaggacatcgagcagatggccaacgggatcgccctcggcctgatggccctaaagctcatcacccagttcgaaacctatcagctgtggactgcgctggtcagcctgacctgctccaacaccattttcaccctgacagtggcctggcgcaccgccaccctgatcttggcgggggtgagcctgctccccgtgtgccaatcctcctccatgcggaagaccgactggttgccgatggccgtggcggccatgggcgtgccgcccttaccgctgttcatcttcagcctcaaggacacactgaagcgccgctcctggccgcttaatgagggtgtgatggccgtgggattagtcagcatcctggcctcctcactgttacgtaacgatgttcccatggctggccccctagtggccggcgggctgctcatcgcctgctacgtgatcactgggacgtccgctgacctgaccgtggaaaaagccgccgatgtgacttgggaagaggaggcggaacagaccggggtcagccataacctgatgatcaccgtggacgacgacggtacgatgcgcatcaaggacgatgagacggagaatatcctcaccgtgctgctgaagaccgctctcctgatcgtttccggcatcttcccctacagcattccggccacccttctcgtgtggcacacctggcagaagcaaacgcagcggagcggcgtgctatgggacgtcccctccccgcccgagacccagaaggccgagcttgaggagggggtgtaccggatcaagcagcaaggcatcttcgggaagacccaggtgggcgtcggggtgcagaaggagggagtgttccacaccatgtggcacgtcacgcggggcgcagtcctcacccacaacggtaagcgcctggagccgaactgggcgtccgtgaagaaggacctgatttcgtacggagggggctggcggctgtccgcccaatggcagaagggagaggaggtccaggtaatcgccgttgagcctggcaagaacccaaagaacttccaaaccatgcccggtatattccagacaaccaccggggagatcggagccatagcgctcgacttcaagcctggtacaagcggcagtcccatcatcaaccgcgagggaaaagtcgtagggctgtacggcaacggagtggtgacaaagaacggcgggtacgtgagtggtatcgctcagacgaacgccgaacccgacggcccgacccccgagctcgaggaggagatgttcaagaaacggaaccttaccatcatggacctgcacccggggagcggaaagactcgcaagtacctgcccgccatcgtccgagaggccatcaagaggcggctccgtacgctgatcctggcgcctacccgggtcgtggccgccgagatggaggaggcactcaaggggcttccaatccgctaccagaccacagccacgaagtccgagcacaccggccgggagatcgtggatctgatgtgtcacgcgacattcaccatgcgcctcctgagccccgttcgggttcccaactacaatctcatcatcatggacgaggcccacttcacggacccggcttccatcgcagcacgcgggtacatcagcacccgggtgggcatgggcgaggccgccgccatcttcatgaccgccacgccgcccgggacggcggacgcctttccccagagcaacgccccgatccaagacgaggagcgagacatccccgagcgcagctggaactccgggaacgagtggatcaccgacttcgtcgggaagactgtgtggttcgttcccagcattaaagccggcaacgacatcgctaactgcctgcggaaaaacggcaagaaggtcatccaactgagtcgcaagaccttcgacacggagtaccaaaagaccaagctgaacgactgggacttcgtcgtaaccacagacatcagcgagatgggcgcgaacttcaaggccgaccgtgtaatcgacccccgccggtgcctcaaaccggttatcctcacagacggtccagagcgtgtgatcctcgcgggtcccatgccggtcaccgccgcctccgcggcccaacggcgcggacgggtggggcgcaacccgcaaaaggagaacgaccagtacatattcaccggccaaccgctcaacaacgacgaggatcacgcccactggaccgaggccaagatgcttctggacaacatcaatacgcccgaggggatcatccccgccctcttcgagccagagcgggagaaatccgccgccatcgatggcgagtaccgactgaaaggcgaatctcggaagaccttcgtggaactgatgcgcagaggggacctccccgtctggttggcccataaagtggccagcgagggcatcaagtacaccgaccgcaagtggtgcttcgacggggagcggaacaaccagatcctggaggagaacatggatgtagaaatctggaccaaggagggcgagaagaagaagctccgcccccggtggctggacgcgcgaacctactccgacccactggccctaaaggagttcaaggacttcgccgccggaagaaagagcatcgctctggacctggtgactgagatagggagagtgccgtcccacctcgcgcaccgcacccgcaacgccttggacaacctggtcatgttacacaccagcgagcatggcggtcgcgcctaccggcacgccgtggaggagctgcctgaaaccatggaaactctgttgctgctgggcctgatgatcctgctgaccgggggcgccatgctgttcctgatcagcggcaaagggatcggcaagacatccatcgggctgatctgcgtgatcgcgagctccggaatgctctggatggccgacgtccctctgcaatggatcgcgagcgcaatcgtgctggagttcttcatgatggtgctcctaatcccggagcctgagaagcagcgcacgccccaggataaccagctggcctacgtcgtgatcggcattctaacgctggcggccatcgtggccgccaacgagatgggtctgctcgagactaccaagcgggatttaggcatgtccaaagagcccggtgtcgtgagtccgacctcctacctggatgtggacctccacccagcgagcgcttggacactttacgcggtcgcaaccaccgtgataacccccatgctgcgccacacgattgagaacagcaccgcgaacgtgagcctcgcggccatcgccaaccaggccgttgttctgatgggactggacaagggttggccgatatcaaagatggacctcggcgtgccgcttcttgcccttgggtgctacagccaggtcaacccactgaccctgacagcagccgtgctgctgctggcaacgcactacgccataattggccctggcctccaggccaaggccacgcgggaggcccagaaacgcaccgccgccgggatcatgaaaaaccctaccgtggacgggatcatgacgatcgacctggacccggttatctacgacagtaagttcgagaagcagctgggccaggtcatgctccttgtgctgtgcgcggtccagctcctgctgatgcggacttcctgggcgctctgcgaggccctgaccctggccaccgggcccattacgaccctctgggagggatcccccgggaagttctggaacaccaccatcgccgttagcatggctaacatcttccgcggctcctacttagcgggggccggcctggccttcagcatcatgaaaagcgtgggaacaggaaagcgggggaccgggtcccagggcgagaccctcggggagaagtggaagaagaagctgaaccaactgtcgcgcaaggagtttgacctctacaagaaatccggcatcaccgaagtcgaccggacggaggccaaggaggggctaaagcgcggcgagatcactcggcacgcggtgagccgcggctccgccaagctgcagtggttcgtggagcggaacatggtcatccccgagggacgcgtaatcgacctcggctgcggccgaggcgggtggtcttactactgcgctggcctgaaaaaggtgaccgaggtaagaggctacaccaagggcgggccgggacacgaggaacccgtacccatgtctacctacggctggaacatcgtcaagctgatgagcggcaaagacgtcttttacctgcccccggagaagtgcgacacgctcctttgcgacatcggcgagtccagcccctcccccaccgtggaggagagcaggactatccgggtactgaagatggtcgagccgtggctcaagaacaaccagttctgcatcaaggtgctgaacccgtacatgcccacggtgattgagcacctggagcgccttcagcggaagcatggagggatgctggtcagaaaccccctgtcccggaactcgacgcacgagatgtactggatctctaacggcaccgggaacattgtaagctcggtgaacatggtcagcagactcctgctgaaccggttcaccatgacccaccgccgacctacgatcgagaaggacgtcgatctcggcgccggtacgcgacacgtgaacgccgagccggagaccccaaacatggacgtcattggggagcgcatcaagcgcattaaagaggagcacaactcaacctggcactacgacgacgagaacccctacaaaacgtgggcgtaccacggcagctacgaggtgaaggccaccgggtccgccagcagcatgatcaatggcgtcgtcaagctgctgaccaagccttgggatgtggttcccatggtgatccaaatggccatgacggacaccacgcccttcggccagcagagggtgttcaaggagaaggtcgacacccgcactccccgaccgatgcccggcacacgcaaggttatggaaattaccgcggaatggctctggcggaccctgggtcggaacaagcggccccgcctctgcacccgagaggagtttacgaagaaggtgcggaccaatgccgcaatgggcgccgtcttcaccgaagaaaaccagtgggactccgcccgcgcggccgtggaggacgaagagttctggaagctcgttgacagggagcgcgagttacacaaacttgggaagtgcggaagctgcgtctacaacatgatgggcaagcgcgagaagaagctcggggagttcggcaaagcgaagggcagccgcgccatctggtacatgtggctgggagcccggtacctggagttcgaggcgctcggcttcctgaacgaggaccactggttcagccgcgaaaacagctacagcggcgtggagggcgaggggcttcacaaattgggctacatcctccgggacatttcgaagatcccgggcggggctatgtacgccgacgacaccgccggctgggacacgcgcatcaccgaggacgatctgcacaacgaggagaagatcacccagcagatggacccggagcaccggcagctcgccaacgcaatcttcaaactgacctaccaaaacaaggtggtgaaggtgcagcgccccactccgaaggggaccgtgatggacatcatcagtaggaaagaccagagaggcagtggccaggtcgggacctatggcctgaacacgttcacgaacatggaggcccagctcgtgcggcagatggagggggagggcgtgctgtctaaggccgacctggaaaacccgcacctactggagaagaagatcacgcagtggctagaaactaaaggggtcgagcgccttaagagaatggccatttccggggacgactgcgtggtgaagccgatcgacgatcgcttcgccaatgcattactggccctcaatgatatggggaaggttcgtaaggacatcccccagtggcaacccagcaaagggtggcacgactggcaacaggtccctttctgctcccaccacttccacgagctgatcatgaaggatggccgcaagctggtggtgccttgccggccccaggacgagctcatcgggcgcgctcgcatcagtcagggcgccgggtggtccctgaaggagacagcgtgtctgggcaaagcctacgcccagatgtggagcttgatgtatttccatcggcgcgaccttcggctggcgtctaacgctatctgcagcgcggtacccgtgcactgggtacctacctcccgcacgacctggagcatacacgcccaccaccagtggatgacaaccgaagacatgctcacggtgtggaaccgagtgtggatcgaggacaacccttggatggaggataagacccccgttaccacctgggaggacgttccctacctgggcaagcgcgaggaccagtggtgtggcagcctgatcggcctcacatcccgggccacctgggcccagaacatcctgacagccatccagcaggtccgcagcctaatagggaacgaggagtttctcgactacatgccctctatgaagcgcttcaagaaagaggaggagagcgaaggcgcgatctggtga

SEQ ID NO: 25929 - RNA, 9873 nt, synthetic construct
  misc_feature 1..9873: note = derived and/or modified CDS sequence (opt11) from DENV-3__FJ898459__SS-prME
  source 1..9873: mol_type = other RNA
accagcctatgcctgatgatgatcctaccagcggcactcgcattccacttaacctcaagggacggggagccccgtatgatcgttgggaaaaatgaacgtggcaaatcactcctgttcaaaaccgcatcagggatcaatatgtgcacccttatagctatggatctaggcgagatgtgtgacgacacagtgacgtacaaatgcccacatatcactgaggtagagccagaggatatagattgctggtgcaatcttacatcaacgtgggtcacatacggcacatgcaaccaagctggagaacacagaagagataaacgttcagtcgcgctagccccacatgtcggtatgggactcgacactagaacgcaaacttggatgtcagcagagggggcatggcgacaggtggaaaaagtcgaaacatgggccttaaggcatcccggtttcactattctggcactcttcctcgcacactatattggaacgagtctaacgcaaaaagtagtgatctttatactgctaatgctcgtaacgccaagtatgaccatgagatgcgtcggcgtgggaaacagggacttcgtcgagggccttagcggggccacatgggtagacgtcgtgctagagcacggagggtgtgtaacaacaatggcgaaaaacaaaccgacattggacatagaacttcagaaaacggaggcaacacagctggccacactacgcaaattgtgcattgaaggcaaaataacaaatatcacaaccgacagtagatgcccaactcagggcgaagccgtgctgcctgaagaacaagaccaaaactacgtgtgcaagcacacctatgtcgacagagggtgggggaacggatgcggcctatttgggaagggcagtctagtaacctgtgccaaattccagtgcctcgaaccgatagaaggcaaagttgtacaatacgaaaacttaaaatacacagtcataataacggttcatacaggcgaccagcatcaagtgggcaacgaaacgcagggagtaacagcagagattacaccccaagcatccaccacagaggcaatactgcctgaatacgggacgctcggcttggagtgctcgccccgcaccggcctcgacttcaatgaaatgatactcttgacaatgaaaaacaaagcatggatggtacacagacaatggttcttcgatctgcccctaccctggacatcaggggccacaacagaaacacctacctggaacagaaaggaactcctagtaacattcaagaacgcgcacgctaagaagcaagaagtcgtagtcttagggtcacaagagggcgcgatgcacacagccctaacgggtgcgacagaaatccaaaatagcggagggacgtcaatcttcgcgggccacctaaagtgcagactgaagatggacaaactcgagctcaaagggatgtcctacgccatgtgtactaacacattcgtcctcaagaaggaggtaagcgaaacccaacacggcaccatcttgataaaggtagagtacaagggagaggacgcgccctgcaagataccattcagcactgaggatgggcaaggaaaggcccacaacgggagactcataacggcgaacccagtagtcactaagaaagaagaacccgtgaacatagaagcggagcccccatttggtgaaagcaatatcgtcatagggattggagacaacgcgctcaagataaattggtacaagaaagggagctcaatcgggaaaatgtttgaagccacagcacggggagcacgtcggatggctatcctaggcgatacggcctgggacttcgggagcgtaggaggggtactgaactcgttggggaagatggtgcatcaaatattcgggagcgcatacaccgcactgttctcaggcgtgagctgggtaatgaagataggcatcggcgtcctgctgacctggatcggtctgaacagtaagaacacgagcatgagcttcagctgtatcgccatcggaataataaccctgtacctcggggcggtagttcaagctgacatgggctgcgttataaactggaagggcaaagaacttaaatgtgggagtggaatattcgttacaaatgaggtgcacacctggaccgagcagtacaaatttcaagccgatagccccaagcgcctcgccacagccatagccggggcgtgggagaacggcgtctgtggcatacggagcacgacccgaatggagaacttactttggaaacaaatcgcgaacgagctcaactacatcctgtgggaaaacaacataaaactcaccgtcgtcgtcggcgatatcatcggagtactcgagcagggcaaacggacactcacaccgcagccaatggagctgaagtactcatggaaaacatggggaaaagccaaaatagtgaccgccgagacacagaatagctctttcataatcgacggtcccaatactccagaatgtccaagtgcatcccgtgcttggaacgtgtgggaggttgaagattacggcttcggcgtattcacaaccaacatctggctcaagctgagagaggtgtacacacaactatgtgaccatagactcatgagcgcagcggtaaaagacgaacgcgcggtacatgcagacatggggtactggatcgaaagccagaaaaacggctcctggaaactggagaaggcttcactaatagaagttaagacttgtacctggcccaaatcacacaccctctggtccaacggcgtcctggaatctgacatgataataccgaaaagcctagcagggcccatctcccaacataatcataggcccggctaccatacacagaccgccggcccctggcaccttggcaaactcgaactagacttcaattactgtgagggtacaacagtcgtcatcaccgaaaactgtggcacccgcggaccaagcctacggaccaccacagtcagcggcaaactcatacacgagtggtgctgcagatcctgtaccctccctccactccgctacatgggcgaggacggctgctggtatggcatggaaatcagacccataagcgaaaaagaggagaacatggtcaaatcattagtatcggccggatccggtaaagtcgacaatttcacgatgggcgtactctgcctcgcgattctctttgaggaggtcatgagaggcaagttcggaaagaaacacatgatcgcaggcgtattctttacattcgtcctactcttgagtggccagatcacatggcgtgacatggcacacacgctgattatgataggtagtaacgcgagtgacagaatgggtatgggggtaacatacctagcactgatcgcgaccttcaaggtccaaccgttcctcgctctcgggtttttcctaagaaagctaactagccgagagaatctcctcctcggagtgggactggctatggccacgactctgcagttaccggaagacatagagcagatggcgaatggcatcgccctaggcctcatggcactcaagttaataacgcagttcgaaacctaccaactttggaccgcgctcatctctctaacctgctccaacacaatgttcaccctaacagtggcatggagaacggccacgctaatcctagcaggagtatcgctcttgccggtgtgtcagagtagcagtatgcgtaagacagactggctcccaatggccgtcgcggcaatgggcgtgccaccactacctctgttcatatttagcctcaaagacactctcaaacgaagatcatggcctcttaacgagggtgttatggccgtcggactggtgagcatcctagcatcatcgctgctgcgcaacgacgtccctatggctggcccattggtggccggtggcctactaatcgcatgttatgtaatcactggtacgagtgccgacttaacggtcgaaaaggctgctgacatcacatgggaggaagaagctgaacaaacaggggtgagccacaacttaatgataacagtcgacgacgacggaactatgcgaataaaagacgacgagaccgaaaacatccttacagtgctattgaagaccgcattgcttatcgtgagcggagttttcccatactcgatcccagcaaccctccttgtatggcacacatggcaaaaacaaacccaacggtctggagtactatgggacgtgccatccccaccagagacgcagaaggcagagctcgaagaaggtgtataccgtataaaacaacaaggaatatttggcaagactcaggtgggggtcggcgtgcagaaggaaggtgtcttccacacgatgtggcacgtcactagaggtgcagtcctaacgtacaacggaaaacgactcgagcccaactgggcaagcgtcaagaaagacctaattagctacggaggaggatggcgactctcagcccaatggcaaaaaggagaagaggtccaagtgatagctgttgagccggggaaaaaccccaaaaacttccagactatgccgggaacatttcaaaccacgaccggtgaaattggcgccattgcgttggacttcaaaccgggcacatcaggcagtccgatcataaatcgagagggaaaagtagtaggcctgtacggcaacggcgtggtgacaaagaacggcggatatgtctctggcatagcgcagaccaatgccgaacccgacggaccgacccccgagctagaagaggaaatgttcaagaaaaggaacctcacaatcatggacctacacccgggatccggtaaaacacgaaaatacctgccagccatcgtaagagaagcgatcaaacggcggttacgaacactaatcctcgcaccaacacgagtcgtcgcggctgagatggaggaagccctaaaaggcttaccaatacggtatcagaccacagcaacgaagtccgaacacaccggtcgagagatcgttgacctaatgtgccatgcgacgttcacaatgaggctactctcaccagttagggtaccaaactacaacctaatcataatggacgaagcacacttcacggacccggcatccattgcagcaagagggtatatcagcacgcgtgtggggatgggtgaagcagctgccatatttatgaccgcaacaccaccgggtaccgccgatgcgtttccccaatcaaacgcaccaatacaagacgaagaacgagacattccagagcgttcatggaactcaggtaacgaatggataacagactttgcaggcaaaaccgtatggtttgtcccgagtataaaagctgggaacgatatcgctaactgtctccgcaaaaacggcaagaaggtcatacaactcagcaggaagacatttgataccgaataccaaaagactaaacttaatgactgggactttgtggtcaccacggatatatcagaaatgggagccaacttcaaagcagaccgggtgatcgacccgaggcggtgtctcaaacccgtaatcctaaccgacggccctgaacgggtgatcctcgcgggcccgatgcctgtcaccgccgcaagcgcggctcagcggaggggtagagtcggacgcaacccacaaaaagaaaacgaccaatacatatttacgggccaaccattaaacaacgacgaggaccacgctcactggacagaggcgaaaatgctgctcgacaacatcaacacgccggaaggaataattcctgcactcttcgaaccggaaagggagaaaagcgcggcaatagatggggaataccgcctaaagggtgaatcccgaaaaaccttcgtagaactgatgagacgaggcgatctccctgtttggcttgcgcacaaagtggcaagcgagggcataaaatacacagaccgcaagtggtgttttgacgggcagaggaacaatcaaatcctcgaagaaaatatggatgttgaaatctggacgaaagagggtgaaaagaaaaagctaagacccaggtggctagacgccaggacttacagcgacccactggcactgaaggagttcaaagactttgcagcgggacgcaagtccatcgcccttgatcttgtaacggagataggaagggtccctagtcacctagcacatagaacccgcaacgcactagacaacctagtgatgttgcatacaagcgaacacggaggccgggcataccggcacgcggtagaagaactaccagaaacgatggagacactactgttgcttggactaatgatactgctaactggcggggcaatgttattcttaatcagcggaaaagggatcgggaaaacctcgatagggctaatctgcgtcatagcctcttcaggcatgctgtggatggcagaaatcccgctccaatggattgcctcagcaatagtcctggagttcttcatgatggtacttctcatcccagagcccgaaaagcagcgaacacctcaagacaaccaattagcctacgtggtaatagggatactaaccctcgcggccataatagcagcgaacgaaatggggctactagaaaccacgaaaagagacctcgggatgtcgaaagaaccgggtgtcgtatcccccacctcatacctggatgtagacctccatccggcgtcagcatggactctttacgcagtcgctacaacagtcataacccctatgctccgccacacgatcgaaaactccacagcaaatgtctccctagccgcaattgcaaaccaagccgtggtgctgatggggctcgataaaggatggcccatatctaaaatggacctgggcgtaccactcctcgcactagggtgttatagtcaagtgaacccccttaccctcaccgcagctgtactactcctgataacacactacgccattataggtcccggactccaggccaaagcaaccagagaagcacaaaagcgaacagcagcgggcattatgaaaaaccccaccgtggacggtataatgacaatagacctcgatcctgtaatatacgacagcaaattcgagaagcaactaggacaagtaatgctcctagtactatgtgccgtacagctgcttcttatgaggaccagttgggcattgtgcgaggcactcaccctcgccaccggaccgataacgaccctctgggagggtagcccaggtaaattctggaatacgacaatcgcggtcagcatggcaaacatcttcaggggatcgtatctcgccggtgcggggctggcattcagtataatgaagtcagtcggaacggggaaacgagggaccgggagccagggcgaaaccctcggtgagaagtggaagaagaaactcaatcagctctcgcgtaaggagttcgacctatacaagaaatccggaatcacagaggtggaccgtaccgaagccaaggaaggccttaaacgtggagaaaccacccatcacgcagtttcccgcggatctgcaaaactgcaatggttcgtagagaggaacatggtgattccggagggtagggtaatagaccttgggtgcgggagaggtgggtggagctattactgcgccgggctcaaaaaggtaaccgaagtacgaggctacaccaaaggagggccaggacacgaggaaccagtcccaatgagtacgtacggatggaatatagtaaaattgatgtcgggcaaagacgtgttctacctgccgcccgaaaaatgcgacaccctactctgtgacatcggggagagttcaccaagtccgaccgtcgaagaaagtcgtacaatccgagtcctaaaaatggtggagccatggcttaaaaataatcagttctgcataaaagttctcaatccctacatgccgacagtgatcgaacacctagaaagactccagcgaaaacacggcggaatgctcgtcaggaacccactgtcaaggaacagcacccacgaaatgtattggatatccaacggaacaggaaatatagtcgcatctgtgaacatggtatcacgcctactattgaacaggttcaccatgacacatagacgccccacaatagaaaaagacgttgacctaggcgcgggaacccggcacgttaacgcggaaccagagactccaaacatggatgtaataggtgaacggataaagagaataaaagaggaacacaacagcacctggcactacgacgacgaaaacccctacaaaacctgggcctaccacggttcctacgaggtcaaagctacgggatcagcttcaagcatgatcaatggagttgtaaaactcttgactaaaccctgggacgtggtgcccatggtaacacaaatggcaatgaccgacacgaccccatttggccagcagcgggtcttcaaagaaaaagtcgacaccaggacgccaaggtccatgccaggtacacgccgggtgatgggtatcacagcagaatggttatggaggactctcggccggaacaagaaaccacgactctgtacacgcgaagagttcaccaagaaagtgcgcaccaacgcggcaatgggtgcggtatttacagaagaaaaccaatgggactcagccaaagcagcagtcgaagatgaggacttctggaagctcgtagatagggagcgggaactacataaactcggtaagtgcggctcgtgcgtatacaacatgatgggaaaacgggagaagaaactgggagagttcggaaaagccaaaggatccagagcgatatggtacatgtggctcggagctagatacctcgagttcgaggcgcttggtttcctaaacgaagatcactggttctcgcgagaaaattcgtactccggcgtcgaaggagagggactccacaaactaggctacatactgagggacatcagtaaaatccccggcggagcgatgtacgcggacgacacggcaggttgggacacaaggattacggaggatgatctccacaacgaagaaaagataacacaacagatggacccagaacacaggcagttagcaaatgccatcttcaagctgacctaccaaaacaaggtggtcaaagtacaacgtcctacacctaccggaaccgtcatggacatcatatcgaggaaagaccagcgaggtagcgggcaagtaggcacatacggcctcaacacctttacaaacatggaagcgcaactaatccggcagatggaaggcgagggcgtactgagcaaggctgatcttgaaaacccacacctcccagagaagaaaataactcaatggctagaaacgaaaggtgtcgaaaggcttaagagaatggcgatatcaggagacgactgcgtagttaagccaattgacgacagatttgccaacgcgttgctagcactcaacgatatgggaaaagtgcgaaaggacattcctcagtggcagccttccaaaggatggcacgactggcaacaagtacccttctgcagccatcacttccatgaacttataatgaaagacggacgaaagctcgtcgtaccatgccgtccgcaagacgagctaatcggccgggcacgaatctcacagggggctgggtggtcacttcgggaaactgcgtgcctcggtaaggcctacgcccaaatgtggtctctaatgtacttccaccggcgggacctacgactcgcaagcaatgcaatctgcagcgcggtgccggtacactgggtacccacatcaaggacaacatggtctatacacgcacatcaccagtggatgacgacagaggatatgttaacggtatggaatcgcgtttggatagaggacaacccttggatggaggacaaaacccccgtcacaacatgggaaaacgtcccgtacctggggaagcgggaggatcaatggtgcgggagtctgatcggcttaacatcgagagcaacctgggcccagaacattcccaccgctatacaacaagttaggagccttatagggaacgaggagttcttagactacatgccctccatgaaacggttccgaaaagaagaggagtccgaaggggcgatatggtag

SEQ ID NO: 25930 - RNA, 9873 nt, synthetic construct
  misc_feature 1..9873: note = derived and/or modified CDS sequence (opt11) from DENV-3__EU482555__SS-prME
  source 1..9873: mol_type = other RNA
acctccttatgcctcatgatgattctacccgcggctctcgcgttccacctcacttcgcgcgacggagaacccaggatgatcgtaggcaaaaatgaaagagggaaaagtctgctattcaaaacggcgagcggcataaatatgtgtacgctgatcgcaatggacctcggcgaaatgtgtgacgacactgtaacctataaatgcccgcacatcaccgaagtagaaccggaagacatcgactgctggtgcaacctgacctcgacgtgggtcacatacggaacctgcaatcaagctggtgaacatagacgcgataaacgcagcgtggcactggccccacatgtcggcatggggttagatacccgcacccaaacgtggatgtccgcagaaggggcatggcgacaggtggaaaaagtagaaacgtgggcattaagacacccggggttcaccatcctcgccctttttctggcgcattacatagggacatcgttgacgcagaaagtcgtgatcttcatcctcctcatgctcgtgactccatcgatgactatgcgatgcgttggggtaggtaaccgagacttcgtagaaggcctctccggggcaacgtgggtcgacgtagtgttggagcatggagggtgtgtaacaaccatggccaaaaataaacccacactggacatcgaattgcagaagactgaagcgacacagctggccacactgaggaaactatgcatcgagggaaagatcactaatatcacaacagactccaggtgcccgacccagggcgaggctgtgctccccgaagaacaagaccaaaactacgtatgtaaacacacatatgtggaccgaggatgggggaacgggtgcggcctgttcggcaaaggatccctggtaacctgcgctaaatttcagtgtctagagcccatagaaggcaaggtcgttcagtatgagaatctgaaatacacggttatcatcaccgtccacaccggcgaccaacaccaggtcggcaacgagacacaaggggtaacggccgaaatcactccacaggcatcaacgacagaagcaatactacccgaatacgggaccctcggactggagtgctcaccaagaaccggtctggacttcaatgaaatgatcttactgacaatgaagaacaaagcgtggatggtccaccgccaatggttcttcgatctgcccctaccttggacctctggagcaaccaccgaaacgcctacttggaaccggaaagaactgctggttaccttcaagaacgcccatgctaagaaacaggaggtcgtggtcctaggctctcaggaaggggctatgcacacggcactcacaggggccaccgaaatccagaatagcggagggacgtcgatatttgcgggccacctcaagtgtcgcttgaaaatggataaacttgagctcaaagggatgtcgtatgccatgtgtactaacacttttgttttgaaaaaggaagtatccgaaacacaacacgggaccatactcatcaaagttgagtacaaaggagaagacgcgccctgcaagatccccttcagtacagaggacggacagggcaaggcgcacaacggaaggctaataaccgcaaatccagtcgtcaccaaaaaggaagaacctgtcaatatcgaggcagaaccgccttttggagaaagcaacatcgtcatcggaataggagacaacgcactaaaaattaactggtacaagaaaggtagttccataggaaaaatgtttgaagcaaccgcacgaggcgcacgtcgtatggcgatactaggagataccgcttgggactttggtagtgtaggaggggtactaaactccctaggcaagatggtgcatcagatatttggtagcgcgtacaccgccttgttttccggtgtcagctgggtcatgaaaataggaataggcgtactactcacttggatagggctcaactccaaaaataccagtatgtcatttagctgcatcgcaattggagtaataacgctttacttgggcgccgtagtgcaggcagacatgggatgtgtcatcaattggaaggggaaagaactaaaatgcggctcagggatattcgttacaaacgaagtccacacgtggacagaacagtacaagttccaagcagactcccccaagcggttggcgacggccatcgccggtgcctgggagaatggcgtctgcggcatacgtagtaccacgagaatggaaaaccttttatggaaacagatcgcgaatgagctcaactacatactctgggagaacaacataaaactcacggtcgttgttggagacatcataggcgtcctagagcagggaaagcgcaccttgaccccacaaccgatggagcttaaatacagctggaagacctgggggaaagcgaagatcgtaacagctgaaattcagaactcctctttcatcatagacggcccaaatacccccgagtgcccgagcgccagccgcgcgtggaacgtttgggaagtcgaagactatggatttggggtttttaccaccaacatatggttaaaactgcgtgaagtctacacccaactatgcgatcacaggctaatgagcgcagctgtaaaggacgaacgagccgtacatgccgacatgggatactggatcgagtcccagaaaaacggcagctggaagctagaaaaggcgtcactaatcgaggtcaagacctgtacctggccaaagtcacataccctatggagcaacggtgtgctcgaaagcgatatgattattcccaaatccctggcgggacctatctcacaacacaactaccggcccggataccacacacaaacagctggcccctggcacctaggcaagttagacctggattttaattattgcgaggggacgaccgtcgtcattactgagaactgcggaacgaggggaccatcactccgcacaaccactgtatcgggaaagttgatacacgaatggtgctgtcgcagctgcaccctaccaccgctaagatacatgggagaagacggctgttggtacgggatggagatcaggccgataagcgagaaagaggaaaacatggtcaagagcctggtttcagctggcagcggcaaggtagataacttcacaatgggcgttttatgcctcgcgatcctgttcgaagaggtgatgagaggcaaattcggcaaaaagcacatgatagccggggtattcttcacattcgtgctcctgctaagcggccaaatcacgtggcgagatatggcccatacgctgattatgataggctctaatgccagtgacaaaatgggcatgggtgtcacgtacctagctctaattgccacattcaaaatccaacccttcttggcgttgggatttttcctcaggaaactgacgtcccgagagaatcttttactgggcgtagggctcgctatggccacgacattgcagctaccagaagacattgagcaaatggccaacggcatcgcgctcggtctcatggcactaaaactcataacgcaatttgaaacctatcaactctggacagctctcatctcactaacctgctccaatacaatgtttaccctcactgtagcctggagaactgccaccctaattctagcaggcgtatcattactaccggtttgccaatcgtcctccatgaggaaaacagactggctgcccatggcagtagcggctatgggagtcccacccctaccactatttatattctcactaaaagacaccctaaagcggagatcctggccactgaacgaaggagtcatggcggtaggcctggtcagcatactagcaagcagcctattacgcaatgatgtaccgatggcaggtcctctcgttgccggaggattgctaatagcctgctatgtgataaccggcacttcagccgatctcacagtagagaaagcggcggatatcacgtgggaggaagaagcagagcagacgggcgtgagccacaacctgatgatcacagtagatgacgacggaactatgcgtataaaagacgacgaaacagaaaacatcttgacggtcttacttaaaacggctctactgatagtctccggggtctttccctacagtatcccagcgacattgttagtctggcacacctggcaaaaacaaacacagcggtcgggagtcttgtgggacgtccccagcccacccgagacgcaaaaggctgaactcgaagaaggagtatacagaatcaaacagcagggaatatttgggaagacccaagtcggagtaggtgtgcagaaggaaggcgtctttcacacgatgtggcacgtgaccagaggcgccgtactgacctacaacggaaaaagactcgaaccgaattgggcctccgtcaagaaagacctaatcagctatggaggcggatggcgactgagtgctcaatggcaaaaaggcgaagaagttcaagtgatcgctgtagaaccaggcaaaaaccccaaaaacttccaaacgatgccaggaacctttcagacgacaacaggggaaattggagcgatagcgctggacttcaagccagggacgtcgggatcacctatcattaacagagaaggcaaagtggttggcctatacgggaacggtgtagtaacgaaaaacggcggatatgtctccggtatagcacaaaccaacgctgagccggacggtccgacaccagagttagaagaggaaatgttcaaaaagcggaaccttacgatcatggatctccatccaggcagcgggaagactcgcaaatacctaccggccatcgtgcgggaggcgattaaaagacgcctgcggaccttgatcctagcgccaacacgggtagtggcagcggagatggaggaagcgctaaagggtctacccatccgatatcagacaaccgccacgaaaagcgaacacaccggtcgagaaatcgtagacctcatgtgccacgcaaccttcacaatgaggctcttgtcgcccgtacgcgtgcccaactacaacctaatcataatggatgaggcacatttcacagaccccgcgtcaatcgcagccagaggctatatctcgaccagggttggaatgggcgaggcggctgcgatattcatgacggctaccccgccaggcacggcggacgcgtttccccaaagcaacgcaccaatacaggacgaggagcgggacatacccgaaaggtcctggaactcgggaaacgaatggatcacggactttgccgggaaaacagtgtggttcgtcccttcaatcaaagcaggcaacgacatcgcaaactgcctacgaaagaacggtaagaaggtcatccagttaagtagaaagacatttgatacggagtaccagaagactaaacttaacgactgggacttcgtggtgacaaccgacatttctgaaatgggggcgaacttcaaggccgatagagtcatcgaccctcgccgctgtctcaagccagtaatcctcaccgacggaccagagcgagtcatactagcaggacccatgcccgtaacggcggcctccgccgcccagaggagaggacgcgtaggcaggaacccacaaaaagaaaacgaccagtacatcttcacaggacaaccactaaataatgacgaggaccacgcccattggacagaagcaaagatgctactggacaacataaacacgcccgaaggaatcattccggcactcttcgagccagaacgtgagaaatccgccgcaatcgacggagaatacaggctgaagggagaatctcgaaaaacgttcgtcgagctcatgcgaagaggcgacctacctgtttggcttgcgcacaaggtagcaagcgaaggcataaaatacaccgaccgcaagtggtgttttgacggacaacggaacaaccaaattttggaggaaaacatggacgtcgaaatatggacaaaggaaggcgaaaagaagaaactcaggcccagatggctcgacgctaggacctacagtgacccactagctctaaaggagttcaaagacttcgcagcgggcaggaaaagcattgcactcgatctagtcacggaaatagggagagtgccctcgcacctggcgcaccgaaccagaaacgcattggataacttggtaatgctacacacatctgaacatggtggcagggcctacagacacgcagtagaagaactgccggaaactatggagacactgctgcttctaggattaatgatcctgctcacaggcggagccatgctattcctcattagcgggaaggggatcgggaagacttccataggcctaatttgcgtaatagcctcatcaggcatgctatggatggccgaaatcccgctccaatggatagcctcagccatagtcctagagttctttatgatggtactattaatcccggaaccagagaaacagaggaccccgcaggacaaccagctagcatacgtcgtgataggcatattgaccctagccgcaatcattgcagcgaatgaaatgggactgctagaaacgaccaaaagagatctggggatgtcaaaggagcctggtgtggtgagtcccacatcgtatctcgatgtagatctccatcctgcatccgcctggacgttatatgccgtagcgacgacggtgatcacgcctatgctccgccacacgatcgagaacagtacagccaacgtgtccctggcggctatcgcgaatcaagccgtagtgctaatgggcctagacaaagggtggccgatctccaaaatggacctgggcgtacccctcctagcgctcggctgctacagccaagtcaatcccctcacactgacagcagcagtccttctactcataacgcactacgcaatcatcgggcccggtcttcaagctaaagctacgagagaagcccagaagcgcactgccgccggaatcatgaagaacccgaccgtcgacggcataatgacaattgacttggaccccgttatctatgacagcaaattcgaaaagcaactaggacaagtaatgctgcttgtcctctgcgccgtccaactgctgctcatgagaaccagttgggcgctatgcgaggcgttaacactcgccacgggaccgatcaccacgctctgggagggcagcccgggaaaattctggaacacaacaattgccgtctcaatggcgaatatcttccgggggagctacttagcaggcgcgggtctggcattcagtataatgaaatccgtcggaacaggcaaacggggcacgggatcccaaggcgagacgttgggcgaaaagtggaaaaagaaactaaaccagctctcacgaaaagagttcgacttatataagaaatcagggataacagaagtagaccgaacggaagcaaaggaagggctcaaaaggggcgaaaccacccaccatgccgtaagtcgtggcacggcgaaactccaatggttcgtggaacggaacatggtaataccagagggacgtgtaatagacctcggctgcggcaggggaggatggtcctactattgcgccggcctgaagaaagtgacggaggtcaggggatacacaaaaggaggacccgggcacgaggaaccagtgcccatgtcgacatatggctggaacatagtaaaactcatgtcaggaaaggacgtattctatcttcccccggaaaagtgcgacacactcttatgcgacatcggcgagtcatcaccgagccctacagtcgaagagtcgcgaacgatccgagtactaaagatggtagagccctggctgaaaaacaaccagttctgcatcaaggtactaaatccctacatgcccactgtcatagaacacctagagcgactccaacgcaagcacggcgggatgctagtccgcaaccctctgtcacggaacagtactcatgaaatgtactggatctcgaatggcacagggaacatagtcgcaagcgtaaacatggtaagtcgccttcttctcaacagatttacgatgacgcaccgtcgcccgaccatagagaaggacgtagaccttggcgcgggtacacggcatgtcaacgcagaaccagaaacccccaacatggacgtgatcggcgagaggatcaagcgaatcaaagaagaacacaacagtacctggcactacgacgatgaaaatccgtataaaacttgggcataccacggatcatacgaggtcaaagccaccggttccgcatccagtatgatcaacggcgtagtaaagctcttgacgaaaccatgggatgtagtaccaatggtaacgcaaatggcaatgaccgatactacacctttcggacaacaaagagtatttaaagaaaaagtcgataccagaacaccccggtcgatgccaggcacgagacgtgtcatgggcatcaccgccgaatggctatggaggacgctcggccgcaacaagaagccacgcctatgcacgagagaggagttcacgaagaaagtacgaaccaacgcggccatgggtgcagtttttaccgaggaaaaccagtgggacagcgcaaaagcagctgttgaggacgaagacttctggaaactcgtagaccgggaacgtgagctacacaaactgggcaaatgcggtagctgtgtatacaacatgatgggcaaaagggagaagaaactcggcgaatttgggaaggcgaagggctcacgagctatatggtacatgtggctaggagcgcgttacctcgagttcgaagcactcgggttccttaacgaagatcactggttttcacgagaaaatagctattcaggggtagagggggagggattacacaaattggggtacatcctacgagacatcagcaagataccaggtggggcaatgtacgcggatgacacagcaggatgggacacgcgcataacagaagacgatctacataatgaagagaaaattacccagcaaatggacccagagcaccggcaactagccaacgcaatattcaaactcacgtaccaaaacaaagtcgtaaaagtccaacgacccacccccacgggcacagtcatggacataatttcacgaaaggaccagcgcggatccgggcaggtcggcacgtacggcctgaacacctttacgaacatggaggcccagctgatacgacaaatggagggtgaaggcgtgctgagtaaagcagacctagaaaacccacatctgccagaaaagaagattacacagtggcttgagacaaagggagttgaacgactacgtcgtatggctatatcaggtgacgactgcgtggtcaaaccgatcgacgaccgattcgccaacgcgctgctcgcactaaatgatatgggaaaggtacgcaaggacataccccaatggcaaccgtcaaaaggatggcatgactggcaacaagtccccttctgctcacaccatttccatgagctcataatgaaagatggcaggaagctagtcgtcccgtgtcgaccccaggatgaactcataggtcgagccagaatcagccaaggagccgggtggagccttagagaaaccgcttgtctcggaaaagcctacgcccaaatgtggagcctgatgtacttccaccgcagagacttaagacttgcgagcaacgcaatctgctcagcagtgccagtccactgggtccccacatcacgcacgacatggtcaatacatgcgcatcaccagtggatgaccaccgaagacatgcttactgtttggaaccgtgtctggatcgaggacaacccatggatggaagacaagacccctgtcacgacatgggagaacgtcccatatctcggaaagcgggaagaccaatggtgcggaagtctaataggcctgacctccagggccacctgggctcagaacattccgaccgctattcaacaggtccgcagcctaatcgggaatgaggagttcctcgattatatgcctagtatgaaacgatttagaaaagaggaagagtccgaaggcgctatatggtaa

SEQ ID NO: 25931 - RNA, 9873 nt, synthetic construct
  misc_feature 1..9873: note = derived and/or modified CDS sequence (opt11) from DENV-3__EU529692__SS-prME
  source 1..9873: mol_type = other RNA
acttcactatgcctcatgatgatcctaccagcggcgttagcgttccacctcaccagtcgtgacggggaaccacggatgatagtagggaaaaacgaaagagggaaatcgttactgttcaaaacagcaagcggaatcaacatgtgtaccctaatagctatggacctaggtgaaatgtgcgacgatacagtaacctacaaatgcccacacataacagaagtcgaaccggaagatattgactgttggtgcaacctgacgagcacgtgggttacatacggaacatgtaaccaagccggcgagcacaggagagacaaacggagcgtggccctcgcgcctcacgttggaatgggtcttgacaccagaacccaaacctggatgagcgcagaaggagcttggcgacaagttgaaaaggtggaaacctgggcgttgagacaccctggatttacaatacttgcactgttcctggcgcactacatcggtacatcgctgacacagaaagtagtaatattcatacttctgatgctggtaacaccatcaatgacgatgcgatgcgtgggggttgggaaccgggacttcgttgaaggactaagcggggccacatgggtggacgtcgttctcgaacatggaggctgcgtaaccacgatggccaagaataaacctaccctcgacatcgaacttcaaaagacagaggccacacagcttgccacactaagaaaactgtgtatagaagggaagattaccaacatcaccacggacagccggtgtcccactcagggagaagccgtcctcccagaagaacaagaccaaaactatgtctgtaaacacacatacgtcgaccgcgggtggggcaacggctgtggcctcttcggaaagggcagcttagtaacctgcgccaaattccaatgcctggagccaatcgaaggcaaggtcgtacagtacgaaaacctgaagtacaccgtaatcatcacggtacacacaggcgaccaacaccaagtagggaatgaaacacaaggggtaacagcggaaataactcctcaagcctccaccaccgaggccatcctccccgagtacgggaccctagggctagagtgctccccacgcaccggcttagattttaatgaaatgatccttctgaccatgaaaaacaaagcctggatggtccataggcaatggttcttcgaccttccgttaccctggactagcggagccaccaccgaaaccccgacatggaataggaaagaacttctcgtaacattcaagaacgcgcatgcgaagaaacaggaagtggtagttctaggcagccaagaaggagcgatgcatacggcactcacgggtgcgacagaaatccaaaactccgggggcacctccatattcgctggtcatttgaagtgccgcctaaagatggataagttagaattgaaaggaatgtcctacgcaatgtgcacaaacacattcgtactgaaaaaggaggtctccgaaacacagcacgggacgattcttattaaggtggaatataagggagaagatgcgccttgcaagattcctttcagcaccgaagacggccaggggaaagcacacaacggacgactaattactgcgaatcccgtcgtaacaaagaaagaggaaccagtaaacatagaagctgagccacctttcggcgagtcaaacatcgtcataggaatcggagacaacgcattaaaaattaactggtacaagaaagggtcgtcaataggaaaaatgttcgaagcaaccgcacgcggcgcaagacgaatggcgatattgggagatactgcatgggattttgggagtgtaggcggtgtactcaacagtctgggtaaaatggttcatcagatattcggttccgcttacacggccctattctctggtgtgtcatgggtcatgaagataggcataggggtgctgctaacctggatcggcctcaactcgaaaaacacctccatgtctttctcatgcatcgccataggggtcataaccctatatctcggagcggtcgtgcaggctgatatggggtgcgtcatcaactggaaaggaaaagagctaaagtgtgggtccggaatcttcgtcactaacgaggtgcacacatggacagaacagtacaaatttcaggccgacagccccaagagactcgcaacagcgatagcaggcgcctgggagaacggcgtctgcggaatacggagcacaaccagaatggagaacttgctatggaaacaaattgcaaacgaactcaactacatcctatgggaaaacaacatcaagctaactgtagttgtgggcgacataattggagtgctagagcagggaaaacggacacttacgccccaacccatggaactcaaatacagctggaaaacctggggaaaagccaaaatcgtaacggccgaaatccaaaatagctcgttcataatcgacggacccaacacccccgaatgtccatccgcaagcagagcctggaacgtttgggaagtagaagactacggattcggagtcttcacaacaaatatatggctcaagctgcgggaggtatatacacaattatgtgaccatcgcctgatgagtgcagccgtaaaggatgaacgagcagtccacgccgacatgggctactggatagaaagccagaaaaatggatcgtggaaactcgaaaaagcctccttgattgaggtaaaaacttgcacttggcctaaatcgcataccttatggagcaacggagtactagaaagcgatatgataatccccaaatcactcgcaggcccgatctcgcaacacaactatcgtcccggatatcacacccagacggcaggcccctggcatctcggaaaattagatcttgacttcaactattgtgagggaacaacggttgtcataacggaaaattgtgggaccagagggccgagtctccgaacaaccacagtctcaggcaaactcatccacgaatggtgctgccggtcttgcacactacccccgctcagatatatgggggaggacggctgctggtacgggatggaaataaggccaatatcggagaaagaagagaatatggtaaagagcttagtgtccgcaggaagcggaaaggtggataacttcacaatgggcgtgctatgcctagcgatcctcttcgaggaagtcatgagaggaaaattcgggaaaaagcatatgatagccggtgtattcttcacattcgtactgttactctccggccaaatcacctggcgagacatggcccacacattaatcatgatcggaagcaatgccagcgataaaatgggcatgggggtaacctacctcgccctaatagcaaccttcaagatccaacccttcctggcgctaggattctttctccgcaaactaacgagcagggaaaacttactcttaggagtaggcctggctatggcaacaacactccaactcccagaggatatagagcagatggctaacggaatcgcacttggactcatggcactaaagctaataacgcaatttgaaacctaccaattatggacagccctaatctccttaacttgcagcaacaccatgtttacactcacagtggcatggagaaccgctaccctcattttggctggagtcagtttattacccgtttgtcaatcctcctccatgcgaaaaacagactggctaccgatggccgtcgcggcaatgggggtgccgcctctcccactgttcatattcagcttaaaggacacgctcaagagaagatcctggccactaaacgaaggcgtaatggcagtcggactggtgagcatcctcgcgagcagcctcctaagaaatgacgtaccaatggcgggaccgctagtagcaggagggctgctgatcgcatgctacgtgatcaccgggacctcagccgacctcaccgtagagaaagctgcggacataacatgggaggaagaggccgagcaaacgggcgtttcgcacaatctaatgattacagtggatgatgatgggacaatgaggatcaaagacgacgaaacagagaacatattgaccgtattgctcaaaacggccttactgatcgtgtcgggcgtatttccatatagcatccccgccactctcctagtctggcacacatggcagaaacaaacacaaagaagcggtgttctatgggacgtaccgagcccgccagaaactcaaaaggcagaattggaagaaggcgtctaccgaataaagcagcaggggatattcgggaagacacaagtaggtgtcggagtacagaaagaaggggtcttccacacgatgtggcacgtgacccgcggagcggtgctcacctataacggtaaaaggctggagccgaactgggcctccgttaaaaaggacctgatctcttacggtgggggttggagattatcagcacagtggcaaaagggtgaagaggtccaagtcatagcagtcgaacccggcaaaaaccctaagaacttccaaaccatgcccgggacattccagacgacaacgggagaaatcggggcgatagccttagacttcaaaccgggaacgagtgggagtcccattataaaccgagaaggcaaagtcgtcggcctctatggaaacggcgtggtaacgaagaacgggggctacgtcagcgggatcgcccagactaatgcagaaccggacggcccaaccccggagctcgaggaagagatgtttaagaagaggaaccttaccataatggacttgcatccgggaagcggaaagactcggaagtatctacccgccgtcgtacgggaagcaatcaagcggaggctaaggacgttaatactcgcccctactagagtggtggccgccgagatggaggaagccctcaaaggattacccatcagatatcaaacgaccgcaacaaagtcagaacacacgggacgggagatcgtagatttgatgtgccacgctaccttcaccatgcgcctactcagcccagtgagggtcccgaactacaacctgataataatggacgaggcccacttcacggatcctgcaagcatagcagcccggggatacatatccacacgagtaggcatgggagaagcggcagcaatcttcatgaccgcaacgcccccaggaacagcggacgcattcccccaatcgaacgccccaatacaggacgaggaaagagacattcccgaaagatcctggaacagcggtaacgagtggataacggacttcgcggggaaaaccgtctggtttgtaccctctatcaaagccggaaatgatatagcaaactgcctgaggaaaaacggcaagaaagtgatacagttatcacgcaagacattcgacacggaataccagaaaaccaaactgaatgactgggatttcgtggtcactacggatattagcgaaatgggggcaaatttcaaagccgaccgagtaatcgacccgcgccgatgcctgaaaccggttatcctcaccgacggaccagaaagagtcatactcgccggccccatgcccgtcacggcagcgtcggccgcccaacgcaggggaagagtaggtagaaacccgcaaaaggaaaacgatcagtacatcttcaccggccagcccctgaataacgatgaagaccacgctcattggacggaggccaaaatgcttcttgacaacatcaatacaccagaaggaatcatccccgcccttttcgaacccgagagagagaaaagcgccgcgatagacggagaatacaggcttaagggagaatcacgaaaaacctttgtggaactgatgcgacgcggagacctacccgtgtggcttgcccataaggtggcttccgaagggataaagtatactgaccgaaaatggtgcttcgatggtcaacgaaacaaccaaatcctggaagaaaacatggacgtcgaaatttggacgaaggagggcgagaagaagaaacttcgcccacgctggctggatgcacgaacgtacagcgaccccctcgccctaaaagagttcaaagatttcgccgccgggcggaaatccatcgcacttgacctagtaacggaaatagggcgggtaccctcacatcttgctcacagaacccggaacgcactagataatctagttatgttacacacatcggagcacggagggcgagcatatcggcacgccgttgaagaacttccagagaccatggagaccctcctactgctaggattaatgatactcctaaccggcggggccatgctattcctaattagcggtaaaggaatcggaaaaacatccatcgggctcatttgcgttatagcgtcgagtggaatgctctggatggccgagatcccgctacaatggatcgcctccgccatagtactcgagttcttcatgatggtcctgctgattcccgagccagagaagcagcgaacaccacaggacaaccaactagcctatgtggtaattggcatcctaacactagcagctatcatagccgcgaatgaaatgggcctactcgagacgacgaaacgggacctgggaatgagcaaggaaccgggagtagtgtctcccaccagctacctcgacgtcgacctgcacccggccagtgcatggaccctgtacgcagtggctacaaccgtcataacccccatgctgaggcacacaatcgaaaactcgaccgccaacgtatcgttagcagcgatcgctaaccaggcggtggtcctgatgggcctcgataaagggtggccaatctcgaaaatggacctcggcgtaccgctactggcacttggctgctacagccaggtgaatccgctgacactcaccgcggcagtattacttctaattacccattacgcaatcataggacccgggttacaagcgaaggccacaagagaagcccaaaagcggaccgcagccggcatcatgaagaacccaacagtagacggcattatgaccatagacctcgaccctgttatttacgacagcaaattcgaaaaacagctaggtcaggtcatgttactcgtcctatgcgcggtacagctcctattaatgcgtacctcctgggccctctgcgaagcactaacactcgcaaccgggccaataacaacactatgggaggggagtccgggtaaattctggaacacgacaatagcagtctctatggccaatattttcagaggcagctacctagcaggagccggattggctttcagcataatgaaaagcgtaggaacaggtaaacggggcaccggaagtcaaggcgaaactcttggggagaaatggaagaagaaattgaaccaactctcaaggaaagagttcgacctgtacaagaaatcaggtatcacggaagtcgaccgtacagaagccaaggaaggattgaaacgaggcgagacaacacatcatgccgtgagcaggggtactgccaagctccagtggttcgtcgagagaaatatggtgattcctgaaggaagagtaatcgaccttgggtgcggccggggaggctggtcctactactgcgccgggctgaagaaagtaactgaagtacgcgggtacactaaaggaggaccgggccacgaagaaccagttcccatgtcaacatacgggtggaacattgtgaaacttatgtcaggaaaagatgtattttacctcccaccggaaaagtgcgacacactcctttgtgatataggcgaatccagtccatcgccaacagtagaagagagtcgaaccattagagtattgaaaatggtcgagccttggctcaaaaataaccaattttgcataaaggtgctcaatccctacatgcccaccgttatcgagcacctggagcgcttacaaaggaaacatggaggtatgctggtacgcaatccgctcagcaggaactctacccacgagatgtactggatttcgaatggaacagggaatatagtcgcgagcgtgaatatggtatcccgtctccttctaaaccgatttaccatgacccacaggcggcccaccatcgaaaaggacgtagacttaggagctgggactcggcacgtgaacgccgaaccggagacacctaacatggacgttatcggcgagaggatcaagcgaataaaggaggaacataactcaacgtggcactatgacgacgaaaacccgtataaaacatgggcataccacggctcctacgaagtgaaagccacggggtcagcaagcagcatgatcaacggggtagttaaactactcactaaaccttgggacgtagtacccatggtgacccaaatggcaatgacagacacgaccccgttcggccaacagagagtatttaaggagaaagtcgatactcggaccccacggtcaatgcccggcacgagacgcgtgatgggcataacagccgagtggttgtggaggacactaggccgaaacaaaaagccccgactctgtacaagggaggagttcacgaagaaggtacgaacaaatgcagcgatgggggctgttttcacggaggaaaaccaatgggattcagcaaaagcggcggttgaagatgaagacttttggaagctagtcgaccgggaaagggagctccacaaactcggtaagtgcggaagctgtgtctacaacatgatgggcaaaagggaaaagaaacttggcgagtttggaaaagcgaaaggcagcagagcaatatggtacatgtggctaggggcccgctatcttgagttcgaagcactgggattcctgaacgaagaccactggttttcacgagaaaactcctacagtggcgtagaaggcgagggactgcataagttaggatacattctgagagacatcagcaaaatacctggtggcgcaatgtatgcggacgacaccgccggctgggatacgcgtatcaccgaagacgacctacacaacgaagagaaaatcacgcagcaaatggacccggaacaccgtcagcttgcaaacgcgattttcaaactgacctaccagaacaaggttgtaaaagtccaaaggccgacgccgacaggaacagtgatggatataatctcaagaaaggatcaaagggggtcaggccaggtaggtacgtacggactcaacactttcacgaacatggaagtacaattaatcaggcagatggaaggtgaaggcgtcctcagcaaggcagatctcgaaaaccctcaccttccggagaagaagataacccaatggctggaaaccaaaggagtcgaaaggctgcgtcgaatggcgatcagtggtgacgactgtgtcgtcaaaccgatagacgaccggttcgccaatgctctattagcacttaacgatatgggcaaggtgcgaaaggacatcccccagtggcaaccatcaaaagggtggcatgactggcaacaagtcccgttctgctcgcaccactttcacgaactgattatgaaagacgggcgaaagctagtagtcccatgcagaccacaagacgaactcataggtcgcgcgcgaatcagtcaaggagccgggtggtcactccgcgagacggcatgcctaggtaaagcgtacgcgcagatgtggagcttgatgtactttcaccgccgagatttaagactagcctccaacgctatatgctcagcggtgccagttcattgggtcccaacaagcaggacgacatggtcaattcatgctcaccaccaatggatgaccacggaagatatgcttacggtatggaacagagtctggatcgaagacaacccttggatggaggacaaaacgccagttaccacatgggaaaacgtcccctaccttggaaagcgtgaagaccaatggtgtgggtcgctaatagggctcacctcccgtgctacctgggcccaaaacatacctacagcgatacaacaggtgaggagcctaataggaaacgaagagttcctggactacatgccaagcatgaaaagatttcgaaaagaagaggaatcagagggggcgatatggtag

SEQ ID NO: 25932 - RNA, 9873 nt, synthetic construct
  misc_feature 1..9873: note = derived and/or modified CDS sequence (opt11) from DENV-3__EU482558__SS-prME
  source 1..9873: mol_type = other RNA
accagcctctgcttaatgatgatccttcccgcggcgctggcgttccacctcacctcgagggatggggagccccggatgatagtcggaaagaacgaacggggcaaaagcctgctgtttaagaccgcctccggtattaacatgtgcaccctcatagccatggacctgggcgagatgtgcgacgataccgtaacatacaaatgcccgcatatcacggaggtggaacccgaggacatagattgctggtgcaatctgacctcgacttgggtgacttacggaacatgcaatcaggccggtgagcaccggcgcgacaagcggtccgtcgccctcgcgccccacgttggcatggggctggacacccgaacccagacctggatgagtgccgaaggcgcctggcgccaggtggagaaggtagagacgtgggcactacgccacccggggttcaccatcctcgcgctgttccttgcccattacatcggcacatccctcacccaaaaggtcgtcatcttcatcctgttaatgctcgtcactcccagcatgaccatgcgatgcgtgggggtaggcaatcgcgacttcgtcgagggattgtccggggccacctgggtggacgtggtgctggagcacggcggatgtgtcaccacgatggcaaagaacaagcccaccctcgacatcgaactacagaagacggaggccacgcaattggcgacgctccggaaattgtgcatcgaaggcaaaattaccaatattaccaccgacagtcggtgcccgacgcagggcgaggcggtactgccggaagagcaggaccagaactacgtatgcaagcacacctatgtggaccgtgggtggggcaacgggtgtggactcttcgggaagggcagtctggtgacctgcgccaaattccagtgcctggaacccatagagggcaaggtcgtgcagtacgagaacttaaaatacactgtgatcatcactgtccatactggggatcaacatcaggtgggcaacgaaactcagggcgtcacagccgagatcaccccccaagccagcactactgaggcgatcctgcctgagtacggcacactggggctcgagtgctccccgcgcaccggcctggacttcaacgagatgatcctgctcactatgaaaaacaaggcctggatggtgcaccgacagtggttttttgacctcccccttccctggactagcggcgccaccaccgagacgccaacctggaaccgcaaagagcttctggtaaccttcaagaatgcccacgccaagaagcaggaggttgtggtgctggggtcccaggagggcgcgatgcacacagccttgacgggggcgactgagatccagaactcaggcgggacttccatattcgccggacacctgaagtgccggctgaagatggataagctcgaattgaagggcatgagctacgccatgtgcacaaacacgttcgtcctgaagaaggaggtctccgagacccagcatgggaccattttgatcaaagtggagtataagggcgaggacgtcccgtgcaagatccccttcagcaccgaggacggtcagggcaaggctcacaacggccgcctgatcacggccaatcctgtggtgaccaagaaggaggagcccgtcaacatcgaagctgaaccgccctttggggagagcaacatcgtgatcggcatcggcgacaacgccttgaagatcaactggtacaaaaagggctccagcatcgggaagatgttcgaggcgaccgcgcggggtgcccgccgtatggctatccttggcgacaccgcctgggacttcgggtccgtgggcggggtactcaactcgctgggaaagatggtgcaccagatattcgggtccgcatacacggcgctgttcagcggcgtgtcctgggtaatgaaaatcggcatcggagtgctcctgacctggatcggtctgaatagtaagaacacctccatgagcttctcctgcatcgccatcgggatcataaccctctacctaggcgctgtggtccaggccgacatggggtgcgttatcaactggaaggggaaggagctcaaatgcggaagcggtatcttcgtgactaacgaggtccatacctggaccgagcagtacaaattccaagcggacagcccgaagcgtctagccaccgccatcgcaggcgcctgggagaacggggtgtgtggcatccgcagcacgacccggatggagaaccttctgtggaagcagatcgcgaacgagttaaactacattctgtgggagaacaacatcaagctgacagttgtggtgggggacatcatcggcgtactcgagcagggcaagcgcactttgacgccccagccgatggagctgaagtactcctggaagacgtgggggaaggccaagatcgtcaccgccgaaacccaaaacagctccttcatcattgacggccccaacacgcccgagtgccccagcgcctctcgggcctggaacgtgtgggaagtggaggactacggcttcggtgtcttcactaccaacatctggcttaagctgcgcgaggtatacacccagctgtgcgaccaccggctcatgagcgccgccgtgaaggacgagcgcgctgtccacgctgacatgggctactggatcgaatcccagaagaacggttcctggaaactggagaaggctagcctaattgaggttaagacctgcacgtggccgaagtcccacacactctggagcaatggcgttctggagtcggacatgatcatacccaagagtctggccgggcccatctcccagcacaattacagacccggttaccacacccagaccgccgggccctggcacctcggcaagctggagttggattttaattattgcgagggcactaccgtcgtgatcactgagaattgcggaacccggggccccagtctccggactaccaccgtctctgggaagctgatccacgagtggtgttgccgcagctgcaccctgcccccgctgcgttacatgggcgaggatggctgctggtatggcatggagatcaggcccatcagcgaaaaggaggagaacatggtaaaatctctggtgtccgccggtagcgggaaggtagacaacttcactatgggcgtcctgtgcctcgccatcctgtttgaggaagtgatgcggggtaagttcggcaaaaagcacatgatcgctggggtgttcttcaccttcgtcctgctactgtccggccagatcacctggagagacatggcgcacaccctgattatgataggcagcaacacgtccgaccggatggggatgggtgtaacctacctcgccctgatcgccaccttcaagatccagcccttcctggctctcgggttcttcctgcgcaagctcactagccgggagaacctgctattgggcgtgggcctcgcgatggccacgaccttacagctgcccgaggacatcgagcaaatggcaaatggtatcgcactcggcctgatggcgctgaagctcattacccagtttgagacgtaccagctgtggacggcgctgatcagcttgacctgctccaacaccattttcacgctgacggttgcttggcggacagccaccctgatcctggccggggtgagcctactaccggtatgccaatccagctccatgcggaagaccgactggctccccatgacggtggccgccatgggcgtgcctcctttaccgctgttcatcttttccctcaaggacaccttaaagcgccgctcctggcccctgaacgagggggttatggccgtaggcctcgtaagcatcctggcctccagcctgctccggaacgacgtccccatggcaggccccctggtggccggcggactgttgattgcctgctacgtgataacgggaacctcagccgacctcacagtcgagaaagccgccgacgtgacatgggaagaagaggctgagcaaaccggggtgagccacaatctgatgatcaccgtcgacgacgacgggaccatgcgcataaaagacgacgagacggagaacatcctcaccgtgttgcttaagaccgcactccttatagtgtccggcatcttcccgtacagcatccccgccaccctgctcgtatggcacacttggcagaagcagacacagcggtccggagttttgtgggacgtgcccagcccgcccgaaacccagaaggccgagctggaggagggggtctaccgcatcaagcagcagggcatattcgggaagacccaggtgggggtgggtgtccaaaaagagggcgtgttccacacgatgtggcacgtgacccgaggcgccgtcctcacctacaatgggaagagactggagcccaattgggcgtcagttaaaaaggacctgataagctacggggggggttggcggctctctgcccaatggcagaagggggaggaggtgcaggtcatcgccgtggagcctggcaagaatccgaagaacttccagaccatgcccggcactttccagaccaccactggggagattggggccatcgcgctggacttcaaaccgggtacgtcaggcagccccatcataaaccgtgagggcaaagtggtcgggctgtacggcaacggggtggtgaccaagaacggcgggtacgtctccggcatcgctcagaccaacgccgagccggacggtcctacccccgaactggaggaggagatgttcaagaagcgtaacctgactatcatggacctgcaccccggcagcggtaaaacccgcaagtacctgccggccattgtgcgggaggcgattaagcgcagactccgcaccctgatccttgcgccaacccgggtggtcgccgcggagatggaggaggcactcaaagggttgcccatccgctaccaaacgacggccaccaagtccgaacacaccggccgtgagatcgtggatttgatgtgccacgcgacgttcaccatgcgtctcctgagcccagtgcgggtgccgaactataacctgatcatcatggacgaggcccacttcacagaccccgcctccatcgccgcacgtggctacatcagcacccgtgtgggcatgggagaggcggcagccatcttcatgactgccacgcctcccgggacagcagacgcctttccgcagtccaacgcccccatccaggacgaggagcgcgacattcccgagcgcagttggaactccggcaacgaatggataaccgacttcgccgggaagacggtgtggttcgtcccttccataaaggccggaaatgacatagccaactgtctccggaagaacgggaagaaggttatacaactgtccagaaagaccttcgacaccgagtaccaaaaaactaagctgaacgactgggactttgtggtgaccaccgacatatccgagatgggtgccaacttcaaggccgatcgagtgattgacccgcgcaggtgcctcaagcccgtgattttgaccgacggccccgaacgcgtcattctggcagggcccatgcctgtgacagcagcgagcgccgctcagcggcgcggccgggtggggcgcaacccacagaaggagaacgaccagtacatcttcacagggcaacccctcaacaacgacgaggatcacgcccactggacagaggcaaaaatgttactcgataacatcaatacccccgaggggatcatccccgccttgttcgagcccgaacgggaaaagtccgccgccattgacggcgaataccggctgaagggcgagtcccggaagacatttgtcgagctgatgcggcggggggatctccccgtgtggctggcgcacaaggtcgccagcgagggcattaaatacaccgaccgtaagtggtgcttcgacgggcagcggaataaccagatcctggaggagaatatggacgtagaaatttggacgaaagagggcgagaaaaagaaattacgtccccggtggctggacgcgagaacctactcggacccgcttgccctcaaggaattcaaggacttcgccgctggccgcaaaagtatcgcgctagacttagttaccgagatcggacgggtcccctcccatctcgcgcacagaacccggaacgctctggacaacctggtgatgctgcacacatcggagcacggcgggaaggcctatcgccacgccgtggaagagctgcccgagactatggagaccctgctcctgcttgggctgatgatcctgctgaccggcggcgcgatgctgttcctgatcagcggcaaggggattggcaagacgtccattggcctgatctgtgtcatcgccagctcgggcatgctctggatggcagagataccgctacagtggatagccagtgcgatcgtcctggagttcttcatgatggtactcctgatccccgaacccgagaagcagaggactcctcaggacaaccagctggcgtacgtcgtgatcggcatcctaaccttagctgcaatcatagccgccaatgagatggggctgcttgagaccacgaagagggatctgggcatgagtaaggagccgggtgttgttagtcccacctcatacctggacgtggacctccacccggcgagcgcctggaccctgtacgctgtagccaccacggtcataacgcccatgctgcggcatactattgagaactcaaccgcaaacgttagcctggccgccattgccaaccaggcggttgtcctgatgggcctggacaaagggtggccgatctccaagatggacctcggtgtgcccctgctggcgctgggatgctacagccaggtgaacccactcacgttaaccgccgccgtcctcttgttaatcacacactacgccatcatcggaccgggactccaggccaaggcgacccgcgaggcccagaaacggaccgccgccgggatcatgaagaacccgaccgtggatgggatcatgaccatcgacctggaccccgtgatctacgactccaagttcgaaaaacagctggggcaggtcatgctcctggtcctgtgtgccgtgcaactactgttgatgaggacttcctgggcgctctgcgaggctctgacgctggcaaccgggcccataacaaccctctgggaaggctcccccgggaaattctggaacacgaccatcgcggtcagcatggcgaacatctttcgggggagctacctcgcaggggccggccttgccttctccatcatgaagtccgtagggactggcaagcgcggcaccgggagccagggcgaaaccttgggagagaagtggaagaagaagctgaaccagctgagccggaaggagttcgacttgtacaagaagtccggcatcactgaggtcgaccgaaccgaggccaaggaggggctaaagagaggagaaatcacacaccacgcggtgagccgcgggtccgccaagctacaatggtttgtggagaggaacatggtgatcccggagggtcgtgtcatcgacctcggctgtggccggggcgggtggagctactactgtgccggcctgaagaaggtgaccgaagtgcgcggctacacgaagggggggcccgggcatgaggagcccgtgcccatgagcacctacggctggaacatcgtgaagctgatgtcaggtaaagacgtgttctacctcccccccgagaagtgcgacaccctgctgtgtgacatcggcgagtccagcccctcccctaccgttgaggagtctcggacgatccgcgttctgaagatggtggagccgtggctcaagaacaaccagttctgcatcaaggtcctgaacccctacatgcccaccgtgatcgagcacctggagcgccttcagcggaagcacggcggaatgctggtgcgcaatcccctgtcccggaacagcacccacgagatgtactggatctccaacggcaccgggaacatcgtcgctagcgtgaacatggtatcccgcctcctgctgaatcggttcacgatgacacacaggcggccgaccattgagaaggacgtagatctcggcgcgggcaccagacatgtaaacgcggagcccgaaacgcccaatatggacgtaatcggggagcgcatcaagagaattaaggaagagcacaactcaacctggcattatgacgacgagaacccatacaagacctgggcctatcatggatcatacgaagtcaaggccacggggagcgcctccagcatgatcaacggagtggtcaagctgctgacgaagccttgggacgtggtgcccatggtcacccagatggccatgaccgacacaacgcccttcgggcagcagcgggtgttcaaggagaaggtggacacccgcaccccacggagcatgccgggcacccgccgggtcatgggcatcaccgcagaatggttatggcgcaccctagggcggaacaagaagcccagattgtgcacccgagaggagtttacgaagaaggtacgaacaaacgccgcgatgggggcagtgtttaccgaggagaaccagtgggattccgcgaaggccgccgtagaggacgaggacttctggaagctcgtggaccgggaacgggaactgcacaagctcggtaaatgcggcagctgcgtgtacaacatgatggggaagagggagaagaagctcggcgagttcggcaaggctaaggggtcacgagccatttggtacatgtggctgggggcgcgctacctagagttcgaggccttggggttccttaacgaagatcactggttcagccgcgagaacagttatagcggcgtagagggggagggcctgcacaaactgggctacatcctgcgcgacatatccaagatccccggtggggccatgtacgctgacgacaccgccgggtgggatacccggatcactgaagacgacctgcacaatgaggagaaaattacccagcagatggaccctgagcaccgccagctcgcgaacgccatcttcaagctgacatatcagaacaaggtggtgaaagtacagcggcccacccccaccggcacagtgatggatatcatctcacgaaaggaccagcggggctccggccaggtgggcacatacggactgaacaccttcaccaacatggaggcccaactcatccgccaaatggagggcgagggtgtcctaagcaaggccgacctggagaacccccatctgccagagaagaagatcacgcagtggctggagactaagggcgtggagaggctgaagagaatggccatctccggcgacgactgcgtcgtcaagcccatcgacgatcggttcgccaacgccctcctggccctgaacgacatgggcaaggtgcgcaaggacatccctcagtggcagccttctaaaggctggcacgactggcagcaagtcccgttctgctcccatcattttcacgagctcattatgaaggacggacggaagctggtcgtcccatgccgcccccaggacgagctgattggccgggcccgcatcagccagggggctggctggagcctccgggagacagcgtgcctgggcaaggcatacgcccagatgtggtctctgatgtacttccaccgccgagacctccgactggcctccaacgcgatctgcagcgccgtgccggtccactgggtgccgacctcccgcacgacctggagcattcacgcccatcaccagtggatgaccaccgaggatatgctgacagtctggaaccgggtctggattgaggataacccctggatggaggacaagacccccgtaaccacctgggagaacgtgccctaccttgggaagcgcgaggatcagtggtgcggctccctgatcggactgacgtcccgcgcaacatgggcgcagaacatacctactgcaatccagcaggtccgctcgctcattggcaatgaggagttcctggactacatgccctccatgaagcggttccgcaaggaggaggagagcgagggggccatctggtaa

SEQ ID NO: 25933 - RNA, 9873 nt, synthetic construct
  misc_feature 1..9873: note = derived and/or modified CDS sequence (opt11) from DENV-3__EU482563__SS-prME
  source 1..9873: mol_type = other RNA
accagcctttgccttatgatgattctgcccgcagccctagccttccatctcacctcgagggacggggagccccggatgatcgtcgggaagaacgaacgcggcaagtcccttctgttcaagaccgcctccgggatcaacatgtgcaccctaatcgcgatggaccttggcgagatgtgcgacgacaccgttacctacaagtgcccacacatcgccgaggtcgagcccgaggatatagactgctggtgtaacctgacctctacctgggtgacatatgggacttgcaaccaggcaggcgagcaccggcgtgacaagcggagtgtcgctctcgcgccccatgtgggcatggggctggatacgcgcacccagacatggatgagcgccgaaggggcctggaggcaagtggagaaagtcgagacgtgggcactgcgccacccggggttcacgattctcgccctgttcctggcccactacatcggcacctccctcactcaaaaggtggttatctttgtcctgcttatgctcgtgacccccagcatgacgatgcggtgcgtgggggtaggcaaccgtgactttgtggaaggtctgtctggagccacttgggtggacgtcgtgctggagcacgggggttgcgtgactacgatggccaagaataagccgacgcttgacatcgagctacaaaagaccgaggccacgcagttggccaccctccggaagctttgcatcgaaggaaagatcacgaacatcaccaccgatagcaggtgcccaacccaaggagaggcagtcctgccggaagagcaggaccagaactacgtgtgtaagcacacgtacgttgatagagggtggggaaatgggtgcggactattcgggaagggatcgctagttacttgcgcaaagtttcagtgcctggagccgatcgaagggaaggtggtgcagtacgagaacctcaagtatacagtcataataactgttcacacgggggaccagcaccaggtaggtaacgaaacccagggagtgaccgccgagataactccccaggcgagcaccaccgaagcaatcctgcccgagtacggcacactagggctagaatgcagtcctcgcacagggctggacttcaacgaaatgattctgttaaccatgaaaaataaagcctggatggtgcaccggcaatggtttttcgaccttcccctgccgtggacgagcggcgccaccaccgaaacacccacttggaaccgcaaggagttgcttgttacgtttaagaacgcacatgctaagaaacaagaggtcgtggtgctcggctcccaggagggcgccatgcacactgcactcaccggggcaacggaaatacagaacagcggagggacatccatattcgccggacatctgaagtgtcggctgaagatggacaaactcgaacttaagggcatgagctacgcaatgtgcaccaacacctttgtgctgaaaaaggaagtgtcggagacccagcacgggactatcctgatcaaagtcgagtataagggggaggatgccccgtgcaagatccccttctcgacagaggacggccagggcaaagcccataacggcaggctgatcaccgcgaaccctgtggtgacgaaaaaggaggaacccgttaacatcgaggcggagccgcccttcggggagagcaacatcgtgatcggcatcggggataatgcccttaagatcaattggtacaagaagggctcgagcatcgggaaaatgtttgaggcaaccgcccggggcgcgcgccgtatggcgatcttaggcgacaccgcgtgggacttcggttcagtgggcggagtactcaatagcctcggcaagatggtacaccaaatcttcggaagcgcgtacacagcactgttcagcggcgtatcgtgggttatgaagatcggcattggggtgctcctgacgtggatcggcttgaacagcaagaacacctcaatgagcttctcctgcatcgcgataggaatcatcaccctttatttaggcgcggtggtacaagccgacaccggctgtgtaatcaactggaagggcaaagagttaaagtgcggcagtggtatcttcgtgacgaacgaggtccacacgtggactgagcagtacaagttccaagccgactcccccaagcgtcttgccactgccatcgcgggggcctgggagaacggggtgtgcggtattcgttccacgacccggatggagaacctgctgtggaaacaggtcgcaaacgaactgaactacattttatgggagaacaatataaagctgacggtcgttgtcggagacatcattggcgtattagagcagggcaagcgtactctgacgccccaaccaatggaactgaaatactcgtggaagacctgggggaaggccaagatcgtaacagcggaaacccagaactcctccttcatcatcgatggccccaatacgcccgagtgtccctccgcctcccgcgcatggaacgtgtgggaagtcgaggactatgggttcggtgttttcaccaccaacatctggctcaagctgcgtgaggtgtatacccaactatgcgatcaccggttaatgtcagccgcggtcaaggacgaaagagcggtgcacgcggatatgggctactggatcgagtcccagaagaacggttcctggaaactggaaaaggcatcactgatcgaggtaaagacttgtacctggcccaagagccacacactctggtcaaacggcgttttagagtctgacatgatcatccccaagagcctggcggggcccatctcccagcacaattaccggccaggctaccacacacaaaccgccgggccctggcacctcggcaagctagagctggactttaactattgtgagggcaccaccgtagtgataaccgagaactgcggaaccaggggacctagcttacggacaacaacggtctcaggaaagctgatacatgaatggtgctgccgcagctgcaccctgccccctctccgatacatgggcgaggatgggtgctggtacggtatggagattagacccatatccgagaaggaggagaacatggtgaagagcctggtcagcgcgggctctggaaaagtagataacttcactatgggagtactctgcttggctatcttgttcgaggaggtgatgcggggtaaattcggtaagaagcacatgatcgccggggtcttcttcactttcgttctgcttctgtcaggccagatcacatggcgcgacatggcccacaccctgattatgatcggtagtaacgcgtctgaccgcatggggatgggcgtgacctacctcgccctgattgccaccttcaagatccagcccttcctcgcgctagggtttttcctgcgtaaattgacatcacgggagaacttactgttgggcgtgggcttggccatggcaaccacgctgcagctgcccgaggatattgagcagatggccaacgggattgctctcggtttaatggccctgaagcttatcacacagttcgagacctaccagctgtggaccgccttaattagcctaacatgctccaacacgattttcacgctgaccgtcgcttggcggacggcgacactgattctcgcaggagtcagcctgctccccgtctgccaatcctcgagtatgaggaagtccgattggctgccaatgacagttgccgcgatgggcgtgccgcccctaccgttgttcatcttctcgctaaaagacacgctgaaacgccgcagctggcccctgaacgagggggtgatggcagtgggccttgtatccatcctggccagctccctgctcagaaacgacgtacccatggctggtcccttggttgctggcgggctgctcatagcatgctacgtaattacggggacctcagcggaccttacagtggagaaggccgccgacgtgacctgggaagaggaggcagaacaaacgggcgtctcccacaacctgatgattaccgtggacgacgatgggaccatgcgcattaaggacgacgagaccgagaacatcttaaccgtgctcctgaagacggcactgctgattgtgtcaggcatattcccgtacagcattccggcgaccctgctcgtatggcacacctggcagaagcaaacacggcgtagcggggtgctttgggacgtacctagcccaccggagactcagaaagccgaactggaagagggggtctatcggatcaaacagcaaggcattttcggcaaaacccaggtaggcgtcggggtgcagaaggagggcgtctttcacaccatgtggcacgtcactcgcggggcggtcttgacctacaacgggaaaagattggaacccaattgggccagcgtgaagaaggacctgatctcctacggcgggggttggcgtctcagcgcgcagtggcagaagggggaggaggtccaggtgatcgccgtggagccaggcaagaaccccaagaacttccagaccatgcccggcacctttcagaccacgaccggcgaaatcggcgccatcgccctggatttcaaacccgggaccagcggctcgccaatcatcaaccgggagggcaaggtggttgggctgtacggtaatggggtagtcaccaagaacggagggtacgtgtcggggatcgctcaaacgaacgccgaaccggacggccccacccccgagcttgaggaggagatgttcaagaaaaggaatctcaccattatggacctgcaccctgggtccggcaagaccaggaagtatctgccggcaatcgtgcgtgaagccatcaagcgacgcctccggactctcatcctggcgcccaccagagtagtcgccgcggaaatggaggaggccctcaaaggactgcccatccggtatcaaaccacagccacaaagagtgagcacaccggcagagagattgttgaccttatgtgccacgccacatttacgatgcggctcctgtcccccgtccgcgtgccaaattacaatctgatcatcatggacgaggcccattttacggatcccgcaagcatcgccgcgaggggctacatctcgacacgcgttggcatgggcgaggccgctgccatctttatgaccgccaccccgcccgggacggccgatgctttcccgcaaagcaacgcgcctatccaagacgaggagcgcgacatcccggagcggtcgtggaatagcggcaacgagtggatcactgacttcgcggggaaaaccgtgtggttcgtgccctctatcaaggccgggaacgacatcgccaattgcctccgcaagaatggtaagaaggtgatccaactgtcccggaagaccttcgatacggagtatcagaagaccaagctgaatgactgggatttcgtggtgaccacggatatctctgagatgggcgccaacttcaaagctgaccgcgtgatcgacccacggagatgcctcaaacccgtcatccttaccgatggcccagagcgggtgatcttggcggggccaatgcctgtgacagcggcatccgccgcgcaacgtcggggccgcgtggggcgaaatccccagaaggagaatgatcagtacatcttcaccggacagcccctcaacaatgacgaggaccacgcacactggaccgaggccaagatgctgctggataatatcaacacgccagaggggataatcccggctctgtttgaaccggaacgtgagaaatcagcggcgattgacggtgagtaccggctgaagggcgagtcaaggaagacgtttgttgagctcatgcggcgcggggacctccccgtttggctggcccataaggtggcttccgaggggattaagtacaccgaccggaaatggtgctttgacggccagcgaaacaaccaaatcctggaggagaacatggacgtggaaatctggacgaaagagggcgagaagaaaaagctgaggccccgctggctcgacgcaaggacatatagcgaccccctagcgctcaaggaattcaaagactttgccgccggcaggaaatccatcgcccttgacctggtcacggaaatcgggcgtgtgccctctcacctggcgcaccgaacgcgtaatgccctcgacaacttggtgatgctccacaccagcgagcatggcgggaaagcgtacaggcacgccgtcgaggaactacctgaaaccatggagacgctgctcctgctcgggctcatgatcttacttactgggggtgcaatgctgttcctgatatcgggcaaggggattggcaagacctccatcgggctgatctgcgtgatcgccagttcgggaatgctttggatggcggagatcccactgcagtggatagcctcggccatcgttcttgagttcttcatgatggttctcctgattcccgaacccgagaagcaacgcacgccacaggataatcagctggcctacgtggtgatcgggatcttgacgctggctgcgattatcgccgcgaacgaaatgggactgctcgagaccactaaacgggacctgggtatgagcaaggagcctggggtcgtgtcccccacttcatacttggacgtggacctccaccccgcgtccgcatggactctatacgcggtcgcaaccacggtcataacccccatgttacggcacaccatcgaaaacagcaccgccaacgtgtccctagccgcgatcgcgaaccaggctgtggtcctcatggggctggataaaggatggccaatctcgaagatggacctcggcgtgcccttgctggccctagggtgctactcccaggtcaaccctctcaccctgacggctgcggtgctcttattaataacgcactacgccatcatcggcccgggcctccaggcaaaggccacccgggaagctcagaaacgcacagcggccggtatcatgaagaatcccactgtggacggcattatgaccatcgacctggacccggtgatttatgacagcaagttcgagaagcagctgggccaggtgatgctactagttttatgcgccgttcagcttctactcatgagaacatcctgggctctctgcgaggcgttaacgctggccaccggccccataacgactctgtgggagggcagccctgggaagttttggaacaccactatcgcggtgagtatggcgaacatattccggggaagctatctggcgggagcaggcctggccttctccatcatgaagagtgtggggacgggcaaacggggcacagggtctcagggtgagaccctcggcgaaaaatggaagaagaaactgaatcaactgagtcgcaaagagttcgacctttataaaaagtcaggtataaccgaggtcgaccgaaccgaagccaaggaggggctaaagcggggagagataacccaccacgcggtaagccggggctctgccaagttgcagtggttcgtggagcggaacatggtcattcccgaggggcgagttatcgacctcggctgcgggcgcggcggatggtcgtactactgtgctggactgaaaaaggttaccgaagtccgaggctacaccaagggcgggccggggcacgaggaaccggtgccgatgtccacctacggttggaacatcgtgaaattaatgtccgggaaggacgtcttctacctaccgcccgagaagtgcgatacgctgctgtgcgacatcggcgagtcctcccccagccccaccgtagaggagtcccgcaccatccgcgtgctgaagatggttgaaccctggctcaaaaataatcagttctgcataaaggttttgaacccctacatgcccaccgtgatcgaacacctggaacggctccaacgcaagcacggagggatgcttgtccggaacccattgagccgcaattccacgcacgagatgtactggattagcaacggcaccggcaacatcgtggcctcggtgaatatggtctcacgactcctgctgaatagattcaccatgacccaccgacgcccgacgatcgagaaagacgttgatctcggtgccggcactcggcacgtgaacgccgagcccgagacgcccaacatggacgtcatcggggagaggatcaagcggataaaggaggagcataacagtacctggcactacgacgatgaaaacccgtacaagacgtgggcctatcacggctcctatgaggtgaaggcgaccgggtcggccagctctatgatcaatggagtcgtgaagctgctgaccaaaccctgggacgtggttcccatggtgacgcagatggcgatgacagataccacccccttcgggcagcagagagttttcaaagagaaagtagacacaagaactccgcgctccatgcccggcacccggcgcgtgatgggcatcacggccgagtggttatggcggacgctggggcgtaacaagaagccccgcttatgcacacgcgaagagtttaccaagaaagtgcgaaccaatgcggcgatgggcgccgtgttcactgaggagaaccagtgggacagcgccaaggccgcagtggaggacgaagatttctggaaactcgtcgatcgggagcgcgagctgcacaagcttgggaaatgcggttcatgcgtctacaacatgatggggaaacgggaaaaaaagttaggtgagttcgggaaggccaaggggtcacgtgccatctggtacatgtggctgggcgccaggtacttggaatttgaggcacttgggtttctgaacgaggatcactggttttcccgcgagaatagctactccggcgtggagggggaaggactgcacaagctcggctacatcctgcgagacatcagcaaaatccccggtggggccatgtacgcggacgacacggccgggtgggacacacggattacggaggacgacctccacaacgaggagaagattacccagcagatggacccggaacaccgccagttagctaacgccatcttcaagctaacctaccagaacaaggtggtaaaggtacaacgtccaacccccaccggcaccgtgatggacataatctcgcgcaaggaccagcgagggtcgggccaggtcggcacctatggtctcaacacgtttaccaacatggaggcgcagctcatccggcagatggagggggagggagtactgaccaaggcggacctggagaaccctcatctcagcgagaagaagataacccaatggctagagacgaaaggggtcgagcgcctgaaacggatggcaatctcgggggatgattgcgtagtgaaacctatcgacgaccgcttcgcaaacgccctgctggcgttaaacgatatggggaaggtgcggaaggacatcccccaatggcagccttccaagggttggcacgactggcagcaggtccccttctgcagccaccactttcacgagttgatcatgaaggacgggcggaaactcgtagtgccatgccggccccaggatgagttaatcggccgcgcacgcatctcccagggggccggatggtccctccgcgagacggcatgtctgggaaaggcttacgcccaaatgtggtcactaatgtatttccacaggcgagacctgcgcctggcaagcaacgccatctgctctgcagtcccagtgcactgggtgccaacctcgcgaaccacatggtccatccatgcacaccatcagtggatgacgactgaggacatgttgaccgtctggaaccgcgtgtggatcgaagacaacccatggatggaagacaaaacgcccgtaaccacctgggagaacgtcccctatctcggtaagcgggaagaccagtggtgcggatcccttatagggttaaccagccgcgccacgtgggcccagaacatccctaccgcaatccaacaagtacggtccctcattggaaacgaggagtttcttgattacatgcccagtatgaagcgcttccggaaggaggaggaaagcgagggggccatatggtga

SEQ ID NO: 25934 - RNA, 9873 nt, synthetic construct
  misc_feature 1..9873: note = derived and/or modified CDS sequence (opt11) from DENV-3__EU529696__SS-prME
  source 1..9873: mol_type = other RNA
accagcctctgcctcatgatgatcctgccggccgccctggcattccatctcaccagccgcgacggtgagccccggatgatcgtggggaagaacgagcgcggcaagagcttgctgtttaagacagcgtctggaatcaacatgtgtaccctgatcgccatggacctgggcgagatgtgcgacgacaccgtcacctacaaatgcccacatatcacggaggtcgagcccgaggacattgattgctggtgtaatctaaccagcacctgggtgacctatgggacatgcaaccaggccggcgagcaccgccgcgacaagcgaagtgtggccctcgcgccgcacgtcgggatggggctcgacactcgcacgcagacctggatgagcgccgagggcgcttggcgccaggtggaaaaagtcgaaacgtgggcactgcgccaccccgggttcaccatcctcgccttgttccttgcccactacatcggcacctccctcacacagaaggtggtgatcttcattttgctgatgctggtcacgccaagcatgacgatgcggtgcgtgggtgtaggcaaccgagacttcgtcgagggcctgtctggggccacctgggtggacgtggtcctggagcacggcggctgcgtcactaccatggccaaaaataaacccaccctcgacatcgaactgcagaagaccgaagccacccagctagcgacgctccggaagctgtgcattgagggcaagatcaccaacatcaccactgatagccgctgcccaacgcagggcgaggcagtgctgccggaggagcaagaccagaattacgtctgtaagcacacttatgtggatcggggctggggtaacggttgcggcctcttcgggaaggggtctctggtgacatgcgccaagttccaatgcctggagcccatcgagggcaaggtcgttcaatacgagaacctcaagtacaccgtgattatcactgtccacaccggcgatcaacatcaggtgggcaacgagacccaaggggttaccgccgagatcacgccccaagcctctacaacggaggctatcctgcccgagtatggcactcttggtcttgagtgctccccccgaaccggtctggacttcaacgaaatgatcttactcacgatgaagaacaaggcttggatggtgcatcggcagtggtttttcgacctgcccctgccatggacctcgggcgcaaccaccgagacccccacgtggaaccgcaaggaactcctcgtgacattcaaaaacgcgcacgccaagaagcaagaagtcgtggtgttagggtcccaggaaggcgcgatgcacacagcccttacgggtgctaccgagattcagaactcaggcggcacctcgatcttcgcgggtcacctaaagtgccgactgaagatggacaagctagaactaaagggcatgagctacgccatgtgcaccaacacattcgtcctaaagaaggaggtgtcggaaacccaacacgggacgatcctcattaaagtagagtataagggcgaggacgcgccttgtaaaatccccttcagcaccgaggatgggcaaggcaaggcccataacggccgactgatcacagccaaccccgtcgttaccaagaaggaggagcccgtaaacatcgaggccgagccgcccttcggggagagcaacatcgtcatcggcatcggggacaacgcgcttaagataaactggtacaagaagggctccagcatcgggaagatgttcgaggcgaccgctcggggggcacgccggatggctatattaggcgacaccgcttgggacttcgggtccgtgggcggggtgctcaacagcctagggaagatggtccatcagatcttcggttccgcctacacggccttgttcagcggggtgtcgtgggtaatgaaaatcggcatcggcgttctcctgacctggatcggtctgaacagcaagaacacgagcatgagtttctcctgtatcgccatcggggtaatcaccctctacctaggcgcagtggtccaggcggacatggggtgcgtgatcaattggaagggcaaggagcttaagtgtggcagcggaatcttcgtgactaacgaggttcacacctggaccgagcaatataaattccaggcagactccccaaagcgactcgccacggcaatcgccggagcttgggagaacggggtgtgcggcatccgatctacaacccggatggagaatttgctgtggaaacagatcgcaaacgagctcaactatatcctatgggaaaataacatcaagctgaccgtggtcgttggggacatcatcggcgtgctcgaacagggcaagaggaccttgacgccccagccgatggaactgaagtactcctggaaaacctgggggaaagccaagattgtgacggcggagatccagaacagctccttcatcatcgacggccccaacaccccagagtgccccagcgcgagtcgggcttggaacgtgtgggaagttgaggactacgggttcggcgtgttcacgaccaacatctggctcaaactgcgggaggtgtacacccaactgtgcgatcaccggctcatgtccgcggcggtgaaggacgagcgggccgtacatgccgacatgggctactggatcgaaagccagaagaatgggtcctggaagttggagaaggccagcctgatcgaggtaaagacctgcacctggccgaaatcccacacgctctggtctaacggcgtgcttgagtcggacatgatcattccgaagagcctagccgggccaatctcccagcataactaccggccgggctaccacacccagaccgccgggccctggcacctagggaagctagaccttgacttcaactattgcgagggcacaacggtcgtgatcaccgaaaactgcgggactcgcggccccagcctccggacgacgactgtgtccggtaagctgattcacgaatggtgctgcagaagctgcactctgccacccctccggtacatgggcgaggacgggtgctggtacggcatggagattagaccaatctccgagaaggaggaaaacatggtcaagagcctagtgtccgccggcagcgggaaggtcgacaacttcaccatgggtgtcttatgtttagcgatcctgttcgaagaggtgatgagagggaaattcggcaagaagcatatgatcgcgggggtgttcttcacgttcgtcctgctcctgtcaggccagatcacctggcgcgatatggcccacaccctcatcatgatcggcagcaacgcatccgacaagatggggatgggcgtcacatacctcgccctgatcgcgaccttcaagatacagcctttcctggccctcggtttcttcctaaggaaattaaccagcagggaaaacctcctgttgggcgtgggcctcgctatggcgacaaccctgcagctgcccgaagatatcgaacagatggcgaatgggattgccctcggcttaatggccttaaagctaatcacgcagttcgagacctaccaattatggaccgccttgatctctctgacctgctccaacacgatgttcaccctgaccgtagcctggcggaccgctacgttaatccttgccggggtgtcgctgctgccggtctgccagtccagctccatgcgtaaaacggactggctcccaatggccgttgccgccatgggcgtgccacccttaccgcttttcatcttcagcctcaaagataccctgaaacggcggtcctggcccctgaatgagggagttatggcggtggggctcgtgagcatcctggcgtccagcctgctccgcaacgatgtccccatggccggcccacttgtggccgggggcctgctcatcgcctgctacgtgataaccggtactagcgccgacctgaccgtggagaaagccgccgacatcacttgggaggaggaggccgagcaaacaggtgtgagccataacctaatgatcacggtggacgacgacgggacaatgcggatcaaagatgacgagaccgagaacatactcaccgttctactgaaaaccgcactcctgatcgtttctggagtgttcccttatagcattccagcgacactgctagtttggcatacctggcagaagcagactcagagatccggcgtgctgtgggacgtgccttcgccaccggagacccagaaggcagagctcgaggagggagtttaccgtattaagcagcaggggatctttgggaagacccaagtaggcgtcggggtccagaaggaaggcgtgttccacaccatgtggcacgtgacccgcggcgccgtcctcacctacaatgggaagcgcctggagcccaactgggctagtgtgaaaaaggacctgatcagctacggcgggggctggcgcctgtccgcgcagtggcagaaaggggaggaagtgcaggttattgccgtggagccgggcaagaatcctaaaaatttccaaaccatgcccggcaccttccaaacaaccacgggggagatcggcgccatcgccttagactttaagcccggcaccagcggcagccccatcattaacagagaaggcaaggtagtcgggttgtacggaaacggggtagtgacgaagaacggcgggtacgtctccggcatcgcccagactaacgcggagccggacggacctacgcccgagctagaggaggagatgttcaaaaaacggaatttgactataatggacttgcaccccgggagtggcaaaacgcgaaagtacctgcccgcagtggtccgcgaggccatcaagcggcgcttgcggacgctcatcctggcccccacgcgcgtcgtcgccgcggaaatggaagaggcgttgaaggggctacccatccggtaccagactaccgcaaccaagtccgaacacacgggccgcgaaattgtggacctgatgtgccacgcaaccttcaccatgcggttactgagccctgtcagagtgccaaactacaacctgatcattatggatgaggcccacttcacggaccctgcttccatcgccgcccgcgggtacataagcacgcgcgtgggcatgggagaggctgccgctatctttatgactgccacgccgcccgggacggctgacgccttcccgcagtccaatgcgcctatacaagacgaggagcgggacatcccggaacgctcgtggaactccggtaacgaatggatcacggactttgccgggaaaaccgtttggttcgtgccttccataaaagcaggcaacgatatcgccaactgcctccggaagaacgggaagaaggtgatccagctgtcccggaagacctttgataccgagtatcagaagacgaaattaaatgattgggacttcgttgtaacgaccgacattagcgaaatgggcgcgaacttcaaggcggatcgtgtcatagacccacggcggtgcttgaagccagttatactgaccgatggccccgagcgggtcatcctggccgggcccatgccggtaaccgccgcctccgccgcgcagaggcgcggcagggtcgggagaaacccccagaaggagaacgatcagtacatctttactggccagcccttaaacaacgacgaagaccacgcccactggacggaggccaaaatgctgctggacaacatcaatacacctgaggggatcatccctgccctcttcgagccggagcgcgagaaatccgcggccatcgacggcgagtaccggctgaaaggggagtcccgcaaaaccttcgtggagctcatgcggagaggcgacctgcccgtatggttggcacataaggtagcgagcgagggcattaagtacaccgaccggaaatggtgtttcgacgggcaaaggaacaaccagatcctggaggagaacatggatgtggagatctggaccaaggagggtgagaagaagaaactccgtccccgctggctggacgcccggacctattccgatccgctggccctcaaggaattcaaggacttcgccgcgggacgcaagagcattgccttagacctggtaaccgagatcggtcgcgtgccctcccacctcgcccatagaacccgcaatgcgctggacaacctagtgatgttgcatacaagcgagcatggcgggcgggcctaccgccacgcagtcgaggaactgcccgagaccatggagaccttactcctgctgggcctcatgatactgctgactggcggagcgatgctgttcctgataagcggtaaagggatcggcaagacctccatcgggctgatctgcgtcatcgccagcagcggcatgttatggatggcggaaatcccgctacaatggatcgcgtcggcaatagttttagagttcttcatgatggtactcctcatcccggagcccgagaaacaacggacgccccaggataaccagctggcctacgtggtgataggtatcctcacactggccgcgatcatcgcagccaacgagatgggcctgttggagacgaccaagcgcgacttaggcatgtctaaggagccgggggtcgtgtcccccacatcgtacctggacgtggacctacaccccgcatcagcgtggaccctgtacgcagttgccactaccgtgatcacccctatgctgcggcacaccatcgagaattccacggccaacgttagcctcgctgcgatcgccaatcaggcggtcgttctgatggggttggacaaggggtggccgatatccaagatggacctcggcgtgcctctgctggccctcgggtgctacagccaggtaaacccgcttaccctaaccgccgctgtgctgctgttgatcacacactacgccatcatcggccctggtctccaggccaaggccactcgcgaagcccagaaacggactgcggcagggataatgaagaatccaacagtagatggcatcatgaccatagacctggatcctgtcatctacgactcgaaatttgaaaagcagctaggccaggtgatgctcttggttctgtgtgccgtccagctcctgctgatgcgcacttcatgggccctctgtgaggcgctgaccctggccacgggccccatcaccacgctctgggagggctccccaggaaagttctggaataccaccatcgcggtcagcatggcgaacatcttccggggctcctatctggccggggcgggcttggccttcagtatcatgaagtccgtaggaaccggcaaacgcggcactgggagccaaggcgagaccctcggggaaaaatggaagaagaaactgaaccagctgtctcggaaagagttcgacctctacaagaagtccgggatcacagaggtcgatcgcactgaagccaaggaggggctcaagcggggagagacaacacaccacgccgtgtccagaggcaccgcgaagttgcaatggttcgtggaaaggaacatggtcatcccggaggggcgcgtgatcgacctcggctgcggaagaggcgggtggtcctactactgcgctggcttgaagaaggtcactgaggtcagaggctacacgaagggcgggccaggtcacgaggaacccgtgccaatgagcacgtacggctggaacatcgtgaagctgatgagcgggaaggatgtcttctacctccctcccgagaagtgtgataccctgctgtgtgacatcggcgagtcgtccccatccccaaccgtggaggagagtagaaccatcagagtgctcaagatggtcgagccttggctgaagaataaccaattttgcatcaaggtgctgaacccctacatgcccactgtcatcgagcatctggagcgcctgcaacggaaacatggcgggatgctggtccgcaaccctcttagccgtaactccacccacgagatgtactggatcagcaacgggaccggcaatattgtggcctccgttaacatggtcagccgcttgttactgaaccggttcaccatgacgcaccgccggccgaccatagagaaggacgtggacctcggcgccggcacccgccacgtgaacgccgagccagagacccccaacatggacgttattggggagcggatcaagcgcatcaaggaggagcacaactccacctggcactatgacgacgagaacccatacaagacctgggcctaccacggcagctacgaggtcaaggcgaccgggtcggctagctccatgattaatggcgtcgtgaagcttttaaccaagccctgggacgtagtcccgatggttacgcagatggccatgaccgataccactccattcgggcagcaacgggtgttcaaggagaaggtcgacacgcgcaccccgaggagcatgcccggcacacgcagggtgatgggaattacggcggagtggctatggcggacactggggcggaacaagaagccaagactgtgtacccgggaggagttcaccaagaaggtgcgcactaacgcggccatgggcgccgtgttcacggaggagaatcagtgggacagcgccaaggccgcggtggaggatgaggatttctggaagctcgtagaccgcgagcgtgagctgcacaagctgggaaagtgcggctcctgcgtttacaatatgatgggaaagcgggaaaaaaaacttggcgagttcggtaaggccaaaggatcacgggccatatggtacatgtggctgggcgcccgctatctggaatttgaggcgctcgggttcctgaatgaggaccactggttctcccgggaaaacagctactccggcgtggagggggaagggctacacaagctgggctacatcctgcgcgacatcagcaagatccccgggggcgctatgtatgccgacgacaccgcggggtgggacacccggatcaccgaggatgatctgcacaacgaggagaaaatcacgcagcagatggaccctgagcaccgacagctcgccaacgccatttttaagctgacgtatcaaaacaaggtggtcaaggtgcagagaccgactcccaccggcacggtgatggacatcatatcacggaaggaccagcgggggagcgggcaggtcggcacgtatgggctgaacaccttcactaacatggaggcgcaactcatccgccagatggaaggcgagggagtgctgtccaaggccgacctagagaatccccacttgccggagaagaagattacccaatggctggagacaaaaggcgtggagcgtttacgcagaatggccatcagcggcgacgactgcgtcgtgaagcccatcgacgacagattcgcgaacgctctcttggcactgaacgacatggggaaggtcagaaaggacatcccccagtggcaacccagtaagggctggcatgattggcagcaggtcccgttctgcagccatcacttccacgagctcatcatgaaagacgggcgaaagctggttgtgccatgccggccccaagacgaactgatcggacgggcgcggatctcccagggggccggctggtctcttcgcgagaccgcctgcctgggcaaggcgtacgcccaaatgtggtctctgatgtacttccacagacgggacctccgccttgccagcaacgcgatctgctctgcggtccctgtgcactgggtcccgacctcccggaccacttggtccattcatgctcatcaccagtggatgacgaccgaggacatgctgaccgtctggaatcgcgtgtggatcgaagataacccctggatggaggacaaaacgcccgtgaccacctgggaaaatgtcccctatcttgggaagagagaggaccagtggtgcggtagcctcatcgggttgaccagccgcgccacctgggcccagaacatcccgacagcaatccaacaggtccggtcgctcataggcaacgaggaattcttagactacatgcccagcatgaagcgcttcaggaaggaggaggagagtgagggggccatctggtaa

SEQ ID NO: 25935 - RNA, 9873 nt, synthetic construct
  misc_feature 1..9873: note = derived and/or modified CDS sequence (opt11) from DENV-3__EU529697__SS-prME
  source 1..9873: mol_type = other RNA
accagcctttgcctcatgatgatcctgcccgccgccctggcgtttcacctcacgtcccgggacggggagccccggatgatcgtggggaagaacgagcgcggcaagagcctccttttcaagacagccagcggtatcaacatgtgtaccctcatcgccatggacctcggagaaatgtgtgacgacaccgtgacctacaagtgtcctcacatcgccgaggtggagccggaggacatagattgctggtgtaatctgaccagcacctgggtaacatacgggacctgcaaccaagcgggcgagcaccggcgcgacaaacggtccgtggcgctcgcgccccacgtcggtatggggctggacacgagaacgcagacctggatgagtgccgaaggcgcctggcggcaggttgagaaggtcgagacctgggcgctgagacaccccgggtttacaatcctcgccctgttcctggcccactacatcggaaccagtctgacccagaaggtggtgatcttcgtcttgctgatgctcgtgacccccagtatgacgatgcggtgcgtgggggtcggcaacagagacttcgtggaaggcctgtccggagccacctgggtagatgtagtgctggagcacggcgggtgcgtgaccaccatggccaagaataaacccacgctcgacattgagctgcagaagaccgaggcgacccagctagccaccctccggaagctatgcatcgaaggcaaaatcacgaacatcaccactgatagcagatgtccaacgcagggcgaggccgccctgccggaggagcaggaccagaactacgtctgcaagcacacgtacgtggatcgcggctggggcaacgggtgcggcctcttcgggaaaggctccctggtgacctgcgcaaagttccagtgcctggagcccattgaaggcaaggttgtgcagtacgagaacctcaagtacaccgtcatcatcaccgtccacactggggaccagcaccaggtgggcaacgagacccagggggtcaccgccgagattacgccccaggcgagcacgactgaggccatcctgcctgagtacggcacactggggctcgagtgctccccgcgcaccggcctggacttcaatgagatgatcctgctcaccatgaagaacaaagcctggatggtgcacaggcaatggttcttcgacctgcctctgccctggacgtctggcgcaactaccgagactcccacatggaaccggaaggagctcttagtgacattcaagaacgcgcatgccaagaaacaggaggtagtcgtgctggggtcccaggagggcgccatgcataccgctctcacgggggccacggagatccagaacagcggcggcacctccatctttgcgggccatttaaagtgtcggctaaagatggacaagctcgagctgaaaggcatgagctatgccatgtgcaccaacacgttcgttttgaagaaggaggtttccgagacgcagcacggaacgatcctcatcaaggtcgaatacaaaggcgaggacgccccgtgcaagatcccgttctcaaccgaggacggtcagggtaaggcgcacaacggacggctgataaccgcgaaccccgtcgtaacaaagaaggaggagcccgttaacatcgaagccgagccacccttcggcgagagcaacattgtcatcggcatcggggacaacgcgctgaagataaactggtacaagaaaggttccagtatcgggaagatgttcgaggccaccgcccggggcgcgaggcggatggccatcctgggcgacactgcctgggacttcgggtccgtgggcggtgtcctcaacagcctggggaaaatggtccaccagatcttcgggtccgcctacacggccctgttcagcggggtgagctgggtgatgaagattgggatcggggttctcttaacgtggatcgggctgaacagcaagaacacatctatgagcttcagttgtatcgccatcgggatcatcaccctctacctgggagccgtggtgcaagccgacaccgggtgtgtcataaactggaagggtaaagagctgaagtgcggcagcggcatcttcgtgacaaacgaagtccacacctggaccgagcagtataagttccaggccgactccccaaaacgcctggcaaccgcgatagcgggcgcctgggagaacggggtatgcggcatccgctcgacgacacggatggagaacttactgtggaagcaggttgccaacgagctcaattacatcctctgggagaataacatcaaactgaccgtggtggtgggggacatcatcggggtgctcgagcaggggaagaggaccctgacgccccagccgatggagctgaagtactcctggaagacctggggcaaggcgaagatcgtcaccgccgagacccagaacagctccttcatcatcgacggcccaaacacgccagaatgcccgagcgcctcccgtgcctggaacgtgtgggaggtggaggactatgggttcggcgtcttcaccaccaatatatggttaaagctgcgcgaggtgtacacccagctatgcgaccaccggctcatgagcgccgcggtgaaggatgaacgtgctgtccacgctgacatgggctactggatcgagtctcaaaagaatgggtcctggaagctggagaaggccagcctgatcgaagtgaagacctgcacgtggccaaagtcccacaccctctggagcaacggagttcttgaatccgacatgataatccctaaaagtctggctgggcccatctcacagcataattaccgacccggataccacacacagaccgcggggccatggcatctgggaaagctagagctggacttcaactactgcgagggcacgacggttgtgatcactgagaattgcgggacacgcggccccagcctccgaacgaccaccgtgtccgggaagcttatccacgagtggtgctgcaggagctgcaccttgcccccgttgaggtatatgggggaggacgggtgttggtacggcatggagatccgccccatctccgagaaggaagaaaacatggtcaagtcactggtgagcgccggcagcggcaaggtggacaatttcaccatgggcgttttatgcctcgcaatcctgttcgaggaggtaatgaggggcaagtttggcaagaagcacatgatcgcgggggtgttcttcaccttcgtcttgctcctgtccggtcagattacgtggcgcgacatggcacacaccctgatcatgattggctcgaacgctagtgaccggatggggatgggcgttacgcacctcgccctgatagccaccttcaagatccagcccttcctggccctcggcttcttcctgcgcaagctgactagcagggagaatttattactgggcgtgggcctggcgatggccaccaccctgcagctacccgaagacatcgagcagatggccaacggaatcgcactcggactgatggctctaaagctcattacccagttcgagacctaccaattatggaccgcgctgatcagcttaacgtgctccaacaccatcttcaccctaaccgtcgcatggagaaccgccaccctgatcctcgcgggggtgagcctgctgccggtctgccaatcctcctccatgcggaagtccgactggcttcccatgaccgtggccgcgatgggcgtgccgcccctacccctgttcatcttctccctcaaggacaccttaaagcgccgctcttggccactgaatgagggtgtcatggccgtgggcctcgtgtcgatattggcctcaagtcttctccggaacgacgtccccatggccggccccttggtagccggagggctgctcatcgcgtgttatgttataacggggacatccgctgatctgaccgtcgagaaggccgccgacgtaacctgggaggaggaggccgagcagaccggggtgtcccacaatctaatgataaccgtcgacgacgatggaaccatgcgcatcaaggacgacgagactgaaaacatcctcaccgtgctgctaaaaacagctctcttgatcgtgtcagggatatttccgtactccatccccgccaccctcctcgtctggcacacgtggcagaaacagacccggcgcagcggcgtgctgtgggacgtcccctcaccgccggagacgcagaaggcagagctggaggagggggtctaccggatcaagcagcagggcatcttcgggaagacccaagtcggcgttggggtccagaaggagggcgtgttccacactatgtggcacgtgactcgcggcgccgtcctcacgtataatggaaagcggctggagccaaactgggcgagtgtgaagaaggacctgatatcctacggcgggggctggcgcctcagcgcccagtggcagaagggagaggaggttcaggtcatcgccgtggagcctggcaaaaaccccaagaacttccagaccatgcccggtacattccagaccacgaccggtgagatcggcgccatcgccctggactttaagcccgggaccagcgggtcgcccatcatcaaccgggaggggaaggtggtagggctgtacggtaacggggttgtgaccaagaacggagggtacgtcagcggcatcgcgcagacgaacgccgaaccggatggccccaccccagagctggaggaggagatgttcaagaagcgcaacttgaccattatggacctgcaccccggttcaggcaagacccgtaagtacctgccggccatcgtgcgcgaggccatcaagcggagactccggacattgatcctggctcccaccagggtggtggcagcggagatggaggaggctctcaaggggctgcccatccggtatcagaccaccgcaaccaagagcgagcacaccggtcgcgagatcgtggacttgatgtgtcatgccaccttcactatgcggctcctgtcccccgtgcgcgtccccaattataaccttatcatcatggacgaagctcacttcacggacccggccagcatagccgcccgggggtatatttccacccgcgtgggcatgggcgaggcggccgccatcttcatgaccgccacgccgcctgggactgccgacgctttcccacagagcaacgcccccatccaggacgaggagagagacatccccgagcggtcctggaacagcgggaatgagtggatcaccgacttcgccggcaagaccgtctggttcgtcccctccatcaaggccggaaacgacatagcaaactgccttcgcaagaatgggaagaaggtgattcaactaagccggaagacattcgacacggagtaccagaagacaaagctgaatgactgggacttcgtagtcaccactgacatatccgagatgggcgcgaacttcaaagcagatagggtgatcgacccgcgacgctgcttaaaacccgtgatcctgacagacggccccgagcgtgtcatcctggccgggcccatgccggtcacggcggcaagcgcggcgcagcgccggggccgcgtggggcgcaatccccagaaggagaacgaccagtacatcttcactggacagcctctcaacaacgacgaggaccacgcccactggaccgaggccaagatgctgctcgacaacatcaacacccctgagggtatcataccggccctcttcgagcccgagcgtgagaagtccgcagccatagacggcgagtaccggctgaaaggcgagagcagaaagacgttcgttgagctcatgcggcggggggacctcccagtgtggctggcccacaaggtagcctccgaaggcatcaagtacacggatcggaagtggtgtttcgacgggcagcgcaacaaccaaatcttggaggagaatatggatgtggagatatggaccaaggaaggcgagaagaaaaagttacgtcccaggtggctcgacgcgcgcacctatagcgacccgctggccctcaaagagttcaaggatttcgccgccggacggaagtcgatagctctggatctggtcacggagatcgggcgtgtacccagccacctcgctcaccggacccgtaacgccctggacaacctggtgatgctccatacctccgaacacggagggaaggcctaccggcatgccgtggaggagcttcccgagaccatggaaacgctgctcctcctgggcctcatgattctgctgaccgggggcgccatgctgttcctgatctccggcaaagggatcggcaaaacctccatcgggctgatctgtgtcatcgcgagctctggtatgctctggatggccgagatcccgcttcagtggatcgcctccgccatcgtgctggagttcttcatgatggtgctcttgatccccgagccggagaagcagcgcacgccacaggacaaccagctggcctacgtcgtaatagggatactcacgctcgcggcaataatcgctgctaatgagatggggttattagaaaccaccaaacgggacctaggaatgtctaaggaaccgggtgtagtctctccgacgagctacttggacgtcgatctccaccccgcgtcagcctggacgctgtacgcggtggccacgaccgtcatcactcccatgctgcgccacacgatcgagaacagcactgccaatgtgtccttggcagccatcgcgaaccaggccgtggtgctcatgggactgaacaaggggtggccgatcagcaagatggatctcggcgtacccttgctggcgcttgggtgctattcccaggtgaaccccctgaccctgaccgcggccgtcctcctgctgatcacgcactacgctatcatcgggccgggcctccaggccaaagctacccgggaggcccagaagcgcaccgccgcagggattatgaaaaacccgaccgtagacggaatcatgacgatcgatttagatcccgtgatctacgattcaaagttcgagaagcagctggggcaggttatgctcctggtgttgtgtgctgtgcagctcctgctgatgcggacctcctgggcgctctgcgaggccctgacactggccaccggccccatcacgaccctctgggagggctctccggggaagttctggaacacaaccatcgccgtcagtatggcgaacatcttccgcggctcttacctcgcgggcgccggcctcgccttctccattatgaagtcagtagggacgggaaagcgaggcactggtagccagggcgagaccctcggggagaagtggaagaagaagttaaaccagctctcccgtaaggagttcgacctctataagaagtccgggattaccgaggtcgaccggacagaggccaaggaaggcctgaagcgcggcgaaataacgcatcacgccgtctcccggggctcggcgaagcttcaatggttcgtcgaacggaacatggttatccctgagggtcgggtcatcgacctaggctgcggtcgcggcgggtggtcatactattgcgccggcctcaagaaggtaaccgaggtgcggggctacaccaagggcgggcccgggcacgaggagccggtcccgatgagtacctacggctggaacatcgtaaagctgatgtccggaaaggatgtgttctacctcccgcccgagaagtgcgacactctgctgtgcgacattggcgagtcgtcgccctcccccacggtagaagagtcccgcaccatccgcgtgctgaaaatggtggagccgtggttaaagaacaatcagttctgcatcaaggttctgaatccctacatgccaaccgtgatcgagcacctggagcggctgcagcgcaagcacggcgggatgctggtgagaaatcccctgagccgtaactccacacacgagatgtactggatcagcaacggaaccgggaatatcgttgcctccgttaacatggtgagccgtctactgctgaaccgcttcaccatgacccaccggcgcccaacgatcgagaaggacgtcgacttgggagccggaacccgacacgtgaacgccgagccggagacccccaacatggatgtaataggagagcgaatcaagcgaatcaaggaggaacacaactccacctggcactatgacgacgaaaacccttacaagacgtgggcatatcacggcagctacgaggtcaaggccaccggttccgccagcagcatgatcaacggcgtggtcaagctgctgaccaagccgtgggacgtggtgcccatggtcacgcagatggccatgacggataccacacccttcggccagcagcgcgtgttcaaagagaaagtggacacacggacgccgagaagcatgcctggcacccggcgcgtcatgggcatcaccgcggagtggttgtggcggaccttaggtcgcaacaagaagccccggctgtgcacgcgcgaggaattcaccaagaaggtgcgcaccaacgccgccatgggcgccgtgttcaccgaggaaaaccagtgggacagcgccaaggccgccgtcgaggacgaggacttctggaagctcgtagatcgggaacgtgagctccacaagctgggtaagtgtggctcctgcgtctacaatatgatgggaaagcgggagaagaagctaggtgaattcggtaaagccaaaggtagccgcgccatctggtacatgtggctcggcgcccggtacctggaattcgaggcgctcgggttcctgaacgaggatcactggttctcccgagagaacagctactccggcgtagagggggaagggctgcataagcttggctacatcctgcgggacatctcgaagatccccgggggcgcgatgtatgccgacgacacggctgggtgggacacccgcatcacggaggacgacctgcacaacgaggagaagatcacccagcagatggacccggagcaccggcagctggccaacgcgatattcaaactgacgtatcagaacaaggtggtgaaggtccagcgacccacacccaccggcaccgtgatggacatcatatcccggaaggaccagaggggtagcgggcaggtcggaacctatgggctgaacacgttcacgaacatggaagcccagctcatcaggcagatggagggcgagggcgtcctgaccaaggccgacctggagaacccccacctctccgagaaaaagatcacccaatggttagagacgaagggagtggagcgcctgaagcggatggccatcagcggcgacgactgcgtggtcaagccgatcgatgaccgtttcgcaaacgcgttactggccctgaacgacatggggaaggttaggaaggacattcctcagtggcagccctccaagggctggcacgattggcagcaagttcccttctgcagccaccacttccacgagttaattatgaaggacggccgcaagctagtcgttccttgccgaccccaggatgagctgatcggccgcgcgcggatctcccagggggccggctggtctctccgggaaaccgcttgtttaggcaaagcttacgcccagatgtggtccctgatgtacttccaccgcagggacctccgcctggcgagcaacgcaatctgctccgcagtgcccgtccactgggtgccaaccagtcggaccacgtggagcatccacgcccaccaccagtggatgaccaccgaggacatgctcaccgtgtggaaccgcgtgtggatcgaggacaacccgtggatggaggacaagacgcccgtgaccacctgggagaacgtgccatacctcggtaagagggaagaccagtggtgcggctccctgatcgggctgaccagccgtgcaacgtgggctcaaaatatccccaccgccatccagcaggtacgctccctcataggtaacgaggagttcctggactatatgccgagcatgaaacgatttcggaaagaggaagagtccgaaggcgcgatctggtga

SEQ ID NO: 25936 - RNA, 9873 nt, synthetic construct
  misc_feature 1..9873: note = derived and/or modified CDS sequence (opt11) from DENV-3__EU482564__SS-prME
  source 1..9873: mol_type = other RNA
accagcctctgcctcatgatgattctgccggccgccctagcttttcacctcacctcgcgtgacggagagcctaggatgatcgtggggaagaacgagaggggcaagtccctgctattcaaaacggcctccggcatcaatatgtgcaccctcatcgcaatggacctcggggagatgtgcgacgataccgtaacatataagtgcccccatatcacggaagtggaacctgaagatatagactgctggtgcaacctgaccagcacctgggttacctacgggacgtgtaaccaggccggcgaacacagacgggacaagcggtccgtcgctttagcgccgcacgtgggtatggggctggacacccgcacgcagacatggatgtctgcagagggagcttggcgccaggtggagaaggtcgaaacctgggccctgcgccacccaggatttaccatcctagccctgtttctggcacattacatcgggacctccctcacccagaaggtggtgatctttatcctgctgatgctcgtcacgcccagcatgaccatgcgttgcgttggggttggcaaccgggacttcgtcgagggcctgtccggggcgacctgggtggacgtcgttttggagcacggcgggtgcgtgacgacgatggccaaaaacaaacctacgctcgatatagaactgcagaaaaccgaagctactcaattagccaccctccgtaaactgtgcatcgagggcaagataaccaatattaccactgatagccgctgccccacacagggcgaagccgtgctgccggaagagcaggatcagaactacgtgtgcaagcacacatacgtggaccgggggtggggcaacggttgcggtctgttcgggaagggctccctggtgacctgcgcaaagttccaatgcctggagcccatcgaaggtaaggtcgtgcagtatgagaacctcaaatacaccgttatcatcacggtccataccggggaccagcaccaggtgggcaacgaaacgcagggcgtcaccgctgagataacgccccaggccagcaccacggaggccatcttgcccgagtacggaaccctgggactggagtgctcgccgcgtacgggccttgacttcaacgagatgatacttctaacgatgaagaacaaggcctggatggttcacagacaatggtttttcgacctgccgctgccctggactagcggcgccacaaccgagacgccaacgtggaaccgcaaggagctcctggtgaccttcaagaatgcccatgccaagaagcaggaggtcgtggtgctggggtcccaggagggcgcgatgcacaccgccctcacgggggccaccgagatccaaaactcaggagggaccagtatcttcgctggccacttaaaatgccggctcaagatggacaagctggaattaaagggcatgagttacgcaatgtgcacgaatacgttcgtcctgaagaaggaagtttccgagacccagcacggcaccatcctgatcaaagttgaatataagggtgaggacgcgccgtgcaagatcccgttcagcacagaggacgggcagggcaaggcacacaatgggaggctcatcactgccaacccggtcgtaacgaaaaaggaggagccggtaaacatagaagccgagccacccttcggcgagtctaatatcgtcataggcatcggggacaacgcgttgaagatcaactggtataagaaaggctcctctatcggaaaaatgtttgaggccaccgctcggggcgccaggcgcatggccatactgggcgacacagcgtgggacttcgggtccgtagggggagtgctcaattccctgggcaagatggtccaccaaatcttcgggtccgcctacactgccctcttcagcggcgtgtcttgggtcatgaaaataggaatcggggtcctcctaacctggatcgggctcaactcaaagaacacctccatgagcttttcctgcatcgccatcggtgtcataactctctacctaggagcggtagtacaagcagacatggggtgcgtcataaactggaaggggaaggagctcaagtgcggaagcggcatatttgtgacgaatgaggtccacacctggaccgaacaatacaagttccaggccgactcccctaagcgccttgccaccgccatcgccggcgcgtgggagaacggggtgtgcggtatccgcagcacgacccggatggagaatctgctgtggaagcaaattgctaatgagttgaactacatactatgggaaaacaacatcaagttgacggtcgtcgtgggcgacattatcggcgtgctggagcagggcaagcgcaccctgacaccccaacctatggagctgaagtactcctggaagacctggggcaaggcaaagatcgtcaccgccgaaatccaaaactcaagtttcatcatcgacggcccaaatacgcccgagtgcccatcggcttcccgagcgtggaacgtgtgggaagtcgaggactacgggttcggtgttttcaccaccaacatctggttgaaattgcgcgaggtatacacacagctctgcgaccaccggctcatgagcgctgcggtgaaggacgagcgcgcggtccatgctgacatgggctactggattgagagccagaagaacggtagttggaagctggaaaaggccagcctgatagaggtgaaaacctgtacctggccgaagagtcacaccttatggagcaacggtgtgctggagtccgacatgatcatccccaagagcttggccgggcctatctctcagcacaattaccggccgggctaccacacccagacggccgggccctggcaccttggcaagctggacctggatttcaattactgcgagggcaccacggttgtgatcaccgagaattgcgggactcgacggccctctctccgaaccacgaccgtgtcggggaagctgatccatgaatggtgctgccggagctgcactcttccgcccctccgctatatgggcgaggacgggtgttggtacgggatggagatccggcccatatccgagaaggaggaaaacatggtcaaaagcctggtgtccgccggcagtggcaaggtggacaattttaccatgggggtcctctgtctagcgatcctgttcgaagaagtgatgcgcggcaagttcgggaagaagcacatgatcgccggagtcttcttcacatttgtcttgctcctgagcgggcagataacctggcgggacatggcccacacccttatcatgatcggcagcaacgcctcagataagatgggtatgggggtgacatacttagcactaatcgcgacgttcaaaattcaacccttcctggccttaggcttcttcctccgcaaactcacttcacgcgagaacctattactgggggtcggccttgccatggccaccacacttcagctgcccgaggacatagagcaaatggcgaatggaattgccctagggttgatggcgctgaagctcatcacgcagttcgagacctaccagctgtggacagctctgatcagcctgacctgctccaacacgatgtttactttaacggtggcgtggcgcacggcgacattaatcctcgctggtgtgagcttgctgcccgtttgccagtcgtcatctatgcggaagaccgattggctccccatggcggtggcagcgatgggggtgccgcccctcccgctgttcatcttctccctcaaggacaccctcaagcgccgctcctggccccttaacgagggcgtcatggcggtagggctcgtgagtatcttagccagcagcctgctccgtaacgacgtccccatggcgggcccgctggtggccggcggtctgctcatagcttgctacgtcatcacaggcacgagtgccgatctgaccgtcgaaaaagccgcggacatcacctgggaggaggaggcagagcagaccggggtgtctcacaatctgatgatcacggtggacgatgatggcacgatgcgaatcaaggacgatgagacggagaatatcctcacagtcctcctgaagacggcactcctgatagtctcgggagttttcccgtacagcatccccgcgacgctgctagtctggcatacctggcagaagcagacccagcggtccggcgtgctatgggacgtgcccagcccgcccgagacccagaaggctgagctggaggaaggcgtctacagaatcaaacaacaggggatcttcggcaagacacaggtgggagttggcgtccagaaggaaggggtgtttcatacaatgtggcacgtgacccggggcgcagtcttgacatacaacggtaagaggctggagccaaactgggcctccgtgaagaaagatctcatcagctacggaggcgggtggcgactctccgcccagtggcaaaagggggaggaggtccaggtcatcgccgtcgagcccgggaagaacccgaagaacttccagactatgccaggcacgttccagactacgaccggagagatcggggccattgccttagacttcaagcccggcactagcggaagcccaattattaaccgtgaaggcaaagtggtcggcctgtacgggaatggcgttgttaccaaaaacggggggtatgtctctggtatcgcccagacgaacgcggaaccagacggccccacgcccgagctagaggaggagatgttcaagaaacgcaacctcacaatcatggacctgcatcccggctcagggaagacacgcaaatacctgccggccgttgtgcgggaagcaatcaagaggcggctccgcaccctgattctggcaccaacgcgggtcgtggcagccgagatggaggaagccctcaaaggcctcccgatccgctaccagaccaccgcgactaagagcgagcatactgggcgggagatcgtggatttaatgtgccatgcgaccttcaccatgcgcctcctcagcccggtccgcgtgcccaattacaacctgatcattatggacgaagcccacttcacagaccccgcgtcaatcgccgcgcgcggctatatttccacacgtgtagggatgggcgaagccgccgctatctttatgaccgccacgccgcctggtaccgccgacgcattcccccaatcaaacgcacccatccaggacgaggagcgcgacattcctgagaggagctggaactccgggaacgaatggatcacggattttgccggcaagacagtctggttcgtaccctcgatcaaggccgggaatgacatagccaactgcttgcggaagaacggaaagaaagtgattcagctatccagaaagaccttcgacactgagtaccagaagactaagctcaacgactgggacttcgtcgttaccacagacatcagtgagatgggggccaacttcaaggcggatcgggtgatcgacccgcgccggtgcctcaagccagtcatcctgaccgacggtcccgagcgcgtgatattagccggccccatgccggtgacggccgcctccgcggcacaacggagagggcgggtcggtcgcaacccacagaaggaaaacgaccagtacatctttaccgggcaaccgctcaacaacgacgaggaccacgcccactggacggaggccaaaatgttgcttgataatatcaacactcccgaggggataatcccggccctcttcgagcccgagagagagaagtccgccgccatagacggggaataccgcctgaaaggcgagtcccggaagacattcgtggagctgatgaggcggggggacctcccagtctggctagcccataaggttgcaagcgagggtattaagtatactgatagaaagtggtgcttcgacggccagcggaacaaccaaatcctggaagagaacatggatgtggaaatctggaccaaggagggtgagaagaagaagttgcgcccgcggtggctggacgcccgcacctactccgacccgctggctctcaaggagtttaaagactttgccgccggcagaaagagcatcgccctggacctggtcaccgagatagggcgggtgccatcccatctcgcccaccgcacgcggaacgcgctagataatctggtcatgttacacaccagcgagcatgggggccgcgcctaccggcacgcggtcgaagaactgcccgagaccatggagacccttctgctactggggctcatgatcctgctgacgggcggggccatgctgttcttaataagcggcaaggggatagggaaaacctccatcggactgatctgcgtgatcgcatcttccggcatgctttggatggcggaaatcccgctgcagtggatcgccagcgccatcgtgctggagtttttcatgatggtcctactgatacccgaacccgagaaacagagaacgccccaggacaaccagctggcgtacgtggtgatcggaatcctcaccttagccgcgataatcgccgcgaatgaaatggggctgctcgaaacaaccaaaagggatctcggcatgtccaaggagccgggagtagtgtcccccaccagttacctggacgtggacctgcaccccgccagcgcgtggaccctatacgcagtcgcaacgaccgtgatcaccccaatgttgcgccacacaatcgagaattccacggccaacgtgtcgctcgccgcgatagccaaccaagcggtcgtgctgatggggctggacaagggctggccgatctccaaaatggacctcggggttccgctgctggcgctcggctgttatagccaagtgaacccactgaccttgaccgccgcggtgcttttgcttataacccactacgccataatcgggcccgggctccaggctaaggccacgcgtgaggcccagaagaggacagcggccggaatcatgaagaacccgacggtcgacgggataatgacgatagatctggatcccgtcatctacgattctaagtttgagaagcagttggggcaagtgatgctcttagtgctgtgcgccgtccagctcctgctaatgcggacgagctgggcgctctgcgaggcgctaaccctggcgaccgggcctatcaccacgctatgggaaggatccccgggcaagttctggaataccaccatcgccgtttcgatggcaaatatcttcagaggatcctatctggccggcgccgggcttgccttttccatcatgaagtccgtaggcaccggaaagcggggcacgggcagccagggggagaccctgggcgagaagtggaaaaagaaacttaaccagcttagccgcaaagagttcgatttatacaagaagtccgggatcaccgaggtcgacaggaccgaggccaaggagggcctgaagcgcggggagaccacacatcacgctgtctcccggggcaccgccaagctccagtggttcgtggagcgcaacatggtcatcccagaagggcgcgtgatcgacctcgggtgcggtcgcgggggctggtcatactactgcgcagggctgaaaaaggtaacagaagtccgtggttacacgaagggcgggcctggccacgaggaaccagtgcccatgagcacctatggctggaacatcgtgaagttgatgagtggcaaggacgtcttctacctccctcccgagaagtgcgacaccctgctgtgcgacatcggcgagtcatcgcccagcccaaccgtagaggagtcccgaaccatccgcgtgctgaaaatggtcgagccgtggctcaagaacaaccaattctgcataaaggtgcttaacccttacatgcccacggtgatcgagcatctggagcggctccagcgcaagcacggcggcatgctggtaaggaaccctttatctagaaattccacccatgagatgtactggatctcgaacggcaccgggaacatcgttgcatccgtgaacatggtcagccggctcctgctgaacagatttactatgacacaccggcgcccgacaatcgaaaaggacgtggacctcggagccggcaccaggcacgtgaacgccgaaccagagacaccgaacatggatgtcattggagagcgcatcaagcggatcaaggaggagcacaactccacgtggcattatgacgacgagaacccgtacaagacctgggcttatcacggcagctatgaggtgaaggctactggcagcgcctcctccatgatcaacggggtcgtgaagctgctaaccaagccgtgggacgtggtcccaatggtgacgcagatggccatgacggacacgacccccttcggccagcagcgcgtgttcaaagagaaggtcgacactcggactccgcggagtatgccaggaacccggcgtgttatgggtatcacggcagagtggctgtggcgaaccctggggcgaaacaaaaagcccagactgtgcaccagagaggaatttactaagaaggtacgcaccaacgctgccatgggggcagtcttcacggaggagaaccaatgggacagcgccaaggccgctgttgaagacgaagacttctggaagctggtcgaccgggagcgcgagctgcacaagttaggtaagtgtgggtcctgcgtctacaacatgatgggcaagcgggagaaaaaacttggggagttcggcaaggccaaggggagcagagccatctggtatatgtggctgggggcccgctacttggaatttgaagccctcggcttcctgaacgaggatcactggttcagtcgcgagaactcctactccggggttgagggcgaaggattgcacaagctcggctacatcctgcgggacatcagcaagattcccggcggggcgatgtatgccgatgacactgcaggctgggacacccgaatcacagaggacgatttacacaacgaggagaagataacgcagcaaatggatccggagcaccgccagctcgctaatgccatcttcaaactgacctaccagaacaaggtggtcaaggttcaacgccccacgcccaccggcacggtcatggacatcatttccagaaaagatcaaaggggctcaggccaagtggggacgtacggacttaacacgtttaccaacatggaggcacagcttatccgtcagatggagggcgaaggcgtattgtccaaggccgaccttgaaaacccccacctccccgagaagaagataacccaatggttggagacaaaaggtgtggaacgactgcggaggatggccatctccggcgatgactgtgtagtgaagcctatagacgatcggttcgctaacgccctactggcgctgaacgacatgggtaaggttcgcaaagacataccgcagtggcaaccatccaaggggtggcacgactggcaacaggtcccgttttgtagtcatcacttccacgagttgatcatgaaggacggccggaaactagtggtcccctgccgcccacaggacgaacttatagggcgcgcacgcatctcccagggggccgggtggtccctgcgcgagaccgcgtgtctgggcaaagcctacgcccagatgtggtccctgatgtacttccacagacgcgatctccggctggcctctaacgcaatttgttcggcggtccccgtacactgggtgccaaccagtcgcacgacgtggtctatccatgcgcaccatcagtggatgaccaccgaagacatgctgaccgtctggaacagggtttggatcgaggacaacccttggatggaagacaagaccccagtgaccacctgggaaaacgtcccctacttaggcaagagggaggaccaatggtgcgggagcctgatcggactcaccagccgggcgacatgggcccagaatatcccgacggccattcagcaggtccgcagccttatcgggaatgaagaattccttgactacatgcccagcatgaagcgtttccgcaaggaggaggagtccgagggcgcaatctggtga

SEQ ID NO: 25937 - RNA, 9873 nt, synthetic construct
  misc_feature 1..9873: note = derived and/or modified CDS sequence (opt11) from DENV-3__EU529699__SS-prME
  source 1..9873: mol_type = other RNA
accagcctctgtttgatgatgatcctgcccgctgccttagcgtttcacttaacaagccgggacggagagccccggatgatagtggggaagaatgagcgcgggaagagcctgctgttcaagaccgccagcgggatcaacatgtgcaccctaatcgctatggacctgggcgagatgtgcgatgatacagtgacttacaagtgcccacacatcaccgaagtagagccggaggacatcgactgttggtgtaacctaaccagcacctgggtgacctatggtacctgcaaccaagccggcgagcaccggcgcgacaagagatccgtggcactcgcgccccatgtgggtatgggcctggacacccgaacccagacctggatgtctgccgaaggcgcctggcggcaggtcgaaaaggtcgagacgtgggccttacgccacccgggcttcactatcctcgcgctgttcttggcacactatatcggcacctccttaacccagaaggtggtcatcttcatcctgctgatgctcgtcacacccagcatgaccatgcggtgtgtaggcgtgggaaaccgcgacttcgtcgagggcttatctggggccacgtgggtagacgtagtccttgagcacggcggctgcgtgactacaatggcgaagaacaagcctaccttagacatcgaactgcagaagacagaggccacccagctagctacattgcggaagctgtgcatcgagggcaagattaccaatatcacgaccgacagccgctgtcccacgcaaggcgaagccgtgttgccggaagagcaggaccagaactacgtctgcaagcacacctacgtggaccgggggtggggcaacgggtgcggcctcttcgggaagggatccttggtcacctgcgccaagttccagtgcctagagcctatagagggcaaagtcgtccaatacgagaatttaaagtataccgtaatcatcacggtccatactggggaccagcaccaggtgggcaacgagacccaaggggtcaccgctgaaatcacgccccaagccagcaccaccgaggcaatcctgccagaatacggcaccctgggcctcgagtgttccccgcgtaccggcctggacttcaacgagatgatcctactcaccatgaagaataaggcctggatggtccaccgtcagtggttcttcgatctgcccctcccctggacgagcggagccaccactgagacgcccacctggaaccgaaaggagctcctggtgacatttaagaacgcacacgctaagaaacaggaagtagtggtgcttggctcccaggagggtgcgatgcacaccgctctgacgggagccaccgagattcagaacagcggggggacttccatcttcgccggtcacttaaagtgtcggctgaaaatggataagctcgaactgaagggcatgagctacgccatgtgcaccaacacgtttgtcttgaagaaagaagtcagcgagacccaacacgggaccatccttattaaggttgagtacaagggggaggatgtcccgtgtaaaatcccctttagcaccgaggacgggcagggcaaggcacacaacggccggcttattactgccaacccagtggtgaccaagaaggaagagccggtcaacattgaggccgaaccgcccttcggggagtcgaatatcgtgatcggcattggggacaacgcacttaaaatcaactggtacaagaaagggtccagcatcggtaagatgttcgaagcgactgcgcggggcgccagacgcatggcgatcctgggcgacaccgcttgggacttcggctccgtgggtggtgtcctcaacagcctgggcaaaatggtgcatcaaattttcgggtccgcgtacacggccctattctctggcgtgtcatgggtcatgaagatcggcattggtgtgctcctgacgtggatagggctgaacagcaagaacacctccatgagcttcagttgcattgccatcgggattataacactgtatctgggcgccgtagtacaggccgacatgggatgcgtaatcaattggaagggtaaggaattaaaatgtggctcggggatcttcgtgaccaacgaggtgcacacatggaccgaacaatacaagttccaggcggatagtcccaaacgcttagccactgccatcgcaggcgcgtgggagaacggtgtctgcggcatccggtccacgacgcggatggagaacctgttatggaagcagatagcgaacgaactcaactacatcctgtgggagaacaacatcaagcttaccgtggttgtcggagacacgatcggcgtgctcgaacagggcaagcgcacgctgacaccccagccgatggagctgaagtactcctggaagacatgggggaaggccaaaatagtcaccgccgagacgcagaatagctcgttcataatcgatggccccaatacccccgagtgccctagtgcatcccgggcgtggaacgtgtgggaggtggaagattacgggttcggagtattcactaccaatatctggctcaaactgcgcgaagtgtacacccaactgtgcgatcatcgactcatgagtgccgccgtcaaggacgaacgcgccgtccacgccgacatgggctattggatcgaaagccagaagaacgggagctggaagctcgaaaaggcgagcctgattgaagtaaaaacctgcacctggccgaagtcgcacaccctctggagcaacggcgtgctggagtccgacatgatcatccccaagtccctggcaggtcccatctcccagcacaactacaggccgggctaccacacccagacggccggtccctggcacctcggcaagttagagctggacttcaactattgcgagggcacaaccgtagttatcaccgaaaactgtggaacccgcggtccgagcctccgaaccactaccgtgtctgggaaattgatccatgagtggtgctgtcgcagctgcaccctgccaccgctccggtatatgggcgaggacgggtgctggtatggcatggagatccgcccagtctcagagaaggaggagaatatggtcaagagcctggtgtccgccggtagcgggaaggtcgataacttcaccatgggcgtcctgtgcctcgcgatactgttcgaggaagtgatgcggggaaaattcggcaagaaacacatgatcgcgggagtcttcttcactttcgtgctcctactttcgggtcagattacctggcgggacatggcccatacactaatcatgatcggctctaacgcctctgaccgaatggggatgggcgtgacatatctcgccctgatcgccaccttcaaaatccagcccttcctcgcgttagggttcttccttcgcaagctgaccagcagagagaatctcctgctaggcgtaggcctcgccatggccacgaccctgcagctgcctgaagacatcgagcagatggccaacggtattgcgctcggcttaatggcactgaagctcatcacccagttcgagacataccagctgtggacggcgctgatcagccttacgtgttccaacacgattttcactcttacggtagcctggcgcaccgccaccttaatcctcgcgggggtcagcctgctgccggtgtgccagtccagctcaatgcgaaagaccgattggctccccatgactgtcgcagccatgggcgtgccgccgctcccgttgttcatcttcagcttaaaggacaccctgaagcgccgctcctggccgttgaacgagggtgtaatggctgtcgggctcgtcagcatcctggcctcatctctgttgcggaacgacgtgcccatggcgggccccctggtagccgggggcctgctcatagcctgctatgtgattaccggcaccagcgccgacctgacggtcgagaaggctgcggatgtgacctgggaagaggaggccgagcagactggcgtctcacacaacctgatgattacagttgacgacgacggtaccatgagaatcaaggatgacgagacagagaacatcttgaccgtcttgttaaagaccgccctcctgatcgtctctggcatctttccgtacagcatcccggccaccctgctcgtctggcacacgtggcagaaacagacccaacggtcgggcgtgctgtgggatgtcccctcaccgcccgagacccagaaggcagaactggaggagggggtgtaccgcatcaaacagcagggcatcttcgggaagactcaggtgggcgtcggggtccaaaaggaaggcgtgttccacacgatgtggcacgtgacccggggcgcggtattaacctacaacggaaagcgccttgaaccgaactgggcctcagtgaagaaggacctcatcagctacggcggcggctggcggctctcggcccagtggcagaagggggaggaggtacaggtaatcgccgtggagcccggtaagaatcctaagaacttccagacaatgcccggcacgtttcagaccaccaccggcgaaataggcgccattgccctggacttcaagccaggcacgagcggcagccccataatcaaccgcgaggggaaggtcgtgggtctctacggcaacggggtggtcactaagaacggcgggtacgtgtccggtatcgcccaaaccaacgcagagccggatggtcccacacccgagctagaggaagagatgttcaaaaagcggaacctcaccatcatggacctccaccccggttctggcaaaacccgcaagtacttaccggccattgtccgcgaggcgataaagcgccggctccgcaccctgatactggctcccacccgggtcgtggccgccgagatggaggaggctctcaaagggctgcccatcaggtaccagacaaccgctactaagtcagagcacaccggccgggagatcgtggacttaatgtgccacgctacgttcacaatgagactgctcagccccgtccgggtgccgaactacaacctgatcatcatggatgaggcccacttcaccgacccagccagcatcgccgcgcgcgggtacatctctacacgggttggcatgggtgaggccgccgccatcttcatgacggcaacgccgcccgggacagccgacgcgttccctcagtccaacgcccccatccaggacgaggaacgcgacatacccgagagaagctggaactccggcaacgagtggatcaccgactttgccgggaagacggtttggtttgtgcccagcatcaaggcgggcaatgacattgctaactgtcttcggaaaaacgggaagaaggtgatccagctatcccgcaaaaccttcgacaccgagtatcagaagactaaactgaatgactgggacttcgtcgtgactaccgacataagcgagatgggggccaattttaaggcagaccgggtgatcgacccgcgccgctgtttgaagcccgtcatcctgaccgacggaccggaacgtgtaatcttggcggggcccatgccggtcaccgcggcatctgctgcgcagcgtcgcgggcgggttgggcgcaatcctcagaaggagaatgaccaatatattttcaccggtcagcccctcaataacgacgaggaccacgcccactggacggaggccaagatgctgctggataacatcaacaccccagaagggatcatcccggccctcttcgagcccgagcgggagaagtccgccgccatagacggcgagtaccgcctgaagggcgaatctcgtaagaccttcgtggagctgatgcgccgcggggacctcccagtctggctggcgcacaaggtggcctccgagggcataaagtacaccgaccgcaagtggtgcttcgatggccagcgcaacaaccagatcctggaggaaaacatggacgtggagatctggactaaggagggagagaagaagaagctgcgtcccaggtggttggacgcgcgcacatactccgatccattggccctcaaggagttcaaggattttgccgcgggccgcaagtcgatcgccctggacctggtcacggagataggacgggttccgagccacttagcccacaggacccggaacgctctcgacaacctggtgatgctccacacgagcgagcacggggggaaggcctatcgccacgcagtcgaagagctgccagagactatggaaaccttactcttactgggcctcatgatcttgttgacgggaggcgcaatgctattcctgatcagtggcaaggggatcggcaagacctcaataggcctcatctgcgtaatcgcttcctcgggcatgctctggatggccgagatccccctgcagtggatcgcatctgccatcgtactcgaattcttcatgatggtcctcctgatccccgagcccgagaagcagcgcacgccacaagacaaccagctggcctacgtggtgatagggatcctaactctcgccgccatcattgccgcgaacgagatgggcctgctcgagaccacgaagcgggaccttggtatgtccaaagaacctggtgtcgtgagccccacctcctacctggacgtggacctccaccccgcttccgcctggactctgtacgcggtcgccaccacggtgatcactcccatgctgcggcataccatcgagaactccaccgccaatgtgagcctcgccgcgatcgcaaaccaggcggtcgtgctgatgggcctggataagggctggccgatcagtaagatggacctcggcgtgcccctgctggcactcgggtgctacagccaggtcaaccctctgactctgaccgccgccgtgctcctgctgatcactcactacgccattatcggccccggtctccaggcgaaagccacccgcgaggcccagaagcggacggccgcggggataatgaaaaacccaactgttgacggaatcatgacaatcgacctggacccagtcatatacgactccaagttcgaaaaacagctgggccaggtgatgctcttggtgctgtgcgctgtgcagctcctgctgatgcgcaccagctgggctctgtgcgaggccctcactctggcaaccggccccataactacattgtgggaggggtcccccgggaagttttggaacacgacgatcgcggtaagcatggcgaacatcttcagaggatcctacctggccggggctggcctggcctttagcatcatgaagtcagtgggtaccggcaagcgcggcaccggtagtcagggcgagaccctgggtgagaaatggaagaaaaagctgaaccagctgagccggaaagagttcgacctctacaagaagtccggcatcacggaggtcgaccggaccgaggcgaaggaaggtctaaaacggggagagattacccatcacgccgtgagcagaggctctgccaagctgcagtggttcgtggagaggaacatggtgatcccggaagggcgcgtgatcgacctgggctgcgggcgtggagggtggagctattactgtgccggcttgaagaaggtgacagaggtcagaggttataccaagggagggcccggacacgaggaacccgtgccaatgtccacctatggatggaacatcgtaaagctgatgagcggaaaagacgtcttctacctcccacctgaaaagtgcgataccctgttgtgcgacattggcgagtccagtccctcccccaccgtggaagaaagccggacgatcagagtgctgaagatggtcgaaccttggctcaagaacaaccaattctgcatcaaggtgctcaacccctacatgcctaccgttattgagcacctcgagcgcttacagcgcaagcacggagggatgctggtcagaaaccccctaagtcggaactcaacccacgagatgtactggatctccaatggcaccggtaacatcgtggcctcggtgaacatggtctcccgtctactgctgaaccggttcacgatgacccatcgccgcccgacaatcgagaaggacgtcgacctcggtgcgggcacacgacacgtaaacgccgagcccgagacgcccaacatggacgtcatcggggagcggatcaagcgcatcaaggaagagcacaactccacctggcactacgacgacgagaacccgtacaagacctgggcctatcacgggtcctatgaggttaaggccaccggatctgcctccagcatgatcaatggtgtcgtgaaactgctcacaaagccatgggatgtagttccaatggttacccagatggctatgaccgacacgacgcccttcgggcagcagcgggtgttcaaggagaaggtcgacacccgcacaccgaggagtatgcccggcactcgcagagtgatgggtatcaccgccgaatggctctggcgtaccctggggcggaacaagaagccccgcctatgcacacgggaggagtttactaagaaggtgcgtacgaatgccgccatgggcgctgtcttcaccgaggagaaccagtgggactctgccaaggccgccgtggaggacgaggacttctggaagttggtggacagggagcgggaactgcacaagctgggcaagtgcggctcctgtgtctacaacatgatgggcaaacgcgagaagaagctcggcgagttcggcaaggccaaggggtcccgggccatctggtacatgtggctgggagcccgatacctggagttcgaggccttaggctttctgaacgaggaccactggttcagtcgggagaattcctattctggcgtcgaaggagagggcctgcacaagctcggttacatcctccgcgacatctctaaaatccccgggggtgcgatgtacgccgacgataccgcggggtgggatactcggatcacggaggacgacctacacaacgaggagaagatcacgcagcagatggatccggagcacagacagctcgccaacgccatattcaagctgacctaccaaaataaggtggttaaagttcagaggcccactcccaccggcacagtcatggacattatcagccgcaaagaccagcgaggctcggggcaggtcggcacttacgggctaaacaccttcaccaacatggaggcacagctcatacgacagatggagggagagggggtgctttctaaagccgacctggagaatccccacctcccggagaagaaaatcacgcagtggctggagaccaagggcgttgagcggcttaagaggatggcgatatccggcgatgactgcgtggtgaagcccatcgacgatcggttcgccaatgccctcctggcgttaaacgacatggggaaggtgcgcaaggacattccacagtggcagccctctaagggctggcacgattggcagcaggtgcctttctgctcccaccacttccacgagctcatcatgaaagacgggagaaagctggtagttccctgccggccccaggacgagttaatcggccgggcccgcatcagccagggagcggggtggtccctgcgggagaccgcctgcctgggcaaggcatacgcccagatgtggagcctgatgtatttccaccgccgcgaccttcgtcttgcgtccaacgccatttgctctgccgtccccgtccattgggtgccaacctcccggacgacctggagcatacacgcccatcaccagtggatgaccacagaggacatgcttacggtctggaaccgggtgtggatcgaggacaacccttggatggaggataagacccccgtgaccacctgggagaacgtcccgtacctcggcaaacgcgaggaccagtggtgtggcagtctgatagggctgacgtctcgggcaacttgggcgcagaacatcccaaccgccatccagcaggtccgctctctcatcggcaacgaagagtttctggactacatgccctctatgaagcgtttccgcaaggaggaggaaagcgagggggcaatatggtaa

SEQ ID NO: 25938 - RNA, 9873 nt, synthetic construct
  misc_feature 1..9873: note = derived and/or modified CDS sequence (opt11) from DENV-3__EU482566__SS-prME
  source 1..9873: mol_type = other RNA
acttctctctgcctgatgatgatcctccccgccgccctggctttccatcttacctcaagggatggggaaccccggatgatcgtcgggaagaacgagagaggcaagagcctgctgttcaagaccgcttccggtatcaacatgtgtaccctgatcgccatggacctgggagagatgtgcgatgacactgtgacctacaagtgtccccacatcaccgaggttgagccggaggacatagactgctggtgtaacctaactagcacctgggtcacttacgggacctgcaaccaggccggcgagcaccggcgcgacaagcgatccgtcgcactcgcgccacacgtgggaatgggactcgacacacgcacccaaacctggatgagcgccgagggtgcctggcgccaggtggagaaggttgaaacctgggccttgcgccacccggggtttaccatcctcgcattgttcctggcgcactacatcggcacatccctcacccaaaaggtggtgatcttcacgctgttgatgctagtcaccccgagcatgaccatgaggtgtgtgggtgtcgggaacagagacttcgtcgagggactgagtggggcgacctgggtagacgtggtcctggagcatggcgggtgcgtgacgaccatggcgaagaacaagcctactctcgacattgaactgcagaaaaccgaggcaacccaactggctaccctccggaagctatgtatcgagggtaaaatcaccaacatcaccaccgactcacgatgccctacgcaaggagaggccgtgctacctgaggagcaggaccagaactacgtctgcaagcacacttacgtggaccgagggtgggggaatggctgcggcctcttcggaaagggatccctggtgacctgcgcgaagttccaatgcctcgaacccattgaaggcaaagttgtgcaatatgagaacctaaaatacactgtaattatcacggtccacaccggcgaccaacaccaggtgggcaacgagacccagggagtcacggctgagattactccacaagccagcacaaccgaagctatcttacccgagtacggaaccctggggctcgagtgcagtccgagaactggcctggacttcaatgagatgatcctgcttaccatgaagaacaaggcctggatggtccaccggcaatggttcttcgatttgccactgccctggaccagcggcgccaccacggagacccccacctggaaccgtaaagaattgttagttaccttcaaaaatgctcatgccaaaaagcaggaggtcgtcgtgttggggtcacaggaaggggccatgcacaccgccctcaccggggccaccgaaatccagaacagcggcggcacttcgatcttcgccggacatttaaaatgccgcctgaagatggacaagcttgagctgaagggcatgagctacgccatgtgcaccaacacctttgtcctgaaaaaagaggtgtccgagacccaacacgggaccatccttatcaaggtggagtacaagggtgaggatgtcccttgtaagattcccttcagcacggaggacgggcaagggaaggcgcacaatggtcgcctgatcaccgccaatcccgtggtgactaagaaggaggaacccgtcaacattgaggccgaaccgccatttggggagtctaacatagtgattggcatcggtgacaacgccctgaagattaactggtacaaaaagggctccagcatcggaaaaatgttcgaggcgaccgcccgaggcgcccgtcggatggccatcctgggcgacacagcctgggactttgggtccgtgggcggggtcctcaacagcctagggaaaatggtgcaccaaatattcgggtctgcgtacacggctttatttagcggcgttagctgggtgatgaagattggcatcggggtgctcctcacctggattggtctgaacagcaaaaacacgtcaatgagcttctcgtgcatcgccatcgggatcatcaccctctaccttggcgccgtggtccaggcggatatggggtgcgtaataaattggaaaggaaaggagcttaagtgcggttctgggatattcgtgacgaacgaggtccacacctggaccgagcagtataagttccaggcggactccccgaagcgcctcgccacggccattgctggcgcctgggagaacggggtgtgcgggatccgctcgaccacccgtatggaaaacttactgtggaagcagatcgcgaacgaactcaactacatcctgtgggagaataatatcaagctcaccgtggtcgtcggtgacatcatcggcgtgctcgagcagggcaagcgcacactgacgccgcagccgatggagctgaagtactcctggaaaacctgggggaaggccaagatagtaacagcagagacgcagaacagcagttttattatcgacggcccaaacacccccgagtgccccagcgcttccagggcgtggaacgtgtgggaggtcgaagactacgggtttggcgtcttcaccactaacatctggctcaagttgcgcgaggtgtacacccagttatgtgatcaccggctcatgagcgccgccgtgaaggacgagcgggccgttcacgccgacatgggttactggatcgagagccagaagaacgggtcatggaagctggagaaggcgagcctgatcgaggtgaagacatgcacttggccgaagtcccacactctgtggagcaatggagtcctggagtccgacatgatcatacctaagtcactggccgggcccatttcccagcacaactaccgacccgggtaccacacccagaccgccgggccatggcacctcggtaaactggagctggacttcaactactgcgagggcacaaccgtcgttatcacggaaaattgcgggaccaagggcccaagcctgcgcaccaccaccgtgtccgggaaactgatccatgaatggtgctgcaggagttgcaccctgcccccattacggtacatgggcgaggacgggtgctggtatggcatggagatcagacccatctcggagaaggaagagaatatggtaaagtcgctggtgtccgccggtagcggaaaggtggataactttactatgggagtcctctgcttggcaatcctgttcgaggaagtgatgcgcgggaagttcggcaaaaagcacatgatcgccggggtgttctttacgtttgtcctgctcctgagcggccagataacctggcgggacatggcccacactctgatcatgatcggcagcaacgcatccgaccgcatggggatgggagtgacctacctcgcccttatcgccaccttcaaaatacagcccttcttagcgctggggttctttctgcggaagctgaccagccgcgagaacctcctattaggtgtgggcctggccatggccacaaccctgcagctgcccgaggacatcgaacaaatggccaacggtattgcgctcggactgatggccctcaagcttatcacccagtttgagacttaccagctgtggacggcgctgatcagcctgacctgcagcaacaccatttttacactgacggttgcttggcggaccgccactctgatccttgcgggggtgagcctactaccggtctgccagtccagctccatgcgcaagactgactggctcccgatgacggtagccgccatgggcgtgccgccactcccgctgttcatcttcagcctcaaggacacccttaaacggcgctcctggcccttaaacgagggggtcatggccgtgggcctcgtgagcatattggccagcagcctgctccgcaacgatgtcccgatggcgggccctctcgtagccggcggtctgttgatcgcctgctacgtgatcaccggaacctctgccgacctcacagtcgaaaaggccgcggacgtcacttgggaggaggaggccgagcagaccggagtttcacataacctgatgatcaccgtcgacgacgacggtaccatgcggataaaggacgacgagacggagaacattctcaccgttctgctgaagaccgcccttctgattgtgtccggcatcttcccctactcgatccccgcaaccctgctggtgtggcatacgtggcagaagcagacgcagcgttccggcgtgctctgggacgtcccctcgccgcccgagacccagaaggcggagttggaggaaggagtctataggatcaaacagcagggcatattcgggaagacacaggtgggagttggggtccagaaggagggtgtgttccacacgatgtggcacgttactaggggtgccgtcctcacctataacgggaagcgtttagagcccaactgggcctccgtgaagaaagatctgatcagctacggcggagggtggcggctctccgcccaatggcagaagggggaggaagtccaggtcatcgccgtggagccgggcaagaaccctaagaacttccagaccatgcccggcacgttccaaaccaccacgggcgaaatcggtgcgatcgccctcgacttcaagcccgggacgagcgggagccccataatcaaccgcgagggaaaggtggtcgggctgtatggcaacggcgtagtgactaagaacggagggtacgtctccggcatagctcagaccaacgctgagcccgacggaccgacccccgagctggaagaggagatgttcaaaaagaggaacctaacgattatggaccttcaccccgggagcggcaagacgcgtaaatacctgccggccatcgtccgcgaggcgataaagagacgcctccgtacactgatcctggcccccacacgcgtggtcgcggccgagatggaggaggcactcaagggtctgcccatccggtatcagaccaccgcgaccaagtctgagcatacaggccgcgagatcgtggacctgatgtgtcacgccacgttcacaatgcgcctcctgagcccggtccgcgtcccgaactacaacctcatcatcatggacgaggcccacttcactgatcccgcgagtatcgcagcgcgggggtacatcagcacccgtgtgggcatgggcgaagccgccgctatcttcatgacggccacgccgcccgggaccgccgacgccttcccgcaatccaacgctcccatccaggacgaggaacgggacatccccgagcgaagctggaactccggcaacgagtggatcaccgactttgccgggaaaacggtgtggtttgtccccagcatcaaggcgggcaatgacatcgccaattgcctacgcaaaaatgggaagaaagtaatccagctgagtcgcaagaccttcgacaccgagtaccagaagaccaagctgaacgattgggacttcgtggtcacgaccgacatcagcgagatgggggccaactttaaggcggatcgagttatcgatccgaggcggtgtcttaagcccgtgatcctgacagacggccccgagagggtcatcttagcggggcctatgccggtgaccgcggcttctgccgcccagcgccggggcagggtggggcggaatccccaaaaagagaatgaccaatatatcttcaccggccagcccctcaacaatgacgaggaccacgcccattggacggaggctaaaatgctgctggacaacatcaacacgcctgaggggatcatcccggccctcttcgagccggagcgggaaaagtccgccgccatcgatggcgagtaccggctgaagggcgaatcccgcaagaccttcgtcgagcttatgcgaaggggggacctccccgtgtggctggcccacaaggttgccagtgaggggattaaatacactgaccggaaatggtgctttgacggccagcgcaataaccagatcctggaggaaaacatggacgtggagatctggacgaaggagggcgaaaaaaagaagctccggccgcgctggctagatgcccggacgtattctgacccgctggccttgaaggaattcaaggactttgccgccggccgcaagagcatcgcgctggacctcgttaccgagataggccgcgtgccgtcgcacctggctcaccggactcgcaacgctctggacaacctagtgatgctgcacacgtctgagcacggagggaaagcctaccgtcacgctgtggaggagctccccgaaacaatggagacactgctgctactgggcctcatgatccttctcaccggtggggcgatgctgttcctcataagcggcaagggtataggcaagacatccatagggttgatatgcgtcatcgccagctccggcatgctctggatggccgagattcctctccagtggatcgccagcgcgatcgtgctggagttcttcatgatggtgctcctgatccctgagcctgagaagcagcgtacgccccaggacaaccagctggcctacgtcgtgatcgggatcctcacgttagcagccatcatcgcggccaacgagatgggactgctggagaccacgaaaagagatctggggatgtccaaagagcctggggtggtcagccccacgtcctacctggatgtggaccttcaccccgcaagtgcctggaccctgtacgccgtggcaaccacggtcattacccccatgttacgccacaccatcgagaacagtaccgctaatgtgtccctcgccgctatcgcaaaccaagctgtggtacttatgggactagacaagggatggccaatcagcaaaatggatctcggggtgcccctgctagccttagggtgctacagccaggtcaaccctttgactttgaccgccgctgtgttactgctcatcacccattacgccatcatcggcccagggttgcaggcgaaagccacgcgtgaggcccagaagcgcacggccgccgggatcatgaaaaaccctaccgtcgacggcattatgaccatcgacttagacccagtcatatacgattccaaatttgagaagcagctggggcaggtcatgctgttggttctgtgtgcggtacagctgctgctgatgcggacctcgtgggccctctgcgaggctctgactcttgcgaccggccccatcactaccctgtgggagggtagtcccggaaagttttggaatacgaccattgcggtaagcatggcaaacatctttcgcggctcctacctcgcaggagcaggcctggccttcagcatcatgaaatccgtgggtaccggcaagcgtggtaccgggagccagggagagaccctcggggagaaatggaagaagaagctgaaccagctgagccgcaaggagtttgacctctataagaaaagcggcataacggaggtggaccgcacagaggcgaaggaagggctaaagcgcggggagattacacaccacgccgtcagccggggctccgccaagctgcagtggttcgtggaacgaaatatggtgatcccggagggacgggtcatcgacctcgggtgcgggcgcggtggttggtcatactactgcgccggcctgaaaaaggtgaccgaggtgcggggctacacgaagggggggccgggccacgaggaacccgtccccatgtccacctatggctggaatatcgttaaattaatgtccggtaaagacgtattttatctcccgcccgaaaagtgcgacaccctcctgtgcgacataggtgagtcctcccccagtcccacggtagaggagagcaggacgatcagagtgttaaagatggtggaaccatggctcaagaataaccaattctgcatcaaggtactgaacccctacatgcccaccgttatcgaacacctggaacgcctccaacgcaagcatggcgggatgctagtgcgaaacccgctgtcccgtaatagcacacacgagatgtactggatttccaacggtactgggaacatcgtcgccagcgtgaacatggtgtcccggctcctgctgaaccgcttcacgatgacccacagacgtccgaccatcgaaaaggacgtcgacctcggcgcgggcacccgccacgtcaacgccgagcccgagacgcctaacatggacgtgatcggggaacgtatcaagcgaatcaaggaggagcataactcaacatggcactatgacgacgaaaacccgtacaagacttgggcctaccacgggtcctacgaggtcaaggccaccggatcagcctccagcatgatcaacggggtcgtgaaactgctgacgaagccctgggacgtggtgcccatggtcacccagatggctatgacagacacaactcccttcgggcagcaacgtgtgttcaaggagaaggttgacacccggaccccgcgctcgatgcccgggacccggcgcgtgatgggcatcacggcagagtggctttggcggaccttggggcgcaataagaagccgagactgtgtacccgcgaggagtttaccaagaaggtccgcacgaacgccgccatgggagcggtgtttaccgaggagaaccaatgggactctgccaaagccgccgtcgaggacgaagatttctggaagctggtggaccgcgaacgcgagctgcacaagttagggaagtgcgggtcttgcgtttacaacatgatgggcaagcgggagaagaagctcggcgagttcggcaaggcaaaggggtcccgcgctatctggtatatgtggctgggcgcccgttatttggagttcgaggccctcgggttcctcaacgaggaccattggttcagccgcgagaactcgtacagcggagtcgagggggaggggcttcacaagctcggctacatcctgcgtgacatctccaagatccccggtggcgccatgtatgctgacgacaccgccgggtgggacactcgtatcacggaggacgacctgcacaacgaagagaagatcacccagcaaatggaccccgagcaccgtcagttagccaacgccatattcaagcttacctaccagaacaaggtggtgaaggtccagcggcccacccccaccggcactgtaatggacatcatcagccggaaagaccagcgcggctccggacaagtgggaacctatggtctgaacaccttcaccaacatggaggcgcagctcatacggcagatggagggtgagggggttctgtctaaggccgacctggagaacccgcatctcccggaaaagaagatcacccaatggcttgaaaccaaaggggtggagcgcctgaagcggatggcgatctccggtgacgattgcgtggtgaagccaattgacgaccgcttcgccaacgccctcttagccctgaacgacatgggcaaggtgcggaaagacatcccccaatggcaacccagcaagggctggcacgattggcagcaggtcccattctgctcccaccactttcacgaactaatcatgaaggatgggcgcaagctggtcgttccctgccggccccaggacgagctgatcggccgcgcccggatcagccagggggcgggctggtcgttaagagagacggcttgcctgggcaaggcatatgcacagatgtggagcctaatgtacttccaccggcgcgacctgcggctggcgtctaacgccatctgcagcgcggtacccgtccactgggtgcccacctcccggacgacctggtcgatccacgcccatcaccagtggatgaccactgaggacatgctgacggtgtggaatcgcgtttggatcgaggacaatccctggatggaggacaagacccccgttaccacctgggagaatgtcccgtaccttgggaagcgagaggaccagtggtgcggctcactgatcgggttaacgtcccgcgccacttgggcgcaaaacatcccgaccgcgatacagcaggtcagaagcctcattggcaacgaggaattcctggactatatgccctctatgaagcgcttccggaaggaggaggagagcgagggggccatttggtga

SEQ ID NO: 25939 - RNA, 9873 nt, synthetic construct
  misc_feature 1..9873: note = derived and/or modified CDS sequence (opt11) from DENV-3__EU529702__SS-prME
  source 1..9873: mol_type = other RNA
acctcgctctgcctcatgatgattctgcccgcagccctggcgttccacctcaccagccgggacggggaaccccgtatgatagtggggaagaatgaacgcggcaagagccttctgtttaagaccgccagcgggatcaatatgtgcaccctcatcgcaatggacctgggggagatgtgtgacgataccgtgacctacaagtgcccccacatcacggaagtcgagcctgaggacatcgattgctggtgcaatctgacgagcacgtgggtgacctacgggacttgtaaccaggccggggagcaccgtcgcgacaagcggtccgttgccctcgcgccgcacgtgggtatggggcttgacacccgcacccagacttggatgtcggcggagggggcctggcggcaggtagagaaggtggagacgtgggccctgcgacatccggggttcaccatcctcgcgctgtttctggcccactacgtgggcacctccctcacccagaaggtggtgatcttcatcctgctgatgctcgtgactcccagcatgaccatgcggtgcgtgggggtcggcaatcgcgacttcgttgagggactgtccggggcaacctgggtggacgtagtcctggagcacggcgggtgcgtgaccacgatggccaagaataaacccaccttggacatcgagctgcagaagaccgaggccacccagctggcgactctccggaagctgtgcatcgaaggcaagatcacgaacatcacgaccgacagtaggtgccccacgcagggcgaggctgttctgcccgaggagcaggaccagaattacgtgtgcaagcacacctacgttgacagagggtggggcaacgggtgcggtctcttcgggaagggctccctggtgacctgcgccaagttccaatgcctggagcccatcgaggggaaggtagtgcagtacgagaacctcaagtacaccgtcatcatcactgtgcataccggggaccagcaccaggtcggcaacgagacccagggggtgacggccgaaataacgcctcaggcctcgaccaccgaggccatcttacccgagtacggcacgctggggctcgagtgctccccgcgtacgggcctggatttcaacgagatgatcctgctcacgatgaagaacaaggcctggatggtgcaccggcagtggtttttcgacctgcccctgccctggaccagcggcgccaccactgagacgcccacctggaaccgtaaagaactcctggtcaccttcaagaacgcccacgcgaagaagcaagaagtcgtagttctaggtagccaggagggcgcgatgcacacagccctcacaggagccaccgagatccagaacagcggcgggacctccatcttcgccggccacttaaaatgcagactgaagatggacaagctcgaactgaagggtatgagctacgccatgtgcaccaacacgttcgtgctgaagaaggaagtgtccgagactcaacacgggaccatcctcatcaaggtcgagtacaagggcgaggacgtgccgtgcaaggtgcccttcagcaccgaggatgggcagggcaaggcgcacaacggtcggttgatcacggcaaaccccgttgtcaccaagaaagaggagcccgtaaacatcgaggcagaaccgcccttcggggagtcaaatatcgtcatcggcattggggataacgccttaaaaatcaactggtataagaagggctcctcaatcgggaagatgttcgaggcgaccgccaggggcgcacgccggatggccatcctgggagacaccgcctgggacttcggttccgtgggcggggtgctcaattcgctgggcaaaatggtccaccagatcttcgggtctgcgtatacggccctgttcagcggcgtgagctgggtcatgaagatcggaatcggggtcctcctgacctggatcgggctaaacagcaagaacacctccatgagcttctcatgtatcgtgatcgggatcatcaccctctacctgggcgcagtggtccaggccgacatggggtgcgtgatcaactggaagggcaaggagctgaagtgcggcagcgggatattcgtgacgaacgaggtccacacctggactgagcaatacaagttccaagccgactcccccaagcgactcgcgaccgccatcgcaggcgcctgggagaacggggtgtgcggcattcgcagcacaacgcggatggagaacctgctttggaagcaaatcgccaacgagttaaactacatcctgtgggagaacaacattaaacttacggttgtcgttggggacatcatcggcgtcctcgagcagggcaagcgcaccctgacgccacaaccgatggagttgaaatacagctggaagacctgggggaaggccaagatcgtgactgcggagacccagaacagcagtttcatcatcgacggtcccaacactcccgagtgcccctctgcctcccgggcctggaacgtgtgggaggtggaggactacggtttcggcgtcttcagcaccaatatctggctcaaactccgtgaggtgtacacccaactgtgcgaccaccggctcatgagcgcggcagtcaaagatgagcgcgccgtccacgcggacatgggctactggatcgagtcccagaagaacggaagctggaagctggagaaggcctccctgattgaggtgaagacatgcacctggcctaagtcccacacgttgtggtcaaacggcgtgctggagtccgacatgataatccccaaatccctggcggggcctatcagccagcataactaccgtccgggctaccacacccaaaccgccggaccgtggcacctcggcaagctggaactggacttcaactactgcgaggggaccacggtggtcatcaccgagaactgtgggacccgcgggccctccctccggaccacaaccgtctcggggaagctgattcacgagtggtgttgccgctcctgcaccctgcccccgctccggtacatgggtgaggacggatgttggtacggcatggagatacgccctatcagtgagaaagaagagaacatggtgaagtcccttgtgagcgccggctccgggaaggtggacaacttcaccatgggcgccctgtgtctcgccatcctgtttgaggaagtcatgcgggggaagttcggcaagaaacacatgatcgctggggtgttcttcacgttcgttctgctcctgagtggacagatcacctggcgcgacatggctcacaccctgatcatgattggctcaaatgccagcgaccggatggggatgggcgtgacctacttagccctaatagccactttcaaaatccagccattcttggccctcgggttcttcctgcgcaaattgactagcagagaaaacctccttctgggcgttggcttggccatggccaccaccctgcagctgcccgaggacatcgagcaaatggccaacgggatcgcgctcggtctcatggcactgaagctaatcacgcagttcgagacctaccagctgtggaccgccctgatctcgctgacctgcagcaacacgattttcaccctgaccgtggcgtggaggacggccacattgatcttggcgggggtgtccctgctgccggtttgccaaagcagcagcatgcgcaagaccgactggctccctatgaccgtcgccgccatgggcgtgccgcccctcccgctgtttatcttctccctcaaggacaccttgaagcgccggagctggcctctgaacgagggcgtgatggctgttggcctcgtgtcgatccttgccagctccttattgcggaacgacgtgcccatggcgggcccgctggtcgccgggggactgctcatcgcatgttacgtgataacggggactagcgccgatctgaccgtggagaaagccgcggatgtcacctgggaagaggaagccgaacagacgggcgtgtcccacaacctgatgatcaccgtggacgacgacgggaccatgcgcatcaaggacgatgagaccgagaacatcctcaccgtcttactgaagacagccctccttatcgtgagcggcatcttcccgtattccatccccgccacgcttcttgtgtggcacacctggcaaaagcagacccagcgtagcggtgtcctgtgggacgttcctagcccgccagagacgcagaaggccgagctggaggagggagtgtaccgcatcaagcagcagggcatcttcgggaagacccaggtaggcgtgggggtgcaaaaagaaggcgtcttccacaccatgtggcacgtgacgcggggcgcggtgctcacctacaacgggaaacgtttggagcccaactgggcctccgtcaagaaggacctgatctcctacggcgggggctggcggctcagcgctcagtggcagaagggggaggaggtgcaggttatcgccgtcgaacccggcaagaaccccaagaacttccagaccatgccgggcacttttcaaaccacaactggggagattggagcaatcgctctggacttcaagcccgggaccagcggtagtccgatcatcaacagagagggaaaggtggtggggctgtacggcaatggcgtcgtgaccaaaaacggcgggtacgtgagcggaatcgcccagactaacgccgagcccgatggcccgacccctgaactcgaggaggagatgttcaaaaagcggaacctcaccatcatggacctgcatcccgggtccggtaagacccggaagtacctgccggcgatcgtccgggaggcgatcaagcgccggctccgcacgcttatactggcgccgacccgtgtggtggccgcggagatggaggaggccctcaaggggctgcctatcaggtaccagaccacagccacaaagagcgagcacaccgggcgggagatcgtcgacctgatgtgccacgccaccttcaccatgcgccttctgtccccggtgcgggtgccgaattacaacctgatcatcatggacgaggcccacttcacggatcccgcaagcatcgccgcacgcgggtatatatctacccgggtcggcatgggcgaggccgccgccattttcatgaccgcgacgccgccgggcacggccgacgccttccctcaatctaacgccccaatccaggacgaggagcgcgatatccccgaacgctcctggaatagcggcaacgagtggataaccgacttcgccgggaagaccgtgtggttcgtcccttcgattaaggcggggaacgatatcgccaactgtctccggaagaatgggaagaaggtcattcagctgagccgcaagacattcgacacggagtaccagaagactaaactgaacgactgggacttcgtggtgaccacggatatctccgagatgggcgccaacttcaaggcagatcgggtcatcgacccgcggcgctgcttaaaacccgtgatcctgacggacggcccagagcgcgtgatcctggccggtcccatgccggtaacagcggccagcgccgcgcagcggcgcggacgggtggggcgaaacccgcagaaggagaacgaccagtacatcttcaccggccagccattgaacaacgacgaagaccacgcccactggaccgaggctaagatgcttctggacaacattaacacccccgaggggatcatcccagccctcttcgagcccgagcgggagaaatccgccgccatcgacggcgagtaccgcctgaagggcgagagcagaaagacgttcgtagagctgatgcgacgcggcgacttgcctgtatggctagcgcacaaggttgccagtgagggtatcaaatacaccgaccgtaagtggtgctttgacggtcagcggaacaaccagattctggaagagaacatggacgtcgagatttggaccaaagagggcgagaagaagaagctccgcccccgatggctggacgcccgcacctatagcgacccgttggccctgaaggagttcaaggacttcgccgcagggcgtaagtccatcgcgctggacctggtgacggagatcgggcgggtgcccagccacttggcccaccgcacccggaatgccctggacaacctcgtaatgctccacacctctgagcacggcgggaaagcctaccggcacgcggtggaggagctgcccgagaccatggagactctgctcctgctgggcctcatgatcctgctgaccgggggtgccatgctatttctgatcagcggcaaggggatcggcaagaccagcattgggttaatctgcgtgatcgcctccagcggcatgctctggatggccgagatcccgctgcagtggatcgcctccgcgatcgtcctggagttcttcatgatggtcttgttgatccccgagcctgaaaagcagcgcacgccccaggacaatcagctggcatacgtggtcatcggcattctcacgctggccgcaatcattgccgctaacgagatgggcctgctcgagaccacgaagcgcgatctgggcatgagcaaggagcctggggtagtgtctccaaccagctacttagacgtggacctccatcccgcctccgcttggacgctgtacgccgtggcgaccaccgtgatcacccctatgctgcggcacacgatcgagaactccaccgcaaacgtcagtctcgccgccatcgccaaccaggcggtcgtgctgatgggccttgacaaggggtggccgattagcaagatggatctcggcgtgccgctgttggcgctcgggtgctacagtcaggtgaatcccctgacgcttaccgccgccgtcttgctgctgatcacccactatgccatcataggccccggcctccaagcgaaagccactcgcgaggcacagaagaggaccgccgccgggatcatgaaaaacccgaccgtcgacggcatcatgacgatagatctggatcccgtgatctacgactcaaagttcgagaaacagctgggccaggtgatgctcctggtcctgtgcgctgtccagctcctgctgatgcgcacctcctgggccctatgcgaggccctgaccctagccaccggccccatcacgaccctctgggagggcagccccggaaagttctggaacaccaccatcgctgtgtctatggccaacatcttccggggaagctacctggccggtgcgggcctggccttctccatcatgaaaagcgtcgggacggggaaaagaggtaccgggagccagggcgagaccctcggggagaagtggaagaaaaagttaaaccaactgtcccgaaaggagttcgacctctacaagaagtccggcatcaccgaggtggaccgcactgaggcgaaggaagggctgaaacggggagagatcacgcaccacgccgtgtcgcgcggcagcgctaaactgcagtggtttgttgagcggaacatggttatacctgaggggcgcgtgattgacctcggctgcgggcggggagggtggtcctactactgcgccggcttaaagaaggtcaccgaagtgcgtggctacactaaaggcgggcccgggcacgaggagcccgtgcccatgagcacctatggatggaacatagtcaaactgatgagcgggaaagacgttttctacctaccacccgagaagtgcgacacgttgctgtgcgacataggcgagagctcccccagccccaccgtggaggagtccaggaccatcagagtcctaaagatggtggagccttggctcaagaacaaccagttctgcatcaaggtgctgaacccctacatgcccaccgtcatcgagcatctggaacgcctccagcggaagcacggcgggatgctggtgcgcaatcccctgagccggaacagcacgcacgagatgtactggatcagcaatggcaccgggaacatcgtggcctccgtcaacatggtgagccgcctcctgctgaaccggttcaccatgactcaccgccggccgacgattgagaaggatgtcgatctcggcgcgggcaccagacacgttaacgcggagcccgaaacgcccaacatggacgttattggggagcggatcaagcgcatcaaggaggagcacaactctacatggcactacgacgacgagaacccgtacaagacctgggcttaccatggcagctatgaggtcaaggccaccgggtcagcgagcagcatgatcaacggcgtggtgaagttgctgaccaaaccctgggacgtcgtacccatggtgacgcagatggcgatgacagatacgacccccttcggtcagcagcgggtcttcaaagagaaggtggacacccgcacgcctcggtccatgcccgggacgagacgggtgatgggaattacggccgaatggctttggcgcaccctggggcgtaacaagaagcctcgtctatgcacccgggaagagttcaccaagaaggtccgcacaaacgccgcgatgggcgcggtgttcaccgaggagaaccagtgggacagcgccaaggccgccgtcgaagacgaggacttctggacgttagtggaccgcgagcgggagctgcacaagctggggaagtgcggctcgtgcgtgtataacatgatggggaagcgtgagaaaaagctcggcgagttcggcaaggccaaggggtcacgggcgatatggtacatgtggttgggcgcccgctacctggagttcgaggcccttgggtttctgaatgaagaccactggttctctcgagagaacagctactctggcgtggaaggcgagggtctgcacaagctcggctacatactgcgcgacatcagcaagatccctgggggcgccatgtacgccgacgacacagcgggctgggatacccggatcaccgaggatgacctccacaacgaggagaagatcacgcagcagatggacccggagcaccggcagctcgccaacgcgatatttaagctgacctaccagaacaaagtcgtgaaggtgcagcggcccacgcccaccggcaccgtaatggacatcatctcccgaaaggatcagcgggggtctggccaggtgggcacctacggacttaacaccttcaccaacatggaggcccagctcatccgccagatggagggcgagggggttctgtccaaagcagacctggagaacccccatctgccggagaagaaaattacccagtggctagaaaccaagggcgtcgagcggctgaagcggatggcgatcagcggcgacgattgcgtggtgaagcccatcgatgaccggttcgccaacgccctcctggccctgaacgacatgggaaaggtgcgcaaggacatcccccagtggcagccttccaaaggctggcacgattggcagcaagttccgttctgcagccaccacttccacgaattaatcatgaaggatggccggaagctggtagtcccctgccgcccccaggacgagctgatcggccgggccagaatctcccagggcgcgggctggagcctccgggaaacagcctgtctgggcaaggcctacgcccagatgtggtccctgatgtacttccaccgacgcgacctgcggctggcgagcaacgccatctgctccgccgtgcccgtgcactgggtccctaccagccgcaccacatggagcatccacgcgcaccaccagtggatgaccaccgaggacatgctgacggtatggaaccgggtctggatcgaggataacccctggatggaggacaagacacccgttaccacgtgggagaacgtgccctacctggggaagcgcgaggatcagtggtgcggctccctgatcgggttgaccagccgtgccacgtgggcgcagaacataccgaccgcaatccagcaggtccgctccctcatcggcaacgaggagtttctggactatatgccgagcatgaagcggttccggaaggaggaggagtccgaaggggccatatggtga

SEQ ID NO: 25940 - RNA, 9873 nt, synthetic construct
  misc_feature 1..9873: note = derived and/or modified CDS sequence (opt11) from DENV-3__EU529703__SS-prME
  source 1..9873: mol_type = other RNA
accagcctgtgtctcatgatgatactgccggcggccttggcgttccacctcaccagccgggacggggaaccccggatgatcgtggggaagaacgagcgcggcaagagcctgctgtttaagactgcctccgggatcaacatgtgcactcttatagcaatggacttaggagaaatgtgcgatgacacagtgacctacaaatgcccacacatcaccgaagtggagccagaggacatcgactgctggtgcaacctcacgagcacgtgggtcacctacgggacctgcaaccaggcgggagagcaccggcgcgataaacgctcagtggccctagcgccccacgtgggcatggggttagacacccgcacccagacctggatgtcggccgagggcgcctggcggcaagtcgagaaggtggagacatgggccctgagacatcccggattcaccatcctcgccctgttcctggcacactacatcggaacctccctcacccagaaggtggtgatcttcatcttgctaatgctagttacgcccagcatgacaatgcgctgtgtcggcgtgggcaaccgcgatttcgttgagggcctgtcaggggcaacctgggtggatgtggttctagaacacggcgggtgtgtgaccacgatggccaagaacaagcccaccctcgacatcgagctgcagaagactgaggccacccagctggcgacgctccggaaactgtgtatcgagggcaagatcaccaacatcaccaccgatagccgctgcccaacacaaggtgaggccgcccttcccgaggaacaggaccagaactacgtctgcaagcatacctatgtggacagggggtggggaaacggatgcggcctgttcgggaagggctccctggtgacctgcgcgaagttccagtgcctggagcccatcgagggcaaggtggtccagtacgagaatctcaaatacaccgtgattatcacggtgcacaccggcgaccaacaccaggttggaaacgaaactcagggggtgaccgccgagatcacccctcaggccagcaccaccgaggcaatcctgcccgagtatggaaccctggggcttgaatgctctccgcgcaccggcctggactttaacgagatgattttactcacgatgaagaacaaggcctggatggtacacagacagtggttcttcgaccttcccctcccctggaccagtggggcaacgaccgagacgccgacctggaaccgcaaagaactactggtgaccttcaaaaatgcccacgctaaaaagcaagaagtggttgtgctagggtcccaggagggcgccatgcataccgcgctcacgggggccaccgagatccagaactcgggggggacctccatcttcgctggacacctgaagtgccggctgaagatggacaagcttgagttaaagggcatgtcctacgcgatgtgcaccaatacgttcgtgctgaaaaaggaagtctccgagacacagcatggaactatccttataaaggtggagtacaagggcgaggacgccccatgcaaaattcctttcagcaccgaagacggacagggcaaggcccacaacggcagactaataaccgccaacccagtcgtcacaaagaaagaagagccggttaacatcgaggcagagccgccctttggggaatcaaacatcgtgatcggcatcggggacaacgcactgaagatcaactggtataagaaaggctccagcatcgggaaaatgttcgaggccaccgcccggggcgcccgccgcatggcgatactgggcgacacggcctgggactttgggtccgtcgggggtgtgctcaacagcctaggcaagatggtgcaccaaatttttgggagcgcctacacggcccttttctcaggcgtatcctgggtgatgaaaatcggcatcggggtgctcttgacctggatcggcctgaactccaagaacaccagcatgagcttctcgtgcattgccatcgggattatcaccctctacctgggcgcggttgtgcaggccgacatggggtgcgtgattaattggaagggcaaggagttgaagtgcggcagcgggatcttcgtcaccaacgaggtgcatacctggaccgagcaatacaagtttcaagccgattcgccgaagcgtctcgccaccgcgatcgcgggggcctgggagaacggagtgtgcggcattcgttcaacgacccgtatggagaacctgttgtggaagcagattgccaacgagctcaattacatcctgtgggagaacaacatcaagctcaccgtagtggtcggggacatcatcggcgtcttggagcagggaaagcgcacgctgaccccccagccaatggagttaaagtactcttggaaaacctgggggaaagccaagatcgtgacggccgaaacccagaactcttcgttcattattgacggccccaacacgcccgagtgtccgagcgcgtctcgtgcctggaacgtgtgggaggtcgaggactatgggttcggcgtgtttacaacgaacatctggctcaagctgcgcgaggtatacacacagctgtgcgaccatcggctaatgtcagccgcggtaaaggatgagagggcggtccacgccgatatgggctattggatcgaatctcaaaagaacgggtcctggaagttggagaaggccagcctgatcgaggtaaagacctgcacgtggccgaagagccacaccttgtggagcaacggcgttctggagtccgacatgatcatccccaagagcctcgcgggaccaatcagccagcacaaccatcggcctggctatcacacccagaccgccgggccatggcatctcggtaaactggaacttgatttcaactattgcgagggcacgaccgtggtgattaccgaaaactgcgggacccgcggaccctctctgcgcacgaccacagtctccggaaagctgatccacgaatggtgctgccgtagctgcacgctgcccccgctccggtacatgggggaggacgggtgctggtacggcatggagatccgtcctatctcggagaaagaggaaaacatggtaaagtccctggtgtccgcgggctcggggaaggtggacaacttcaccatgggggtgctgtgccttgccatccttttcgaggaagtaatgcggggaaaattcggcaagaagcacatgatagccggggtcttcttcacgtttgtgctgttactttctggtcaaatcacctggcgggacatggcacacaccctgataatgatcggcagcaacgcctccgaccgcatggggatgggcgttacgtacctcgcgttaatagcgacattcaagatccagcccttcctggccctagggttcttccttcgcaagctgaccagccgcgagaacctgctgttaggcgtcggcttggcgatggcgaccacgcttcagctgcccgaggatatagagcagatggccaacggtatcgccctcggcctgatggccctgaagctcatcacgcagttcgagacctaccagctgtggactgccctgatctcgctcacgtgctcgaacactatcttcactcttaccgtggcgtggcgcacggcaaccctgatcctcgcgggggtaagcctgctcccggtctgccagagttcgtccatgcggaaaaccgattggctccccatggccgtggcggccatgggcgtgccgcccctcccgctgttcatctttagcttaaaagacaccctgaagcgccgctcttggcccctgaatgagggcgttatggcggttggcctcgtaagcatactggcctcgtctctgcttcgtaacgacgtgcctatggcgggcccattggtggccggcggcctgctcatcgcctgctatgttatcacggggacatccgccgacttaaccgtggagaaggccgccgacatcacctgggaagaggaagccgaacagaccggtgttagccacaacctgatgatcaccgtcgatgatgatggcactatgcgcatcaaagacgacgagaccgagaacatactcaccgtgttgctgaagacagcgctcctcatagtgtccggaatcttcccttatagcattcccgcgacgctgctcgtctggcacacgtggcagaagcagacacagcggagtggcgttctgtgggacgttccctcaccccccgagacgcagaaggccgaactggaagagggtgtctaccgcattaagcagcagggcatcttcgggaagacccaggtgggcgtgggggtgcagaaggaaggtgtattccacaccatgtggcacgtcactcggggggcagttctgacgtacaacggaaaacgtctggagcccaactgggcgtcggtgaagaaggacctgatcagctacggcggaggttggcggctctccgcccagtggcagaagggggaggaggttcaggtcatagctgtcgagcccggtaagaaccctaagaacttccagaccatgcccggcacgttccagaccacgacgggtgagatcggcgccatcgctctggactttaaacccgggaccagcggctctcccattatcaatagggaggggaaagtggtcgggctgtacgggaacggggtggtgaccaagaacggcgggtatgtctccggaatcgcacagacaaacgccgagcccgacggcccgacccccgaactggaggaggaaatgttcaaaaagcgtaacttaaccattatggacctgcaccccgggagtggcaagactcgcaaatacctgccggcgattgtgcgggaggcaatcaagcgccggttacgaacgctgattttagcccccacccgggtcgttgcggccgaaatggaggaggcccttaaggggcttcccatccgctaccagaccaccgcaacaaagtccgagcacactgggcgggagattgtggacctgatgtgccacgccaccttcaccatgcgcttgctgtcgcccgtgcgagtccccaactacaatctgataataatggacgaggcgcacttcacggaccccgccagtatagctgctcgcgggtatatcagtacccgcgtgggtatgggcgaggcggccgccatcttcatgaccgccacgccgccagggacggccgacgcgtttccgcagtcaaacgcccccatccaggacgaagagcgcgacatccccgaacgcagctggaactccggcaacgagtggatcaccgacttcgccgggaagaccgtgtggttcgtccccagcatcaaggccgggaacgacatcgcaaactgcttacgtaaaaatggaaagaaggtgatccaactctcgcgcaaaacattcgacacggagtaccagaaaaccaaactgaacgactgggacttcgtggtcaccaccgacatttccgagatgggcgcgaacttcaaagccgaccgtgtgatagatccccggcggtgcctcaaacccgtgatcctaacggacggcccggaacgtgtcatcctggccgggcccatgccggtgactgccgcatccgcggcccaacggagaggccgggtgggccgcaaccctcaaaaagagaacgaccagtacatcttcaccggccagcccctcaacaatgacgaggatcacgcccactggactgaggccaaaatgctgctagacaacattaacacacccgaggggatcatcccggccctcttcgaacccgaacgcgagaagtccgctgccatcgatggcgagtaccgcctgaagggcgagagtcggaagacgttcgtcgagctgatgcgccggggggacctcccggtgtggctggcccacaaggtggccagcgaggggatcaagtatacagacaggaaatggtgcttcgacgggcagcgaaacaaccaaatcctggaagagaacatggacgtagagatctggaccaaggagggagagaagaaaaagctcagaccccggtggctggacgcgcgcacatattccgacccgctcgccctcaaggagttcaaggacttcgcggccggcagaaagtccatcgcactggatttagtgacggagatcgggcgggtgccctcccacctcgcgcacagaacacggaacgcgttggataacctggtgatgttacataccagcgagcatggagggcgcgcctataggcatgccgtggaggaactgcctgagaccatggaaactcttctcctgctaggcctcatgatcttactaaccgggggcgccatgctgttcctgatcagtggcaaaggaatcggcaagacctccatcgggctgatttgcgtcattgcgtcatccggcatgctctggatggccgagatcccgctgcagtggatcgccagcgccatcgtgctcgagtttttcatgatggtgttactgatccccgagcctgaaaagcagaggactccccaagacaaccagttggcctacgtcgtgatcgggatcctcacgctagcggccatcatcgcagccaacgagatgggcctgctcgaaaccaccaagagagacctgggaatgtccaaggagccgggggtagtcagccccacttcctacctggacgtggacctccaccccgcgtccgcctggaccctgtatgccgtcgcaaccacagttataacgcccatgttacgccacacgatagaaaactcaactgccaatgtatcactcgcagccattgccaatcaagccgtggtcttaatgggcttagataaggggtggcccataagtaagatggacctcggcgtacccctgctggccctcggttgctacagccaggtcaaccccctgactctgactgcggcagtcctgctgttaattacgcactacgcgatcatcggtcccggcctccaggccaaggccacccgtgaggcgcagaagcgcaccgccgccgggatcatgaagaaccccaccgtagacggcatcatgacgatagacctggaccccgtcatctacgacagtaagtttgagaagcagcttggtcaggttatgctcctggtgctgtgcgcggtgcagctcctgctgatgcggacctcttgggcgctttgtgaggctctgactctggcaaccggacccataaccacgctctgggagggctccccagggaagttttggaacacgaccatcgccgtcagcatggccaacatcttccgcggcagctacctggcgggggccggccttgccttctcaatcatgaaatcggtggggacgggcaagcggggcaccggatcacagggcgaaaccctcggggagaagtggaaaaagaagctaaatcagcttagccgcaaggaattcgacctctacaagaagtccggcatcaccgaggttgacaggaccgaggcaaaggaagggctcaagcgcggcgagataactcatcatgctgtaagccggggctctgcgaagctgcaatggtttgtggagcgcaacatggtgataccggaggggcgggttatcgacctcggctgcggacgtggcgggtggtcctactactgcgctgggctgaagaaggtgaccgaggtgaggggttacacaaagggcgggcccggccatgaggaacccgtacccatgtccacctatggctggaacatcgtgaagctgatgagcgggaaggacgtgttctaccttccaccagagaagtgcgatactctgctgtgcgacatcggcgagtcctctccttctcccactgtcgaagagtctcgcactatccgcgtgctgaagatggtggagccctggctcaaaaacaaccagttctgcatcaaggtcctgaacccctacatgcccaccgtgatagaacacttagaacggctccaacgaaagcacggcggtatgctagtgcggaatcccctgtcccgcaactctacgcacgagatgtactggatctcgaacggaaccggcaacatcgtggcatccgtgaacatggtttcacggttgctgctcaacagattcacaatgacacaccggagacctacgatagagaaagatgtggacctcggcgccgggacccgacatgtgaacgcagagcccgaaacccccaacatggacgtgatcggtgagcgcataaagcggatcaaggaggagcacaacagcacctggcattatgacgacgagaacccatacaagacgtgggcgtaccacggatcctacgaggtcaaggccaccgggtccgcctccagcatgatcaacggcgtggtgaagctgctgaccaagccgtgggatgttgtgcccatggttacacaaatggccatgacggataccacccccttcgggcagcagcgagtcttcaaggagaaggttgacacgcggacgccccgctcgatgcccggcacgcggcgtgtaatgggcatcacagcagaatggctttggcggaccctcgggagaaacaaaaagcctcggctttgtacacgcgaggagttcaccaagaaggtgcgcaccaatgctgcgatgggcgcggtcttcaccgaggagaaccagtgggactccgccaaggcggccgtcgaggacgaggacttttggaagctcgtggaccgggagcgcgagctgcacaagctcgggaagtgcggcagctgcgtctacaacatgatggggaaacgggagaagaagctaggcgagttcggcaaagctaaggggagtcgcgcgatttggtatatgtggctgggggctaggtacttagagttcgaggcgctagggttcctgaacgaggaccactggttcagtcgcgagaattcttacagcggcgtcgagggggagggcctgcacaagctcggctacatcctgcgggacatatccaagatacccgggggggccatgtacgccgacgacacagccggttgggatacccgcatcaccgaggacgaccttcacaacgaggagaagatcacccagcagatggaccctgaacaccggcaactcgctaacgccatcttcaagctgacgtatcaaaacaaggtggtgaaggtccaacgtcccacacctaccggaacagttatggatatcattagccggaaggaccagcgcggcagcggccaggtagggacctacggcttgaacacgttcaccaacatggaggcccagctgatccggcagatggagggcgagggggtactgagcaaggccgacctggagagtcaccacctcccagagaagaagatcacccagtggctggagaccaaaggcgtcgagcgcctgaagcggatggccatcagcggggacgactgcgtggtcaagcccatcgacgaccgcttcgcaaacgcgctcctggccctgaacgacatgggtaaggtgagaaaggacataccccagtggcagccctccaagggctggcacgactggcagcaggtccctttctgtagccatcacttccacgaactgatcatgaaggacgggcggaagttggtcgtgccctgcaggccccaagacgagctgatcggacgtgcccggatctctcagggggctggctggtcactccgcgaaacggcctgcctaggcaaggcctacgcccagatgtggtccctgatgtacttccaccgccgggatctccggctggctagtaacgccatatgctccgcggtgccggtccactgggtgcccacatcacggaccacgtggtctatccatgcccaccaccagtggatgacgaccgaggacatgctcactgtttggaatcgcgtatggatagaagacaacccctggatggaggataagacccccgtcacgacctgggaaaacgtgccctatttagggaagcgggaggaccagtggtgcggatccctgatcggacttacaagccgcgccacctgggctcagaacattccaacagccatccagcaggttaggtcgctcattggaaatgaagaattcctggattacatgccaagcatgaagcgtttccggaaagaggaggagtccgagggagcgatctggtga

SEQ ID NO: 25941 - RNA, 9873 nt, synthetic construct
  misc_feature 1..9873: note = derived and/or modified CDS sequence (opt11) from DENV-3__EU529705__SS-prME
  source 1..9873: mol_type = other RNA
acctcactctgcctgatgatgatccttcccgcggcactggccttccacctcaccagtagagatggcgaaccaaggatgattgtgggaaagaacgagcgggggaaatccttactgttcaaaacagccagcgggatcaacatgtgcaccctcatcgccatggacttgggcgagatgtgtgacgacaccgtgacctacaagtgtccccatatcactgaggtagagcccgaggacatcgactgctggtgcaacttgaccagcacttgggtgacctacgggacgtgcaaccaggccggcgagcaccggcgcgataagcgcagcgtggccctcgcgccccacgttggcatggggctggatactcggacccagacgtggatgtctgccgagggcgcctggcgccaggtagagaaggtcgagacgtgggctttgaggcacccgggcttcaccatcctcgcgctgttcctcgcccactacatcggaacctccctcacccagaaggttgttatcttcatcctgctgatgctcgtcacgcccagcatgaccatgaggtgcgtgggaatcggcaaccgtgacttcgtggagggcctgtccggggccacgtgggtcgacgtggtgctggaacacggcggttgcgtcacgacgatggccaaaaataagcccacgctcgacatcgagctgcagaagaccgaagctacccagctggcgacgctccggaagttgtgtatcgaagggaaaattaccaacatcaccaccgactctcgctgtcccacgcagggcgaggccgtgttaccggaggagcaggaccagaactacgtgtgcaagcacacttacgtcgatagaggttggggcaacgggtgcggcctattcggaaagggctcgctggttacctgcgccaagttccaatgcctcgagcccatcgaggggaaggtggtccagtacgagaacttgaagtacacggtgattatcacagtacacaccggggatcagcaccaggtcggcaacgagacccaaggggtgaccgcagaaataacgccccaggccagcaccaccgaggcgatccttcccgagtacggcaccttaggcctcgagtgctcaccccgcaccgggctggacttcaacgagatgatcctgctcaccatgaagaataaggcgtggatggtccaccgccaatggttcttcgacctgcccctgccctggacaagcggcgcgaccaccgagacgccgacgtggaaccgcaaggaactcttagtaaccttcaaaaacgcccacgccaagaaacaggaagtagtcgtcctgggatcccaggagggggcgatgcacaccgccctcactggggctaccgagatccagaactcgggcgggacctccatcttcgccggccacctgaaatgccggctgaagatggacaagctcggcctgaaagggatgagctacgccatgtgcaccaatacgttcgtgctgaagaaggaggtctccgaaacccagcacggtaccatcctcatcaaggtggagtataagggggaggacgtgccgtgcaaggttcccttcagcaccgaggacggccaggggaaggcgcatagtgggagacttatcacggccaacccggtggtgaccaagaaggaggagcccgtcaatatcgaggccgagccgcccttcggcgagtccaatatcgttatcgggataggcgacaacgccctaaagatcaactggtacaagaaggggagctctatcggcaagatgttcgaggcgaccgctcggggcgcccgccgcatggccatcctgggggacacagcctgggacttcggcagcgtcggtggtgttctcaactccctggggaagatggtgcaccaaatcttcggaagcgcatacacggccctgttctccggcgtgagctgggtcatgaagatcgggattggcatcctcttaacttggatcggtctgaactccaaaaacacaagcatgtccttttcatgtatcgtgatcggcatcatcacgttatacctgggagccgtcgtccaggccgacatgggctgcgtgatcaactggaaggggaaggagctgaagtgtgggagcggcatattcgttacgaacgaggttcatacctggaccgagcagtacaaattccaagccgacagtcccaagcgtctcgcgaccgccatcgcaggggcctgggagaacggggtgtgtgggatccgctccacgacccgcatggagaacctcctgtggaagcagattgccaacgagctaaactatatactgtgggagaacaatattaagctcaccgtagtcgtcggcgatattatcggcgtgctcgagcaggggaaaagaacgttgacgccacagccaatggagctgaagtacagctggaaagcgtggggcaaggccaagatcgtcaccgccgagactcagaactccagcttcataatagacgggcccaatacccccgagtgtccctccgcctctcgggcgtggaacgtatgggaggtggaagattacggctttggggtcttcacgacgaacatctggctcaagctgcgcgaggtttacacccaactgtgcgaccaccggctcatgagtgccgccgtgaaggacgagcgagccgtccacgccgacatgggctactggatcgagtcccagaaaaatggcagttggaaactggagaaggcgtccctgatcgaggtgaaaacctgcacatggcccaagagccacacgctctggtcgaacggtgtactggaatcggacatgatcataccaaagtccctggccggacccatcagccagcacaattaccgtccggggtatcacacccagacggccggcccctggcatctcggcaagctggagctggatttcaactactgcgaggggaccacggtggtgattaccgaaaactgcggcactcgcgggccctccctgcggaccactacggtgagcggaaagttaatccacgagtggtgttgtagatcatgcacactacccccgctccggtacatgggggaggacggatgctggtacggcatggagatccggcccatcagtgaaaaggaggagaacatggttaagtccctcgtgagcgcgggctccggtaaggtagacaacttcaccatgggggtcttgtgtttagccatactgttcgaagaggtaatgcggggcaagttcgggaagaaacacatgatcgcgggcgtctttttcacgttcgtcctgcttttaagcggccagatcacgtggcgtgacatggcacacaccctgatcatgatcggatccaacgcgagcgaccggatgggcatgggcgtgacctacctcgccctgatcgccacgttcaaaatccagcccttcctggcactcggctttttcctgcgcaagctgaccagccgggagaacctcctgctgggcgtggggctcgccatggcaacaaccctgcagctgcccgaggacatcgagcagatggcaaacgggatcgcgttagggctgatggccttaaagctcatcacgcagttcgaaacctaccagctgtggacagccctgatctccctgacctgttctaatacgattttcaccctcaccgttgcctggcgcaccgccacgctgatcctcgcgggcgtgtcactgctgccggtctgccagagctccagcatgcggaagaccgactggctccccatgaccgtggcggccatgggggtgcctcccctcccgttattcatcttctcccttaaggacactctcaagaggcgtagctggcccctgaacgagggtgtcatggcggtgggccttgtctccatcctggcaagctccctcctccggaacgacgtgcccatggcggggcccctggttgccggtgggctgctcatcgcctgctacgtgatcacaggcaccagcgccgatttgacagtagagaaggccgcggacgtgacctgggaggaagaggccgagcagactggggtgtcccacaacctgatgatcaccgtagacgacgacggcaccatgcgcatcaaggatgatgaaacagagaacatcctcactgtgctgctgaagacggccctcctgatcgtgagcggcatctttccgtactccatacccgccaccctgctggtctggcatacttggcagaagcagacgcagcgtagcggggtgctatgggatgtaccctctccgcccgagacgcaaaaggccgagctggaggagggtgtctatagaatcaagcagcaggggatcttcggaaagacccaggttggggtgggcgtccagaaggagggcgtgtttcacaccatgtggcatgtgacgcgcggagcggtcttaacatacaacggcaagcgccttgagcccaattgggcctcggtgaagaaggacctgatttcctacggcggcgggtggcgcctcagcgcccagtggcagaagggtgaggaggtgcaggtcattgccgtggagcctgggaagaaccccaagaacttccaaaccatgccagggaccttccagaccaccaccggagagatcggcgcgatcgccctggacttcaaaccgggtaccagcggctctcccatcatcaaccgcgaagggaaggtggtaggtctgtacggcaacggagtggtcaccaaaaatgggggctacgtaagcggcatcgcccagacgaacgccgagccagacgggccaacccccgaactggaggaagagatgtttaagaagcggaacctcaccattatggacctgcatcccggctccgggaagacccgcaagtacctgccggccatagtgcgggaggcgatcaagcgccggctccgaacgctgatactggctcctacccgggtggtcgcagcagaaatggaggaggccctcaaggggctgcccattcgctaccagaccaccgcgacgaaaagcgagcacactggacgggagatcgtggacctgatgtgccacgcaaccttcacaatgcgcctcctgtccccagttcgggtcccgaactacaacctgataattatggacgaagcccacttcacggatcccgccagcatagccgcgcgtggttacatcagcacccgggtgggcatgggggaggccgcggcgatatttatgaccgcgacaccgcccggcaccgccgacgcgttccctcaaagcaatgcccccatacaggatgaggaacgggacattcccgagcgcagctggaactcggggaacgagtggatcactgacttcgccggcaagaccgtgtggttcgtcccatctatcaaggcgggcaacgatatcgccaactgcctccggaaaaacggcaagaaggtgatacagctgagccgcaaaaccttcgacacggaatatcagaagactaagctgaacgactgggactttgtagtaaccaccgacatctccgaaatgggcgccaacttcaaggccgaccgggtgattgatccgcgccggtgccttaagcccgtgatactgacggatggtcccgagcgagtcatcttagccggtcctatgccggtgaccgcagccagcgccgcccagcggcgcggacgggtgggccggaacccccagaaggagaacgaccaatatatcttcaccgggcaaccactcaacaacgatgaagaccacgcgcactggaccgaggctaaaatgctgttggacaatatcaatacccccgaaggtatcattcctgcccttttcgagcccgaacgggagaagtccgcggcgatcgacggcgagtaccgcttaaagggggagtcacggaagacgtttgtcgagctgatgagacggggcgacctccccgtatggctcgcccacaaagtcgcctcagaggggataaagtacaccgaccgaaagtggtgctttgacggccagcggaacaaccagatcctagaagagaacatggacgtggagatctggaccaaggagggcgagaagaaaaagctcagaccccggtggctggacgcccgtacctactcggaccctctggccctcaaagagttcaaggactttgcagcggggcgtaaatccatcgccctcgacctggtgacggagattggccgggtccccagtcatctcgcccaccgcacccgcaatgccctggacaacctggttatgctccacaccagcgagcacgggggccgagcctatcggcacgctgtagaggagctgcccgaaacaatggagacgctgctcctcctggggctaatgattctgctgacgggcggcgccatgcttttcctgatctctgggaagggaatcgggaaaaccagcatcggcctgatctgcgtcatcgcatccagcggcatgctctggatggccgagataccgttgcagtggatcgcttctgcgatcgtactggagttcttcatgatggtgttgctgattcccgagcccgagaagcagcgcacgccccaggacaaccagttagcatacgtcgtcatcggcatactaacactggccgcgatcattgccgcgaacgaaatgggtttgctcgagaccaccaagcgcgacctggggatgtcaaaggagccgggggtagtctcccccacctcgtacctcgacgtggatcttcacccagcttccgcctggacgctatacgccgtggcaaccaccgtcatcacacccatgctgcgccacacgatcgagaacagcaccgccaacgtgtccctcgccgccatcgccaaccaggctgtggtcctgatggggctggacaaaggctggccgatcagcaagatggacctcggggtgcctttgttagccctcggctgttacagtcaggttaaccccctgacgctgaccgctgccgtcttgctgctgatcacgcactacgccatcatcggccccgggctccaggcaaaggccactcgggaggctcagaagcgcactgccgccggcattatgaagaatccgaccgtggacgggatcatgactatcgacctggaccccgtgatctacgatagcaagttcgaaaagcagctcggccaggtcatgctcctggtactgtgcgcggtgcagctcctgctgatgaggacctcctgggccctctgcgaggctcttaccttggcgaccggccctattaccacactctgggaggggagccccggcaagttctggaacaccaccatcgcggtctccatggccaacatctttcgagggagctacctcgccggtgccgggctggctttctcaatcatgaagtccgtgggcaccggcaagcgaggcacgggcagccagggagagaccctcggggaaaagtggaagaaaaagctgaaccagctgtcccgcaaggagttcgacctttataaaaagtccggcattaccgaggtggaccgtaccgaagcgaaggagggcctgaagaggggcgagatcacgcaccacgccgtctcccggggcagcgccaagctgcagtggttcgtagagcgcaacatggtgattccggaaggcagagtcatcgacctggggtgtggccgcgggggctggtcctactactgtgccggtctgaagaaggtgaccgaagtgcgggggtataccaaaggcgggccaggtcacgaggagcccgtaccaatgagcacctacggctggaacatcgtgaaactgatgtccggcaaagatgtgttctacctccctcccgagaaatgcgacacgctgctgtgcgacatcggagagagctccccgagccccacggtcgaagagtcccgcacgatccgcgtgctgaagatggtggagccgtggcttaaaaacaaccaattttgcataaaggtcctgaacccctacatgccgaccgtgatcgagcatctggagcggctccagcgcaaacacggcggcatgctggtgcggaaccccctctctcgcaactccacccacgaaatgtactggatcagcaatgggacaggcaacatcgtagcctccgtgaacatggtgagccgactgctgctgaacagattcaccatgacccacagacgccccaccatcgagaaggacgtcgatttgggtgcggggacccggcacgtgaacgccgagcccgagacccccaatatggacgtgatcggtgaacgcatcaagcggattaaagaggagcataactctacctggcactacgacgatgaaaacccgtacaagacgtgggcctaccatgggagctacgaggtcaaggccaccggctccgcctcgtccatgatcaacggggtggtaaagctgctgaccaagccatgggacgtcgtgcccatggtaacccaaatggcgatgacggataccaccccgttcggccaacagcgtgtgttcaaggagaaggttgacacgcggacgccacgctcgatgccaggaacacggcgcgtcatgggcatcaccgccgagtggttatggcggaccctgggccggaacaagaagccccggctatgcactcgcgaagagttcacgaagaaagtgaggactaacgccgccatgggggcggtgttcaccgaggagaaccaatgggattccgccaaagcagccgtggaggacgaggacttctggatcttggtcgacagagagcgcgagctgcacaagctgggcaagtgcggttcatgcgtgtataatatgatgggcaagcgggagaagaagctcggggagttcgggaaggcgaagggctcgcgcgcaatctggtacatgtggcttggggcccgttacctggagttcgaagccctcggcttcctgaacgaagaccactggttttcccgcgagaatagttattccggggtggagggcgagggcctgcataaactcgggtacatcctgcgggacatcagcaaaatccccggcggggcaatgtacgccgacgacacggcgggctgggacaccagaatcaccgaggacgatcttcacaacgaggagaaaataacccagcagatggacccggaacaccggcagctcgcgtccgccatattcaagctgacgtatcagaataaggtcgtgaaggtccaacgccctacccccaccggcaccgtgatggacattatcagccggaaggaccagcgcggttccggccaggttggaacctacggcctaaacacgttcaccaacatggaggcccaacttatcagacagatggagggcgagggcgtcctgagcaaggccgacctggaaaacccgcatctccccgagaagaaaataacccagtggctggagaccaagggcgtggagagacttaagcggatggcgatctccggggatgactgcgtggtcaagccaatcgacgatcgcttcgccaacgcgctcctagccttgaacgacatgggtaaggtccggaaggacattcctcagtggcagccgagtaaggggtggcatgactggcagcaggtcccgttctgtagtcaccacttccacgaattgattatgaaggatggccgcaagttggtcgtaccctgccggccccaggacgagttgatcgggcgcgcccggatatctcagggcgcgggctggtccttgcgcgagacggcctgtctggggaaggcttacgcccagatgtggagccttatgtacttccaccgccgggacctccgtctggcgtccaacgccatctgtagcgccgtgcccgtccactgggtgccgaccagccggaccacctggtcaatccacgcgcaccaccagtggatgaccaccgaagacatgctgaccgtgtggaatcgcgtctggatagaggacaacccctggatggaagacaagacccctgtgacgacctgggagaatgtcccctaccttggcaaacgggaggaccagtggtgcgggtcactgatagggctgacaagtcgtgccacctgggcgcaaaatatcccgacggccatccaacaggtgcggagcctcatcgggaacgaggagttcctggactacatgcccagcatgaagcgcttccggaaggaagaggaaagcgaaggcgccatctggtag

SEQ ID NO: 25942 - RNA, 9873 nt, synthetic construct
  misc_feature 1..9873: note = derived and/or modified CDS sequence (opt11) from DENV-3__EU596492__SS-prME
  source 1..9873: mol_type = other RNA
accagcctatgcctcatgatgatcctccccgccgccctggcgttccatctcacctcccgggacggggagccccgtatgatcgtggggaagaacgagcgaggcaagagtctgctgtttaaaaccgcctctgggatcaatatgtgcaccctcatcgccatggacctgggcgagatgtgcgacgacacagtgacctacaagtgcccccacatcgcggaggtggagccggaggacatcgactgctggtgcaacctgacctcgacctgggtgacttacgggacctgcaatcaagccggggaacatcggcgcgacaagcgatccgtggcgctcgcgcctcacgtgggcatgggtctggacacgcgcacacagacctggatgagcgccgaaggcgcctggcggcaggtcgaaaaggtggagacctgggcgctcagacacccggggttcacaattctagccctgttcctggcccactacatcggcacctctctcacccagaaggtggtgattttcgtcctgttgatgctcgtcacccccagcatgactatgcggtgcgtgggggtaggcaaccgcgatttcgtggagggcctgtcaggcgccacatgggtggatgtcgtgttagagcacggcgggtgcgtgaccaccatggccaagaacaagcccacgctcgatattgagctacagaagaccgaggctacccagctggccaccctccggaagttgtgcatcgagggcaagatcacgaacatcaccaccgatagcaggtgccctacccagggcgaggccgccctgccggaggagcaggaccagaactacgtctgcaaacacacgtatgtggaccggggatggggaaatggatgcggcctcttcgggaagggctccctggtaacatgcgccaagttccaatgcctggaacccatcgaaggcaaggttgtacaatacgagaacctcaagtacaccgtgataatcaccgtccacacgggggaccagcaccaggtcggcaacgaaacccagggggtcaccgctgaaatcaccccccaagccagcaccaccgaggccattctgcccgagtacggcacactgggactcgaatgttccccacgcaccgggctggacttcaacgagatgatcctgctcacgatgaagaacaaggcctggatggtgcatcggcagtggtttttcgaccttcccctgccctggacgagcggggccacaaccgagacccctacgtggaatcgtaaggagctcttggtgaccttcaagaacgcccacgctaagaagcaggaggtcgtagttctggggtcccaggagggcgccatgcacaccgcgctcactggggccacggagatccagaactcaggcggtacctccatctttgcgggccatctgaaatgccggctgaagatggacaagctcgagctaaaagggatgtcatacgccatgtgcacaaacaccttcgtcctgaagaaggaagtgtccgaaacccaacatgggaccatcctcatcaaagtggagtacaagggcgaggacgccccgtgcaagatccccttcagcactgaggacgggcagggcaaagctcataatggccgcctgatcacagcgaaccctgtagtgactaaaaaggaggagcccgtgaacatcgaggccgagcctcccttcggggagtcgaacatcgtcataggtatcggcgacaacgccctaaagatcaactggtacaagaaggggtccagcatcgggaagatgttcgaagctaccgcccggggcgccaggcggatggctattttaggggacaccgcctgggacttcgggtcagtcggcggggtactcaacagcctgggcaagatggtccaccagatattcgggtccgcgtacaccgctctgttcagcggcgtgtcctgggtgatgaagatcggtattggggtcctcctgacgtggataggcctgaacagcaaaaacacctccatgagcttctcctgcatcgcgatcgggatcatcaccctctacctgggtgccgtggtgcaggccgacaccgggtgcgtcgtgaactggaagggtaaagagctgaaatgcggcagcgggatattcgtgacgaacgaggtccatacatggaccgagcagtacaagtttcaggcagacagtcccaagcgcctcgccaccgcgatcgccggagcctgggagaacggggtgtgtggcatccgctcgacgacccggatggagaacctgctatggaagcaagtcgccaacgagctcaactacatactgtgggagaacaatatcaagctgactgtcgtcgtgggagatatcatcggggtcctcgagcaggggaaacgcaccctgacgccacagccaatggaactgaagtacagttggaagacctgggggaaagccaagatcgtgacggcagagacccagaacagctccttcatcattgacggcccaaacacacccgagtgccccagcgcctccagggcctggaacgtgtgggaggtcgaggactacgggttcggcgtgttcaccacgaacatttggctcaagctccgcgaggtgtacacacagctgtgtgaccaccgcctcatgagcgccgcggtcaaggacgagcgcgctgtgcacgccgacatgggctattggatcgagagccagaagaacggatcctggaagctcgaaaaggccagcctgatcgaggtgaagacctgcacgtggcctaagtcccacaccctctggagcaacggcgtactggaatccgacatgatcatccctaaaagcctagccgggcccatctcccaacacaactaccggccgggctaccacacccagacagccgggccctggcacctcggcaagctggagcttgactttaactactgtgagggcacgaccgttgtcattaccgagaactgcgggacccgcggccccagcctgcggactacgaccgtctcaggaaagctgatccacgaatggtgctgccgcagctgcaccctgcccccgctccggtacatgggcgaggacgggtgctggtacggcatggagatccgacccatttccgaaaaggaagagaacatggtcaagagcctggtttccgccggctcagggaaggtcgataacttcactatgggcgtgctgtgcctcgccatcttgttcgaggaggtgatgagagggaagttcggtaagaagcacatgattgccggggtattcttcaccttcgtgctcctcctttccggccagatcacctggcgcgacatggcgcacacgctgatcatgatcggctccaacgcgtccgacaggatggggatgggcgtgacctacctcgccctgatagccaccttcaagatccagccctttctggcgctcgggttcttcctgagaaagctgacctccagagaaaacctcctgctaggcgtcggcctagcgatggcaacgacgctgcagctgcccgaggacatcgaacaaatggccaacgggatcgcgctcggcctgatggcgctaaagctcatcacccagtttgagacctaccaactgtggaccgcgctgatcagcctcacgtgcagtaacacaatcttcaccctgacggtggcctggcgcacggccaccctgatcctcgccggggtcagccttctgccggtgtgccagtccagctccatgcggaagtccgactggctccccatgaccgtggccgcaatgggcgtgccgcccttgcctctcttcatcttctccctcaaggacaccctgaagcgccgcagctggcccctgaacgaaggggtgatggccgtgggcctcgtctccatattagcgagctccctgctccggaacgatgtgcccatggccggccccctggtggccggaggactattaattgcgtgctacgtcatcacggggacgagcgctgacctgaccgtggagaaggcggccgacgtgacctgggaggaggaggccgaacaaaccggcgtctcccataatctgatgatcaccgtggatgacgacgggaccatgcgcataaaagacgacgagacagagaacatcctcaccgtgctgctgaagacggccttgctgatcgtatccggcatcttcccgtacagtatccccgccacccttctcgtgtggcacacctggcagaagcagacacggcgcagcggcgtgctgtgggacgtacccagcccgcccgagacgcagaaggctgagttggaggagggggtgtaccggatcaagcagcagggcattttcgggaagacccaggtgggcgtcggggtccaaaaggagggcgtgtttcacaccatgtggcacgtcacccgcggcgccgttctcacgtacaacgggaagcggctggagcccaactgggcgagcgtgaagaaggacctgatcagttacggcgggggctggcgcctgagcgcccagtggcagaagggggaggaggtccaggtgatcgccgtggagcccggcaagaaccccaaaaatttccagaccatgcccggcacattccagaccacgactggggagatcggcgccatcgccctagacttcaagccaggcaccagcggcagtcctatcatcaaccgggaggggaaggttgtagggctgtatggcaacggggtagtcaccaagaatggtgggtacgttagcggcatcgcgcagacgaacgccgagcccgacggccccaccccggaactggaggaggaaatgtttaagaaacgaaatctcaccatcatggacctccaccccgggtccggcaagacccggaagtatcttccggccatcgtgcgcgaagcaataaagcggcgcctgcggacgctgatcctggcacccacccgcgtcgtggctgccgagatggaggaggcccttaaagggctgcccatccggtaccaaaccaccgccaccaaaagcgagcacaccggccgcgagatcgtggacctgatgtgccacgccacattcaccatgcggctcctgtcccccgtccgcgtgccgaactataacctgatcatcatggatgaagctcacttcacggaccccgccagcatcgccgcccgggggtatatctccacccgcgtgggcatgggcgaggcggccgcgatcttcatgaccgccactccgcccgggacggccgacgctttcccgcagtcgaacgcccccatccaagacgaggagcgcgacatccccgagcgctcctggaacagcgggaacgagtggattaccgacttcgccgggaagaccgtctggttcgtcccctccatcaaggccggcaatgatatcgccaactgccttcgcaagaacgggaagaaggtgatccagctgagccggaaaaccttcgacactgagtaccaaaagaccaagctgaatgactgggacttcgtcgtgaccaccgatatctccgagatgggcgcgaacttcaaggccgaccgcgtgattgacccgcggcgctgcctcaaacccgtcatcctaacggacgggcccgagcgggtgattctggccgggcccatgcctgtcactgccgccagcgcggcccagcgacggggccgcgtggggcggaatccgcagaaagagaacgaccagtacatcttcaccggccagcccctcaacaacgacgaggaccacgcccactggactgaagccaagatgttactggacaacatcaacacccccgagggtatcatcccggccctctttgagcccgagcgcgagaagtccgccgccatcgacggggaataccggctgaagggcgagtcgaggaaaacgttcgtggagctgatgcggcgcggggacttgcccgtatggctggcccacaaggtggcctcagagggcatcaagtataccgaccggaagtggtgcttcgacgggcagcggaacaatcagatcctggaggagaacatggatgtggagatctggaccaaggagggagagaagaagaagctccggccccgctggctggacgcgagaacctatagcgacccgctggccctaaaagagttcaaggacttcgccgccggccggaagtccatcgccctggatttggttacggagatcgggcgggtgcccagccacttagcgcaccgcacccgcaacgccctggacaacctggtgatgctacacaccagcgagcatggcggtaaggcctaccggcacgccgtcgaggagctgcccgagaccatggaaacgctgctcctgctggggctcatgatccttctgactgggggcgccatgctcttcctgatctccggaaaggggataggaaagaccagcataggtctgatctgcgtgatcgcgagtagcggcatgttatggatggcagagatcccgctgcagtggatcgcctcagcaatcgttctggagttcttcatgatggtgctgcttatccccgagccagagaagcaacgcacgccacaagacaaccagctggcctacgtggtgatcgggatactcaccctggcggccatcatcgccgccaacgagatgggcctgctcgaaaccaccaagcgtgatctaggcatgagcaaggagccgggggtcgtgtcccccactagctacctggacgtggacttacacccggcgtccgcttggacgctgtacgccgtcgccacgaccgtgatcaccccgatgctacgccacacaatcgagaacagtaccgccaacgtgagcctcgcggccatcgccaaccaggcggtagtgctgatgggcctgaacaagggctggcctatcagcaagatggacctaggagtccccctgctggccctcggttgctactcccaggtcaaccccctgaccctgaccgcagccgtgctcctgctgattacgcactacgcaatcatcggccccggcctccaggccaaggccacccgggaggcgcagaagcgaaccgccgcggggattatgaagaacccgaccgtggacggcatcatgacgatcgacctcgaccccgtcatctacgactcgaaattcgagaagcagttggggcaagtgatgctcctggttctgtgcgctgttcagctcctgctgatgcggacctcatgggcgctttgcgaagccctgaccctggccaccggccccattacgacactgtgggagggctccccggggaagttctggaacaccacaatcgccgtctccatggccaatatctttaggggcagctacctggccggggccggcctggccttctccattatgaagtccgtgggcactggcaagaggggcaccgggagccagggcgaaaccctcggggagaagtggaagaagaagctgaaccagctgtcacgcaaggagttcgacctctacaagaaatctggcatcacagaggtcgaccggaccgaggccaaggaggggcttaagaggggcgagatcacgcaccacgctgtgtcccggggcagcgctaagctgcagtggttcgttgagcgcaacatggtcattccggaggggcgggtgatcgatctcggctgcgggcgcggcggctggagctactactgtgcgggattgaagaaggtaaccgaggtgcggggctacaccaagggtgggcccgggcatgaggagcccgtgcccatgagcacgtacggctggaacatcgtgaagttaatgtccgggaaggacgtattctaccttccgcccgagaagtgcgacacgctgctgtgcgacatcggggagtcgtccccctcaccaaccgtggaggagtcccgcaccatccgcgttctgaagatggtcgagccgtggctcaaaaacaaccaattctgcatcaaggtgctgaacccctatatgcccaccgttatcgagcacctggagcgactccagcgcaagcatggcgggatgctggtccggaaccccctgagccgcaactccacgcatgagatgtactggatcagcaacggcaccgggaacatcgtcgcctccgtgaacatggtcagccggctcctactgaaccgattcaccatgacacaccgaagaccgacgatcgagaaggacgtggacctcggcgccgggacccggcatgtaaacgccgagcccgaaacacccaatatggacgtgatcggggagcgcatcaagcgtatcaaggaggagcacaactcgacatggcattacgatgacgagaacccgtacaagacgtgggcgtaccacggcagctacgaagtgaaggcgaccggttccgccagcagcatgatcaacggcgtcgtgaagctgttaaccaagccctgggacgtggtacccatggtgacacagatggcgatgacagacaccaccccgttcgggcagcagcgcgtgtttaaggagaaggtcgacacccgaacgccgcgctccatgcccggcacccgacgcgtgatgggcattaccgctgagtggctctggcggactctggggcgcaacaagaagccccggctgtgcactagggaggagttcaccaagaaggttcgcaccaatgccgcaatgggcgctgtcttcactgaggagaaccagtgggatagcgccaaggcggccgtagaggacgaggacttctggaagctcgtagaccgcgagcgcgaactgcacaagttggggaagtgtggctcctgcgtgtataacatgatggggaaacgggagaagaagctcggcgagttcggcaaagccaaggggtcgcgcgccatatggtatatgtggctgggcgcccggtacctagaatttgaggcgttggggttcctgaacgaggaccactggttctcgcgcgagaacagctactccggcgtggagggagagggattgcacaagctcggctacatcttacgggatatctctaagatccctgggggcgccatgtacgccgacgacacggccgggtgggacactcgaatcaccgaagacgacctgcacaacgaggaaaagatcacccagcagatggacccggagcaccggcagctcgccaatgcgatcttcaagctgacgtaccagaacaaggtggtcaaggtgcagcgccccaccccgaccggcaccgtgatggacataatctcacggaaggaccagaggggctcagggcaggttggaacctacgggctgaacacgtttacaaacatggaggcccaactcatccggcagatggagggagagggggtactgaccaaagcggatctggagaacccccacctctccgagaagaagatcacacagtggctcgagacgaagggcgtggagcgcctgaaacggatggcaatcagcggcgacgattgcgtcgtgaaaccgatcgatgaccgcttcgctaacgcactcctcgcgctgaacgacatgggaaaggtgcgcaaggacatgccccagtggcagccgtccaagggctggcacgattggcagcaggtcccattttgcagccaccacttccacgagctcatcatgaaggatggtagaaagctggtggtcccgtgccggccccaggatgagctaatcggccgcgcccggatctcccagggggccggctggtcgctccgagagacagcgtgcttaggcaaggcctacgcccagatgtggagcttgatgtactttcaccggcgggacctccgtctagccagcaacgccatctgttccgcggtccccgtgcactgggtgcccaccagccggactacgtggagtatacacgcccaccaccaatggatgacgaccgaggacatgctgaccgtctggaatcgcgtttggatcgaagacaacccgtggatggaggacaagacccccgtgaccacctgggaaaatgtcccctacctcggaaagcgggaggaccaatggtgtggatcccttatagggctgaccagccgcgccacgtgggcccagaacatccccacagccatccagcaggtacgatccctcataggcaacgaggagttcttagactacatgccgagcatgaagcgcttccggaaggaggaggagtccgagggcgcgatctggtaa

SEQ ID NO: 25943 - RNA, 9873 nt, synthetic construct
  misc_feature 1..9873: note = derived and/or modified CDS sequence (opt11) from DENV-3__EU596493__SS-prME
  source 1..9873: mol_type = other RNA
accagcctgtgcctcatgatgatcctgcccgccgccctggcattccacctcaccagccgggacggggaaccccggatgatcgtcgggaagaacgagcgcggcaagagtctactcttcaaaaccgcctctggtatcaacatgtgcacccttattgcgatggacctgggcgaaatgtgcgacgacaccgtgacgtacaagtgccctcacatcgccgaggtggaaccggaagatatagactgctggtgcaacctgacaagtacctgggtgacttacgggacctgcaaccaagcaggcgagcaccgccgcgacaagaggtccgtggcgctcgcgccccacgtgggcatgggactggacacccgcacgcaaacctggatgagcgccgaaggcgcctggcggcaggtcgagaaggtcgagacctgggcgctgagacatccgggcttcacgatcctagccctgttcctagcccactacatcggcacctccctcacccagaaagtggtcatctttgttctgttgatgctagtgaccccttccatgacgatgcggtgcgtgggggtcggcaatcgcgacttcgtggagggcctgtcgggggccacatgggtagacgtcgtgctggagcacggcgggtgcgttaccaccatggcgaagaacaagcccacactagacatcgagctgcagaagaccgaggcaacccagctggcaaccctcaggaaactttgtatcgagggcaagatcaccaacattaccaccgatagccgctgccccacccagggcgaggccgtcctcccggaggaacaggaccagaactatgtatgcaagcacacgtacgtggaccgggggtgggggaacgggtgcggcctgttcgggaagggctccctggtgacctgtgccaaattccagtgcctggagcccatcgagggcaaagtggtgcagtatgaaaacctcaagtacactgtcatcatcaccgtgcacacgggggaccagcatcaggtcggaaacgagacccagggggtcaccgccgagatcacgccacaggcgtcgacgaccgaggccatcctgcccgagtatggcaccctggggctcgaatgctccccgcgcactggcctggactttaacgagatgatcctgctcaccatgaagaacaaggcatggatggtgcaccgacagtggttcttcgaccttccgctgccctggacgagcggggcaaccaccgaaacccccacttggaatcgcaaggagctcctggtcactttcaagaacgcacacgcaaagaagcaggaggtggtggtcctgggatcccaggagggcgcaatgcacacggccctcaccggggccacggagatccaaaacagcggtgggacctccatcttcgccggtcatctaaaatgccggctaaagatggataagctggagctgaaaggaatgtcgtacgcgatgtgtactaacaccttcgtgctgaagaaggaggtgtccgagactcagcacgggaccattctgatcaaagtcgagtacaagggggaggacgccccgtgcaagatccccttcagcacagaggacgggcagggcaaggcccacaacggcagactcatcaccgcgaaccccgtggtgacgaagaaggaggagcccgtcaacatcgaggcggagccgcccttcggggagagtaacatcgtgatcggcatcggggacaacgctctgaaaatcaactggtacaaaaaggggtcctccattggcaagatgttcgaggcaacggccaggggcgcacgccggatggcgatcctgggcgacacagcctgggacttcgggtccgtgggcggggtcctcaacagcctgggtaagatggtgcaccagatcttcggctccgcctacacggctctgtttagcggcgtgtcctgggtcatgaagatcggaattggggtgttactgacgtggatcggcctgaacagtaagaacacgtctatgagcttctcctgtattgccatcgggatcatcactctctatctgggcgcggtggtccaggctgacaccgggtgtgtgatcaactggaagggcaaggagctgaagtgcggcagcgggatctttgtgacaaacgaggtccacacgtggaccgaacagtacaagttccaggccgacagccccaagcgcctcgccaccgcaattgcgggcgcctgggagaacggagtgtgcggcattcgcagcacgacccggatggagaacttactgtggaagcaggttgccaacgagctcaattacatcttgtgggagaacaacatcaaacttaccgtcgtggtcggggacatcataggcgtcctggagcagggcaagcgcaccctgactccgcagccgatggagttgaagtactcctggaagacctgggggaaggctaagatcgtgaccgcggagacccagaacagcagtttcatcatcgatggccccaacacacccgagtgccccagtgcctcccgggcttggaatgtgtgggaggtcgaggactacgggtttggcgtgttcaccacaaacatctggttgaagctgcgcgaggtgtatacccagctgtgcgaccaccggctcatgagcgccgccgtcaaggatgaacgcgcggtgcatgccgacatgggctactggatcgagagccagaaaaacggttcctggaaactagagaaggcgagcctgatcgaggtcaagacctgtacgtggccgaagtcacacaccctctggtctaacggcgtccttgagtccgacatgatcatccccaagagcctggccgggcccatctcccagcacaactaccggcccggctaccacacccagaccgccgggccctggcacctcggcaagctggagctggactttaattactgcgagggcacgaccgtggtgatcaccgaaaactgcggaacccgcggcccctccctccggacgacaactgtctccgggaaacttatccacgagtggtgctgccgcagctgcaccctcccaccgctccgctacatgggcgaggacgggtgctggtacggtatggagattaggcccatttccgagaaggaagagaacatggtcaagagcttagtgtccgcgggcagcgggaaggtcgacaacttcacgatgggcgtgctatgtctcgccatactgttcgaagaggtgatgcgggggaagttcggcaagaagcatatgatcgccggcgtattcttcaccttcgtgctgctcctgtccggccagatcacctggcgcgacatggcccacaccctgatcatgatcggcagcaatgcgtccgaccggatggggatgggcgtgacgtacctcgctctaatcgccaccttcaagatccagcccttcctggcactcgggttcttcctgcgtaagctgaccagccgggagaacctactgctgggcgttggactcgccatggcgaccacgctgcagctgcccgaggacatcgaacagatggctaacgggatcgccctcggcctgatggccctgaagctcataacccagttcgagacctaccagttatggaccgcactgatcagcctcacgtgttcaaacaccatcttcaccctgaccgtggcttggcgcaccgctaccctgatcctcgccggggtgagcctgctcccggtgtgccagtccagctctatgcggaagtccgactggctccccatgaccgtggccgccatgggcgtgccgcctctaccgcttttcatcttcagcttaaaggatacactgaagcgccgcagttggcccctgaatgagggggtgatggcggttggcctcgtcagcatcctggccagctctctgttgcggaatgatgtgcccatggccggccctttagtggccgggggtctgctcatcgcctgctacgtgatcacgggtacgagcgcggacctcaccgtggagaaggccgccgacgtgacttgggaggaggaggccgagcagaccggtgtctcccacaacctgatgatcaccgtggacgacgacggtactatgcgcatcaaggacgatgagaccgagaacattctcaccgttctactgaagacggccctcctgatcgtgtcaggcatcttcccttattcgatccctgcgaccctgctcgtgtggcatacctggcagaagcagactcggcgttccggcgtcctgtgggacgtcccttcccctcccgagacgcagaaggccgagctggaggagggggtgtaccggatcaagcagcagggcatcttcgggaagacacaggttggtgtcggcgtgcagaaggaaggcgtgttccacaccatgtggcacgttacacgaggcgccgtgctcacgtacaatgggaagcgactggagcctaactgggccagcgtcaagaaagaccttatttcctacggcgggggatggcgcctcaacgcgcagtggcagaagggggaagaggtccaagtgatcgccgtagagcccggcaagaaccccaagaacttccagactatgcccgggaccttccagaccacgaccggggaaatcggcgcaatagcgctggacttcaagcccggcaccagcggcagccccataatcaatagggaaggcaaagtcgtgggactgtacggcaacggtgtggtcaccaagaacggagggtacgtttccggcatcgcccaaacgaacgcagagccagacgggcccacccccgagctggaggaggagatgtttaagaagcgcaacctcaccatcatggacctgcaccccgggtcgggcaagacacgaaagtacctgccggcaatcgtaagagaggcaatcaagcggcgcctccggacgctgatcctggctcccactcgcgttgtggcggccgagatggaagaggccctaaagggcctgcctatccggtaccagacaaccgccaccaagtccgaacacactggccgcgagatagtggatctgatgtgccacgccaccttcaccatgagactcctgtcccctgtccgcgtgccaaattacaatctgatcatcatggacgaagcccacttcacggaccccgcgtcaatcgccgcacgggggtacatcagcacccgcgtggggatgggcgaagccgcggccatattcatgaccgccacgccgccggggacggccgacgccttcccgcaaagtaacgcgcccatccaggatgaggaacgtgatatacccgagcggagctggaacagtggcaacgagtggatcaccgacttcgccggaaagacagtgtggttcgtgcccagcatcaaggccggcaacgacatcgctaactgcctccggaagaacgggaaaaaggtgatccagttgtcccggaagacctttgacacggagtaccagaagaccaagctgaacgactgggacttcgtagtgacgaccgacatcagtgagatgggcgccaacttcaaagcggaccgcgtgattgatccgcggcgctgcctcaagcccgtcatcctgacggatggtcccgagcgggtgatcctggccggacccatgccggtaaccgccgcctccgccgcgcaacgccggggcagagtcgggcgaaacccccagaaggagaacgaccagtacatcttcaccggccagccgctcaacaacgacgaggaccacgcccactggaccgaagccaagatgctgctggacaatatcaacacgccggaggggatcatccccgctctcttcgagcccgagagagaaaagagtgcggccatcgatggcgagtaccgcctgaagggcgaatcccggaagacgttcgtggagctgatgcggcgaggggacttgcccgtgtggctggctcacaaggttgccagtgagggcatcaagtacactgatcggaagtggtgcttcgacgggcagcgtaacaaccagatcttggaggagaacatggacgtcgagatctggaccaaagagggcgagaagaaaaagctccggccacgctggctggacgcacgcacctattccgacccgttagcgttaaaggagttcaaggacttcgccgccggccggaaatcaatcgccctggacctagtcacggagatagggagagtgccctcgcaccttgcccaccggacccgcaacgctctggacaacctggttatgctccacacaagcgaacacggcgggaaagcctacagacacgccgtggaagaactgcccgagacgatggagacgctgcttctgctgggactcatgatactgctgaccgggggcgccatgctgttcctaattagcggcaaagggatcggcaagacctccatcgggctgatctgcgtgatcgcgtcgtctggtatgctctggatggcagagatcccgctgcagtggatagcatctgccatagtgctggagttcttcatgatggtcctcttaatccccgagcccgagaagcagcgcacgccacaggacaatcagctggcatacgttgtgatcgggatcctcaccttagccgcgataattgcagccaacgagatgggcctgctcgaaaccaccaaacgggacctgggaatgtccaaggagcccggggtcgtgtcgcccacttcctacctggacgtggacctccaccccgcctcggcgtggacgctctacgccgtcgccaccaccgtaatcacccccatgctgcggcatacgatagagaactccaccgccaacgtgagcctcgcagcgattgccaaccaggccgtcgtgctgatgggcttggacaagggctggccgatctccaagatggacttaggcgtgcccctgctggccctagggtgctacagccaggtcaaccccctgaccctgaccgccgcggtgctcctcctgatcacgcactatgccatcatcggccccggcctccaggccaaagccacaagggaggcccagaagcgcacagcggccgggatcatgaagaacccgacagtggatggcatcatgacgatcgacctggaccccgtcatctacgactccaagttcgagaagcagctgggccaggtgatgctcctggtgctgtgcgccgtgcagctcctgctgatgcggaccagctgggccctctgcgaggcgctgaccctggccaccggaccaatcacgaccctctgggaaggctcccccggcaagttctggaataccaccatcgccgtgtcaatggccaatatcttccgtggatcctacttagctggggcgggcctggcctttagcatcatgaagtcagtggggacgggcaaacggggaaccgggagccagggcgagacactcggtgagaagtggaagaagaagctgaaccagctgagccgcaaggagtttgacctctacaagaagtccggcattacagaggtcgaccggactgaagccaaagagggtctgaaacgcggcgagatcacgcaccacgccgtgagccggggctccgccaaactacagtggttcgtcgagcgcaacatggtcatccctgagggacgggtaatcgatctcggctgcgggcgcggaggttggagctattactgcgcgggtctcaagaaggtaacagaggtccggggatacaccaagggcgggccagggcacgaggagcccgtgcccatgtccacctacggatggaacatcgttaaactgatgagcgggaaggacgtcttctacctaccgcccgagaagtgtgatacgctgctgtgcgacatcggcgagtccagcccctcccccaccgtggaggaaagccgcaccatccgcgtgctgaagatggtcgagccctggttaaagaacaatcagttctgcatcaaggtcctgaacccctatatgcccaccgtgattgagcacctggagcggctccagcgcaagtacggcgggatgctggtccggaacccgctgtcccgcaacagtacacatgagatgtactggatttccaatggcaccggtaacatcgtggcgagcgtgaacatggtcagccggctcctgctgaaccgattcaccatgacccaccggcgcccgactatcgagaaagacgtggacctcggcgccggcaccagacatgtgaacgccgagcccgagacccccaacatggacgtcatcggggagcgcatcaagcgtattaaggaggagcacaacagcacctggcactacgacgacgagaacccgtacaaaacgtgggcctaccacggctcctatgaggtgaaggcgacagggagcgcctcctccatgatcaacggagtcgtgaagctgctaaccaagccctgggatgtagtccccatggtgacccagatggccatgacggacaccaccccctttgggcagcagcgcgtgttcaaggagaaggtcgacacccggacgccgcgcagcatgcccggcaccagacgcgtcatgggcatcaccgcagagtggctctggcggaccttagggcgcaacaagaaaccccggctttgtacgcgcgaggagttcaccaagaaggtacgcaccaacgcagctatgggcgccgtcttcaccgaggagaaccagtgggactccgcgaaggccgcggtggaggacgaagacttctggaagttagtggaccgggagagggagctgcacaaactggggaagtgcgggagctgcgtatacaacatgatggggaagcgggagaaaaagttaggggagtttggcaaggccaaggggtcccgcgccatctggtacatgtggctgggggcccggtacctggagttcgaggcactcgggttcctgaatgaggaccattggtttagccgcgagaactcctactccggcgtggagggggagggcttgcacaagctcggctatatcttgagggatatctccaagatccccggaggagcaatgtacgccgacgacactgccgggtgggacacccgcatcaccgaggacgacctccacaatgaggaaaagataacccagcagatggacccggagcaccggcagctcgcgaacgccatcttcaagctgacgtaccagaacaaggtggtcaaggtgcagcgacccacccccaccggcaccgtgatggacatcatttcgcgaaaggaccagcgcggctccggccaggtgggcacctacgggctgaataccttcaccaacatggaggcgcagctcatccgccagatggagggcgagggggtgctgaccaaggccgacctggaaaacccccatctcagcgagaagaagataacccaatggcttgagacgaaaggcgtggaacgcctcaagcggatggccatcagcggcgatgattgcgtcgtcaagccgatcgacgaccgcttcgccaacgccctcctggccctgaacgacatgggaaaggtgcggaaagacattccccagtggcaaccgagcaagggctggcacgactggcagcaagtccctttctgctcccatcatttccacgagctaatcatgaaggacggccgcaaacttgttgtcccgtgccggccgcaggacgagttgatcggccgagcccggatctcgcagggagccggatggtctttacgcgagactgcctgtctgggcaaggcatacgcccaaatgtggagcctaatgtatttccaccgccgggacttgcgcctggcctccaacgccatctgtagcgccgtccccgttcactgggtgcccaccagcagaaccacgtggtcgatccacgcgcaccaccagtggatgaccaccgaggacatgctgaccgtctggaaccgcgtgtggatcgaggacaatccctggatggaggacaagacgccagtgacaacctgggagaatgtcccctacctaggaaagcgggaagaccagtggtgcggtagcctgatcgggctgacctcccgtgccacgtgggcccagaacatacctacagccatccagcaagtacggagtctcatcggcaatgaagagtttctggattacatgccgagcatgaagcgcttcagaaaggaggaagagagcgagggggcgatctggtga

SEQ ID NO: 25944 - RNA, 9873 nt, synthetic construct
  misc_feature 1..9873: note = derived and/or modified CDS sequence (opt11) from DENV-3__EU596494__SS-prME
  source 1..9873: mol_type = other RNA
accagcctctgtctcatgatgatcctgcctgccgccctggccttccacctcaccagccgggacggcgagccgcgtatgatcgtggggaaaaacgagaggggcaagtccctgttgttcaagaccgccagcgggatcaacatgtgcaccctcatagcgatggacctgggcgaaatgtgcgacgacaccgtgacctacaaatgcccccacatcgccgaagtcgagcctgaggatatcgactgctggtgcaacttgaccagcacctgggtgacctacgggacctgcaaccaggccggagagcaccggagagataagcggtctgtcgcgttagcgccccacgtggggatggggctggacacgaggacccagacctggatgagcgccgagggcgcctggcggcaggtagagaaggtggagacgtgggcgctgcgccacccggggtttaccatcctcgcgctgttcctggcccactacatcggtaccagcctcacccagaaagtggtgatctttgtcttgctgatgctcgtgacccccagcatgacgatgcggtgtgtgggggtcgggaaccgcgacttcgtggagggcttatcgggagccacctgggtggatgtagtgctggagcatggcgggtgcgtgaccaccatggcaaagaacaagccgacgctggacatcgagttacaaaagaccgaggcgacccagctggcgaccctccgaaagctgtgcatcgagggcaagatcacgaacatcaccaccgacagccgctgccccacccagggcgaggccgtcctgccggaagaacaggaccagaactacgtgtgcaagcacacgtacgtggaccgggggtggggcaacgggtgcggcttattcggcaagggttccctggtgacctgcgctaagtttcagtgcctggagcccatcgagggaaaggtcgtgcagtacgaaaacctcaagtataccgtcatcatcacggtacacactggggatcaacaccaggtcggcaacgagacccaaggggttacagccgagatcacgccccaggcgagcacgaccgaggccattctgcccgagtacggcaccctagggctcgagtgcagcccgcgcacgggcctggacttcaacgagatgattctgctcacgatgaagaacaaggcttggatggttcaccggcagtggttcttcgacctgccgttaccctggacgagcggcgccaccactgagaccccgacgtggaacaggaaggagctcctggtcacctttaagaacgcccacgcgaaaaagcaggaggtggtggtcctgggatcccaggagggcgccatgcacacagccctcaccggaagcacggagatccagaactccggaggtaccagcatctttgctggccaccttaagtgccggctgaagatggacaagctcgagctgaagggcatgtcctacgccatgtgcacaaacacctttgtgctgaagaaggaggtgagcgaaacgcagcacgggaccattctcatcaaagtcgagtacaagggcgaggacgcgccgtgcaaaattcctttctcaaccgaggacgggcagggcaaggcccacaacggccgcctgatcaccgcaaaccctgtggtgacgaagaaggaggagccggtcaacatcgaggccgagccgcccttcggagaatccaacatcgtgatcggcatcggagacaacgcgctgaaaatcaactggtacaagaaggggagctccatcgggaagatgtttgaagccaccgcccggggagcccgccggatggccattttaggtgacactgcgtgggactttggtagcgtgggcggggtgctcaatagcctgggcaaaatggtgcaccagatattcgggtcggcctacactgccctgttctctggcgtaagctgggtcatgaagataggcataggtgtgctcctgacgtggataggccttaactccaagaacaccagcatgtccttctcctgtatagccattggaatcatcaccctctacctgggcgccgtagtccaggcggataccggctgcgtgatcaactggaagggcaaggagctgaaatgcggttccgggatcttcgttacaaacgaggtccacacctggacagagcagtacaaattccaggccgattctcccaagcgcctcgccaccgcaatcgcgggcgcgtgggagaacggggtgtgcgggatccgctccacgacccggatggagaacctgctgtggaaacaggtcgccaacgagctcaactacatcctgtgggagaacaacatcaagctgaccgtagtggtgggagatatcatcggtgtcctcgagcagggaaagagaaccctgacgccccaaccgatggagctgaaatacagctggaagacctggggcaaggccaagatcgtgactgccgaaacccagaacagctcatttatcatagacggccccaacacccccgagtgccccagcgcgtcccgggcctggaacgtgtgggaggtcgaggactacgggttcggcgtgttcaccaccaacatctggctgaagctgcgcgaggtatacacccagctttgcgaccataggctaatgtctgccgctgtcaaggacgagcgcgccgtgcacgcagacatgggctattggatcgagtcccagaagaacgggagctggaagctggaaaaagcgtccctgatcgaggtgaagacctgcacgtggcccaagagccataccctctggtccaacggtgtactggagagcgacatgatcattcccaaatccctggcggggcccatcagccagcacaactatcgtccggggtaccacacccagaccgctggtccatggcacctcggtaagctggagctggactttaactactgcgagggcacaaccgtggtgattaccgagaattgcgggacccgcggccccagtctccggacgaccaccgtcagcgggaagctgatccacgaatggtgctgccgcagctgcaccctacccccgcttcggtacatgggtgaggatgggtgctggtacggcatggagatccgccccatcagcgagaaggaggagaacatggtgaagtcactggtgagcgccggatccggtaaggtcgacaacttcacgatgggtgtgttgtgtctcgcaatcctgttcgaggaggtaatgcggggtaagttcggcaaaaagcatatgatagccggggttttcttcaccttcgtgcttcttctgtcgggtcagattacctggcgcgacatggcccacaccctgattatgattggctctaacgcgtctgaccggatggggatgggagtgacgtacctcgccttaattgcgacgttcaagatccagcccttcctggccctcgggttcttccttcgcaagctaactagccgggagaatctcttactgggcgtgggcctcgccatggccaccacgctgcaactaccagaggacatagagcagatggcgaatgggatcgccctcggcctgatggccttgaagctcataacgcaatttgagacataccagctgtggactgccctgatctcgctcacgtgcagcaataccatctttacgctgactgtcgcttggcgcacggcgaccctaatcctcgcgggggtctccttactgccagtctgccagagctccagcatgcggaagtccgactggctccccatgaccgtcgcggccatgggagtgccgcccctcccgctgttcatcttcagcctcaaggataccctcaagcgccgctcatggccgctgaacgagggggtaatggctgtaggcctagtcagcatcctggcgagcagtctgctccggaatgatgtgcctatggccggccccctggtcgccgggggcctgctcatagcctgctacgtcataactgggacctccgcggaccttaccgtggagaaggcggccgacgttacctgggaggaggaagcggagcagacgggcgtcagccataacctgatgatcaccgtggacgacgacgggaccatgcggatcaaagatgacgagactgagaacatactcaccgtgttgctgaagacggccctcctgatcgtttccggcatcttcccgtacagcatccccgccaccctgctcgtgtggcacacatggcagaagcagacccggcgctcgggcgtgctgtgggacgtcccctcaccgcccgagacgcagaaagcggagttagaggagggggtataccggatcaagcagcaaggtatattcgggaagacccaggtgggcgtcggggtgcagaaggagggcgtgttccacaccatgtggcacgtcaccagaggcgccgtgctcacgtataacgggaagcggttagagcccaactgggcctccgtgaagaaggacctgatcagctacggaggggggtggcgcctcagcgcccagtggcaaaaaggagaggaggtccaggtcatcgcggtggagccaggcaagaaccccaagaacttccagaccatgcccggcaccttccagaccacgaccggagagatcggcgcaatagccctagacttcaagcccgggaccagtggcagccccatcataaacagagagggtaaggtcgtggggctgtacggaaacggggtggtcaccaagaacggcgggtatgtgtccggcatcgcccagacgaacgcagagccggatggccccacccccgagctagaggaggagatgttcaagaagcgcaacctcaccatcatggacctgcaccccgggtcggggaagactcgaaagtacctgccggccatcgtgcgcgaggccatcaagcggcgcctccggacgctaatcctggcccccacgcgagtcgtggctgccgagatggaggaggcgctcaaggggctgcccatacgttaccagacaaccgccacgcgcagcgagcacaccggcagagagatcgtggacctgatgtgccatgccaccttcaccatgcgcctcctgtcacccgtccgggttccaaactataacctaatcataatggacgaggcccactttacggatcccgcctcgatcgcggcccgcgggtacatcagcacacgcgtcggcatgggcgaggctgccgctatcttcatgaccgccacgccgccggggacagctgacgcctttccgcagtccaatgccccaatccaggacgaggagcgggacatcccggagcgaagttggaactccggaaacgagtggatcactgatttcgcggggaaaaccgtctggtttgtacccagcatcaaggcgggcaatgacatcgccaattgcctccggaagaacgggaagaaggtcatccagctgtcccgcaaaaccttcgacacggagtaccagaagaccaagctaaacgactgggatttcgtcgtcacgaccgacatcagcgagatgggcgccaacttcaaggccgaccgggttatcgaccctcgtcggtgcctcaagcccgtcatcctgacggacggtcccgagcgcgtgatcctggcaggccccatgccggtgaccgccgcctccgccgcacagcgccgcggccgggtcgggcgaaacccccagaaggagaacgaccagtacatcttcaccggccagcccctgaacaacgacgaggaccacgcgcactggaccgaagccaaaatgctcctggataacatcaacacccccgaggggattatcccagccctattcgagcccgaacgggagaagtccgccgcgatcgacggcgagtaccgcctgaagggcgaatcccgcaagaccttcgtggaactaatgcgaaggggtgacctccccgtctggcttgcacacaaggtggcctcggaaggcatcaagtacaccgaccgcaagtggtgcttcgacggccagcggaacaaccaaatcctggaggagaacatggacgtggagatctggaccaaggaaggcgagaagaagaaactccgtcccaggtggctggacgcacggacctacagtgatccgctggccctcaaggagttcaaggacttcgcggccggtcgcaagagcatcgccctggacctggtaacggagatcgggcgtgtgcccagccacctcgcccaccgcacccggaacgcgctagacaacttagtgatgctccacacctcagagcatggagggaaggcgtaccgccacgccgtcgaggagctgcccgagacgatggagacgctgctactgctgggcctcatgatcctgctgaccggaggcgccatgctgttcctgataagcggcaaggggatcggcaagacctccatcgggctgatctgcgtgattgcctcctccggcatgctgtggatggcggagatcccgctgcagtggatcgcgtcagccatcgtgctggagttcttcatgatggtcctcctgattcctgaacccgagaaacagcgaaccccccaggacaaccagctggcctacgttgtgatagggatcctcactctggccgcaataatcgcggccaatgagatggggctgttggagactaccaagcgcgacctgggaatgtccaaggagccgggggtcgtgagccccacctcctacctggacgttgacctccaccccgccagtgcctggacgctatacgcggtcgccaccaccgtgatcacccccatgctgcggcacacaatcgagaattccaccgccaacgtcagcctcgccgccatcgcaaaccaggccgtcgtgctgatgggtctggacaaggggtggccgatctccaagatggacctcggtgtgcccctgctggccctcggatgttactcgcaggtgaaccccctgactctgaccgccgccgtgctcctgctaatcacgcattacgcgataatcggccccggcctgcaggccaaggccacccgggaagcccagaagcggaccgcggcggggatcatgaaaaatcccaccgtggatggaatcatgacgattgacctggaccccgtaatctacgactccaagttcgagaagcagctgggccaggtgatgttgttagtgctgtgcgccgtccagctcctacttatgcgcacctcttgggccctctgcgaagctctcacgttggcgaccggccccatcacgaccctctgggagggcagccccgggaaattctggaacacaaccatcgccgtgagcatggccaacatcttccggggctcctacctggccggggccgggctggcgttcagcatcatgaagtccgtggggacgggcaagcgcggtacggggtcccagggcgaaaccctcggggagaagtggaagaaaaaactgaaccaactgagccggaaggagttcgacctctacaagaagtctggtataacagaagtcgaccgcaccgaggccaaggagggcctgaagcggggcgagatcacgcaccacgccgtgagccgcggctcagccaagctgcagtggttcgtggagcgcaatatggtaatcccggagggacgcgtgatcgatctcggctgcgggcggggcggttggtcctactactgcgcgggcctgaagaaggtgactgaggtccgcggctacacgaagggtgggcccggacatgaggagcccgtccccatgagcacatacggctggaacatcgtgaagctgatgtctgggaaggatgtcttctacctccctcccgagaagtgtgacacccttttatgtgatatcggcgagtccagcccttcccccaccgtggaagagagccgcaccattcgtgtgctaaaaatggtggagccgtggctcaagaataatcagttctgcatcaaggtgctgaacccctatatgcccactgtgatcgaacacctggagcgtctccagcggaagcacggcgggatgctggtcagaaaccccttgtcccggaacagcacgcacgaaatgtactggatctcgaacggtacagggaacattgtggcgtcagtgaacatggtctcccgcctcctgctgaatcggttcaccatgacacaccgccggccgacgattgagaaggacgttgaccttggggccggcacccgtcacgtgaacgccgagcccgagacccccaacatggatgtcatcggggagcggatcaagcgcatcaaggaggagcacaacagcacctggcactacgacgacgagaacccgtacaagacgtgggcctaccacggctcttacgaggtgaaggccacgggaagcgcgagctcgatgatcaacggtgtagtgaagctgctgaccaaaccctgggacgtggtccccatggtgacccagatggctatgacggacaccaccccatttgggcagcagcgggtgttcaaggagaaggtcgacacccgcactcctcggagcatgcccggcacccgccgggtgatgggcatcaccgctgagtggctctggcgcaccctggggcggaataagaaacctcgcctgtgcacgcgcgaggagttcacgaaaaaggtgcggaccaacgctgcgatgggcgccgtcttcaccgaagagaaccagtgggactccgccaaggccgccgtggaggacgaggatttctggaagctcgtggaccgcgagagagagctacacaaattagggaagtgcgggagctgtgtctataacatgatggggaaacgcgagaagaagctcggcgagttcggcaaggccaagggctccagggcaatatggtacatgtggctgggcgcccgctatcttgagttcgaggcactcgggttcctgaacgaggatcattggttcagccgggagaattcctacagcggagtggagggggagggattacacaaactcggctacatcctgcgcgacatctcaaagatacccgggggtgccatgtacgccgacgacacggccgggtgggacacccggatcaccgaggacgacctgcacaacgaggagaagataacccagcagatggacccggagcaccgccagctcgccaacgccatcttcaagctgacgtaccagaacaaggtggttaaggtccagcggcccacacccaccggcactgtcatggacatcatctctaggaaggatcagcggggctctgggcaggtgggcacctacggcctgaataccttcaccaacatggaggcccagctcatccgccaaatggaaggcgagggggtgctgaccaaggcggacctggagaatccccacttgagtgagaagaagatcacccagtggctggagacgaagggcgtggagaggctcaagcgcatggccatctccggtgacgactgcgtcgtgaagccaatcgatgaccggttcgccaacgccctcctggccctgaacgacatggggaaggtacgcaaggacatcccacagtggcaaccgtcaaagggctggcacgactggcagcaggtacctttctgctcccaccacttccatgagctcatcatgaaggacgggcggaagctagtggtgccttgccgcccccaggacgagctgatcggtcgggcccgcatcagccaaggggcagggtggtccctccgcgagaccgcttgcctagggaaagcctacgcccagatgtggagcctgatgtatttccaccggcgcgatctcaggttagcttccaacgccatatgcagcgccgttcccgtgcactgggttcccacctcccgtactacgtggtccatccacgcgcaccaccagtggatgaccaccgaagacatgctaacagtctggaacagagtgtggatcgaggacaacccctggatggaggacaagacgcccgtgaccacttgggagaacgtcccctacctcggaaaacgggaggaccagtggtgcggctctttaatcgggctgacgtcccgggcaacgtgggcccaaaacatccccacagccatacagcaggtccggagcctcatcggcaacgaggagttcctggactacatgccgtctatgaagcggttccgcaaagaggaggagtcggagggggccatttggtaa

SEQ ID NO: 25945 - RNA, 9873 nt, synthetic construct
  misc_feature 1..9873: note = derived and/or modified CDS sequence (opt11) from DENV-3__EU687218__SS-prME
  source 1..9873: mol_type = other RNA
accagcctgtgtctcatgatgatactgcctgcagccctcgcgtttcacctcaccagccgagacggggaaccccggatgatcgtcgggaaaaacgaacggggcaagagcttactgttcaaaacggcatctggtatcaacatgtgcacccttatcgccatggacttgggcgaaatgtgcgatgatacggtgacttacaaatgtccccatataacggaagtggaacccgaggacatagattgttggtgcaatctcaccagcacctgggtgacctacgggacttgtaaccaggccggtgagcaccgtcgcgacaagcggagcgttgccctcgccccacacgtgggcatgggtctcgacacccgcacccaaacctggatgagcgccgagggcgcctggcgccaggtagagaaagtcgaaacgtgggcactgaggcaccccgggttcactatcttagcactcttcctggcccactacatcggcaccagtctcacccagaaagtggtgatctttatactgctgatgctcgtcacgccctccatgaccatgcggtgtgtgggggtgggcaaccgcgacttcgtggagggcctgtccggggccacctgggtcgacgtggttctagaacatggtgggtgtgtgacgacgatggccaagaacaagccgaccctagacatagagcttcaaaagacggaggccacgcaactcgcgacgctccgaaagctatgcatagaggggaaaatcaccaacataaccaccgacagccgctgccccacgcaaggcgaagccgtgcttccggaggaacaggaccaaaactatgtctgtaagcacacctacgttgaccgggggtggggcaatggatgtggactcttcgggaagggctcactggtgacctgcgccaagtttcagtgcctggaacccatcgaaggcaaagtcgtgcagtacgagaacctcaagtacaccgtgatcataacggtgcacactggcgaccaacaccaggtgggtaacgagacccagggagtgacagccgaaatcacgccccaggccagcacaaccgaagcgatactgcctgagtacggcaccctggggctcgagtgctcccctcgcacgggactagacttcaacgagatgattttactaacgatgaagaataaggcctggatggtccacaggcagtggttctttgacctgcccctgccctggaccagcggcgccaccaccgagactccgacatggaaccgcaaggagctcctagtaaccttcaaaaatgcccacgcaaagaagcaggaggtagttgtgctggggtcccaagagggcgcgatgcacaccgccctcactggggccaccgagatccaaaatagcggaggtacctccattttcgccggccacttaaagtgccgtttaaagatggataagctcgagctgaagggaatgtcttatgctatgtgcacaaacacgttcgtcctgaagaaggaagtgtccgagacccagcacgggaccatactcattaaggtggagtacaagggggaagacgtgccgtgcaagatacccttcagcaccgaagacgggcaggggaaggcacacaacggtagactaatcacggccaacccagtggtcaccaaaaaggaagaacccgtcaacatcgaggccgagccgccgttcggggagagcaacatcgttatcggcattggcgacaatgccttaaagatcaactggtataagaaaggcagcagcatcggtaaaatgtttgaggcgacggcccgaggcgcacgccggatggccatattgggcgacaccgcctgggatttcgggagtgtaggaggggtcctcaactctctgggcaagatggttcaccagatattcgggagcgcgtacacggccctgttctcaggggtgtcctgggtaatgaagataggaatcggggttcttctgacctggatcggactgaacagcaaaaatacctccatgtcttttagttgcatagcaataggcatcatcaccctctatctgggggcggtggtccaggcagacatggggtgcgttattaactggaagggcaaggagttgaaatgtggcagcgggatctttgtgacgaacgaagtccatacttggacagagaagtataagttccaagccgactcccctaaacgcctcgccacagccattgccggcgcctgggaaaatggggtctgcggcatccgctcaacgacccggatggagaaccttctgtggaaacagatcgcaaacgagttaaactacattctgtgggagaacaacatcaagctgacggtggtcgtaggggatatcattggcgtgctcgagcagggcaagcgtacccttacgccccagccgatggagttgaagtattcctggaagacctgggggaaagccaagatagtcacggcggagacccaaaattccagcttcatcatcgacggccccaacacgcccgagtgccccagcgccagtcgggcgtggaacgtctgggaggtggaagactacgggttcggcgtcttcacaactaacatctggctaaaactcagggaggtgtatacccagctgtgtgaccaccggcttatgagcgccgccgtgaaggacgagcgcgccgtacacgcggatatggggtactggattgagagccaaaagaacggatcctggaagctggagaaagcgtcactgatcgaagtaaagacctgtacttggcccaaatcgcacacactctggagcaacggtgtgctggagtccgacatgatcatccccaaaagcctggccgggcccatatcccagcacaactaccgcccaggataccatacccagaccgctggaccctggcaccttggcaagctggagctggactttaattactgcgagggcacaaccgtagtaattacagagaactgcgggacccgcggccccagcttgcggaccacaaccgtgtcggggaaactgatccacgaatggtgctgccgcagctgtaccctacccccattacgatacatgggtgaggacggttgctggtacggcatggagatccgtccaatctccgagaaggaagagaacatggtcaagagcctggtatcagccgggagcgggaaggtggacaacttcacgatgggcgttctgtgtctggccattctgttcgaggaagtgatgaggggtaagtttggcaagaagcacatgatcgcgggggtgttcttcaccttcgtcctgttactctccggccagatcacctggcgcgacatggcccacacactgatcatgattggtagtaacgcatctgatcggatgggtatgggtgtcacgtacctcgcactgatcgccactttcaagatccagcctttcttagcactcgggttcttccttcgaaagctcactagccgggagaacttgctgctaggggtgggccttgccatggctaccacgctgcaactgcccgaggacatcgagcagatggccaacggaatagcactcggcctgatggcgttaaaattaatcacccagttcgagacctaccagctctggacggcgctgatatctctcacgtgctccaatacgatcttcaccctgaccgtagcttggcgcacagctaccctgatcctcgccggggtgagcctactgccggtctgccagagtagctccatgcgcaagacagattggctccccatgacagtggctgctatgggcgtgccacccctcccgctgtttatctttagcctcaaagacacgctgaagagaagatcctggcccttaaacgagggggtcatggccgtaggcctcgtgagcatcctggcctccagcctgctccggaacgacgtccctatggccggccccctggtggctggcggtctgcttatcgcctgctacgttataactgggacctccgccgatctgacagtagagaaggccgcggacgtgacgtgggaggaggaggccgaacagacaggtgtttcgcataacctcatgatcaccgtcgacgacgacgggactatgcgcatcaaggacgatgagaccgaaaatatactcacggttcttctcaagacggccctgctcatcgtgagtggcatcttcccgtacagcatccctgccaccttactcgtctggcatacctggcagaagcagacgcagcggagcggcgtgctttgggacgttccctcgccgcccgaaactcagaaggccgagctggaggagggcgtttaccgaataaagcagcaaggcatattcggaaagacacaggtgggtgtgggggttcagaaggagggtgtctttcacaccatgtggcatgtgacgcggggagcggtcctcacctacaatgggaagaggctggaacccaactgggcctccgtgaagaaagacctaatcagctatggcgggggctggcggctctcagctcagtggcagaaaggcgaggaggtgcaagtcatcgccgtggagcctggcaagaatcccaagaacttccagacaatgcctggcacttttcagacgacaactggggagatcggtgcgatcgcacttgacttcaagcctgggaccagcgggagccccatcataaaccgcgagggcaaagtcgtcgggctgtacggcaacggcgtcgtgacgaaaaacggcgggtacgtttccggaatagctcagaccaacgccgaacccgacggccccacccccgagctggaagaggaaatgttcaagaagcggaacctcaccatcatggatctccatcccgggagcggcaagacgcgtaaatacttgccggccatcgtgcgcgaggcgataaagcgcaggttaaggaccctgatcttggcgccgacgagggtggtagcagcggaaatggaggaggccctcaaggggttaccaattcgctaccagaccaccgcgaccaagtccgagcataccggccgggaaattgtggatctaatgtgccacgccaccttcacgatgcgcctcttatctcccgtcagggtcccgaattataacttaatcatcatggatgaggcccacttcaccgaccccgcctccatcgccgcgcgagggtacatcagcacccgggttggtatgggcgaggccgccgcaatcttcatgacagcgacaccgccagggaccgccgacgcctttccccaatccaatgcccccatccaggacgaggagcgagacatacccgaaaggagctggaactccggcaacgagtggatcactgatttcgctggcaaaacggtctggttcgtcccgagcattaaggcgggtaacgacatcgccaattgcctccgcaaaaacgggaagaaagtgatccagttatccagaaagacgtttgacaccgagtatcagaagaccaaactgaatgactgggacttcgtagtgacaacggacatctctgagatgggcgccaactttaaagccgaccgggtaatcgacccgagacgctgcctaaagcccgtgatcctgaccgacggcccagagcgtgtcatcttggccgggcctatgcctgtgacagctgcctccgccgcccagcggcgcggacgggtgggtcgcaacccacagaaggagaacgaccagtacatcttcaccggccagcccctcaacaacgatgaggaccacgcccactggacagaggcgaagatgctgctcgacaacataaacacgcccgaggggataatccctgcccttttcgaacctgagcgtgagaagtcggcagcgatcgatggggagtatcgcctaaagggcgagtcccggaagacattcgtcgagctgatgcgccgcggggacctccctgtatggctggcgcataaagtcgccagcgagggcatcaagtacaccgaccgtaagtggtgcttcgacggtcagaggaacaatcaaatactggaggaaaacatggatgtcgagatatggaccaaagagggcgagaagaagaagttacgaccccggtggctggacgctcgcacgtacagcgacccgctggcgctcaaggagttcaaggactttgctgcaggaagaaagagcatcgccttagatcttgtgaccgaaattgggcgcgtcccgtcacacctcgcccaccgcacccgaaacgccctagataacttggtaatgttgcacaccagcgagcacggtgggaaggcctaccgccacgcggtggaggagctgccagaaacgatggaaaccctgctgttactaggactcatgatcctgctgactggcggggccatgctattcctgatttcaggtaaagggataggcaagacctcgattggattgatttgcgtcatcgccagctccggcatgctctggatggccgagatcccgctgcagtggatcgccagcgcaatcgtgctggagttctttatgatggtgttgctgatcccagagccagaaaaacagcggacaccccaggacaatcagctcgcctacgtggtaatcgggattttgacccttgccgccatcatcgccgctaacgagatgggcctactagaaacaaccaagcgcgacctgggaatgtctaaggagcccggggtggtcagccccacaagttatttggacgtggacctgcatccagctagcgcctggaccctgtacgcggtggctaccaccgtaatcacgcccatgctgcggcacaccattgagaatagtaccgccaacgtgagtttagcggccattgctaatcaggcggtggtcctgatgggcctcgacaaggggtggccgatctccaagatggacctcggtgtgccattgttggccctcgggtgctacagccaggtgaacccattgacactgacggccgccgtactactcctgatcacccactatgccattattggccccggtctacaggcaaaagcgacgcgcgaggctcagaagcggactgcggccgggatcatgaagaatccgacggtagacggtatcatgacgatcgatctggaccctgttatctacgattccaaattcgaaaagcaactggggcaggttatgctactggtgttatgcgcggtgcagcttctcttgatgcgcacctcatgggcactctgcgaggctctaaccctggccacgggcccgatcaccaccctttgggagggctccccgggaaagttctggaacaccaccatcgcggtctcgatggccaacatattccgaggctcataccttgccggggccggcctcgccttctcgatcatgaagtccgtcgggaccggcaagcgcggtacgggcagccagggtgagaccctcggtgaaaaatggaaaaagaagctcaaccagctgagccggaaagagttcgatctttacaagaaatcaggcatcacggaggtggatcgcacggaagcgaaagaggggctgaagaggggagagattacccaccacgctgtcagcaggggctcggccaagttgcaatggttcgtcgagaggaacatggtgatcccggaagggagggtaatcgacctcggttgcggtcggggagggtggagctactattgcgccggtctcaagaaagtgaccgaggtacgtgggtacaccaaaggtgggcccgggcatgaggagcctgtcccaatgtccacgtacggctggaacattgtcaaactgatgagcggcaaggacgtgttttacttaccacccgaaaagtgcgacaccctgctgtgcgacatcggcgagtcctcgccctcccccaccgtcgaggagagtcggaccatccgcgtgctaaaaatggtagagccgtggctgaagaataatcagttctgcattaaggtcctaaacccatacatgcccacggtgatcgagcatctggaaaggctccagaggaaacacggagggatgctcgtgcgcaaccccctctccagaaattccactcacgaaatgtactggatttctaacggcacggggaacatcgtcgctagtgttaacatggtctctcgcctcctgttaaatcgcttcacaatgacacaccgccgccccactatcgaaaaggatgtcgatcttggcgctggtaccagacacgtgaacgccgagcccgagacgccaaatatggacgtgatcggagagcggatcaagcgcattaaggaggaacataacagcacctggcactacgacgacgagaacccctacaagacctgggcgtaccacggatcctatgaagtcaaggccaccgggtcggcgtcctctatgattaacggcgtcgtgaagctgctcaccaagccctgggacgtagtgccgatggtcacgcagatggcgatgacagacaccacccccttcgggcaacagagagtgttcaaggagaaggtggatacgcggaccccaagaagcatgcccggcaccaggcgggttatgggcatcactgccgagtggctatggcgcacgctggggagaaacaagaagccccgcctctgcactcgggaggagtttaccaagaaagtgcgcaccaatgccgccatgggcgcggtcttcactgaggagaaccagtgggattccgcgaaagcggccgtcgaggacgaagacttctggaagttagtggatcgcgaacgcgaactgcacaaactaggcaaatgcgggagctgcgtctacaacatgatgggcaaacgtgagaagaaacttggggagttcggcaaggcaaaggggagccgggccatatggtatatgtggcttggcgcccgctacctggagtttgaagccctggggtttttaaacgaggaccattggttcagccgggaaaattcgtacagcggcgtcgagggggagggactgcacaagctcggctacatcctaagagatatctccaagatccccgggggcgccatgtacgctgacgacaccgctgggtgggacacacggatcaccgaggatgacctgcacaacgaggagaagatcacgcagcagatggatccggaacataggcaactcgccaacgcgatcttcaagctgacctatcagaacaaagtggtgaaagtccagcggccgacccccaccggcactgtcatggatatcatctcccgcaaggaccagagagggtccggccaggtgggcacgtacgggctgaacacctttaccaacatggaggcccaactcattcgccagatggagggagaaggggtcctgagcaaggcggatctagagaacccccatctcccggagaagaagatcacccagtggctggaaacgaagggggttgagcggctgaagagaatggcgatctctggcgacgactgcgtggttaagcctatcgacgaccggtttgccaatgccctcctggcgctaaacgacatggggaaggttcgcaaggacattccacagtggcagccctcaaaagggtggcacgactggcagcaggttccgttctgctcgcaccacttccacgagctaattatgaaggacggccggaagttagtagtgccctgccgcccacaggatgaactcatcggtcgagcccgcataagccagggggccggctggtctctccgggagacagcatgcctgggcaaagcatacgcccagatgtggagcctgatgtatttccacaggcgcgacctccggctggcgtccaacgccatctgcagcgccgtgcctgtccactgggttccgacctccagaaccacgtggtctatccacgcccaccaccaatggatgaccactgaggacatgctgactgtgtggaaccgtgtctggatcgaggacaacccctggatggaggacaaaaccccggtgaccacctgggaaaatgtgccgtacctcgggaagcgcgaggaccagtggtgcggcagcctgatcgggctgaccagccgggctacatgggcgcagaacatcccgaccgcgatccagcaggtacgcagcttaatcggcaacgaagagttcctggactacatgccatccatgaagcggttccgcaaagaggaggagtccgaaggggcgatctggtaa

SEQ ID NO: 25946 - RNA, 9873 nt, synthetic construct
  misc_feature 1..9873: note = derived and/or modified CDS sequence (opt11) from DENV-3__EU726772__SS-prME
  source 1..9873: mol_type = other RNA
accagcctgtgcctcatgatgatcctccccgcggctttagcgttccacctgacctctcgggatggagagccccggatgatagtgggtaaaaatgaacgaggcaagagcctgctgtttaagacggcctccgggatcaacatgtgcactctaatcgctatggacctgggcgagatgtgcgatgacaccgtgacctataaatgcccgcacatcacggaggtggagcccgaggacatcgactgctggtgcaatctgacctcaacctgggtaacctacggaacctgtaaccaagccggcgagcaccggcgcgataagcggtccgtcgccctcgcgccccacgtgggtatgggtctggacacccgcacccagacctggatgagcgccgagggggcctggcgacaggtggagaaggtagagacgtgggcgctgcgccacccggggttcaccatactcgccctgttcctggcccactacattggcacctccctcacccagaaggtggtgatcttcatcttattgatgctcgtcacgcccagcatgaccatgcgatgcgtcggcgtgggcaacagagacttcgtcgagggcctgtccggggccacttgggtggacgttgtcctcgagcacggaggctgcgtgaccacgatggccaagaacaagccgaccttggacatcgagctgcagaagacggaggccacacagctggcgacgttacgcaagctctgcatcgagggcaagatcactaacataaccaccgacagcagatgccccacgcagggcgaagccgtgctgccggaggaacaggaccagaactatgtctgtaagcacacctacgtggaccggggatggggcaatggttgtggtttattcggaaagggctcactggttacctgcgccaaattccaatgcctggagcccatcgagggcaaggtcgtgcagtacgaaaacctcaagtacaccgttattatcacggtccacactggcgaccaacaccaggtggggaacgagacgcagggggtcaccgcggagatcaccccccaggcgagcaccaccgaggcgatcctgcccgagtacggcacgctgggactcgagtgctccccgcgcactggcctggatttcaacgagatgatccttctcacgatgaagaacaaggcctggatggtgcaccgacagtggttcttcgacctgcccctgccctggaccagcggcgccaccaccgagactcccacctggaaccgcaaggagctcctggtgaccttcaagaatgcccacgctaagaagcaggaggtcgtggtgctgggttcccaggagggtgcgatgcacaccgccctcacgggagcaaccgagatacagaatagcggcgggacctcgattttcgccggccacctgaagtgccggctcaaaatggacaaactcgagctgaagggtatgagctacgctatgtgtaccaatacgttcgtcttgaagaaggaggtctccgagactcagcacgggaccattctcatcaaagtggagtacaagggagaggacgtcccgtgtaagatcccctttagtacagaagatggccagggcaaagcgcacaacgggcgcttgataacagcgaaccccgtcgtgaccaaaaaggaggagcccgtcaatatcgaggccgagccgcccttcggtgagagcaacatcgtgatcggcatcggggacaatgccctgaagattaactggtacaagaaggggtcgagcatcggcaaaatgttcgaggcgaccgcccggggcgccaggcggatggccattctgggagacaccgcatgggatttcgggtccgtgggcggagtgttgaacagcctgggcaaaatggtgcaccagatcttcgggtccgcgtacactgccctgttcagcggcgtatcgtgggtcatgaaaataggcattggggtgctcctgacctggattggactgaacagtaagaacacctcgatgagcttctcctgtatcgccatcggtataatcaccctctacctgggcgccgtggtccaggccgacatggggtgtgtgatcaactggaagggcaaggagctgaagtgcggcagcgggatcttcgtgactaacgaggtccacacctggaccgagcagtacaagttccaggcggactcccccaagaggctggccaccgccatcgccggcgcctgggagaacggggtgtgcggcatccgcagcacgacaagaatggagaatctgctgtggaagcagatcgcgaacgaactcaactatatcctgtgggagaacaacatcaagctgaccgtggtagtgggggacatcatcggggtgctcgagcagggtaagcgcaccctcaccccccagccaatggagctgaagtactcctggaaaacctggggtaaggctaagatcgtcaccgccgagacgcagaacagctcgtttataatcgacggcccgaacacgcctgagtgtccgtctgcctccagggcgtggaacgtgtgggaggttgaggattacggcttcggcgtcttcaccacgaatatctggctgaagttgcgcgaggtgtacacgcagctgtgcgaccaccggctcatgagcgccgccgtgaaggacgagagagccgtccacgccgacatgggctactggatcgagagccagaaaaacggatcctggaagctggaaaaggcgtctctgatcgaggtgaagacctgtacgtggccgaaatcccacactctctggtcaaacggcgtgctggagtccgacatgatcattcctaagagcctggccgggcccatctcccagcataactaccggcctgggtaccacacacagaccgccgggccatggcacttgggcaaacttgagctggacttcaactactgcgaggggactactgtcgtgatcaccgagaactgtggaacccgcggccccagcctccggacgaccactgtgtccgggaagttaatccacgagtggtgctgccgcagctgcaccctgcccccgcttcggtacatgggggaggacgggtgctggtacggcatggagattcgacccatatccgagaaggaggaaaatatggtcaagagcctggtgtccgcaggctctgggaaggtggacaactttacaatgggcgttctgtgcctcgcgattctgttcgaggaggtgatgcgggggaagtttggcaagaaacacatgatcgcaggggtgttcttcacctttgtcctcctcctgtccggccagatcacctggcgcgacatggcacacaccctaatcatgatcggcagcaacgcctccgaccggatggggatgggggtcacgtatctcgcactgatagccacctttaagattcagcctttcctggcgcttgggtttttcctgcgcaagctgaccagccgggagaacctcctgctgggggtgggcctggccatggcgacgactttgcagctgcccgaggacatcgagcagatggccaatggcatcgcgctcggcctgatggccctgaagctcatcacccagttcgagacctaccaattatggaccgccctgattagcctcacctgctctaataccatcttcaccctgacagtagcctggagaacggccaccctgatcctcgcaggggtcagcctgctgccggtctgtcagtcctcgtccatgcggaagaccgactggcttcccatgaccgtggccgcgatgggggtgccgcccctccctctgttcatctttagcctgaaggacacgctgaagcgccgctcctggcccctgaacgagggggtcatggccgtaggtctggtgagcatcctggcctcaagcctgctccggaacgacgtccccatggccggccccctggtggctgggggactgctcatcgcctgctacgtgataaccgggaccagcgccgatttgaccgtcgagaaagcggcggacgtaacgtgggaggaggaggccgagcaaaccggcgtgagccacaatctaatgatcaccgtagacgatgacgggaccatgcgcattaaggacgacgagactgaaaacattctcacggttctactgaagacggccctcctgatagtatccgggatctttccgtatagcatccccgcgaccctgctcgtctggcatacgtggcaaaagcaaacgcaacggtccggcgtgctgtgggacgtcccctctccccccgagacccagaaggccgagctggaggagggggtgtaccgtatcaagcagcagggcattttcgggaagacacaagtgggagtgggggtccagaaggagggcgtgttccacaccatgtggcacgtgacgcggggcgcggtccttacgtacaacggtaagaggctggaacccaactgggcctctgtgaagaaggacctgatcagctacggcggtgggtggcgactctccgctcagtggcaaaaaggggaggaggtgcaggtcattgccgtggagcccggcaagaaccccaagaactttcagaccatgccaggcacattccagacgaccaccggggaaatcggagcgatcgccttggactttaaaccagggaccagcggcagcccgatcatcaaccgcgaaggtaaagtagtcggcctgtacggcaacggggtggtcacgaaaaacggcgggtacgtcagcggcattgcccagacgaacgccgagccggacggccccacccctgagctggaggaggagatgtttaagaagcggaacctcaccattatggacctgcatcccgggagcggtaagacgcgcaagtacctgccggccatcgtgcgggaggcgatcaaaaggcggcttcgcaccctgattctagcgcccacccgcgtagtcgccgctgagatggaggaagccttaaaggggctgccgatacgctaccagacgacggcgaccaagtccgagcacacaggccgggagatcgtggatctgatgtgccacgccacgttcacgatgcgcctcctgagccccgtccgggtaccaaactacaacctgatcattatggatgaggcccacttcacggaccccgcttccatcgccgcgcgcggctatatcagcacacgggtgggcatgggggaggccgccgccattttcatgaccgcgacgccacccgggaccgccgacgccttcccgcagagtaacgcgcccatccaggacgaagagcgtgatatccccgagcgctcttggaactccggcaacgagtggatcaccgacttcgcagggaagaccgtatggttcgtcccaagcataaaggctggcaacgatatcgcaaactgcctccgaaagaacgggaaaaaggtgatacagctgtcccgcaagacgtttgacacggagtaccagaagaccaagctgaacgactgggacttcgtggtcaccacggacataagcgagatgggcgccaacttcaaggcggatcgggtgatcgaccctcgccggtgcctcaagcccgtcatcctcacagacggcccggagagggtcatattggccgggcccatgcctgtgaccgcggcatcagccgcccagcggagaggccgggtgggccgaaacccccagaaagagaacgaccagtacatattcacgggccagcccctcaataacgacgaagatcacgcacattggaccgaggcgaagatgctgttagacaacatcaatacgcccgaggggatcattccggctctcttcgaacccgagcgggagaagtccgccgccattgacggggagtaccgcctgaaaggcgaatcccggaagacattcgtcgagctgatgagacgtggggacctgcctgtgtggctggcccacaaggtagccagcgagggtatcaagtacaccgaccgcaaatggtgcttcgatgggcagcggaacaatcagatactggaggagaacatggacgtggagatctggaccaaggaaggcgagaaaaagaagctccgcccacgctggctcgacgcccgcacgtactccgaccctctggcccttaaggaattcaaggactttgccgcgggccgcaagagcatcgccttagatctggtgacagagatcgggagggtcccatcccacctcgcccaccgcaccagaaacgcgctggacaacctggtgatgctgcacaccagtgagcacgggggcaaggcctaccggcacgcggtcgaggagctgccagaaacgatggagaccttgcttctgctgggcctcatgatcctgctgaccgggggcgccatgctttttcttatcagcggcaaggggatcggcaagacctccatcggtctgatctgcgtcatcgccagctccggcatgctatggatggctgagatcccgctgcaatggatcgcctccgccatcgtgctggagttcttcatgatggtgcttctcatcccggagcccgagaagcagcgtactccccaggacaaccagctggcctacgtggtgatcgggatccttaccctcgccgctattatcgccgcgaacgaaatgggcctgctcgagaccaccaagagagacctggggatgtccaaggaacctggggtggtcagccccacctcctacctggacgtggacttacaccccgccagcgcctggacactgtacgccgtggcgaccaccgtcatcacgcccatgctgcggcacaccattgagaacagcaccgccaacgtgagtctcgcggccatagcaaaccaggcagtggtcctgatgggcttggacaaggggtggccgatctccaagatggacttaggcgtgcccctgttagccctcgggtgttatagccaagtgaaccctctgaccctgacggccgcagtgctcctcctaattactcactacgctataataggcccgggcctccaggcgaaggccacccgtgaggcccagaagagaaccgccgcggggattatgaagaatccgacggtggatggcatcatgaccatcgaccttgatcccgtcatttacgactccaagttcgagaagcagctgggtcaggttatgctactagtgctgtgcgcggttcagctcctgctgatgcgcaccagctgggccttatgtgaggccctgaccctggctacgggccccatcacgacgctctgggagggctcccctggaaagttctggaacaccacgatcgcggtgtcaatggccaacatcttccggggctcctacctggccggtgccggcctggcttttagcatcatgaagtccgtagggaccggcaagcgcggaaccgggagtcagggtgagactctaggggagaagtggaaaaagaagctgaaccagctgtcaaggaaagaattcgacctctacaagaagtccggcatcaccgaggtggaccgcacggaggcgaaggaggggctgaaaagaggcgagatcacccaccacgccgtcagccgcggatcggccaagctgcagtggtttgttgagcggaacatggtgatcccagaggggcgcgtaatcgaccttggctgcggtcggggcgggtggagctactactgcgccggcttgaagaaggttaccgaggtgcgcggctacaccaaaggcgggcccggccacgaagagccggtccccatgagtacgtacggctggaacatcgtgaagctaatgagcgggaaggacgttttttacttaccgccagagaagtgtgacacactgctgtgtgacatcggtgagagctctccttcacccaccgtggaggagagccggacgatccgcgtgctcaagatggttgagccgtggctgaagaacaaccaattctgcatcaaggttctgaacccctatatgccaaccgtgatcgagcacctcgagcgcttacaacggaaacacggcgggatgctggtgaggaatcccctgtccaggaacagcacccatgaaatgtattggatctccaacggtaccggaaacatcgtcgccagcgtaaatatggtgtcccgcttgcttcttaaccgcttcaccatgacgcaccgtaggccgaccattgagaaggacgtcgacctaggcgctggcacccggcacgtgaacgccgagccagagacccctaacatggacgtcattggcgagcggatcaaaagaatcaaggaggagcataactctacgtggcactacgacgacgaaaacccgtacaaaacctgggcttaccacggctcctacgaggtcaaggcaaccgggagcgcatccagcatgatcaacggcgtagtcaagctgctgaccaagccctgggacgtggtgcccatggttacccagatggccatgaccgacacaacccctttcggccagcagcgggtgttcaaggagaaggtggatacgcgcactccgcggagtatgcccggtactcgtcgggtcatgggcatcaccgcagagtggctctggcgcacattagggcggaacaagaagccccgactgtgcacccgggaggagtttaccaagaaggtgcgcacgaacgccgccatgggcgcggtgttcaccgaagagaaccagtgggactcggccaaggccgcagtggaggacgaggacttttggaagctcgtagaccgcgagcgtgaactgcacaagctggggaagtgcggaagctgcgtgtacaacatgatggggaagcgcgagaaaaagctcggtgaatttggaaaagccaaagggtcccgagcgatatggtacatgtggctgggggctaggtacctggagtttgaggcactcggcttcctgaacgaggaccactggttctcccgggagaactcctatagcggcgtcgagggggagggcttgcacaagctcggttacatcctgcgggacatctccaagatcccggggggcgccatgtatgcagatgacaccgcggggtgggacaccagaatcaccgaggacgacctgcacaacgaggagaagatcacgcaacagatggacccggagcaccgtcagctcgccaatgccatcttcaagctgacctaccagaacaaggtggttaaggtccaaaggcccacccccaccggcaccgttatggatatcatctcacgaaaggaccagcgaggctccgggcaggtgggaacgtacgggctaaacacctttactaacatggaggcccagctcatccgccagatggagggcgaaggggtcttgagcaaggcggacctggagaacccccacctcccagagaagaagattacccagtggctggagacaaaaggtgtggagcggctgaaacgcatggcgatctcaggcgacgactgcgtggtcaaacctatagatgatcggttcgcgaacgccttgctggccctgaatgatatggggaagggccgcaaggacataccccaatggcagcccagcaagggttggcatgactggcaacaggtgccgttctgctctcaccacttccacgaactcatcatgaaggacggccggaaactagttgtcccctgcaggccccaggacgagctgataggccgggcccgaatcagccagggggcgggctggtccctgcgggagactgcctgcctcgggaaggcctacgcccagatgtggagcttaatgtacttccaccgccgcgaccttaggcttgcgtccaatgcgatctgttcagcagttcccgtgcactgggtgccgaccagtcgcaccacgtggagcatccacgcccaccatcagtggatgaccacagaggacatgctgaccgtgtggaaccgtgtttggatagaggacaatccctggatggaggacaaaacgccagtcaccacctgggagaacgtgccatacctcggcaagcgcgaggatcaatggtgcggtagcctgatcggcctgacctcccgggccacgtgggcccagaacattccgacggccatccaacaggtcagatccctcattgggaacgaggaatttctggactacatgccctccatgaagcgattccgcaaggaggaggaatcggaaggcgcaatctggtga

SEQ ID NO: 25947 - RNA, 9873 nt, synthetic construct
  misc_feature 1..9873: note = derived and/or modified CDS sequence (opt11) from DENV-3__FJ182013__SS-prME
  source 1..9873: mol_type = other RNA
acttctttatgccttatgatgatcctgcctgcagccttggccttccatctcaccagtcgggacggggagccccggatgattgtggggaaaaacgagagaggcaagtcactgctgttcaagaccgcctccgggattaatatgtgcaccctcatagcaatggacctcggcgaaatgtgcgacgacaccgtgacctacaagtgcccccacatcaccgaggttgagcccgaagacattgactgctggtgtaacctaacttccacctgggtgacatatggtacgtgcaaccaggccggcgagcaccggcgcgacaaacggtccgtcgccctcgcgccccatgtgggtatggggctcgatacccgcacccagacctggatgagcgccgagggcgcctggcgacaggtggaaaaggtagagacgtgggccctgcgacatccggggttcacaatattggcgctgttcttagcccactacgtgggcacctccctcactcagaaagttgtgattttcatcttgctgatgctggtgactcccagcatgaccatgcggtgcgtgggggtcggcaaccgcgacttcgtggaggggctgtccggggccacatgggtagatgtcgtgctggagcacggggggtgcgtgacaactatggccaaaaataaacccaccctcgacatcgagctgcagaaaaccgaagcaacacagctagccacgctccgcaagctgtgcattgagggcaagatcaccaacataacaaccgattcgcggtgccccactcagggcgaggccgtcctgccggaggagcaggaccagaattacgtgtgtaaacacacgtatgtagatcggggatgggggaacgggtgtggcctcttcgggaagggctccctggtgacttgcgctaagttccaatgcctcgagcctatcgagggcaaggtggtgcagtacgagaatctcaagtataccgtcataattacggtgcataccggggaccagcaccaggtcggcaacgaaacgcaaggggtgaccgccgagatcacgcctcaggccagtactactgaagcgatactgcccgagtacggcactctagggctagagtgctcccctagaaccggcttggattttaacgagatgatcctgttgactatgaagaataaggcctggatggtgcaccggcagtggttcttcgacttacctttaccctggaccagcggcgctaccactgagacgcctacatggaaccgcaaagagttactagtgacctttaagaacgcccacgctaagaaacaggaggtagtggtgctgggcagtcaggagggagccatgcacaccgccctaactggggccaccgagatccagaacagcggcggaacgtccatcttcgccggccatctgaagtgccggctgaagatggataaactcgaattaaaggggatgtcctatgccatgtgcaccaatacgttcgtgctcaaaaaggaggtatccgaaacacagcacggtacgatactaatcaaggtcgaatacaagggcgaggacgtgccgtgcaagattcccttcagcaccgaggatgggcagggcaaagcccacaatggccggctcataacagctaaccccgtggtcaccaaaaaggaggagcctgtgaacatcgaagccgagccccctttcggagagtcgaacattgtgatcggcataggcgacaacgctctgaagatcaactggtataagaaaggtagcagcatcgggaagatgttcgaagccaccgctcgaggcgccagacggatggccatcctgggcgataccgcctgggacttcgggtccgtgggcggggtgctcaactccctgggcaagatggtacaccaaatcttcgggtcggcgtacactgccctgttctcaggcgtctcctgggtgatgaagataggaataggggtgctcctaacatggatcggcctgaatagcaagaacacctccatgagcttctcctgcatcgccatcggaataatcaccctctacctgggcgccgtagtgcaggccgacatggggtgtgttattaattggaagggcaaggaactcaagtgcggcagcgggatcttcgtgactaacgaggtgcacacctggaccgagcagtacaagttccaagcggattcccctaaaagactcgccaccgccatcgccggcgcctgggaaaacggtgtgtgcggtatccgcagcacgacccggatggagaacctgctgtggaagcagatcgctaatgagctcaactatatactttgggaaaacaacataaagctgaccgtcgtggtgggtgacatcatcggcgtacttgagcagggcaagagaacccttacgccccagccgatggagctgaagtattcctggaagacctgggggaaggctaagatagtcaccgcggagacccagaacagctccttcatcatcgacggacccaacacgcccgagtgccccagcgccagcagagcgtggaatgtatgggaagttgaggactacgggttcggggtgttcacaacaaacatctggttaaagttgagggaggtatatacccagctgtgcgaccaccgtctcatgtcagcagcggttaaggacgagagagcagttcacgctgacatggggtactggattgaatcccaaaagaacgggtcctggaagttggagaaggcgagccttattgaagtcaagacctgcacttggcctaagtcgcacaccctctggagcaacggggtcctggagtctgacatgatcatcccgaagagcctggcagggcccatctcccagcacaattaccgtccgggctaccatacccaaaccgccggcccctggcacctcggcaaacttgaactggattttaattactgcgaagggacgactgtggtaatcaccgagaactgcgggacccgcgggccaagcctccggacaacaacggtttccgggaagctaatccacgagtggtgctgccggagctgcaccttacccccactccggtacatgggcgaggacggctgctggtacggcatggagattcgcccgatctccgagaaagaggagaatatggtcaagagcctggtgtccgccggctccgggaaggtcgataacttcacgatgggtgtgttgtgcctcgctatcctgttcgaggaggtaatgcgggggaagttcggcaagaaacatatgatcgcgggggtcttcttcactttcgtgcttctcctatcaggccagatcacctggcgcgacatggcccacactctgatcatgattggcagcaacgcatccgatcggatggggatgggcgtgacatatctcgccctgattgccaccttcaaaatccagccgttcctagcgctcggcttcttcctgaggaagctgactagtagagagaatttgctgctgggcgtaggcctcgccatggccacgacgctgcaactgccggaggacatcgagcaaatggccaacggtatcgcgttaggcctcatggccctcaagctcatcacccagttcgaaacttatcagctgtggaccgctctaatctcactcacgtgtagcaacaccatattcaccctgaccgtggcatggcgcacggccaccctgatactcgcgggtgtcagcctgctgcccgtgtgtcagtccagctccatgcggaagactgattggttgcccatggccgtggccgccatgggagtgccacccctgccgctgttcattttcagcctcaaggacaccctgaagcgccgctcctggcccctgaacgaaggggtgatggccgtgggcctcgtatcaatcctggcgtccagcctgttgcggaacgacgtgcccatggccggcccccttgtggccgggggcctactcatagcctgctacgtgataaccggcacctccgcggacttaaccgtagagaaggcggccgacgtgacgtgggaggaagaggccgagcagacgggcgtttcgcacaacctgatgatcaccgtggacgacgacgggaccatgcgtattaaggacgacgagaccgagaacatcctcaccgtgctactgaagacggccctcctgatcgtatccggcattttcccgtacagcatccccgccacactgttagtgtggcacacctggcagaagcagacacagcgctccggagtgctgtgggatgtccccagcccgccggagacgcaaaaggccgagctggaagagggagtataccgcataaagcagcaagggattttcgggaagacccaggtgggcgtcggtgttcagaaggagggcgtgttccacacgatgtggcacgtcacacgtggggctgtgttaacatacaacgggaagcgcctggagcccaactgggccagtgttaagaaggacctaataagctacggcggggggtggcggctctccgcccagtggcagaaaggtgaggaggtccaggtgatcgcggtggaaccgggtaagaaccctaagaactttcaaaccatgcccggaaccttccagaccacaaccggggagatcggcgccatcgctctagacttcaagcccggaacaagcggtagcccaataatcaacagggagggcaaggtagtggggctttatggaaacggagtggtcaccaagaacggcgggtacgtgagtgggatcgcccaaacgaatgcagagcctgacggccccactcccgaattagaagaagagatgttcaaaaagcggaacctcaccatcatggacttacaccccgggagcggcaagaccagaaaatacctgccggcgattgtgcgggaggcaataaaacgacgtctcagaacgcttattttggcccccacccgcgttgtggccgcagagatggaggaagcgctcaaggggttgcccatacgctaccagacgaccgccactaagtccgagcataccggccgggagatcgtggatctaatgtgtcacgcaaccttcaccatgcgcctcttaagccccgtccgggtaccgaactacaacctgatcatcatggacgaagcccacttcacggaccccgcctccatagcggcccgcgggtatatcagtactcgggtgggcatgggtgaggccgcagcaatcttcatgacagccaccccccccgggacggccgatgccttcccacagtccaatgccccgatccaggacgaggagcgcgacatccccgagagaagctggaactccggaaatgaatggataaccgactttgcggggaagaccgtctggttcgttccctctattaaggccgggaacgacatcgccaactgtctacgtaagaacgggaagaaggtgatccagttgtcccgcaagaccttcgatacggagtaccagaagaccaagctaaacgactgggattttgtcgtaaccaccgacataagcgagatgggcgccaacttcaaggcggaccgggtgattgacccgcgacgctgcctgaagcctgttatccttacggacggccctgaacgcgtaatccttgctgggcccatgcccgtgaccgcagcctcagcggcccagcggcgcggcagggtggggcgcaacccccagaaggagaacgaccagtacatcttcaccggccagccgttgaacaacgacgaagaccacgcccactggaccgaggccaagatgctgcttgacaacatcaatacccccgagggcattatacccgccctcttcgagcccgagagagaaaagtccgctgcgatcgacggagaataccgcctgaagggggaatcccggaagacgtttgtagagctgatgcgccgaggagacctgccagtttggctggcgcacaaggtggccagcgaaggcattaagtacaccgatcggaagtggtgtttcgatgggcagcggaataaccagatactggaggagaatatggatgtggagatttggaccaaggagggcgagaaaaagaagctccgcccccgttggctggacgcccgcacgtactccgacccgttagccctcaaggaattcaaagacttcgcggccggccgcaagagcatagccctggacctggtcacggagattgggcgggtgccgtcccacttagcacaccgaacccggaacgccctggacaacctggtaatgctccacacctctgagcacggcgggaaggcgtaccgtcacgccgtcgaggaactgcccgagaccatggagacgctgttactgctgggcctcatgatattgctgacagggggcgccatgcttttcctgatcagcggcaaggggatcggaaagacctctattggtctgatctgcgtgatcgccagctccgggatgctctggatggctgagatcccgctgcagtggattgcctccgcaatcgtgctggagttttttatgatggtcctcctcattcccgagcccgaaaagcagagaacgccccaggacaaccagctggcctacgtggtgattgggatactcacgttggccgccatcatcgccgctaacgagatggggctgctcgaaacaactaagcgcgacctgggcatgtccaaggaaccgggggtcgtgagccccacctcctacctggacgtggacctacaccccgcatcggcctggaccttatacgcggtcgccacgaccgtgatcaccccgatgttacgccacacgatcgaaaacagcaccgccaacgtgagcctagctgccatcgcgaaccaagccgttgtactgatggggctagataaggggtggccgatctccaagatggacttaggcgtgcccctgctcgccctcgggtgctacagccaggtcaacccgctcaccctgactgccgccgtgctcctgctcatcactcactacgcgataatcggccccggcctccaggccaaggctacccgcgaggcccagaagcggaccgccgcggggatcatgaagaaccccaccgtagacggcatcatgacgatcgacctcgacccggtcatctacgactccaagtttgagaagcaactcggccaagtgatgctactagtgctgtgcgcggtccaactactactgatgcgcaccagttgggccctttgcgaggcgctaactctggcgaccgggcctatcacgaccctctgggagggctcccccgggaagttctggaacaccactatcgccgtgtcgatggctaacatattccggggctcctacctggccggagccgggctcgcattcagcatcatgaagagtgtgggaacgggcaagcgcggcactgggtcgcagggcgagactctcggggagaagtggaagaagaagctgaaccagctgagccggaaagagttcgacctctataagaagtccggcattaccgaggtcgaccgaaccgaggccaaagaagggctgaagaggggagagatcacacaccacgccgtaagccgcggctccgctaagttacagtggttcgtggaacgcaacatggttataccggaggggcgcgtgatcgacctcggatgcggacgaggtgggtggagctactactgcgccggtctgaagaaggtgaccgaggtccgcggttacaccaaaggcgggcccgggcacgaggagcccgtacccatgtcaacctatggctggaacattgtgaagcttatgagcgggaaggacgtcttctatctcccgcctgaaaagtgcgacacgctgctgtgcgatatcggcgagtcatcgccttccccgaccgtggaggagagccggacgatccgcgtgctgaagatggtcgagccgtggctcaaaaacaaccagttttgcatcaaggtgctcaatccctacatgcctaccgtgattgagcaccttgagaggctccagcggaagcatggcggtatgctggtccgcaacccactgagccggaatagcacgcacgagatgtactggatctccaacggaaccggcaacatagtggcgagtgtaaacatggtctctagactccttctgaacagattcaccatgacgcatcgccgacctacgatcgagaaggatgtggacctcggtgccggcacccgtcacgtgaacgccgagcccgagacacccaacatggatgtcatcggggagcggatcaagcgcatcaaggaggaacacaacagcacctggcactatgacgacgagaacccttacaagacctgggcctaccacgggagctacgaggtaaaggccaccgggagcgcgtccagcatgataaacggggtcgtgaagttactgaccaaaccctgggatgtggtcccaatggtcacccagatggctatgacggacaccaccccgttcggacagcagcgggtgttcaaggagaaggtagacacccgcacgccccggagcatgcccgggacccgccgggtgatgggcatcaccgccgagtggttatggcgcaccctggggcggaacaagaagccgcgcctgtgcactcgggaggaattcaccaagaaggtgcgcaccaacgcggcgatgggcgctgtcttcaccgaggagaaccagtgggactccgcgaaggccgccgtggaagacgaggatttctggaagctcgtggaccgggagcgagagctgcacaagctggggaaatgcggcagctgcgtctacaatatgatggggaagcgcgagaaaaagctcggcgagttcggcaaggcgaaggggagtcgggctatatggtacatgtggctgggcgcccgctacctggagttcgaggctctagggttcctgaatgaggaccactggttcagccgggagaactcctattcaggcgtggagggggaaggcctgcacaagctgggttatatcctgcgcgacatctcaaagatcccgggcggggctatgtacgccgatgacacggccggttgggacacccggatcactgaggacgacctgcacaacgaggaaaagatcacccagcaaatggacccagaacaccgacagctggccaatgccattttcaagctgacgtaccaaaacaaggtggtcaaggttcaacggccaacgcccacaggcaccgtgatggatatcatatcgcgcaaagaccagcggggctccgggcaggtcggcacttacggcctgaacacattcaccaacatggaggcgcaattaatacgccaaatggagggcgagggagtgctgagcaaggcggacttggagaatccccacctcccggagaagaagataacgcagtggctggaaaccaagggcgtggaaagattaaagagaatggccatttccggcgacgattgcgtcgttaaacccattgacgaccggttcgccaacgcccttctggccctgaacgacatggggaaggtgagaaaagacattccgcagtggcagccctctaagggctggcacgactggcaacaggtcccgttttgctcccaccatttccatgagctcatcatgaaagacgggaggaagctagtggtgccctgtcggcctcaggacgagctgatcggccgagcacgcatctctcagggggccgggtggagcttgcgagaaacagcctgtctcggcaaagcctacgcgcagatgtggagcctgatgtacttccaccgccgtgacctccggctagcctctaacgccatctgcagtgcggtgccagttcactgggtgccgacctcccgaacaacctggagcatccacgcccaccaccagtggatgacgaccgaggacatgctgacggtctggaacagggtgtggatcgaggacaatccctggatggaggacaagacgcccgtgacgacgtgggaaaacgtcccctacttaggcaagcgcgaggaccagtggtgcggctcactgatcgggctgacctcccgggcgacgtgggcccagaacatccctacggccatacaacaggtgcgcagcctaatcggcaacgaggaatttctggactacatgccatccatgaagcgtttccgcaaggaggaggagagtgaaggggcaatctggtag

SEQ ID NO: 25948 - RNA, 9873 nt, synthetic construct
  misc_feature 1..9873: note = derived and/or modified CDS sequence (opt11) from DENV-3__EU781136__SS-prME
  source 1..9873: mol_type = other RNA
acatccctgtgtctgatgatgatcctgccggccgccctcgcgttccacttgacctcgcgggatggggaacctcgtatgatcgttgggaaaaacgagcgcggcaagagtctcctgttcaagactgcctctggcataaacatgtgcaccctcatcgctatggatttgggcgagatgtgtgatgatactgtgacctataaatgcccccacatcacggaagttgagcctgaggatattgattgctggtgtaacctcaccagcacctgggtgacctacgggacctgcaaccaggccggggaacaccggagggacaaacggtccgtggccctcgcgccccacgtggggatgggcttggacacccgcactcagacctggatgagcgccgaaggtgcctggcggcaggtagagaaggtcgagacgtgggctctgcgacacccggggttcactattctagctctgttcttagctcattacatcggcacctcacttacccagaaggtggttatcttcatcctgctgatgctagtaacgcctagcatgacgatgcgctgcgtgggtgttggcaaccgcgactttgtcgagggcttgtccggggcaacctgggttgacgtggtcctggagcacgggggctgcgtgaccaccatggccaagaacaaacccaccttggacatagagctgcagaagactgaagctacccagcttgcgacgctccggaaactgtgcattgagggcaagattaccaacatcaccaccgacagccgctgccctactcagggggaggccgtgcttccggaggagcaggaccagaattacgtgtgcaagcacacctacgtggacagggggtggggcaacgggtgtgggctctttgggaaggggtcccttgtgacctgtgctaagttccagtgtttagaacccatcgagggcaaggtcgtgcagtacgagaacctcaagtacacagtcattatcactgtccatactggggaccaacaccaggtgggcaacgagacccaaggggtgaccgctgagatcacgccgcaagcatcgacaaccgaggcgattttgcccgaatacggcacattagggttagagtgttcaccgcgtaccggcctggactttaatgagatgatcctgctcaccatgaagaataaagcctggatggtgcacagacagtggttcttcgacctgccgctcccctggacgagcggcgctacaaccgagacgcccacgtggaaccggaaggagctacttgtgactttcaagaatgcacacgccaagaagcaagaagtcgtcgtattggggtcccaggagggcgctatgcacacagcgcttaccggggccaccgagattcaaaattcaggcgggacctccatcttcgccggccacttaaagtgtcggttaaagatggataagctcgagctgaaaggcatgagctatgccatgtgcaccaatacttttgtcctgaagaaagaggtgtccgagacccagcacggtaccatcctaatcaaagtagagtacaagggcgaagacgtgccgtgcaagatccccttcagcaccgaggacggccagggcaaagctcacaacggacgcctgatcacggccaaccccgttgtcaccaagaaggaggaaccagtcaatatagaggctgagcctcccttcggagagagtaacatcgttataggcatcggggacaatgcactgaaaatcaactggtacaagaagggctcgtcaatcgggaagatgttcgaagcgaccgcgagaggggcaagacggatggcgatcctgggcgacacagcatgggattttggctccgtcggcggggtcctcaatagcttagggaagatggtgcatcagatcttcgggtccgcgtacacggccctctttagcggcgtttcatgggtcatgaagattggaatcggggtgctcctgacctggatcggcctgaacagcaagaacacctccatgagtttttcctgtatcgccattgggatcatcaccctctacctgggcgccgtggtccaggccgacatggggtgcgtagtaaactggaaaggcaaagaactgaagtgcggcagcgggatcttcgtcacgaatgaggttcacacctggacagagcagtataaattccaggcggactcacctaagcgcctcgccacggccatagctggcgcctgggagaacggggtgtgcggcattaggagcactactcgcatggagaacctgctgtggaaacagatcgcaaacgagttaaactacatcctgtgggaaaacaacatcaaactgaccgttgtggtaggggacatcattggcgtcctcgagcaaggcaaacgtactctgactccccagccgatggaactgaaatactcgtggaagacctgggggaaggccaagatcgttaccgccgagacccagaacagctccttcatcattgatggcccaaacacgcccgaatgcccaagcgcctccagagcgtggaacgtgtgggaggtcgaggactatgggtttggtgtgttcaccaccaacatctggctgaaactgcgcgaagtatatacgcagctgtgcgaccaccgtctcatgagcgccgccgtgaaggacgagcgcgccgtgcacgccgacatgggctattggatcgagagccagaagaacgggtcctggaagctggagaaggcgagtctgatcgaggtcaagacttgcacatggccgaaaagccacaccctgtggagcaacggcgttttggagtccgacatgatcattcccaagtcactggccgggcccatctcccagcacaactacagaccgggctaccatacccagactgccggaccctggcacctcgggaagttggagctggacttcaactactgcgagggcacgactgtggttattacagaaaactgcggaacccgcggacccagcttgcggacgaccaccgtctcggggaaacttatccacgagtggtgctgccggagctgcaccctgcccccgcttcggtacatgggtgaagacgggtgttggtacggcatggagatcaggccgatctccgagaaagaggagaacatggttaagagcctcgtctccgccggaagcggaaaggtagacaatttcacgatgggcgtgttatgcttagcgatcctgttcgaggaagtgatgcgagggaagttcggcaaaaagcacatgattgcgggggtgttcttcacattcgtgctgctcttatcaggccagatcacctggcgcgacatggcccacacactgatcatgattggcagcaacgcctccgacaggatggggatgggcgtgacctacctcgcccttatagccaccttcaagattcagcccttcctagcgctcgggttctttctgcgcaagttaaccagccgggagaacctcctactgggagttggtcttgctatggccaccacactgcagctgcccgaggacatcgagcagatggccaacggaattgcgcttggcctaatggcgcttaagctcatcacccagttcgaaacctatcagctgtggacggcgctcatctctctcacgtgctccaataccatcttcaccctgaccgtcgcctggcgtacggccacactaatcctcgctggggtgagcctgttgcctgtgtgtcagagctcgtccatgcggaagaccgactggctccccatgaccgttgccgccatgggcgtgccgcctctcccgctattcatcttcagcttgaaggatacgctgaagaggcgcagctggccactgaacgagggtgtgatggcggtggggctcgtcagcatcctggcatccagccttctccggaacgatgtgcccatggcgggcccccttgttgccgggggattactgatcgcctgctacgtcattaccgggacatccgccgatctgaccgttgagaaggccgcggacgtgacgtgggaggaagaggcggaacaaaccggcgtcagccacaacctgatgatcaccgtggatgacgacgggaccatgcgcatcaaggatgacgagaccgagaacatcctgaccgtgttactcaagaccgccttgctgatcgtgtccggcatcttcccgtacagcatccccgccaccctgctcgtctggcatacctggcagaagcaaactcaacggagtggcgtgctgtgggacgtccccagcccgcccgagacccaaaaggccgagctggaagagggggtgtaccgcatcaagcagcagggcattttcggaaagacccaggtgggcgtcggtgtgcaaaaggaaggagtgtttcacaccatgtggcatgttacacgaggcgcggtgctcacctacaacgggaaacgcttggagcccaattgggccagcgtcaagaaggatttaatctcatacggtgggggctggcgactctccgcccagtggcagaagggggaagaggtacaggtgattgcggttgaaccaggcaagaaccccaagaacttccagactatgccgggaaccttccagacgaccaccggtgagataggcgcgatcgccctagatttcaaacccggtacctccggctcccccataatcaaccgcgagggcaaggtcgtgggactgtacggcaatggggtggtcacgaagaatggagggtacgtgtccggaattgctcagacaaacgccgagccggacggccccacccccgagctggaggaggagatgtttaagaagaggaacctcaccataatggacctgcaccccggcagcggaaagacgcgcaagtacctgccggccattgtgagggaggcgataaagcgacggctccgcaccctgatcctggcccccacccgggtcgtggctgccgagatggaagaggcgctcaagggactgcccatccgctatcagaccaccgcaaccaagtcagagcacaccggccgggaaatcgtggaccttatgtgccacgccaccttcacgatgcgcctcctgagccctgtccgggtaccaaactataatctgatcatcatggacgaggcccatttcaccgaccccgcctccatcgccgcccggggttacatcagcacccgtgtgggcatgggcgaggccgcggccatattcatgaccgcgacgccacccgggacggccgacgccttcccgcagtccaacgccccgatccaggacgaggagcgcgacatacccgagcgtagctggaactccggcaacgagtggataacagatttcgcgggaaagacagtttggttcgtgccttccatcaaggcgggcaacgacatcgccaactgcctccggaagaatgggaagaaagtgatccagctctcccggaagacgtttgacaccgaataccagaagaccaaattaaacgactgggactttgtcgtaaccacggacatcagcgagatgggagccaacttcaaggccgatcgtgtgattgaccctcgccggtgcctcaagccagtgatcctcaccgacggcccagaacgcgtgatactggcagggcctatgccagtgaccgctgccagcgccgctcagcggcgtggtcgggtcgggcgcaacccccagaaggaaaacgatcagtacatcttcactgggcaaccattaaacaacgacgaggatcacgctcattggaccgaggcgaagatgctgctggacaatatcaacacgcccgaggggataatcccggccctcttcgagcccgagcgggagaaaagcgcagccatcgacggggaataccgcctgaagggcgagtcccgcaagaccttcgtggagttgatgcgccgcggggacctccccgtctggcttgcgcacaaggttgccagcgagggcatcaagtacactgaccgcaagtggtgcttcgacgggcaacggaacaaccagatattagaggagaacatggacgtggagatctggaccaaagaaggcgagaagaagaagctccggccccggtggctggacgcgcgcacgtattcggatccgctggccctcaaggagttcaaggactttgccgcgggaagaaagagcattgcattagacctggtcaccgaaatcggacgggtcccctcacatctagcccaccggacccggaatgccctggacaacctggtcatgctccacacgagcgagcacggagggaaagcctaccggcacgctgttgaggagctacccgagacaatggaaaccctgctactgttaggcctcatgatcctgctgaccgggggcgctatgctgtttctgatctccggcaagggtatcgggaagacctccatcgggttaatctgcgtgatagccagctccggaatgctgtggatggccgagataccgctgcagtggatcgcctcagcgatcgtgctggagttcttcatgatggtcttgctgatccctgagcctgaaaaacaacggacgccgcaggacaaccaattagcatacgtcgtgatcgggatcctcaccctggcagccatcattgcagcaaacgaaatgggcctgttagagaccacaaagcgtgacctgggcatgtccaaggagccgggggtcgtgtctcccacatcctacctggacgtcgacctccaccccgccagtgcttggaccctctacgccgtcgcgaccacggtgatcactccaatgctgcggcacactatcgagaacagcacggccaatgtaagcctcgccgccatagcgaaccaagctgtcgtgctgatgggccttgataaggggtggccgatttccaagatggatctcggagtgcccctgctggccctagggtgttacagccaggtcaacccactgactctgaccgccgccgtgctactgctgatcacgcactacgccatcatcggtcccggcctccaggccaaggccacccgggaggcgcagaagcggaccgccgcagggatcatgaagaacccgacggtggacggcatcatgaccatcgacctcgacccggttatctacgactccaagttcgagaagcagctgggccaggtgatgctccttgtgctgtgcgcagtccaactcctgctgatgcgcacttcatgggccctctgcgaggccctaacgctggccactggcccgatcaccaccctctgggaaggctcccccgggaagttctggaacaccaccatcgcggtgagcatggccaatatctttagggggtcctacctggccggggccggcctcgcgtttagtatcatgaagtccgtggggaccgggaagcggggtaccggcagccaaggtgaaaccctcggcgagaaatggaagaagaaattaaaccaactgagccggaaggagttcgacctctataagaagtcgggcatcaccgaggtcgaccgtacggaagcgaaggaagggctgaagcggggtgagatcacccatcacgccgtgagccgcggttccgcaaagctccagtggttcgtcgagcggaacatggtaattccggagggacgcgtgatcgacctcggatgcgggcggggaggttggagttactactgcgctggcctgaagaaagtcaccgaggtcaggggctatacaaagggcggtcccgggcatgaggagcccgtgcccatgtccacctacggttggaacatcgtgaagctgatgagcgggaaggacgtcttctacctcccgcccgagaagtgcgacaccctgctgtgcgacatcggcgagtccagcccttcccccactgtggaggaaagccggaccatccgcgttctgaagatggtcgagccgtggctcaagaacaaccagttttgcatcaaggtacttaacccctacatgcccaccgttatcgagcacctggagcgcctccagcggaagcacggagggatgcttgtccgcaatccgctgagtcggaacagcacccacgagatgtactggatttcgaatggcaccgggaacatcgttgcctctgtcaacatggtctcccgccttctgcttaaccggttcacgatgacccacaggcggccgactattgagaaggacgttgacctcggcgcgggcacgcgccatgtgaacgcagagccggagacccccaacatggacgtcatcggtgagcggatcaagcgcataaaggaggagcacaactcgacttggcactacgacgacgagaacccgtacaagacctgggcctaccacggctcctacgaggtcaaggccaccgggtcggcctccagcatgatcaatggcgtcgtgaagctactgaccaagccatgggacgtcgtccctatggtaacgcaaatggcgatgactgacaccacacccttcgggcaacaaagagttttcaaggagaaggtcgacacgcgcaccccgcgaagcatgcccggcacacgccgggttatgggaatcaccgccgaatggttatggcgcacgctggggcggaacaagaagccccgcctgtgcacccgggaggagttcaccaagaaggtgcgcacgaacgcagccatgggtgcggtctttacggaggagaaccagtgggactccgccaaggcggccgtagaagacgaggacttttggaagctcgttgacagagagcgggaactgcacaagctggggaagtgcggcagctgtgtatacaacatgatggggaagcgcgagaaaaagctcggcgagtttggcaaggccaaggggtctcgggctatctggtatatgtggctaggcgcccgctacctagagttcgaggccttggggttcctgaacgaggaccactggttctcgcgggagaactcgtacagcggggttgagggggagggccttcacaagctgggctacatcctgagggatatctccaagattcccgggggcgccatgtacgccgatgacaccgcagggtgggacacacggatcacggaggacgacctgcacaacgaggagaaaatcacgcagcaaatggacccggaacaccgccagctcgccaacgccatatttaagctgacctaccagaacaaagttgtcaaggtccagcggcctaccccaaccggcacagtgatggatatcattagccgcaaggatcagcggggcagcgggcaagtcggaacgtatggactgaacaccttcacgaatatggaagcccagctcatccgccagatggaaggggaaggggtgctgagcaaggccgacctggagaacccccacctccccgagaagaagataacccagtggctggagacgaaaggcgtcgagcggcttaagagaatggcaatctccggcgacgactgcgtcgtaaaaccgatcgacgaccggtttgccaatgccctcttagcccttaacgacatggggaaagtgcgcaaggacatcccccagtggcaaccctcgaaggggtggcacgactggcagcaagtcccgttctgcagtcaccatttccacgagctcatcatgaaagacgggcggaagctggtggtgccgtgtcgcccgcaggacgagctgatcggtcgggcccgcatctctcaaggggcggggtggtccctacgcgagaccgcatgtttgggaaaagcctacgcccagatgtggagcctaatgtatttccatcgccgcgatctccggctcgcgtctaatgccatctgtagcgccgtacccgtacactgggtcccgacctcccgaacaacgtggagcatccacgctcaccatcagtggatgacaactgaggatatgctgaccgtctggaaccgcgtgtggatcgaggacaacccctggatggaggataagactcccgtgaccacctgggagaacgtcccctacctcgggaagcgcgaggaccagtggtgcgggtcgctgatcggactcaccagccgggctacgtgggcccaaaacattccgaccgccatccagcaggttcgcagccttatcggaaacgaggagttcctggactatatgccctctatgaagaggttccgcaaagaggaggagagtgagggggcaatttggtga

SEQ ID NO: 25949 - RNA, 9873 nt, synthetic construct
  misc_feature 1..9873: note = derived and/or modified CDS sequence (opt11) from DENV-3__EU781137__SS-prME
  source 1..9873: mol_type = other RNA
accagtctctgcctcatgatgatcttacccgcggccctggcgtttcacttgacctcaagagacggagagcctcggatgattgtagggaagaacgagcggggcaagtctctactattcaaaacggcctctgggatcaacatgtgtacccttatcgctatggatctgggcgaaatgtgcgacgacacggtcacttacaagtgcccacacatcaccgaggtggagcccgaagacatcgattgctggtgcaacttaaccagcacctgggttacctacggaacctgcaaccaggctggagagcaccggcgcgataaacggtccgtggctttagccccgcacgttggcatgggtctggacacacgaacccagacatggatgagcgccgagggagcgtggcgacaagtggagaaggtggaaacctgggcgctaaggcacccgggtttcaccatccttgcgttgttcctggcgcactacatcggcacctccctcactcagaaggtggtcatcttcacgttactaatgctcgtaactccgagcatgactatgcggtgcgtgggggtgggcaaccgcgactttgtcgaggggctgtccggggctacttgggtggacgtggttctggagcacggcggttgcgtgactaccatggccaaaaacaagcctaccctcgacatcgaattgcagaagactgaagccacgcagttggccactctccgaaagctatgcatcgagggcaaaatcaccaatatcaccacggacagccgatgcccaacccagggtgaggccgtgctgccagaggagcaggaccagaactatgtttgcaagcacacctacgtggaccggggatggggcaacgggtgtggcctcttcgggaaaggcagtctggtgacttgtgccaaatttcagtgtctagagcccatcgaggggaaagtcgtgcagtacgagaacctcaagtacacggttatcatcaccgtccacaccggggaccagcatcaagttggaaacgagacccagggggtcactgccgaaatcacccctcaggcaagtaccacagaggcgattctgcccgagtacggcaccctagggttggagtgttccccaagaaccggcctcgactttaacgagatgatcctgctcaccatgaaaaacaaggcctggatggttcatagacaatggtttttcgacctgcctctgccgtggacttcgggcgccaccactgagaccccgacatggaacagaaaggagctgctggtgacctttaagaacgcgcacgctaagaagcaggaggtcgtggtgctaggttcccaggagggcgcgatgcacacggccctcacgggtgcaactgagattcagaactcaggagggacgtccatcttcgctgggcatctgaagtgccgcctgaagatggacaagttagagcttaagggcatgagttatgcaatgtgtacgaacaccttcgttttgaaaaaagaggtttccgagacccagcacgggaccatcctcatcaaggtggagtacaagggcgaggacgttccctgcaagatcccctttagcaccgaggacggacaaggcaaggcccataacggcagactgatcacggccaaccccgtcgtgactaaaaaagaggaacccgttaatatcgaggctgaacccccattcggtgagtccaacatcgtgatcggtataggggataatgccttgaagataaactggtataaaaaaggctctagcatcgggaaaatgtttgaggcgaccgcccgtggcgcccgccgtatggccatactgggcgacaccgcctgggacttcggcagcgtgggcggtgtcctcaacagcctaggcaaaatggtccaccagatcttcggctcggcttacaccgcactgttcagcggtgtgagttgggtgatgaagataggcatcggcgtacttctgacctggatcgggctgaacagcaaaaatacctccatgtctttctcatgcatcgcaatcggaataattacactctatctcggcgcagtggtccaggctgacatgggttgtgtgatcaactggaagggcaaggaactgaagtgcggcagcgggatcttcgtgacaaacgaagttcatacttggaccgagcagtacaaattccaggcggactcccccaagcgtcttgcaactgctatcgccggcgcgtgggagaacggcgtctgtggcatccggagcacaacgcggatggagaatctgctgtggaaacaaattgcgaacgaactcaactacattctctgggagaacaatatcaaactgaccgtggtcgtgggtgatatcataggtgtactggaacagggtaagagaaccctgacgccacagcctatggaactgaagtacagctggaagacctgggggaaggccaagattgtcaccgccgaaacgcagaacagctcttttattatcgacggccccaatacccctgaatgccccagtgcctcccgggcctggaatgtatgggaggtggaggactacggcttcggggtttttaccaccaatatatggctcaaactgcgcgaggtgtacacccagctgtgcgaccaccggctcatgagtgctgctgtgaaggatgagcgcgctgttcacgccgacatgggctactggatcgagagccagaagaacgggtcctggaagctggaaaaagcttcattaatcgaggttaagacgtgcacgtggccgaaatctcataccctatggagcaacggtgtgctcgagtccgacatgataatcccgaagagcctggccggacccatctcgcagcataactaccgtccaggctaccacacccaaacggcaggcccttggcacctcggcaaactggagctggatttcaactactgtgagggcacgactgtcgtgatcacggaaaactgcggcacgcgtgggccatccctccggacaaccacggtgtccggtaagctcatccacgagtggtgctgccgctcatgcacgcttcccccgttgagatacatgggcgaggacgggtgctggtatgggatggagatccgccccatatccgaaaaagaggagaacatggtaaagagcctcgtatccgcagggtcggggaaagtagacaactttacgatgggcgtgctgtgcctcgccatcctcttcgaggaggtcatgcgggggaagttcggcaaaaaacatatgatcgcgggggtgttcttcaccttcgtattactcctctccggacagataacctggcgcgacatggcacacacgctgattatgatcgggagcaacgcctccgatcggatggggatgggcgtgacgtacttggccctgatcgccacctttaagatccagcccttcctggcgctagggttcttcctccgcaaactgacctcccgggaaaatctcctgcttggcgtgggactcgcaatggcaactacacttcagttacccgaggacatcgaacagatggcgaacgggattgcgctcggactgatggccctgaagctcataacccagttcgagacgtatcagttgtggacggccctgatatcgctgacctgtagcaacaccatattcaccctcacggtggcctggcgtacggcgaccttgatcctcgcgggtgtgagcctgttaccggtctgccagagcagctccatgaggaaaacagactggttgcccatgactgtcgccgcaatgggggtaccgccgctcccacttttcatcttcagcttgaaagatacactgaagaggcgctcatggcccctgaacgagggagttatggccgtcggcttggtgagcatcctggcatcctctctgctccggaatgacgtcccaatggccggcccacttgtggccgggggccttcttatcgcctgctatgtgatcaccgggacctcagcagacctaacagtcgagaaggccgcggacgtgacttgggaggaggaggccgagcaaaccggcgtttcgcacaaccttatgatcaccgtcgatgacgatggaaccatgcggataaaagacgatgagacggaaaacatccttaccgtgttattgaagaccgccctgctcatcgtaagcggcatcttcccatatagcattcctgccaccttactcgtctggcatacgtggcagaagcagacacagcgaagtggcgtgctgtgggacgtgccgagtccgccagagacacagaaagccgagctggaggagggggtctatcgcatcaagcaacagggaatcttcgggaaaacccaggtgggcgtgggagtccagaaagagggcgtgttccatacgatgtggcacgtaaccagaggcgcggtgctgacttataacgggaagcggctggagccgaactgggccagcgtaaagaaagacctgatcagctatggcgggggttggcgactctccgcacagtggcagaagggggaggaggttcaagtcatcgccgtcgagcccggtaagaaccctaaaaacttccagaccatgccaggaacgttccagacaaccacaggggaaatcggcgcgatcgccctggacttcaagcccggcacgagcggtagcccaatcataaaccgcgagggcaaggtagtgggtctgtatggcaacggagtggtgacgaaaaacggcgggtacgtctccggcatcgcacaaacgaacgcggagcccgacggaccaacgcccgagctcgaggaggaaatgttcaagaagcgtaaccttacaatcatggaccttcatcccgggtctgggaagacacgcaagtacctgccggctatcgttcgtgaggcaatcaagcgccggctccgtacgctgatattagctcccacacgtgtcgtcgccgcagagatggaggaggccctcaagggcctaccaatccgctaccaaacgaccgcgaccaagtccgagcacaccggccgggagatcgtcgacctgatgtgccatgcaacattcactatgagacttctatcccccgtgcgggttcccaactataacctgatcatcatggacgaggcccacttcacagaccccgcctccattgcggcccgcgggtacatcagcacccgggtgggaatgggcgaagcagctgccatattcatgacggcgacaccgcccgggaccgccgacgccttcccgcagtcgaacgcgcctatccaggatgaggagcgcgacatccctgagcgcagttggaattccgggaacgaatggatcaccgacttcgcaggtaagacggtgtggttcgtcccctctatcaaagcgggcaacgacatcgccaattgtctccggaagaacgggaagaaggtgatacaactgtccagaaagactttcgacacagagtatcaaaaaacgaagttgaacgactgggatttcgtggtaacgaccgacatctcggaaatgggcgccaacttcaaggccgatagggttatagaccctaggcggtgcctcaaacccgtgattctgaccgacggccctgaacgggtcattcttgctgggcccatgccagttactgcggcgtcggcagcccagcggcgcggcagggtggggcgaaacccccagaaggagaacgaccaatatatcttcacgggccagcccctcaacaacgacgaggaccacgcccactggactgaggcgaagatgctactggacaacatcaatactccagaggggataattccggccctgttcgagcctgagcgtgagaagtccgcggctattgacggcgagtaccgcctgaagggcgaatcacgtaagactttcgtggagctgatgcgtaggggagatcttcccgtgtggctcgctcacaaggtcgccagcgagggcatcaagtacacggaccgcaagtggtgcttcgacgggcaacgcaacaaccagatactcgaggagaacatggatgtggagatctggacgaaagagggcgaaaagaaaaagctccgcccccggtggctagacgcccgcacctattccgaccccttagccctcaaggaattcaaggatttcgccgccggccgcaaaagtatagcccttgacctggtgaccgaaatcgggcgcgtgccctcgcacctcgcacaccgcacacggaacgccctcgacaacctggtaatgttgcacaccagcgagcatggcggaaaagcttataggcacgctgttgaggaactgcccgaaaccatggaaacgttgttacttctgggtctcatgatccttctgaccgggggcgcaatgctgttcctgatttcaggtaaggggatcgggaagacgtccatcgggttaatctgcgtaatcgcctcttccggtatgttatggatggcggagatacccctgcagtggatagcgagcgcaatagttctggaattcttcatgatggttttgctgatccccgagcctgagaagcaacggaccccacaggataatcagttggcctacgtcgtgatcgggatcctgaccctggccgcaattatcgcagccaacgaaatgggcctgcttgaaaccacgaagcgcgacctgggaatgtccaaggaacccggcgtcgtctcaccaacatcttacctggacgtggacctccaccccgcaagcgcgtggaccttatacgccgtagcgactactgtcatcaccccgatgcttcggcacaccatcgagaacagtaccgcaaacgtgagcttagccgctatagccaaccaagcggtggtcttaatgggcctggacaaggggtggccgatctccaaaatggacttaggcgtgcccctgttagcccttgggtgttacagtcaggtcaaccccctaaccctcaccgccgccgttctcctccttattacccactacgccatcatcggaccagggctccaggcgaaggccacacgcgaggcccagaagcgtacggccgccgggatcatgaagaacccgacggtggacggcataatgaccatcgatctggatcccgttatctacgatagcaagttcgagaaacagttgggacaggtgatgctgctggtattatgcgcggtgcaactcctccttatgcgcaccagctgggcactatgcgaggccctgacgctggccaccggccccatcacgactctttgggagggctcccccggcaagttctggaataccacgatcgcggtcagcatggccaacattttccgtggaagttatctggccggtgcgggcctggccttcagcatcatgaaatctgtgggcactggcaagcgcggtaccgggtcccagggcgaaaccctcggggagaagtggaaaaagaagctgaaccaactgtctcgcaaggagtttgacctgtacaaaaaatccggcatcacggaagtggatcgcacggaggctaaggagggtctgaagcggggcgagattactcatcacgctgtcagccggggctccgccaagctgcaatggttcgtggaacggaacatggtgataccggaaggccgcgtgatagacctcggctgtgggcgaggcggctggagctattactgtgccggccttaagaaagtgactgaggtgcgcggatacacgaaaggggggcccggacacgaagagcccgtccccatgtccacctacggatggaacatcgtgaagctgatgtcagggaaagacgttttctacctccctcccgagaagtgcgacaccctgttgtgcgacatcggtgagtcctcgccatcccctactgtcgaggaaagtcgaacgatccgcgtgctgaagatggtagagccatggctaaagaataaccagttctgcattaaggtcctaaatccatatatgcccaccgttatcgagcatctggagcgactgcaacgtaagcacggggggatgctggtacgcaaccccctgtcccggaacagcacccacgagatgtactggatttccaatggcaccggaaacatcgtagcaagcgtcaacatggttagccgcctccttcttaatcggttcacgatgacccaccgccggccgaccatcgagaaagacgtcgacctcggtgcgggcacaaggcacgtgaacgccgagcccgaaactcccaacatggatgtaatcggtgagagaatcaagcgtataaaggaggaacacaatagtacttggcactacgacgatgagaacccgtacaagacctgggcctaccatggtagttatgaggtaaaagctaccgggagcgcctcctccatgattaacggtgtggtcaaactccttacgaagccatgggatgtagtgcccatggtcacgcagatggcaatgacggacaccacgcccttcggtcaacagcgggtatttaaagagaaggtcgacacccgcacaccgcggagcatgcctgggacacgtcgcgtcatgggcatcacggcagagtggctgtggcgaaccctggggcggaataagaagccccgtctttgcaccagagaagagttcaccaaaaaggtgcgcactaacgccgctatgggcgccgtgttcacggaggaaaaccagtgggactccgccaaggcggccgtcgaggacgaggatttctggaaactcgtggatcgcgagcgggagctgcataagttgggcaagtgtggatcatgtgtgtacaatatgatggggaagagggagaagaagctgggcgaattcggcaaggccaaagggtcccgggccatatggtacatgtggctcggggcccgttatctggaattcgaggccctcgggttcctaaacgaggaccactggttcagccgggagaattcctacagcggcgtcgagggcgaaggactgcataagctgggctatatcctgcgcgacatttccaagatcccagggggagccatgtacgccgacgatacggcgggctgggacaccagaatcacagaagacgatctacacaacgaggagaaaattactcagcagatggacccggagcaccgccagctcgccaacgccatattcaagctgacctaccagaacaaggttgtgaaggtccaacggcccacccctaccggcactgttatggatataattagccgtaaagaccagcggggaagtggtcaggtagggacctatggcctgaacacattcaccaacatggaggcgcagttaatccgccagatggaaggtgagggggtcctgagcaaggccgacttagagaacccccatctccccgagaaaaagattacccaatggctggagaccaagggtgttgaaagactgaagcgcatggccatctccggagacgactgcgtcgttaaacccatagacgaccggttcgcgaacgcgctcctggccctgaacgacatggggaaggtgcgcaaggatattcctcagtggcagccctcgaaaggctggcacgactggcaacaagtgcccttctgctcacaccatttccacgagctcgttatgaaggacgggcgaaagctggtggtcccctgtcgcccccaggatgagctgataggacgtgcccgcatcagccagggtgctggctggtctctcagagaaaccgcctgcctgggcaaggcctacgcccagatgtggtctttaatgtacttccaccggcgcgaccttcggttggcctcgaatgccatctgtagcgccgtccccgtgcactgggtgccgacatcccgtaccacgtggagtatccacgcacatcatcaatggatgacaaccgaggatatgctaacggtatggaacagagtctggatcgaggacaatccctggatggaggacaagacccccgtaacaacctgggaaaatgtgccgtatttgggaaaacgcgaggaccagtggtgcgggtcactgatcggactgacgtcgcgcgcaacctgggctcagaacatcccgactgccatccaacaggtaaggagcctcatcgggaacgaggagttcctggactatatgccgtctatgaagcggttccgcaaagaggaggaaagcgagggggccatctggtga

SEQ ID NO: 25950 - RNA, 9873 nt, synthetic construct
  misc_feature 1..9873: note = derived and/or modified CDS sequence (opt11) from DENV-3__EU726773__SS-prME
  source 1..9873: mol_type = other RNA
accagtttatgcctcatgatgattctccccgcggcgctggcgtttcacctcaccagccgcgatggtgaacctcggatgatcgttgggaaaaatgagcgtggcaagagcctgctgttcaagacggcctccgggatcaacatgtgcacattaatcgccatggacctcggagagatgtgtgacgataccgttacctacaagtgtccccatataaccgaggtggagcccgaagacatcgactgctggtgtaacctgacgagcacctgggtaacgtacggtacgtgcaaccaagccggcgagcacaggcgcgacaagaggagtgtggccctcgctccccatgtgggcatgggcctggatacccgcacccagacgtggatgagcgccgagggggcgtggcggcaggtcgaaaaggtcgagacgtgggccctccgccatccggggttcacaatcctcgccctctttctagcccactacatcgggacttccttaacccagaaggtggtcatcttcatacttctgatgctcgtgacacccagcatgaccatgcgatgtgtgggtgtcggcaatcgtgacttcgtcgagggcctatccggggccacctgggtggatgtggtcctggagcacggcggctgcgttacaacgatggccaagaacaagcccaccctagatattgagctgcagaagaccgaggccacccagctggcgacgctccggaagctgtgtatagagggcaaaattactaatatcacgacggactctcgctgccccacccagggcgaggccgtgctcccggaggaacaggaccagaactatgtgtgcaagcacacgtacgtggatcgagggtggggcaacggatgcggcctattcgggaagggctctctggttacatgcgcgaaattccagtgcctggagcccatcgagggcaaggtcgtgcagtacgaaaacctcaaatacaccgtgatcatcacggtacacacaggtgatcaacaccaggtcggaaacgagacccagggggtgaccgccgagatcacgccccaggccagcaccactgaagcaatactccccgagtacggcaccctgggtttggagtgctcccctcgcaccgggctagactttaacgaaatgatcctgcttacgatgaagaataaggcttggatggtgcaccggcagtggtttttcgacctgcccctgccgtggaccagcggggcaacgacagagacccccacgtggaatcgtaaggagttacttgtgactttcaaaaacgcccacgccaagaagcaggaggtcgtggtgctggggtcccaggagggtgctatgcacactgccctgacaggggccacagagattcagaacagcggggggacctccatattcgccggtcacctgaagtgcagactgaaaatggacaagctcgagctgaagggcatgagctatgccatgtgcacaaacacttttgtactgaagaaggaagtgagcgagacccagcacggtaccatcttgatcaaagtggagtacaagggcgaggatgtcccgtgtaagattcccttcagcaccgaggacgggcagggcaaggcgcataacggccgcctcattaccgccaaccccgtggtgacaaaaaaagaggagcccgtcaatatcgaggcagaacctcccttcggggagagcaacatcgtgataggcattggtgacaacgcactgaaaataaactggtataagaaaggctcaagcatcgggaagatgtttgaggcgaccgcccggggcgcacgccggatggctatcttgggcgacaccgcttgggacttcgggtctgttggcggggtcctcaactccctcggcaaaatggtgcaccagatcttcgggagcgcgtacaccgcacttttcagtggggtgtcctgggttatgaagataggtataggcgtgctacttacttggatcggcttaaacagcaaaaatacctccatgtcattctcctgtatcgtgatcggcatcatcaccttgtacctgggcgccgtcgtgcaagccgatatgggctgtgtgatcaactggaagggcaaggaactgaagtgcggctcagggatattcgtcacgaacgaggtgcacacatggacggagcagtacaagttccaggctgatagccccaagcgcttggccaccgctatcgccggcgcctgggagaatggtgtgtgcggcatccgcagcacgacccggatggagaacttactgtggaaacaaatcgccaacgagctcaactatatcctgtgggaaaacaacattaaactgacggtagttgtcggggatatcatcggggtgctcgagcaaggcaagcgcaccctgacgccccagccgatggagctgaagtactcttggaagacctgggggaaggccaagatcgtgacggccgagactcagaacagctcctttatcatcgacggtcccaacacgcccgagtgcccttctgccagccgagcgtggaatgtgtgggaggtagaggattacgggttcggcgtatttaccaccaacatttggctcaaactaagagaagtctacacccaactctgtgaccaccgactcatgtcagcggctgtcaaggacgaacgagccgtgcacgccgacatgggctactggatcgagagccagaaaaatgggtcctggaagctggagaaggccagtttaatcgaggtaaaaacctgcacatggccgaagtcccacactctctggagtaacggggtcctggagtccgacatgatcattcccaagagcctggcggggcctatctcccaacacaactaccggccgggctatcacacccagaccgccgggccctggcacctgggcaagctggagcttgacttcaactactgcgagggcacgactgtggtgatcacagagaattgcggcacccgcggacccagcctacggacgactacggtcagtgggaagctcattcacgagtggtgctgcagatcgtgcaccctccctccgctccggtatatgggcgaggacggctgttggtatggcatggagatccgcccaatctcggaaaaggaggagaacatggtcaagagcctcgtgagcgccggcagcgggaaggtcgacaatttcacaatgggcgtgctgtgcctagccatactgttcgaagaagtgatgcgggggaagtttgggaaaaaacacatgatcgcgggggtgtttttcaccttcgtgctactcctctccggccagatcacctggcgcgacatggcgcacaccctcataatgatcggcagcaacgcatccgatcgtatgggtatgggcgtaacgtacctagccctgatcgccacttttaaaatccagccgtttttagccctcgggttctttttgcgcaagttgacgagccgggagaacctcctgctgggtgtcggccttgcgatggccactacgctgcagctgccggaggacatcgaacagatggccaatgggatagccttgggtctcatggcgctaaagttaattacccaattcgagacctaccagttatggaccgccttaatcagcctcacgtgttctaacaccatctttaccctgaccgtcgcctggcgcactgccaccctgatcctcgccggggtcagcctactgcctgtgtgccagtcctcttccatgcggaagaccgactggctccccatgaccgtggcggcaatgggcgtaccgcccttaccgctgttcatcttcagccttaaggacacgctgaagcgccgctcctggcccctgaacgagggggtcatggccgtgggcctcgtcagcatactggcttcctccctactccggaatgacgtgcccatggccggccctcttgtggccggcgggctgctcattgcctgctacgtcatcaccggaacttccgcagatctgaccgtggaaaaggcagccgacgtgacgtgggaggaggaggcggaacagacgggggtttctcataacctgatgatcaccgttgacgacgacgggacgatgcgaatcaaggacgacgaaacggagaacatcctcacggtgctgctgaagaccgccctcctgatagtgtcaggcattttcccttatagcattcccgcaaccctgctcgtgtggcatacctggcagaaacagacgcaacggtccggggtgctgtgggacgtccctagtccgcccgaaacgcagaaagctgagctggaagagggggtgtaccgtatcaagcagcagggcatcttcgggaagacccaggtaggggttggggttcaaaaagaaggcgtcttccacaccatgtggcatgtgactcgtggcgccgtgctcacgtacaacggaaagcgcctggagcccaactgggcgtccgtgaagaaagatttgatctcttacggcgggggctggcggctctccgcccagtggcagaagggggaggaggtccaggtgatcgccgttgagccgggaaagaacccgaagaacttccagactatgcctggtaccttccagaccaccaccggggaaatcggagccatcgcgttggactttaaacccggaacctctggcagccccataatcaaccgggaaggcaaggtcgtgggtctgtatggcaatggtgtcgtaacgaagaacggcgggtacgtgtccggtatcgcccagacaaacgccgagccggatggtcccacaccagagctggaggaggagatgttcaagaaaaggaacctcacgattatggacctacaccccgggtcagggaagactcggaagtacctgccagcaatagttcgtgaggccatcaagcgcaggctccgcacactgatacttgctcccacgcgggtcgtggccgctgagatggaagaggccctgaaaggcctgccgatacgctaccagactaccgcgaccaagtccgagcacaccggccgggagatcgtagacctgatgtgccacgctacctttacgatgcgtctcttatcgcccgtccgggtgcctaattataacctgattattatggacgaggcgcatttcaccgaccccgcctcaatcgccgccagaggatacatcagcacccgggtcggcatgggcgaggcagccgccatctttatgaccgccacgcctcccggaactgctgacgccttcccgcaatccaacgctcccatccaagacgaggaaaaagacatcccagaacgcagctggaatagcggcaacgagtggatcacagacttcgccggaaagacggtttggtttgtaccgagcatcaaggccggcaacgatattgcgaactgcctccgaaagaatgggaaaaaggtgatccaactctcccggaagacattcgacaccgaatatcagaagactaagttaaacgactgggactttgtcgtcaccaccgatatcagcgaaatgggcgctaacttcaaagccgatcgcgtgattgacccgaggcggtgcctcaagcctgtcatcttgacggacggacccgaacgggtaatcttagcagggcccatgccggtgaccgcggcgtccgccgcccagagacggggccgcgtcggcagaaacccccaaaaggaaaacgaccagtatatcttcaccggccaacccctcaataatgacgaggatcatgctcactggactgaagccaaaatgctgctggacaatatcaacacacccgagggaatcatccccgccctcttcgaacccgagagggagaagagtgccgcaatcgacggtgagtacagactaaagggggaaagtcgcaagacctttgttgaactgatgagaaggggtgacctacccgtttggttggcccacaaggtcgcgtcagagggcatcaagtacacggaccggaagtggtgcttcgacggccaacgcaataaccagattctggaggagaacatggatgtggagatctggaccaaggaaggcgagaaaaagaagcttcggccccgctggctggacgcccgtacgtacagcgacccgctggcgctcaaggagttcaaggatttcgcggccggccgcaagagcattgcgctagatctggtcacggaaataggtagagtcccatcccacctcgcccacaggaccagaaacgccctggacaacctggtcatgctccatacctccgaacatgggggcaaggcctaccggcacgccgtcgaagaactgcccgagactatggagaccctgctattgttgggcctcatgatcctgctgactggtggcgcaatgctgtttctgatcagcggcaaggggatcggcaagacctcaattgggctcatctgcgtcatcgccagctccggcatgctatggatggctgaaatcccgttgcagtggatcgccagcgcaatcgtgcttgagtttttcatgatggtccttctgatacccgagcccgagaagcaacgcactccacaagacaaccaactagcgtacgtggtgataggaatcttgaccctggccgccatcatagccgccaacgagatggggctgctggagactacaaagcgggaccttggcatgagtaaagaacccggggtcgtaagccccacgtcttacctcgacgttgacctccaccccgccagcgcatggaccttgtatgcagtcgccacgacggttattacgcctatgctgcgccacaccatcgagaattcgactgccaacgtgagcctcgccgccattgccaaccaggccgtcgtcctaatgggcctagacaaggggtggccaatctccaaaatggacctcggcgtacccctgctggctctcgggtgctacagccaggtcaaccccctgacactgacggccgcagtgcttctactaatcactcattacgccatcatcggacccgggttgcaggccaaggcgacccgggaagcccaaaaacgcactgcagcaggtatcatgaagaacccgacggttgacggcataatgactatcgatctcgaccccgtgatctatgactcaaagttcgagaagcagttaggccaagtcatgctcctcgtgttgtgcgctgtgcaactcttgctgatgcggacctcttgggcactctgtgaagccctgaccctggcgactggccccataaccactctctgggaggggtcgcccggaaagttctggaataccacaatcgccgtgtctatggcaaacatcttccggggctcctacctggctggggccggcctggccttctccataatgaaatcggtgggcaccggtaagcgggggaccgggtcacagggcgagaccctcggggagaagtggaagaagaagctgaaccagctctcacgcaaagagttcgatctctacaagaaatccgggatcaccgaggtagaccggaccgaagctaaggaggggctaaagcgtggagaaatcactcaccacgcggtgtctcggggctccgccaagctgcagtggttcgtggagcgaaacatggtcatccctgagggacgggtgatcgaccttgggtgcgggcgcggcgggtggagctactactgtgccggccttaaaaaggtcacagaggtccgtgggtacactaagggcgggcccggtcatgaagaaccggtgccaatgagcacttacggttggaacatcgtaaagctaatgagcgggaaggacgtattctatctcccccccgaaaagtgcgatacccttctgtgcgacataggcgagtcctccccctcccccacggtggaggagagtcgaaccatcagagtgctgaaaatggtcgaaccgtggctcaagaacaaccagttctgcatcaaggttttgaatccctacatgcccacggtgatagagcacctcgagcgcctccaaagaaagcacggcgggatgctggtccggaacccgctgtctcgcaatagtacccacgagatgtactggatctctaacggtacggggaatatcgtggcgagcgttaacatggtgtcccggctcctgctgaaccgtttcactatgacgcaccggcgtccgaccatcgagaaggacgtcgacctcggcgccggaacacggcacgtaaacgccgagcccgagacccccaacatggacgtcatcggggagcgcataaagcgtattaaggaggagcataacagcacctggcattacgacgacgagaatccgtacaaaacctgggcataccacggttcctatgaggtgaaggccaccgggagcgcctccagcatgatcaacggcgtcgtgaagctactgaccaaaccctgggacgtagtccccatggtaacccagatggccatgactgacaccacgccattcggccagcagcgggtattcaaggagaaggtcgatacgcggaccccgcgcagcatgcccggaacccggcgcgttatgggaatcaccgcggagtggctttggcggactctgggacgtaacaagaagccgaggctatgcacgcgagaggagttcaccaagaaggtgaggacgaacgccgctatgggcgccgtattcactgaggagaatcagtgggactcggcgaaggccgcagttgaagacgaagacttctggatcttggtggatcgggagagagaacttcacaaattggggaagtgtggaagctgcgtttacaatatgatggggaagcgagaaaagaagctcggcgagttcggcaaggccaaggggagtcgcgccatctggtacatgtggctgggtgcacgctacctcgagttcgaggcactcgggttcctgaacgaggatcactggttcagccgcgagaactcctattctggcgtagagggggagggcctgcataaactcggctatatactacgcgacatctcaaagattccaggaggcgccatgtacgcagatgatacagccgggtgggatacccgcattaccgaggatgacctgcacaacgaagagaagattacgcagcagatggacccagagcaccggcaacttgcgaatgctatcttcaagcttacctaccaaaacaaggtggtcaaggttcaacgccccacgcccaccggcacggtgatggatataatcagccggaaggaccagcgcggatccggccaggtcggtacgtacggcctaaacactttcacaaatatggaggcccagctcatacggcaaatggagggcgagggggtgctgagcaaggccgatcttgagaacccacacctcccggagaagaagatcacccagtggctcgaaacaaaaggagtggagcgcctgaagcggatggcgatctccggcgacgactgcgttgtgaagcccatcgacgaccgctttgcaaacgccctgctggcactgaacgatatggggaaggtgcggaaagacatccctcaatggcagcccagcaagggctggcacgactggcagcaggtaccattttgctcccaccacttccatgagctcatcatgaaggacgggcgcaagctggtggtgccctgcagacctcaggacgaactcataggccgcgcccggataagccagggggccggctggtccctgcgcgagaccgcgtgcttgggcaaagcctacgcacagatgtggagtttaatgtatttccaccggcgcgacctccgcctcgcatccaatgcgatatgcagcgccgtacccgtgcactgggtgcctacctctcggaccacgtggtcgatccacgcccaccatcagtggatgacaaccgaggacatgctgacggtttggaaccgcgtgtggatagaagacaacccgtggatggaggataagacacccgtgaccacatgggagaatgtcccctatctcgggaagcgggaggaccagtggtgtggatctctaatcgggttaacctcccgggcaacgtgggcccagaacatcccgacggcgatccagcaggtcaggagcctcatcgggaacgaggagttcctagactacatgccctcaatgaagcgctttcggaaagaagaggagtccgagggagcgatttggtga

SEQ ID NO: 25951 - RNA, 9873 nt, synthetic construct
  misc_feature 1..9873: note = derived and/or modified CDS sequence (opt11) from DENV-3__EU726774__SS-prME
  source 1..9873: mol_type = other RNA
acctccctgtgcctcatgatgatcttaccagccgcgctggcgtttcacctcacaagccgcgacggcgagccccggatgatcgtggggaagaacgagcgcggcaagagcctactattcaagacggcctccgggatcaacatgtgcacccttatagccatggacctaggcgagatgtgcgatgacacagtgacgtataagtgcccccacataacggaggtggaaccggaggacatcgactgttggtgtaacctgacctcaacctgggtgacctacgggacgtgtaatcaggcgggcgagcaccggcgagacaagcggtccgtcgccttggcgccccatgtgggtatgggtctggacacccgtactcagacatggatgtcagccgagggcgcctggcgccaagtggagaaggtcgagacgtgggccctccggcacccgggattcaccatcctcgcgctgttccttgcccactacatcggcacctccctcacacagaaggtggtgatcttcattctgctgatgctcgtcacgcctagcatgaccatgcggtgcgtgggggtgggcaatcgcgactttgtcgagggcctgtccggggccacgtgggtggacgttgtcctggagcacggcgggtgcgtgaccacgatggccaaaaacaagcccaccctcgacatcgagctgcaaaaaaccgaggccacccagctggcgacgctccggaaattatgcatagagggcaagattaccaacatcaccaccgacagccgttgtccaacgcagggcgaggccgtcctgcctgaggagcaagaccagaactacgtctgcaagcacacgtatgtggaccgggggtggggcaatggatgcggactcttcggcaagggttccctggtcacgtgtgccaagttccagtgtctggagcccatagagggaaaggtagtgcagtacgaaaatctcaagtacaccgtcatcatcacggtccacacgggcgaccaacatcaggtgggcaatgaaactcagggggtcaccgcggaaatcactcctcaagccagcaccacagaggcgatccttccggagtacggcaccctggggctcgagtgctccccgcggaccggtctggatttcaatgagatgatcctactcacgatgaagaacaaggcgtggatggtgcatcggcaatggttctttgacctgccccttccgtggacctctggcgccacgaccgaaacgcctacctggaaccgcaaggagctactagttacctttaaaaacgcccacgcgaagaagcaagaggtcgtggtgctggggtcccaagaaggcgcgatgcacaccgccctcacgggggcgaccgagatccagaacagcggcgggacctccatattcgccggccaccttaaatgccggttgaaaatggacaaactcgagctgaaggggatgagctacgccatgtgcaccaatacgttcgtcctgaagaaagaggtgtccgagacccagcacgggacgatcctcatcaaggtggaatataagggcgaggacgtcccgtgtaagatccccttcagcaccgaggacgggcagggcaaggcgcacaacggccgcctgatcacggcaaatccggtggtgaccaagaaagaggagcccgtcaatatagaggccgagccgcccttcggggaatcaaacatcgtgatcggaatcggggataatgccctgaaaataaactggtataagaagggctccagcatcggcaagatgttcgaagcgacggcacggggcgcgcgccggatggccattctgggtgacaccgcctgggacttcggatccgttggcggggtcctcaacagcctgggcaagatggtgcaccagatcttcggctccgcttacacggccctcttcagcggcgtgtcctgggtcatgaaaatcggcataggagttttactgacctggatcgggctgaacagtaagaacaccagcatgagtttctcctgtatcgccatcgggataattactctctacctgggcgccgtcgtccaggccgacatggggtgcgtgatcaactggaagggcaaggagctgaaatgcggatcgggaatcttcgtgaccaacgaagtccacacctggaccgagcagtacaagttccaggcggacagccccaagcgcctcgccacagccatagccggcgcctgggagaatggggtctgcggcatccgctcgacgactcggatggagaacctgctgtggaagcagatagcgaacgagctcaactacatcttgtgggagaacaacatcaagctgacagtggtcgtgggtgataccatcggggtgctcgagcagggcaaacgcacactgacgccccaaccgatggagctgaagtactcatggaagacctgggggaaggccaagattgtcacagccgagacgcaaaactcctccttcatcatcgacggccccaacacccccgaatgcccgagcgcgtcgcgggcgtggaacgtgtgggaagtggaggactacgggttcggcgtcttcaccaccaacatatggctcaaacttcgcgaggtgtacacccagctgtgtgaccacagactcatgtccgccgccgtgaaggacgaaagagccgtccacgccgacatgggctactggatcgagagccagaaaaacggctcctggaagctcgaaaaggcgtccctgatcgaggtgaaaacgtgcacctggccgaagtcccacaccctatggagcaacggcgtgctggagagtgacatgatcatccccaaatcattagcagggcccatttcccagcacaattaccgcccaggctaccacacccaaacagccgggccctggcatctcggcaagttggagctggacttcaattactgcgagggcaccaccgtcgttataaccgaaaactgcgggacgcgcggcccgagtctccggaccaccaccgtgtccgggaagctaatccacgagtggtgctgccgctcatgcacgctgcccccgctgaggtacatgggcgaggacggctgctggtacggcatggaaatccgccccatctccgagaaggaagagaacatggtcaagagcctggtttcagccgggagcgggaaggtggacaactttaccatgggcgtcctgtgcctcgcaatcctgttcgaagaggtgatgcgtgggaaattcggaaagaagcacatgatcgccggggtgttcttcacctttgtcctcctgctgagtggtcagatcacctggcgcgacatggctcacacgctgatcatggtggggtccaatgcgtccgaccggatggggatgggcgtcacctacctcgccctcatcgcgaccttcaagattcagcccttcctggcgctcggtttcttcctgcgcaagctgacgagcagggaaaacctcctgctgggcgtcggactcgcaatggcaacgactcttcagctgcccgaggacatcgagcagatggccaacggaatagcgctcggtctgatggccctgaagctcactacccagttcgagacgtaccagctttggaccgccttaatcagcctgacgtgctccaacacaatcttcacgttaaccgtagcgtggcgcacagccacgctgatactcgcgggggtcagccttttgccggtatgccaaagtagcagcatgcggaagacggactggctccccatgactgtggccgccatgggtgtaccgcccctcccgctgttcatatttagccttaaagacaccttaaagcgacgctcctggcccctaaacgaaggagtgatggccgtcggcctagtcagcatcctggcatccagcctgctccgcaacgatgtgcccatggcgggccccctggtagctggcggcttactcatcgcctgctacgtgatcactgggacgagcgccgacctgaccgtggagaaggccgctgacgtcacctgggaagaggaggccgaacagaccggcgtcagccacaaccttatgatcaccgtggatgacgatgggaccatgcgcatcaaggacgacgagaccgagaacatcctcaccgtgctgctaaagaccgccctccttatcgtctcaggcattttcccttacagcatccccgccacactgctcgtgtggcacacctggcaaaagcagacccagagatccggggtgctgtgggacgtccccagcccgcccgaaacccagaaggccgagctcgaggagggggtgtaccgcattaaacagcagggcatcttcggaaagacccaggtgggcgtcggggtgcagaaggagggcgtgttccacaccatgtggcacgtcacccggggcgcggtgctcacctacaacggtaaacgactggagcccaactgggcctccgtgaagaaggacctgatcagctatggcgggggttggcggctctccgcacagtggcagaagggcgaagaggtgcaggtgatcgcggtggaaccgggcaagaacccgaagaacttccagacgatgcctggcacctttcagacgaccacgggagagatcggcgcgattgctctggacttcaagccggggaccagcggcagtccaatcataaatagagagggcaaagtcgtggggctgtatgggaatggggtggtcaccaagaacggtggatacgtgtccggtatcgcccagactaacgcagagccggacgggcccacgcccgagctggaggaggaaatgttcaagaagcgtaacctcacgattatggatctgcaccccggaagcggaaagacccgcaagtacctgccggccatagtgcgggaggcgatcaagcgccgactccgcaccctcatcctggcgcccacgcgggttgtggccgccgaaatggaagaagccctcaaggggctgcccatacgctatcagaccacggcgaccaagtccgagcacacgggcagagagatcgtggacctgatgtgccacgcgacattcaccatgcgcctcctcagtcccgtccgtgttcccaactacaatctgataatcatggatgaggcccactttaccgaccccgcctcaatcgccgccagagggtacatcagcacgcgagtgggcatgggcgaggcggccgccatcttcatgaccgcgacgccgcccgggaccgccgacgccttcccacaatccaacgccccgatccaagacgaggagcgcgacatccccgagcgcagctggaactccggcaatgaatggattacggattttgccgggaagaccgtttggtttgttccctctatcaaggcgggcaacgatatcgcaaactgtctcagaaagaacgggaagaaggtgatccagctgtcccgcaagaccttcgacacggagtaccagaagacgaagctgaacgattgggactttgtcgtgacgaccgacatcagcgagatgggggcgaactttaaggccgaccgggtgatagaccctcgccggtgcttaaagcccgtcatccttaccgatggccccgaacgtgttatactggccggtcccatgccggtgaccgcggcctccgccgcccagcgacggggtcgggtcgggcgtaacccgcagaaagagaacgaccaatacatcttcacgggccaacccctcaacaacgacgaagaccacgcgcactggaccgaggcgaagatgctgctggacaacattaacacccccgagggaatcatcccggcccttttcgagcccgaacgggagaagtccgcggccatcgacggcgagtacagattgaaaggggagtcaagaaaaacgtttgtggagctcatgcgccgcggggacctgcccgtctggttagcgcataaggtggccagcgagggcatcaagtacacggaccgtaaatggtgtttcgacggccagcggaacaaccaaatactcgaggagaatatggacgttgagatttggaccaaagagggcgagaagaagaagctccgaccccgctggctggacgcccgcacttactccgaccccctcgcactcaaggagttcaaggacttcgccgcaggtcgcaagagcatcgccctggacctggtcaccgagatcgggagagtgccctcccacctcgcgcaccgcacccggaacgctctggacaacctcgtgatgctccacactagcgagcacggcgggaaggcttaccgacatgcggtcgaggagctgcccgagaccatggagaccctattgctgctgggtctcatgatcctgctgaccggcggcgccatgctgttcttaatcagcgggaaggggatcggcaagacctccataggcctgatatgcgtgattgcaagctccggcatgctctggatggctgagatcccgctgcagtggatcgcctctgctatcgtgctggagttctttatgatggtcctcctcatccccgaacccgagaagcagcggacaccccaagacaaccagctggcgtacgtagtgattgggatcctcaccctagccgccatcatcgcagcgaacgaaatgggcctgctcgagacgaccaagcgcgacctgggcatgtccaaggagccaggggtcgtgagccccacctcctacctggacgtggacctacaccccgccagcgcctggaccctgtacgccgtcgcgacgaccgtgatcacccccatgctccggcacacgatcgaaaattccacagccaatgtgagcctcgccgccatcgccaatcaggcggtcgtgctgatgggcctggacaaagggtggccgatatccaagatggacctgggcgtgccattgctggccctcgggtgttactctcaggtcaaccccctgaccctgaccgccgccgtgctcctgctgatcacacattacgccattatcggccccggcttacaagcgaaggcaacgagagaggcccagaagcgtacagccgcgggaatcatgaaaaatccgaccgtggacggcatcatgacgatcgacctggaccccgtcatctacgactccaaattcgaaaagcagttgggccaggtgatgctcttggtcctgtgcgccgtgcagctcctgctgatgcgtacctcatgggccctctgcgaggcactaaccctggcgaccggcccgatcaccacgctctgggagggctcccccgggaagttttggaataccacgatcgcggtctcaatggcaaacatctttcggggctcctatctggccggagccggcctcgccttcagcatcatgaagtccgtggggaccggcaagcgcggcaccgggagccagggcgagacgctcggggagaaatggaagaagaagctgaaccagctgagccggaaggaattcgacctctacaaaaagtcaggcatcaccgaagtcgatcgcactgaagcgaaagagggactaaagcggggcgagatcacacaccacgccgtgagccgcggctccgccaagttacagtggtttgtggaacggaacatggtcataccggagggccgagtgatcgacctcggctgcgggcggggcgggtggtcatactactgcgccggccttaaaaaggtgacggaggtccgcggctacacgaagggcgggccagggcatgaggagcccgtccctatgtccacctacggctggaatatcgtgaagctgatgagtgggaaggacgtcttctatctcccgcccgagaagtgcgacaccttgctgtgcgacattggcgaatccagcccatcccctacagtggaagagagtcgtactatccgagtgctaaagatggtcgagccgtggctcaagaacaaccaattctgcatcaaagtactgaacccctacatgcccacggttatagagcacctggagcgcctccagcggaagcacggagggatgctggtgcgcaaccccttgtcccgcaacagcacccatgagatgtattggatttccaacgggacagggaacatcgtagccagtgtaaacatggtctcccgcctattactgaaccgttttaccatgacccaccgccggccaacgatcgagaaggacgtggacttaggcgcgggtacgaggcacgtgaatgccgagcccgagacccccaatatggatgtcatcggagagcgaataaagcggattaaggaggaacacaacagtacctggcattacgacgacgagaacccctacaagacctgggcttaccacggctcctacgaggtgaaggccacggggagcgccagtagcatgatcaatggcgtcgtgaagctgctgactaaaccgtgggacgtggtccccatggtgacccagatggcgatgaccgacacgaccccgttcgggcagcagcgggtgtttaaggagaaggtcgatacccgcaccccacgaagcatgcccggcacgcgacgggtcatgggcataaccgctgagtggctttggcgcaccctcggcaggaacaaaaagccccgcctgtgcactcgggaagagttcacgaaaaaggtgcgcaccaacgccgctatgggcgcggtcttcaccgaggagaaccagtgggactccgccaaggcagccgtggaggacgaggacttttggaagctcgtggaccgcgagagggagctgcataagctggggaagtgtggaagctgcgtctacaacatgatggggaagcgcgagaagaagctcggcgagttcggaaaggccaaggggtcccgtgcgatctggtacatgtggctgggcgcccgctacctggagttcgaggccctcggtttcctgaatgaagaccactggtttagccgggagaatagttacagcggcgtggagggggaggggctccacaagctcggctacatcctgcgcgatatttctaagatccctgggggagccatgtatgcagatgacaccgccgggtgggacacgcggataaccgaggacgacctgcacaacgaggagaagataacccagcagatggatccggagcacagacaactcgccaacgcgatcttcaagctgacctaccagaacaaggtggtcaaggtgcagcggccaacccccacgggcaccgttatggacataattagccgcaaggaccagcggggctccggacaggtcggcacttacgggctgaacacctttacgaacatggaggcccagctcatccgccagatggaaggcgaaggggtgcttagcaaagcggacctggagaacccacacctcccggaaaagaagatcacccagtggctggagaccaagggcgtggagcggctgaagcgtatggcgatatcaggcgacgattgcgtagttaaacccatcgacgaccggttcgcgaatgccctactggccctcaacgacatgggtaaagtccgcaaggacattccccagtggcagcccagcaaggggtggcacgactggcagcaggtgccgttctgcagtcatcacttccacgagttgataatgaaggacgggcgaaagcttgtggtgccctgtcgcccgcaggacgagttgatcggtcgagcgcgcataagtcagggggccggatggtccctccgggagaccgcctgcctgggcaaggcctacgcccaaatgtggagtttgatgtacttccaccgacgcgacctccggctggcatccaacgcaatctgcagcgccgtccccgtgcactgggtgccaacgtctaggaccacctggagcatccacgcccaccaccagtggatgaccaccgaggacatgctgaccgtctggaaccgggtgtggattgaagacaacccctggatggaggacaagactcccgtgaccacgtgggagaacgtcccctacctcgggaagcgcgaagaccaatggtgcggcagcctgatcgggcttacctcccgggccacctgggcgcaaaacatccccaccgccatccagcaggtccgcagcctcatcggcaacgaggaattcctggactacatgccctccatgaagcggttccgcaaggaggaggagagcgagggggcgatctggtga

SEQ ID NO: 25952 - RNA, 9873 nt, synthetic construct
  misc_feature 1..9873: note = derived and/or modified CDS sequence (opt11) from DENV-3__EU687219__SS-prME
  source 1..9873: mol_type = other RNA
acctcgttgtgcctcatgatgattttgcccgcagccctggcgttccacctcaccagccgggacggggagccccgtatgatcgtggggaagaacgagagaggcaaaagcctgctgttcaagaccgcttccgggatcaacatgtgcactctcatcgccatggacttgggcgagatgtgcgacgataccgtgacctataaatgcccccacatcgccgaggttgagcccgaggacatcgactgctggtgcaatctgaccagcacttgggtgacctatgggacctgtaaccaggccggcgagcatcgccgcgataagcggtccgttgcgctcgcgccccacgtggggatgggtctcgacacccgcacccaaacttggatgagcgcagagggtgcctggcggcaggtcgagaaggtcgaaacctgggcgctgcgacacccggggttcaccatactcgcccttttcctggcccactatatcgggacctccctcacccagaaggtggtgatcttcatcctgctgatgttggtcacgcccagcatgacgatgcgctgcgtgggtgtgggtaatcgcgacttcgtcgagggcctgtccggggccacgtgggtggacgttgtcctagagcacggcgggtgtgtgaccaccatggccaaaaataaaccaactctcgacatagagctgcagaagaccgaggcgacacagctggcaactttacgtaaactgtgcatagaggggaaaatcaccaatatcacgaccgattcacgctgccctacccagggggaagctgttttgcccgaggaacaggatcagaactacgtgtgcaagcacacgtacgtggatcgagggtgggggaacgggtgtggcctcttcgggaaggggtccttggttacctgcgccaagttccagtgcctggaacccatcgagggaaaggtcgtccagtacgagaacctcaagtataccgtgatcatcaccgtccacacgggggatcagcaccaggtggggaacgagacccagggagtcacagccgaaatcacgccgcaggcgagcactaccgaggcaatcctgcccgagtacggcaccctaggactagagtgctcaccgcgtaccgggctggactttaacgagatgatcctgcttaccatgaagaacaaggcctggatggttcaccgccagtggtttttcgacctgcccctgccctggaccagtggagccaccaccgaaaccccgacgtggaatcgcaaggagcttttagtgaccttcaagaacgcccacgcaaagaagcaagaggtcgtggtgctgggctcccaggagggcgccatgcacactgccttgaccggggcgacggaaatccagaacagcggtgggacatccatttttgccggtcacctcaagtgccgcctgaaaatggacaagctcgagttaaaaggcatgagctacgctatgtgtaccaacacgttcgtcctaaagaaggaggtgtcagagacccagcacgggaccatcctcataaaggtagaatacaagggtgaagacgtcccgtgcaagatccccttctccaccgaagatgggcaaggaaaggcccacaacggccgccttatcaccgccaacccggtggtgacgaaaaaggaggagcccgtgaacatcgaggccgagccgcccttcggggagagcaacatcgtgatcggcataggggacaacgcgctaaaaatcaattggtacaagaaaggcagttcaatcgggaaaatgttcgaggccactgcgcgtggcgccagaagaatggccatcctgggcgacaccgcgtgggacttcgggtccgtagggggcgtgctcaacagtctgggcaagatggtgcaccagatattcgggtccgcctacaccgccctgttcagcggcgtgtcctgggtcatgaagatcggaataggtgttctcctgacgtggataggcttaaactcaaagaacacctccatgtctttttcctgtatcgccatcgggatcatcacattgtacctgggcgccgtggtgcaggcggacatggggtgcgttattaactggaagggcaaggaattaaagtgtggctcagggatcttcgttacgaacgaggtgcatacgtggaccgagcagtacaagttccaggccgattcccccaagcgcctcgccaccgccatcgccggtgcatgggaaaacggggtctgcggaatcaggagcaccacacggatggagaatctgctctggaagcagatcgcgaacgagctcaactacatcctgtgggagaacaacataaagctgaccgtcgtcgtgggggacatcatcggggtgctcgagcaaggcaagcgcacactgacgccccagcctatggagctgaaatactcgtggaagacatgggggaaggcaaagatagtcaccgccgaaacccaaaacagctcctttattatcgacggcccgaacaccccggagtgccccagcgtgtcccgggcgtggaatgtgtgggaagtcgaagactacgggttcggtgtgttcacgaccaacatttggctcaaactgcgcgaggtgtacacccagctttgcgatcaccggctgatgagcgccgcggtgaaggacgaacgagccgtgcatgctgacatggggtactggatcgaaagccagaagaacgggtcctggaaactggagaaggcgagccttatcgaggtaaagacctgtacctggccgaagtcccacacgctctggtccaacggcgtcctggagtccgatatgatcatacccaagagcctggcagggcccatatcacagcacaactatcggcctggctatcacacccagaccgccgggccgtggcacttaggcaagctggagttagatttcaactactgtgaggggactacggtagtgatcacggaaaactgcgggacgcgcggcccgagcttgcggaccacgaccgtgtccgggaagctgatccacgagtggtgctgccgcagctgcaccttgcccccgctccggtacatgggagaggacgggtgctggtacggcatggagatccgccccatctctgaaaaggaggagaacatggtaaagagcctggtgtccgcgggatcggggaaggtcgacaacttcacaatgggggtgttatgtctcgccattctgttcgaagaggtgatgcgggggaagttcggcaagaagcacatgatagcgggggttttcttcacgttcgtgctgctattatcagggcagattacctggcgcgacatggctcacactctgatcatgatcggatcaaacgcgagcgaccggatgggaatgggggtgacctatctcgccttaatcgccacgtttaagattcagcccttcttggcgctagggttcttcctacgcaagctgactagccgggaaaacctcctgcttggagtcggcctcgccatggccacaaccttacagctccccgaggacatcgagcaaatggcgaacgggatcgcgctcgggttgatggccctaaagctcatcacgcagttcgaaacctaccagctgtggactgccctaatcagcctgacgtgctccaacacgatcttcaccctgaccgtggcctggcgcaccgccacgcttatactcgcgggggtatcattgctgccggtgtgtcaatccagctcgatgcggaaaaccgactggctcccaatgaccgtggccgccatgggcgtgccccctcttccgctgtttatcttcagcctcaaggacacactgaaacgacgtagctggcccctcaacgagggggtgatggccgtgggcctcgtatccatcctcgcctccagcctgctccggaatgacgtgcccatggcaggccctctggtggccggaggcctgcttatagcttgctatgtgatcactgggacctccgctgacttgaccgtggaaaaggcagcggacgtgacctgggaggaagaggcggagcagacgggagtcagccacaacctgatgattaccgtcgacgatgacggcacaatgaggatcaaagacgacgagactgagaacatccttacggtgctgctcaaaacggccctcctaatagtctccggcatcttcccgtatagcatccccgccaccctgctcgtgtggcatacttggcagaagcaaacccagcgttccggggtactgtgggatgtccccagcccgccggagacgcagaaggccgagttggaagagggggtatatcgcattaaacagcagggcatcttcgggaagacacaggtgggcgtgggggtgcaaaaggaaggcgtgttccataccatgtggcatgtcacacgaggcgcggtcctcacgtacaatggtaaacgcctggaacctaactgggcaagtgtgaagaaggatttaataagctacggaggagggtggcggctgagcgctcagtggcagaagggggaggaagtccaagtgatcgccgtggagcccggaaagaaccccaagaacttccagaccatgcccggcaccttccaaaccacgacgggcgagatcggagcgattgccctagatttcaagcctgggacaagtgggagccccatcatcaaccgcgagggcaaggtcgtgggactgtacggcaacggggtgatcaccaagaatggaggatacgtctccggtatcgctcagaccaatgcggagcccgacggccccacccccgagctagaggaggagatgttcaagaagcggaacctcaccatcatggacctgcatccagggagcggcaagacccgcaaatacctgccggccatcgtccgcgaggctatcaaacgccgcctacgcacgctgattctagcccccaccagagtagttgccgccgagatggaggaggccctcaagggattacccatacgctatcaaaccacagcgactaaatccgagcacactggtcgggagatcgtggacctgatgtgccacgccacattcaccatgcgactcctgagccccgtgcgggttccgaactataatctgattataatggatgaggctcacttcactgaccccgcttctatcgctgcgagagggtacataagcactcgggtgggcatgggcgaggcagcggccatctttatgacggcgacgccgcccgggacggccgacgccttcccgcagtccaacgcacccatacaggacgaggagcgggacatccccgagcggagctggaactccggcaacgaatggatcactgatttcgccgggaagaccgtatggtttgtacccagcattaaggcgggcaacgacatcgctaactgcctgcggaagaacgggaagaaggtgattcagctatcccgaaagaccttcgacacggagtaccagaagactaagttgaacgattgggacttcgtggtaaccaccgacatctccgagatgggcgcgaacttcaaggcggaccgggtcattgacccgcgccggtgcctcaagccggtaatcttgactgatggccccgagcgggtcatcctggccgggcctatgcctgtgacggcggcaagtgccgcccagcggaggggtcgcgtgggacgcaacccccagaaggagaacgaccaatacatctttactggtcagcccctaaacaacgacgaggaccatgcccactggaccgaggcgaagatgctcttagacaacatcaacaccccagaggggatcattccggccttattcgaacccgagcgggagaaaagtgccgctatcgacggcgagtaccgcttaaagggcgagtcccgaaagacgttcgtcgaactcatgcgccggggcgatctccccgtgtggctggcacacaaggttgccagcgagggcatcaaatacacagaccgcaagtggtgcttcgacgggcagcggaacaaccagatcctggaagagaacatggacgtagagatatggacaaaggagggcgagaagaagaagctacgcccccggtggctggacgcccgcacctactccgacccgctagccctcaaagagtttaaggactttgccgctggccgcaagagcatcgccttggacctggtaacggaaatagggcgggtaccctctcacctcgcccaccgaacccggaacgccctagacaacctggttatgctgcacaccagcgagcatggcgggaaagcctataggcacgcggtggaagaactgcccgagaccatggagaccctcttgctgctgggcctcatgatcctgctgaccggtggcgcaatgctattcttgatcagcggaaagggaatcggcaagacctctatcgggctgatctgcgtcatcgccagcagcggaatgctatggatggcagagatcccgctgcagtggatcgccagcgcgatcgtgctggagttcttcatgatggtgctcctgattcccgaaccagagaaacaacggacgccccaggacaatcagctggcctacgtcgtgattggaatcctcacgctagccgccatcatcgctgctaacgaaatgggcctcctcgagaccaccaagcgcgacctgggaatgagtaaggaacccggggttgtctcccccaccagctacctcgatgtggacctgcatcccgccagcgcctggacgctatacgcggtggcgaccaccgtcataacccccatgctgcggcatacgatcgagaactccacggcaaacgtgtccctcgcggcgatcgccaaccaggcggtcgtcttaatgggcctcgataagggatggcccatctcgaagatggacctcggcgttcccttgctggctttagggtgctacagccaagtcaaccccctgaccctgactgccgcagttttacttctgataacgcactatgccatcatcggccccggcttgcaggcgaaagctacgcgcgaggcacagaagagaaccgccgcagggatcatgaaaaacccgaccgtggacggaatcatgacgatcgacctggatcccgtgatctacgactccaaatttgagaagcagctgggacaggtgatgctcttggtgctgtgtgcggtacaactactgctgatgcgtaccagctgggccctctgcgaggctctgacactggccaccggccctataaccaccctctgggagggcagtcccggcaaattctggaacaccactatcgcagtaagcatggccaacatcttccgagggagttacctcgccggggctggcttagcttttagcatcatgaaatccgtgggaaccggcaagcgaggcaccggtagtcaaggagagaccttgggggagaaatggaagaagaaactgaatcaactgagccggaaggagtttgacctctacaagaagtcgggcatcaccgaagtggaccgcacagaggctaaggaggggttaaagcgtggcgaaatcacgcaccacgctgtcagccgcggctccgccaagctgcaatggttcgtggagcggaacatggtgatacccgagggacgtgtcattgacctcggctgcgggagaggcggctggtcgtattactgtgctggcctgaagaaggtaaccgaggtgaggggctacacaaagggaggacccgggcatgaagaacccgtccccatgtccacctacggttggaacatcgttaagctgatgagtgggaaggatgtgttttacctcccgccggagaagtgtgacacgctcctgtgcgatattggcgagagtagcccctcacccaccgtcgaggaaagccggacgatccgcgtgctgaagatggtggaaccatggctcaaaaacaaccagttctgcatcaaggtccttaatccgtacatgcccactgtaattgagcacctggagcgcctccaaaggaagcacggcgggatgctggtgcgcaaccccctgtcacggaacagcacacacgagatgtactggatttccaatggcaccgggaacattgtggccagtgtgaacatggtatcccgcctcctgctgaatcggttcaccatgacccaccgcagaccaacaatagagaaagacgttgatctcggcgcgggcacccgccacgtgaatgcagagccggagaccccaaacatggacgtgattggagaacggattaagagaatcaaggaggagcataactctacttggcactacgacgatgagaacccgtacaaaacgtgggcctaccacggctcttatgaggtaaaggccaccgggtctgcatcctctatgatcaacggcgtcgttaagctcctcaccaaaccatgggacgtcgtgccaatggtcacccagatggcaatgactgacaccacccccttcggacagcagcgggtgtttaaggagaaggtggatacccgcacaccccggagcatgcccggcacccgacgcgtcatgggtatcaccgccgagtggttgtggcggaccctagggcggaacaaaaagccgcgcctgtgtacccgggaggagttcaccaagaaagtgcgcaccaacgccgccatgggcgcggtgtttactgaggagaaccagtgggactccgccaaggccgctgtcgaggatgaggacttctggaaacttgtggaccgcgaacgggagctgcacaagctggggaagtgcggcagttgcgtgtacaatatgatggggaaacgcgagaagaagctaggcgagttcggaaaagcgaaaggcagtcgggcgatctggtatatgtggctgggcgcccgctacctggagttcgaggccctcggatttttgaacgaggaccactggtttagccgtgagaactcttacagcggagtggagggtgagggactgcacaagctcggatacatcctgcgcgatatctctaaaatccccggcggggctatgtatgccgacgacacggcggggtgggacacccggatcacagaggatgacctgcacaacgaggaaaagattacccaacaaatggaccccgaacatcgccaactcgccaatgcgatctttaagctgacgtaccagaacaaagtggtgaaggtccaacggcccacccctaccggcactgtgatggacataattagccgcaaggatcagcggggctccgggcaggtaggtacctatgggctgaatacgtttaccaacatggaggcccagctcatcaggcaaatggagggcgaaggggtgcttagcaaggctgacttagagaatccccacctcccggagaagaaaatcacccagtggctggagactaagggcgtagagagactgaaacgcatggcgataagcggagacgactgtgtggtaaagccaatcgacgaccgattcgccaacgcactgttagccctgaacgacatggggaaggtgcggaaggacattccccagtggcagcccagcaagggctggcacgactggcaacaggtcccgttctgctcccaccacttccacgagctcataatgaaggacgggcggaaattggtcgtaccttgcagaccccaggacgagctcatcggccgggcccgcatcagccaaggggcgggatggtccctccgagagacagcctgtctgggcaaggcctatgcccagatgtggagcctaatgtactttcacagacgcgacctccggctggcctccaacgcgatctgcagcgcggtacccgtccactgggtgcctacctcccgcacgacctggagcatccatgcccatcaccaatggatgacgaccgaggacatgctgaccgtgtggaaccgggtctggattgaagacaatccttggatggaagacaagacccccgtgacgacctgggagaacgtgccctacctgggaaagcgcgaggaccagtggtgtggcagcctgatcggactgacatcccgagcgacttgggcgcagaatatcccgacagccatccagcaagtccgcagcctcatcggcaatgaagagttcctggactatatgccctcgatgaaaaggtttcgcaaggaggaggagtccgagggggccatctggtga

SEQ ID NO: 25953 - RNA, 9873 nt, synthetic construct
  misc_feature 1..9873: note = derived and/or modified CDS sequence (opt11) from DENV-3__EU726768__SS-prME
  source 1..9873: mol_type = other RNA
accagcctgtgcctcatgatgatcctgccagcggcgctggcgttccacctcaccagccgggacggcgagccgcggatgatcgtggggaagaacgagcgcggcaagagcctactgttcaaaactgcgtccgggatcaacatgtgcaccctcatcgcgatggacctgggcgagatgtgcgacgacaccgtgacgtacaagtgcccgcacattacggaggtggagcccgaggatatcgactgttggtgcaacttgacctccacctgggtgacctatgggacgtgtaatcaagccggcgaacaccggcgcgacaagcggtcagtcgctctcgcgccccacgtgggcatggggctggacacccgcacccagacctggatgagcgccgagggggcatggcgccaagtcgagaaggtggagacgtgggccctgcgccacccggggttcaccatccttgcgctgttcctggcccactacataggaacgtctctcacccagaaggtggtgatcttcatcctgctcatgctcgtcaccccgagcatgacgatgcggtgcgtgggggtgggtaaccgcgacttcgtcgagggcttgtctggggctacctgggtggacgtggtcctggagcacggcggttgcgtcaccacgatggccaagaacaagccgaccctcgacatcgagctgcagaagaccgaggccacccagctagcaacgctccggaagctgtgcatagagggcaagataacgaacatcaccaccgacagtaggtgcccaacgcagggcgaggccgtgctgccagaggagcaggaccagaactacgtctgcaaacacacctacgtagaccgggggtggggcaacgggtgcggcttatttgggaagggctcactggtgacctgcgccaagttccagtgcctggagcccatcgagggcaaggtggtgcagtacgagaacttaaagtacaccgttatcatcacggtccacaccggagaccagcatcaggtgggcaatgagacccaaggggtcaccgcggagatcacacctcaggctagcaccaccgaggcgatcctgcccgaatacggcaccctgggtctcgagtgctcaccgcgcaccggccttgacttcaacgagatgatcctgctaacgatgaagaacaaggcctggatggtacaccggcagtggttcttcgatcttcccctgccctggaccagcggcgccaccactgagacgcccacctggaaccgcaaggagctcctggtgacattcaaaaacgcccacgccaagaagcaggaggttgtggtactgggatcccaggagggcgcgatgcacaccgccctcactggggcgacggagatccagaacagcggcgggaccagcatcttcgccggccacctgaaatgccggctgaagatggacaagctcgagctgaagggcatgtcatacgccatgtgcaccaacacgtttgtactgaagaaggaggtgtcggaaacccagcacgggaccatcctcataaaggttgagtacaagggcgaggatgtcccgtgcaagataccgttcagcaccgaggacgggcagggcaaggcgcacaatggccgcctaatcacggccaaccccgtggttaccaagaaggaggagccggtcaacatcgaggcggagccgccattcggggaaagcaacatcgtgattggcatcggggacaacgcccttaagatcaactggtacaagaagggcagcagcatcgggaagatgttcgaggcgactgccagaggcgctcgccggatggcaatcctgggcgacaccgcctgggactttggctccgtaggtggggtcctcaacagtctgggcaagatggtgcaccagatcttcgggtccgcatatacagccctgttcagcggcgtgtcgtgggtcatgaaaatcggcattggggtgctactaacgtggatcggccttaacagcaagaacacttccatgagcttttcgtgtatcgttatcgggataataaccctctatctaggagccgtagtccaagccgacatggggtgcgtgatcaactggaagggcaaggagttaaagtgtggctcggggatcttcgttacgaacgaggtgcacacgtggacagagcagtacaagttccaggccgactccccaaagagactggcgaccgcgatcgcgggcgcctgggaaaacggggtttgcggcatccgctcgacaacccgaatggaaaacctgctgtggaagcagatcgccaacgaactcaactacatcctgtgggaaaacaatatcaagctcacagtcgtggtgggggatataatcggagtcctggagcagggcaagcgaaccctgacgccccaaccgatggaactgaagtattcatggaagacctgggggaaggcgaagattgtgactgccgagacccagaactcctccttcatcatcgacggccccaacacgcccgagtgccccagcgcctcccgggcctggaacgtgtgggaggtggaggactacgggttcggcgtgttcaccacgaacatctggctcaagctgcgcgaggtgtacacccagctgtgcgaccaccggctcatgtccgcggccgtaaaggatgagcgcgccgtgcatgccgacatggggtactggatcgagtctcaaaagaacgggtcctggaaactggagaaggcctcgctgatagaggtgaagacctgcacgtggcctaagtcccacaccctctggagcaacggcgtcctggagtcagacatgatcattccaaaatcactggcgggccccatctcccagcacaactaccggcctggttaccacacccagaccgccggaccctggcacctcggcaagctggagctggacttcaactactgtgagggcacgaccgttgttatcacggaaaactgtgggacccgcggcccctctctccggactacaaccgtttctggaaagctgatacatgagtggtgctgcaggagctgtactctgcccccgctccgatacatgggcgaggacgggtgctggtacggcatggagatccgccccatctccgagaaggaggagaatatggtgaagtctctggtgtccgccggcagcgggaaagttgacaacttcacgatgggcgtgctgtgcctcgccatcctgttcgaggaggtgatgcgaggcaagttcggaaagaagcacatgatcgccggcgtcttcttcacattcgtgctcctcctgtccggccaaatcacctggcgcgacatggcgcacaccctgatcatgatcggcagcaacgcctccgaccggatgggcatgggcgttacctacctcgctctgatcgcgaccttcaagatccagccttttctggcccttgggttcttcctgcgcaagctgacctcgagggagaacctcctgctgggtgtcggtctcgcgatggcaaccactctgcagctgcctgaggacatcgaacagatggccaatgggatcgcactcggactaatggcgttgaagctcatcacacagttcgagacctatcagctgtggaccgccctgataagcctcacgtgctccaacaccatcttcaccctaaccgtggcctggcgcacggccaccctgatcctcgcgggggtaagcctgctgccggtatgccagtccagctccatgcggaaaacggactggctccccatgacagtggcggccatgggcgtgccgcccctcccgctgttcatcttcagcctcaaggacacgcttaagcgccgctcctggcccctgaatgagggggttatggccgtgggactcgtctcgatcctggcctcctccctgcttcggaacgacgtgcccatggccggccccctggtggccggagggctgctcattgcctgctacgtcatcaccggcacctccgccgacctcacagtggagaaggccgccgatgtgacatgggaggaggaggcggagcaaaccggggtctcgcacaacctgatgattactgtcgacgatgacgggaccatgcgtatcaaggacgacgagactgagaacatcctgacggtgctgctgaagaccgcgctcttgatcgtctcagggatattcccgtacagcatccccgccactctgctcgtgtggcacacctggcagaaacagacgcagcgttcgggcgtgctgtgggacgtccccagcccgcctgaaacccagaaagcagagctggaggagggagtgtaccgcatcaagcagcagggcatcttcggcaaaacccaggtgggggtcggggtgcagaaggagggtgtgttccacaccatgtggcacgtaacgcggggcgccgtgctcacctacaacgggaagcgcctggagcccaactgggctagcgtgaagaaggacctgatctcatacggagggggctggcggctctccgcccagtggcagaagggagaggaggtccaggtgatagccgtggagcccggcaagaaccccaagaacttccaaacgatgcccggcaccttccagacgaccaccggggagatcggcgccatcgccctggacttcaaacccggcaccagcggcagccccataatcaaccgcgagggcaaggtcgtggggttgtacggcaacggggtcgttacgaagaacggcgggtacgtgtccggcatcgcccagaccaacgccgagccggacggccccacccccgagttagaggaggaaatgttcaagaagcggaacctcaccatcatggacttgcaccccggcagcggtaagacgcgcaagtatctgccggccatcgtgcgggaggccatcaagcgccggctccgcaccctcattttggcgcccacccgggtcgtggccgccgagatggaggaggccctcaaggggctgcccatacgctaccagaccacagccactaagtccgagcacacaggcagggagatcgtggacttaatgtgtcacgcgactttcacgatgcgcctcctgagccccgtccgggtgcccaactacaacctgatcataatggacgaggcccatttcaccgaccccgcctccatagcggcgagagggtatatcagcacaagagtcggcatgggcgaggcggccgccatcttcatgaccgccacgccaccgggtaccgcggacgccttcccgcagtccaacgcccccatccaagacgaggaacgcgacatccccgagcgcagctggaactccggcaacgaatggataaccgactttgccggtaagaccgtctggttcgtgccgtcgatcaaagccggcaacgacatcgctaactgcctccggaagaacgggaagaaggtgatccagctgtcccgcaagactttcgacacggaataccagaagacaaaattaaacgactgggactttgtcgtaaccacggacatctctgagatgggcgccaactttaaggctgaccgggtgatcgacccgcgcagatgcctcaagcccgttatcctgaccgacggccccgagcgcgtgatcctggccgggcccatgccagtgaccgctgcgtccgccgcccagcggaggggacgggtcgggcgcaatccgcagaaggagaacgatcaatatatctttaccggccagccgctcaacaacgacgaggaccacgcccactggaccgaggccaagatgttactggataacattaacacgcccgaggggatcatcccagccctcttcgagcccgaacgcgagaaatccgcagcaattgatggcgagtaccgcctgaagggcgagtcccggaagacattcgtggagctgatgcgccgcggggacctcccggtctggttagcccacaaggtggccagtgagggcataaagtatacggaccgcaagtggtgcttcgacgggcaacggaacaaccagatcctggaggagaacatggacgtggagatctggaccaaagagggcgagaagaagaaacttcgcccccggtggcttgacgcccgcacgtatagtgacccgctggcactcaaagagttcaaggacttcgcggccggaagaaagagcatcgcgcttgacctggtcacagagatagggagagtccccagccacctcgcccaccgcacccggaacgccctggacaatctggtgatgctccacaccagcgagcacggcgggaaggcctatcgccacgccgtcgaggaactgcccgagacgatggagaccctgctactactgggcctcatgatactgctgacagggggtgcgatgctgtttctgatcagcggcaaagggataggcaagacctccatcggcctgatctgcgtgatagccagctccgggatgctctggatggcggagattccgctgcaatggatcgccagcgcaatcgtgttagagttcttcatgatggtcctcctgatcccggagcccgagaagcagcggacaccccaggacaaccaactggcatacgtagtgatcgggatcctcaccctcgccgcgatcatcgccgccaacgagatgggcctgttagagacaaccaagagagacctgggcatgtccaaggagccgggcgtagtgagccctacgtcctacctggatgtggacctccaccccgcgtctgcctggactctgtacgccgtcgccaccaccgtgatcacgcctatgctgcggcacaccatagagaactcaaccgcgaacgtgtctctcgctgcaatcgcgaaccaggccgtcgtgttgatgggcctagacaaagggtggccgatcagcaagatggacctaggcgtacccctgctggcgctcgggtgctactcacaggtaaaccccctaaccctgacggcagccgtgctcctgctcatcacccactacgccatcatcggcccgggcctacaggccaaggcgacgcgcgaggcgcagaagaggactgccgccggaattatgaagaacccgacggtggacggaataatgaccatcgacctggaccccgttatctacgactccaaattcgagaagcagctgggccaggttatgctcctggtgctgtgcgcggtacagctgctgctgatgcgcactagctgggcgctctgcgaggctctgaccctggccacgggccccattaccaccttatgggagggctcccccgggaagttctggaacaccacgatcgccgtgagcatggcgaacatatttcggggctcctacttggcgggggccggcctggccttcagcattatgaagtccgtcgggacgggcaagagaggcaccgggagccaaggcgagaccctcggagagaaatggaagaaaaagctgaaccagctgagccggaaggagttcgacctctacaagaagtccggtatcactgaagtcgaccgcacggaggccaaagaggggctgaagagaggtgagatcacccatcacgcggtgagccgcggctccgccaagctgcaatggttcgtggagcggaacatggtgataccggaagggcgcgtgatcgacctgggctgtggaagaggcgggtggagctactactgcgcgggcctgaagaaggtgaccgaggtccgcggctacaccaagggcgggcccgggcacgaggagccggtgcccatgtccacgtacggctggaacatcgtcaaactgatgagcgggaaggacgttttctatctcccgccggagaagtgcgacacactgctgtgcgatatcggcgagagtagcccctcccccaccgtagaggagagccgtaccatccgcgtgcttaaaatggtagagccttggctgaagaacaaccaattctgcatcaaggtgctgaacccctatatgcccacggtgatcgagcacctggagcgcctccagcggaagcacggcggaatgctggtccgcaaccccctgtcccggaacagcacccacgagatgtactggatctccaacggcaccggaaatatagtggctagcgtgaacatggtttcccgcctgctgctgaaccggttcaccatgacgcaccgccggccgaccatcgagaaagacgtggatctcggcgccggcacacgtcacgtgaacgcagagccagagacccccaacatggacgtcatcggggagcgaatcaagcgcatcaaggaggagcataattccacatggcattatgacgacgagaacccgtacaaaacatgggcctaccacggctcatacgaagtgaaagccaccggctcggcctcctccatgatcaacggcgtcgtgaagctgttgacaaagccatgggacgtggtccccatggtgacgcaaatggccatgaccgacaccaccccattcggccagcagcgcgtgttcaaggaaaaggtggatacccgcaccccacggagcatgcccggcacccgacgggttatgggcatcaccgcggagtggctctggcgtacactgggtcggaacaaaaagccccgcctgtgtacgcgggaggagttcacaaagaaggtgcgcaccaatgcggctatgggcgcggtattcaccgaggagaaccagtgggactccgcgaaggccgccgtcgaggacgaggacttctggatccttgtggaccgcgagcgggagctgcacaagctggggaagtgcgggagctgcgtttacaacatgatggggaagcgcgagaagaagctcggcgagttcggcaaagccaaggggtcccgggccatctggtacatgtggctgggcgcgcgctacttagagttcgaagccctcggattcctgaacgaggaccactggttcagccgggaaaattcctacagcggcgtggagggggagggcctgcacaagctgggctatatattaagagacatttccaagatacccgggggcgccatgtacgccgacgacacagccgggtgggacacccggatcaccgaagacgacctgcataacgaggagaaaatcacacagcagatggacccggagcaccgccagctcgccaatgcgatcttcaagctgacctaccagaacaaagtggtcaaagtgcagcggccgacccccaccggcacagttatggacatcatcagcaggaaggaccagcgtggctccggacaggtgggcacgtacggtttgaacaccttcaccaatatggaggcccagctcatccgccagatggagggcgagggggtgctgagcaaagccgacctggaaaacccccacctcccagaaaagaagattacccagtggctggaaacgaagggcgtcgagaggctgaagcgcatggccatctccggcgacgactgcgtcgtgaagcccatagatgaccgcttcgccaacgccttgttagcccttaacgacatgggtaaggtgcgcaaagacatcccccagtggcagcccagcaagggttggcacgactggcagcaggtcccgttctgctcccaccactttcacgagctcatcatgaaagacggccggaagctggtggtgccgtgcagacctcaggacgagctgatcggccgagcccgcatcagtcagggggccggttggtccctccgggagaccgcgtgtctgggcaaggcctacgcccaaatgtggtcgctgatgtacttccaccgaagggacctccggctggccagcaacgcaatatgcagcgccgtccccgtgcactgggtaccgacctcccgcaccacgtggagcatccacgcccatcaccagtggatgaccactgaggacatgctgacggtctggaaccgggtatggatcgaggacaatccctggatggaggataagacgcccgttaccacgtgggagaacgtcccctacctcgggaagagggaggaccaatggtgcggcagcctgatcgggctgacctctcgggccacgtgggctcagaacatcccgaccgctatccaacaggtccgcagcttaatcgggaacgaagagttcttagattacatgccctcgatgaagcggtttcgcaaagaggaggagtctgagggggccatctggtga

SEQ ID NO: 25954 - RNA, 9873 nt, synthetic construct
  misc_feature 1..9873: note = derived and/or modified CDS sequence (opt11) from DENV-3__EU687226__SS-prME
  source 1..9873: mol_type = other RNA
accagcctttgcctcatgatgatcctgcctgccgccttagcgttccacctcactagccgggacggcgagcccagaatgattgtggggaagaacgagcgcggcaagagcctgctgttcaagacggcttccgggatcaacatgtgcaccctcatagcaatggacctgggcgagatgtgcgacgacaccgtgacctacaagtgtcctcacataactgaagtggagcccgaggacatcgactgctggtgcaacctaacgagcacctgggtgacctacgggacgtgtaaccaggcgggcgagcaccggcgcgataagcggagcgtggccctcgccccccatgtgggcatggggttagacactcgcacgcagacgtggatgagcgccgagggcgcctggcggcaagtcgaaaaggtcgagacgtgggcgctgcgccacccggggttcaccatactagcgctgttcctagcccactacatcggaacgtccctcacccagaaggtggttatctttattctgctgatgctcgttacgccctctatgaccatgcggtgcgtgggggtgggcaaccgcgacttcgttgagggcctgtccggggccacctgggtggacgtggtccttgagcacggcggctgcgtgaccacgatggccaagaacaaacccacccttgacattgagctgcagaagacggaggccacccagctggcgacgttgcggaagctgtgcatcgagggcaagattacaaacatcactaccgattcgcgttgccccacgcagggcgaagccgtgctgccggaagagcaagaccaaaactacgtctgtaagcacacctacgtggaccggggatggggcaacggatgcggactcttcgggaagggctccctcgtgacctgcgccaagttccagtgcctggagcccatcgagggcaaggtcgtacagtacgagaacctcaagtacaccgtgatcatcacagtccataccggggaccaacaccaagtgggcaacgagacacagggggtcaccgccgagatcacgccccaggccagcaccaccgaggcgatcctgcccgagtacggaaccttagggcttgaatgttccccgcgcaccggcctggacttcaacgagatgatcttgctcacgatgaagaacaaggcctggatggtacatcggcagtggttcttcgatctgcccctgccctggaccagcggcgccaccaccgagacgcccacttggaaccgtaaggagttactggtgaccttcaagaacgcccacgccaaaaagcaggaagttgtggtgctggggtcccaggaaggtgcaatgcataccgcactcaccggggccaccgagatccagaacagcggcgggacctccatcttcgccggccacctgaagtgtcggctgaagatggacaagcttgagctaaagggcatgagctacgccatgtgcacgaacacgttcgtcctcaaaaaggaggtgtccgagacccagcacgggaccattctcataaaggtcgagtacaagggcgaggacgtgccgtgcaaaatcccttttagcaccgaggacggccaaggcaaagcgcacaacggccgcttgatcacggccaaccccgtggtgaccaagaaggaggagcccgtgaacatcgaggccgagccgcccttcggggagagcaacatcgttatcggcattggtgacaatgcactgaagatcaactggtacaagaagggctccagcatcgggaagatgttcgaggcgaccgcccggggcgcccgccggatggccatcttgggcgacacggcctgggacttcggatccgtgggcggggttctcaacagcctgggaaagatggtccaccaaatcttcgggtccgcgtacacggcactgtttagcggagtgtcctgggtcatgaagatcggcattggtgtcttgctgacctggatagggctaaacagcaagaacacatccatgagcttcagctgcatcgccatcggcatcataactctgtacctgggcgccgtggtccaggccgacatggggtgtgtgatcaactggaagggcaaggagctgaagtgcggcagcgggatcttcgtgacgaacgaggttcatacttggaccgaacagtacaagttccaggcggactcccccaaacgcctcgccaccgccatcgctggcgcctgggagaatggggtgtgcggcatcagaagcacgaccagaatggagaacctgctgtggaagcagatcgcgaacgagctcaactacatactttgggagaacaacatcaagctgaccgtggtcgtgggggatatcatcggcgtactcgagcagggcaagcgcaccctgacgccccagccgatggagctgaagtactcctggaaaacctgggggaaagccaagattgtgacagcggagacccagaacagctctttcattatcgacggccccaacacgcccgagtgccccagcgcctcccgagcgtggaatgtgtgggaggttgaggactacgggttcggcgtgttcactaccaacatctggctcaagctgcgcgaggtgtacacccagctgtgcgaccacagattgatgagcgccgccgtgaaggacgagcgcgccgttcacgcagacatgggatactggatcgagagtcagaagaacgggtcctggaagctggagaaggcgagtttaatcgaagtgaagacttgcacgtggccgaagtcccacacgctctggagcaacggggtgctggagtccgatatgatcatccccaagtccttagccgggcccatctcccagcataactatcggcctggctaccacacccagaccgccgggccgtggcacctcggcaagctggaactggacttcaactactgcgagggcacgaccgtcgtgatcaccgagaactgcgggaccaggggccccagcctgcggacgaccaccgtgtccgggaagctgatccacgagtggtgctgcagaagctgcaccctgcccccgctccggtacatgggcgaggatggctgttggtacgggatggagattaggcccgtctccgagaaggaggagaacatggtcaagagcttggtgtcggccggcagcggaaaggttgacaacttcacgatgggcgtgctgtgcctcgccatcctgttcgaggaagtgatgagggggaagttcggcaagaagcacatgatcgcaggggtgttcttcaccttcgtgctgctcctgtccggccagattacgtggcgcgacatggcacataccctgatcatgatcggcagcaacgcatccgaccggatgggaatgggcgtgacgtacttggccctgatcgccaccttcaagatccagccattcctggcgcttgggttcttcctacgcaagctgaccagccgggagaacctcctgctgggcgtcggactcgccatggccacaactctgcagctgcccgaggatatcgagcagatggcgaacgggatcgctctcggcctgatggcattaaagctcattacccagttcgagacctaccagctgtggaccgcccttatcagcctcacgtgctccaacaccattttcaccctgaccgtggcctggcgcacggctacccttatcctcgctggggtcagcttgctaccggtatgccagtccagctccatgcggaagaccgactggctccccatgaccgtggccgccatgggtgttccgcccctgcctctattcattttcagcctaaaggataccctgaaacgaagaagttggcccctgaacgagggcgtgatggctgtgggcctcgtcagcatactggcctcatcactactccggaatgacgtgcccatggcgggccccctggtggcaggaggcctcctcattgcctgctacgtgatcaccgggacctccgcggacctaaccgtggagaaggccgcagatgtgacgtgggaggaggaggccgagcagaccggcgtcagccacaatctgatgatcaccgtggacgatgacgggaccatgcgcatcaaggatgacgagaccgagaacatactcaccgtcctgctgaagaccgccctcctgatcgtctccggtatcttcccgtacagcatccccgccaccctgctcgtatggcacacctggcataagcagacgcagcggtcgggcgtgccatgggacgtccccagccctccggagacccagaaggccgagttagaggagggggtgtacagaatcaagcagcagggaatcttcgggaagacccaggtgggcgtcggagtgcagaaagagggcgtatttcactccatgtggcacgtcacccggggcgcggtgctgacctacaacgggaagcgcctcgagccaaactgggccagcgtaaagaaggacctgatctcctacggaggaggctggcggctaagcgcccagtggcagaagggggaggaggtccaggtgatcgccgtggagcccggaaagaaccccaagaatttccagaccatgcccgggaccttccaaaccacgactggggagattggagcgatcgccctcgacttcaagccaggcaccagcggctccccgatcatcaaccgcgaaggcaaggttgttgggctgtacggaaacggggtggtcaccaagaatggcgggtacgtgagcggcatcgcgcagacgaacgccgagcccgacggccccaccccagagcttgaggaggagatgttcaaaaagcggaacctgaccatcatggatttgcacccggggtccggcaagacccgcaagtacctgcccgccatcgtgcgggaggcgataaagcgccggctgcgcacgctcatcctggcccccactcgggtcgtggccgccgagatggaggaggccctgaaggggctccctatccgctaccagaccaccgcgaccaagtctgagcacaccggccgggagatcgtggacctgatgtgtcacgcgacgtttacgatgcgcctgctctccccggtccgtgtgcccaattacaacctgattattatggatgaggcacacttcacggaccctgccagcatcgccgcgcgcgggtacatctccacccgggtgggcatgggcgaggccgcagccatctttatgaccgcgactccacccggcacggctgacgccttcccccaaagcaacgcccccatacaagacgaagagcgcgacatccccgagcgctcctggaacagcggcaacgagtggataacggacttcgccgggaagacggtatggttcgtgccctccatcaaggcgggcaacgacatcgccaactgcctgcggaagaacgggaaaaaggtgatccagctcagcaggaaaaccttcgacacggagtaccaaaagaccaagctgaacgactgggacttcgtcgtgaccactgatatctccgagatgggcgccaacttcaaggccgaccgggtgatagaccctcgccggtgccttaaacccgtaattctcacggatggccccgagcgcgtgatactggccgggccgatgcccgttaccgcggccagtgccgcccagcggcgcggccgggtcgggcgtaacccccagaaagagaacgaccagtacatcttcaccggccagcccctgaacaacgacgaggaccacgctcactggaccgaggccaagatgctcctggacaacatcaacacccctgaggggatcatccccgctctgttcgagcccgagagggagaagtccgccgccatagacggcgagtaccgcctcaagggagaatctcggaaaacgttcgtagagctgatgcgccgcggggatctgcccgtctggctcgcgcataaagtggcctccgagggcatcaagtacaccgatcgcaaatggtgcttcgacggccagcggaacaaccagatcttggaggagaacatggacgtggagatctggaccaaggagggcgagaagaagaagctgcgcccgcggtggctcgacgcccgcacctacagcgaccccctggcccttaaggagttcaaggactttgccgcgggccgcaagtccattgccctcgacctggtcactgagatagggcgcgtgccctcacacctggcccacaggacccggaacgccctcgacaacctggtgatgctccacactagcgaacatggtgggaaggcctatcgccacgcggtcgaggaactcccggagaccatggagacgctgctgctcctgggcctaatgatcctcctgaccggcggcgccatgctgttcctcatatccggcaaggggatcggaaagaccagcatcgggctgatctgcgtaatcgccagtagcggcatgctgtggatggccgagatccccctccaatggatagcctccgcgattgtgttagagttcttcatgatggtcctgctcatacctgaacccgagaagcaacggacgccgcaggacaaccagcttgcatacgttgtgatcgggatcctcacgctcgccgccatcatcgctgcgaacgagatggggctgcttgagacaaccaagcgcgacctgggcatgagcaaggagcccggggtcgtgagtcccactagctacttggacgtggacctgcaccccgcgtccgcctggacgctatacgccgtcgccaccaccgtaatcacacccatgctgcgtcatacgatcgaaaacagcaccgccaacgtgtcgttagccgcaatcgccaaccaggccgtcgtgcttatgggcctggacaaggggtggcccatcagcaagatggatctgggcgttcccttactggccttggggtgctactcccaggtcaaccccctcaccctgaccgccgccgtgctgctcctgatcacgcactacgccatcatcggcccgggcctgcaggcgaaggccacccgcgaagcccagaagcgaaccgcggccgggatcatgaagaaccccaccgtggacggcatcatgacgatcgacctcgaccccgtcatttacgacagcaagttcgagaagcagctgggccaagtgatgctgctggtgctgtgcgcggtccaactgctcctgatgcgcacctcctgggctctgtgcgaagccctcaccttggccaccggccccatcacgaccctgtgggaaggtagcccagggaaattctggaacaccaccatcgcggtgtccatggcaaacatcttccggggctcgtacctcgccggagccggcctggccttcagcatcatgaaatccgttgggactggcaaacgcggcaccgggagccagggcgagacgctgggggagaagtggaagaaaaagctaaaccaactgtcccgcaaggagttcgacctctacaagaagtctggcataaccgaggtcgaccgcaccgaggcaaaagaagggttgaagagaggcgagatcacgcaccacgccgtgtccaggggcagcgccaagctgcagtggttcgtggagcggaacatggtcatccccgaggggcgcgtcatcgacctgggctgcgggaggggcggttggtcctactattgcgccggcctcaaaaaggtgacggaggtccgcggctatacaaaggggggtcccgggcacgaggagcccgttccaatgtctacctacggctggaacatcgtgaagttaatgtctgggaaggacgtattctacctgccgcccgagaagtgcgacacgctcctgtgcgacattggcgagagctcaccaagcccgaccgtggaggagtcccggactatccgcgtgctgaaaatggtcgaaccctggctgaaaaacaatcagttctgcatcaaggtgctcaacccgtacatgcccaccgtgatcgagcacctggagcgcctgcagcggaaacacggtgggatgctcgtcaggaatccgttatcacggaactcgacgcacgagatgtactggatatcaaatggcaccgggaacatcgtggcgtcagtgaacatggtaagccgcctgctcctgaaccggttcaccatgacacaccgcagacccacgatcgagaaggacgtagacctgggtgcgggcacccgccatgtgaacgccgagcccgagacacccaacatggacgtcatcggtgagaggatcaagcgcatcaaggaggagcacaacagtacttggcactacgacgacgagaacccctacaagacgtgggcctaccatggcagttacgaggtcaaagccaccgggtccgcgagcagtatgatcaatggagtcgtgaagcttctgacaaagccctgggatgtagtccccatggtcacccagatggcgatgacggacaccaccccgttcggacagcagagggtgttcaaggagaaggtcgacacccgcactccccgcagtatgcctggcaccagacgggttatgggcatcacagcggagtggttgtggcgcaccctcgggcgaaataagaaaccccgcctgtgcacgcgtgaggaattcacaaagaaggtgcgcactaacgccgccatgggtgcagtcttcaccgaggagaaccagtgggatagcgccaaggccgctgtggaggacgaagacttttggaagctggttgaccgcgagcgggagctccacaagctggggaagtgcggctcctgcgtgtacaacatgatgggcaaacgcgagaagaagctgggcgagtttggcaaagcaaagggtagcagagcgatctggtacatgtggctcggcgctcgatacctggagttcgaggccttagggttcctcaatgaggatcactggttctcccgggagaacagctactcaggcgtagagggcgagggcctgcacaaactgggctacatcctccgagacatcagcaagatcccaggcggggccatgtacgccgatgacactgcggggtgggatacccgcatcacggaggacgacctgcacaacgaggagaagatcacccagcagatggaccccgagcaccgccagctagccaatgcgatcttcaagctcacgtaccaaaataaggtggtcaaggtacagcgccccacccccaccggtaccgtcatggacatcatctcccgcaaggaccagcgcgggagcgggcaggtcggcacctacgggctaaacacgtttaccaacatggaggcccagctgatacgccaaatggagggagagggggtgctctccaaggccgacctggagaacccccatctccccgagaagaagatcacccagtggctcgagaccaagggcgtggagcggctgaagcgcatggcgatcagcggcgacgactgcgtcgtaaagcccatcgatgaccggttcgctaacgccttgctcgccttaaacgacatggggaaagtgcgcaaggacatcccccagtggcagccgtccaagggttggcatgattggcagcaggtacctttctgcagccaccacttccatgaactaatcatgaaggacggccggaaactcgtggtgccctgtcgcccccaagacgaactgatcggccgtgcccgcatctcccagggggctggctggagcctgcgggagactgcctgtctcggcaaggcctatgcccaaatgtggtccctgatgtacttccaccgccgcgacctgcggctcgcatcaaacgctatctgctccgcggtcccggtgcactgggtgcctacgagccgtaccacctggagtatccacgcccaccaccagtggatgacgaccgaggatatgctgaccgtatggaaccgggtgtggatcgaagataacccctggatggaggacaagaccccagtgaccacctgggagaacgtcccatacctggggaagcgcgaggatcagtggtgcggctcactcatagggctgaccagccgggccacctgggcgcaaaacatcccaacggccatccaacaagtccgctccctgattggcaacgaagagttccttgactatatgccaagcatgaagcggttccgcaaggaggaggagtctgagggggccatctggtga

SEQ ID NO: 25955 - RNA, 9876 nt, synthetic construct
  misc_feature 1..9876: note = derived and/or modified CDS sequence (opt11) from DENV-3__EU687233__SS-prME
  source 1..9876: mol_type = other RNA
acctcgctctgcctcatgatgatactgcctgctgccctggccttccatctcaccagccgggacggggaacccaggatgattgtggggaagaatgagcgcggcaagtctctgctattcaagacggccagcgggatcaatatgtgcaccctcatcgccatggacctgggcgagatgtgcgacgacaccgtgacctataagtgcccacacatcgccgaggtggagcctgaggacatcgactgttggtgcaacctgaccagcacctgggtgacctacgggacgtgcaaccaggccggcgagcaccggcgcgacaagcgaagtgtcgcgctcgcaccccacgttggcatgggactagacactcgcacccagacctggatgagcgccgagggagcctggcgccaggtggagaaggtcgagacctgggcgcttcgccacccggggttcacgatcctcgccctgttcttagcccactacatcggcacctccctcacgcagaaggtcgttatcttcatattactcatgcttgtcacccctagcatgaccatgcggtgtgtgggggtgggcaaccgcgacttcgtcgagggcctgtccggcgccacctgggtggacgtggttctggagcacggcgggtgcgtaaccacgatggccaagaacaagccgacgctcgacatcgagttacagaagactgaagcgacccaactggccaccctccggaagctgtgcatcgagggtaagattacgaacattacaaccgattcgcgctgtccgacccagggcgaagcggttctgccggaggagcaggaccagaactacgtctgcaaacatacgtatgtggaccgggggtggggcaacgggtgcggcctcttcggcaagggctccctcgtgacctgtgccaagttccagtgcctggagccaattgagggcaaagtcgtacagtacgagaacctcaaatacaccgtgatcatcaccgtgcacacgggggaccagcaccaagtgggtaacgaaacgcagggggtcaccgcggagatcacgccccaggcaagcacgaccgaggccatcttgcccgagtacggcaccctgggtctcgagtgctccccgcgcaccggcctggacttcaacgaaatgatcctgctcacgatgaagaacaaggcctggatggtgcaccggcagtggtttttcgacctgcccctcccttggacctccggcgccacaaccgagacccccacgtggaaccgaaaggagctcctggtgaccttcaagaacgcccacgcgaagaagcaagaagtcgtggtgctgggatcccaggagggcgccatgcacaccgccctcacaggggcgacggagatccagaatagcggcgggacctccattttcgccggccacctgaagtgccggctcaagatggacaagctcgagctgaaaggcatgagctacgcgatgtgcacgaacactttcgtcctcaagaaagaggtgtccgagacgcagcacgggaccattctcataaaagtggagtataaaggcgaggacgtgccgtgcaagatccccttcagcaccgaggatggacagggcaaggcccacaatggacgcctgatcaccgccaaccccgtggtgacgaagaaggaggagcccgtcaacatcgaggccgagcctcctttcggggagagcaatatagttatcggaattggggacaacgcgctgaagatcaactggtacaagaagggctccagcatcggtaaaatgttcgaggcaaccgcccggggtgcccgccgcatggccatcctgggggacaccgcgtgggatttcgggtccgtgggcggggtcctcaacagcctgggcaagatggtccaccagatctttgggtccgcctacaccgctctgttcagtggagtttcctgggtcatgaagatcggcatcggggtactcttaacgtggattggcttgaacagcaagaatacctcgatgtcattttcgtgcatcgccatcgggatcatcactctttaccttggcgctgtggttcaagcggacaccggctgcgttatcaactggaagggcaaggagctgaagtgcggctcagggatcttcgtgactaacgaggtccacacctggactgagcaatacaagttccaggccgactccccgaagcgcctcgccaccgcaatcgctggcgcgtgggagaacggcgtgtgcggcatccgctctaccaccaggatggagaacctgctgtggaagcagatcgcaaacgagctcaactacatcctgtgggagaacaacatcaagctgaccgtggtcgtgggggacatcatcggcgtgctagagcagggcaagcgcaccctgacgcctcagccgatggagctgaagtatagctggaagacctgggggaaggcaaagatcgtcaccgccgagacccagaacagcagcttcataatagacggccccaacacgcccgaatgccccagcgcgtcccgggcctggaacgtgtgggaggtggaggactacggattcggcgtcttcaccaccaacatctggctcaagctgcgcgaggtttacacgcagctgtgcgaccaccggcttatgagcgcggccgtcaaggacgagagggccgttcacgcagacatgggctattggatcgagagccagaaaaacggatcctggaagttagagaaggcatccctaattgaggtgaagacctgcacgtggcccaagtcccacaccctctggagcaacggggtgctggagtccgacatgatcattcccaagagccttgccgggcccatctcccagcacaactatcgtcccggctatcatactcagaccgccgggccctggcacctcgggaagctggagctggacttcaactactgcgagggcacgacggtcgtaatcaccgagaactgcgggacacggggcccatcgctccggacgaccaccgtatccgggaagctgatccacgagtggtgctgccgcagttgcaccctgcctccgctccggtacatgggcgaggacgggtgctggtatggaatggagattagacccatctccgagaaggaggaaaacatggtcaaaagcctggtgagcgccggcagcgggaaggtggacaacttcaccatgggagtcctctgcctagcgatcctgttcgaggaggtgatgcgggggaagttcggcaaaaagcacatgatagcaggggtattcttcaccttcgtcctgttactgtccggccaaatcacctggcgggacatggcccacaccctgatcatgatcggctccaacgcctcggaccggatgggcatgggtgtgacctacctcgccctgatcgcgaccttcaagatccagcctttcctagccctcgggttcttcctgcgcaagctgacctctcgggagaacctcttactgggagtgggcttggccatggctaccaccctgcagctgcccgaggacattgagcagatggcgaacgggatagcactcggcctgatggccctgaagctcatcacgcagttcgagacctaccagctgtggacagcactgattagcttgacgtgttccaacactatcttcaccctgaccgtcgcctggcggacggcgaccctgatcctcgccggtgtgagcctcctgccggtctgccagtcctcatccatgcggaagtccgactggctccccatgaccgtggctgccatgggcgtgccgcccctcccgctgttcatcttctccctcaaggacaccctgaagcgccgcagctggcccctgaacgagggggtcatggccgtagggctcgtgtcgatcctggcgagctccttgctccggaacgacgtgcccatggccggccccctggtggccggaggcctgctcatcgcgtgctacgtgatcacggggacaagcgccgacctgaccgtggagaaggcggccgacgtgacctgggaggaggaggccgagcagacgggcgtgtcccacaaccttatgattaccgtcgacgatgacgggacaatgcgcataaaggacgatgagaccgagaacatcctcaccgtgctgctcaaaacggccctcctcattgtgagcggaatcttcccgtactccatccccgccactttgttagtctggcacacctggcagaagcagacccggcgctcgggcgtgctgtgggacgtgccatccccgcccgagacgcagaaggctgagctggaggagggggtctaccggatcaagcagcagggcatcttcggtaagacccaggtgggggtcggggtccagaaggagggcgtgttccacaccatgtggcacgtaactcgcggcgccgtccttacgtacaatgggaaacggttggagcccaattgggcgagcgtgaagaaagacctcatcagttacggcgggggctggcggctcagcgcccagtggcagaagggggaggaagtacaggtgatcgcggtggagcccggcaagaaccccaagaacttccagaccatgcccggcaccttccagaccacaaccggggagataggcgctattgccctggacttcaagcccggcaccagcggctccccaatcatcaaccgggagggcaaggtggtagggctgtacggcaatggggtcgtaaccaaaaacggcgggtacgtcagtggcatcgcccagacgaacgccgagccggatggcccgacccccgagttggaagaggagatgttcaagaagcgcaacctcaccatcatggacctgcaccccgggtcaggcaagacccggaagtacttgccggccatcgtgcgcgaggcaataaagcgtcgccttcggacgctgatcctggcccccacccgcgtagtcgccgccgagatggaggaggcgctcaaaggtcttccaatccggtatcagaccactgccaccaagtctgagcacaccggccgcgagatcgtggacctgatgtgccacgccactttcaccatgcggttgctgtcccccgtgcgcgtcccgaattacaacctcatcatcatggacgaggcccacttcaccgaccccgctagcatcgcggcccgggggtacatctccaccagagtgggcatgggcgaggccgccgcgatcttcatgacggccacgccacccgggaccgcggatgcgtttccgcagagcaacgcccccatccaggacgaggagcgagacattcctgaaagatcctggaacagcggcaacgagtggattaccgactttgcgggaaagaccgtgtggttcgtacctagtatcaaggccggcaacgacatcgccaactgcctccgcaaaaacgggaagaaggtcatccagctgagccgcaagacgttcgacacggagtaccaaaagaccaagctgaacgactgggacttcgtagtcaccaccgacatctccgagatgggcgccaacttcaaggctgaccgcgtcatcgacccgcggcgctgcctcaagcccgtgatcctgaccgacggccccgaacgggtcattctggcgggacctatgccggtaacagccgccagcgctgcccaacgcaggggccgcgtggggcggaacccccagaaggagaacgaccagtacatctttaccggccagcccctaaacaacgatgaggaccatgcccactggaccgaggccaagatgctgctggacaacatcaacacgcccgagggaataatcccggcactcttcgaacccgaaagggagaagtccgccgccatcgacggcgagtaccggctgaagggggagagccgcaagacgtttgtcgagctaatgcggcgcggggacttgcccgtgtggctggcccacaaggtcgcgagcgagggcatcaagtacaccgaccggaagtggtgcttcgacgggcagcgcaacaaccagatcctggaggagaacatggacgtagagatctggaccaaggagggtgagaagaagaaactccggccccgctggctggacgcacgcacctattccgacccgctggccttaaaggagtttaaggacttcgcggcgggccggaagtccatcgccctggacctcgtgacggagatagggcgcgtaccaagccatctcgcgcaccggacccgcaacgccctggacaatctggttatgctccacacctccgagcacggcgggaaggcgtacagacacgccgtggaggagctgcccgagacgatggagacgctgctcctgctgggtctcatgatcctgctgacagggggcgccatgctattcctgatttccggtaaggggatcgggaagactagcatcgggctgatctgtgtcatcgcctcctccggcatgctctggatggccgagatcccgttgcaatggattgcgtccgccatagttctggagtttttcatgatggttctcctgatccccgagcccgagaagcagcgcacgccgcaagataaccaactagcctacgttgtgatcgggatcctcacgttagccgccatcatcgcggccaacgagatgggcctgctcgagacaaccaagcgggacctggggatgagcaaggagccgggggtggtctcccccacgagctacctggacgtggacctccaccccgcctctgcctggactctgtacgcagtggcgaccactgtcatcacccccatgctgcgccacactatcgagaacagcaccgcgaacgtgtccctagccgccatagcgaaccaagccgtcgtcctgatgggcctggacaagggatggcctatctcgaagatggacctcggcgtgcccttactggcccttgggtgctacagccaggtgaacccccttaccctgacagccgccgtcctcctactgataacgcactacgcgattataggccccggcctgcaggccaaggccacccgggaagcccagaagagaaccgccgcggggatcatgaaaaacccgacagtggacggcatcatgacgatcgatctggacccggtaatctatgacagcaagtttgagaaacagctggggcaggtaatgctcttagtgctgtgtgccgtgcagctcctgctgatgcggaccagctgggccctctgtgaggccctgaccctggcgaccggccccatcacgaccctctgggaggggtccccagggaagttctggaacaccacgatcgccgtctccatggccaacatcttccgcggctcatacctggccggagccggcctggcgttttccataatgaagtccgtgggcacgggtaagcgcggaaccgggagccagggcgagactctcggggagaagtggaagaagaagctgaaccagctgtcccgcaaggagttcgacctctacaaaaagtccggtatcacggaggtggatagaacagaggccaaggaggggctgaagcgaggcgagatcacgcatcatgcagtatcccggggctctgccaaactgcagtggttcgttgagcgaaacatggtgatcccagagggccgggtcatcgacctcggttgcggacgcggcgggtggtcctattactgcgcgggcttaaagaaggtgaccgaggtgcggggctacaccaagggcgggcccggccacgaagaacccgtccccatgagtacctacggctggaacatagtgaagctgatgtccgggaaggacgtgttctacctcccgccagagaagtgcgacacgctgttatgcgacatcggcgagagctcaccctcgcccaccgtcgaggagtccaggaccatccgcgtcctgaagatggtggagccgtggctcaagaacaaccagttctgcataaaggtcctgaatccctatatgcccactgtgatcgagcacctggagcggctccagcgcaaacacggcggaatgttagtgcggaaccccttgagccgcaactccacgcatgaaatgtactggatcagtaacggcaccgggaacattgtcgcgtccgtgaacatggtgtcgcggctcctgctgaaccgctttaccatgacccatcggcgcccgacgatagagaaggatgtcgacttaggcgcgggcacccggcacgtgaacgccgagcctgagacccccaacatggacgtaattggggagcgcattaagcggatcaaggaggaacacaactccacatggcactacgacgacgaaaacccgtacaagacgtgggcataccacggcagctatgaggtcaaggcaaccgggtccgcgagcagcatgatcaatggtgtcgtcaagttactgactaaaccctgggatgtcgtgcccatggtcacccagatggcgatgactgacaccacccccttcgggcaacaacgagtgttcaaggaaaaggtggacacccggacaccgcgctccatgcccggcacccggcgcgtaatgggcatcactgctgagtggctctggcggaccctgggacgaaacaagaagccccggctgtgcacccgcgaggagttcacgaagaaggtgcggaccaacgccgcgatgggcgccgtgttcacagaggagaaccagtgggacagcgctaaggcagccgtcgaggacgaggacttctggaagctcgtggatcgggagcgcgagttacacaagctggggaagtgcggatcctgcgtgtacaacatgatggggaagcgggagaaaaagctcggcgagttcggcaaagcgaagggaagccgcgccatctggtacatgtggctgggcgcacgttacctggagttcgaggctctcgggttcctgaacgaggaccactggttctcccgcgagaactcgtattccggcgtcgagggggaaggcctgcacaagctcggctacatcctgcgggatattagcaagatccccgggggcgccatgtacgcagacgacacggcgggttgggacacgcgcatcaccgaggacgacctgcataacgaagaaaagatcacccagcagatggacccggagcaccggcagctcgccaacgctatcttcaaactgacgtaccagaacaaggtggtgaaggtccagagacccacgcccaccggcaccgtgatggacatcatctccaggaaggaccagcgcggaagcggacaggtgggtacttacggcctgaacacgtgtcactccaacatggaggcccagctcatcaggcaaatggaaggcgagggcgtcctatccaaagcggacctcgagaatccccacctctctgagaagaaaattacccagtggctggagactaagggcgtagaacgtctgaaacggatggccattagcggcgacgactgcgtggtcaagcccattgacgaccgcttcgcgaatgcactcttggccttaaacgacatgggaaaagtccggaaggatatcccccagtggcagccctccaagggatggcacgactggcagcaggtccccttctgcagccaccatttccatgagctcatcatgaaagacgggcggaagctggtagtgccgtgccggccccaggacgaattaatcggccgcgcgcggattagtcagggggccgggtggagcctccgcgagaccgcctgcctgggcaaggcctacgcgcagatgtggagtcttatgtatttccaccgccgagacctcaggctggccagcaacgccatatgcagcgccgttcccgtccactgggtgcccacgtcacggaccacctggagcatccacgcccaccaccagtggatgacgacggaggacatgctgaccgtctggaaccgcgtctggatcgaggacaacccgtggatggaggacaagacccccgtgacgacgtgggagaacgtgccctacctcgggaagcgcgaagaccaatggtgcggctccctgatcggcctgaccagccgcgcgacctgggcccaaaacatcccaactgccatccaacaggtacggtccttgatcggcaacgaggagttcctggactacatgccgagcatgaagcgctttcggaaggaggaggagtccgagggggctatctggtga

SEQ ID NO: 25956 - RNA, 9873 nt, synthetic construct
  misc_feature 1..9873: note = derived and/or modified CDS sequence (opt11) from DENV-3__EU687234__SS-prME
  source 1..9873: mol_type = other RNA
accagtctgtgcctcatgatgattctacccgcggcgctggcattccatctcaccagccgagacggggagccccggatgattgtgggtaaaaacgaacggggcaagtccctgttgttcaagacagccagcggcatcaacatgtgcaccctcattgctatggacctgggcgaaatgtgtgatgacaccgtgacctacaagtgtccccacatcactgaggtggagcctgaggatatagactgctggtgtaacctgaccagcacgtgggtgacctacggtacgtgcaaccaggccggcgagcaccgacgcgataagcggtcagtcgccttagcgccccacgtgggaatgggattagatacccgcacccaaacctggatgagcgccgagggcgcctggaggcaggtggagaaggtggagacgtgggccctacgccatcctggcttcaccatactagcgcttttcctggcccactacatcggcacctccctcacccagaaggtggtgatcttcatcctcttgatgctcgtcacgcccagcatgacgatgcgttgcgtgggggtgggtaaccgcgacttcgtagagggactgtccggggccacctgggtcgatgtggtcctggaacacggcgggtgcgtgacaacgatggccaagaacaagccgaccctcgacatcgagctacaaaagaccgaagctacccagctagcgacgctccggaaattatgcatcgagggcaagatcactaacatcacaacggacagccgctgcccgacgcagggcgaagccgtgcttccggaggagcaggaccagaactacgtctgcaagcatacctacgttgaccgggggtggggcaacgggtgcggtcttttcggcaaggggtccctggtgacctgcgctaagttccaatgcctggagcccatagagggcaaggtcgtgcagtatgaaaacctcaaatacacggtgatcatcacggtccacacaggggaccagcaccaggtgggcaacgagacacagggggtaaccgccgagattacgccccaagccagcaccacagaggcgattttaccggagtacggtaccctggggctcgagtgctctccgcgcacgggtcttgattttaatgagatgatcctgttgacgatgaagaataaggcctggatggtacaccgacagtggttcttcgacctgcctctgccctggaccagcggcgccacgacggagacgcccacttggaaccgcaaggagctcctcgtgaccttcaagaacgcccacgccaaaaagcaggaggtcgtggttctggggtcccaagagggcgcgatgcacaccgccctaacgggtgcaaccgaaatacagaacagcggagggacctccatattcgccggccatttaaagtgccggctgaaaatggacaagctcgagcttaagggcatgagctatgccatgtgtaccaacaccttcgtcctaaagaaggaggtatccgagactcagcacgggacaatcctcattaaagttgagtacaaaggggaggacgtcccatgtaaggtgccgttcagtaccgaggacgggcaggggaaagcacatagcggccggttgatcacggccaaccccgtagtcacgaagaaggaggagcccgtgaacatcgaggccgagccccccttcggggagagtaacatcgtgatcggcattggagacaacgccctcaagatcaactggtacaagaagggatcttcaatcgggaagatgttcgaagcaacggcccggggcgcccgacgcatggctatcctaggggacacggcctgggacttcgggagcgtgggcggggtgctcaactccctggggaagatggtgcatcaaatcttcgggagcgcgtacacggcattattcagcggggtcagctgggtgatgaaaatcggcatcggggtgctcctgacctggataggtctgaactccaagaacaccagcatgtccttcagctgtatcgtcattgggatcatcacgctttacctgggcgccgtggtgcaggcggatatggggtgcgtcatcaactggaagggaaaggagctgaagtgcggctccgggatcttcgtgacgaatgaggttcacacctggactgagcagtataagttccaggccgactccccaaaaagactcgccaccgccatcgccggtgcttgggaaaacggtgtctgcggaatacgctccaccacccggatggagaacctactttggaaacaaatcgccaacgagctcaactatatcctgtgggagaacaatatcaagctgacagtggtggtcggagatatcatcggcgttctcgagcaaggcaagcgcaccttgacacctcagccgatggagctgaagtacagctggaagacctgggggaaggcgaagatcgtgaccgctgagactcaaaattcctccttcatcatcgacgggcccaatacgcccgaatgcccctccgcctctcgggcctggaatgtatgggaggtagaagactacgggttcggcgtgttcaccaccaacatctggctcaagctgcgcgaggtttacacccaactgtgtgaccaccggctcatgagcgcggccgttaaggacgagcgcgccgtgcacgccgacatggggtactggatcgagtcccaaaagaatgggtcctggaagttagagaaagcctctctcattgaagtgaagacctgtacgtggcccaaaagtcacaccttatggtccaacggcgtgctcgagagcgacatgatcatccctaagtcgcttgctgggcccattagccagcacaactaccggccgggctaccacacacagacggctgggccgtggcatctcggtaaattggagctggattttaattactgcgagggaacaaccgtcgtcataaccgagaactgcgggacccgaggtccctcgctccggactactacggtcagcgggaagctgattcacgagtggtgctgccgcagttgcacattgcccccgctcaggtacatgggcgaggatggttgctggtacggcatggagatccgccccatctctgagaaggaggaaaatatggtgaaatccttggtcagcgccggcagcgggaaggtagataacttcacgatgggcgtgctatgcctcgccatcctgttcgaggaggtcatgcggggaaagttcggcaagaagcacatgatagccggggtgttcttcactttcgtgcttctcctgagcggccagatcacctggcgcgacatggcacacaccctgattatgatcggctcaaatgccagcgaccgaatggggatgggcgttacgtatctcgccctcatcgccacctttaagatccagccattcctagccctcggcttttttttgcgcaagctgacctcacgggagaatttgctgctgggcgtaggcttagcgatggcaaccacgctgcagctgcctgaagacatcgagcaaatggccaacggcatcgccctcggcctgatggcgctgaagctaataacccagttcgagacctaccagctgtggaccgccctgatctcgctcacgtgcagcaacacaatcttcacccttaccgtcgcctggaggactgccaccttaatcctcgccggggtctccctacttccggtctgccaaagctccagcatgcggaaaaccgactggctgcccatgaccgtcgctgccatgggagtgccgccgctcccgctgtttatcttctccttgaaagacacgctgaaaagacgctcttggcccctgaacgagggcgtgatggccgtaggcctcgtgtccatcctggcctcgtccctgctccggaacgacgtgcccatggcaggccccctggtcgccggcgggctgctcatcgcctgttacgtcattactgggaccagtgccgacctgaccgttgagaaggcggccgacgtcacttgggaggaggaggcggagcagaccggggtaagtcataacctgatgatcaccgtggacgacgatggcaccatgcgaatcaaagacgatgagaccgagaacatcctcacggtcctgctgaagactgctctcttaatcgtgagcggcatcttcccgtactccatccccgccaccttgctcgtatggcacacctggcaaaagcaaactcagcggtccggcgtcttatgggacgtgcccagcccacccgaaacccagaaggccgagctggaggaaggagtataccgtataaagcaacaaggcatattcgggaagacccaggtcggcgttggggtccagaaggagggcgtctttcatactatgtggcacgtgacgcgaggcgcagtcctcacgtacaacgggaagagactggagccgaattgggcgagtgtcaagaaggatctgatctcctacggcgggggatggcggctcagcgcccaatggcagaaaggggaagaggtccaggtcattgcagtagagccaggcaagaaccccaagaactttcagaccatgcccgggactttccaaacgaccacgggggagatcggcgccatcgccttagatttcaagcccgggacaagtggctccccaatcatcaatcgagagggaaaggttgtgggcctgtacggcaacggtgtcgtgacgaagaacggggggtatgtaagcggtattgcccagacgaacgctgaaccggacgggccgacccccgagttggaggaggagatgttcaaaaaacgaaacctcacgatcatggaccttcaccccgggagcgggaagacgaggaagtacctgccggccatcgtccgggaagctatcaagcgccgcctccgcaccctaatcttggcacccacccgggttgtggccgccgagatggaggaggcgctcaaggggctaccaatccgctaccagaccactgctaccaagagcgaacacaccggccgggaaattgtagacctgatgtgccacgctactttcacgatgcgcctcctgtccccggtacgggtgccgaactacaacctgatcatcatggacgaggctcacttcaccgaccccgctagcattgccgcccgcgggtacatctccacacgcgttggcatgggcgaggcagctgctatcttcatgacggctacgccgcccgggaccgcggacgccttcccgcagtccaatgcacccatccaagacgaagagcgcgacatccccgagaggtcgtggaatagcggcaatgaatggatcacagacttcgcagggaagaccgtgtggttcgtgccctccatcaaggccggcaacgacatagcgaactgcctgcgtaagaacgggaagaaggtcatccagcttagtcgaaagacgttcgacaccgagtatcagaaaaccaagctgaacgactgggacttcgtggtgacaaccgacatttctgaaatgggagcaaacttcaaggcagatagagtcatagacccgcgcagatgcctcaagcccgtaatcctgacggacggccccgagcgcgtgatactggcggggcccatgccggtcaccgccgcgtctgcggcccagcggcggggccgggtgggtaggaacccccagaaggagaacgatcaatacatcttcaccggccagcccctcaacaacgacgaggaccacgcccactggaccgaggcaaaaatgcttctggataatatcaacacgcctgagggtatcatcccggccttattcgagcccgagcgggaaaagtccgccgccatcgacggagagtaccgcttgaaaggggagagccggaagacgttcgttgagctgatgcgcagaggggacctccccgtgtggctggctcataaggtggcatccgagggcataaagtacaccgaccgcaagtggtgcttcgacgggcagagaaataaccagatcctggaggaaaacatggacgtggagatctggaccaaggagggcgaaaagaaaaagctccgcccccggtggttggacgcgcgcacgtactcggatccgctggcgctcaaagagttcaaggactttgctgccggccgaaagtccatagccttggatctggttaccgagatcggacgcgtgcccagccatctcgcccatcgcacccgaaacgcgctggataacctggtcatgctccacaccagcgagcacggcgggcgcgcctaccggcacgccgtcgaggagctgcccgagacgatggagacccttctactgctcggcctcatgatcctgctaaccgggggcgcgatgctgttcttaatatctgggaaggggatcggcaagaccagcataggactgatttgtgtgatcgcctccagcgggatgctctggatggcagagatccctttgcagtggatcgcatcggccatcgtcctcgaattcttcatgatggtgttactgatccccgaacccgagaagcagcgtaccccccaggacaaccagctggcgtacgtggtcataggaatcctcaccttagcagccatcatcgccgctaacgagatggggctactggagactaccaagcgggacctgggcatgagcaaggaaccgggcgtggtgtcccctacgagttacctggatgtcgaccttcaccccgcgagtgcctggacgctgtacgcagtcgcgaccaccgtgatcacacccatgctgcgccacaccatagaaaacagcaccgccaacgttagcctcgccgccatagccaaccaggccgtggtgctgatgggcttagacaagggctggccgattagcaagatggacttgggcgtgcccctgctggcgctagggtgctactcccaggtaaaccccctaaccctgacggccgcggtgctcctgcttatcacccactacgccatcatcggacccggactccaggcgaaagcgacccgggaggcccagaagagaaccgcagctgggatcatgaagaaccctacagtcgacggcatcatgaccatcgacctagaccccgttatttacgactcgaagtttgagaagcagcttggccaggtgatgctcctggttctatgtgcagtgcagctcctcctgatgcggacatcatgggcactgtgcgaggccttaaccttagcaacgggccccatcaccacactgtgggaaggaagccccgggaagttctggaataccactatcgcagtgtccatggcgaacatcttcaggggtagctacctggcaggcgccgggttagccttctccataatgaagtccgttggcacaggcaagcggggcaccggcagccaaggcgagacgctcggggaaaagtggaagaagaagctgaaccagctgtcccgcaaggagttcgacctgtataagaaatctggcataactgaggtggaccgaactgaagccaaggaggggctgaaaaggggcgagattacccaccacgcggtgtcccgtgggagcgcgaagttgcagtggttcgtcgagcgcaacatggtgatcccggaaggccgtgtgatcgacctcggctgtgggcgaggcggctggtcctattactgcgcaggcctaaagaaggtcaccgaggttcggggctataccaagggcggccccggacacgaggagccggtgcccatgtctacgtacggctggaacatcgtcaaactgatgtccgggaaggacgtgttctacttgcctccggaaaagtgcgacaccctgctgtgtgacataggggagtcctcccccagccccacggttgaggagtccagaaccatccgcgtcctgaaaatggtcgaaccgtggctcaagaacaaccagttctgcatcaaggtgctaaatccctatatgcccacggtcatagagcatctggagcggctccaacgcaagcacggcggcatgttggtgcggaaccccctgagcagaaactccacccacgagatgtactggataagcaacggaactggaaatatcgtggcttccgtcaacatggtgagccggctcctgctaaacaggttcaccatgacgcatcggagaccgactatcgaaaaggacgtcgacttgggcgccggcactcggcacgtgaacgcggagcccgagacgcccaacatggacgtaatcggcgaacgcatcaagcgcatcaaggaggagcacaactctacgtggcactacgacgatgagaatccgtacaagacctgggcctaccatggcagctacgaggtgaaggcgacggggtctgccagcagcatgatcaacggagtggtgaagctgctgaccaagccgtgggatgtagtacccatggtgacacagatggcaatgaccgacaccacacccttcgggcagcagcgggtcttcaaagagaaggtcgatacgcggacccctagatccatgccgggcacccgacgcgtgatgggcatcaccgcagagtggctctggcggacgctggggcgcaacaagaaaccgaggttgtgcactagagaggagttcaccaagaaagtccgcacaaacgctgccatgggcgcagtgttcaccgaggagaaccagtgggacagcgcgaaggccgccgttgaggacgaggacttctggatccttgtcgatagagaacgcgagctgcacaaactggggaagtgtggttcctgcgtgtacaacatgatgggaaagcgggagaagaagctcggggagttcggcaaggcgaagggtagccgcgcgatctggtatatgtggctgggcgcccggtacctggagtttgaagccctcgggttcctgaacgaggatcattggttctcccgcgagaacagctactccggagtggagggggagggcctgcacaagctcggctatatattgagggacatctctaagatccctgggggcgcgatgtacgccgacgacaccgcgggctgggataccagaatcaccgaggacgacctccacaatgaggagaagatcacccagcagatggacccagagcaccggcagctcgcctccgctatctttaagttaacctaccagaataaagtcgtgaaggtgcagcgccccaccccgaccggcaccgttatggatatcatctcacgtaaagaccagcgggggtccggccaggtgggcacgtacgggttaaacaccttcaccaacatggaggcacaactgatccggcaaatggagggggagggggtgctgagcaaggctgatctggaaaacccgcacctcccggagaaaaagatcactcagtggctggaaacaaagggcgtcgagcgactgaagcgtatggctatcagtggtgacgactgcgtggtgaagccaattgatgatcgtttcgcgaacgccctcctggccctgaacgacatggggaaggttcggaaagatatccctcagtggcagccgagcaagggctggcacgattggcaacaggtgccgttctgctcccaccacttccatgagttgatcatgaaggatgggcgaaaactggttgttccctgtcggccccaggatgaactgatcggacgggcacggattagccaaggggcgggctggtctcttcgcgagaccgcgtgcctgggcaaagcgtatgctcagatgtggagtctcatgtacttccaccgccgggatctcagactggccagtaatgcgatctgttcagctgtgcccgtgcactgggttcctaccagccggaccacctggtccatccacgctcaccatcagtggatgacaaccgaggacatgctcacagtttggaaccgcgtgtggatcgaggacaacccatggatggaagacaagacgcccgtcactacctgggagaatgtaccctacctcgggaagcgggaagatcagtggtgcggcagcctgatcgggctgacctcacgcgccacgtgggcccagaacatcccgacagcgatccagcaagtccgtagcctcataggtaatgaggaatttctggactacatgccttccatgaaacgcttcagaaaagaagaggagagcgaaggggcgatctggtga

SEQ ID NO: 25957 - RNA, 9873 nt, synthetic construct
  misc_feature 1..9873: note = derived and/or modified CDS sequence (opt11) from DENV-3__EU687196__SS-prME
  source 1..9873: mol_type = other RNA
accagcctctgcctcatgatgattctgcccgccgccctggcgttccacctcaccagccgggacggcgagccccgaatgatagtggggaaaaacgaacgcggcaaaagtctgctgttcaagacggcctccgggatcaacatgtgcaccttaatcgccatggaccttggggagatgtgtgacgacaccgtgacctacaagtgcccccacattacagaggtggaacccgaagatattgactgctggtgcaacttgacctcgacctgggttacttacggaacttgcaaccaggcgggcgagcaccggcgcgacaagcggtcggtggccctcgcgccccacgtgggcatggggctggacaccaggacacagacctggatgtcggccgagggcgcctggcggcaggtcgagaaagtggagacgtgggccctgcgccatccgggcttcaccatactcgcgctgtttctggcgcactatatcgggacttccttgacacagaaggtggtgatcttcatcctgctgatgctcgtgacgcccagcatgactatgcggtgcgttggggtgggaaaccgggatttcgtcgagggcctgtccggggccacgtgggtggacgtggtcctggaacatggcgggtgcgtcaccacgatggccaagaacaagcccactctcgacatcgagctacagaagaccgaggccacccagctggcgaccctgagaaagctctgcatagagggcaagatcaccaacatcaccaccgacagccgctgccccacacagggcgaggctgtgctgccggaagaacaggaccagaactatgtttgcaaacacacctacgtggaccggggttggggcaacgggtgcggactcttcggaaaggggtccctggtgacttgtgcgaaattccagtgcctggagcccattgagggcaaagtcgtgcagtacgagaacttgaagtacaccgtgatcatcacggtccacactggggaccagcaccaggtgggcaacgagacgcagggggtcacggccgagatcacgccgcaggccagtacgaccgaggcgatcttacctgagtacggcaccctcgggctagaatgctcacctcgaaccggcctggatttcaatgaaatgatcctgctcacgatgaaaaacaaggcttggatggtgcaccggcaatggttcttcgatctccccctgccctggaccagcggagccaccaccgagacgcccacctggaatcgcaaggagctcctggtgaccttcaagaacgcccacgccaagaagcaggaggtcgtggtgctggggtcccaggagggcgcgatgcacaccgccctcacgggggcaaccgaaatccagaacagcggcgggacgtcaatctttgccggccacctgaagtgcagactgaagatggacaagctcgagctgaagggcatgagctacgcaatgtgtaccaacacgttcgtactcaagaaggaggtgtccgagacccagcacggtacgatcctcatcaaggtggaatacaagggcgaggacgtcccgtgcaagattcccttctcaaccgaggatgggcagggaaaagcgcacaacggccggctgatcacggcaaatcctgtggtgaccaagaaagaagaacccgtcaacatagaagccgagccgccgtttggggagtcgaatattgttataggcattggggataacgccctgaaaatcaactggtataagaagggatcttctatcgggaagatgttcgaggcgaccgcccggggcgcacgcagaatggccatcctgggcgataccgcctgggacttcgggtccgtgggaggggtcttgaactcactggggaaaatggtgcatcaaatcttcgggtccgcgtacacagccctgttcagtggcgtgtcctgggtgatgaaaataggcatcggcgttttgcttacttggatcggcctaaattccaaaaacacctccatgagcttttcctgtatagccatcggaatcatcactctctacctgggagcggttgtacaggcggacatggggtgtgtgatcaactggaaaggcaaggagctgaagtgcggcagcggaatcttcgtgacgaatgaggtacacacctggaccgagcaatacaagttccaggctgactcccccaagcggctcgcgaccgccatcgccggcgcctgggagaacggggtgtgcggcatacggagcacgacccggatggaaaatctgctctggaagcaaatcgctaacgagctcaactatattctgtgggagaacaacataaagttaaccgtggtcgtgggcgacaccatcggcgtgctcgagcagggcaagaggacgctgacgccccagcccatggagctgaagtactcctggaagacctggggtaaggccaagatcgtcaccgccgaaactcagaactcttccttcatcatcgacggccctaacacgcccgagtgccccagcgcctcccgggcgtggaatgtgtgggaggtggaagactacgggttcggcgtcttcactaccaacatctggctcaagctgcgggaggtctatacccagctgtgcgaccatcggctcatgagcgccgccgtgaaggacgagcgcgccgtccacgcagacatgggctattggattgagtcccagaagaacgggtcctggaagctggagaaggcgagcctaatcgaggtgaagacgtgcacatggccgaagtcccacaccctctggagtaacggcgtgctagagtccgacatgatcatccccaagagcctcgccgggcccatctctcaacataactatcggccgggctaccacacgcagacggccggcccctggcaccttggtaaactcgagctggacttcaactactgtgagggcacgaccgtcgtcataaccgagaactgcggtacgcgtggtccctcactccggaccaccacggtgtcgggaaagctgattcacgagtggtgctgccgcagctgcacgctgccacccctgcggtacatgggcgaagacggatgctggtacggaatggagatccgccccatctccgagaaggaggaaaatatggtcaaatcgctggtctccgccggcagtgggaaggtggacaacttcaccatgggagtcctgtgcctggccatcctgttcgaggaggttatgcgggggaagttcggcaaaaagcacatgatcgcgggggtgatcttcactttcgtcctgctcctgtcaggccagatcacctggcgcgacgtggctcacacgttgattatgatcggcagcaacgcctccgaccggatggggatgggggtcacctacctcgccctgatagcaaccttcaagatccagcctttccttgcgctcgggttcttcctccgcaagctgaccagccgggagaacttgctactgggagtcgggctcgctatggctacgaccctgcaactccccgaggacatcgagcagatggccaacggtatcgcgctcgggctgatggccttgaagctcaccacccagttcgagacgtatcagctctggaccgccctgataagcctgacctgctccaacaccatttttacgctcaccgtggcctggcgaaccgctacgctgatcttggcgggagtcagcctgctgcccgtgtgccaaagcagctcgatgcggaagacggactggcttcccatgaccgtggccgccatgggagtgccgcccctcccactcttcatattcagcctcaaggataccctgaaacgccggtcctggcccctgaacgagggagtcatggccgtgggtctcgttagcatcctagcctccagcctgttacgtaacgacgtgcccatggcgggacctctggtggccgggggcttactcatcgcctgttacgtcatcacgggcacttcagccgacctgaccgttgagaaggccgcggacgtgacatgggaagaggaggccgagcagacaggcgtcagccataatctgatgattactgtggacgacgacggcactatgcgcattaaggacgacgaaaccgaaaacatcttgactgtgcttttaaagaccgcccttctaatcgtctccggcatcttcccttacagcatccctgctacgctactcgtgtggcacacgtggcagaagcagacccagcggtccggggttctgtgggatgtccccagcccacccgagacgcagaaggccgagctggaggagggtgtttaccgcatcaagcagcagggcatattcggcaagacgcaagtgggcgtcggggttcagaaggagggcgtgttccacacaatgtggcacgttaccagaggggcggtgttaacgtacaacggaaagaggttagaacccaactgggcctccgtgaagaaggacctaattagctacggtgggggctggcgtttatccgctcagtggcagaagggggaggaagtccaagttatcgccgtggagcccggtaagaaccctaagaacttccaaacgatgcccggcatcttccagacaaccacgggggagatcggcgcaatcgccctggacttcaagcccgggacgagcggcagccccatcattaacagggagggaaaggtagtggggttatatggcaacggggtggtcaccaagaatggcgggtacgtatccgggatcgcccagacaaacgccgaaccggacggccccacccccgagcttgaagaggaaatgttcaagaagaggaacctcactataatggacctccaccctggtagcggcaaaacccgcaagtacctccccgccatagtgcgggaggctatcaagcgccggctccgtaccctgatcctggcccccactcgggtcgtggccgcggaaatggaggaagcactcaaggggctgcctattcgctaccaaaccacagcgaccaagtccgaacacacggggcgggaaatcgtggatctgatgtgccacgcaacgttcaccatgcgcctcctgtcgcccgtccgggtgccgaactacaacctgatcatcatggacgaggcccactttaccgaccccgcctccatcgccgcgcgcggatacattagcacccgggtgggcatgggcgaagcggccgcgatcttcatgacggccacgcccccagggaccgccgacgccttcccgcagtccaacgcccctatccaggacgaagaacgcgacatccccgagcgcagctggaactccggcaacgagtggataaccgactttgccggtaagacggtatggttcgtgccctcgatcaaggcgggcaacgacatcgccaactgcctccggaaaaacgggaagaaggtgatccagctgtcccgcaagacctttgatacagagtaccagaagaccaagctgaacgactgggacttcgtagtgacgacggatatctctgagatgggcgcgaatttcaaggcagaccgggtaatagacccgcgccggtgcctcaaacccgttatcctgacagacggcccagagcgcgtgatcttagccgggccaatgcccgtcacagcggcctccgcagcacaacgacgcggccgagttggtcgcaatccacaaaaggagaatgaccagtacatcttcacaggccagcccctcaacaacgacgaagaccacgcacactggaccgaagctaagatgttgctggacaacatcaacacccccgaagggatcattcccgccctcttcgagccggaacgggaaaagtccgccgccattgacggagagtaccgcttgaagggcgagtctcggaagaccttcgtggaactgatgcgccgcggggacctccccgtctggctggcgcacaaggtggcctcggagggtattaagtacaccgaccgaaagtggtgcttcgatgggcagcggaataaccagatcctggaggagaacatggacgtggagatctggacgaaggagggagagaagaagaaactccgcccacggtggctagacgcccgcacctactcagaccccctggccctcaaagagttcaaggacttcgccgcgggacgcaagagcatcgctctggacttagtcaccgagatcggacgcgttccctcccacctcgcccatagaacccggaacgccttggacaatctagtgatgctccacatgagcgagcacggaggcaaggcctaccgccacgcggtcgaagaactgcccgaaacgatggagaccctgctcctgctaggcctcatgatcctcttaaccgggggcgccatgctattcctgatcagcggcaaagggataggcaagacctccatcgggctgatctgcgtgatcgccagttccggcatgttgtggatggccgagatcccgctgcaatggatcgctagtgcgatcgtgctggagttcttcatgatggtcctgctgatcccagaacccgagaagcagcggacaccccaggacaaccagctcgcgtacgtggtgataggcatcctcacccttgcagccatcatcgccgcgaacgagatgggcctgctcgagaccacaaagcgcgatttgggcatgtccaaggaaccgggtgtcgtgagtcccacctcctacctggacgtggacctccaccccgccagcgcctggaccctgtacgctgtcgcgactaccgtgatcacccccatgttgcggcacactatcgagaactcaactgccaacgtcagcttagccgccatcgccaaccaagccgtcgtgctgatgggcctggacaaggggtggccgatctccaaaatggacctcggcgtcccactgctggccctcggttgttactcacaggtcaaccctctcaccttaacggccgccgtgctcctgctgatcacccactacgcgatcatcggccccggattgcaggcgaaagccacccgcgaggcccagaaacgcaccgccgccgggattatgaagaacccgacggtggacggcataatgaccatcgacctggaccccgtcatctatgactcaaagtttgagaagcagctgggccaggtgatgttgctggtgttgtgcgcggtccagctcctcctgatgcgcactagctgggccctctgcgaggccttaaccctggccaccgggccaatcaccaccctctgggagggctcccccgggaagttttggaacacgacgatcgcggtgtcaatggccaacatctttcggggctcctatctggccggggccggcctggctttcagcatcatgaagtctgtggggaccggcaagcgcggcaccggatcccagggcgagaccctcggagaaaagtggaaaaagaagctgaaccagctgagccgaaaggagttcgacctctataagaagagtggtatcacagaagtcgaccgcacggaagcgaaagaggggctgaagcgaggcgagatcacgcaccacgccgtgagccgcggctccgccaagctgcagtggttcgtggagcggaacatggtcatcccggagggtcgggtgatcgacctcggctgcgggaggggcgggtggagctactactgcgccggcttgaagaaggtgacagaagtcagaggttacaccaagggcgggcccggtcacgaagaacccgtgcctatgtccacgtacggctggaacattgtgaagctgatgagcggtaaggatgtcttctacctcccgcccgagaaatgtgacaccctgttgtgcgacatcggggagtcgagcccttccccgaccgtggaggagagtcggaccgttcgcgtcctgaagatggtcgagccttggctcaagaacaaccaattctgcatcaaggttctgaacccctacatgcccacggtcatcgagcacctggaaaggctccaacggaagcacggcggcatgttggtgcgcaaccccctatcaaggaacagcacccacgaaatgtactggatttcgaacggcaccgggaacattgtggccagcgtgaacatggtctcccggctcctgctaaatcggtttaccatgacgcacaggcgtccgaccatcgaaaaggatgtggacctcggcgcgggaacccgccatgtaaacgcagagcccgagacacccaacatggacgtgatcggggaacggatcaagcgcatcaaagaggaacacatcagcacatggcactatgacgacgagaatccgtacaagacctgggcttaccatggttcctacgaggtcaaagccaccgggagcgcaagcagtatgatcaacggagtggtgaagctgctgaccaagccctgggatgtcgtgcccatggtgacccagatggcgatgaccgataccacccccttcgggcagcagcgggtcttcaaggaaaaagtggatacgcgcactccacgcagcatgcccggcacgcgacgggtgatgggtataacggccgagtggctctggcgcacgctggggaggaacaagaagccccgtctgtgcacccgggaggagttcaccaaaaaggtccgcaccaacgccgctatgggcgcggtcttcacggaggagaaccagtgggattcggcaaaggccgccgttgaggacgaggacttctggaagctcgtcgaccgcgagcgcgagctgcacaaattagggaagtgtggcagctgtgtgtacaatatgatgggtaaacgcgagaaaaagctcggcgagtttggtaaagccaaaggatcccgggcgatctggtacatgtggctgggcgccagatacctggagttcgaggccctcgggttccttaacgaagaccactggtttagccgggagaactcatacagcggcgtggagggggagggtctgcataagctcggttacatcctgcgcgacatctccaagatccccgggggcgccatgtacgccgacgacaccgcggggtgggacacacggatcaccgaggacgacctgcacaatgaggagaagatcacgcagcaaatggatccggagcaccgccagttggccaacgcaatctttaaactgacctaccaaaacaaggtcgtaaaggtgcagcggccgacccccacaggaaccgtaatggatataatctcccgcaaagaccagaggggctccggccaagtaggcacgtacgggttgaacactttcaccaacatggaggcccagctcatccgccagatggagggcgagggtgtcctgtcgaaggccgatcttgagaacccccacttaccggagaagaagatcacccagtggctggagacgaaaggcgtcgagcggctgaagaggatggcgatctccggggacgattgcgtcgtaaagcccatcgacgaccggttcgcaaacgccctgctggccctgaacgatatggggaaggttcgcaaagacattccccagtggcagccaagcaagggctggcacgactggcagcaggtccccttctgctcccaccacttccacgaactcatcatgaaggacgggagaaagctggtggtgccatgcagaccccaggacgagctgatcggccgcgcacgcattagccagggtgcaggctggagtttccgagagaccgcctgcctcggcaaagcctatgcccaaatgtggagcctgatgtacttccatcgacgggatttacggctcgcgtccaatgccatctgcagcgccgtgcccgtgcactgggtaccgacctcccgtacaacgtggagtatacacgcgcaccaccagtggatgaccaccgaggacatgctaaccgtgtggaaccgggtgtggatcgaggacaacccctggatggaggacaagaccccggtcacaacctgggagaacgtgccctacttagggaagcgagaggaccaatggtgtggaagcctcatcgggctgacatccagagccacgtgggctcaaaacatcccaaccgccatccagcaggtccggagcctgatcggcaatgaagagtttctagactatatgccctccatgaaacggttccgcaaagaggaggagagcgagggcgccatctggtga

SEQ ID NO: 25958 - RNA, 9873 nt, synthetic construct
  misc_feature 1..9873: note = derived and/or modified CDS sequence (opt11) from DENV-3__EU854298__SS-prME
  source 1..9873: mol_type = other RNA
acctcgctatgcctaatgatgatcctgcccgccgcactagcattccacctcaccagccgggatggagagccgaggatgattgtggggaagaacgaacggggcaagtctttgctgtttaaaaccgccagcgggatcaacatgtgcaccctcattgccatggacctgggcgagatgtgcgacgacaccgtcacctacaagtgtccgcatataacggaggtcgaacccgaagacatcgactgttggtgcaacctgaccagcacatgggttacgtatgggacttgcaaccaggctggcgagcaccgaagagataaacggagtgtcgccctcgcgccccacgtgggcatggggctggacacccgcacccaaacctggatgagtgccgaaggcgcctggcgccaagttgagaaggtggagacgtgggcgctgagacacccggggtttaccattctcgctctgtttctggctcactacatcgggacctcgttaacccagaaggtcgtgatctttatcctactcatgctcgtcacgcccagcatgaccatgcggtgcgtgggggtggggaatcgcgacttcgtcgaaggcctgtccggggcgacctgggtcgacgtggtcctggagcacggcgggtgcgtcactacgatggccaagaacaagccgaccctcgatatcgagctacagaagaccgaggccacccagctggccacactccggaaattatgtatcgagggcaagataaccaacatcaccacggactcacgttgccccacccagggcgaggccgtcctaccggaagaacaggaccagaactacgtctgcaagcacacgtacgtggaccgggggtggggcaacggttgcggcctcttcgggaaagggtccctggtaacctgcgccaagtttcagtgcctggaacccatcgaggggaaggtcgtgcagtacgagaacctcaagtacacagttattatcacggtgcacacgggggaccagcaccaggtgggaaatgaaacccaaggagtcaccgctgagatcacacctcaagcgagcactaccgaggctatacttcccgagtacggcaccctagggttagagtgcagcccccgaaccggcctggatttcaatgagatgatcctcctcacaatgaagaataaagcctggatggtgcaccgtcagtggttcttcgatttacccttaccctggacatccggggccaccaccgaaacacccacctggaatcggaaggagctcctagtgactttcaaaaacgctcacgcaaagaagcaggaggtcgtggtgctggggtcccaggagggtgcgatgcacaccgcccttaccggggccaccgagatccagaactcgggcggtacctccattttcgccggccacttgaagtgtcgcctgaaaatggacaagttggagctcaaggggatgtcttacgccatgtgcaccaacacgttcgtcctgaagaaggaggtgtccgagactcagcacgggaccatcctcattaaagtggagtataagggtgaggacgtaccttgcaagatccctttctccacggaggacggacaggggaaggcgcacaacggccgcctgatcacagccaaccccgtggtgaccaagaaagaggaacccgtcaacatcgaggctgaaccaccctttggtgagagcaacattgtgatcggcatcggcgacaacgcccttaagatcaactggtacaagaagggctccagtatcgggaagatgttcgaggcgacagcccggggcgcacgccggatggcgatcctgggggacacagcctgggattttgggtctgtgggaggggtattgaactctctgggcaagatggtgcatcagatcttcggctccgcgtacacggccttatttagcggtgtttcctgggtcatgaagatcggtataggggtcctccttacctggataggattgaacagcaagaacacatccatgagcttctcctgcatcgccattggtatcataaccctatacctaggcgctgtggtacaagccgatatggggtgcgttatcaattggaaggggaaagagcttaagtgcggcagcgggatctttgtcaccaacgaagtgcacacctggactgagcagtacaagtttcaggcggattcccctaagcgcctagctaccgctatagccggcgcctgggagaacggtgtgtgcggcatccgcagcacgacacggatggagaacctgctttggaaacaaatcgcgaatgagctcaactatattctttgggagaacaatatcaagttaacggtcgtagtgggtgacataatcggtgtgctcgaacagggcaaaagaaccctgacgccacagccaatggagctgaagtactcctggaagacatgggggaaggcgaagatcgtcaccgccgagacccagaactcgtcatttatcatagacgggcctaacacgcctgaatgcccgaacgcaagccgggcgtggaacgtttgggaggtcgaggactacgggttcggcgtgttcactacaaacatctggctcaaattgcgcgaggtgcacacccagttgtgcgatcaccggcttatgtccgccgccgtgaaggacgagcgcgccgtccacgccgacatgggctactggatcgagagccagaagaacgggagctggaagctcgagaaggcttccctgatcgaggtcaaaacctgcacgtggccaaagtcccacaccctgtggagtaatggcgtgctggagtccgacatgatcatccccaagtctctggcgggtcccatatctcagcataactaccgtccgggctaccatacccagaccgccgggccctggcatttgggcaagctggagctggatttcaactattgcgaaggcacgaccgtcgtaattaccgagaactgcgggactcgcggcccttccttacggacgacaaccgtgagcggcaagctgatccatgagtggtgctgtcgctcctgcactctgccacccctacggtacatgggcgaggacggctgttggtatggcatggagataaggcctatatctgagaaggaggagaacatggtcaagtccctggtaagcgccggctcggggaaagtggacaacttcacgatgggcgtcctttgccttgcgatactgttcgaggaggtgatgagggggaagtttggcaagaagcacatgattgcgggagtgttctttaccttcgtcctactcttgagcggccagatcacctggcgcgacatggcccacactctaataatgatcggctccaacgctagcgataggatgggaatgggcgtgacgtacctggccctgatcgcaaccttcaagatccagcccttcctggcgctcgggttcttcctgcgcaaactgacctcccgcgagaacttattgctgggagtaggcctcgccatggccaccaccctgcagctgcccgaagacatcgaacagatggccaacgggatcgccttaggcctgatggctcttaagctcatcacccagttcgaaacctaccagctgtggacggccctgatctctctcacgtgctcgaacaccatcttcactctaaccgtagcttggcgcaccgctacccttatactcgcaggggtgtcccttctcccggtctgccagagcagtagcatgcggaagacggactggctccccatgaccgttgctgcaatgggcgtgcctcccctcccgctgttcatcttttccttaaaggacacgttaaagcgccgcagctggccccttaacgagggcgttatggccgttggccttgtctccatcctcgcatcttctttgctccggaacgacgtcccaatggctggccccctggtggccgggggcctgctaattgcctgctacgtgatcaccgggaccagcgccgatctgaccgtggagaaggccgcggatgtgacgtgggaggaggaggccgagcaaaccggggtatcccacaacttaatgatcaccgtcgacgacgatgggaccatgcgaataaaggacgacgagaccgagaacatcctcacggtgctgctgaagactgcccttttaatcgtgagcggcattttcccgtactccattcctgccaccctgctcgtctggcatacctggcagaagcaaacacagagatcaggcgtgttatgggacgtgccctcgccgcccgaaacccagaaggccgagttggaggaaggggtctatcgcatcaagcaacaagggatcttcgggaagacccaggtgggcgtgggggtccagaaagagggcgtcttccacaccatgtggcacgtgacgcgaggcgcggttctcgcctacaacgggaagcgacttgagcctaattgggcttccgtgaagaaggaccttatctcctacggcggagggtggcggctcagcgctcaatggcagaaaggggaggaggttcaggtcatcgccgtggagccaggaaagaaccccaagaacttccagaccatacctggaacctttcagaccactaccggggagataggggccatcgctctggacttcaagcctgggacctccggctctcccattatcaaccgcgagggtaaggtggtcggtctgtatggcaatggggtggtgaccaagaatggcgggtacgtctctggcatcgcacagacgaacgccgagccggacggtccgacccccgaactggaggaagaaatgtttaaaaagcgtaacctaaccatcatggacctgcaccccgggtccggcaagacccgcaaatacctgccggcgatcgtgcgggaggcaatcaagcggcggctccgcacgctgattttagcgccaacgcgagtcgttgcagccgagatggaagaggctctaaaggggctgcctatccgctaccagacaaccgccaccaagagcgagcacactggccgggagatcgttgatctgatgtgccacgccacatttactatgcgcttgctgtcccccgtgcgagttccgaactacaaccttatcattatggacgaggcccacttcacggaccccgcgagcatcgccgcccgcgggtacatttccacccgtgtgggcatgggcgaggccgcggcgattttcatgaccgccactccacctggaacggcggacgccttcccccaatccaacgctcccatccaggacgaggagcgagacatccccgagcgcagctggaatagcggcaacgagtggatcaccgacttcgcggggaagaccgtgtggttcgtcccttccatcaaagcaggaaacgacatagctaactgtctccggaagaacgggaagaaggtgatccagctgagtcgaaagaccttcgatacggaatatcagaagacgaagctcaacgactgggatttcgtggtcaccaccgacatatcagagatgggcgccaacttcaaagcagatcgggtcatcgacccgcggcgttgtctcaaaccggtgatcctgacggacggacccgagcgggtcatccttgcggggcctatgccagtaaccgctgccagcgccgctcagcgccgcggcagagtggggcgcaacccacagaaagagaacgaccagtacatcttcaccgggcagcctctaaacaacgacgaggaccatgctcactggacggaagccaagatgctgctggataatatcaacactcccgaagggatcatcccggcactcttcgagcccgagcgggagaaaagcgcggcgatcgacggcgagtaccggctgaagggcgagtcacggaaaacgttcgtagagctgatgcgcagaggggatctccccgtgtggctggcccacaaggtcgcctccgaggggatcaaatacaccgaccgcaagtggtgcttcgacgggcagcggaacaaccagatcctggaagaaaacatggacgtcgagatttggaccaaggagggggagcgcaagaagctacgcccccgctggttggacgctaggacctacagcgaccccctggcgctcaaggagttcaaagactttgcggccggtcggaagtccattgccctcgacctggtcactgaaatcgggcgagtacccagccatctcgcgcaccggacccgcaacgcgctggataatctggtgatgctccacacctcggagcacggcggtaaagcgtaccggcacgcagtggaggagctcccggagaccatggagacactgctcctcttaggtctcatgatactgctgaccggcggtgccatgttatttctcataagcgggaaggggatcggaaagaccagcatcgggttgatctgcgtcatcgcctccagcggcatgctctggatggccgagatccctctgcaatggatcgcgtccgcgattgttctggagtttttcatgatggtcctactgatccccgagcccgagaaacagcgcacgccccaggacaaccagctggcatacgtcgtaattggaatcctcacgctggccgccatcattgcggcgaacgagatgggattactcgagaccaccaagcgggacctgggcatgtcgaaggagcccggggtcgtcagtcccacgagctacctggacgtggacctccaccccgccagcgcctggacgctctacgcggtggctacgacggttataacacccatgctgagacacacaatcgagaactccacggccaatgtgtccctcgccgctatcgcgaaccaggccgtggtcctgatgggcctggacaaaggctggccgataagcaagatggacctcggggtaccgctgctggccctcggttgctactcccaggtcaaccctttgactctgaccgctgccgttcttttactcatcacgcattacgccatcatcggccccggcctccaagccaaggccacccgcgaagcacaaaagcgcaccgcagcggggataatgaagaacccgaccgttgacggtatcatgacaatcgatctggaccccgtgatctacgacagcaagtttgagaaacagctgggccaggtgatgctcttggtactttgcgccgtgcaactccttctgatgagaacgtcctgggccctctgcgaggccctgaccctggctacaggccctatcacgaccctctgggagggctctcccggcaagttctggaacactactatcgccgtatccatggccaacatcttccgcggctcctacttagcaggggccggcctggcattctccattatgaagtccgttgggaccggcaagcggggcaccgggtcccagggtgaaacccttggcgagaagtggaagaagaagctgaaccagctaagccgcaaggagttcgatctctacaagaagagtggaatcacagaggttgaccggacagaggccaaggaggggcttaagcgcggcgagatcacgcatcacgctgtctcacggggcagcgccaagctacagtggttcgtggagcgcaacatggtcataccggaggggcgggtcattgacttgggctgcggacgcggcgggtggtcctactactgtgctggcctgaagaaggtgaccgaggttcggggctacaccaagggagggcccggccatgaggagcccgtccccatgtcgacctacggttggaacattgtgaagctgatgtccgggaaggacgtgttctacctcccgcccgagaagtgcgacacgcttctgtgcgacatcggcgaaagctccccctcgcccaccgtcgaagagagccgaaccatccgcgtgttgaagatggtggagccgtggctcaaaaacaaccagttctgcatcaaggtactgaacccctacatgccgaccgtgatagagcacctggaaaggctccaaagaaagcatggcgggatgcttgtacggaaccccctgtcgcggaactcgacgcacgagatgtactggatcagcaacggcaccgggaacatcgtcgcttccgtgaatatggtgtcccggctcttactgaatcgcttcaccatgacccaccgtcgcccgactatagagaaggacgtcgacctcggcgcaggcacccggcatgtaaacgccgaacccgagacccccaacatggacgtgatcggggagagaatcaagcgaataaaagaggagcacaactccacgtggcactacgatgatgagaacccatataagacttgggcctatcacgggagctacgaggtcaaggccacagggtccgcgtcatccatgatcaacggcgtggtcaagttactgaccaagccgtgggacgtggtgccaatggtaacccaaatggccatgacggatactactcccttcgggcagcagcgcgtgttcaaggagaaggtggacacacggaccccgcgctctatgccgggcacccggcgggtgatgggcatcaccgccgagtggctctggcgaaccctggggcgcaacaagaagccccgcttgtgtacacgcgaagagttcaccaagaaggtacgcaccaacgccgcgatgggcgccgtgttcacagaggagaaccaatgggacagtgctaaggccgcagtcgaggacgaagacttctggaaactggtagaccgcgagcgcgagctgcacaagctggggaagtgcggctcctgcgtgtacaacatgatggggaagcgggagaaaaagctcggcgagttcggcaaagcgaaggggagccgtgccatctggtatatgtggctgggcgccaggtacctggagttcgaagccctcggcttcctgaatgaggaccactggttctcccgcgagaactcctactctggtgtcgagggcgaaggcctgcacaagctaggctacatcctgagagatatcagcaagatccccggtggagccatgtatgcggacgatacggcggggtgggacacgagaatcaccgaggacgacctgcataacgaggagaaaatcacccagcaaatggacccggagcaccggcagcttgccaacgccatcttcaagctgacgtatcagaacaaggtggtgaaggtacagcgccccacccccaccggtaccgtgatggatatcatctcccggaaagaccagagaggcagcgggcaagtgggcacatacggcctgaatactttcaccaacatggaagtccaactcattcgtcagatggagggcgagggggtgctgtcgaaggctgacttggagaatccccacctcccggagaagaagatcacccagtggttagagaccaagggcgtagagcgcctgaagcggatggcgatcagtggcgatgactgcgttgtaaagccaatcgacgatcgctttgccaatgccctgctggccctgaatgacatggggaaggtgcggaaagatatcccacagtggcagccctccaagggatggcacgactggcaacaggtcccattctgcagccatcactttcacgagctcatcatgaaggacgggcgcaaacttgttgtgccctgccggccccaggatgagttaatcggccgcgcccggatttcccagggcgctggctggtcattgcgcgagaccgcgtgcctaggcaaagcctacgcccagatgtggtccctgatgtacttccaccgccgtgacctccgtttggcgagtaatgcaatttgttctgcggtcccagtccactgggtaccgacaagcaggaccacctggtccatccacgcccatcaccagtggatgaccaccgaagacatgctgacggtctggaaccgcgtgtggatcgaggacaatccctggatggaggacaaaactcctgtgacaacctgggagaacgtcccctacctcgggaaacgggaggaccaatggtgcggcagcctcatagggctaaccagtcgggccacctgggcgcagaatatcccaacggccatccaccaggtccggtcgttgatcggcaacgaagagtttctggactacatgcctagtatgaagcgcttccggaaggaagaggaactggagggtgccatctggtag

SEQ ID NO: 25959 - RNA, 9873 nt, synthetic construct
  misc_feature 1..9873: note = derived and/or modified CDS sequence (opt11) from DENV-3__FJ373306__SS-prME
  source 1..9873: mol_type = other RNA
accagcctgtgcctcatgatgattctgcccgctgcgctggcgttccatttgaccagccgggacggcgagcctaggatgatcgtggggaaaaacgagcgcggcaagagcctgctgtttaagactgctagcggtataaacatgtgtaccctaatcgccatggacctgggcgagatgtgcgacgacacggtgacctacaagtgcccacacatcacggaggtggagcccgaggacattgactgctggtgcaacctgaccagtacctgggtgacgtacggtacttgcaaccaggccggggagcatcggcgcgacaagcggtctgtcgctctcgcgccgcatgtcggcatggggctggacacccgcacccagacgtggatgtcggccgagggcgcctggcggcaggttgagaaagtcgagacgtgggccctgaggcatccggggttcacgattcttgcgctgttcctggcccactatgtgggcaccagtctcacccaaaaggtggtcatttttatactgctcatgctcgttacgcccagcatgaccatgcggtgcgttggggtgggaaacagagacttcgtggagggtctgtccggcgcgacctgggtcgacgtcgtcctggagcacggcgggtgcgtgaccactatggccaagaacaaaccaaccctcgacatcgagttgcagaagacagaggcaacccagctggctacgctacgcaaactgtgcatcgaaggcaagatcacgaatatcaccaccgacagccgctgtccaacgcagggtgaagcggtcctgcctgaggagcaggaccagaattacgtgtgtaagcacacctacgtggaccgggggtggggcaacgggtgcggattattcgggaagggctccctggtgacctgtgccaagttccaatgcctggagcccatcgagggcaaggtggttcagtacgagaacctcaaatacacggtcatcatcacggtgcacacgggggatcagcaccaggttggcaatgaaactcagggggtgacggcagagattacgcctcaggcatcgactaccgaggccatcttacccgagtacgggaccctggggctcgagtgcagtccccgcaccggcctcgacttcaacgagatgattctgctcacgatgaaaaacaaggcatggatggtgcaccggcagtggtttttcgacctgcccctgccctggaccagcggcgccactaccgagacgcccacctggaaccgcaaggagttactggtcacattcaagaacgcccacgccaagaagcaggaggtggttgtgctagggtctcaggagggcgcgatgcacacagccctcacgggtgccaccgagatccagaacagcggcgggacttcaattttcgccggccacctgaagtgccggctgaagatggataaacttgagctgaagggcatgtcatatgccatgtgcactaataccttcgtgctgaagaaagaggtgtccgagacccagcacggtaccatcctcatcaaggtcgagtataaaggcgaggacgtgccgtgtaaagttcccttctcaaccgaagacgggcagggcaaggcgcacaacggccgcctgatcacagccaacccagtcgtgaccaagaaggaggagcccgtgaacatcgaagccgagccgcccttcggggaaagcaacatcgtcatcggaattggggacaacgcccttaagatcaactggtacaagaagggctcgagcatcgggaaaatgttcgaggccacggcccggggcgcccgccggatggccattctgggtgacacagcctgggatttcgggtcggtcggcggggtgttaaactcactcggcaaaatggtccaccagatcttcgggtcggcgtacacggccctattcagcggtgtctcctgggtcatgaagatcgggatcggggtcctcctgacatggatcggcctcaacagcaagaatacatccatgtctttctcctgcatcgtgatcgggataatcaccctttacctaggcgctgtggtgcaagctgacatgggctgtgtcattaattggaagggcaaggagctgaagtgcggtagcgggatcttcgtgaccaacgaggttcacacctggacagagcagtacaagttccaggcggactcgccgaagcgcctcgcgaccgccatcgccggagcctgggagaatggggtttgcggaatccgctcaacgactcggatggagaacttactgtggaagcagatagcaaatgagctcaactacatcctgtgggagaacaatatcaagttgaccgtcgtcgtgggagacattatcggcgtgctcgagcaaggcaagagaaccctgaccccacagccaatggagcttaaatacagctggaagacgtggggaaaagccaaaatcgtcaccgcagagacccagaactcatcatttatcatcgacggacccaatactcccgagtgccccagcgcttctcgggcttggaacgtgtgggaggtagaagactacgggttcggcgtcttcagcactaacatttggctcaagctgcgcgaggtctacacccaactgtgtgaccacagattaatgtctgcggcggtaaaggacgaacgcgccgttcacgccgatatgggctactggatagagagtcagaaaaacgggtcatggaaactggagaaggcctcactgatcgaagtaaagacctgcacctggcccaagtctcacacgctctggtccaatggcgttctggagagtgacatgatcatacccaaatccctggcggggcctatctcacaacacaactaccggccaggttaccacacgcaaaccgccgggccatggcacctcggcaagctcgagctggactttaattactgtgagggcacaacggtcgtgattaccgagaactgcgggacccgcggccctagtctccggactacgaccgtcagcggtaagctgatccacgagtggtgctgtcgctcctgcaccctgcccccgctccggtacatgggcgaggacgggtgttggtacggcatggaaatccgccccataagcgagaaggaggagaacatggtcaagtcactggtgtcggccgggtccgggaaagtagacaactttaccatgggtgtcctgtgcctagccatcctgtttgaggaggtgatgcgggggaagtttggcaagaagcatatgatcgccggcgtgttcttcacattcgtcctgctcctgagcggccagataacctggcgcgacatggcgcacactctgatcatgatcggctccaacgccagcgaccggatggggatgggagtgacttatctcgcactgattgcaacgttcaagatccagcccttcctggccctcgggttcttcctgcgcaaactgacaagccgggagaacctcctcctgggcgtcggcctcgcgatggccaccaccctgcagctgcccgaggatatcgagcaaatggccaacgggatcgccctcggactaatggcgctaaagctcatcacgcagttcgagacataccagctgtggaccgctctgatctccctgacttgcagcaacacgatattcaccctgaccgttgcctggcgcaccgccacgctgatcctcgccggcgtgtccctcctacctgtatgccagagctccagcatgcggaagacggactggctccccatgaccgttgcggcaatgggcgtgccacccctcccactttttatcttctccttaaaggacaccctcaaacgccgcagctggcccctgaatgagggggtcatggccgtgggcctcgtgtccatcttggcctcgtccctgctacggaacgatgtcccaatggccggccccctagtggccggagggctgctgattgcctgttacgttatcacggggaccagcgcagacctgaccgtcgagaaggccgccgacgtgacctgggaggaggaggcagaacagacgggggtaagccacaacctgatgatcactgtagatgacgacgggaccatgcgcatcaaggacgacgagaccgagaacatcctcaccgtgctgttaaaaacggccttgctgatcgtgagcggcatcttcccctatagcatccccgccaccctgctcgtctggcacacctggcagaagcagacccagcggagcggcgtgctgtgggacgtcccaagcccgcccgagacgcagaaagccgagctggaggagggggtctaccgaatcaaacagcaaggcatcttcgggaagacccaggtcggcgtgggggtccagaaggagggcgtgttccacaccatgtggcacgtcaccaggggcgccgtccttacgtacaacggcaagcggctggagcccaactgggcgagcgtgaagaaggacctgatctcctacgggggagggtggcggttgagcgcccagtggcagaaaggagaggaggtgcaggtcatcgccgtggagcctggtaagaaccccaagaacttccagaccatgccagggaccttccaaaccaccaccggtgagatcggcgccatcgcgctggacttcaagcccggtaccagcggctcccccataataaaccgcgaagggaaggtcgtcggtctgtacggtaacggggtggtgactaaaaacggcgggtacgtgagcggcattgcgcagaccaacgcagagccggatggccccactcccgagctcgaggaagaaatgttcaagaagcgaaacttaaccatcatggacctgcaccccggatcgggcaagacgcgcaaatatctgccggccattgtgcgggaggctatcaagcgccggctccgcacactgatcctggcgcccacccgggtggtcgccgccgagatggaggaggccctcaaagggctgcccatccgctaccagacgaccgccaccaagtcggagcacacaggccgcgagatcgtcgacctgatgtgccacgcgaccttcactatgcgcctcctgtcccctgtgcgagtcccgaactacaatctgatcatcatggatgaggctcacttcacggaccccgcaagcatcgccgcacgcgggtacatctccacccgggtgggcatgggtgaggcagccgccatcttcatgactgccacgccgcccgggactgcggacgccttcccgcagagcaacgcccccatccaggacgaagaacgcgacatccccgagcgcagttggaacagcggcaatgagtggataacggacttcgccgggaagactgtgtggttcgtcccgtccatcaaggccggcaacgacatcgcgaactgcctccggaagaacggaaagaaggtgatccagctcagccggaagaccttcgacacagaataccagaagactaagctgaacgactgggacttcgtggtcactaccgacatctccgagatgggcgccaacttcaaagccgatagggtgatcgacccgcgccggtgcctaaagcctgtcatcctgacggacggccccgagcgcgttatcctggcaggccccatgccggtgacggccgcgagcgcagcccaacggcgcggtcgggtagggcgcaatccccaaaaggagaacgaccagtacatattcaccggacaacctctcaacaacgacgaggatcacgcacactggactgaggccaagatgctgcttgataacatcaacacgcccgaggggatcatccctgccctcttcgagccggagcgggagaagtccgccgccatcgatggcgagtaccgcctgaagggcgagagccggaagacgttcgtggagctgatgcgcaggggagacttgcccgtctggctggcgcacaaggtcgcttcggagggaattaagtatacagaccgcaagtggtgctttgatgggcagcggaacaaccagatcctggaagagaacatggacgtggagatctggacgaaggagggcgagaagaagaagctccgcccccggtggctggacgccaggacctattctgatccgctagccttaaaggagttcaaggatttcgccgcgggccgcaagtccatcgcgcttgatctggtaactgagatcggccgggtccccagccacctcgcccaccggacccggaatgccttagacaacctggtgatgctccacaccagcgagcacggcggtaaggcctaccgccacgctgtagaggagctgccagaaaccatggagacgctgctcctgctggggctcatgatcctgttaaccgggggcgcgatgttgttcctgatatccggcaaggggatcggcaagaccagcatcgggctgatctgcgtcatcgcctccagcggcatgttgtggatggccgaaatcccgctccagtggatagcgagcgcaatcgtgctggagtttttcatgatggtgctcctgatacccgagcccgagaagcagcggacgccccaggacaaccagcttgcgtacgtcgtgatcgggatcctcaccctggccgcgatcatcgccgcgaacgagatgggactactcgagaccaccaagcgcgacttggggatgagcaaggagccgggggtggtctcccccacctcgtacttagacgtcgatctccaccccgcgtccgcctggacgttatacgccgtggccaccaccgtcatcacccccatgctgcggcacacgattgagaacagcaccgcgaacgtgtccctcgccgccattgccaaccaggccgtggtactgatgggcctggacaaggggtggccgatcagcaaaatggacctgggcgtgcccctgcttgcgttaggatgctactcccaggtaaaccccctgaccctaaccgcagccgtccttctcctgatcacgcactacgccattatcggtcccgggctccaggccaaggcgaccagggaggcccagaagcggaccgccgccggcatcatgaaaaaccctaccgtggacggcatcatgacgatcgacttagaccctgtgatctacgacagcaagttcgagaaacagttgggacaggtcatgctacttgtgctgtgcgctgtgcagctccttctgatgcgaacttcctgggcgctttgcgaggccttaacccttgccaccggacccatcacgacgctctgggagggcagccccgggaagttctggaacaccaccatcgccgtgagcatggccaacatcttcaggggctcgtacctggccggagccggtctggccttcagtatcatgaagtccgtggggacgggcaagcgcggcaccgggtcccagggcgagacgctcggggaaaagtggaagaagaagctgaaccagctatcccggaaggagttcgacctctacaagaagtccggcatcaccgaggtggatagaaccgaagcaaaggaggggctgaagcggggcgagatcacgcaccacgctgtgtcacgcggcagcgccaaactgcagtggttcgtggaacggaacatggtgattcccgaagggcgggtgatcgatctcggctgcgggcggggcgggtggtcctactactgcgcaggtctgaagaaggtcaccgaagtgcgcggctacaccaagggcggccccgggcatgaggagcccgtccccatgagtacgtacggttggaatatcgtgaaactgatgtccgggaaggacgtgttttacctcccgcctgagaaatgtgacacgctgctatgcgacatcggcgagagctcccccagccctaccgtcgaggagtccaggaccatccgcgtgctgaagatggtcgagccgtggctcaaaaacaaccaattctgtataaaggtattaaatccctacatgcccaccgtgatcgagcacctggagcgcctccaacggaagcacggcgggatgctggtgcggaacccactcagccgcaactccacgcacgagatgtattggatcagcaacggaactggaaacatcgtcgcatccgtgaacatggtgagtcgcctcctgctcaaccggtttacgatgacacaccgccggccgacgatcgagaaggacgttgacctcggggccggcacccgccacgtgaacgcggagcccgagacccccaacatggacgtcatcggggagcgcataaagcgaatcaaggaagaacataattccacctggcattacgacgacgagaacccatacaagacctgggcataccacgggagctacgaggtgaaggcaaccgggtccgctagctcgatgatcaacggggtggtcaagctactgactaagccctgggatgtggtacccatggtgactcaaatggccatgactgacaccaccccgttcgggcagcaacgggtgttcaaggaaaaggtggacacgcgcacgccgcggtccatgccgggcacccgccgagtgatggggatcaccgcggagtggctatggcgcacgctgggccggaacaagaaacccaggctgtgcacgcgtgaagagttcaccaagaaggtgcggaccaacgccgccatgggcgccgtgttcaccgaggagaaccagtgggactctgcaaaggcagccgtcgaggacgaggacttctggatcctcgtcgacagagagcgggaactgcacaagctggggaaatgcggttcctgcgtctataacatgatggggaagcgcgagaagaaacttggcgagttcgggaaggccaaggggagccgagctatttggtacatgtggctgggcgcgcgatacctggagttcgaagccctcgggttcctaaatgaagaccactggttctccagagagaacagctactcaggcgtggagggggagggactgcacaagctcggatacatcctgagggacatcagcaagatcccaggtggcgccatgtacgccgacgacacagccgggtgggatactcggatcaccgaggacgacctgcacaacgaagagaagatcacccagcagatggatccggagcacagacagctggcgaacgcaatcttcaaacttacctatcaaaataaggtggtgaaggtccagcggcccacccccaccggcaccgtgatggacataatctcccgcaaagaccagcggggtagcggacaggtgggcacctacgggctgaacacgtttaccaatatggaggcccaactcatccgccagatggagggcgagggggtcctgtccaaggccgacctggagaacccccacctcccggagaagaagattacccagtggctagagacgaagggtgtggaacgcctgaaacggatggccatcagcggcgacgactgcgtcgtgaagccgatcgatgaccggttcgcaaacgccctcctggccctgaacgacatgggtaaggtgcgcaaggacatcccccagtggcaaccgtcaaaaggctggcacgactggcagcaagtcccattctgtagccaccactttcacgagttgattatgaaggacgggcggaagctagtcgtgccctgccgcccgcaagacgagctgataggccgggccagaatctcccagggggcgggctggagcctccgggagacagcgtgtctgggcaaggcttacgcccagatgtggtccctaatgtacttccaccgccgtgacctccggctggccagcaacgcgatctgctccgccgtgcccgtacactgggtgcccacctcccgcaccacctggagcatccacgcccaccaccagtggatgacgacagaggacatgctgaccgtttggaaccgggtatggatcgaagacaacccctggatggaggacaagacccctgtgacgacctgggagaacgtgccctacttagggaagcgcgaggaccagtggtgcggctctctgatcgggctcacctccagggctacctgggctcagaacataccgacggcgatccagcaggtccgctcccttatcggcaacgaagagtttctggactacatgcccagcatgaagagattccgcaaggaggaggagtccgagggggccatctggtga

SEQ ID NO: 25960 - RNA, 9873 nt, synthetic construct
  misc_feature 1..9873: note = derived and/or modified CDS sequence (opt11) from DENV-3__EU687197__SS-prME
  source 1..9873: mol_type = other RNA
accagcctgtgtctaatgatgatcctgcccgccgccctggcgttccacctcaccagcagggacggggaaccgcggatgatagtcggcaagaacgagcgcgggaagtctctgctgttcaagaccgcgtctgggattaacatgtgcaccctcatcgccatggacttaggcgagatgtgcgacgacaccgtgacatacaagtgcccccacatcacggaggtggagcccgaggacatcgattgctggtgcaacctgaccagcacctgggtgacctacgggacgtgcaatcaagccggcgagcaccggcgagacaagcggtccgtcgccctcgctccccacgtcggcatgggcctggatacccgcacccagacctggatgagcgccgagggcgcctggcggcaggttgagaaggtcgagacttgggccctacgccatccggggttcacgatactcgcgctgttcctggcccactacatcggcacctccctcacccaaaaggtcgtgatcttcatcctgctaatgctcgtcactccctccatgacgatgcggtgcgtgggggtaggcaaccgcgacttcgtcgagggcctgtccggggccacctgggtagacgtggtattggagcacggcggatgcgtgaccacgatggccaaaaacaaacccaccctcgacatcgagctgcagaagaccgaagccacgcagctggcgacgctcagaaagctgtgcatcgagggcaagatcaccaatatcaccaccgacagtcgctgccccacgcagggcgaggccgtgctgccggaggagcaagaccagaactacgtctgcaagcacacctacgtggaccgggggtggggcaacgggtgcggcctcttcggtaaaggctccctggtgacctgcgcaaagtttcagtgcctggagcccattgagggcaaggtcgtgcagtacgagaacctaaagtacaccgtgataataacggtgcacaccggggaccagcaccaggtgggcaacgagacacagggagtcactgccgagatcacgccccaggccagcaccaccgaggcgatcctgcccgagtacggcaccctggggctcgagtgctcccctagaaccggcctggacttcaacgagatgatcctgctaacgatgaagaacaaggcctggatggtacaccggcagtggttttttgacctgcccctgccctggacaagcggagccaccacggagacgcccacctggaaccgcaaggagctcctggtgactttcaagaacgcccacgccaagaagcaggaggtcgtggtgctggggtctcaggagggagcgatgcataccgccctcacgggggccaccgagatccagaacagcggcgggaccagtattttcgccggccacctgaaatgccggctgaaaatggacaagctcgagttgaaggggatgagttacgccatgtgcaccaacacgttcgtcctgaagaaggaggtgtccgagacccagcatgggacaatcctcatcaaggtggagtacaagggcgaggacgtaccgtgcaaaatccccttctccaccgaggacggacagggcaaggcgcacaacggccgcctgatcacggccaaccccgtggtgaccaaaaaggaagagcccgtaaacatcgaggccgagcctcctttcggggagtcgaacatcgttatcggcatcggggacaacgccctgaagatcaactggtataaaaagggctcctccatagggaagatgttcgaggcgactgcccggggcgcccgcaggatggccatcctgggcgacaccgcctgggacttcgggtccgtgggcggggtcctcaacagccttggaaagatggtacaccagatcttcgggtccgcgtacacagccctgtttagcggcgtgagctgggtcatgaagatcggcatcggagtgctcctcacctggataggactgaactccaagaacacctcaatgagcttctcctgcatcgccatcggtataattacgctctacctgggagccgtggtccaggccgacatggggtgtgtggtaaactggaagggaaaggagctgaagtgcggcagcgggatattcgtaacgaacgaggtgcacacctggaccgagcagtacaagttccaagcggactcccctaagagactcgccaccgccatcgccggcgcctgggagaacggggtgtgcggcatccggagcacgacccggatggagaatctgctgtggaagcagattgcgaacgagctcaattacatcctgtgggagaacaacatcaagcttaccgtcgtggtcggtgacatcatcggtgtactcgaacagggcaagcgcacgctgacgccccagccgatggagctgaagtactcctggaagacctgggggaaagccaagatcgtgaccgcagagacacagaacagctcctttatcatagacggccccaacacgcccgagtgccctaacgccagccgtgcgtggaatgtgtgggaggttgaggactacgggttcggagtgttcactaccaatatttggttaaaactgcgcgaggtctacacccagctgtgcgaccaccggctaatgtccgccgccgtcaaggacgagcgcgccgtgcacgccgacatgggctactggatcgagagccagaagaacggcagctggaagttagagaaggcgtccctgattgaggtgaagacctgcacgtggcccaaatcccacactctttggtctaacggcgtcctagagagcgacatgatcatccccaagtcccttgcagggcccatcagccagcataattatcggccgggctaccatacccagaccgccggcccatggcacctgggtaagctagagctggacttcaactactgcgagggcacgaccgtggtaatcaccgagaactgcgggaccagaggcccttccctccggacgaccaccgtcagcgggaaactgatccacgagtggtgctgccgctcatgtaccctgccgccgctccggtacatgggcgaggacgggtgctggtacggcatggagatacgccccattagcgagaaggaagagaacatggtgaaatccctggtgagtgccggctccggaaaggtcgacaacttcacgatgggcgtcctgtgcctcgccattctattcgaggaggtaatgcgggggaagtttggcaagaaacacatgatcgcgggggtgttcttcaccttcgtgctgctcctgagtggccagatcacctggcgcgacatggctcacacgctgatcatgatcggcagtaacgctagcgacagaatggggatgggcgtgacgtacctcgcgctgatcgccacattcaagatacaacccttcctggcgctcgggttcttcctgcgcaagctgacctcccgggagaaccttttgctgggagtcgggcttgccatggccacaacgctccagctgccagaggacatcgagcagatggccaacgggatcgcgctcggcttgatggccctgaagttgatcacccagttcgagacctaccagctgtggactgccctgatcagcctcacgtgtagcaacaccatcttcaccttaaccgtggcctggcgcacggccaccctgattttggcgggggttagtctgctgccggtgtgccagagctcgagcatgcgcaaaaccgattggcttccaatgaccgtggccgctatgggcgttccgccgttgccactgttcatcttctccctcaaggacacgctgaagcgccgcagctggcccctgaacgagggggtgatggcggtgggcctcgtctccatccttgcatcctccctgctccggaacgacgtgcccatggctggccccctcgtggccgggggcctgctcatcgcctgctacgtcatcaccgggaccagcgccgacctgaccgtggagaaggccgcggacgtcacgtgggaagaggaagccgagcagaccggcgtctcccacaacctgatgatcaccgtggacgacgacgggaccatgcgcatcaaggacgacgagaccgagaacatcctcacggtgctgctgaagaccgcattgctgattgtcagcggcatcttcccatactctatccccgccaccctgctcgtgtggcacacctggcagaagcagacgcagcggagcggcgtgctgtgggacgtccccagcccgcccgagacccagaaggccgagttggaagagggggtctataggatcaaacagcaggggatcttcgggaagacacaggtgggcgtcggggtacagaaggagggcgtattccacaccatgtggcatgtcacgcggggcgcggtgctcgcctacaacggcaagcgcctggagcccaattgggccagcgtgaagaaggacttgatctcatacggcgggggctggaggctcagcgcacagtggcagaagggggaggaggtacaagtgatcgcggtcgagcccggcaagaaccccaagaacttccagaccatgcccggcacgtttcagacaacgacgggtgaaataggcgccatagccctggactttaagcctggcacctccggaagccccatcatcaaccgcgagggcaaggtcgttgggctgtacggcaacggggtggtcaccaaaaacggagggtacgtcagcggcatcgctcagacgaatgccgagccggatggccccacgccggagctggaagaggagatgttcaagaagcggaacctcaccataatggatctgcaccccggcagtggcaaaacccggaagtacctaccggcgatcgtgcgtgaggccatcaagcgccggctgcgcacgctgatcctagctcccacacgggtcgtagccgccgaaatggaggaggcgctcaaagggctccccatccgctaccagaccaccgcaaccaagagcgagcacacggggagggagatcgtggacttaatgtgccacgccaccttcaccatgcgcctcctgtcccccgttcgggtgccgaactacaatctaataatcatggacgaggcccacttcactgaccccgccagcatcgcggcccgcgggtatatctcgacccgggtgggcatgggcgaggccgccgcgatctttatgactgcgacgccgcccgggacggccgacgccttcccgcagagcaacgcccccatacaggacgaggagcgcgacatccccgagcgctcgtggaacagcggcaacgagtggatcaccgacttcgcgggccggaccgtatggttcgtgccttccatcaaagcgggcaacgacatcgccaactgcctccgcaagaacgggaaaaaagttatccagctgagccggaagaccttcgacacggagtaccagaagaccaagctgaacgactgggacttcgtcgtcactaccgacatctccgagatgggcgccaacttcaaggccgaccgcgtgatcgacccacgtcgctgcctcaagcccgtcatactaacggacggccccgagcgggtgatcctggcggggcccatgccggttaccgccgccagtgccgcccagcgccgaggccgcgtagggcggaacccccagaaggaaaacgatcagtacatcttcaccggccagcccctcaacaacgacgaggaccacgcgcactggaccgaggccaagatgctgctggacaatatcaacacacccgaggggattatcccggccctctttgagcccgagcgcgagaagagtgccgcaatcgacggagagtaccggctgaaaggcgagagtcgcaagacgttcgtagagctgatgcggcggggagacctccccgtctggctggcacacaaggtggcctcggagggcatcaagtacaccgaccggaaatggtgctttgacggtcagaggaataatcaaatcctggaggaaaacatggacgtcgaaatctggaccaaggagggcgagcggaagaagctccgccctaggtggctagatgctcggacctatagtgacccactggccctaaaggagttcaaggacttcgcggccggccgcaaatccattgccctggacctcgtcacagagattgggcgggttccgagccacctcgcccaccgcacccggaacgctcttgataatctggtgatgctccacacctccgagcacggagggaaggcttacagacacgccgtcgaggagttacccgagaccatggagacgctgctcctgcttggcctcatgattcttctaaccgggggcgccatgctgttcctgatcagcggcaaagggatcggcaagaccagcatcgggctgatctgcgtgatagcctcctcagggatgctttggatggccgagatcccgctgcagtggatcgcgtccgcaatcgtgctggagtttttcatgatggtcctcctgatcccagagcccgagaagcagcggacgccccaggataatcaactggcttatgtggtgatagggatcctcacgctggccgccattatcgcggccaacgagatgggcttgcttgagaccaccaagcgcgacctgggcatgagcaaggagccgggggtggtgtcccccaccagctacctggatgtggacctccacccggcctccgcctggacgctgtacgcggtcgccaccaccgtaatcacccccatgctgcggcacacgatcgagaacagcaccgccaacgtgtccctcgcagccatcgcgaaccaggccgtcgtgctgatgggcctggacaagggatggccgatcagcaagatggacctaggagtgcccttgctggccctcggctgctactcccaagtcaaccccctgaccctgacagccgccgtgctcctgctgatcactcactacgcgatcatcgggcccggcctccaggccaaggccactcgggaggcacaaaaacggactgccgcggggattatgaagaaccctactgtggacggcatcatgacgatcgacctggaccccgtcatctacgatagtaagttcgagaagcagctgggccaggtgatgctcctggtgctgtgcgccgtccagctactgctgatgaggacctcctgggcactctgcgaggccctgacgcttgcgaccggccccattacgaccctctgggagggcagccctggtaagttctggaacacaactatcgctgtctccatggccaacatcttcaggggcagctacctggccggggccggccttgcgttctccatcatgaaatccgttgggacgggaaagcgcggcactgggtcccaaggcgagaccctcggggagaagtggaagaagaagctgaaccagttaagccggaaggagttcgacctctacaagaagtccggaataaccgaggtcgatcgcaccgaagctaaggagggcttgaagcggggcgagatcacgcaccacgcggtctccagaggcagcgccaagctgcaatggttcgtggagcggaatatggtcatcccggaggggcgcgtgatcgacctcggctgcgggcgcggggggtggtcctattactgcgccggcctgaaaaaagtcaccgaggtccgaggctacaccaaaggggggccagggcacgaagaaccggtgcccatgagcacgtacggatggaacatcgtgaagctgatgagtgggaaggacgtgttctacctcccgcccgagaagtgcgacaccctactgtgtgacataggcgagagctccccctcgcccaccgtggaggagtcgcgcaccatccgcgtgctgaagatggtggaaccttggctcaagaataaccagttctgcatcaaggtgctgaacccgtacatgccgacagtgatcgagcacctggagcgcctccagcgaaagcacggagggatgctggtgcgcaatcccctgagccggaattccacgcacgagatgtactggatcagcaatggcaccgggaatatcgtggcgtccgtgaacatggtctcacgcctgctgctgaacaggttcactatgactcaccgccgtccgacgatcgaaaaagacgtggatctcggcgccggcacccgccatgtgaacgctgaacccgagacacccaacatggacgtcatcggcgaacggatcaagcggatcaaagaggagcacaacagtacttggcactacgacgacgagaacccgtacaagacttgggcctatcatgggagctacgaggtcaaggccactgggtccgcgtcctccatgatcaacggcgtcgtgaagctgctgaccaagccctgggacgtagtgcccatggtgacccagatggccatgacggacaccacccccttcgggcagcagcgagtgtttaaggagaaggtcgacacccggacaccgcggagcatgcccggtacccgccgggttatgggcatcactgccgagtggctctggcgcaccctggggcggaacaagaagccccgcctgtgcacgcgcgaggagttcactaagaaggtgcggaccaacgccgcaatgggcgccgtcttcacggaggagaatcagtgggacagcgcgaaggccgccgtggaagacgaggacttctggaagctcgtcgaccgcgagcgcgagctgcacaagctgggaaagtgcggctcttgcgtctacaacatgatggggaagcgtgagaagaagctcggcgagttcggcaaggcgaaggggtctcgggccatctggtacatgtggctgggcgcccgctacctggagttcgaggctctcgggttcctgaacgaggaccactggttctcccgggagaacagctactccggcgtggagggggagggcctgcacaagctcggttatattctgcgcgacatcagcaagatcccggggggtgccatgtacgcggacgacacggccgggtgggacacccggatcaccgaggacgatctgcacaatgaggagaagatcacacagcagatggacccggagcaccgccagttagccaacgccatcttcaagctgacgtaccagaacaaggttgtgaaggtgcagcggcccacacccacgggcaccgtgatggatatcatatcccgaaaggaccagcggggcagcggccaggtcggcacctacgggcttaacactttcaccaatatggaggtgcagctcatccgccaaatggagggcgagggggtgctgtccaaggccgacctcgagaacccccacctcccagaaaagaaaatcacccagtggctggagaccaagggcgtcgagcggctgaagcgcatggcaatcagcggcgacgactgcgtggtcaagcccatcgatgatcggtttgccaacgccctcctggccctaaacgacatggggaaggtccgcaaggacatcccccagtggcagccttccaagggctggcacgactggcagcaggtcccgttctgctcgcatcacttccacgagctaatcatgaaggacgggcggaagctggtggtgccctgcagaccccaggatgagctgatcggacgggccaggatctcccaaggggcggggtggtcgctgcgcgagacggcttgcctgggtaaggcctatgcccagatgtggtccctgatgtattttcacaggcgtgacctccggctcgcgtccaacgccatctgttccgccgtgccagtgcactgggtcccgacgagcagaacgacctggtccatccacgcccaccaccagtggatgacgaccgaggacatgctgaccgtgtggaaccgggtgtggatcgaggacaacccttggatggaggataagacccccgttacgacctgggagaatgtgccctacctcgggaagcgagaggaccagtggtgcggctcgctgatcggcctgacatcccgagccacctgggcgcagaacatcccgacggccatccaccaggttcgcagtctcatcggcaacgaggagttcctggactatatgcccagcatgaagcggtttcggaaggaggaggaactggagggggccatatggtga

SEQ ID NO: 25961 - RNA, 9873 nt, synthetic construct
  misc_feature 1..9873: note = derived and/or modified CDS sequence (opt11) from DENV-3__EU687198__SS-prME
  source 1..9873: mol_type = other RNA
acctctctttgcctgatgatgatcctgccggccgcgctcgcgttccacctcacgtcccgcgatggtgagccacgcatgatcgtagggaagaatgaacgcggcaagagcctgttattcaagaccgccagtggcatcaacatgtgcaccctcatcgccatggacttaggagagatgtgtgatgacaccgtgacctataagtgccctcacatcgccgaggtggaacccgaggacattgattgctggtgcaacctgaccagcacctgggtgacctacggtacttgtaaccaggcaggcgagcaccggcgagataagcgatccgtggcgctcgcgccacacgtgggcatgggcttggacactcgcacccagacctggatgtcagccgaaggcgcctggcgacaggtcgagaaggttgagacctgggctctgcgacacccagggttcacgatcctcgccctgttcttagcacattatataggcacctcgctcactcaaaaggttgtgatttttatcctgctgatgctcgtcaccccgagcatgacgatgcggtgcgtgggggtgggcaatcgcgacttcgtcgagggtctgtcaggggccacctgggttgacgtggtcttggaacatggagggtgcgtgaccactatggcaaagaacaagcctacgctcgacattgagttgcagaaaaccgaggcgacccagctcgccacgttgcggaagctatgcattgagggcaagataacgaacatcactacagacagccgctgccctactcagggggaggcagtgctgcccgaggaacaggatcaaaactatgtgtgtaaacacacgtacgtggaccggggttggggtaatggatgcggactcttcgggaagggttccttagtgacctgcgctaaattccagtgtttagagccaatagagggcaaggtagtgcagtacgagaacttgaagtacaccgttataatcactgtacacacgggggaccagcaccaggtgggtaacgagacccagggggttaccgccgagataacaccccaagccagcacgaccgaagcgatcttgcccgaatacgggaccctggggctcgagtgctccccacgcaccggcctggattttaacgaaatgattctgctcacgatgaagaacaaagcctggatggtgcacagacagtggttctttgacttacctctgccatggacttcaggcgcgacaacggagacccccacgtggaaccgcaaagagctcctcgtgaccttcaagaacgcgcatgcgaagaagcaagaggtggtagtgttaggctctcaagaaggcgccatgcacacggccctcacgggcgccaccgagatacagaacagcggcggtacgtctatcttcgccggccacctcaaatgccggctaaagatggataaactcgagctaaaaggtatgtcctacgcgatgtgcaccaatacctttgtcttaaagaaggaggtgtccgaaacgcagcacggtaccatcctcatcaaagtggagtataagggcgaggacgtcccttgcaagatccccttcagcacagaggacggtcagggcaaagcccataacgggcggctgatcacggccaaccccgtggtgacgaagaaagaagaacccgttaacatcgaggccgagccgcctttcggggagtcgaatatcgtgatcggcgtcggcgacaacgcactgaaaatcaactggtacaagaaaggctcgtctatcggcaagatgttcgaggcgaccgcccggggcgcccgccggatggccatccttggcgacaccgcgtgggacttcggatccgttggcggggtgctgaacagcctgggcaagatggtgcaccagatctttggttcggcgtacacagcactgttttctggagtctcctgggtaatgaagataggtatcggggtgctgctaacgtggataggcctcaacagcaaaaacacctcaatgagtttctcctgcatagccatcgggatcatcactctttacctgggcgccgtagtacaggccgacaccggctgcgtgatcaattggaaagggaaggagctcaagtgtggaagcgggatcttcgtaaccaacgaggtgcacacgtggaccgagcagtataagttccaggccgactccccaaagaggttagccaccgcaattgccggcgcgtgggagaacggggtgtgtggcatccggagcacaacccgaatggaaaacctgctgtggaagcaaatcgccaacgaactcaactacatcctgtgggagaacaacataaagctgaccgttgtcgtgggggacatcatcggcgttctcgaacagggcaagcgcacgctgacaccgcaacctatggagctcaaatacagttggaagacctgggggaaagccaagatagtaaccgccgaaacccaaaacagctcctttatcatcgacggtcccaatactcccgagtgcccctcggcgtcccgggcctggaacgtttgggaggtagaggactacgggttcggcgtattcaccacaaacatctggcttaagctccgcgaagtgtacacgcagctgtgcgaccaccggctgatgagcgcagctgtcaaggacgaacgcgccgttcatgccgacatgggctactggatcgagagccagaagaatgggtcctggaagctggagaaggcctcgctgatagaagtgaagacctgcacgtggcctaagtcgcacaccctctggtcaaacggggtgctggaatccgatatgataatcccaaagagcctggcggggcccatttcccagcacaactaccggccggggtaccacactcagaccgccgggccttggcacctaggcaagctggagctcgatttcaactactgcgagggcacaacggtggtcatcacagaaaattgtgggacccgcggtccttcgctccggaccacgaccgtgtccggtaagctgatccacgagtggtgttgcaggagctgtaccctgcctccactccggtatatgggcgaggacgggtgctggtacggtatggagatacgccccatctcggagaaggaagaaaacatggtcaagagcttggtgtccgccggctcaggcaaggtggacaactttacgatgggcgtgctttgcttggcgattctgtttgaagaggtgatgcgggggaaattcggcaagaagcatatgatcgcaggcgtatttttcacctttgtgctgctcctgagtggccagatcacctggcgcgacatggctcacaccctgatcatgatcggctctaatgcttccgatagaatgggtatgggcgtgacctacctggcacttatcgccacctttaaaatacagcctttcctcgcccttggatttttcctgcggaagctgacgagccgggagaatctactactgggcgtcggcttggccatggccaccacgctgcagctgcccgaggacattgagcaaatggcgaacgggatcgccctcggtctgatggccctaaagttgataacccagtttgagacctaccagctgtggaccgcccttatcagcttgacgtgctccaacacaatcttcactcttacagtggcgtggcgtacggcgaccctgatcctcgccggggtcagcctgttaccggtctgccaatcttcatccatgagaaaatccgactggttacctatgacagtggccgccatgggggtgcctcccctccccttgttcatcttctcactcaaggacaccctcaagcgtcggtcatggccactgaatgagggggtgatggcggtgggcctcgtctccatcttggcgagcagcctgctccggaatgatgtgcccatggcgggccccttagtggccggtggcctcctcatcgcctgctacgtcatcacgggaacctcggcggacctgaccgtagagaaggctgccgatgtaacctgggaggaagaggcggaacaaacgggcgtctcccataatcttatgattactgtagacgacgatgggaccatgcgcatcaaagacgacgagacagagaacatcctcaccgtgttgctgaagacggccctcctgatcgttagcgggatcttcccgtattccatacccgccaccctgctcgtgtggcacacgtggcagaagcagacccgtcgctcaggggttctgtgggacgtgcccagtccgcctgagacccaaaaggcggagcttgaagagggtgtttacaggattaagcagcagggtatcttcgggaagacccaggttggcgtcggcgtgcagaaggagggcgttttccataccatgtggcacgtcacccgcggagccgtcctcacgtacaacgggaagaggctagaacccaactgggcctcagtgaagaaagaccttatctcatatggagggggctggcgcttgagcgcccagtggcaaaagggggaggaggtccaggtcatcgcggtagaacccggcaagaatccgaagaactttcagacaatgcccggcaccttccagaccacgaccggggagatcggcgcaatagcgctggattttaaacccggtactagcggctcgccgatcatcaaccgggagggaaaagtcgtgggtctctacggtaacggggtggtcaccaagaacggcgggtacgtgagcggtatcgcccagactaacgccgagcccgacggcccgacccccgaactagaggaggaaatgttcaagaagaggaatttgacgatcatggacctacaccccgggagtggcaagaccaggaagtacctgccggcgatcgtgcgcgaagccattaaacggcgactccggacactgatactggctcccacccgcgtcgtggctgccgagatggaggaggcgttaaagggcctgccgatcaggtaccagaccacggccaccaagtcagagcacaccggacgtgagatcgtggatctgatgtgccatgccaccttcacaatgcgtctcctgtcccccgtacgcgttccgaattacaacttgatcatcatggacgaagcccacttcacggacccggccagcatagcagcccggggatacatcagcacgcgggtgggaatgggcgaagccgctgcgatcttcatgaccgcgacgccgccgggaaccgctgacgcgtttccccagtctaacgcgcccatccaggacgaggaacgggacatccccgagcggtcctggaacagtggtaacgagtggatcaccgacttcgcgggcaagaccgtttggtttgttccctccatcaaggcgggaaacgacatagcaaattgcctcagaaagaacggaaagaaagtgattcaactgtcccggaagaccttcgacacggagtatcaaaagacccgcctcaacgattgggacttcgtcgtcaccaccgatatctccgagatgggcgccaacttcaaggccgaccgggtgattgacccgcgtaggtgcctcaagcccgtcatcttgacagacggccccgagcgagtaatattggcggggcccatgccggtgacagccgcctcggcagcccaacggcgcggccgggtcgggcgcaatccacagaaggagaacgaccaatacattttcaccggccaaccgcttaacaacgacgaagaccacgcgcactggaccgaggccaaaatgttactggacaacataaacaccccggagggtataataccggccctcttcgagcccgagagagagaagtccgccgcgatagacggggagtaccgccttaagggtgagagccggaagacatttgtggagctgatgcgccgcggggaccttccggtctggctggcccacaaggtggcctccgaaggcatcaagtacaccgaccgaaagtggtgtttcgacgggcagcggaacaaccagatcctggaggagaacatggacgtggagatttggaccaaagagggcgaaaagaagaaacttcgcccccggtggctggacgccagaacttacagcgacccgctggccctcaaagagttcaaggacttcgcggcaggccggaagagtatcgccctggatctggttactgaaatcggacgggtcccatcacatctcgcccaccgcaccaggaacgccctggacaacttggtgatgttgcacactagcgagcacggcgggaaggcgtaccggcacgcggtcgaggagctcccagagactatggagacgctgctcctattaggcctcatgatcctactgacgggaggcgcaatgcttttcctgatctccggaaaggggattggcaaaaccagcatcggtctgatctgcgtcatcgcctcctccggaatgttgtggatggccgaaatcccactgcagtggatcgcttccgcgatcgtcctggagtttttcatgatggtcctcctgattccggagcccgagaagcagcggacgccccaggacaaccagctagcctatgtcgtcatcgggatcttgactctggccgccataattgcggccaatgagatgggcttactcgagaccactaagcgggacctgggcatgagcaaagagccgggggtcgtttcgcccactagctacttggacgtagacctccaccccgcctccgcgtggacgctgtatgcggtcgccaccaccgtgatcaccccaatgctgcggcacacgatcgaaaactccacggccaatgtgtcgttagccgccatcgcgaaccaggccgtcgtgctcatggggctcgataaggggtggccgatcagcaagatggacctcggcgtgcccctgttagccctcgggtgctactcccaggtcaaccccctgacccttacagccgccgtgttactgcttataacgcattacgcgattatcgggcccggcctccaggctaaggcaacgcgtgaggctcagaagcgcaccgctgcaggcatcatgaagaaccccaccgttgatggcatcatgacaattgacctggacccagtcatctacgacagcaagttcgagaagcagctgggacaagtcatgttacttgtgctctgcgccgtccaattgctgctgatgagaacctcctgggcgctatgcgaagcgctgacgctggctaccggcccgatcacgactctatgggagggaagccccgggaagttttggaacacaaccattgccgtctccatggccaatatcttccggggcagctacctggccggggctggcctggcgttctccataatgaagtcagtgggaacgggcaagcgcggcactgggtcgcaaggcgagactttgggggagaagtggaagaagaagctgaaccagctgtcccgaaaagagttcgacctctataaaaagtccggcataaccgaggtggatcgcaccgaagccaaggaaggcctgaagaggggtgagatcacccaccacgccgtgtcgcgcggcagcgccaaacttcagtggttcgtggagcggaacatggtcatacccgaggggcgcgtgatcgacctgggctgcggtcggggcggatggtcctactattgcgccggtctgaagaaggtgacggaggtcagggggtacactaagggcgggcccgggcatgaggaacccgttcccatgtcgacatacggctggaatatcgtgaagctgatgtccgggaaggacgtgttctatctcccgcccgagaagtgtgacacgctgttatgcgacataggcgagagctcgccaagtcccacagtggaggagtcccgcaccatccgggtgctgaagatggtcgaaccctggctcaagaacaaccagttctgcataaaggtgttgaacccatacatgcccacagttatagaacacctggaacgcctccagcggaagcacggtggaatgttagtgcggaatccccttagcagaaattcaacgcacgagatgtattggatcagcaatggcacggggaacattgttgcgtccgtgaacatggtcagccgcctccttctgaacagattcaccatgactcaccgccgtcccactattgagaaagacgtagatctcggcgctggcaccagacacgtgaatgcggaacctgaaacacccaacatggacgtaattggcgaacggatcaaacgcatcaaggaggagcacaactccacctggcactacgacgatgagaacccgtacaagacttgggcttatcacggtagctacgaggtgaaggccacaggatccgcgagcagcatgatcaacggcgtcgtgaagctacttaccaagccctgggatgtggtccccatggttacccagatggccatgacggacacgaccccgtttggccaacagcgcgttttcaaagagaaggtcgacactcgcacgcctcggtccatgcccgggacccggcgggtgatgggcattacagccgagtggctgtggcgcaccctgggcaggaacaagaagccccgtctgtgtacgcgcgaagagttcacgaagaaggtacgtacaaacgccgcgatgggtgctgtcttcaccgaggagaaccagtgggacagcgccaaggcggccgtggaggacgaagatttctggaaactggtcgaccgcgagcgggaactgcacaaacttggtaagtgtggatcttgcgtctacaacatgatgggtaagcgcgagaaaaagttgggggagttcggcaaggctaaggggtcacgggccatatggtatatgtggctgggcgcccgctatctggagtttgaagccctcgggtttctgaatgaggaccactggtttagtcgagagaacagctactccggcgtggagggggagggtctgcacaagttaggctacatattgcgcgacatttcaaagatacccgggggcgcgatgtatgctgacgacaccgccgggtgggacacacggatcaccgaggacgacctacacaatgaggagaagatcactcagcaaatggaccctgagcatcgccagttggccaacgccatcttcaaactcacctaccagaacaaggttgtcaaagtgcagcggcctacccccacaggaacagttatggatatcatttcccgcaaagatcagcgggggagcgggcaggtcggtacatacgggctcaacacgtttaccaatatggaggcgcagctcatccgccagatggaaggcgagggggtgctctccaaagccgacctggagaacccccacctcagcgagaagaagatcacccaatggctggagaccaagggcgtggaacgcctaaaacgcatggccatctctggagatgattgcgtggtgaaaccaatcgacgacaggttcgctaacgccctcctggccctgaacgacatggggaaggtccgcaaagacatcccccagtggcagcccagcaagggctggcacgactggcagcaggtccccttttgcagccaccatttccacgagctcatcatgaaagacggccggaagctggtggtgccatgtcggccccaggacgaactaatcggtcgtgcgcggatcagccagggtgcgggctggagtctccgcgagaccgcatgcttaggcaaggcctacgcgcagatgtggtcactgatgtacttccaccggcgcgatctccgattggccagtaacgccatctgcagcgcggtccccgtccattgggttccgacctctagaaccacctggtcgatacacgcccaccaccagtggatgacgaccgaggatatgctgacagtttggaatagggtttggatcgaggacaacccgtggatggaggacaagacgcccgtgacgacttgggagaacgtcccctaccttggtaagcgcgaagaccaatggtgcggctccctgattgggttgaccagcagggcaacctgggcacagaacatacccactgcaatccaacaggtccgcagcttaatagggaatgaggagttcctggactatatgccttccatgaagcgctttcgcaaggaggaagagtccgagggggcaatatggtga

SEQ ID NO: 25962 - RNA, 9873 nt, synthetic construct
  misc_feature 1..9873: note = derived and/or modified CDS sequence (opt11) from DENV-3__EU726769__SS-prME
  source 1..9873: mol_type = other RNA
acaagtttgtgcctcatgatgatcttaccggcggcattagcatttcacctcacatcccgggatggcgagccccggatgatcgtaggcaaaaacgagcgaggtaaaagtcttttattcaagacggcctcagggatcaatatgtgtacgctgattgccatggacctcggtgagatgtgcgacgacaccgtgacctacaagtgcccacatattacggaagtagagcccgaagacatcgattgctggtgcaacctgacctcaacatgggtgacttacgggacgtgcaaccaagccggggagcatcggcgggacaagcggtccgttgccctcgcaccacatgtcggcatgggcctggatacacgaacccaaacgtggatgtcggccgagggagcttggcgtcaggtggagaaggtcgagacgtgggccctgcgccacccggggttcaccatcctcgcgctgttcctcgcccactacatcggcacttccttaacccaaaaagtggtgatatttatcttacttatgctcgttacgccaagcatgaccatgcggtgcgtgggggtcggcaaccgcgacttcgtcgaggggctgtccggggcgacctgggtcgatgtggtgctggagcacggaggttgcgtgaccacgatggccaaaaacaagcccaccctcgacatcgagctgcagaaaacagaagccacccagctcgctacgctccgtaagctgtgtatcgaggggaagatcaccaacataaccacggacagccgttgcccgacgcagggagaggcggtgctcccggaggaacaagaccagaactacgtctgcaagcatacctacgtggaccgggggtggggcaacgggtgtggcctattcgggaagggatccctggtgacctgcgccaaattccagtgcttggaacccatagagggcaaggtcgttcagtacgagaaccttaagtataccgttatcatcacggtccatactggtgaccagcaccaagtcgggaatgagacccagggagtcaccgccgagatcacccctcaagccagcacaaccgaggcgatcctgcccgagtatggaactctagggctcgagtgctccccgcggaccgggctggacttcaatgagatgatcctcctcacgatgaaaaacaaggcctggatggtgcatcggcagtggttcttcgacttacccctgccttggacgagcggcgccaccaccgaaacgccgacttggaaccgcaaggagctcctcgtgaccttcaaaaacgcccacgccaagaagcaggaggtcgttgtcctgggaagtcaggagggagcgatgcacaccgccttaacgggggccacggaaatccagaacagcggcggcaccagcatcttcgcaggccacctgaagtgcaggctgaagatggacaagctcgagctgaagggcatgtcttatgctatgtgcaccaacacgttcgtgctgaagaaagaggtttccgagacccagcacgggaccatcttaatcaaggtggagtacaagggcgaggacgtaccctgcaaaatacctttctcaaccgaggacgggcagggcaaggcgcataacggccgcctcatcacggccaaccccgtcgtgaccaagaaagaggagcccgtcaatattgaagctgaaccgccctttggggaaagcaacatagtgattggcatcggggacaacgccctcaagatcaattggtacaagaaaggcagttcaatcgggaagatgtttgaggccacggccagaggggcccgtcggatggcgatcctgggagacaccgcctgggacttcgggtccgtgggcggagtcctcaattctttgggtaagatggtacatcagatcttcggttccgcgtacacggctctgttcagcggcgtgagttgggtgatgaagatcggcatcggcgttctcctgacctggataggattgaacagcaagaacacctccatgagcttctcctgcatcgttattgggataatcaccttatacctaggagccgtcgtgcaggccgatatgggatgcgtgatcaattggaaaggcaaagaactgaagtgcgggagcgggattttcgtaaccaacgaggtacacacatggaccgaacagtataagtttcaagcggactcacctaagagattagcgacggctatcgccggcgcctgggagaacggagtgtgcggcatccgcagtacgacccggatggagaacctgctgtggaaacagatcgctaatgagctcaattacatactgtgggaaaacaacataaagctgaccgttgtggtgggggacatcatcggcgtcctcgagcaaggcaagagaacactgacgccgcaaccaatggagcttaagtacagctggaaaacgtgggggaaggcgaagatcgtcaccgccgaaacccaaaatagctccttcatcatagacggcccaaatactcccgagtgccccagtgcctccagggcctggaacgtgtgggaggtcgaagactatgggttcggggtgttcaccaccaatatctggctgaagctgagggaggtatatacccaactgtgtgatcacagactcatgagcgccgcggtcaaggacgagcgcgccgtgcacgcagatatgggctactggatcgagtcccagaagaacgggtcctggaaacttgagaaggcctccctgatcgaggtgaagacgtgcacgtggccaaagtctcacaccctctggtcgaacggcgtcttagagtcagacatgatcatccccaagtccctggcgggtcccatctcccaacacaattaccggccgggataccacacccaaacggccggtccctggcacctcggaaagctggaattagacttcaactactgcgaaggcacgacggtggtaatcaccgaaaactgcgggacacgcgggcccagcctccggaccaccaccgtgtccggcaagctgatacacgaatggtgctgccgcagctgcaccctgccgcccctgcggtacatgggcgaagacgggtgctggtatggcatggaaattcgcccgatctcagagaaggaggagaacatggttaagagcttggtgtccgccggcagcggaaaggtcgacaacttcacgatgggagtgctgtgcctcgccatcctgttcgaggaggtgatgcgggggaagttcggaaagaagcacatggtggccggggtgttctttacgttcgtgctgcttctgagcggccagatcacctggagagacatggcgcacaccctaatcatggtcggtagcaacgcgtcagaccggatggggatgggagttacgtatttggctctgatcgccaccttcaagatccagcccttcctggccctcgggttcttccttcgcaaactgacgtcccgggagaatctccttctgggagtagggttggccatggccacaacgttacaactgcctgaagacatcgagcaaatggccaacggcatcgcactcggcctgatggcgctcaaactcatcacccagttcgagacatatcagctgtggaccgccttaatcagcctcacatgttctaacaccatcttcacgctgaccgtggcctggcgcacggcaactcttatcctagccggtgtgtcgctgctgccggtctgccagtcatcgtccatgagaaaaaccgactggctccccatgactgtagcggctatgggggttccgcccctgccgctctttatttttagcctaaaagatacgctaaagagaagatcgtggcccctgaacgagggagtcatggctgtgggactcgtgagcatcctcgcctccagcctgttgcggaacgacgtccccatggccgggcccctcgtggccggcgggctgctaatagcttgctatgtgatcacgggaacatcggccgatctgaccgtcgaaaaagccgctgatgtgacctgggaagaagaggcggagcagactggggtgagccacaacttgatgatcactgtggacgacgacggcaccatgcgcattaaagacgacgagacggagaacatcctcaccgtgctactgaaaaccgccttgctgatcgtgtcaggcatcttcccgtactcaattcccgccacgctgctcgtctggcacacctggcagaagcagacccagcggtctggcgtgctgtgggacgtacccagcccgcccgagacacagaaggcggagctagaggagggcgtctacaggatcaaacaacaaggaatatttggcaagacccaggtgggcgtgggcgtccagaaggagggcgtgtttcacaccatgtggcacgttacgcggggagccgtcctcacttacaatggcaagcgcctggagcccaactgggcgtccgtaaagaaggacctgatctcatatggtggagggtggcgattatccgcacaatggcagaagggggaggaggtgcaggtcatcgcggtggagcccggcaagaaccccaaaaacttccagaccatgcccggcacctttcagacaaccacaggggaaatcggcgccatcgcgctggacttcaagcccggtaccagcggcagtcccatcatcaaccgcgaggggaaagtagtagggctctacggtaatggtgtcgtcacaaagaacggtggttacgtgtccggcatagcacagacgaatgccgagccggacggcccgacacccgagctggaggaggaaatgttcaaaaagcgaaacctcaccatcatggacctgcaccccgggagcggcaagacacggaagtaccttccggcaatagtgcgcgaagccattaagcgtcggctcagaacgctgatcctcgcccccacgcgggtcgtcgcagccgaaatggaggaggccctcaagggactgccaatccgttaccaaacaacggccactaagtccgaacacactggccgcgagatcgtggacctgatgtgtcacgcaacattcacgatgcggctcctgtcacccgtgcgggtcccgaactacaacctgatcattatggacgaggcccacttcaccgatccagcctctatagctgccagagggtacataagcacccgggtgggcatgggcgaggcggccgccatcttcatgactgccacacctcccggcactgcggacgcctttcctcagagcaatgcacccatccaagacgaagaacgcgacatccccgagcgcagctggaactcgggcaacgagtggatcaccgacttcgcaggtaaaactgtgtggttcgtccccagtatcaaggctggtaacgacatcgctaactgcctgaggaaaaacgggaagaaggtaatccagctgtccagaaagacttttgacaccgagtaccaaaagaccaaactgaacgactgggacttcgtggtaacaaccgacatcagcgagatgggagcaaactttaaagctgaccgggtaatcgatccgcgacggtgcctcaagcccgtgatcctgaccgacggtcccgagcgcgttattctcgccgggccaatgccggtgaccgccgcgtccgcggcacagcgccgcggcagagtcgggcgcaacccacagaaggagaatgatcagtatatatttacaggccaaccactcaacaatgacgaagaccacgcccactggaccgaggctaaaatgctgctagacaacatcaacacgcccgaggggatcataccggcattgttcgagcccgaacgggagaaatccgcagccatcgacggcgagtatcgcttaaaaggagagtcccggaaaacattcgtggagttaatgcgccgcggggacctcccggtgtggctagcccacaaggtagcaagcgagggcattaagtacacggaccgcaagtggtgctttgacgggcagcgaaataatcagatcctggaggagaacatggatgtagaaatttggaccaaggagggagagaagaagaaactgcgcccgcgctggctggacgcgcggacatactccgaccccctagcacttaaggagtttaaggatttcgccgccggccggaaaagcatcgccctggacctggtgaccgagataggcagggtcccctctcacttagctcaccgcacacggaacgccctggacaacttggtcatgctccacacaagcgagcacggagggaaggcataccgccacgccgtggaggaactgcccgagacgatggagaccctgcttctgctgggcttgatgatcctgctgactgggggtgcgatgttattccttatcagcgggaaggggatcggtaagacctccatcggtctgatctgcgtcatcgccagctccgggatgctctggatcgccgagatccccttgcagtggattgcgagcgccattgtcctggagttcttcatgatggtgttacttatcccagagcccgaaaagcagagaacgcctcaagacaaccaactagcgtacgtcgtaatcgggatccttaccctcgcagccatcatcgccgccaacgagatgggcctgctagaaaccaccaaacgcgacctgggtatgtccaaggagccgggggtggtaagccccacctcctatcttgatgttgacctccaccccgcgagcgcctggaccttatacgccgtggccaccaccgtcatcacgcccatgctgcggcataccatagagaactcaaccgcgaacgtgtcgctcgccgccatagccaaccaagccgtggtactgatgggactggacaaggggtggccgatatctaagatggatctcggcgtccccctgcttgcgctcggctgctacagccaggttaaccccctaaccctgacggcggctgtcctcctgctgattacccactacgcgatcataggcccgggactccaagccaaggcgacccgcgaggcccagaagcggaccgccgccgggataatgaagaacccgacggtggatgggatcatgaccatcgatctggaccccgtaatctatgactccaagttcgagaaacaactggggcaggttatgctcctagtgctgtgtgccgttcagctcctgctgatgcggaccagttgggcactctgcgaggccctgacactagccacgggcccaattaccacgttatgggagggatcccccggaaagttctggaacaccacgatcgccgtatcaatggccaatatcttccggggctcctacctcgccggtgcgggccttgccttcagcatcatgaaatccgtggggaccggcaagcgcgggaccggcagccagggcgagacactcggtgaaaagtggaagaaaaagctgaaccagctgtcacgaaaagagtttgacttatataagaagtccggcatcacagaggtagaccgcacggaggcaaaagaagggctgaagcggggagagatcacgcaccacgcggtcagccgtggatccgccaagctgcagtggttcgtcgagcggaacatggtgatacccgagggcagagtcattgacctcggctgtggcaggggtggttggagctattactgcgctggcctaaagaaggtaaccgaagtgcgcggctacacgaaaggcggcccggggcacgaggaaccggtcccgatgtccacgtatggctggaacatcgtgaaactgatgtcagggaaggacgtgttctacctaccacccgaaaaatgtgacacgctgctttgcgatatcggagagtccagcccatctcccactgtcgaagagagccggaccatccgggtgctgaaaatggtggagccgtggctcaaaaacaaccagttctgcatcaaggtcctgaacccatacatgcccacggtgatagagcacctggagcgtctccaacggaagcacggcggtatgctggttcgcaacccactgagccggaactccacccacgagatgtactggatctccaacggcacagggaacatagtcgcgtccgtgaacatggtgtctcgtctcctacttaatcggttcaccatgacgtatcgacgtcctactatcgagaaagatgtcgatctcggcgccggcacgaggcacgtgaatgcggagcccgagacgcccaacatggacgtcataggggaacggataaagcgtatcaaggaggagcacaacagtacctggcactacgacgacgagaacccatacaagacctgggcctaccacggctcctacgaggtaaaggccaccgggagcgcctccagcatgattaatggcgtggtgaagctgcttacaaagccctgggacgtggtgccaatggtcacacaaatggccatgaccgacacaaccccctttgggcaacaacgggtcttcaaggaaaaggtggatacgagaaccccgcggagcatgccaggcacccgcagggtcatgggcatcaccgcggaatggttatggcgcacgctgggtcggaacaagaagccccgcctgtgcacacgtgaggagttcaccaaaaaggttcgcacgaacgcagccatgggtgcggtattcacggaagagaatcagtgggacagcgcgaaggcagccgtcgaggacgaggacttttggatcttagtggaccgggaaagggagttacacaaggtgggaaaatgcggtagctgcgtgtataacatgatggggaagcgcgagaaaaagttgggggagttcggcaaggctaaggggtcccgcgccatctggtacatgtggctcggagcacgttacctggagtttgaggctctgggatttttgaatgaggaccactggttcagccgagagaacagctacagcggtgtggagggggagggactgcacaaactgggatacatcctccgggatatctccaagatccctggaggcgccatgtacgccgacgacaccgccgggtgggacactcggatcaccgaggacgacctgcacaacgaagagaagatcacccagcagatggacccggagcataggcagcttgcaaacgccatctttaaactcacctaccagaataaggtggtcaaggtgcaacggcccacgcccaccggaaccgtaatggacatcatcagccgcaaggaccagcgggggtctggacaggtcggcacgtacggcctaaacaccttcacaaatatggaggcccaacttatccggcaaatggaaggtgagggggtactcagcaaggccgatcttgaaaatccccacctccctgagaagaagatcactcaatggctcgagacgaagggtgtagaacggctgaaacgcatggcgatttcaggcgatgactgcgtagttaaaccaatcgacgaccggttcgcgaatgccctgcttgccctgaacgacatggggaaggtgcgcaaggatatcccccaatggcaacccagcaagggttggcacgattggcagcaggtcccgttctgctcgcaccatttccatgagctgatcatgaaggacgggagaaagctggtggtgccatgccgcccccaggatgaactgatcggtcgggccaggataagccaaggggcgggctggtccctgcgtgagaccgcgtgcctaggcaaggcctacgcccagatgtggagcctaatgtacttccaccgccgcgacctgcgcctcgctagcaacgcaatctgctcggccgtacccgtgcactgggtgccgacctcccgcacgacgtggagtattcatgcacaccaccagtggatgaccaccgaagatatgctgaccgtctggaaccgggtgtggatcgaagacaacccctggatggaggacaagacgccagtgaccacctgggagaacgtcccctacttaggcaaacgcgaggatcagtggtgcggctccctgatcgggctgacatcccgcgccacatgggcccagaatatccctactgcgattcaacaggtccggagcttaatcgggaacgaggagttcctcgattatatgccttccatgaagagattccgtaaagaagaggagtcggagggggcaatctggtga

SEQ ID NO: 25963 - RNA, 9873 nt, synthetic construct
  misc_feature 1..9873: note = derived and/or modified CDS sequence (opt11) from DENV-3__EU687239__SS-prME
  source 1..9873: mol_type = other RNA
acttcgctgtgcctcatgatgattctgccggccgccctcgcctttcacctcacctctagggacggggaacctcggatgatcgtcgggaagaacgagcgtggcaagagcctgctgttcaagacggctagcgggatcaacatgtgcaccctcatcgccatggacctgggggagatgtgcgacgacaccgtcacctataagtgcccacatatcgccgaggtggaacccgaggacatcgactgctggtgcaatctgaccagcacgtgggtgacctatgggacctgcaaccaggcgggagagcaccgtcgcgacaagcggtccgtcgcgctcgcgcctcacgtggggatggggctggacacgcgcacgcagacctggatgagcgccgagggcgcgtggcggcaggtcgagaaggtggaaacctgggcgctgcgccaccccgggttcacgatccttgccctgttcttggcccactacatcggcacctctctaacccagaaggtggtgatctttattctgctgatgctagtcacccccagcatgacgatgcgatgcgtgggggtgggcaaccgcgatttcgtcgagggcctgtccggcgccacatgggtggacgtggttctggagcacggtgggtgcgtgacgaccatggccaagaacaagccaacgctcgacattgagctgcagaagactgaagcaacccagttagcaactctacggaaattatgcatcgaggggaaaatcacaaacatcacaaccgactcacgctgccccacccagggtgaggccgttctgcccgaggagcaggaccagaactacgtctgcaagcacacgtacgttgaccgcgggtggggcaacggatgcggcctcttcgggaaggggtccctggtgacctgtgccaagttccagtgcctggagcccatcgagggcaaggtcgtgcagtacgagaatctcaagtacacagtaatcatcaccgtccacacaggggaccagcaccaggtgggcaacgaaactcagggggtcacggccgagatcacgccccaggcgtcaacgaccgaggctatcctgcccgagtatggcaccctggggctcgagtgcagcccccgcacggggctggacttcaacgagatgatcctgctaaccatgaaaaacaaggcctggatggtgcatcggcaatggttcttcgatctgcccctgccctggaccagtggcgcaaccaccgagacccccacgtggaaccgcaaggagctcctggtcaccttcaagaacgcccacgctaagaaacaggaggtcgtggtgctggggagtcaggagggcgccatgcataccgccctcaccggcgctacggagatccagaactcaggtgggacctccatcttcgctggccacctgaagtgccggctgaagatggacaagctggagctgaagggcatgtcttacgctatgtgcaccaatacctttgtgctgaaaaaggaggtatccgagacgcagcacgggactattttaattaaggtagagtacaagggcgaggacgtcccatgcaaaatcccattttcaaccgaggacgggcagggcaaggcccacaacggccgcctgatcacagccaaccctgtggtgacgaagaaagaggagccagtcaacatcgaagcagagccgccctttggggagagcaacatcgttatcggcgtaggggataacgcgttaaagatcaactggtataaaaagggctcgagcatcgggaagatgttcgaggccacggcccggggcgcgagacgtatggcaatcctgggagataccgcgtgggactttgggtccgtgggcggggtgctcaatagcctgggcaaaatggttcaccagattttcgggtcggcgtatactgccctgttctcgggagtctcctgggtgatgaagatcggcataggggtgctgctgacgtggataggcctaaacagcaagaacacctccatgagcttctcctgcatagccatcgggatcatcaccctctacctcggcgctgtcgtccaggcggatacggggtgcgtgattaactggaagggaaaggaactgaagtgcgggagcggcatcttcgtcacgaatgaggtgcacacctggaccgaacaatataagttccaggccgactcccccaagagactcgctacagccatcgctggagcgtgggagaatggggtgtgcggcatacgctcgacaactaggatggagaatctgctgtggaagcaaatagcgaacgaactcaactatatcctctgggaaaacaatatcaagctgaccgtcgtggtaggggacatcatcggcgtcctcgagcagggcaaacgcacactaacgccgcaaccgatggagctgaagtactcctggaagacatggggaaaggccaagatcgttaccgccgagacacagaactcatccttcatcatagatggcccaaatacgcccgaatgcccctcagcgtcccgggcctggaacgtgtgggaggtcgaagattacgggttcggcgtttttacaaccaatatatggttaaagctgcgtgaggtgtacacacagctgtgcgaccaccggctcatgagcgcagccgttaaagatgagcgcgccgtgcacgcggacatgggctactggattgagagccagaagaacgggtcctggaagctggagaaggctagcctaatcgaagtgaagacctgcacctggccgaaatcccacaccctatggagcaatggcgtcctggaatccgacatgataatccccaagagcctggccgggcctatttcccagcacaactaccgtcccggttaccacacccagaccgccgggccgtggcatctcggtaagctggagttagactttaactactgtgaaggcacaaccgtggtgataaccgagaactgcgggacccgcggccccagcctccggacgacaaccgtgtccgggaagctgatacacgaatggtgctgtcggagctgcaccttaccgcctctccgttatatgggcgaagacgggtgttggtacggcatggagatccgaccgatctccgagaaagaagagaacatggttaagagcctggtgagtgccggctcggggaaggtcgacaacttcacgatgggcgtactgtgcctcgctatcttatttgaagaagtgatgagagggaagttcggcaagaagcacatgattgcaggggtcttcttcacgttcgtgctgctactctccgggcagatcacctggagggatatggcccacaccctgattatgattggcagcaacgctagtgacagaatggggatgggcgtgacgtatctcgccctaatcgcgacctttaagatccaacccttccttgcactcgggttctttctgcgcaaactgacctcccgagagaacctcctcctgggcgtaggccttgccatggccaccactctgcagctgccggaggacattgagcagatggctaacgggattgcactcggcctgatggctctgaagttaatcacccagttcgagacctaccagctctggactgccttaattagcctaacctgctctaacaccatcttcaccctgaccgtagcctggcgcacagcgaccctaattcttgccggtgttagcctattgccggtgtgccagtcctcctcgatgcgcaagagcgactggctacccatgacagtggccgccatgggggtaccgcccctcccgctgttcatattctccctcaaggacaccttgaaacgccgcagctggccactcaacgaaggcgtgatggccgtgggactcgtttcgatcctggcgtcttccctgctccggaacgacgttcccatggcgggtcccttagtggcagggggcctgctcatcgcatgctacgtaatcacggggacctctgccgatttaaccgtggagaaggcggcggacgtgacctgggaggaagaagccgagcagacgggcgtctcccataacctgatgatcactgtggatgacgatgggaccatgcgcataaaggacgacgaaaccgagaacatcctgaccgttctgctgaagaccgccctgcttattgtcagcggcatctttccatactcaattccggccacactgctcgtttggcacacttggcagaagcagactcggcggagcggggtgctgtgggacgtcccaagtccgccagagactcagaaggcggagcttgaggaaggggtgtaccggatcaaacagcagggcatattcgggaagacccaggtaggggttggagttcagaaggagggcgtgtttcataccatgtggcacgttacccgcggcgccgtgctcacctacaacgggaagcggctagaacccaattgggccagtgttaagaaggacttgatttcctatggcggaggctggcgcctcagcgcgcagtggcagaagggggaagaggtccaggtgatcgcggtagagcccggcaagaaccctaagaacttccagactatgcccggtacgttccagaccacgaccggggagatcggcgccgtcgccctggacttcaaacccggcacgagcggatcccccattatcaaccgggagggaaaagttgttgggttgtatggaaatggggtcgtgactaaaaacggcggttacgtgagcggcatcgcacagacgaacgccgagccggacggccccacccccgaattagaggaggagatgttcaagaagcgtaatctcaccatcatggacttgcaccccggatctggcaagactcggaaatacctgccggcgatcgttcgggaagccatcaagcgccgcctccggacgttaatcctggcgccaactcgcgtggtggccgctgagatggaggaggcgttgaaggggctgccaatccggtaccagaccaccgccaccaagagcgagcacaccggtcgtgaaatcgtcgacttaatgtgccacgccaccttcacaatgcggctcctgagtcccgtgcgagtgccgaactataacctgatcattatggatgaggcccacttcacggaccctgccagcatcgcggcccgtgggtacatttccacccgcgtcggcatgggcgaggcggccgcgatcttcatgactgccacgccgcccggcactgccgacgccttcccacagagcaacgcccccattcaggacgaagaacgcgacatccctgaacggtcctggaacagtgggaacgagtggatcacggacttcgcaggcaagacggtgtggttcgtaccctcaatcaaggccggcaacgatatcgccaactgtctccgcaaaaacggaaagaaagtcatccagctgtcacggaagaccttcgacacggaataccagaaaactaagctcaacgactgggacttcgtggttaccacggacatttccgaaatgggcgctaactttaaagccgaccgtgtcatcgacccgcggcggtgcctcaaacccgtgatactgacggacggtcctgagcgggtgattctcgcaggacccatgccggtcaccgccgccagcgccgcccagcgccgtggcagagtagggcggaacccccagaaggagaacgaccagtatatcttcaccggccagcccctaaacaatgacgaggatcacgcgcactggacagaagcgaagatgctgctggacaacatcaacacgccggaaggcatcatcccggctctctttgagcccgagagagagaaaagcgccgcgatcgacggcgagtatcggctcaagggagagagccgcaaaactttcgtggagctgatgcggcgcggggacctacccgtgtggctagcacataaggtggcctccgagggcattaaatacacggaccggaagtggtgctttgacggtcagcgcaacaaccagatcctggaggagaacatggacgtcgaaatctggaccaaagagggcgagaagaagaagctacggccgcgctggctggatgcccgcacctacagtgatccgcttgctctcaaggagttcaaagacttcgcagccggccggaagtcaatcgccttagatctggtgaccgagatagggcgcgtgcccagccacctagcccaccggacccgcaacgccttggataacctggtcatgcttcacacatctgagcacggtgggaaggcgtaccggcacgccgtggaagaactgccggagacaatggagacgctgctattactgggcctcatgatcctgctgaccgggggcgccatgctattcctgatctcgggcaagggcatcggcaaaaccagcatcggcctgatctgcgtgattgcctcctcaggcatgctctggatggccgagattccgctgcagtggatagcgagcgcaatcgtcttagaatttttcatgatggtgctcctgatacccgagccagagaaacagaggacgccccaggacaaccagctggcctatgtggtcatcggaatcctcacgctcgcggccatcatcgcggccaacgagatgggactgctcgagaccaccaagcgagacttgggtatgagcaaggagccgggagttgtgtccccgacaagttacctggacgtcgacctacacccagcatcagcatggaccctgtatgcggtggctacaactgtaatcacgccaatgctgcgccatacaatcgagaacagcaccgccaacgtctcactcgccgcgattgcgaaccaggccgtggtgctgatgggccttgacaaggggtggccgatcagcaagatggacttgggcgtccccctgctggccctcgggtgctactcgcaagtaaaccccttaactcttactgccgccgtgctcctgctgatcacgcactacgcgatcatcgggcccggactccaggccaaggccacccgggaagcccagaagaggaccgctgccgggatcatgaagaaccctaccgtcgacggcatcatgacgatcgacttagaccccgtgatatacgatagcaagttcgaaaagcaacttggacaggtcatgctgctggtcctttgcgccgtgcagctgcttctgatgaggacctcctgggccctttgcgaggccctgactcttgcgaccggccccataacgaccctctgggaggggagccccgggaagttctggaacactaccatagccgtttccatggctaacatcttccgcggctcctatctggccggggccgggctggcgttctcaatcatgaaaagcgtcgggacgggcaagcggggcaccggatcacaaggggagacacttggggaaaaatggaaaaagaaactgaaccagctttcccgaaaggaatttgacctttacaagaagtccggcataaccgaggtggaccggaccgaggcaaaggaggggctgaagcgcggcgaaataacgcaccacgcggtatcccggggcagcgcaaagttgcagtggttcgtcgagcgcaatatggtgatcccggagggtcgggtgatcgacttaggatgcgggagaggagggtggtcctactactgcgcaggactgaaaaaggtcaccgaggtgcggggatataccaagggcgggccggggcacgaggagccagtgcccatgagcacctacggctggaacatagtcaagctaatgtccgggaaggacgtgttctacctgccgcccgaaaagtgcgacactcttctgtgcgacatcggcgagtctagtcccagccccactgtagaggagtcgcgcaccatccgtgtccttaagatggtggagccgtggctgaagaacaaccagttctgcataaaagtgttgaacccgtacatgcccaccgtcatagagcatcttgagcggctccagcgaaagcacggagggatgttggtgcggaacccgctaagccgcaactccacgcacgagatgtactggatatctaacggcaccggaaacatcgttgcgtccgtcaacatggtgtcccggctcctcctgaaccgctttaccatgacgcaccggcgcccgacaatcgagaaggacgtggacctcggcgccggtactcggcacgtgaacgctgagcccgagacccccaatatggacgtgatcggcgagcgcatcaagaggattaaggaggaacacaacagtacctggcactacgacgatgaaaacccgtacaagacgtgggcttaccacggctcatacgaggtcaaggcgaccgggtccgcgtcgtccatgatcaacggcgtggtgaagctgcttaccaagccctgggacgtcgtgcccatggtgacacagatggccatgacggacaccactcccttcggccaacagcgcgtcttcaaggagaaggtagacacccggacgccgcgtagcatgcccggaacaagacgcgttatgggcatcactgccgagtggctttggcggaccctcggtcgcaataagaaaccccggctgtgcacgcgcgaggagttcaccaagaaggtccgcaccaacgccgcgatgggcgccgtgttcacagaagagaatcagtgggactctgccaaagcagccgtggaggacgaggacttctggaagctcgtcgaccgggaaagagagttgcataagctggggaagtgcggttcctgcgtgtataacatgatggggaagcgggaaaagaaattaggggagttcggtaaggcgaaaggatcgcgggccatctggtacatgtggctgggtgcccggtatctggagttcgaggccttggggttcctaaacgaggatcactggtttagtcgtgagaatagctactccggtgtagaaggtgaaggtctgcacaagctcggctacatcctgagggacatcagcaagatcccaggtggcgccatgtatgcggatgacaccgccggctgggacacccgcatcacggaggacgacctgcacaacgaggaaaagataacccagcagatggacccggagcaccggcaattggccaacgctatcttcaagctgacataccaaaacaaggtcgtgaaggttcagcgccccactcccacaggcaccgtgatggacattatctcccggaaggaccagcgcggcagcggccaggtaggcacctacgggctgaacacgtttactaacatggaggcgcagctcatccggcagatggagggagagggggttctatccaaagcggacctggagaatccccatctctccgaaaagaagataacccagtggttggagaccaagggcgtcgagcgcctgaaacggatggccatctctggtgatgactgcgtggtgaagccgatcgacgacaggttcgcgaacgcgctcctggctctgaacgatatggggaaggtcagaaaagatatcccacagtggcagccatcaaagggctggcacgactggcaacaggtgcccttctgctcccaccatttccatgagctgatcatgaaggatgggcgcaagctggtagtcccatgtcggcctcaagacgagctaattggccgagcgcggatcagccaaggggccggctggtccctccgcgagacggcctgtctgggcaaggcatacgcacagatgtggagcctgatgtatttccaccgtagagaccttcgcttagcctccaacgctatttgcagcgcggtacccgtacactgggtccccacgagccggaccacctggtccatccacgcccaccaccaatggatgacgaccgaggacatgctgaccgtttggaaccgagtatggatcgaagataacccttggatggaggacaagacccccgtcacgacctgggaaaatgtgccctacctcgggaagagggaagaccaatggtgcggcagcctgatagggctgacctcccgcgcaacctgggcccagaatataccgacggctatccaacaggtgcggagcctcatcggcaacgaggagttcctggactacatgccgtccatgaagcggttccggaaggaagaggagtctgagggggtcatatggtga

SEQ ID NO: 25964 - RNA, 9873 nt, synthetic construct
  misc_feature 1..9873: note = derived and/or modified CDS sequence (opt11) from DENV-3__FJ182004__SS-prME
  source 1..9873: mol_type = other RNA
acgagcctatgcctcatgatgatcctgcccgcggccctagcgttccacctcaccagccgggacggggagccccggatgatcgtggggaagaacgaacgcggtaagtccttgctctttaagaccgccagcggaattaacatgtgcaccctcatagccatggacttaggtgaaatgtgtgacgacacggtgacctacaagtgcccccacatcgccgaggttgagcctgaagacatcgattgctggtgcaacctgactagcacctgggtgacctacggtacctgcaaccaagctggggaacaccggcgagataagcgctccgtcgcgctagcgccccatgtgggcatgggtctggacactaggacccagacttggatgtcagccgagggggcgtggcgccaggtggagaaggtcgagacgtgggcactgcgccatccggggtttactatcttggcactgttcctggcacactacatcggcaccagtctcacgcagaaggtggtcatcttcatcctgctgatgctcgtcacacccagcatgacgatgcggtgcgtgggggtgggcaaccgtgacttcgttgagggcctgtccggggcgacgtgggtggacgtggtactggagcacgggggttgcgtcaccaccatggccaagaataagccaacccttgacattgagctgcagaagacggaagcgacccagctggctacactccggaagctgtgcatcgagggcaagatcacgaatatcaccactgacagccgctgtcccacccagggcgaggccgtcctgcctgaggagcaagaccaaaactacgtgtgcaagcacacgtatgttgaccggggatggggcaatgggtgcggcctattcgggaagggctccctagtgacctgcgccaagttccagtgcctggagcccatcgagggcaaggtagtgcagtacgagaacctcaagtacacggtgatcatcaccgtccacacgggggaccaacaccaggtaggtaacgagacccaaggggtcaccgccgagatcacacctcaggccagcacgaccgaggccatcttacccgagtacggcacgcttgggctcgaatgctcaccgcggaccggactggacttcaacgagatgatcttgctcactatgaagaacaaggcctggatggtacacaggcagtggttctttgacttgcccctgccctggacgagcggggccactacagaaaccccgacttggaaccgcaaggagctcctggtgactttcaaaaacgcccatgcaaagaaacaggaagtcgtcgtgctggggtcccaggagggggcaatgcacaccgcactcaccggggccacggagatccagaacagcggcgggacctccatattcgccgggcaccttaagtgccgtctgaaaatggataagctcgagctgaaggggatgagctatgcgatgtgcactaacaccttcgtactgaagaaagaggtgtcggagacgcaacatgggaccatcttaatcaaagtggagtacaaaggcgaagacgcgccctgcaagatcccatttagcaccgaggacgggcaaggcaaggcacataacggccgcctgatcaccgctaaccccgtcgtgacaaagaaggaagaacctgtgaacattgaggcggagccgcccttcggggagtcaaatatagtcatcggtatcggggacaacgccttaaagatcaactggtacaagaagggcagtagcattggaaagatgtttgaagccaccgccagaggggcccgccggatggcgatcctgggcgataccgcctgggatttcgggagtgttggaggggtgctcaattccctgggcaagatggtccaccagatcttcgggtccgcgtacaccgccctgttttccggcgtgtcctgggtcatgaagatcggcatcggggtattgctgacgtggatcggccttaatagcaagaacacctccatgagtttcagctgcatagccatcgggattattaccctctacctgggtgctgtggtgcaggcggataccgggtgtgtcatcaactggaagggtaaggagctgaaatgcggcagcggaatattcgtaacgaacgaggtgcacacctggaccgagcagtataagttccaggccgattcgcccaagcgcctcgcgaccgcaatcgcgggcgcctgggaaaacggggtctgcggaatccgctcaacgacccggatggagaacttactctggaagcaggtcgccaacgagctcaactatatcctgtgggagaacaatataaagctgacagtagtcgtaggggacattatcggcgtgttagagcagggcaagcggacactgacgccgcaacctatggagctgaagtattcctggaaaacctggggcaaagccaagatcgtcaccgctgagacccagaacagctccttcataatcgatggtcccaatactcccgagtgcccctccgcatcaagggcctggaatgtgtgggaggtggaggactatggctttggggtgtttactaccaacatctggctgaagctgagggaggtgtacacccaactgtgcgaccaccggctcatgagcgcggcggttaaggacgagcgcgcggtacacgccgacatgggatactggatcgagagccagaagaacgggagttggaaacttgagaaggccagcctgatcgaggtcaagacctgcacgtggccgaagtcacacaccctctggagcaatggcgtactggagtccgatatgatcatccctaaatctctggccgggcccatctcccagcacaattaccggccaggctaccacacccagaccgccggtccctggcacttgggcaaactggagctggactttaactactgcgagggcacgaccgtcgtgatcaccgagaattgcgggacccgcggcccgagcctccggacgaccaccgtgtccgggaagctgatccacgagtggtgctgccgcagctgcaccctgcccccgttgcggtatatgggcgaagacgggtgctggtacggcatggaaatccgccccatatccgaaaaggaggagaacatggtcaagagcctcgtgtcggcgggcagcggcaaggtggataactttacgatgggcgtcctgtgccttgccatcctgtttgaggaggtgatgcgcggtaagttcggaaagaagcacatgattgccggtgtgtttttcaccttcgtcctgctcctgagtggccagatcacatggcgcgacatggcccacaccctgatcatgattggcagtaacgcctccgaccggatggggatgggggtgacatacctcgcgctaatcgccacctttaaaatccagcccttcctggccctcgggttcttccttcgaaaacttacctcgcgggagaacctcctgctgggcgtgggactcgccatggcgaccacactgcagctgcctgaggacatcgagcagatggccaacgggatagccctcggcctgatggccttaaaacttatcacccaattcgagacataccagctgtggaccgccctaatcagcctgacttgtagcaacaccatcttcaccctgaccgtcgcgtggcgcacagccaccctaatcctcgccggggtatcgctgctgccagtctgccagtccagcagtatgagaaagtccgactggctccctatgaccgtggccgccatgggcgtgccgccgctcccgctgttcatcttctccctcaaagacacgctgaagcgccgcagctggcccctgaacgagggggtcatggcggtgggtctcgtgtccattcttgccagctccctgctccggaacgacgtccctatggcgggccccctagtggcagggggccttctaatcgcctgctacgtgatcacggggacaagcgctgacctgaccgtcgaaaaagccgccgacgtaacttgggaggaggaagccgagcaaactggcgtgtcccataacctgatgattaccgtcgacgacgacggcacgatgcgcataaaagacgacgagactgagaacatcctgaccgtgttgctgaaaacggccctcctgattgttagcggcatcttcccgtactccatcccggccactctgctcgtctggcacacctggcaaaagcaaaccagacgtagcggtgtgctgtgggatgtgccctcaccgcctgagacgcagaaagccgagttggaggagggggtctaccgcatcaaacaacagggcatcttcgggaagactcaagtgggagtgggagtgcagaaggaaggtgtgttccacaccatgtggcacgttacccgaggcgccgtcctcacgtacaacgggaagcggctggagcccaactgggcctccgttaagaaagacctgatctcctacggagggggctggcgcctcagcgcgcaatggcagaaaggggaggaggtgcaggttattgccgtggaacccgggaagaaccccaagaactttcagaccatgcctggcaccttccagacgacgactggggagataggcgcaattgccctggacttcaagcccgggaccagcggcagccccatcataaaccgggagggcaaggtggtcgggctgtacggcaacggggtcgtgaccaaaaacggcggttacgtctcggggatcgcccagacgaatgcggagccggacggccctacccccgagctggaagaagaaatgttcaaaaagcgcaacctcaccatcatggacctgcaccccgggtccggcaagacccggaagtatctgccggctatcgtacgagaggccatcaagcggaggctccggacgctgatactggcacccacccgagtcgtcgctgcggagatggaggaagctctcaaagggctgccgataagataccaaaccaccgccaccaaaagcgaacacactggccgcgagatcgttgaccttatgtgccacgccacttttacaatgcggctcctgagccccgtgcgtgtcccgaactacaatctgatcatcatggatgaggcccacttcactgacccagcgtcaatcgccgcccgtgggtacatctccacccgcgttggaatgggagaagccgcggccatattcatgaccgccacaccgcccgggactgccgacgccttcccccagagcaatgcgcccatccaggacgaggagcgcgacattcccgagcggagttggaactccggaaacgagtggattaccgatttcgccgggaaaaccgtatggttcgtcccatccatcaaagccggaaacgacatagccaactgcttgagaaagaacgggaagaaagtgatccagctttctcggaagaccttcgatacggagtaccagaagacaaagctaaacgattgggacttcgtggtcaccactgacatctccgagatgggggctaacttcaaggcggaccgcgtgatcgatccgcggcgctgcctgaagccggtcatcctgacggatggccccgaacgggtcatactagccgggcccatgccggtgaccgctgcaagtgccgcgcagcgccggggccgcgtgggtcggaatcctcagaaggagaacgatcagtacattttcaccggccaacccctcaacaatgacgaggatcacgcccactggaccgaagccaagatgctgctggacaacatcaacaccccggaggggatcatcccggcccttttcgagcccgagcgcgagaagtctgccgccatagatggcgagtaccggctgaagggagagagccgtaagacgttcgttgagctgatgcggcgcggagacctccccgtgtggctcgcccacaaggtcgcctccgagggaatcaagtacaccgacagaaagtggtgctttgacgggcaacgcaacaaccagatacttgaagagaatatggacgtcgagatctggacgaaggagggcgagaagaagaagctcaggccccgctggctggacgcgcgcacttacagcgacccgctggctctcaaggagttcaaagacttcgcagccggaagaaagagtattgcactggaccttgtgacggagatcggacgcgttccgagccacctagcccaccggaccagaaacgcgctggacaacctggtgatgctccacaccagcgaacacggcgggaaggcataccggcacgccgtcgaggagctaccagagaccatggagaccctattgctgctgggcttgatgatcctgcttaccgggggcgccatgctgtttctgatatccggcaaggggatcggaaaaacctccatcggcctgatctgcgtcattgcctcctccgggatgctctggatggcggaaattccgctgcaatggatcgcctccgccatcgttttggagtttttcatgatggttctactgattccggaaccagagaagcagcgaacgccccaggataaccaattggcctacgttgtgatcgggattctcacgctagctgcgatcatcgctgccaacgagatgggtctgctcgaaacaaccaaacgggacctgggcatgtcgaaggagccgggggtggtatcccctaccagctacctggacgtcgacctccaccccgccagcgcttggacactgtacgccgtggccacaaccgtcattacccccatgctacggcacacaatcgaaaacagcaccgctaacgtctccctcgcggctattgccaaccaggccgtggtactgatgggcctggataaggggtggccgatcagcaaaatggacctcggggtgcccctgcttgcgctcgggtgctactctcaggtgaatcctctgaccctgactgctgcggtattgttactcatcacgcactacgccatcattggccctggcttgcaggctaaggctacgagggaggcccagaagaggaccgccgccgggatcatgaagaacccgactgtggacggtataatgacgatcgacctagatccggtgatctacgacagcaagttcgagaagcaactggggcaggtaatgcttctggttctgtgcgctgtccagctgctgctaatgcgcacctcctgggccctctgcgaagcgttgacactggcgactggccccattactactttatgggagggcagccccgggaagttctggaacactaccatcgccgtcagcatggccaacatattccgcggaagctacctggccggggccggcctcgcgttctccatcatgaagtcggtaggtacgggtaagcgcggcacgggatcgcagggtgaaaccctcggggagaaatggaagaagaaacttaaccagctgtcccgaaaggagttcgacttgtataagaagtccggcattaccgaagttgaccggaccgaagctaaagaaggcctaaagagaggcgaaatcactcaccacgcggtcagccgcggctccgccaagctacagtggttcgttgagagaaacatggtgatcccggagggcagggtcatcgatctcggatgcggtcgcggcgggtggtcctactactgcgcgggcctgaaaaaggtgaccgaagtacggggctacaccaagggcgggccggggcacgaggaaccagtcccaatgagtacttacggttggaacattgtgaagttgatgagcgggaaggatgtgttctacctccctccagagaagtgtgacacgctactgtgcgatatcggggaatcatcccctagccccacggtcgaggagtcccgcaccatcagagtcctgaagatggtggaaccgtggctcaagaacaatcagttctgtattaaggtgttaaacccatacatgcccaccgtcatcgagcacctggaaaggctccagagaaagcacggcgggatgctggtgcggaaccctctaagccgaaattccacacacgagatgtactggatctcaaatggaaccggaaacatcgtcgcctccgtcaacatggtgtctcggctcctgctcaatcgctttaccatgacacaccgccgtcctacgatagagaaggacgtcgacctaggcgcgggtacccggcatgtcaacgccgagcccgagacccccaacatggacgtaatcggtgaacgcataaagcggatcaaggaggagcacaactctacctggcactatgacgatgagaatccctacaagacgtgggcctatcacggctcatacgaggtaaaagcgacgggcagtgccagcagcatgatcaatggcgtggtaaagctgctgaccaagccctgggacgtggtaccaatggtaacgcagatggccatgactgacactaccccctttgggcagcagcgcgtgttcaaggaaaaagtggatacccggacgccacgctccatgcctggcacccgtcgcgtcatgggcatcaccgctgagtggctctggagaaccttaggacgcaacaagaaaccccgtctgtgcacgcgagaagagtttaccaagaaagtgcgaaccaacgcggccatgggcgcagtgtttacggaggagaaccagtgggactcagccaaggctgcggtcgaggacgaggacttctggaagctcgttgaccgcgagcgcgagctgcacaagctcggaaaatgcggatcctgtgtgtacaacatgatggggaagcgggagaagaagctaggcgaatttggcaaggccaaggggagcagggcgatatggtatatgtggctaggcgcccggtacttggagttcgaggccctcgggttccttaatgaggatcattggttctcccgcgagaacagttacagtggggtcgaaggagaggggttacacaaactcggctatatcttgagagatataagcaagattcccggaggggcgatgtacgcggacgacacggcgggctgggacacccgcatcaccgaggacgacttacacaacgaggaaaagattacgcaacagatggacccggagcataggcagttagccaacgccatctttaagctcacgtaccagaacaaggtcgtgaaggttcagcgcccgacacccacaggcacagtgatggacatcatctcccggaaggaccagcgcggcagcggccaagtgggaacgtacgggctgaacacgttcaccaatatggaagctcagcttatacggcagatggagggcgagggggtcctgaccaaggccgatcttgaaaacccacacctatccgagaagaagatcacccagtggcttgagacaaaaggcgtggagaggctaaagcggatggccattagcggcgacgactgcgtggtaaagccgatcgacgaccgattcgccaacgccctcctggctctgaacgatatggggaaagtgcggaaggacataccccagtggcagccttccaagggctggcatgattggcagcaggttcccttctgcagccatcacttccacgagctcatcatgaaggacggcaggaaacttgtggtgccgtgccggccacaggacgaactgatcggccgggcccggatctcccaaggcgctggctggagcctccgagaaaccgcctgcctgggcaaggcatacgcacagatgtggtccctgatgtacttccacagaagggacctccgtctggccagcaatgcaatatgctccgccgtgccagtgcactgggtccccaccagccggaccacgtggtcgattcacgcgcaccaccagtggatgaccacagaagatatgctgaccgtgtggaaccgcgtgtggatagaggacaacccgtggatggaggacaaaacgccagttaccacctgggaaaacgtgccgtacttaggtaaacgggaggaccaatggtgcggctctctgatagggctgacatcacgagccacctgggcccaaaacattcccaccgccatccagcaggtccggtctctgatcggcaatgaggagttcctggactatatgccgagcatgaagcgtttccggaaagaggaggagtcagagggggcaatttggtga

SEQ ID NO: 25965 - RNA, 9873 nt, synthetic construct
  misc_feature 1..9873: note = derived and/or modified CDS sequence (opt11) from DENV-3__FJ024465__SS-prME
  source 1..9873: mol_type = other RNA
accagcctgtgcttaatgatgattctccccgctgccctggcctttcatttgactagccgggacggcgagccccggatgatcgtcgggaagaacgaacgggggaagagccttctgttcaagacggcgtccgggataaacatgtgcacccttatcgctatggacctgggcgaaatgtgtgatgacacagtgacctacaagtgcccccatattgcggaggtagaaccagaggatatcgattgctggtgcaacctgacgagcacctgggtgacctacggtacctgcaaccaggccggggagcacagaagggataaacggagtgtagctctcgcaccccacgtgggcatggggctggacacacgcacacaaacttggatgagcgccgaaggcgcttggcgccaggtagaaaaggtagagacctgggcacttcgccacccgggtttcacgatcctcgccctgttcctggcccactacataggcacctcccttacacagaaggtggttatattcatcctgctaatgttagtcacccccagcatgactatgaggtgtgttggggtgggcaaccgcgacttcgtcgagggcctgtccggggccacctgggtggatgtggtcctggagcacgggggttgcgtgactaccatggcaaagaacaagcctactctcgacatcgagcttcagaagaccgaggccacccagcttgcgacgctccggaagctctgcatcgagggcaagatcactaacattacgacagactctcgctgccctacccagggtgaggcggtgctgccggaggagcaggaccagaattacgtctgcaagcacacgtacgtggaccgcgggtggggcaatgggtgcggactcttcggtaaaggctcgctggtcacatgcgccaagttccagtgtttagagcccatcgagggcaaggtagtacagtatgagaacctcaaatataccgtgatcataactgtccacactggtgaccagcatcaggtgggcaacgagacccaaggagtcaccgcggaaatcacgccccaggccagcacgacagaagccatactgcctgaatacggcacgctgggcctcgagtgctcccctcgaaccggcctggactttaatgagatgatcttgctcaccatgaaaaacaaagcatggatggttcaccggcagtggttcttcgatctgcccctgccctggacgagcggagcgaccactgagaccccaacttggaaccgcaaagaactcctggtcactttcaagaacgcccacgcgaagaagcaggaggtcgtggttttgggtagtcaggagggcgccatgcacaccgctctcactggggccacagagatccagaacagcggcggaacctccatattcgcgggccatctgaaatgccggctcaagatggacaagctagagctgaagggcatgagctacgcgatgtgtactaatacgttcgttttgaaaaaggaagtgtccgagacgcaacacggcaccatattaatcaaggtggagtacaagggcgaggacgtcccgtgcaagattcccttctcgaccgaggacggacagggaaaggcgcacaacggcagattgatcacagctaatcccgtcgtaacgaaaaaggaagaacccgtcaacatagaggccgagccaccattcggtgaatcgaacatcgttatcggaatcggggacaacgccctgaagatcaactggtacaaaaaaggcagcagcattgggaagatgttcgaggccaccgcgcggggcgcccgccggatggcgatccttggggacactgcgtgggatttcgggtcggtaggcggggttctcaacagtttaggcaaaatggtgcatcagatcttcgggtccgcgtacaccgccctgttctcgggagtatcttgggtaatgaagataggcatcggggtgctcctgacgtggattggcctgaactccaagaatacctccatgagcttctcatgcatcgccatagggatcatcaccctctacttgggcgccgtcgtccaggcggacacaggctgcgtaattaactggaaaggaaaggaactgaagtgcggcagcggaatattcgtgacaaacgaggtgcacacctggacggagcaatacaaattccaggccgacagccccaagcgactggccacagccatcgccggcgcgtgggagaacggggtatgcggcatccgcagtaccacccgcatggagaacctgctgtggaagcagattgccaatgagctcaactacatcttatgggaaaacaacatcaagctgaccgtggtagtaggggacatcataggcgtgctcgagcaaggcaagcgcacgcttaccccccagcctatggaactgaaatacagttggaaaacttggggaaaggcaaagatcgtcaccgccgaaacccaaaatagcagcttcatcatcgatggacccaatactcccgagtgccccagcgcctcccgggcttggaatgtttgggaggtggaagactacgggttcggtgtcttcaccaccaatatctggctcaagctgagggaggtatacactcagctgtgtgaccaccggctcatgagcgcagcagtgaaggatgagagggcggtccatgcagacatgggctactggatcgagagccagaagaacgggagctggaagctggaaaaggccagcctgatcgaggtcaaaacctgcacgtggcccaagtcccacactctctggagtaacggcgtcctggagagtgatatgatcatacccaaaagcctagcggggcccatctcccagcacaactaccggccgggctatcatactcagaccgccgggccctggcacctaggaaagctcgagctggatttcaactactgcgagggcactaccgtcgtgatcaccgagaactgtgggacacggggccccagcctccggacgaccaccgtgtctggtaaactgatccacgagtggtgctgccgcagctgtaccttgcccccgctccgctacatgggagaggacgggtgctggtatggcatggaaatccgccccatatccgagaaggaagaaaacatggttaagagcctggtttccgccggcagcgggaaggtcgacaacttcaccatgggggtcctgtgtctcgcgattctgttcgaagaggtgatgcgagggaaattcgggaaaaagcacatgattgcgggggtgtttttcacgttcgtgctgttgctgagcggccaaatcacttggcgcgatatggcgcataccctgatcatgattggcagcaacgcctccgatcggatgggcatgggcgtaacttatttagcgctgattgcgaccttcaaaatccagccgtttctggccctcgggttcttcctgcgcaagcttacgagccgagagaacctactgttaggcgttggacttgccatggcaactacgctgcagctacccgaggacatcgagcagatggcgaacgggatcgccctcggactgatggcgctgaagctcataacccagtttgagacgtatcagctgtggaccgccctgatcagcctcacgtgcagtaacacaatcttcaccctgacagtcgcttggcgcacagccacccttattctcgccggtgttagcctgctgccggtctgccagtcgtctagcatgagaaagagcgactggctgcccatgaccgtggccgctatgggggttccgcccctgccgctgttcatcttttccttgaaagacaccctgaagcggcgctcatggcccctgaacgagggagtcatggccgtcggcttagtttcaattctggcaagctccctgctccgaaacgacgtacccatggccggccccctggtagccggcggcctcctcattgcgtgctacgtgattacgggaaccagtgccgacctggctgtcgagaaggccgcagacgtgacatgggaagaggaggcggagcagaccggcgtgtcccacaacctgatgattacggtcgacgacgatgggactatgcgcatcaaggacgacgagaccgagaacatcctcacggttctgctgaaaaccgctctcctaattgtgagtggcatcttcccgtactccatccccgcaactctgctcgtatggcacacctggcagaagcagacccagcggagcggagtgttatgggatgtacctagcccccccgagacccagaaggccgagctggaggagggagtatatcgtataaaacaacagggcatttttggcaagacccaggtgggggtgggggtccagaaagagggcgtgttccacaccatgtggcacgtcaccagaggggccgtcctcacctacaacgggaagcgcctggagcctaactgggcatcagttaaaaaggacctcatttcctacggcgggggttggcggctcagcgcgcagtggcagaagggggaggaagtgcaggtcatcgccgtggaacccggaaagaaccccaagaacttccagacgatgcccggcaccttccagaccacaacgggggaaattggcgccatcgccttagacttcaagcccggaacaagcggctctcctatcatcaatcgcgagggcaaggttgtcggactttacggcaacggcgtggttaccaagaacggcgggtatgtcagcgggatagcacagacgaacgcggaaccggacggccccacaccagagctcgaggaagaaatgtttaagaaacgtaatttaactattatggatctccacccgggctcaggcaaaacacgcaaatacttgcccgccattgttcgcgaagccatcaaacgccggctccgtactctgatcttggctcccacgcgcgtggtcgccgccgagatggaggaggcactgaaaggcctgcccatacgctaccagaccacagccactaagagcgaacacacgggccgggagattgtggatctgatgtgccacgccaccttcacgatgagactcttgagcccggtgagagtcccgaactacaacctgataatcatggacgaagcacatttcaccgacccggcgtctatagccgcccgcgggtacatctccacacgtgtgggaatgggcgaggcagctgccatatttatgaccgccacgccgcccggcaccgccgacgcattcccgcaatcaaacgcgccgattcaggacgaggagcgagacatacccgagcggtcgtggaactcgggcaacgagtggatcacggactttgccgggaagacggtgtggttcgtcccctccatcaaggccggcaacgacatagccaactgtctccggaagaacgggaagaaggtgatccaactgtcacgaaagaccttcgacacagaatatcagaagacaaagctgaatgattgggacttcgttgtcaccaccgacatctccgagatgggcgccaacttcaaggcggaccgggtgattgaccctcgccggtgcctcaagcctgttatcctaacggacggccccgagcgcgtaatccttgctggccccatgcccgtgactgccgcctcagccgcgcaacggcgagggagggttgggcgcaacccccaaaaggagaacgaccaatatatctttacgggccagccgcttaacaacgacgaagaccacgcccactggaccgaagccaagatgctgctggataacattaacacccccgaggggatcataccggccttgttcgaaccggagcgggagaaatccgcggccatcgacggcgagtacaggctgaagggcgagtccagaaagaccttcgtcgaactgatgaggcgcggagacctcccagtatggctggcccataaggtcgcctccgagggcatcaaatacacggaccgcaagtggtgtttcgacgggcagcggaacaaccagatccttgaggagaacatggatgtcgaaatctggaccaaggagggggagaagaagaagcttcgccctcggtggctggacgctaggacctacagcgatccactggctctcaaggagtttaaggacttcgccgccgggcgcaaatccatcgccctggacctggtgacagagattggccgggtaccaagccacctagcacaccgcactcgtaatgcgctggacaatctggtgatgctccacaccagcgaacatggcgggaaggcgtaccgccacgcggtggaggaactacccgaaactatggagactctgttattgctggggctcatgattttactaaccggcggggccatgctgttcctgatctccggtaaggggatcggcaagaccagcataggcctgatctgcgtcattgcctcctccggaatgctctggatggctgaaattcctcttcagtggattgcctccgccatcgtactggaattcttcatgatggttctcctgatccccgaacccgaaaagcaacgtaccccccaggacaaccaactggcttatgtcgtgatcggaatcctcacccttgccgccataatagccgcgaacgagatgggcctcttggagacgacgaagcgcgatctgggcatgagcaaggagccaggagtggtctcccctactagctacttagacgtagatctccacccggcgtccgcctggactctgtacgccgtggccacgacggtgatcacccccatgttacggcacaccattgagaactctacggccaacgtgtccttggccgcgattgcaaaccaggctgtggtactgatgggcttagacaagggatggccgatctcgaagatggacctcggcgtgcccttgctcgccttagggtgttactcccaggtgaaccccctgactttaactgctgccgtcctcctgctgatcacgcactacgccatcatcggccccggccttcaagccaaagccacgagggaggcccaaaagcggaccgcagccgggataatgaagaacccgaccgtggacggtattatgacaatcgatctggatcccgtcatctacgacagcaagtttgagaaacagctgggtcaggtgatgctgctggtgctgtgcgccgtgcagctcctgctcatgcgcacgtcctgggccctatgtgaggcactgaccctggcgaccgggcctatcaccacgctttgggagggaagccccggaaagttttggaacaccaccatcgccgtctccatggccaacatctttcggggcagttacctggccggggctggcttagccttctccattatgaaatccgtggggaccggcaaacgcggtactggtagccagggcgagacgctcggggagaagtggaagaagaagctgaaccagctctcacggaaggagttcgatctctacaagaagtctggcatcacagaggtcgaccgcaccgaggccaaggaggggttgaagcgaggcgaaatcacccaccacgccgtctccagaggttctgcaaagctgcaatggttcgtagaacggaacatggtgatccctgaggggcgcgtcatagacttaggttgcgggaggggcggttggtcatactattgcgcgggcctaaagaaggtaacggaggtgcgcggatacaccaagggcggtcccgggcacgaagaacccgttcccatgagcacctatggctggaacatcgtgaagctgatgtccggaaaagacgtgttctacctcccacccgagaaatgcgataccctgctgtgtgacataggtgagtcgtccccatcacccacagtggaggaatcccgaactatccgcgtactgaagatggtggaaccgtggctcaagaacaaccaattttgcatcaaagttctgaacccgtacatgcccacggtgatcgaacacctcgaaaggctccagcggaagcacggcgggatgctagtgcgcaaccccctgagccggaactccacccatgaaatgtactggatctcgaacggcaccgggaatattgtagcctccgtgaacatggtgagcaggctcctgttaaataggttcaccatgactcaccgccggcccaccatcgagaaggacgtcgacctcggggctggcacgcgccatgtgaacgccgagcccgagaccccaaatatggacgtgatcggggagcgaataaagcgcatcaaagaggagcacaactctacctggcactatgacgacgaaaatccgtataagacctgggcataccatggctcgtacgaggtgaaagcgactgggtccgcaagcagcatgataaatggcgtggtcaaactgctgaccaagccgtgggacgtcgtgcccaccgtgacacagatggccatgacggataccacccccttcgggcagcagcgggttttcaaggagaaggttgatacccgcacgccgagatccatgcccggtacacgccgggtcatgggcatcacagccgagtggctctggcgcaccctggggcggaacaagaagccacgactttgcacgcgggaggagttcacaaagaaagtgcggaccaacgcggcaatgggggccgtgttcaccgaggagaaccagtgggacagcgcaaaagccgcggtcgaggacgaagacttttggaagctcgtcgacagagagcgcgagttacacaagctggggaagtgtggtagttgcgtgtataatatgatggggaagcgggagaagaaattaggcgagttcggaaaggccaaggggagccgggcaatctggtatatgtggctaggggcacgctatctggagttcgaagcgcttggcttcctcaacgaggatcactggttctcacgggagaattcctactctggggtcgagggggagggcctacacaagctggggtacatccttcgagacatcagcaagatcccgggtggtgcaatgtacgcggatgacacggccggttgggacacccgcatcaccgaggatgatttgcacaacgaggagaagattacccagcaaatggacccggagcaccgccagcttgccaatgcaatcttcaagctaacataccagaacaaggttgttaaggtccaacggcccaccccgaccgggactgtgatggacatcatctcgcgtaaagaccagcggggcagcggccaggttggcacctacgggctgaacacgttcacgaatatggaggcgcagctcatcaggcaaatggagggcgaaggggtcctgtccaaggccgacctggagaatagccacctctctgagaagaagatcacccagtggcttgaaaccaagggggtggaaagactgaagcgcatggccatcagcggcgacgactgcgtggtaaagccaatcgacgaccggttcgcaaatgcccttctggcgctgaacgacatggggaaggtgcgcaaagacataccgcaatggcagccctccaaaggctggcacgactggcagcaggtccccttttgctcccaccacttccacgagctcatcatgaaggacgggagaaagctggtcgtaccctgccgcccgcaggacgaactcataggccgtgcccgtatctcacagggagccggctggagcctccgggaaactgcctgtctgggtaaagcgtacgcccaaatgtggtcgctgatgtacttccaccgcagggacttgcgtctggccagcaacgccatctgttcggcggtacccgtccactgggtccccaccagtcggaccacttggagcatccacgcgcaccaccagtggatgacgaccgaagacatgctgaccgtgtggaatcgggtatggatcgaagacaacccctggatggaagacaagaccccggtaacgacgtgggagaacgtgccttatctggggaagcgcgaggatcagtggtgcggctccctgattggactgaccagccgggcgacctgggcccagaacatccccacggccatccagcaagtacgctccttgattgggaatgaggagttcctcgactacatgcccagcatgaagcggtttagaaaggaagaggagtccgagggggcaatttggtga

SEQ ID NO: 25966 - RNA, 9873 nt, synthetic construct
  misc_feature 1..9873: note = derived and/or modified CDS sequence (opt11) from DENV-3__FJ024466__SS-prME
  source 1..9873: mol_type = other RNA
accagcctatgcctcatgatgatcttacccgcagccttggcctttcatctcaccagccgggacggcgagcctcggatgattgtagggaagaacgagcggggcaaatccctgctgttcaagaccgcctccgggatcaacatgtgcactctcatcgccatggatctgggggagatgtgcgacgacactgtgacctataagtgcccccacatcgcggaggtggagcccgaggatatagattgttggtgcaatctaaccagcacctgggtgacctatgggacctgcaaccaggcgggcgagcacaggcgcgacaagaggtccgtggcgttggctccccacgtggggatggggctggacacgcgcacccaaacctggatgtctgccgagggcgcatggcgccaggtggagaaggtggagacctgggcactgcgccacccggggttcaccatcctcgccctgttcctagcccactatatcgggaccagcctcacccagaaggttgtgatctttatcctgctgatgcttgttaccccctctatgacgatgagatgtgttggggtcggcaatcgcgatttcgttgaaggcctgtcgggggccacctgggtggacgttgtactggaacacggcgggtgcgtgaccaccatggccaagaacaagcccacgctcgacatcgagctgcaaaaaaccgaggcgactcagctggccaccctacggaagctgtgcatcgaaggaaaaatcacgaatatcacgacagatagcaggtgtcccactcagggcgaggcggtgctgccggaagagcaggaccaaaactatgtctgcaagcacacgtacgtggaccgggggtggggcaatgggtgtggcttgttcggcaagggttccctggtgacgtgcgccaagttccaatgcctcgagcccatcgagggcaaggtcgtccagtacgagaatctcaagtacaccgtgatcatcaccgttcatacgggggatcagcaccaggtgggcaacgagactcagggcgtgaccgccgaaatcactccccaagcatccacgaccgaggcgatattgcccgaatacggcaccctcgggttggaatgctccccgcgcaccggcctggactttaacgagatgatcctcctcaccatgaagaacaaggcgtggatggttcaccgacagtggttcttcgacctgccgctgccctggaccagcggcgccaccacagaaacccccacgtggaaccggaaggaattactggtgaccttcaagaacgcccacgcgaaaaagcaggaggttgtggtgctggggtcccaggagggcgctatgcacaccgccctcacgggggcaacggaaatccagaactcgggagggaccagcatatttgccggtcacctgaaatgccggctgaagatggataagcttgagctgaaagggatgagctacgcgatgtgcaccaatacctttgtcctgaagaaggaggtttccgaaacgcagcatgggacaatactcataaaggtggagtacaagggggaagacgcaccatgcaagataccctttagcactgaagacgggcagggcaaggcccataacggccgtctgattaccgctaaccccgtcgtgacgaagaaagaggaacccgtgaacatcgaggcggagccgccattcggcgaatcgaacatcgttattggcatcggagacaacgccttaaaaataaactggtacaagaagggctcgagcatagggaagatgttcgaggccaccgcccgtggagcgcgcagaatggcaatcctgggcgacaccgcttgggacttcggctccgtgggcggggtgcttaacagcttggggaagatggtgcaccaaatcttcggaagtgcctacaccgctctgtttagcggcgtgtcatgggtgatgaagatcggcataggggtgctccttacgtggatcggcctcaacagcaaaaacacctccatgtcattctcctgtatcgccatcgggatcatcactctctacctgggcgctgttgtgcaagcggacaccgggtgcgtcatcaactggaagggcaaggagctgaaatgcggcagcgggatctttgtgacgaacgaagtgcacacctggaccgagcagtatagattccaagccgatagtcccaaacgactcgccactgcaatcgcgggcgcatgggagaacggtgtctgcggcatacggagcacgacccgcatggagaacttactgtggaagcagatcgcaaacgagctcaactacatcctgtgggagaacaacataaaacttaccgtggtcgtcggagacatcataggcgtgctcgagcagggcaagcggaccctcacaccccagccgatggaactcaaatactcctggaagacctggggcaaggccaagatcgtgactgcggagacccagaactcgtcctttatcatcgatgggcccaacacgcccgagtgccccagcgcctcccgcgcatggaatgtttgggaggtggaagactatggattcggggtgttcaccacgaacatttggctcaaactgcgcgaggtttatacccagctgtgcgaccatcgtctaatgtccgcggccgtcaaggacgagcgcgcggtgcacgccgacatgggctactggatcgagtcccagaagaacgggtcctggaagttagagaaggccagcctgatcgaagttaagacatgcacatggccgaagtcccacaccctatggagtaatggcgtcctggagagtgacatgatcatccccaagagcctggcagggccaatctcccagcacaattaccgcccgggctaccatacccagacagccgggccctggcacctcggcaagctggagctggatttcaactactgcgaaggaacgacggtggtcatcaccgacaattgcggcacccgaggcccctccctacgcacgaccaccgtttccggaaagctcatccacgagtggtgctgccggtcatgcaccctgccccctctccgctacatgggagaagacgggtgctggtacggcatggagatacggcccatatccgagaaggaagagaacatggtcaagagcctcgtctccgcgggctctgggaaggtggacaacttcacgatgggggtgctgtgcttggccatccttttcgaggaggtcatgcgcgggaagttcggcaagaagcacatgatcgcgggggtgttcttcaccttcgtgctgctcttgtccggccagattacctggcgggacatggcccacactctgatcatgataggtagtaacgcctccgaccggatggggatgggcgtcacgtacttagcgctgatcgccaccttcaagatccagccctttctagccctcgggtttttccttcgtaagttaacgagccgcgagaacctcctcctgggcgtgggcctcgccatggcgaccacgctgcagttgcctgaggacatcgagcagatggccaacgggattgccctcggcctgatggccctgaagctcatcacccaattcgagacctaccagctgtggaccgccctgatcagccttacgtgcagtaacaccatcttcaccttaaccgttgcgtggcggacggcgaccctaatcctcgccggggtcagcctgctgcctgtatgccagtcctcctccatgcgcaagagcgactggctccccatgacggttgccgcgatgggagtaccgcccctcccgctgttcatcttctccctcaaggacaccctgaagcgacgtagctggcccctaaacgagggggtgatggccgtgggcctagtgtccatcctggcaagcagtctgcttcgcaacgacgtcccaatggcgggacccctggtcgctggaggcctgttaatagcctgctatgtcatcacagggacgagcgcggacctgaccgtggagaaggcggccgacgtcacatgggaggaggaggccgagcagacgggcgtgagtcacaacctgatgattaccgtggatgacgacggcaccatgcgtatcaaggacgatgagaccgaaaacattctcaccgtcttgctgaagacggctctcctgatagtgagcgggatctttccgtactccattcccgcgacactgctcgtgtggcatacctggcaaaagcagacccgccggagcggcgtcctgtgggacgtgccctcacccccggagacacaaaaggccgagctagaggaaggggtataccgcatcaagcaacaggggatctttggtaagacccaagtaggcgtaggggtgcaaaaggagggcgtcttccacaccatgtggcacgtgacccggggcgcagtgctcacgtacaacgggaagcgcctggagcctaactgggccagcgtgaagaaggatctgatttcctacggcggaggctggaggctcagcgctcaatggcagaagggagaggaggtccaggtcattgccgtggaacccggcaagaatcctaagaatttccagacaatgcccggcactttccaaacaactaccggggaaatcggcgccattgccctggacttcaagcccgggactagcggcagtcctattatcaaccgagagggcaaggtagtggggttatacggaaacggggtcgtgacgaagaacggtgggtatgtatccggcattgcacaaacgaacgctgagccagatggtcccacccccgagctcgaggaggagatgttcaagaagcggaatctaaccatcatggatctgcaccccgggtccggcaaaacccgcaagtaccttccggcaattgtccgggaggccataaaacgccggctccgcactctgatattggctccaacgagagtggtcgccgcggagatggaggaggccctcaagggcctccccatccgctaccagacaaccgccactaagtccgaacacaccggccgggagatagtagacctgatgtgccacgccaccttcactatgcgtctcttgtccccggttcgggtaccgaattacaacctgatcatcatggacgaggcccactttacggaccccgcgagcatagcggcccgcggatatatcagcacccgagtcggcatgggcgaggcagcggctatattcatgaccgccacgccgcccggaactgctgacgcattcccgcagagcaacgcgcccatccaagatgaagagcgggacatccctgagcgctcatggaacagcggcaatgaatggatcactgacttcgccgggaagaccgtgtggttcgtgccctcgatcaaggccggaaacgacatcgctaactgcctccggaagaatgggaagaaggtcatccagttgagccgaaagactttcgatacggaatatcagaagacaaagctgaacgactgggacttcgtggtgaccacagacatctccgagatgggcgctaactttaaggcggatcgggtcatcgacccgcgccggtgcttaaagcccgtgatcctcacggatggccccgaaagagtgatattggccgggccgatgccggtcaccgccgccagcgccgcgcagcggcgcggccgggtggggcggaacccccagaaggagaacgaccagtacatcttcaccggccagcccctcaacaatgatgaggaccacgcccactggaccgaggccaagatgttactggataacattaacacgccggaggggatcataccggcactcttcgagcccgagcgggagaagtccgcagccatagacggcgagtaccgcctgaagggcgagtcccggaagacgtttgtggagttgatgcgacggggggatctccccgtctggctggcccacaaggtggcctcagaaggcatcaagtacacagaccgcaagtggtgcttcgacgggcagcggaacaatcagatcttggaggagaacatggatgtcgagatctggacgaaggagggcgagaagaagaagctccgcccccgctggttagatgctcggacctactctgacccgcttgcgctcaaggagtttaaggacttcgccgccggccgcaagtccatcgccctggaccttgtaacggagatcgggcgcgtgcccagccatctcgcgcaccgcacccggaacgcgctggacaaccttgtcatgctccacaccagtgagcacggtggcaaggcctaccgccacgctgtagaggaactgcccgaaaccatggagacgcttctcctgctgggcctaatgatcctgctgaccgggggcgccatgctgttcctgatctcgggcaagggaattggcaagacctcgattggtctgatatgcgtgatcgcctccagcggcatgctgtggatggcggaaatcccccttcagtggatagcatccgccatcgtcctggagttctttatgatggtgctattgatccccgaacccgaaaagcagcggacgccacaggacaaccagctggcgtacgtggtcatcgggatcctcacgctggcagcgatcatcgctgcaaatgagatgggcctcctggagaccaccaagcgcgacctgggaatgtctaaggaaccgggggtagtgtcccccaccagctacctggacgtcgacctccatcccgcctccgcatggacgctgtacgcagttgccaccacagtgattaccccgatgctgcggcatacgatcgagaacagcaccgctaacgtctccctcgccgcgatcgctaaccaggccgtagtgctcatggggctggacaaggggtggccgatctctaaaatggacctcggcgtcccactcctggccctcgggtgctactcgcaggtcaaccctctaacgctgaccgccgccgtgttgctattgatcacgcactacgccatcattggccccggcctacaggcgaaggcaacgcgggaggcccagaagcgtaccgcggccggcatcatgaagaacccgaccgtcgatggcatcatgacgattgacctggaccccgtgatctacgacagcaagtttgagaagcagttgggccaggtgatgctcttagtattgtgcgccgtgcaactcctgctgatgcgcacctcctgggccctctgcgaggcgctgactctggccacaggacccattacgactctctgggagggcagccccgggaagttctggaataccacaatagcagtgtccatggccaacatattcagaggcagctatctggcaggggccggcctggccttctccatcatgaagtccgtcgggacgggcaaacgcggcaccgggagccagggcgagaccctcggcgagaagtggaaaaagaagctgaatcaactatcacggaaggagtttgatctatataagaagtccggtatcaccgaggtcgaccgcaccgaggccaaggaggggctgaagcggggcgagataacgcatcacgcagtgtcccgcggcagcgccaagctgcagtggttcgtcgagagaaacatggtgataccggagggccgcgtgatcgacctagggtgcgggcggggagggtggtcctactactgcgccgggctgaagaaggtcaccgaggtgcggggctacaccaaaggcgggcccgggcacgaggagcctgtgcccatgtccacttatggctggaacatcgtcaaactgatgtccgggaaggacgtgttctacctcccgcccgagaagtgcgacacgttactgtgcgacatcggcgagagctctccttcaccaaccgtggaggagtcccggacgatacgggtgctgaaaatggtggagccgtggcttaagaacaaccagttctgcatcaaggtgctcaacccctatatgcccacagtgatcgagcacctggagcgcctccaacgaaagcacggcgggatgctcgtgcgcaacccccttagccggaactccacgcatgagatgtactggataagcaacggcaccggcaacattgtggctagtgtgaacatggtgagccgcttgctgctgaaccgattcacgatgacccaccgtagaccgacgatcgagaaagacgtcgacctcggcgcgggcacccgccacgtcaacgccgagcccgaaactcctaacatggacgtaatcggggagcgcatcaagcgcatcaaagaggagcacaactccacctggcactacgatgacgagaacccctacaagacgtgggcctaccatggcagctacgaggtaaaggcgactgggtccgccagcagcatgatcaacggcgtcgtaaaactactgaccaagccctgggacgtcgtgcccatggtgacccaaatggcaatgacagatacaacacccttcgggcagcagcgggtcttcaaagagaaagtggacacccgcacacctcggagtatgcccggcacccgccgggtgatgggcatcaccgctgagtggctctggagaaccctcgggcggaacaagaagccccgtctctgcacacgggaagagttcactaagaaggtccggacgaacgcggcaatgggcgcagtgtttaccgaggagaaccagtgggacagcgccaaagccgcggtggaggacgaggacttctggaagctcgtcgacagagaacgggagctgcacaagctggggaagtgtggctcctgcgtgtacaatatgatggggaagcgggagaagaagcttggtgagttcgggaaagccaaggggtcgcgggccatttggtacatgtggctgggcgctcgctatttagagtttgaagctctcggtttcctcaacgaagaccactggttctcccgagaaaatagctactccggggtcgagggggagggcctgcacaagctcggctacatcctgcgggacatctcaaagatcccaggcggcgcgatgtacgccgacgacacggcgggttgggacaccaggataactgaggacgatctgcacaacgaggagaaaatcacccaccagatggatccggagcaccgccagcttgccaacgctattttcaagctgacgtaccaaaacaaggtcgtgaaggttcagcggcccacacccaccggtaccgttatggacatcatctcccgcaaggaccagcggggcagcggccaggtgggcacctatgggctgaacacgttcaccaacatggaggcgcagctcatccgccagatggagggagagggggtgctctccaaggccgacctggaaaacccccacctctccgagaagaagatcacccagtggctggagaccaagggcgtggagcggctgaagcgcatggccatctccggcgacgattgcgtggttaaaccgatcgacgaccgcttcgccaacgccctcctggcactgaacgacatggggaaggtccgtaaggacatcccccagtggcaaccgagcaagggctggcatgactggcagcaggtccccttctgctcgcaccacttccacgagctcatcatgaaggacgggcggaaattggttgtcccgtgtcgcccccaggacgagctgatcggcagagcgcgcatctcacagggggccggatggtcgctccgagaaacggcgtgcctgggcaaggcgtacgcccagatgtggtccctgatgtactttcatcggcgggacttgcgtctggcctccaacgccatctgctccgccgtgcccgtacattgggtacccacttcccgcaccacctggtccattcacgcgcaccaccagtggatgacgaccgaggacatgttaaccgtatggaaccgggtgtggatcgaggacaacccctggatggaagacaaaactcccgtcactacatgggagaatgtgccctatcttggcaagcgcgaggaccagtggtgtggcagcctgatcgggctgacgtcacgggccacctgggcccagaatatccccacagctatacaacaggtccgcagcctcattggcaacgaggagttcctcgactacatgccgtccatgaagcggttccgcaaggaggaggagagcgagggagctatctggtga

SEQ ID NO: 25967 - RNA, 9873 nt, synthetic construct
  misc_feature 1..9873: note = derived and/or modified CDS sequence (opt11) from DENV-3__FJ024467__SS-prME
  source 1..9873: mol_type = other RNA
accagcttatgtttgatgatggtgctgcccgcggcgctcgcgttccacctcaccagccgcgacggcgagccccggatgattgtagggaagaacgagcgcggcaagagcctgctgttcaagacggcctccgggatcaatatgtgtaccctaattgccatggacctcggcgagatgtgtgacgataccgtaacctacaagtgcccacacattaccgaggttgagcccgaagacattgactgctggtgcaacctgaccagcacttgggtgacctacgggacgtgcaaccaggccggcgagcaccggcgcgataagcggtccgtggcgctggccccccatgtcgggatggggttggacacccggacccaaacctggatgtctgccgagggcgcttggcggcaggtcgagaaggtggagacgtgggccctgcgccacccggggttcacaatcctcgcgctgttcttggcccactacatcggtacgtccctcacccagaaagtcgtcatcttcatcctgctgatgctggtgacgccctctatgaccatgcggtgcgtgggggtgggcaaccgcgacttcgtggaaggcctgtccggggccacctgggtggatgttgtcctggagcacggtgggtgtgtgaccaccatggccaagaataagccaaccctagacatcgagctacagaaaaccgaggccacccagctggcgacgctccggaagctttgcatcgagggcaagatcaccaatataaccacggatagccggtgccccacccagggtgaggccgtcctaccagaagagcaagatcagaactacgtgtgcaagcacacctacgtggaccgggggtggggcaacggctgcgggttattcgggaaaggctcccttgtgacctgcgctaagttccagtgcctggagcccatcgaaggtaaggtggtacagtatgagaacctgaaatacaccgtcatcatcacggtccatactggggatcagcaccaggtaggtaacgaaacccagggggtgacggcggagattacgccccaagccagcaccaccgaggcgatcctccccgaatacggcaccctggggttggagtgttccccgaggacgggcctggacttcaacgagatgatcttactcacgatgaagaacaaggcctggatggtgcaccggcagtggttctttgacctgcccctaccctggacgagcggagccaccaccgagacgccgacgtggaaccgcaaagagctgctggtcaccttcaagaatgcccatgccaagaagcaggaggtggtggtactggggagccaggagggcgcgatgcacaccgccctcacgggggccaccgagatccagaacagtggggggacctcaatttttgccgggcacctgaagtgccggctgaaaatggacaagctcgagctgaagggcatgagctacgctatgtgcaccaacacgtttgtgctgaagaaggaggtgtccgagacccaacatgggaccattctgatcaaggtagagtacaagggcgaggacgccccgtgcaaaatcccgttcagcaccgaggacggccagggcaaggcccacaacgggcgcctgattactgccaacccggtggtcaccaagaaagaagagcccgtgaacatcgaggcagagccgccgttcggggagagcaacatcgtgatcggcatcggggacaacgccctgaagatcaactggtacaagaagggctccagcatagggaagatgttcgaggccactgcccggggcgcacgccggatggccatcctgggggacaccgcgtgggacttcggatccgtggggggggtactcaactcgctgggaaagatggtgcaccaaatctttggttccgcgtatacggccctgttcagcggtgtgtcgtgggtcatgaagataggcatcggggtacttttaacctggattggcctgaactcaaagaacacctccatgtcgttctcctgcatcgccataggggtgatcaccctctatctgggcgcagtagtacaggcggatatggggtgcgtaatcaactggaaaggcaaggagctaaaatgtggcagcggcatcttcgtcacgaacgaggtgcacacctggaccgagcagtacaagttccaagccgactcccccaagagactcgccaccgcgatcgcaggcgcgtgggagaatggggtgtgcggcattcgcagtactaccaggatggagaacctgctgtggaagcagatcgccaatgagctcaactacatcctatgggagaacaacatcaagctgaccgtcgtggtgggggacatcatcggagtactcgagcaaggcaaacgcaccttgacgccccagccgatggaactgaagtattcctggaaaacctgggggaaggccaagatcgtaaccgccgagacgcagaatagctccttcatcatcgacggacccaacacacctgagtgcccaagcgcttcacgggcctggaacgtgtgggaggttgaggattacgggttcggcgtgttcacgacaaatatatggctgaagctgagggaggtgtacacccaactgtgcgaccaccggctcatgagcgcggccgtcaaagacgagcgcgcagtgcatgcggacatgggctactggatcgagagccaaaagaacgggtcctggaagctggagaaggccagcctgatagaggtaaagacctgcacgtggccgaagtcccacaccctctggtccaacggcgtcttggagtccgacatgataattcccaagtccctggcagggcccatatctcagcacaaccatcggccgggttatcagacccagaccgccgggccctggcacctgggcaagctggaattagatttcaactactgcgagggcacgaccgttgtaatcaccgagaactgcgggaccaggggccccagcctccggacgaccaccgtctccgggaagctaattcacgaatggtgctgccgcagctgcacactgcccccgctccggtatatgggcgaggacggatgctggtacggcatggagatccgccctatctccgagaaggaggaaaacatggtcaagagccttgtgtccgccggcagcggcaaggtcgacaacttcacgatgggtgtgctgtgcctcgcgatcctgtttgaggaaatgatgcggggtaaattcggtaagaagcacatgatcgccggggtattcttcaccttcgtgttactcctgagcggtcagatcacctggcgggacatggcccacacactaatcatgattggcagcaacgcctccgaccgaatgggtatgggagtgacttacctcgccctgatagcagcctttaagatccagccgtttctggcactcggtttcttcctgcgcaagctgaccagccgggagaatctactgctgggcgttggccttgccatggcaaccactctgcagctccctgaggacatcgagcagatggccaacgggatcgccctcggtcttatggccctgaaactcatcacgcagtttgagacataccagctctggaccgccctgataagcttaacctgctccaatacaatgttcactttaaccgtcgcgtggaggaccgccacgctaatcttagccggggtgagcctgctgccggtgtgccaatcaagctccatgcggaagacagattggctccccatggccgtggccgcgatgggggtcccgccgctccctctgtttatcttcagcctcaaggacaccctgaagcgccgctcctggcccctgaatgagggggtcatggccgtggggctcgtgagtatcttagcctccagcctgctccggaacgacgtccccatggcaggtcctcttgtggccgggggattgctaatcgcatgctatgtgatcaccgggacttccgccgacctgaccgtcgaaaaggctgccgacatcacctgggaggaggaggccgagcagaccggcgtgtcacacaacctgatgatcacggtggatgatgacgggaccatgcgcataaaggatgacgagactgagaacatcctcaccgtcctgctgaagaccgcgctcctgatcgtgtccggcgttttcccctacagcattcccgccacgctgctcgtctggcacacctggcagaagcaaacccagcggtccggcgtgctgtgggacgtgccaagcccgcccgagacccagaaggcagagctggaggagggggtctaccgtatcaagcagcaaggtatcttcggtaaaacccaagtgggcgtgggggtccaaaaggaaggcgtattccatactatgtggcacgtaacccgaggcgccgtccttacctacaacgggaagcgcctggagcccaactgggcgagtgtgaaaaaagacctgatcagctacggcgggggctggcggctctccgcccagtggcaaaagggggaggaagtgcaggtcatcgccgttgagccgggcaagaaccctaagaacttccagacgatgcccggcaccttccagaccacaacgggtgaaatcggcgccatcgccctggacttcaagcccggcacgagcggtagccctatcatcaatcgagagggcaaggtggtcgggctgtatggaaacggtgtggttaccaagaacggcgggtacgtcagcggcatcgcacagaccaacgccgagccggacggacccacgcccgagctggaggaagagatgttcaagaagcggaacctcaccatcatggatttacaccccggaagcggcaagacccgcaagtatctgccggccatcgtgcgggaggccatcaaacgccggctccgcacgctgatcctggcccccactcgggtggtcgcggctgaaatggaagaggccctaaagggtctgcctatcaggtaccagaccacggcaaccaagagtgaacacacgggcagagaaatcgttgacctgatgtgccacgccaccttcaccatgcgcctcctgagcccagtgcgagtccctaactacaacctgattataatggacgaagcccacttcacagaccccgccagtatcgctgcccgcgggtacatcagcacgcgtgtgggaatgggcgaggcggccgccattttcatgactgccacaccgccaggaaccgccgatgccttcccacagtccaacgctccaatccaggacgaggaaaaggacatccccgaacgaagctggaactccggaaatgagtggatcacggatttcgccggaaagaccgtgtggttcgtccccagcattaaagccggcaatgacatcgcaaactgcctccgcaagaacgggaagaaagtgatccagctcagccggaagaccttcgacaccgaataccagaagacgaagctaaatgactgggatttcgtggttaccaccgacatcagtgagatgggcgcgaacttcaaagccgaccgcgtgatcgaccccagacgctgcctaaagcccgtcatactgaccgacggcccggagcgcgttatattagccgggcccatgccggtaacagctgcatccgcggcccagagacggggccgcgtgggtcggaacccccagaaggagaacgaccaatatattttcaccggccagccgctcaacaatgacgaggatcacgcccattggaccgaggcaaagatgctgctggacaacatcaataccccagaaggaatcatcccggcactcttcgagccagagagggagaagtccgctgcaatcgacggtgagtatcggctaaagggcgagtcccggaagacatttgtcgagctcatgcggcggggggacctaccagtgtggctggcccacaaggtcgccagcgagggcatcaagtacaccgaccggaagtggtgcttcgacgggcagaggaacaaccagatcttggaggagaacatggacgtggagatatggacgaaagagggcgagaagaagaagttgcggccccgctggttagacgctagaacttattccgaccctctggccctcaaggagttcaaggattttgccgcaggccgcaagtccatcgctctggacctggtgacggaaatcgggcgcgtcccgtcccacctcgcgcacaggactcggaacgcgctggacaacctggtgatgctccacacttctgagcatggagggcgggcctaccgccacgcagtagaggagttgcccgagacgatggagaccctgctcctgctgggcctcatgatcctgctgaccggcggggccatgctgttcctgataagcgggaaggggatcggaaaaacaagtatagggctgatctgtgtcattgcgagcagcggcatgctgtggatggccgagatcccactacaatggatcgcctcagccatcgtcctcgaattcttcatgatggtactcttaatcccagaacccgagaagcagaggacgccccaagacaaccagttagcctacgtggtgatcgggatcttgacccttgctgccatcatcgccgccaacgagatgggtttactcgagacgacgaagcgcgatctgggcatgtccaaggagccgggggtggtcagcccaacctcctatctggacgtggacctccatcccgcgtccgcttggacgctgtatgcggtggccacgaccgtcatcacacctatgctgcggcacaccatcgagaactctacggccaacgtaagcctcgcagccattgcgaaccaagcggtggtcctgatgggcttggataagggctggccgatctcaaagatggacctcggcgtgcccctgcttgccctcgggtgctacagtcaggtgaatcctctgaccctgaccgcggcggttctcctactgatcacccattacgccatcattggtccgggcctccaggccaaggccacgcgtgaggcgcagaagcggaccgcggccgggatcatgaagaacccgacagtggacggcatcatgaccatcgatctggaccccgtgatctacgactccaagtttgagaagcagttagggcaggtcatgctcctggtgttatgcgccgtgcagctcctgctaatgcgaactagctgggcgctgtgcgaggccctcacccttgccaccggacccataacgacgttgtgggaaggctccccggggaagttctggaacaccacaatcgccgtcagcatggcaaacatcttccggggttcctacctggcgggtgccggcctggctttcagcatcatgaagtccgtaggtaccggcaagcgcggcacggggagtcagggagagaccctcggggagaagtggaagaaaaagctgaaccagctgtcgcggaaggagttcgatctctacaagaagtccgggatcactgaggtggaccgcaccgaagccaaggaggggctgaaaagaggcgagaccacgcaccacgctgtcagccgcggcaccgcgaaactgcaatggttcgtggagcggaacatggttatcccggagggccgcgtcatcgatctcggttgcggtcggggtggttggtcctactactgcgccggcttgaaaaaggtgaccgaggtgcgcggctataccaagggtgggcccgggcacgaggagcctgtccccatgagcacttacggctggaacattgtgaaactgatgtccgggaaagatgtgttctacctcccacccgagaagtgcgatacccttctgtgcgacatcggagagagttccccctcccccaccgtcgaggagtcccgaaccatccgcgtgctaaaaatggtggagccgtggctcaagaacaatcagttctgcatcaaggtcttaaacccatacatgcccacggtcatcgagcacctggagcgcttacagagaaagcacggcggaatgctggtgcgcaaccccctgagccgtaactccacccacgagatgtactggatctccaacggcaccgggaacatagtcgcctccgtgaacatggtgagccgcctcctcctgaatcggttcaccatgacgcaccgccggccgaccatcgaaaaagatgttgatctgggcgccggcacccgccacgtcaacgcagaacccgaaacccccaacatggacgtcatcggggaaaggataaaacgaattaaggaggaacacaacagcacgtggcactatgatgatgagaacccgtacaaaacatgggcgtaccacgggagctatgaggtcaaggccaccggatctgccagctccatgatcaacggcgtggtcaagctgttaacaaagccctgggacgttgtgcccatggtcacgcagatggcaatgactgataccacccccttcgggcagcagcgggtattcaaggagaaggtggacacgcgcacgccgcggagcatgcccggcactcgccgggcgatgggcatcaccgccgagtggctctggcgcacgctggggcggaacaaaaaaccccgcctgtgcacgcgggaggaattcaccaagaaggtccgcacaaacgccgccatgggcgctgtgttcacggaggagaaccagtgggatagcgccaaggccgccgtggaggacgagaacttctggaagctagtagaccgcgagcgagaactgcacaaactggggaagtgcggctcttgtgtgtacaacatgatgggcaagcgcgaaaagaagttaggcgagttcggcaaggccaaggggtcccgtgccatctggtatatgtggttaggtgcccgctacctggaattcgaggccttggggttcctgaacgaggaccactggttctcacgggagaacagctactccggcgtggagggggaaggcctgcacaagctcgggtacatcctccgcgatatcagcaaaatccccgggggtgccatgtacgccgacgacaccgccgggtgggacacacggatcaccgaagacgatctgcacaacgaggagaagatcacgcagcagatggacccggaacaccgccagctcgcgaacgccatcttcaaactgacttaccagaacaaggtcgtgaaggtgcaacggcccacccccaccggcaccgtcatggacatcatctcccgcaaggaccagcgagggagcggccaagtgggtacgtacggtctgaacaccttcactaatatggaggcccagcttatccgacagatggagggcgagggggttctgtctaaggccgacctggaaaacccacacctgccggagaagaaaatcacccagtggctggagaccaagggtgtcgagcggctgcgtcggatggcaatatcgggcgatgactgcgtggtgaagccgatcgacgacagattcgcgaatgccctcttagccctgaacgatatggggaaggtccggaaggacatcccacagtggcaaccgtccaagggctggcacgactggcagcaggtcccgttctgcagccatcacttccacgagttaatcatgaaggacgggcgcaaactggtcgtcccctgccggccccaggacgagctgattgggcgcgcacggatctcccagggagcgggctggagcctcagggagaccgcctgcctaggaaaggcctacgcccaaatgtggagcttaatgtacttccaccgcagggatctccgtttggccagcaacgcgatctgctccgctgtgcccgtgcactgggttccgacgagccggaccacgtggtccatccacgcccatcaccagtggatgacaaccgaggacatgctcaccgtgtggaaccgagtgtggatcgaggacaacccctggatggaagacaagacgccagttaccacttgggagaacgttccttatctcgggaagcgggaggaccagtggtgcggaagcctaatcgggctgaccagccgcgccacgtgggcccagaacataccgaccgcgattcagcaagtccgctccctcatcggcaatgaggagttcctagactacatgccaagcatgaagcgcttccgtaaggaggaggagtccgaaggggccatctggtga

SEQ ID NO: 25968 - RNA, 9873 nt, synthetic construct
  misc_feature 1..9873: note = derived and/or modified CDS sequence (opt11) from DENV-3__FJ024468__SS-prME
  source 1..9873: mol_type = other RNA
acctcgctgtgtctaatgatgatcctgccggccgctctggcttttcacctcaccagccgggacggggaaccccggatgatcgtggggaagaacgagcgcggcaagtctctgctgttcaagaccgcgtcgggtatcaacatgtgcaccctcatcgcgatggatctgggcgagatgtgtgacgacaccgtaacgtacaagtgccctcacatcaccgaggtggaacccgaggacatagactgttggtgcaacctgaccagcacctgggtgacgtacgggacgtgcaatcaggccggcgagcatcggcgtgacaagcggtcagtcgccctcgcgccccacgtgggcatgggactggacacccgaacccaaacctggatgagcgccgagggcgcctggcgccaggtggagaaggtcgagacttgggccctacgtcacccggggttcaccatactcgcgttattccttgcacactatattggtactagccttacccagaaggtggtaattttcatcctcctgatgctggtcacgccctcgatgaccatgcggtgtgtgggggtgggaaaccgggacttcgtcgaaggcctgtccggggccacctgggtggacgtggtcctggagcacggcgggtgcgtgaccacgatggcgaagaataaacccaccctcgatatagagctgcagaagaccgaagccacccagctggcgacgctccggaaactttgcatcgaaggcaagattaccaacattaccaccgattcccgctgccccacgcagggcgaggccgtgctgccggaggagcaagaccagaactacgtctgcaagcacacatatgtggaccgggggtggggcaatggatgtggcctgttcgggaagggctccctggtgacctgtgcaaagttccagtgcctggagcccatcgagggcaaggtcgtgcagtatgagaacctgaagtacacagtgatcatcacggtccataccggggaccagcatcaggtggggaacgagacccagggagtcacagccgagatcacaccgcaggccagcacgaccgaggccatcctgcccgagtacggcaccttaggactcgagtgctccccgcgcaccggcctggacttcaatgagatgatcctactcactatgaagaacaaagcatggatggtacaccggcaatggttcttcgatctgcccctgccctggacgagcggcgcaactaccgagacgcccacctggaaccgcaaggagctcctggtgaccttcaagaacgcccacgcgaagaagcaggaggttgtggtcctgggtagtcaggagggagcgatgcacaccgccctcacgggggctaccgagatccagaacagcggcggcacctctatcttcgccggccacctgaagtgccggctgaagatggataagctcgagctaaagggcatgagctacgccatgtgcactaacacgttcgtcctcaagaaggaggtatcagagacccagcacgggaccatcctcatcaaagtggagtacaagggcgaggacgcgccttgcaagatccccttttcaacagaggatgggcaggggaaagcccacaacggccgcctgatcacggccaaccccgttgtgaccaagaaggaggaacccgtgaatatcgaggccgagccgccgttcggggaaagcaacatcgtcatcggtatcggggacaatgctctgaagattaactggtataagaagggctccagcatcgggaagatgttcgaggccaccgcccggggcgcccgccggatggccatcctgggcgacacagcatgggacttcgggtctgttggcggggtgctcaacagcctaggcaagatggtccaccaaatcttcggctccgcctacaccgccctgtttagcggcgtgtcctgggtcatgaagatcggcatcggggtgctgctgacctggatcggactgaacagtaagaatacctcaatgtctttctcctgcattgcgatcggggtaatcaccctctacttaggtgcggtggtccaggcggacatgggctgcgtgatcaactggaagggcaaggagctgaaatgcggctcagggatcttcgtgacgaacgaggtccacacatggaccgaacagtacaaattccaggccgactccccaaaacgattagccactgcaattgccggcgcgtgggagaacggggtgtgcggcatccgcagcaccaccagaatggagaacctgctttggaaacagatcgccaacgaactgaactacatcctttgggagaataatatcaagctgaccgtcgtcgtgggggacatcatcggcgtgctggagcaaggtaagcgcaccttaacgccccaaccgatggaactgaagtactcctggaagacctggggcaaagccaagatcgttacggctgagacccagaacagctccttcatcatcgacgggcctaatacgcccgagtgtccctctgcgtcgcgggcctggaacgtgtgggaggtggaggattacgggttcggcgtattcactactaacatatggttaaagctgcgcgaggtttacacgcaactatgcgaccaccgactcatgagcgcagccgtgaaagacgaacgcgccgtccatgcggatatgggctattggatcgagtcgcagaagaacgggtcgtggaagttggagaaggcaagcctgatcgaggtgaagacctgtacgtggccgaaatcacacaccctctggagcaatggcgtgttagagtccgatatgatcatccccaagagcctcgctgggcccatttcccaacacaactaccggccgggttatcacacgcagacagcaggaccctggcacttgggaaagctggagctggacttcaactactgtgagggtacgaccgtcgtgataacggagaactgcggcacccgcggcccgagtctccggacaaccactgtgtccggcaaactgatccacgaatggtgctgccgcagctgtacgctgcccccgctacggtacatgggcgaggacgggtgttggtacggaatggagatccgccccatatctgaaaaggaggagaatatggtaaagagtctcgtatccgcaggcagcggtaaggtcgataacttcacgatgggcgtcttatgcttggcgatcctgttcgaggaagttatgcggggtaagttcggcaaaaagcacatgatcgccggggtattcttcacctttgtcctcctgctttccggccagatcacatggcgcgatatggcccacaccctgatcatgatcggatctaacgcttccgacaaaatgggaatgggcgtgacttacctcgccctgatcgctacattcaagatccaacccttcctcgccctcgggttctttctgcggaagctgaccagcagagagaacctcctgctgggcgtggggctcgccatggccaccacgctgcagttgcccgaggacattgagcagatggcgaacgggatcgccctcggattgatggccctgaagctcatcacccagttcgagacttaccagctgtggacagccctgatcagcctcacgtgctccaataccatgttcaccctgaccgtcgcttggcggactgcgacgctgatcctcgcaggggtaagccttctgccagtctgccagtcctcatccatgcgcaagacggattggctcccgatggcggtggctgccatgggcgttccacccctcccgttgttcatcttcagcctcaaggacacattaaagcgtcgcagttggcctctgaacgagggggtcatggcggtgggcctcgtctcaatcctggcatcctccctcctccgcaacgacgtcccgatggccggcccgctagtggccgggggcctgctcatagcctgctacgtgatcacaggaacctccgcggacctgactgtcgagaaggccgccgacatcacatgggaggaggaagctgagcagacgggcgttagccacaacctgatgattaccgtggacgacgacgggaccatgcggatcaaggatgacgagaccgagaacatccttacagtcctgctgaagacggccctcctgatcgtgtccggcgtgttcccgtacagcatccccgccaccttacttgtttggcacacctggcagaaacaaacccagcgctccggagtgctgtgggacgtgccaagtccacccgagacgcaaaaggccgagctggaggagggggtctaccggatcaaacaacagggcatcttcgggaagacacaggtgggggtgggggtccagaaggagggagtgttccataccatgtggcacgtaactagaggcgctgtcttgacgtataatgggaagcggctggagcccaactgggcctcagtgaagaaagacctcatcagctacggcggaggctggcgcttgagtgcgcagtggcaaaagggggaggaggtccaagtcatcgccgttgagcccggtaagaaccctaagaacttccagacgatgccgggcacgttccagaccacgaccggggagatcggcgccatcgccctggacttcaaacctgggaccagcggcagtcccatcatcaaccgggagggcaaggtcgtggggttgtacggcaatggggtggtgaccaaaaacggtgggtacgtgtccggtatcgcccagacgaacgcggaaccggacggccctacgcccgagctcgaagaggagatgttcaagaagcgcaacttaaccataatggacttgcaccctggcagcggcaagactcggaagtacctgccggccatcgtccgcgaagctatcaagcgacgcctccggacactgatcctggcccccacccgcgtagtcgcagcggagatggaggaagccctcaaagggctccccatccggtaccagaccaccgccaccaagtccgaacacaccggccgtgagatcgtggatcttatgtgtcacgccactttcaccatgcggctcctgtcccccgtgcgcgtccctaactataacctgataatcatggacgaggcccatttcacggacccagcaagtatcgccgcgagggggtacatcagcacccgcgtgggaatgggcgaagctgccgccatattcatgaccgctacgccgcccgggacggccgacgccttcccgcagtccaacgcgccgatacaggacgaggaaagagacatccccgagcgctcttggaactccggaaatgagtggataaccgacttcgcggggaagaccgtctggttcgttcccagcatcaaggcaggtaacgacatcgccaattgcctccgcaagaacggcaaaaaggtgatacaactgtcccgaaagacatttgacacggaataccagaagaccaagctgaacgactgggattttgtggtcacaacggacatcagtgagatgggcgccaacttcaaggcggaccgcgtgatcgacccccggcgctgcttgaaacccgtgatcctgacggacggtccggaacgggtcatcctcgccggacccatgccggttaccgccgcatccgccgctcagcggagaggaagggtggggcgcaacccacaaaaagagaatgaccagtacatcttcaccggccagcccctcaacaacgacgaggaccatgcacactggaccgaagccaagatgctgctggacaacataaacacgcccgaggggatcatcccggccctcttcgaacccgagcgcgaaaaatccgcggccatcgacggtgagtaccgtctgaagggcgagtcgcgcaagacattcgtcgaacttatgcggcgtggtgaccttcccgtatggctggcccacaaggtcgcctctgagggcattaaatacaccgaccggaagtggtgcttcgatgggcagcgcaacaatcagatactggaggagaatatggacgtggagatctggacaaaggaaggcgagaagaagaagctccggccccgctggctagacgcacggacatactccgacccgctggcgctgaaggagttcaaggacttcgccgcgggtcgcaagagcatagcactcgacctggtgacggaaatcgggagagtcccctcccatctcgcccaccggacccggaacgcgctggacaatttggttatgctccacaccagtgagcatggcgggagggcctatcgacatgccgtagaggagttacccgagaccatggagacgctgttgctgttgggcctcatgatcctgctgacagggggtgccatgttattcctaatcagcggcaaggggatcggcaagacctctatagggttaatctgcgtcattgcctctagtggcatgctatggatggcggagatccctctgcaatggatagccagcgctattgttctggagttcttcatgatggtgctgctgatacccgagcccgagaagcagaggacaccacaagacaatcagctcgcatacgtcgttatcggtatcctcacgctggccgcaatcatcgcagccaatgagatgggactgttggagactaccaagcgcgacttgggcatgtccaaggagcccggggtggtctcacccacctcctatctggacgtggacctccacccggcatcagcgtggacgctgtatgccgtcgccaccactgtcatcacacctatgctaagacacacgatcgagaactccaccgcaaacgtcagtctggccgcgatcgccaaccaggccgtagtgctgatgggcctggacaagggttggccgatctccaagatggacctcggcgtgcctctgctggcactcgggtgctacagccaggtgaaccccttgaccctgaccgccgcggtcctcttgctgatcacgcactacgccatcataggccccggcctccaggccaaggccacccgcgaggcccagaagcggactgcggccggcattatgaagaacccgaccgttgatggcataatgactatcgacctggaccccgtgatctacgattccaagtttgagaagcaactggggcaggtaatgttgctggtgctgtgcgccgtgcaactactcctaatgcggacaagctgggccctctgcgaggcgctgaccctggccaccggccccatcacgaccttgtgggaaggctctcccgggaagttctggaacaccacaatcgctgtcagcatggcgaacatctttcggggtagttacctggccggcgcgggcctcgctttcagcatcatgaagtccgtggggacgggcaaacgcggcaccggttcacagggcgagaccctcggcgagaagtggaagaagaaactgaaccagctgtcgcggaaggagttcgatctctacaagaagtccggcatcacagaggtggatcgcaccgaagctaaagaggggctgaagcggggagagacgacgcaccatgccgtaagccgcggaacggccaagctacaatggttcgtggaacggaacatggtgattccggaggggcgcgtcattgacctaggctgcgggcgaggcgggtggtcctattattgcgcgggcctgaaaaaggtgaccgaggtccgcggctacactaagggcgggcccgggcatgaggaacccgtccccatgagcacttacggctggaatatcgttaagctgatgtccgggaaggacgtcttctacctcccgccggagaagtgcgacaccctgctgtgtgatataggagagagttcccccagccccaccgtcgaggaatcccggacgatacgcgtgctaaagatggtggaaccgtggctcaagaacaatcagttctgcatcaaggtcctgaatccatatatgcccactgtgatcgagcacctagagcgcctccagcggaaacacggcgggatgctggtgcgcaaccccttaagccggaactccacccacgagatgtactggatcagcaacggcaccgggaacatcgtggcgtccgtgaatatggtgagcaggttactcctgaaccggtttacgatgacccaccgccgtccaaccattgagaaggatgtcgacctcggcgccggcacccgccacgtgaacgccgagcccgagacgccgaacatggacgtgatcggggaaagaatcaagcgcataaaggaggaacacaatagtacctggcactacgacgacgagaacccgtacaagacctgggcataccacggctcgtacgaggtcaaggccaccgggtcggccagctccatgatcaatggagtggtaaagctgctgacgaagccctgggacgtggtgcccatggttacccagatggccatgactgacaccacgccgttcgggcagcagcgggtgttcaaggaaaaggtcgacacccgcacaccccggagcatgccgggtacccgcagagtgatgggcatcactgctgagtggctctggcgcactctggggcggaacaagaagccacggctgtgcacccgggaagagttcaccaagaaggtgcgcacgaatgcggcaatgggtgccgtgttcaccgaggagaaccagtgggacagcgccaaggcggctgtcgaggacgaggacttctggaaacttgtggaccgcgagcgggagctgcataagctgggcaagtgcggttcatgcgtgtacaacatgatgggaaaacgcgagaaaaagctcggcgagtttggcaaagccaaggggagccgggccatctggtacatgtggctgggagccaggtacctggagttcgaggccctcgggttcctgaacgaggatcactggttctcccgggaaaatagctactccggcgtcgaaggggagggtctgcacaagctcggctatatcctgcgcgacatctcaaagatcccagggggcgcaatgtatgctgacgacaccgctgggtgggacacccggatcacagaggacgacctgcataacgaggagaagattacgcagcagatggaccccgaacaccgccaactcgccaacgccatcttcaagctgacctatcagaacaaggtggtcaaggtacaacgacccacccccacaggcacggttatggacattatcagccgcaaagaccaacggggctctggacaggtgggtacctacgggttgaacacatttaccaatatggaagcgcagctcatccgccagatggaaggcgagggggtactatcgaaggcagacttagaaaatccccatcttccggagaagaagattacccagtggctggagaccaagggcgtcgagaggctgcgacggatggccatctccggggatgactgcgtcgtgaagcccatcgacgaccgcttcgcaaatgccctcctggcgctaaacgatatgggaaaggtgaggaaggacatcccccagtggcagcccagcaaaggctggcacgactggcagcaggtcccgttctgcagccaccattttcatgaattaatcatgaaggacgggcgtaagctcgtcgttccctgccggccccaagatgagctgatcggccgcgccagaatttcccagggggccgggtggagccttcgcgagaccgcctgcctgggcaaggcgtacgcccagatgtggtccctgatgtacttccaccgacgggacctcaggcttgccagcaacgccatctgctccgcggttcccgtccactgggtacccacctcgcggacgacctggtccatccacgcgcaccaccagtggatgaccaccgaggacatgctgaccgtgtggaaccgagtctggatcgaggacaacccctggatggaggacaaaacccccgtaacaacctgggagaacgtgccctacctcgggaagcgggaggaccagtggtgcggaagtctgatcgggctgacaagccgcgccacctgggcccagaacatcccaaccgccatccagcaggtccggtccctaatcgggaatgaagagttccttgattacatgccctcgatgaagcgcttccgcaaggaggaggagtccgagggggccatctggtag

SEQ ID NO: 25969 - RNA, 9873 nt, synthetic construct
  misc_feature 1..9873: note = derived and/or modified CDS sequence (opt11) from DENV-3__FJ024470__SS-prME
  source 1..9873: mol_type = other RNA
acctctctgtgcttaatgatgatactgcccgccgccctggcgttccacctcaccagtcgagatggggagccccggatgatagtggggaagaacgaacggggaaagtcattactgttcaagacagcctccggtatcaacatgtgcaccttgatcgcgatggacctgggcgagatgtgcgatgacactgtcacttacaagtgtccccacattactgaggtggagcccgaggacatcgattgctggtgcaacttaacatctacctgggtgacctacgggacatgcaatcaggccggcgaacaccggcgcgacaagcggtccgtggccctggcgccacatgtgggcatgggcctggacacgcgcactcagacctggatgagcgcagagggcgcctggcgacaggtggagaaggtcgagacgtgggccctgcggcacccgggattcactatccttgcccttttccttgcccactacatcggcacttctttaacccagaaggtggtgatcttcatcctgttaatgctagtaacccccagcatgactatgcggtgcgtgggggtgggtaaccgcgacttcgtcgagggactgtctggggccacctgggtagacgtggtcctggagcatggcggatgtgtgaccacgatggccaagaacaagcccactctcgatatcgaactgcagaagaccgaggccacccagttagcgacgctccggaaactgtgcatagaaggcaagatcaccaatatcaccacagacagccgctgccccacccagggcgaggccgccctgccggaggagcaggatcaaaactacgtgtgcaaacatacctacgtggaccggggctggggcaatggttgcggccttttcgggaaaggctccctggtgacatgcgctaaattccagtgcctggagcctatagagggcaaggttgtccagtacgaaaacttgaaatatactgtaatcatcaccgtgcacaccggtgaccagcaccaagtaggcaacgagacgcagggggttaccgccgagatcactccccaggcgagcaccaccgaagccatcctgcccgaatacggcaccttaggtttggagtgctctccgcgcaccggcctggacttcaacgagatgatccttttgacgatgaagaacaaagcgtggatggtgcatcggcagtggtttttcgacctgcccttaccctggacctcgggcgcaactaccgagacacccacctggaaccgcaaggaattgctggttaccttcaagaacgcccacgcgaagaagcaggaggttgttgtgctcgggtcccaggagggcgcaatgcacacagccctcacaggggccaccgagatccagaactctggcggcacctctattttcgcgggccatctaaagtgccggcttaagatggacaagctggagcttaaggggatgagctacgcgatgtgcactaacacattcgtgctgaagaaggaggtctcagaaacccagcacgggaccatcttgatcaaagtggagtataagggtgaggacgtgccttgtaaaattcccttcagcaccgaggacgggcaaggcaaggcgcacaacggtcgcctgataacagccaacccagtcgttaccaagaaagaggagcccgtgaacatcgaagccgaaccgccgtttggggagtcgaatatcgttattgggatcggagacaacgctctcaagataaactggtacaaaaagggctccagcatcggcaagatgttcgaagcgaccgcccggggcgcccgtcgaatggccatcctaggcgatacagcgtgggacttcgggagtgtaggcggggtgctaaacagcctaggcaagatggttcaccagatcttcgggagtgcatacacggcgctgttcagcggggtgtcctgggtaatgaagataggcatcggggtcttgctgacctggatcggcctgaacagcaagaacacctcaatgagcttcagctgcatcgccatcgggattatcaccctgtacctgggcgcggtggttcaagcggacatgggttgtgtgatcaactggaagggcaaagagctgaagtgcggcagcgggatcttcgtaactaacgaggtgcatacctggaccgagcagtacaagtttcaggccgactccccaaagcgcctcgccacagccatcgccggcgcgtgggagaacggggtttgcggcatccgcagcactacccggatggagaacctgttatggaagcagatagccaacgagctcaactacattttatgggagaataacatcaagctgaccgtagtggtcggtgacatcatcggcgtgttggagcagggtaaacgaaccctgacgccccagcccatggagctcaaatactcttggaagacttggggtaaggcaaagatagtgaccgcagagacccagaacagcagcttcatcatcgacgggccaaacactcccgagtgtcccagcgcatcccgcgcatggaacgtctgggaggtcgaagattatgggttcggggtcttcaccacaaatatctggctaaaactgcgggaggtatacacgcagctgtgcgaccatcgtcttatgtcggccgcagtcaaggacgaacgtgcagtgcacgcagatatgggctactggatcgagagccaaaagaacgggtcctggaagttagaaaaggccagcctgatagaagtcaagacctgcacttggccgaagtcccataccctctggagcaacggcgtgctggaatctgacatgatcatcccaaaaagcctggccgggccgatctcccagcacaaccaccggccgggctaccacactcagaccgctgggccctggcatctcggcaagctggagctcgacttcaactattgcgagggcacaaccgtagtcattactgagaactgcgggacccgcggccccagccttcggacgacgaccgtttccgggaagcttatccatgagtggtgctgccgcagctgcaccttacccccactccggtacatgggcgaagatgggtgctggtacgggatggagatcaggcccatctccgagaaagaggagaacatggtcaaaagcctggtctctgcaggctccggaaaagtggacaactttacgatgggggttctgtgcctcgcgatattgttcgaggaggtcatgcggggtaaattcggcaagaagcacatgatcgccggggtgttcttcactttcgtgctgctcctctccggccagatcacatggcgcgatatggcccacacactgatcatgatcgggtctaacgcctccgacaggatggggatgggtgtcacctacctggccttaatcgcgaccttcaagatccagccctttctggcgctagggttcttcttgcgcaagcttaccagcagagagaatctcctgctgggtgtgggcctagccatggccaccacattgcaactgccggaggacatcgagcagatggcgaacgggatagctctcggcctgatggccctgaagctcataacccaattcgagacgtaccagctgtggaccgccctgattagcctaacgtgctcaaacaccatcttcaccctcaccgtggcctggagaacggcaaccctgatactcgctggggtcagcctgctgccggtttgccagtcaagctccatgcggaagacggactggttgcccatggccgtagccgccatgggtgtgccgcccttgccgttgttcatcttcagtttgaaggacaccctgaagcgccgctcctggccccttaacgaaggggtgatggcggtaggtctcgtatctatcctggcctcctccctgctccggaacgacgtgcccatggccggcccgcttgtcgccggcggcttgctcatcgcatgctacgtgatcacggggacctccgcggacctgacggtcgagaaggccgctgacatcacctgggaggaggaggccgaacagacgggcgtcagccacaacttgatgatcactgtggacgacgacgggactatgcgcatcaaagacgacgagaccgaaaacatcctcacagtgctgctgaagacggcgttactgatagtatcaggcatcttcccctactcgatccccgcgaccctgctcgtgtggcacacctggcagaagcagacgcagcgatccggcgtcctgtgggacgtccctagtccgcctgagacgcagaaagccgagttggaggagggggtctaccgcatcaagcagcagggaatcttcgggaaaacccaggtgggagttggggtgcagaaagaaggcgtgtttcacacaatgtggcacgtcacccggggtgccgtactcacgtacaacgggaagcgcctggaacccaactgggcctctgtgaagaaggatctgatcagctacggcggggggtggcgtctctccgcgcagtggcagaagggcgaagaggttcaggtgattgctgtggagcccggaaaaaaccccaagaacttccagaccatgcccggcacgtttcaaaccacgaccggcgagatcggggccattgctttagacttcaaacccgggaccagcggcagcccaatcatcaaccgcgagggcaaggtggtgggtctgtacggcaacggggtggtcaccaagaacggggggtatgtcagcggcatcgcccagacgaacgcagagccggacggacccacccccgagctggaagaggagatgttcaaaaagcggaacctcaccataatggacctgcaccccggctctggaaagacgaggaagtacctgccggccatcgtgcgggaggccatcaagcgccggctgcgcacgctgatcctagcacccacccgggtcgtggccgcggaaatggaggaggcgctgaagggtctgcccatcaggtaccagaccaccgctacgaaatctgagcacaccggccgggagattgtggatctgatgtgccacgccacctttaccatgcgcctcctgagccccgtccgggtgccgaactacaacttaataatcatggacgaggcccacttcacggaccccgcaagtatcgccgccagggggtatatcagtacacgggtgggcatgggcgaggcggcggccattttcatgaccgccactccgccagggacggccgacgccttcccgcagtccaacgcgcccatccaggacgaggagagagacatacccgagcgcagctggaattcggggaacgagtggatcaccgacttcgccgggaagaccgtctggttcgtgccctcaatcaaggctggcaacgacatcgccaactgcctccggaagaacggaaagaaggtgatccaactgtctaggaaaaccttcgatacggagtaccagaagacaaaactgaacgactgggacttcgtcgtgacaaccgacatctccgaaatgggcgccaacttcaaggcggaccgggtgatcgatccgcgcagatgcctcaagcccgttatactgacggatggcccagagcgcgtaatcctggctggacccatgccggtgacggccgcaagcgccgcgcagcggcgcggccgggtcggacgcaacccccagaaggagaacgaccaatacatctttaccgggcagcccctcaacaacgacgaagaccatgcccactggaccgaggccaagatgctcctggacaatatcaacaccccggaagggattatcccggccctctttgaacctgagcgggaaaagtccgcagctatagatggggagtaccgcctgaagggcgagtcccgcaagacgttcgtagagctgatgagacgcggtgacctccccgtgtggctcgcccacaaggtcgctagcgaaggtatcaagtacaccgaccgtaagtggtgcttcgacgggcaaaggaacaaccagatcctggaagagaacatggacgttgaaatatggactaaggaaggcgagaagaagaagctcaggcccaggtggttggacgcaaggacttactccgacccgctggcactcaaggagttcaaagacttcgccgccggccgcaagagcattgccctcgacctggtcacggagatcgggcgcgttccctcgcatctagcacatagaacccggaacgcgctggataatctggtaatgctacataccagcgagcatggcgggcgtgcctatcggcacgcggtcgaagagctgccagagacgatggagacgctgctgctgcttggcttgatgatcctgctgaccgggggggccatgctgttcctgataagcggtaaggggataggcaagacctccatcgggctgatttgcgtgatcgcctcatcaggcatgctttggatggcggagattccgctgcagtggatcgcctctgccatcgtgttagagttctttatgatggtcttactgatccccgaacccgagaagcagcgcaccccccaggacaaccagctggcgtatgtggtgatcgggatcctcactctggccgcgataatcgccgcgaatgagatgggcctgttggagaccaccaagcgggacctcggcatgtccaaggagccgggggtcgtgagccccacctcatatctcgacgtagacctccatcccgcgagcgcgtggacgctatatgctgtcgctacaacggtgatcactcccatgctgcgccacacgatcgagaactccaccgccaacgttagcttggccgcgatcgcgaaccaggccgtagtgctgatgggactggacaaggggtggccgatctctaaaatggacctcggcgtgcccctgctggcgctcggatgctactcgcaggtcaatcccctgactctgacggcagcagttttgttgctgatcacgcattatgccatcatcggaccgggcctccaggccaaggcgacccgggaggcacagaagcgcaccgctgcagggattatgaagaacccgaccgtcgacggaatcatgacgatcgacttagacccagtgatctacgactccaagtttgagaaacagctggggcaggttatgttgctggtgctgtgtgccgtccagctcctcctgatgcggacctcctgggccctctgtgaagcgctgacgttggccacaggccccataaccaccttatgggaggggagcccaggtaagttctggaacaccacaattgccgtgagcatggccaacatctttcgcggatcgtacctcgccggggcggggctagccttcagtatcatgaagtctgtgggtacgggcaagcggggcacggggagccagggcgagaccctcggggagaagtggaagaagaagctgaaccagctgagcagaaaggaattcgatctttacaagaagtctggcatcacggaggtggacaggaccgaagctaaggaggggcttaaaagaggagagatcactcaccacgccgtgagccggggctccgcaaagctgcagtggttcgtggagcgaaatatggtcatcccggaggggcgggtgatcgatcttgggtgtgggagagggggttggtcatattactgtgcgggccttaagaaggtgacggaggtacgaggctataccaagggcgggcctgggcacgaggaacccgtgccaatgagcacctatggctggaatatcgtgaagctgatgtcagggaaggacgtcttctacctccccccggagaagtgcgacaccctgctgtgtgacatcggagagtccagcccgtcccccactgtggaggagagccgcaccatacgagtgctgaaaatggtcgagccttggctcaagaacaaccagttctgcataaaggtgctgaacccgtacatgcccaccgtgatcgagcatctggaacgtttacagcgtaagcacggcgggatgctggtccggaaccccctatcacgcaacagcacgcacgagatgtattggatctccaacggcaccgggaacatcgtggcctccgtgaacatggtatcccgtctcttactcaaccgcttcaccatgacccaccggcgcccgacgattgaaaaggatgtcgatctcggcgccggcactcggcacgtgaacgccgagcccgagacccccaacatggacgtcatcggtgagaggattaaacggattaaggaggagcataacagcacgtggcactacgacgacgaaaacccgtataaaacctgggcttaccacggcagttatgaggtgaaggccactggttccgcctccagcatgataaacggcgtggtcaaactgctgaccaagccttgggacgtggtgccaatggtgacgcagatggccatgactgacactacgcctttcgggcagcagcgcgtcttcaaggagaaggtcgacaccaggacgccgcgctcaatgccgggcaccagacgcgtgatgggcattaccgccgaatggctctggcggacccttgggcgcaacaaaaagccccggctatgcacacgcgaggagttcaccaagaaagtgcgcaccaatgccgcaatgggtgccgtttttaccgaggagaatcaatgggactccgccaaggcggcggtggaggacgaggacttctggaagctggtggaccgagagcgagagctacacaagctcgggaagtgtggcagctgcgtctacaacatgatggggaagcgggagaagaaattaggagaattcggcaaggccaaggggtctcgagcaatctggtacatgtggttaggcgcccggtatctggagtttgaggccctcggatttctaaatgaggaccactggttcagccgcgagaactcctacagcggcgtggagggggagggactgcacaagctcggctacattctgcgggatatctctaaaatccctggaggcgcgatgtacgccgacgacacggccgggtgggacactagaatcaccgaagacgacctgcacaacgaagaaaagatcacccagcagatggacccggagcaccggcagctcgccaacgccatcttcaagctgacctaccaaaataaggtggtaaaggtacagcgccccaccccgaccggcaccgtgatggatatcatatctcggaaggaccaacgcggatccgggcaagtaggaacctacgggctgaacactttcaccaacatggaggcgcagttaatccggcagatggaaggtgagggggtactgagcaaggccgacctggagtcccatcacctgcccgagaagaagatcacgcagtggcttgaaacgaagggcgtggagcgcctaaagaggatggccatcagcggtgacgactgcgtcgtgaagccgatcgatgaccggttcgcgaacgcgctactggcgctgaatgacatggggaaggtgcgcaaggacattccccaatggcagccctccaaaggctggcacgattggcagcaggtccctttctgctcccaccacttccacgagctcatcatgaaggacggcagaaaactagtggtgccgtgccggccccaggatgagctgatcggccgcgctcggatcagccagggtgccggctggagccttcgcgagacggcctgcctggggaaggcatacgcccagatgtggtccctcatgtacttccataggagggacctccgtctggccagcaatgccatatgttccgccgtacccgtgcactgggtgcccacatctcggactacctggtcaatccacgcgcaccatcagtggatgacgaccgaggacatgctgactgtatggaatcgcgtctggatcgaagacaacccgtggatggaggataagacgcccgtgacgacctgggagaacgtcccatacctcgggaagcgggaagaccaatggtgcgggagcctcatagggctaaccagccgagctacctgggcccagaacatcccgacggctatacagcaggtccggtccctcataggcaacgaggagttcttagactacatgccatcaatgaagcgttttcgtaaggaggaggaatccgagggagcaatttggtga

SEQ ID NO: 25970 - RNA, 9873 nt, synthetic construct
  misc_feature 1..9873: note = derived and/or modified CDS sequence (opt11) from DENV-3__FJ024471__SS-prME
  source 1..9873: mol_type = other RNA
accagcctatgtctcatgatgatcctgcccgccgccctggcgttccatctcaccagccgggacggggagccgaggatgatcgtggggaagaatgagcggggtaaaagcctgcttttcaaaaccgcctcggggatcaatatgtgtaccttaatcgccatggacctgggcgagatgtgcgatgacactgtaacgtacaagtgcccgcacatcaccgaggtggagcccgaggacattgactgctggtgcaacctcaccagcacctgggtgacctacggtacgtgcaatcaagccggtgagcacaggcgagataagcggagcgtggccctcgcaccccatgttggcatgggtctggacacacgcacgcagacatggatgtcagccgaaggggcgtggcgccaagtggagaaggtcgaaacgtgggccttacgccatcccggcttcacaatcctcgcactcttcttagcccactatataggcacatccctcacccagaaggtcgtgatctttatcttgctgatgctcgtaacccccagcatgaccatgcgctgcgtgggggttggcaaccgggacttcgtagagggcctgtccggggctacctgggtggacgttgtcctggagcacggcgggtgcgtcaccacgatggcgaaaaataaacctacactcgatatcgagctacagaagaccgaagccacccagctggcgacgctccgaaagctgtgcatcgagggcaagatcaccaacatcaccaccgacagccgctgcccgacgcaaggcgaggccgctctgccagaggagcaggatcagaattacgtctgcaagcatacctacgtcgaccgggggtggggcaacggctgtggcttatttggcaaaggctccctagtgacttgtgccaagtttcagtgtctggaacccatcgaggggaaggtggtccagtacgaaaacctcaagtacacagtgatcatcacggtgcacacaggtgaccagcatcaggtgggaaacgagacccagggggtgacggccgagataacgccccaggcgagcaccaccgaggccattcttccggaatacggtaccctggggttggagtgctccccgcgcacagggctggacttcaatgagatgatattgctaactatgaagaacaaagcctggatggttcaccggcagtggttcttcgacctgcccctgccctggacgagcggggcgaccaccgagactcccacctggaaccggaaggagctcctggtgacattcaagaacgcccacgcgaagaaacaggaggtggtcgtactggggagtcaggagggcgcaatgcatacagcactcacgggggcaacagagatccaaaacagcggagggaccagcatcttcgcagggcacctgaagtgccgtttaaagatggataagctggagctgaagggaatgagctatgccatgtgcaccaacacattcgtgctgaaaaaggaggtctccgagactcagcacgggaccatactcatcaaagtggagtataagggtgaggacgtgccgtgcaagatccccttcagcactgaggatgggcagggcaaagcccataacggccgactgatcacggctaaccccgtggtgacgaagaaagaggagccggtgaacattgaagccgagcccccattcggggagtccaacatcgtcatcggcattggtgacaacgcgctgaaaatcaattggtacaagaagggcagcagcataggcaagatgttcgaggcgaccgcgagaggggctcgccggatggcaatactgggcgacaccgcatgggacttcgggtccgtcggcggtgtgctcaatagcctggggaagatggtccaccaaattttcgggtccgcctacacggccctattctccggcgtctcctgggtgatgaaaattggcataggggtgctgctgacgtggatcggcctgaacagtaagaacacctctatgagcttctcctgcatcgccatcgggataatcaccctgtatctgggcgctgttgtgcaggcggacatggggtgcgtgattaactggaagggcaaggagctgaagtgcggcagcgggatcttcgtaacgaacgaggtccatacgtggacagagcaatacaagttccaggccgacagccccaagcgactcgctaccgccatcgctggcgcttgggagaacggggtgtgcggcatccgaagcacgactcggatggagaatttactgtggaagcagatcgcgaacgagctcaactacatcctgtgggaaaacaacatcaagttgaccgtcgttgtcggggatatcatcggggttctcgaacagggcaagcgcaccctgacgccccagcccatggagctcaagtacagctggaagacctggggtaaggctaaaatagtgaccgcggagacccagaactcgtccttcataatagacggcccgaacacgcccgagtgcccctcagcgtcccgagcgtggaacgtctgggaggtggaggattacgggtttggagtgttcaccactaacatatggttaaagctacgcgaggtctacacgcagttatgcgaccaccggctaatgagcgcagcggtaaaagacgagagggcagtgcacgccgacatgggctactggatcgagagccagaaaaacgggtcgtggaagttagagaaggcctcactcatcgaggtcaagacatgcacatggccgaagtctcacaccctttggagcaacggcgtgctggagagtgacatgatcatccccaagagcctggccgggccaatcagtcagcacaaccatcggccgggctaccacacacagacggcggggccctggcatctgggcaagttagaactcgacttcaactactgtgaaggcacaaccgtggtcatcacggaaaactgtgggacccgtggtccctcgctccggacgaccacagtgtcgggaaagctcattcacgaatggtgctgtcgctcctgcacgttacccccgctccggtacatgggcgaggatgggtgttggtacgggatggagatacgcccaatatccgaaaaagaggagaacatggttaaaagcctggtctccgccggaagcgggaaggtggacaactttaccatgggtgtgttatgcctcgcgatactattcgaggaggttatgcgcggaaagttcggcaagaagcatatgattgccggggtatttttcacatttgtactactcctgtccggtcagatcacatggcgagacatggcacataccctcatcatgataggaagcaatgcctcggatcggatggggatgggcgtgacgtaccttgccctcatcgctaccttcaagatccagcccttcctggcgctcggatttttccttcgaaagttgaccagccgggagaacttgttgctaggcgtgggtctcgccatggccaccacgctgcagcttcccgaggacatcgaacagatggcgaacgggattgccctagggctgatggcccttaagctcatcacccagttcgaaacctaccagctttggaccgccctgattagtttaacgtgctccaacaccatcttcaccctgaccgtggcctggcgcacagctaccctgatcctcgcgggggtctccctcctaccggtgtgtcagtccagctccatgcggaagactgactggttacctatggccgtcgccgccatgggtgtgccgcccctaccgctgttcatcttcagcctcaaggacaccctgaagcgccgctcctggcccctgaacgagggggttatggcggtgggtctcgtttccatcctggcctcgagcctgctccggaacgacgtgcctatggcaggcccgttagtggccgggggcctgttgatcgcctgttacgttatcactgggacgtccgcggacctgaccgtggagaaggctgcggacattacttgggaggaggaggccgaacaaacgggcgtctcgcataacctcatgatcactgtggacgacgacgggacgatgcgcatcaaggacgatgagaccgagaatattctcaccgttctgctgaagacggcactcctgatcgtatccggcatattcccgtacagcatccctgccacgctgcttgtgtggcacacatggcagaagcagacccagcgttccggcgttctgtgggacgtgcccagcccgcctgagacgcagaaagcggagctggaggagggggtttaccggatcaaacagcagggcatcttcgggaagacccaggtgggtgtcggggtccaaaaggagggcgttttccacaccatgtggcatgtcacccggggagccgtgctcacgtacaatggtaagcggctggagcccaactgggcctcggtgaagaaagatttaatctcatacggagggggctggaggctctccgcgcaatggcagaaaggggaggaggtccaagtgattgccgtggagcccggcaagaaccccaagaacttccaaaccatgcccgggaccttccaaaccacaactggggagatcggagcgatcgccttggactttaagcccgggacaagtgggtcgcccattataaaccgggaagggaaggtcgtagggctgtacggcaacggagtggtcaccaagaacggaggatacgtatcaggaatagcacagacaaacgctgaaccggacggcccgacccctgagcttgaggaagagatgttcaagaagcggaacctgaccatcatggacctgcaccccgggagcggaaaaacgaggaagtatcttccggcgatcgtgcgtgaagccatcaagcgacggcttcgcacgctgatactggcccccacgcgggtcgtcgccgccgagatggaggaggcgctcaaggggctgcccatccgttatcagactaccgctacaaagtccgagcataccggtcgagagatcgtagacctcatgtgccatgccacatttacaatgcgcctcctcagccccgttcgggtgccgaactataacctcatcataatggacgaggcccacttcactgatcctgcgtcaatcgcagcacgtggctacatcagcacgcgcgtgggtatgggcgaggccgccgccatcttcatgacggccacgccgcccggaacggccgatgcctttccacaatccaacgcgcccatccaggacgaggaacgcgacatccccgagcgatcctggaactccggcaacgagtggataaccgactttgccggtaagacggtatggttcgtgccctctataaaggccggcaacgatattgccaactgtctccgcaagaatggaaagaaagtgatccagctatccagaaaaaccttcaacactgagtaccaaaagaccaagctgaatgactgggactttgtcgtgacaaccgacatcagcgagatgggtgcaaacttcaaggcagaccgggtgatcgaccctcgcagatgcctcaagcccgtcattctgacagatggccccgagcgcgttatactcgcagggcccatgccagtgaccgctgcctccgcggcgcagaggcgcggccgggttggacgcaaccctcaaaaggaaaacgatcagtacattttcaccgggcagcctctcaataacgacgaggaccacgcgcactggaccgaggccaagatgctgctggataatatcaacacccctgaaggaatcataccggccctcttcgaacccgagcgggagaaatccgcggccatcgacggcgagtaccgccttaagggcgagtcccgtaaaacgttcgtggagctgatgcgccgcggggacctccccgtctggctggcgcacaaggtggctagcgaaggcataaagtataccgacaggaagtggtgttttgacgggcagaggaacaaccaaattctggaggagaacatggacgtggagatatggacaaaggagggcgagaagaagaagctgcgcccccgatggctagatgctcgcacctactccgaccccctcgctcttaaggagtttaaggacttcgccgctggccgtaaaagtatcgccctggacctggtcacggagatcggtcgggtgcctagtcacttggcacaccgcacccggaacgcgctggacaacctggtgatgctgcacacgtcggagcatggagggcgcgcctacagacacgctgtggaggagttacccgaaactatggagacgctgctcctgctgggtctcatgatcctgctgaccgggggcgctatgctgttcttgatctcaggcaagggtatcgggaagacctccatcgggctgatctgcgtcatagcttcatctggaatgctctggatggccgagattccgctgcagtggatcgccagcgccattgtcttagagttcttcatgatggtcctcctaatccccgagccagagaagcaaagaacgccccaagacaaccagctcgcgtacgtagtgatcgggattctaacgctggcagcgataattgccgcaaatgaaatgggcctattagagacgaccaagagagacctgggcatgtccaaggagcccggggttgtgagccccacctcctacctggatgtggacttgcacccggcaagcgcgtggacgctgtacgcagtcgccacaaccgtcatcacgcccatgctccgccacacgatcgaaaattccacggccaacgtgagcctcgccgctatcgccaatcaggccgtcgtgctaatgggactggacaaaggttggccaatctccaagatggatctcggtgtacccctgctcgccctagggtgctatagccaggtaaaccccctaactttgaccgccgctgtgctcctactgatcacgcactacgccatcatcggtccgggcttgcaggcgaaggccacacgggaggcccagaagcgcaccgcggccgggatcatgaagaacccaaccgtggatggtataatgacgatagacctggaccccgtcatctacgatagcaagttcgaaaagcaactgggccaggtgatgctccttgtgctgtgtgccgtccagcttctgcttatgcggaccagctgggccctctgcgaggcgctgaccctggccacaggacccataacgactttatgggagggctcccccgggaagttttggaacacaaccattgccgtgagcatggccaacatttttcgcgggtcctacctggcgggggcgggtcttgcctttagcatcatgaagtctgtggggacgggcaagcgcggcacggggtcgcaaggcgagaccctcggggaaaagtggaagaagaaactgaatcagctgagcagaaaagagtttgacctctataaaaagtccggcatcaccgaagttgaccgtaccgaagccaaggaggggctgaagcgcggcgagattacccaccatgccgtaagtcgtggctcagccaagctgcagtggttcgtggagcggaacatggttatccccgaggggcgggtgatcgacctcgggtgcggccgcggcgggtggtcctactactgcgcgggcctgaagaaagtcacggaggtaagaggctataccaagggcgggcccggccatgaggagcccgtacccatgtccacgtacggctggaacatcgtgaagctaatgagcggcaaagacgtcttttatctcccgcccgaaaagtgcgacactctgctttgtgacatcggggagtcaagcccatcccccaccgtggaggagagccggaccattcgggtcctgaagatggtggaaccgtggctcaagaacaatcagttctgcatcaaagtgctgaacccctacatgcccacagtgattgaacatcttgagcggctccagcgcaagcacggcgggatgttagtccggaatcccctgtcccgtaatagcacgcacgagatgtattggatctccaacgggacaggcaacatcgtcgccagcgtgaacatggtctccaggctccttctgaaccgattcaccatgacccaccggcgcccgacgatcgagaaagacgttgaccttggagccgggacccgtcacgtgaacgcagagccagagactccaaatatggacgtcatcggtgaacgcatcaagagaataaaagaggaacacaatagcacctggcattatgacgacgagaacccgtataagacttgggcatatcatggatcctacgaggtgaaagcgacgggcagcgcgtccagcatgatcaacggcgttgtaaagctacttaccaagccatgggatgtggtacccatggtaacccagatggcaatgaccgataccactcccttcgggcagcagcgagtgttcaaggagaaagtcgataccagaacgccgcgctcaatgcccgggacccggcgagtcatgggcataactgccgagtggctctggcggacactggggagaaacaaaaagcccaggttatgcacacgcgaggagttcactaagaaagtgcgcaccaacgcggccatgggcgctgtctttactgaagagaatcaatgggacagtgctaaggccgccgtcgaggacgaggacttttggaagctcgtggaccgggagcgcgagctgcataaacttgggaagtgtggcagctgcgtgtacaacatgatgggaaagcgggagaagaagctcggtgagttcggtaaggcaaaagggtcaagagctatatggtacatgtggttgggcgcccggtatctggagttcgaggccctaggattcctgaacgaggaccactggttcagccgagaaaattcctactccggcgtggagggggagggcctgcacaaactcggctacattctgcgagacatctccaagatcccaggaggggcgatgtacgcggacgacactgccgggtgggatacccgcatcacagaggatgacctgcacaatgaggagaagatcacccaacagatggacccagaacacagacagctggccaatgcaatttttaagctaacgtaccagaacaaggtggtgaaggtgcagcgcccaacgccaaccgggaccgtgatggacatcatttcccggaaggaccagcgaggatccggacaggtgggcacatatgggctgaacaccttcaccaacatggaagcacaactaatccggcagatggaaggagaaggggtcctgagcaaggccgacctggagtcccatcatctctctgagaagaaaataactcagtggctggagaccaaaggcgtagagcgcttaaagcggatggccatcagcggggatgactgcgtcgtgaaacccatcgacgaccgctttgcaaacgccctattggcgttaaacgacatgggtaaggttcggaaggacatcccacagtggcagccgagcaaaggctggcacgactggcagcaggtccccttctgctcccaccacttccacgaactcatcatgaaagacgggcggaagttggtggttccctgtcgacctcaggatgagctgataggccgcgcccggataagccaaggggcaggctggtcattgcgcgagactgcatgcctgggcaaggcgtacgcccagatgtggtcgttaatgtatttccaccgccgggaccttcgcttggccagtaacgcaatctgcagcgccgtcccagtgcactgggtacccaccagcaggaccacctggtccatccatgcccaccaccagtggatgacgaccgaggacatgttaactgtgtggaatcgcgtttggattgaagacaacccctggatggaggacaaaaccccggtaacgacatgggagaacgtcccctatctggggaaacgggaggaccaatggtgcggctcacttatcgggctgacctcccgagctacatgggcgcaaaatatcccaacggctatccagcaagtccggagtctcattggcaacgaagagttccttgactatatgccctcgatgaagcgcttccggaaggaggaggagagcgagggtgcgatatggtga

SEQ ID NO: 25971 - RNA, 9873 nt, synthetic construct
  misc_feature 1..9873: note = derived and/or modified CDS sequence (opt11) from DENV-3__FJ182005__SS-prME
  source 1..9873: mol_type = other RNA
accagcctctgcttaatgatgatcctcccagccgccctggcgttccacctcacgagccgggatggggagccgcgaatgatcgtggggaaaaacgagcgcggaaaaagcctgctgttcaagaccgccagcgggatcaacatgtgcaccctgatagccatggacctgggcgagatgtgcgacgacaccgtgacctacaagtgcccccacataacggaagtggagcccgaggacatcgattgctggtgcaacctgacgagcacttgggtgacctacggcacgtgcaaccaggccggcgagcatcggcgcgacaagcgatccgtcgccctcgcgccacacgtgggtatggggctggacacccgcacccagacctggatgagcgccgagggcgcctggagacaggtggaaaaggtcgagacgtgggccctgcggcacccaggtttcaccatcctcgcactgttcctagcgcactacatcggcacctccctcacccagaaagtcgtgatcttcatcctgctgatgctcgtcacgcccagcatgaccatgcggtgcgtgggcgtgggcaaccgcgacttcgtcgagggcctgtccggggccacgtgggtggacgtggtcctggagcacggcgggtgcgtgacgacgatggccaaaaacaagcccaccctcgacattgagctgcagaagaccgaggctacccagctggcgacgctccggaaactttgtatagagggcaaaatcaccaacatcaccaccgactcgcgctgtcccacgcagggcgaggccgtgctgccggaagaacaggaccagaactacgtctgcaagcacacctacgtggaccgggggtggggtaacgggtgtggcctcttcgggaagggatccctggtgacctgcgccaaattccagtgcctggagcctatcgagggaaaggtcgttcagtacgagaacctaaagtatacggtgatcatcacagtccacaccggggaccagcaccaggtgggcaacgagacccaaggggtcaccgccgaaatcacgccccaggccagcaccaccgaggcgatcctgccggagtacggcaccctggggctcgagtgctccccgcgaaccggcttggacttcaacgagatgatcctgctaacgatgaagaacaaggcctggatggtgcacaggcagtggttctttgacttacccctgccttggaccagcggcgcaaccaccgagacgcccacctggaaccgcaaggagctcctcgtgacgtttaagaacgcccatgccaagaagcaggaggtcgtggtgctggggtctcaggaaggcgcgatgcacaccgccctcacgggggccactgaaatccagaacagcggcggtacctccatcttcgctggacatctgaagtgtcggctgaagatggacaagctcgagttgaagggcatgtcctacgctatgtgcaccaacacgttcgtcctgaagaaagaagtatccgaaacccagcacgggaccatcctgattaaggtggagtacaagggcgaggacgtcccgtgcaaagtgcccttcagcacagaggacgggcagggtaaggcgcacagcgggcgcttaatcacggccaaccccgtggtcaccaagaaagaggagcccgtgaatatcgaggccgaaccgccctttggagaatccaatatcgttatcggtatcggggacaacgccctgaagatcaactggtataagaagggcagctccatcgggaagatgttcgaggcgaccgcccggggcgcccgccgtatggccatcctgggagacaccgcctgggacttcgggagcgtgggcggtgtgttgaactccctgggcaagatggtgcaccagatcttcggaagcgcgtacacggccttattcagcggagtcagctgggtgatgaagatcggaattgggatcctcctgacctggatcggcctgaactccaagaatacaagcatgtccttcagctgcatcgtcatcgggattatcaccctatacctcggcgccgtcgtgcaggccgacatggggtgcgtgatcaactggaagggcaaggagctgaagtgtggcagcgggatctttgtcacgaacgaggtgcacacttggaccgagcagtacaagttccaggccgacagccccaagcgcctcgcgaccgccatcgccggcgcctgggagaacggggtgtgcggaatacgctccacgacgcggatggaaaacctgctgtggaagcagatcgcaaacgagctcaactacatcctgtgggagaacaacatcaagctgactgtcgtcgtgggggacattatcggcgtcctcgaacagggcaagcgaaccctgacgccccagcctatggagctgaagtacagttggaaggcatggggtaaggccaagatcgttacggccgaaacccagaactccagcttcatcattgacggccccaacactcccgagtgcccttccgccagccgggcgtggaacgtatgggaggtagaggactacgggttcggcgtgttcaccaccaacatctggctcaagctgagggaggtttacacccagctgtgcgaccaccgattgatgagcgccgccgtcaaggacgagcgcgctgtgcatgccgacatgggctactggatcgagtcccagaagaacggtagctggaagctggaaaaggcgagtctgattgaggttaagacctgtacctggccgaagtcccatacgctctggtccaacggcgtcctggaaagcgatatgatcatccccaagtccctggccgggcccatcagccagcacaattaccggccgggctaccacacccagaccgccgggccctggcacctcggaaaactggagctggacttcaactactgcgagggcactacggtggtgatcacggagaactgcgggacccgcggaccttccctccggaccacgactgtgagcgggaagctgatacatgagtggtgctgccgctcctgcacgctgccgccgctccggtacatgggcgaggacgggtgttggtacggcatggagatcagacccatcagcgagaaggaagagaacatggtgaagtccttggtgagcgccggctccgggaaagtcgacaacttcaccatgggcgtgctgtgcttagccatcctgttcgaagaggtgatgcgggggaagttcggcaagaagcacatgatagcgggggtcttcttcacgtttgtgctgttactgagcggacagatcacctggcgcgacatggcccacacgcttatcatgatcggctccaacgccagcgaccggatggggatgggcgtgacgtatctcgctctgatcgccacgttcaagatccagcccttcctggcgctcgggttcttcctgcgcaaactgacaagccgggagaacctcctgctgggcgtcggcctcgcaatggccaccaccctgcagctccccgaggacatcgagcagatggccaacgggatcgcgcttggcttaatggccctgaagctcatcacgcaatttgagacctaccagctgtggaccgccttaatctccctgacctgctctaacacgatcttcaccttaaccgttgcctggcgcacagccacgctaatcctcgccggggtctccctgctgccggtgtgccagagcagtagcatgcggaagaccgactggctaccgatgacagtggccgcgatgggcgtaccgccactcccgcttttcatcttcagcctcaaggacaccctgaagaggcgcagctggcctctgaacgagggggtgatggcagtgggtctcgtctcaatcctggccagctccctgctccgcaatgacgtgcctatggcgggacccctcgtggccggtggcttactcattgcctgctacgtcatcacggggaccagcgccgacctgaccgtggagaaggccgcagacgtgacctgggaggaggaggctgagcagacgggcgtctcccacaacctgatgatcaccgttgacgacgacggtaccatgagaataaaggacgacgagacggagaacatcctcaccgtgctgctgaagacggccctcctgatcgtgagcggcatctttccctattccatccccgccaccctgctcgtttggcacacctggcagaagcagacccagcggagcggagtactgtgggacgtccccagtcccccggagacgcagaaagccgagctggaggagggggtgtatcgcatcaagcaacagggcatcttcgggaaaactcaggtgggcgtaggggtgcagaaggagggcgtgttccacaccatgtggcatgtcacccggggcgcggtcttaacgtacaacgggaagaggctggaacctaactgggccagcgtgaagaaggatctaatctcctatgggggcgggtggcggcttagcgcccaatggcagaagggggaggaagtacaggtgatcgccgtggaacccggcaagaatcccaagaacttccaaaccatgcctggcaccttccagaccacgacaggggagatcggcgcgattgccctggacttcaagcccggtaccagcggctcccccatcatcaacagggagggcaaggtcgtgggtctgtacggcaacggggttgtcaccaagaacggcgggtacgtgagtggcatagcccagacaaatgccgagccagacggccccaccccggagttggaggaggagatgttcaaaaagagaaacctcaccattatggatctacaccccgggtccgggaagacgcgcaagtacttgccggccatagtgcgggaggcgatcaagcgccggctcagaacgctgatcctggcccccacccgggttgtggccgccgaaatggaggaggccctcaaggggctgccaatacgctaccagaccacagcgaccaagagcgagcacaccggccgggagattgtggacctgatgtgccacgccaccttcaccatgcgcctcctgtcccccgtccgggtgccgaattacaacctgatcatcatggacgaggctcacttcacggaccccgccagcatcgccgcgcgcgggtatatctccacccgtgtgggcatgggtgaggcagccgccatctttatgaccgcgaccccgcccgggacggccgacgccttcccgcaaagcaacgcccccatccaggacgaggagcgcgatatcccagagcgctcctggaacagtggcaacgagtggatcaccgacttcgcgggaaagaccgtctggttcgtgccctccatcaaggcgggcaacgacatcgccaactgcttgcggaagaacgggaagaaggtgatccagctgagccgcaagaccttcgacacggagtaccagaagaccaagctgaacgactgggatttcgtcgtaaccaccgacatctccgagatgggcgccaacttcaaagccgaccgggtgatagacccgcgtcggtgcctcaagcccgtaatcctaacggacggccccgagcgcgttatcctggccgggcccatgccagtgaccgcggccagcgcagcccagcggcgcgggcgggtcggccggaacccccagaaggagaacgatcagtacatcttcaccggccagcccctcaataacgacgaagaccacgcccactggaccgaggcgaaaatgctgctggacaacataaacacccccgaggggatcatcccggccctcttcgagcccgaacgggagaagtcagccgccatcgacggcgagtaccgcctgaagggcgagagcagaaagacgttcgtggagctgatgcgccgcggggacctgcccgtctggctggcgcacaaggtggccagcgaaggcatcaagtacacagaccgcaagtggtgcttcgacgggcagcggaacaaccagatcctggaggaaaacatggacgtggagatttggaccaaggagggagagaagaaaaagctccgtccccggtggctggacgcccgcacctacagcgacccgctggccctcaaggagttcaaggacttcgccgcgggtcgaaagtccattgccctggacctagtcacggagatcgggcgggtgcctagccatctcgcccaccgcacccggaacgcgttagacaatctggtgatgctccacactagcgagcacggcgggagagcgtaccggcacgctgtcgaggaacttcccgagaccatggagacgctgctcctgctgggcctcatgattctgctgacagggggcgccatgctgttcctgatctccgggaaggggatcggcaaaaccagcatcggactgatctgcgttatcgcctccagcgggatgctctggatggccgagatcccactgcagtggatcgcctccgcgatcgtgctggagttctttatgatggtactcctgatccccgaacccgagaagcagagaacgccccaggacaatcagctggcctacgtggtgatcggaatcctcaccctggctgctatcatagccgcgaacgagatgggactgctcgagaccaccaagcgggacctgggcatgagcaaggagccgggggtcgtgtcccccacctcttatctggacgtggacctccaccccgcttctgcctggacgctttacgccgtcgccaccaccgttatcacccccatgctacgccacacaatcgagaacagcaccgccaacgtgtccctcgccgccatcgccaaccaggcggtagtactgatgggcctggataaggggtggccgatcagcaaaatggatctcggcgtgcccctgctggccctcggctgctactcccaggtgaaccccctgaccctgaccgccgctgtgctcctactcatcacccactacgccatcatcggccccggcctccaggcgaaggcgacccgggaggcccagaagcgtaccgctgccgggatcatgaagaaccccaccgtggatggcatcatgaccatcgacctggaccccgtcatctacgatagcaagttcgagaagcagctgggccaggtgatgctcctggtcctgtgcgcggtccaactcctgctgatgcggacgtcctgggccctctgcgaagccctgaccctagccaccggccccatcacgaccttgtgggagggcagcccagggaagttctggaacaccaccatcgcggtgtccatggccaatatttttcgcggcagctacctggccggggccggcctggcattctccatcatgaagtccgtggggacgggtaagcggggcaccgggagccagggcgagaccctcggggagaagtggaagaagaagttaaaccagctgtcccgcaaggagttcgacctctacaagaaatcgggaatcaccgaggtcgaccggaccgaggccaaggaggggctgaaacgcggcgagattacgcaccacgccgtgtcccggggcagcgccaagctgcagtggttcgtggagcgtaatatggtaatcccggaggggcgggtgatcgacctcggctgcgggcgcggcgggtggtcctattactgcgccggcctgaagaaggtgaccgaggtccggggatacaccaaaggcggacccgggcacgaggaacccgtgcccatgtcgacctacggctggaacatcgtgaagctgatgtccgggaaggacgtcttctacctcccgcccgagaagtgcgacacgctgctgtgtgacatcggggagagctcccctagccccaccgtggaggagtcccgcaccatcagggtgctgaagatggtcgagccgtggctcaagaacaaccagttctgcatcaaagtcctgaacccctatatgccgaccgtgatcgagcacctggagcggctccagcgcaagcacggcgggatgctggtccggaatcctctgtcccgcaactccacgcacgagatgtactggatcagcaacggcacagggaacatcgtggcttccgtcaacatggtcagccggctcctgcttaaccgcttcaccatgacccacagacggccgaccattgagaaggacgtggaccttggcgcgggcacccggcatgtgaacgccgagcccgagacccccaacatggacgtcataggggaacgcataaagcggatcaaggaggaacataactccacctggcactacgacgacgaaaacccgtacaagacgtgggcctatcacggcagctacgaggtgaaggccacggggtccgccagcagcatgatcaacggagtcgtgaaactgctgaccaagccctgggacgtagtccccatggtgacccagatggcgatgacggacaccacgcccttcgggcagcagcgcgtgttcaaggagaaggtcgatacacggacgccgagatccatgcccggcacccggcgcgtaatgggcatcaccgccgagtggctctggcggaccctggggcgcaacaagaagccaaggctgtgcacgcgcgaagagttcaccaagaaggtgcgcaccaacgccgccatgggcgcggtcttcaccgaggagaaccagtgggatagcgctaaagccgccgtcgaggatgaggacttctggatcctcgtggatcgggagagagagctgcacaagctggggaagtgtggctcctgcgtctataacatgatggggaagcgggagaagaagctcggcgagttcgggaaggcgaaggggagccgcgcgatctggtacatgtggctgggtgcccggtacctggagttcgaagcccttggtttcctgaacgaggaccactggttctcccgcgagaacagctactccggcgtggagggggagggactgcacaagctcggctacatcctgcgcgacatcagcaagatccccgggggcgccatgtacgccgacgacacggcggggtgggacacccgcatcactgaagacgacctgcacaacgaagagaagatcacccagcagatggacccggagcatcggcagctagcctccgccatcttcaagctgacgtaccagaacaaggtggtcaaggtgcagcgccccacccccaccggcaccgtgatggacataataagccggaaggaccaacgcggctccgggcaggtcggcacctacgggctgaacacgttcaccaacatggaggctcagctcatcagacaaatggagggcgagggggttcttagcaaggccgatctggagaacccccatctcccggagaagaagatcacccagtggctggaaaccaagggcgtggagcgcctgaagcggatggcgatctccggtgacgactgcgtcgtgaaacccatcgacgaccgcttcgccaacgccctccttgccctgaacgacatgggaaaggtgcgtaaggacatcccccagtggcagcccagcaagggctggcacgactggcagcaggtcccgttctgctcccaccacttccatgagctcattatgaaggacgggcgcaagttagtggttccgtgccggccccaggacgagttgatcggccgcgcccggatcagccagggggcgggctggtccctccgcgagacggcctgcctaggcaaggcttacgcccagatgtggagcctgatgtacttccaccgccgggacttgcgcctggcgtccaacgccatatgtagcgccgtccccgttcactgggttcccacctcgcggaccacgtggtccatccacgcccaccaccagtggatgacgaccgaggacatgctgacggtctggaaccgcgtgtggattgaggacaacccctggatggaggacaagacccccgtgacgacttgggagaacgtcccctacttggggaagcgggaggaccagtggtgtggcagcctcatcgggctgacctcccgggccacctgggcgcagaacatcccgacggccatccagcaggtccgcagcctcatcggcaacgaggagttcctggactacatgccctccatgaagcgcttccggaaggaggaagagtccgagggggccatatggtga

SEQ ID NO: 25972 - RNA, 9873 nt, synthetic construct
  misc_feature 1..9873: note = derived and/or modified CDS sequence (opt11) from DENV-3__FJ373302__SS-prME
  source 1..9873: mol_type = other RNA
accagcctgtgcctcatgatgatcctgcccgccgcgcttgcgttccacctcaccagccgcgacggcgaaccccggatgatcgtggggaaaaacgagcgcgggaaaagccttctgttcaaaacagccagtggaatcaacatgtgcactttaatcgccatggacctgggcgagatgtgcgacgatactgtgacgtacaagtgcccccacattgccgaggtggagcccgaggacatcgactgttggtgcaacctgaccagcacctgggtgacctatgggacctgcaatcaagctggcgagcaccggcgcgacaagcgctccgtggccttagcaccccacgtgggcatggggttggacacgcgcacccaaacgtggatgagtgccgagggcgcctggcggcaggtagaaaaggtagagacctgggcgttgagacaccctgggttcacgatcctcgccctgtttctggcacactacatcgggacctcgctcacccagaaggtggtaatcttcatcctgctcatgctcgtcactcccagcatgacgatgcgttgcgtgggggtgggcaaccgcgatttcgtcgagggacttagtggagccacctgggtggacgtggtcctggagcacggcggatgcgtgactactatggccaagaacaagcccactttagacatcgagctgcagaagactgaagcgacccagctggccaccttacggaagctgtgtatcgagggcaaaattaccaacatcaccaccgacagccgctgccccacccagggtgaggccgtgctgccggaggagcaggaccagaactatgtctgcaaacatacctacgtggaccgcgggtggggcaacgggtgtgggctattcgggaaaggctccctcgtaacctgtgccaagttccagtgcctggagcctatcgaaggcaaggtcgtgcagtacgagaacctcaagtacactgtgatcatcaccgtccacactggggaccagcatcaagtgggcaacgagacccagggtgtcacagccgagatcacgccccaggcgagcacgaccgaggccattctccccgagtacggcacccttgggctggagtgctctccgcgcaccggcctggactttaacgagatgatccttctgaccatgaagaataaggcctggatggtgcaccggcagtggttcttcgacctgcccctcccctggacgagcggcgcaactaccgagactcccacctggaatcgcaaggagctgctcgtgaccttcaagaacgcgcatgcgaagaagcaagaggtcgtggtgctggggtcgcaggagggggccatgcacacagccctcacgggggccacggagatccagaatagcggcgggacgtccatcttcgcaggtcacctcaagtgtcggctgaagatggacaaactggagctgaaaggaatgagctacgcgatgtgcaccaacaccttcgtactgaagaaggaggtctccgagacgcagcacgggactatcctcatcaaggtggagtataagggcgaggacgccccgtgtaagatcccattttccaccgaggacgggcagggcaaggcacacaacggccgcttgatcaccgccaaccccgtcgtgacgaagaaggaggagcccgtgaatatcgaggcagagccgcccttcggggaaagcaacatcgtcatcggcatcggggacaacgccctgaagatcaactggtacaagaagggatcctcgatagggaagatgttcgaggccaccgcccggggcgctcgccgtatggcaatcctgggagacacggcctgggacttcgggtccgtgggcggggtgctcaacagcctgggcaagatggtccaccagatctttgggtccgcctacaccgccctattctccggcgtatcctgggttatgaagatcggcatcggggtactcttaacctggatcggactgaacagcaaaaacaccagcatgagcttttcttgcatagctatcgggatcatcaccctctacctaggcgcggtggtgcaagccgacaccggctgtgtgatcaactggaagggcaaagagctaaagtgcggctccgggatctttgtaacgaacgaggtacacacctggaccgagcagtacaagttccaagctgactcccccaagaggctcgccaccgccatcgcgggcgcgtgggagaacggggtctgtggcatccgctcaacaacccggatggagaacctgctgtggaagcagatcgccaacgagctcaactacatcctgtgggaaaacaatatcaagctgacagtggtggtcggcgacatcatcggcgtactcgagcagggcaagcgcacgctgacgcctcagccaatggagctaaagtactcctggaagacctgggggaaggccaagatcgtgaccgcggagactcagaactcgtccttcatcatcgacggccccaatacgcccgaatgccccagcgcctcccgggcctggaatgtctgggaggtggaagactacgggtttggcgtgttcaccacaaacatctggctcaagctgagagaagcctacacacaactgtgcgaccaccggctcatgagcgccgccgtcaaggacgagcgagccgtccacgccgatatgggctactggatcgagagccagaagaagggttcctggaaacttgagaaggctagcttaatcgaggtaaaaacttgcacttggcccaagtcacatacactctggtccaacggcgtactcgaatccgatatgatcatccccaaaagccttgccgggcccatctcccagcacaactaccgtccaggttaccacacccagaccgcggggccctggcacctcggcaagctggagctggacttcaactactgcgaaggcacgacagtggtgatcacggagaactgcgggactcgcggcccttcattacggaccactacagtctccgggaagctgatccacgagtggtgctgccgctcgtgcaccctgcccccgttacggtatatgggcgaggatgggtgctggtacggcatggagatccgccccatctccgagaaggaagagaatatggtcaagagcctggtgtccgccggcagcggaaaggtcgacaatttcacgatgggcgtgttatgcctcgccatactgttcgaggaggtcatgaggggtaagttcggaaagaagcacatgatcgccggggtgttctttaccttcgtcttgctcttgtcgggccagatcacctggcgcgacatggcacacaccttaataatgataggcagcaacgcctcggaccggatggggatgggagtgacgtacctggcccttatcgccaccttcaaaatccaacccttcttagctctcgggttcttcctgcgcaagctaacaagccgcgagaacctactcttgggcgtaggcctcgcgatggccaccacactgcagctgccggaggacatagagcagatggcgaatggtattgccctcggcctgatggccctaaagctaatcacccagttcgagacctatcagctgtggaccgcgctgattagcctaacgtgctcgaacaccattttcaccctgacagtagcgtggcgtacggccaccctgattctcgccggggttagcctgctgccggtctgccagtcctcgagtatgcgcaagtccgactggctccccatgaccgtggccgcgatgggcgtgccgcccttacctctgtttatcttcagcctgaaggacaccctgaagcgacgcagctggcccctgaatgagggagtgatggccgtgggcctcgtcagtatcctggcctcctccctgctccggaacgacgtgccaatggccggccccctagttgcaggcggcctactcatcgcctgctacgtcataacgggtacctctgccgacctgacagtggagaaagccgctgacgtgacttgggaggaggaggccgagcagacgggcgtttcccacaacctcatgatcaccgttgacgacgacggaacaatgcgaataaaggacgacgagaccgagaacatcctcacggtcctgcttaagacggcgttgctgattgtgagcggaatattcccatactcgatccccgccacccttttggtgtggcacacctggcaaaagcaaacccgccgcagcggcgtgctatgggacgtccctagcccgccggagacgcagaaggccgagctcgaggagggtgtttatcggattaagcagcagggcatattcggtaagacccaggttggcgtcggggtgcagaaggagggcgtgttccataccatgtggcacgttaccaggggcgccgttttgacctacaacgggaagcggctggagcccaactgggcgagcgtcaagaaagacctgatttcctacggcgggggttggcgcctcagtgcccagtggcagaaaggggaggaggtacaagtgatcgcggtggagccgggcaagaatcccaagaatttccagacaatgcccggcaccttccaaaccacaacgggggagataggcgccatcgccctggatttcaagcccggcaccagcggcagccccatcatcaaccgggaggggaaggtcgtggggctgtatggcaacggcgtggtcaccaagaacggcgggtacgtgagcggaatagcccagactaatgccgagccggatggcccaactcccgagctggaggaggaaatgttcaagaagcgcaacctcacaatcatggacttacaccccgggtcaggcaaaactcggaagtacttaccggccatcgtacgcgaggccatcaagcgccgcttgagaacgctgatactggcgcccacgcgcgtagtagcggccgagatggaggaagcgttaaaggggctgcccattcggtaccagacaaccgccaccaagagcgaacacaccggccgcgagatcgtggatctgatgtgccacgcaaccttcaccatgcggcttctgtcccccgtccgagtccccaattacaacttaatcatcatggacgaggcccacttcacagaccccgccagcatcgcagcacgagggtatatctccacccgcgtggggatgggcgaggccgctgccatctttatgaccgccacgccacccgggacggcggacgcgttcccgcagagcaacgcacccatccaggacgaggaacgcgatattcccgagcggtcctggaacagcggtaacgaatggatcacagactttgccggaaaaaccgtctggttcgttccttccatcaaggccggaaacgacatcgccaactgcctccgcaagaatgggaagaaggttatacagcttagccggaagaccttcgacacggagtaccagaagaccaagctgaacgactgggacttcgtcgtcaccaccgacatcagtgagatgggagcgaacttcaaggcagaccgggtgatcgaccctcggcgctgtcttaagcccgtcatcctgacggacggacccgagcgggtgatcctggctggacccatgccggtgactgccgcctccgctgcgcagaggcggggccgtgttgggcggaacccacagaaagagaacgaccagtacattttcaccggccagccactcaacaatgacgaggaccacgcacactggacagaggcaaagatgctgctggacaacatcaacacccccgagggtattatcccggccctgttcgaacccgagcgcgagaagtccgcagccatcgacggtgagtaccggttgaagggtgagtctcgcaagactttcgtggagctaatgcggcgtggggacctcccggtttggctggcccacaaggtcgcctccgaaggcataaagtacaccgacagaaagtggtgtttcgacgggcagcgaaacaaccagattttggaggagaacatggacgtggagatctggaccaaggagggcgagaagaaaaagctccggccccgctggctggacgcccgcacctactcagatccgctggccctcaaggagttcaaggatttcgccgcgggtcggaagtccatcgcactggacctggtgacggagataggtagagtgcccagccacctcgcgcaccggaccagaaacgccctggacaacctggtcatgctccacaccagcgagcacggcgggaaagcctaccggcacgccgtcgaggaactcccagagaccatggagacgctgctcctgctgggcctcatgatcttgctaaccggaggggcgatgctgttcctgatctccgggaaggggatcggcaagacctccatcgggctgatctgcgtgatcgcgtcaagcggcatgctctggatggctgagatccccctgcagtggatcgcctccgccatcgtgctagaatttttcatgatggtcctcctgatcccagagcccgaaaagcagcgcacgccccaggacaatcagctagcctacgtagtaatcgggatcttaacgctggcggctatcatcgccgctaacgaaatgggcctgctcgagaccaccaagcgggacctgggcatgtctaaggagccgggggtcgtatcaccaaccagctacctggatgtggacctccaccccgcatcggcgtggacgctatacgcagtagcgaccaccgtgatcactcccatgctgcgccacacgatcgagaacagcaccgcaaacgtgtccctcgcggccattgccaaccaggccgtggtgctgatgggtctggacaaggggtggccgatcagcaaaatggacctaggtgttccgctactggcactcgggtgctactcccaagtcaatcccctgaccctgaccgcggccgtgctactgctgatcacgcactatgccatcatcggacccggcctccaggcaaaggcgactcgcgaagcgcagaagaggaccgccgccgggatcatgaagaacccgaccgtagatggaatcatgacaattgacctggaccccgtcatctatgactcaaagtttgaaaagcagctgggccaggtgatgctcttggtgctgtgcgccgtccagctcctattgatgcgaacctcctgggcgctctgcgaggccttaaccctcgcgacggggcccatcacgaccctctgggaaggtagccctggtaagttctggaacaccaccatcgctgtctccatggccaacatattccgcggcagctacctggcgggggccgggctcgcattctccatcatgaaatctgtgggcaccggaaagcggggcaccggcagcaagggcgagaccctaggggagaagtggaagaagaaactgaaccagctgtcccgtaaagaatttgacctctacaagaaaagtggcattaccgaggtcgaccggacggaggccaaggaggggctgaagcgcggtgagatcacgcaccacgcggtgtcccggggcagcgcgaagctgcagtggttcgtggagcgcaacatggtaatcccggaggggcgggtgatcgacttaggctgtggtagaggcggctggtcctactattgcgccggtctgaagaaagtgaccgaggtccggggctacacgaagggcgggcccggacacgaggagcccgtccccatgagcacatacggctggaacattgtaaaattaatgtccgggaaggatgtcttctacctcccgcccgagaagtgcgacacgctgctgtgcgacataggcgaaagctcccccagccctactgtagaggagtcccgcaccatccgcgtgctgaaaatggtcgagccgtggcttaaaaacaatcagttctgtatcaaggtactaaacccctacatgcccactgtgatcgaacacctggagcgcctccagcgcaagcacggcggaatgctggtccggaaccccctgagccggaactcgacgcacgagatgtactggattagcaacggcaccgggaacattgtagcctccgtgaacatggtctctcggctcctactaaacaggttcactatgactcaccggcgccctacgatcgagaaggacgtggacttaggggctggcacgcgacacgtgaacgcggagcccgaaacccccaatatggatgtcatcggcgagcgcatcaagcgtatcaaggaggagcataactcaacctggcactatgacgatgagaatccgtacaagacgtgggcgtaccatggcagctacgaagtgaaggcaaccggatctgccagcagcatgatcaacggcgttgtgaagctgctgaccaagccctgggacgtggtccccatggtgacccagatggccatgacggacaccacccccttcgggcagcagagggtattcaaagagaaggtcgacacccggacaccaaggtccatgcccggcacccggcgcgtgatgggcatcaccgctgagtggctctggcggaccctggggcgcaacaagaagccccggctgtgcacacgcgaggaatttaccaagaaggtgaggaccaacgccgccatgggcgcggtattcaccgaggagaaccagtgggacagcgccaaagcggccgtggaggacgaggacttctggaagttagtagaccgtgagcgtgagctgcacaagctgggaaaatgcggttcctgcgtctataacatgatggggaagcgtgagaagaagctcggcgagttcggcaaagccaaggggtcgcgcgccatctggtatatgtggctcggcgctcggtacctggagtttgaggcactcgggttcttgaacgaggaccactggttctcccgcgagaactcctattcgggcgtagagggcgagggcttgcacaagctcggctacatcttgcgggacatcagcaagatacccgggggtgcaatgtacgccgacgacacggccggctgggacacccgcataaccgaggatgacctacacaatgaggagaagatcacccaacagatggacccggagcaccggcagctcgctaacgctatctttaaactaacgtatcagaacaaggtggtcaaggtgcagagacctacacccaccggcaccgtgatggacatcatctcccggaaagatcagagaggtagcgggcaggtcggcacctacggtctaaatacgttcactaacatggaggcccagttgatccggcagatggagggtgagggggtgctgtccaaggcagacttggagaacccccacttaagcgagaagaagattacccagtggctggagaccaaaggggtggagcgcctgaagcggatggccatctctggcgatgactgcgtcgtgaagcctatcgacgatcgcttcgccaacgcgctcttggccctgaacgacatgggtaaggtacggaaggacatcccccagtggcaacctagcaagggctggcacgattggcagcaggtcccattctgttcacaccacttccacgaactcataatgaaggatgggcgcaagctggtcgtgccgtgcaggccacaggacgagctgattggccgcgcccggataagccagggggccgggtggtctctcagagagacggcttgtctggggaaggcctacgctcagatgtggagcctgatgtactttcaccgccgggacctccgcctggcgtccaacgccatttgtagcgcggttcctgtgcactgggtgccaaccagcagaaccacctggtcaatccacgcccaccaccagtggatgacgaccgaggacatgctgaccgtctggaaccgagtctggatcgaggacaacccgtggatggaggacaagacacccgtgactacctgggagaacgtcccatacctcgggaagcgggaggaccaatggtgcgggagcctgatcgggctgacctcccgtgcgacctgggcccagaacatacctaccgccatccagcaggtccggagcttaatcgggaacgaggagttcctggactacatgccgtccatgaaacgcttcaggaaggaggaggagagtgaaggggcgatctggtga

SEQ ID NO: 25973 - RNA, 9873 nt, synthetic construct
  misc_feature 1..9873: note = derived and/or modified CDS sequence (opt11) from DENV-3__FJ182007__SS-prME
  source 1..9873: mol_type = other RNA
accagtttgtgtctcatgatgatcctgccggcagcactggcattccacctaacaagcagggacggggagcccaggatgatcgtggggaagaacgagcgcggtaagtccctgctgttcaagacggccagcgggatcaacatgtgcacgctcatagccatggacctgggggagatgtgcgatgacaccgtaacttacaagtgcccgcacatcgccgaggtggagcccgaggacatcgactgctggtgcaacctcacaagcacctgggtgacctacgggacctgcaaccaggccggcgaacaccgccgcgacaaacggtcagtagcgttagcgccccacgtgggcatggggttggatacgcgcacccagacctggatgagcgccgaaggagcctggcgtcaggtagagaaggtggaaacctgggctctgcgccaccctgggttcacgatcctcgcgctgttcctggcccactatatcggcacctccctcacccagaaggtggtgatcttcatcctgctgatgctagttaccccctctatgacgatgcggtgcgtaggggtgggcaaccgtgacttcgtcgagggtctgtccggggccacctgggtggatgtggttctggagcacggcgggtgcgtgaccaccatggcaaagaacaagcccaccctcgacattgagttgcagaaaaccgaggcgacacaactagcgaccttacggaagctgtgtatcgaaggcaagatcacgaacatcaccaccgactctcgctgtcccacccagggcgaggccgtgctgccggaggagcaggaccagaactacgtctgcaagcacacatacgtggacagggggtggggtaatggctgcggcctattcggcaagggttccctggtcacctgcgcgaagtttcagtgcctggaacccatcgagggcaaagtcgttcagtatgagaacctcaagtacaccgtgattattaccgtccacacgggagatcagcaccaggtggggaacgagacccagggggtgaccgccgagatcacgccacaggccagcacgaccgaagccatcctgccagagtacggtacactaggactcgagtgttccccgcgcaccggcctggatttcaacgagatgatcctgctcaccatgaagaacaaggcctggatggttcaccggcaatggttcttcgacctgcccctgccgtggacgagcggggccaccaccgagacccccacttggaatcgtaaagaacttctggtgacatttaagaacgcccacgcgaagaaacaggaggtggtggtgttagggtcacaggagggcgcgatgcatacggccctaactggcgccaccgagattcagaacagcggcgggacctcgatcttcgctggccacctgaagtgccggctgaagatggataagcttgagctgaaggggatgagctacgcgatgtgcaccaacaccttcgtactgaagaaggaggtatccgagacgcagcacgggaccatattaatcaaggtggagtacaagggagaggacgccccgtgcaaaatacccttcagtaccgaggacggtcagggcaaggcccacaacggccgcttgatcacggccaaccctgttgtgacgaagaaagaagagcctgtcaacatcgaagcagagccgcccttcggggagagcaacatcgtcattggcacaggggacaacgctctgaagatcaactggtataagaaaggcagcagcatcggcaagatgttcgaggccaccgcccggggagctcgcaggatggcaatcctgggcgacaccgcctgggatttcgggtccgtcggcggagtgcttaacagcctgggcaagatggtccaccagatctttggatccgcctacacggccctgttcagcggcgtctcctgggtgatgaagattggcatcggggtcctcctgacttggatcggcctgaacagcaagaacacctccatgtctttctcctgcatcgccatcggtatcatcaccctctacctgggagcggtagttcaggccgacacggggtgcgtcatcaactggaagggcaaggagctcaagtgtggctcaggcatcttcgtgacgaacgaggtgcacacctggactgagcagtacaaattccaggcagactcccccaagcgcctcgccacggccatagcgggtgcatgggagaacggtgtctgcgggatccgtagcaccacacggatggagaatctgctgtggaaacagattgctaacgagctcaactacatcctgtgggagaacaatatcaagctgaccgtggtggtgggggatatcattggcgtgttagagcagggtaagaggacactgacgccccagccgatggagctgaagtattcctggaagacctggggtaaggccaagatcgtgaccgcggagacgcagaacagctcgttcatcattgatgggcccaacacccccgagtgccccagcgcctcccgagcctggaacgtctgggaggtggaggactacgggttcggcgtcttcaccaccaacatctggctcaaattacgcgaggtctacacccagctgtgcgaccaccggctaatgtcggccgccgtgaaggatgagcgcgcggtgcacgctgacatgggctactggatcgagagccagaagaacgggtcctggaagttagagaaggccagtctgatcgaggtcaaaacgtgcacttggccgaagagccacaccctctggagcaacggcgtgctggaaagcgacatgatcatacccaagagcctggccgggcccataagtcagcacaactaccggccgggttaccatacccagacggcagggccctggcaccttgggaagttggaactggacttcaactactgtgagggcaccactgtggtcattacagaggactgcgggacgcgaggcccgagcctacgaaccaccactgtgtccgggaagttaatacacgagtggtgctgccgctcctgcacgctgccaccgctcaggtacatgggcgaggacggttgctggtacggtatggagatacgccccatcagtgagaaggaggaaaacatggttaagagcctggtctccgcgggcagcgggaaagtggacaactttaccatgggggtgttgtgcctggccatcctgttcgaggaagtcatgcgggggaagttcggcaagaagcacatgatcgccggggtgttcttcaccttcgtactgctcctgtccggccaaataacctggcgcgacatggcccacacgctgatcatgatcggttccaacgcctctgatcggatggggatgggcgtcacctacctcgcccttatcgccactttcaaaatccagcccttcctagccctcgggttcttcctgcgtaagctgacctcccgggaaaacctcctgttgggcgtcggcttagccatggcgacgaccctgcagttacctgaggatatcgagcagatggctaatgggatcgcattgggcctaatggccctgaagctcatcacacagttcgagacctaccagttatggacggccctgatcagcctgacctgctccaacaccatcttcaccctgacggtggcatggcgcaccgccacccttatcctcgccggtgtaagtctgctgccggtgtgtcagtccagctccatgcggaagtccgattggctacccatgaccgtcgccgccatgggggtgccgcccctcccgcttttcatcttttcactcaaggacacactgaagcgccgcagctggcccctgaacgagggggtgatggctgtcggtctcgtgtccattttagccagctccctgctccggaatgacgtaccgatggcgggaccactagtcgcgggaggactcctcatagcctgctacgtgatcaccgggaccagcgccgacctgaccgtggagaaggctgccgatgttacgtgggaggaggaggcagagcagaccggcgtgtcccacaacctaatgataaccgttgacgatgacggtacgatgcgcatcaaggacgacgagaccgagaacatcctcacggtcctactgaagaccgccctcctgatcgtgagtggcatcttcccttactccatcccagcgaccctgctggtgtggcacacctggcaaaaacagacgcgccgcagcggcgttctgtgggacgtgcctagcccgcccgagacccagaaagccgagctggaggagggggtgtatcggataaagcagcagggcatcttcgggaagacccaggtcggcgtgggggttcagaaagagggcgtcttccacacgatgtggcacgtgacccgcggagcggtgcttacgtacaacgggaagcggctggagcccaattgggcaagcgttaagaaggacctaatctcctacggcgggggttggagactcagcgcgcagtggcagaagggggaggaggtccaggtgatcgccgtcgagcccggcaaaaaccccaagaacttccagacgatgcccgggacctttcagacgaccaccggggagatcggcgccatcgccttggacttcaaacccgggaccagcgggtcccccataatcaaccgggagggcaaggtggtcgggctctacggcaacggagtcgtgacgaaaaacggtgggtacgtgagcggcatcgcccagaccaacgcggaaccggacggccccacacccgagctggaggaggagatgttcaagaagcgcaacctcaccattatggatctgcaccccgggtccggcaaaacgcggaagtacctgccggccatcgtccgcgaggcaatcaagcggaggttacggacccttatcctcgcccccacccgcgtggtagccgcggaaatggaggaggccctaaaagggctgcccatccgctaccagaccacggccaccaagtcggaacacaccggccgcgagatcgtcgacctgatgtgccacgccaccttcaccatgcggctcctgagtcccgtgcgcgtgccgaactacaacctgatcatcatggacgaggcccacttcaccgaccccgcgagcatcgccgcccgggggtacatctccacccgcgtcggcatgggcgaagccgcggccatcttcatgaccgccacgccgcccgggaccgccgatgccttcccgcagagcaacgcgcccatccaggacgaggaacgcgacatccccgagcgttcttggaactcaggcaacgagtggatcacagatttcgctgggaagaccgtgtggttcgtgccctccatcaaggccggcaacgacatagccaactgcctccgcaagaacgggaagaaagtcatccagctgagccggaaaacgtttgacaccgagtaccagaagaccaagttgaacgactgggacttcgtggtgacaacggatatctccgagatgggcgcgaacttcaaagcggaccgcgtcatcgacccgcggcgatgcctcaagcccgtgattctcaccgacggcccggaacgggtgatcctggccgggcccatgccggtcaccgcagccagcgccgcgcagcgccggggccgcgtcggtcggaaccctcagaaggagaatgaccagtacatcttcaccggccagcctctcaacaacgacgaggaccatgcccactggaccgaagccaagatgctgttggacaacatcaacacgcccgaaggtattatcccggccctctttgagcccgagagagagaagtccgccgctatcgacggcgaataccggctgaagggcgagagccgcaaaacctttgtggaactgatgcggcgcggagacctccccgtgtggcttgcccacaaggtggcctccgaaggcatcaagtacaccgatcggaaatggtgcttcgacgggcagcgcaacaaccaaatcctcgaggagaacatggacgtcgagatctggaccaaggagggagaaaaaaagaagcttcgtccccgctggctggacgcccgcacgtactctgacccgctggcgctcaaggagttcaaggacttcgccgccggccggaagtctatcgccttggacctggtgactgagatcgggcgcgtgcccagccacctcgcccatcggacccgcaatgcgctggacaacctggtcatgctccacaccagcgagcacggggggaaggcctaccggcacgccgtggaggagctgcccgagacaatggaaaccctgctgctgctgggcctcatgatcctgctcactgggggcgccatgctgttcctgatctccggcaaggggatcggcaaaaccagcatcgggctgatctgcgtgattgcctccagcggcatgctctggattgcggagattccgctgcagtggatcgcctccgccatagtcctggagttctttatgatggtgctcctgatccccgagcccgagaagcagcgcacgccccaagacaaccagcttgcctacgtggtcatcgggatactcaccctggcggcaatcattgccgccaacgagatgggcctgctcgagaccaccaagcgggacctagggatgagcaaggagccgggggtggtgtcccccacatcttacctggacgtggacctccacccagcctcagcgtggactctgtatgccgtggccaccacggtgatcacgcctatgctgcgtcacaccatagaaaacagcaccgcgaacgtctccctcgcagctatagcgaaccaagcagtcgttctgatggggctggataaggggtggccgatcagcaagatggacctgggcgtcccactgttagcactcgggtgctattcccaggtgaaccccctgaccctgacggccgccgttctcctgttaatcacgcactacgccatcatcggtccaggtctccaggccaaggccacccgagaggcgcagaaacgcaccgccgccgggatcatgaaaaacccgacggtcgacggcataatgacaatcgacctagaccccgtgatctacgacagcaaatttgagaagcaactgggccaggtgatgctcctggtcctgtgtgccgtacagttgctgttaatgcggacctcgtgggccctctgcgaggcgctgaccctggccacaggtcccataacgaccctgtgggagggctcgcccggaaagttttggaacacaacgatcgccgtgtccatggccaacatcttccgcggctcgtacctggccggggcgggcttggcattctccataatgaagtccgtcgggaccggcaagcggggcaccgggagccagggcgagaccctaggggagaagtggaagagaaagctgaaccagctgtcccggaaggagttcgacctctacaaaaagtcggggatcaccgaggtggaccgtacggaggccaaggagggtctaaagcgcggcgagattacccatcacgccgtatcccgcggcagcgccaagctacagtggttcgtagagcggaacatggtaatcccggaggggcgagtgatcgacctcggctgcggccggggcgggtggtcctactactgcgctggcttaaagaaggtcaccgaagtgcgcggctataccaagggcgggccagggcatgaagagcccgtgcccatgagcacgtacggctggaacattgtcaaactgatgtccgggaaggacgttttttacctcccgcccgagaaatgcgacaccctgctgtgcgacatcggcgagagctcccccagccccactgtggaggaatcccgcaccattcgggtcctgaagatggtggagccctggctcaagaacaaccagttctgcatcaaggtgctgaacccctacatgcccacagtcatcgagcaccttgagcgcctacagcggaagcacggcgggatgctggtgcgcaatcccttgagccggaactccacccacgagatgtactggataagcaacggcaccggtaacatcgtcgcctcagtcaacatggttagccggctcctgctgaaccggttcaccatgacccatcgccggcccaccatcgagaaggacgtggatctcggagccggcacccgccacgtcaacgccgagcccgagacccccaacatggacgttatcggggagcggatcaagcgcataaaggaggagcacaactccacctggcattacgacgacgagaacccttacaagacatgggcctatcatggcagctatgaggtgaaggcgaccggttccgctagctccatgatcaacggcgtagtgaagctactgaccaagccctgggacgtggtgcccatggtgacgcagatggcaatgacagacaccacccccttcgggcagcagcgggtgtttaaggagaaggtggacacgcgcaccccgaggtccatgcccggtacacgccgggtgatgggcatcaccgccgagtggctctggcgcacgctggggcgtaacaagaagccccgcctgtgcacccgcgaggaattcaccaagaaggttcgaaccaacgccgccatgggcgccgtattcacggaggagaaccagtgggacagcgccaaggccgcggtggaagacgaggacttctggaagctcgtcgacagagagcgggaactgcacaaactggggaagtgtggctcctgcgtctacaacatgatgggaaagcgcgagaagaagctcggcgagttcggcaaggccaagggaagccgggctatatggtacatgtggctgggcgccagatacctggagttcgaggccctcgggttcttaaatgaagaccactggttttccagagaaaacagctactccggcgtggagggggagggcctacacaagctcggctatatcctacgcgacatttcaaagatccccgggggcgcgatgtacgccgacgacaccgccgggtgggacacccggatcaccgaggacgacctgcataacgaagagaagatcactcagcagatggacccggagcaccgccagctcgccaatgccattttcaaattaacataccagaacaaagtcgtgaaggtgcagcggcctacccccaccggcaccgtaatggacatcatctcacgcaaggatcagcgagggagtggccaggtggggacgtacgggctgaacacctttaccaacatggaggcacagctcatccgccagatggagggcgaaggggtactgtccaaagccgacttggagaaccctcacctcagcgagaaaaagatcacccagtggcttgagactaagggcgtcgagcggttaaagcgcatggccatctccggcgacgactgcgtggtgaaaccgatcgatgaccggttcgccaacgccttgctggctttaaatgacatggggaaggtccgcaaggacattccccagtggcagccaagcaaaggctggcacgactggcagcaggtccccttttgttcccaccacttccacgagctcataatgaaggacgggcggaagctggtagtcccgtgccgcccccaagacgagctaatcggccgggcccgcatcagccagggggctggctggagtctccgagagaccgcctgcctgggcaaggcgtacgcccagatgtggagcctcatgtacttccaccgtcgcgatcttcggctggcctccaacgccatttgtagcgccgtgcccgtgcattgggtaccaaccagccgcaccacgtggagtatccacgcgcaccaccagtggatgacgaccgaagacatgctgaccgtgtggaaccgggtgtggatcgaggacaacccatggatggaggacaagacacccgtgacgacctgggagaacgtgccctacttagggaagcgcgaggaccaatggtgtggatccctgatcgggctgacatcccgggccacgtgggcgcagaacattcccaccgccattcagcaggtccgcagcctcatcggcaacgaagagtttctagactatatgccgagcatgaagcggttcagaaaggaggaggagagcgagggggcaatctggtaa

SEQ ID NO: 25974 - RNA, 9873 nt, synthetic construct
  misc_feature 1..9873: note = derived and/or modified CDS sequence (opt11) from DENV-3__FJ182008__SS-prME
  source 1..9873: mol_type = other RNA
accagcctgtgcatcatgatgatcctacctgcggccctggcgttccacctgacctcgcgcgatggcgagccgcggatgatcgtggggaaaaacgaacgcggcaagtcactcctgtttaaaaccgcctccgggatcaatatgtgcaccctgatcgccatggacctcggtgagatgtgcgacgatacagtgacctacaagtgcccccacataaccgaggtggagcccgaggacatagactgctggtgcaacctgacctctacctgggtgacttacgggacttgcaaccaggccggcgagcaccggagagacaagcgatccgtggcactagcgccccacgtgggcatgggccttgacaccaggacccagacctggatgagcgccgaaggagcatggcgccaggtggagaaagtggagacgtgggccctgcgccacccggggttcaccatcctcgccctttttctggcccactacatcggcacctccctgacgcagaaggtggtgatcttcatcctcctgatgctggtcacgcccagcatgaccatgcggtgcgtgggcgtgggaaaccgcgacttcgtcgagggcctctccggtgccacctgggtggacgtggtccttgagcacggcgggtgcgtgacaacgatggcaaagaacaagcctaccctggacatcgagctccagaagaccgaggctacccagctggcgactctgcggaagctttgcatagagggcaagataaccaacatcaccaccgactcgcgctgtcccacgcagggcgaggcagtcttacccgaggagcaggaccaaaactacgtatgcaagcacacctacgtagaccgagggtggggcaacggctgcggcctgtttgggaagggctccctcgttacctgcgccaagttccagtgccttgagcccatcgagggcaaagtcgtgcagtacgagaacctgaagtacaccgtgatcatcacggtccacactggggatcagcatcaggtgggcaacgagacccagggggttaccgccgaaatcacgccccaggcatctacgaccgaggctatcctccccgagtacggcaccctggggctggagtgctcccctcgcaccggcctcgacttcaacgagatgatcctcctgaccatgaagaacaaggcatggatggtgcacaggcagtggttctttgacctccccctgccctggaccagcggtgccaccaccgagacccccacctggaatcgcaaggaactgctcgtgaccttcaagaacgcccacgccaagaaacaggaggtggtggtgctggggtcccaggaaggcgcgatgcataccgccctcactggagctaccgaaattcagaacagcggggggacctccatcttcgccggccacctcaagtgtcggctgaagatggacaagctggagctcaagggtatgagctacgccatgtgcactaatacattcgtcctgaagaaagaggtgtccgagacccagcacgggaccatcctaatcaaggtggaatataagggcgaggacgcgccttgcaagatcccctttagtaccgaagacgggcagggaaaggcacacaacggcaggctcatcacggccaacccagtcgtgactaagaaggaggaacccgtcaacatcgaggcggagccgcccttcggtgagagcaacatcgtcatcggcatcggggacaacgcgctgaagatcaattggtataagaagggctccagcataggcaagatgtttgaggcaacagctcggggcgctcgccggatggctatcctgggcgacaccgcgtgggactttggctccgtgggcggggtgctgaacagcctcggcaagatggttcaccaaatcttcgggtcagcctacacggccctgttcagcggggtgtcctgggtgatgaagatcggcatcggagtactgctcacatggatcggcctgaacagcaagaacacgtcgatgagcttctcctgcatcgccatcggcgtcataacgctgtacttaggcgccgtggtccaagccgacatggggtgcgtaatcaactggaagggcaaggaactgaagtgcggcagcggtatcttcgtgacgaacgaggtccacacctggaccgagcagtataagttccaggccgactcccccaagcgccttgccaccgctatcgccggcgcgtgggagaacggggtgtgcggcatccgcagcaccacccgcatggagaacctcctgtggaagcaaatcgccaacgagctgaactacatcctctgggagaacaacataaagctgaccgtggttgttggagacatcatcggggtgctcgagcagggcaagcgcaccttgactccccagccgatggagctgaagtactcgtggaagacctggggcaaagccaagatcgttacggccgagacccaaaatagctccttcataatagacggccccaacacgcccgagtgccctagcgcctcccgggcctggaacgtgtgggaggtggaagactacgggtttggcgtctttacaaccaatatatggctgaagctcagagaggtatatacccaattgtgcgatcacaggctgatgagcgccgccgtgaaagacgagcgcgccgtgcacgcagacatgggttactggatcgagagccagaagaacgggtcctggaaactcgagaaggccagcctgatcgaggtgaagacctgcacgtggccgaagtcccacactctgtggagcaacggcgtgctcgagtcagacatgatcattcccaagagcctggccgggcccatctcccagcacaactaccggcccggttaccatacccagaccgccgggccctggcacttaggcaagctcgaattagactttaactactgcgaaggcacgaccgtcgtgatcaccgagaactgtgggacccgcggacccagcctgcggacgactaccgtgtccgggaagctcattcacgagtggtgctgccgctcgtgcactctacccccgctgaggtatatgggagaggacgggtgctggtacggcatggagattcgacccatctccgagaaggaggagaacatggtcaaaagccttgtgagcgccggcagcgggaaggtggacaacttcacgatgggcgtactgtgcctggctatcctcttcgaggaggtgatgcgagggaagttcggcaaaaagcacatgattgccggggtgttctttaccttcgtcctgctgttgtctggccagatcacgtggcgcgacatggcccacaccctgatcatgatcggcagcaacgcctccgacaagatggggatgggcgtgacgtacctggccctaatcgcgactttcaagatccaacccttcctagccctggggttctttctccggaagctcactagccgcgaaaacctgctactgggcgtgggcctggccatggccactacgctccagctgcccgaggacatcgagcaaatggcgaacgggatcgccctgggcctcatggctctgaagctgatcacccagttcgagacctaccagctctggaccgcccttatcagcctaacgtgcagtaacaccatgttcaccctcaccgtcgcctggcggacggcaacgctgatcttggccggcgtgagcctcctgccggtctgccagtcaagctccatgcgcaagaccgattggttacccatggccgtcgccgccatgggcgtccccccattgccgctgtttatcttcagcctgaaggacaccctcaaacggcgctcctggcccctgaacgagggggtcatggccgtgggcctggtgagcatactcgcctcctcactgctgcgcaacgacgtacccatggccggccccctcgtggccggtggcctgcttattgcttgttacgtgattacggggacctccgcggacctcactgtggagaaggcagccgacatcacctgggaggaggaggccgagcagacgggcgtgagccacaatttaatgataactgtggacgacgacgggaccatgcggattaaggacgacgaaacggagaacatcctgaccgtcctcctgaagacggcccttctcatcatctccggcgtgtttccgtacagcatacccgcgaccctgctggtgtggcacacgtggcagaagcaaacccagcgctcgggcgtcctctgggacgtgcccagcccgcccgagacgcaaaaggccgagctagaagagggggtgtaccggatcaagcagcagggcatattcgggaagacccaggtcggggtaggggtgcagaaagagggcgtcttccacaccatgtggcacgtgaccagaggcgccgtgctgacctacaacgggaagcggctcgagcccaactgggcctccgtcaagaaggacctgatcagctacggcgggggctggcgcttatccgcgcagtggcagaagggggaggaggtccaggtgattgcggtcgagcccggcaagaacccaaagaacttccagaccatgccgggcaccttccaaaccactaccggtgaaatcggcgccatagccctcgacttcaagcccgggacctcaggcagccccatcatcaatcgggaagggaaagtggtggggctgtacggcaacggggtcgtgaccaaaaacggcggttacgtttccggtatcgcgcagacgaacgcagagccggacggccccacacccgagctggaggaggagatgttcaagaagcgcaatttgaccatcatggacctccaccccgggagcggcaagacccggaagtacctgccggccatcgtccgagaggccatcaaaaggcgcctgcgcacgctgatcctggcccctacccgcgtggtggccgcggagatggaggaagcgctgaaggggctccccattcggtaccagaccaccgccacgaagtccgagcacactggccgcgagatcgttgacctgatgtgccacgccacctttaccatgcggctgctcagccccgtacgcgtgccaaactacaacctgatcataatggatgaggcccacttcacggaccccgcctccatcgccgcgcgggggtacataagcacccgcgtcgggatgggcgaggccgcggccatctttatgaccgccacgccgcccgggacggccgacgccttcccgcagtccaacgcaccaatccaggacgaggagcgggacatacctgaaagaagctggaactcgggtaacgagtggatcacggacttcgctggaaagacggtgtggttcgtccccagcatcaaggcgggcaacgacatcgcaaactgcctgcgcaagaacggtaagaaggtcatccagctctccagaaagaccttcgatacggaataccagaagactaagctgaacgactgggattttgtggtgaccactgacatcagcgagatgggcgcgaacttcaaggcggaccgcgtcatcgacccacggcgctgcctgaagcccgtgatactcacggacggccccgagcgcgtgatcctggccgggcctatgccggtcaccgccgcctccgccgcgcaacgccggggtcgggtgggacggaacccccagaaggaaaacgaccagtacatcttcaccggtcagcccctgaacaatgacgaggaccacgcccactggactgaggccaaaatgctcctggataacataaacacccccgaggggatcatcccggccctgttcgagcccgagagggagaagagcgcggccatcgacggtgagtaccggctcaagggcgagtcccgcaagacgttcgtcgagctgatgaggcgcggggatctgcccgtttggctagcccacaaggtggcgagcgagggcatcaagtacaccgaccgaaagtggtgcttcgacgggcagcgcaataaccaaattctggaggagaacatggacgtcgagatctggaccaaggagggcgagaagaagaagctgcggccccgctggctcgacgcaagaacctactccgacccgctggcgctaaaagagttcaaggactttgccgcaggccgcaagagtatcgccctcgacctggtgacggagataggacgcgtgccctcccacctggcacacaggacacgcaacgcgttagacaacctagtaatgctgcatacctcagagcacggcgggagggcctaccgccatgccgtcgaagagctccccgagaccatggagactttgctgcttctgggcttgatgatcctcctgaccgggggcgccatgttgttcctcatcagcggcaaagggattggcaagacctccatcggcctaatctgcgtgatcgcctcttccggcatgctgtggatggcggagatcccgctacagtggatcgccagcgccatcgtcctggagttcttcatgatggtgctgctcattcccgagcccgagaagcagcggacgccacaggacaatcagctggcctacgtggtcatcgggatactgacactcgccgcgatcatcgctgccaacgaaatgggcctgctggaaaccaccaagcgagatctcggcatgtccaaagagccgggggtagtgagccccacctcctaccttgacgtcgacctgcaccctgccagcgcttggacgctctacgccgtggccaccaccgtgatcacccccatgctgcggcacacgatcgagaactccaccgcaaacgtcagcctggctgcgattgccaaccaagccgttgtgcttatgggcctggacaagggctggccaatctccaaaatggaccttggcgttcccctcctggctcttggatgctacagccaagtgaacccgctcaccctgaccgccgcggtgctactcctgatcacgcactacgccatcatcggccccggtttgcaggcgaaggctacccgcgaggcgcagaaacggaccgcggccgggatcatgaagaacccgaccgtcgacgggataatgaccatcgacctcgaccctgtgatctacgactccaagttcgagaagcagctcggtcaagtaatgctgctagtcttatgtgcagtgcagctgctgctgatgcgaaccagctgggccttatgcgaggcgctcaccctggctaccggccccatcacgacactgtgggaaggcagtccgggtaagttctggaacaccactatcgccgtgagcatggcaaacatcttccggggctcctaccttgccggtgcgggcctggcattcagcattatgaaaagtgtcggaacaggcaagcgcggcaccgggtcgcagggcgagaccctgggggagaagtggaagaagaagctaaatcagctgtcgcggaaagaatttgatctgtacaaaaagtccggcatcaccgaagtggatcggaccgaggccaaggaggggctcaagcgcggggagacgacccaccacgccgtgagcaggggcaccgccaagctgcagtggttcgtcgaacggaacatggtgatccctgagggccgcgtgatcgacctaggatgcgggcgcggcggttggagttactattgtgctggcctcaagaaggttaccgaggtgcgcgggtatactaagggcgggcccgggcacgaggagcccgtgcccatgagcacctacggctggaacatcgtcaagctgatgtccgggaaggacgtgttttaccttccgcccgagaagtgcgacaccctcctgtgcgacatcggcgagagctctcccagccccaccgtcgaagaatcccggactatacgcgtcctaaagatggtggagccttggctgaagaacaaccagttctgcattaaggtgctcaacccctatatgcccactgtcatagagcacctggagcgcttacagcgtaagcacggcggaatgctcgtgcgcaaccctctgtcacggaactccacccacgagatgtactggatcagcaacggcaccgggaacatagttgctagtgtcaacatggtgtctcgcctgttgctcaaccggttcaccatgacccaccgccggccgaccatcgagaaagacgttgacttaggcgccggcacccgccacgtgaatgccgaacccgaaacgcccaacatggatgtgattggagagcggattaagcgcatcaaggaggaacataactctacttggcactacgacgacgagaacccgtacaagacctgggcctatcacggtagctacgaggtgaaggcgaccgggtccgcctcgtccatgattaacggcgtcgtgaaactcctgacgaagccctgggacgtcgtgcccatggtgacccagatggccatgaccgacaccacgccttttgggcagcagcgggtttttaaggagaaagtcgacacccgcacccctcggagcatgcccggtacccgccgggtgatgggcatcacggccgaatggctgtggcgcaccctcgggcggaacaagaagccccgcctgtgtacccgggaagaattcaccaagaaggtccgcacgaacgcggccatgggcgccgttttcaccgaggagaatcagtgggatagcgccaaggccgcggttgaagacgaagacttctggaaactggtcgaccgagagagggagctccacaagcttgggaagtgtggctcctgtgtgtacaacatgatggggaagcgagagaagaagctgggagaattcggcaaagcaaaggggagccgggcgatctggtacatgtggctcggggcgcgctaccttgagttcgaggccctggggttcctcaacgaggaccactggttctcccgggagaactcttactcgggcgtggagggggagggcctgcacaagctgggctacatcttgcgcgatataagcaagatccccgggggcgcgatgtatgccgacgataccgccgggtgggatacgcggatcacggaggacgatctgcataacgaggagaagataacccagcagatggacccggagcaccgccagctggcgaacgccatcttcaaactaacctaccagaacaaggtcgtgaaagtgcaacggcccacccccaccggcacggtcatggatatcatttcccgcaaagaccagcggggctcaggccaggtcggcacctacgggctgaacaccttcacaaacatggaggcccaactgatccgccagatggagggcgagggggtgctctctaaggccgacctggaaaacccccacctccccgagaagaagataacgcagtggttagagaccaagggcgttgagcggttacgccggatggccatcagcggggacgactgtgtggtgaagcccattgatgatcggttcgcaaacgccctgctcgcgctgaacgacatggggaaggtccggaaggacatcccccagtggcagccctcaaagggctggcacgactggcagcaggtgccgttctgcagccaccacttccacgagctgatcatgaaagacgggcgcaagctcgtggtgccgtgccggccccaagatgagctgataggtcgggcccggatctcccagggagccggctggagcctgcgtgagaccgcctgcctcggcaaggcgtacgcccagatgtggagcttgatgtatttccatcggcgggacctgcgcctcgccagcaacgccatatgctccgccgttcccgtgcattgggtcccgaccagccgcacgacctggtccatccacgcacaccaccagtggatgacaaccgaggacatgttaacggtatggaaccgcgtgtggatcgaggacaacccatggatggaggacaagacgccggtcaccacctgggagaacgtgccgtaccttgggaagcgggaggaccagtggtgtggcagtctcatcgggctgacgagccgtgccacctgggcgcagaatatcccaaccgccatccagcaagtacggtccctgattggcaacgaggagttcctcgattacatgccttccatgaagcgcttccgcaaggaggaggagagtgagggtgccatctggtag

SEQ ID NO: 25975 - RNA, 9873 nt, synthetic construct
  misc_feature 1..9873: note = derived and/or modified CDS sequence (opt11) from DENV-3__FJ182010__SS-prME
  source 1..9873: mol_type = other RNA
accagcttatgccttatgatgatcctgcccgctgccttggccttccacctcaccagccgcgacggggagcctcggatgatcgtggggaaaaatgagcgcggcaagagccttttattcaagaccgccagcgggatcaacatgtgcactctcattgccatggacctaggggaaatgtgcgacgacaccgttacctacaagtgcccccatatcgccgaggtggaacccgaagacatcgactgttggtgcaacctgacatctacgtgggtgacctacggcacctgtaaccaggcaggcgagcaccggcgcgataagcggtccgtggcgttggcgccacacgtcggcatgggactggacacccgaactcagacgtggatgagcgccgaaggcgcttggcggcaggtcgagaaggtcgagacctgggctttgcgccaccccggtttcactatcctcgccctgttcttggcccactacatcggaaccagcctgacccagaaagtggtaatcttcgtactcctgatgctcgttaccccaagcatgacaatgcggtgcgtcggggtcggcaaccgcgacttcgtggagggcctatccggggccacctgggtggacgtcgtgctggagcatggtgggtgtgtgactaccatggccaaaaacaagcctacgctcgacatcgagctgcagaagaccgaggcgacccaactggccaccctccgaaagctgtgtatagagggaaaaatcaccaacatcaccacggactcacgctgtcctacccagggagaggcggtcctgccggaggagcaggaccagaactacgtctgcaaacatacgtacgtagaccggggatggggcaacggctgcggtctcttcgggaagggctccctggtgacgtgtgccaagttccagtgcctcgagcccatcgagggcaaagttgttcagtacgagaacctcaagtacacggtcatcatcaccgtgcacaccggggaccagcaccaggtcgggaacgagacccagggggtgaccgccgagatcactccccaagcatcgacaaccgaggctattctgcctgaatacggcaccctgggcctcgagtgctccccgaggaccggcctggacttcaatgagatgatattactcaccatgaagaacaaggcatggatggttcaccgacagtggttctttgacctgccacttccctggacgagcggcgccacgaccgagacccccacgtggaaccgcaaggagctcctggtgactttcaagaatgcccacgcgaagaagcaggaggtggtggtcctgggctcgcaggagggcgctatgcacactgccctcacaggggccacggagatccagaacagcggcggaacctcgatcttcgccggtcacctgaagtgccggctgaagatggacaagctcgagctgaaaggcatgagctatgctatgtgtaccaacacattcgtgctgaagaaggaggtgtcggagacgcagcatgggaccattctcatcaaggtagagtataagggcgaggatgcgccgtgcaagattccctttagcactgaggacgggcagggcaaggcccataacggccgcctgatcaccgccaaccccgtggtgacgaagaaggaggagcccgtcaacatagaggcggagccgcccttcggtgaaagcaatatcgtcatcggcatcggtgacaacgccctcaagatcaactggtataagaagggttctagcatagggaagatgttcgaagcgaccgcccggggggcccgccgaatggcgatactgggcgataccgcctgggattttggatccgtgggcggggtgctcaacagcctgggcaaaatggtgcaccagatcttcgggtccgcctacaccgccttattcagcggcgtgtcctgggtcatgaagataggcatcggggtgcttctgacttggataggcctgaacagtaagaacacctccatgagcttttcctgcatcgccattgggatcatcaccttgtaccttggcgcggttgtccaggctgacaccgggtgtgtgatcaactggaagggaaaagagctgaaatgtgggagcggtatcttcgttactaacgaggtacacacgtggaccgagcagtacaaattccaggccgactcccccaagcgccttgcgaccgccatagctggcgcctgggaaaacggagtctgcgggatccggagcacgacccggatggagaatttgctgtggaagcaggtcgcaaacgaactcaactacatcctgtgggagaacaacatcaaactgactgtcgtggtcggggacataatcggcgtcctcgagcagggcaagcgcactctgacgcctcaaccgatggagttaaaatactcctggaagacctggggcaaagccaagatcgtgaccgctgagacccagaattcttcctttatcatcgatggccctaacacgccggagtgtcccagcgccagccgcgcctggaacgtgtgggaggtcgaagactacgggttcggcgtgttcaccaccaacatatggctcaagctgcgcgaggtgtacacccagctgtgcgaccaccgactcatgagcgccgcggtcaaggacgagcgcgcggtgcacgcggacatgggctattggatcgaatcgcagaaaaacgggtcctggaaattagagaaagctagcctgatcgaggtgaagacctgcacctggccaaagtcccacaccctctggagcaacggtgtgctggagagcgacatgattattcctaaatcccttgcgggtcccatatcccagcacaactatcggccgggataccacacccaaaccgccgggccctggcacctcggcaagctggaactggacttcaactattgcgagggcacgactgtggtaattaccgaaaactgcggtaccagggggcccagcctccggacgaccaccgtgagtggcaagttaatccacgaatggtgctgccgcagctgtaccctgcctccattacgatacatgggcgaagacgggtgctggtacggcatggaaatccgccctatctccgagaaggaggagaatatggtgaagtccctggtgtccgcgggtagtggcaaggtcgacaacttcacaatgggcgtcctctgcctcgccatcctgtttgaggaggtgatgcgggggaagttcggcaagaagcacatgatagccggtgtcttcttcaccttcgtgctgctcctgtccggacagataacttggcgcgacatggcccacaccctgattatgattgggagtaatgcgtccgaccggatggggatgggagtcacatacctcgcgctgatcgccaccttcaagatccaaccattcctggccctggggttctttctgcgcaagctgacttcacgggaaaacctccttctaggcgtcggcctggccatggccaccacgctacaactgcccgaggacatcgagcagatggctaatgggatcgctcttgggcttatggccctgaagcttataacccagtttgagacctaccagctgtggaccgccctgatctcgctgacgtgtagtaacaccattttcaccctgacagtggcatggcgcacggccactttgatcttggccggggtctccctgctgcctgtgtgtcagtcatcgtctatgcgcaagtccgactggctccccatgaccgtggccgcgatgggcgtaccccccctgccgctgttcatcttctccctcaaggataccctgaaacgccgctcgtggccgcttaacgagggggtaatggccgtgggcctcgtcagcattctggccagctcactgctacggaacgacgtgccaatggccggcccccttgtagccggtggcctgctcatcgcatgctacgttattactgggaccagcgcggacctaacagtggagaaggccgctgacgtgacctgggaggaggaggccgagcaaacgggcgtttcccacaacctgatgatcaccgtggatgacgacgggaccatgcggatcaaagacgacgaaaccgagaacatcctcaccgttctgctgaagacggcgcttctgatcgtctctggcatcttcccgtactccatccccgcgaccctgctcgtttggcacacctggcagaagcagactagacgcagcggcgtgctgtgggatgtgccctcgcctcccgagacgcaaaaggccgagctggaggagggagtgtaccggatcaagcaacaagggatcttcggaaaaactcaggtgggcgtgggggtgcagaaggagggtgttttccataccatgtggcacgtcacccggggtgccgtgctcacgtacaacgggaagcgccttgaaccaaactgggcgtctgtaaagaaggacctgatctcttacggtggaggttggcgactcagtgctcaatggcagaagggggaggaggtccaggtgatcgcggttgagccaggcaagaatcccaaaaacttccagaccatgcccggaacctttcaaaccacgaccggggagattggcgcaatcgccctagacttcaagcccgggaccagcggctcccccatcatcaaccgggagggcaaggtagtggggctgtacggtaacggtgtcgtaactaagaatggcggatacgtgtccggcatcgcccagacgaacgcggagccggacgggccaacgcccgagttggaggaggagatgttcaaaaagcgcaacctcaccatcatggacctgcacccagggagtggtaagacccggaagtacctgccggccattgttagagaggccatcaagcgtcgtctgcggacgctaattctggcccccacccgcgtcgtcgccgcggagatggaggaggcactcaaaggcctgcccatacgttaccagaccaccgccacaaagtctgagcataccgggcgggagattgtggacctgatgtgtcacgcaacctttaccatgcggctcctgtcccccgtacgcgtgccgaactacaacctgatcatcatggacgaggcacattttactgaccccgcgagcattgccgcccgggggtacatcagtacgcgcgtgggcatgggcgaggccgccgccatctttatgaccgccaccccgcccgggacggccgatgcattcccgcaaagcaacgctcccattcaggacgaggagcgcgacatccccgagcggtcttggaacagcggcaacgagtggatcacagacttcgctgggaagaccgtctggttcgtgccctccatcaaggccggaaacgacatcgccaactgtctgcgcaagaacgggaagaaggttatccagctgagccggaagaccttcgacaccgagtaccaaaagactaagctgaacgactgggattttgtcgtcaccaccgacatctccgagatgggcgccaactttaaggcggaccgcgtgatagacccgcggcgctgcctcaaacccgtcatcctgacggatggccctgaacgagtcatcctggcagggcccatgcctgtgacggctgccagcgcggctcagaggcggggccgcgtggggcggaacccgcagaaggagaacgatcagtacatcttcaccggccaacccctcaacaacgacgaggaccatgcccattggaccgaggctaagatgctgctggacaacataaatacccccgagggtatcatcccggccttattcgagccggagcgtgaaaagtccgcggcaatcgacggcgagtacagactgaaaggtgagagccggaagacgttcgtggagcttatgcggcggggggacctccccgtttggctggcccacaaggtggccagtgagggtatcaagtacacagaccggaagtggtgctttgacgggcagcgcaacaaccagatcctggaggagaacatggacgtggagatctggaccaaggagggcgaaaaaaagaagctccggccccgatggctggacgcacgaacctatagcgaccccctggcgttgaaagagtttaaagacttcgccgccgggcggaagtcaatagccctggacctggttacggagatcggcagagtgccctcccacttagcccatcggactcggaacgcgctagacaacttggtgatgctacacaccagcgagcacggcgggaaggcctaccggcacgccgtcgaggagctgcccgagactatggagactcttctgctgctcggccttatgatcttgctgaccggcggcgccatgctgtttctgatctccggcaagggcatcggcaagaccagcataggactgatctgcgtaattgccagcagcggcatgctctggatggcggagatcccgctgcagtggatcgcatccgccatcgtgttggagttcttcatgatggtacttctgatccccgaacccgagaagcaaagaacgccacaggacaaccagctggcctacgtagtcatagggatcctaaccctggccgcgatcatagccgccaacgagatgggcctgctcgaaaccacgaagcgggacctagggatgagcaaagagccgggggtcgtctcccccaccagctatctggacgtggacttacaccccgcttccgcgtggactctgtacgccgtcgccacaaccgtgatcacccccatgctgcgtcatactatagagaatagtacagcgaacgtatcgctcgcagcgatagccaaccaggcggtcgtgctaatgggcctcgacaaagggtggccgatcagcaaaatggatctcggcgtgccgttgctggcgttggggtgctactcccaggtaaatccgctgaccctgacagccgccgtgcttctattgataacgcactacgccatcatcggccccggcctccaggccaaagcgacccgcgaggcccagaaacgcacagcggccgggataatgaagaacccgaccgtggatggcattatgacgatcgatctggaccccgtcatctacgactctaagttcgagaagcagctgggccaagtgatgctcctggttctgtgtgccgtacaattactactcatgcggacttcctgggcgctgtgtgaggcgctgacgctggccacaggccccattacgactctctgggagggcagcccagggaagttctggaacaccacaatcgccgtgagcatggccaacattttccgcggaagctacctggcgggtgccgggctggcattctctattatgaagtcagtggggactggtaagcggggcaccggttcccagggcgagacactcggggagaagtggaagaagaagctaaaccaactgagtcggaaggagtttgacctctacaagaagtcaggtataacggaggtcgaccggacagaggccaaagaggggctgaagcgcggagaaatcacccaccacgccgtgtcccggggttcagccaagttacaatggttcgtggagcgcaacatggtaatcccagaggggagagtcattgacctcggttgcggccgcggcgggtggtcgtactactgtgctggcctcaagaaggtgacggaggtccgggggtataccaaaggagggcccgggcatgaagagccggtacccatgagcacgtacgggtggaatatcgtgaaactgatgtccgggaaggatgtcttctacctaccgcctgaaaagtgcgacacgttactgtgtgacatcggcgagagctctccttcacccaccgtggaggagagccgcaccatacgcgtgctgaagatggtcgagccttggctcaagaacaaccagttctgcatcaaggtgcttaacccctatatgccgaccgtaatcgagcacctggagcggctccagaggaagcatggcggtatgcttgtccgtaaccctctgagccgaaattcgacgcacgaaatgtactggatctcaaacgggaccggaaacatcgtggccagtgtgaacatggttagcagactgctgttgaaccgctttaccatgacccatcggcgcccgacgatagagaaggacgtagaccttggcgctggcacccgacacgtgaatgccgaacccgagacccccaatatggacgtcatcggggagcgcattaagcgaattaaggaggagcacaactcaacatggcactacgacgatgagaacccgtacaagacctgggcgtaccacggtagctacgaagtgaaggcgaccgggagcgcctcaagtatgataaatggagtcgtcaagctcctgaccaaaccgtgggacgtcgtacccatggtgactcagatggccatgacggacacaacccctttcggtcagcagagggttttcaaggaaaaggtggatacccggacgccacgctccatgcccggaacccggcgcgtcatggggatcacagcggaatggctgtggagaaccctggggcgcaataagaagccccggctttgtacgcgcgaagagttcacaaagaaggtgaggaccaatgcagccatgggcgccgtgttcaccgaggagaaccagtgggacagcgccaaggccgcggtggaagacgaggacttctggaagctcgtggaccgggagcgcgagctgcacaaactgggcaagtgcggctcctgcgtctacaatatgatggggaagcgggagaagaaactcggagagttcggcaaggcaaaggggagccgcgccatctggtacatgtggctgggcgctcggtatctggaattcgaggccctcggatttctgaacgaagaccactggttttcccgcgaaaacagctactcaggagtagagggagagggcctgcacaagcttgggtacattctgcgggacatctctaagatccccggaggggccatgtacgctgacgacacggccggctgggacacgcgcatcaccgaggatgacctgcacaacgaggaaaagatcactcagcagatggacccggagcatcggcagctcgcagacgccatcttcaagctgacgtaccaaaacaaagtagttaaagtgcagaggcctacccctaccggtactgtaatggacatcataagccgtaaggaccagcgcgggagcgggcaggtgggcacctacggcctgaacacgtttaccaacatggaggcgcagctcatccggcagatggagggcgagggggtacttaccaaggccgatctcgagaacccccacctctcggaaaagaagatcactcagtggctggagactaagggcgtggagcgtctgaagcggatggccattagcggcgacgactgcgttgtgaagcccatcgacgaccgcttcgcaaatgccctcctggcgctgaacgacatgggtaaagtgcggaaggacatcccccaatggcagccctccaagggctggcacgactggcagcaagttcctttctgcagccaccattttcatgagctcatcatgaaagatgggcgcaagctggtggtcccgtgccggcctcaggatgagctcatcggccgcgcgaggatctcacagggggccggctggagccttcgagaaaccgcttgccttggcaaggcctacgcgcaaatgtggagcttgatgtacttccaccgtcgagacttgcgcctggccagcaatgccatctgctccgccgtcccagtgcactgggtgcccacatcgcgaaccacgtggagcatccacgcgcaccatcagtggatgacgaccgaggacatgctgaccgtctggaaccgcgtctggatcgaggacaacccgtggatggaggacaagacaccagttacaacctgggagaatgtcccctacctcggcaaacgggaggaccagtggtgcggatccctgatcgggttaacctcacgcgccacgtgggcccagaacatcccaaccgccattcagcaggtccggtccctcatcgggaacgaggagttccttgactacatgccgagcatgaaacgcttccgcaaggaggaggagagtgagggggcaatctggtga

SEQ ID NO: 25976 - RNA, 9873 nt, synthetic construct
  misc_feature 1..9873: note = derived and/or modified CDS sequence (opt11) from DENV-3__FJ182011__SS-prME
  source 1..9873: mol_type = other RNA
acctctctgtgcctaatgatgatcctacccgctgcgctcgcgttccatctcacttcccgggacggggaacccaggatgatcgtcggcaaaaatgaacgcgggaagtcgctattattcaagaccgcatcaggtatcaatatgtgcacgctaatcgccatggacttaggagaaatgtgcgacgacactgtgacgtacaagtgcccccatatcgcagaagtggaaccagaagacatcgactgctggtgcaacctaacaagtacgtgggtaacctacggcacatgcaatcaagcaggagaacacagacgagataaaagaagcgtcgccctggccccacacgtgggaatgggactggatacaaggacgcaaacctggatgagtgcagaaggcgcatggaggcaagtcgaaaaagtggaaacatgggctttgcgacatccgggattcactatactcgccctattcttagctcactacatcggcacatcacttactcaaaaagtagtgatattcatactgctcatgctcgtcacccctagcatgaccatgcggtgcgtaggcgtagggaaccgggacttcgtagaaggactcagcggcgccacttgggttgacgtagtgttagaacatggagggtgcgtaaccacaatggccaaaaataaacccaccttggatattgaacttcagaaaaccgaagcaacacaattggcgacactgagaaaactctgcatcgaagggaagatcaccaacataacaaccgacagccgctgtcccacccagggcgaggccgtgctgccagaggaacaagatcaaaactatgtctgcaaacacacatacgtcgatcgagggtgggggaacggctgcgggttgttcggaaaaggatcactcgttacttgcgccaagttccagtgcctggaaccgatagagggaaaagtggtacagtatgaaaatctgaaatacaccgtaatcataactgtgcacaccggagaccaacaccaggtgggaaatgaaacccaaggagtcaccgcggagataacaccacaggcgtcaacaaccgaggccattctgccggagtacggtacattaggcctcgagtgctctccgaggactggattagatttcaacgagatgatactcttaacaatgaaaaacaaggcgtggatggttcaccgacagtggttcttcgacctacccctcccatggacatctggtgcaacaaccgaaacgccaacctggaatcgtaaagaattactcgtgaccttcaaaaacgcacacgcgaaaaagcaagaagtcgtcgttctaggaagccaggagggagccatgcacacagctctgacgggagcaacagaaatccagaacagtggtggaacctcaatattcgccggccacctgaaatgtcgactgaagatggataaactagagcttaaaggtatgtcctacgccatgtgcacaaacacatttgtactaaagaaagaggtaagtgagacacagcacggaacgatcctaatcaaggtggaatacaagggggaggatgctccatgcaaaattccctttagcacagaagacgggcagggcaaggcacacaacggtcgcctaataaccgcaaacccggtcgtgaccaagaaagaggagcctgtcaacatcgaggccgaaccccctttcggcgaaagcaacatagtaattggcataggcgacaacgctctaaagataaactggtacaagaaaggcagcagcatagggaaaatgttcgaagcgacagcgcgaggagcgcgacgtatggccatactaggcgacaccgcgtgggacttcggatccgtaggcggtgtgcttaactcacttgggaaaatggtccaccaaatctttggatctgcgtacacagccctcttctccggagttagttgggtgatgaaaatcggaatcggagtcctactaacctggatcggtctaaacagcaaaaacactagcatgtccttctcctgcatcgccataggaataataacactatacctcggcgcggtcgtacaagcagatacagggtgcgtaataaattggaaaggaaaggagctcaaatgcggctccggcatattcgtcaccaacgaagtccatacttggacagaacagtacaaatttcaggcagacagccctaagcggttagccactgcgatcgcgggtgcgtgggaaaacggggtatgtggtatcagatccacgacccgcatggaaaacttgctatggaaacagatagccaacgaactaaattacatactatgggagaataacatcaagctcacagtggtagtaggtgacataataggcgtgttggagcaggggaaacgcaccctgaccccgcaaccaatggaattgaaatattcatggaagacatggggcaaagcgaagatagtaaccgccgagacgcagaactcgtcgttcataatcgatggtccaaatacccccgaatgcccaagcgccagccgcgcctggaacgtctgggaagtggaagactatgggttcggcgtctttaccacgaatatatggctgaaactccgggaggtgtacacacaactgtgcgaccataggcttatgtcagcggcggtaaaagacgaaagagccgtacacgcggacatgggctactggatagaaagccagaaaaacgggagttggaagctcgagaaagcgtcactcatcgaggtgaagacatgcacatggccaaaaagccatacactatggtcaaacggggtccttgagagcgatatgatcatcccgaagagtttagcgggccctatcagccaacacaactaccgcccaggctatcacacgcagacagccggaccatggcacctagggaaacttgagctcgatttcaactactgcgaaggaacaaccgtggtcatcacggataactgtggaacacgaggaccgtcactaaggacgacaacggtcagtggcaaactgatccatgaatggtgctgcagaagctgcaccctcccacccctgaggtacatgggcgaggacggctgctggtacggaatggaaatacgcccaataagtgaaaaagaggaaaatatggtgaaatcgctagtaagcgcaggctccggaaaagtagataactttacgatgggagtactctgcctcgcgattctgttcgaagaagtaatgaggggcaaatttgggaaaaagcacatgatagcgggcgttttcttcacgttcgtccttttgttgtcaggacagataacctggcgagatatggcacacactctcatcatgataggcagcaatgccagcgacagaatgggtatgggtgtgacctacctagccctaatagcgactttcaaaatccaaccattccttgcattaggcttctttctaagaaaactcacatcgcgagaaaatctcctccttggagtcggactggcgatggcgacaaccctccagctcccggaagacatagaacagatggctaacggcatcgcgctagggctcatggcccttaagctgataacacaattcgaaacctatcaactatggaccgcgctgataagcctaacatgcagcaatacaatattcacgctgacagtggcatggcgcacagctaccctaatactggccggagtgtccctactaccagtctgccaatcatcatcaatgcgaaagtctgattggctaccgatgaccgtagccgccatgggggtgccgccgctgccattgttcatattctcattaaaagataccctcaagcgcagatcctggccgcttaacgaaggcgttatggcagtagggttggtgtcaattctcgcaagctcactcctacggaacgacgtaccaatggcggggcctctcgtcgccggcggattgctaatagcctgctacgtaattacgggaacaagcgcagacctcacggtggaaaaagcagccgacgttacgtgggaggaggaagccgagcaaacaggtgtgagccacaacctcatgattacagtcgacgacgacggtacaatgcgcatcaaggacgacgagaccgagaacattctcaccgtccttctaaagaccgccctcctcatcgtgtcgggtatctttccctacagcataccggccacgcttctagtgtggcacacatggcagaaacaaacccggagatcgggagtactgtgggacgtccccagcccacccgagacacagaaggccgagctagaagaaggtgtatacaggattaagcagcagggaatatttggcaagacacaagtcggagtaggggttcagaaagaaggcgtcttccacacaatgtggcacgtaacgcggggtgcggtattgacatacaatggcaaacgactcgaacctaactgggcatcggtgaagaaggaccttatcagttacggcgggggctggcgattatcagcccaatggcagaaaggcgaggaagtccaagtaatcgcggtggagccgggtaagaaccccaaaaacttccaaaccatgcccggcacatttcaaacaaccacgggcgagataggcgcgattgcccttgatttcaaaccgggaacctcggggtcgcccatcataaaccgtgagggaaaagtggtgggattatacggcaacggtgtggtaacgaaaaatggagggtacgtgagtggtatcgcacagacaaacgcagagccggacgggcctactcccgaactagaggaagagatgtttaaaaagcgaaatctgaccataatggacctacacccggggtctggaaagactagaaaatatctcccagcgatcgtccgagaagctataaaaagacgcctccgaaccctaatcctcgcccccacccgcgtagtagccgccgaaatggaagaggccctgaaggggctcccgattcgctaccagactacggcaactaaatcggagcacacaggacgagagatcgtcgacctaatgtgtcacgcaaccttcaccatgcgactgctatcccctgtcagggtaccgaactacaacttgataataatggatgaggcccatttcacagatcctgcgagcatagccgcaaggggatacataagcacccgagtggggatgggagaagcagctgcgattttcatgacagcaacacccccaggaacagcggacgcatttccgcaatctaacgcacccatccaggacgaagagagggatatcccagaacgttcatggaacagcggcaacgaatggataaccgactttgcaggcaaaacagtgtggttcgtcccaagcattaaagccggcaatgacatcgccaactgtttacgcaaaaacggcaaaaaggtaatacagctctccagaaaaaccttcgataccgagtaccagaaaaccaaactgaacgactgggacttcgtcgtaacgactgacattagcgagatgggggcgaattttaaggcagacagagtaatcgatccgcgccgatgcctcaaacccgtcatcctaacagatggccctgagcgagtaatactggcaggacccatgccggtgactgcagcatccgcagcccaaagacggggccgagtcggccgtaatccgcaaaaggagaacgaccaatacatattcacaggccaacccctgaacaacgacgaggaccacgcgcactggactgaagctaaaatgctcctagacaatataaacacaccagagggcataataccagcattatttgagcctgaaagagagaaaagcgcggcaatagacggagaatatcgcctgaagggagaaagtaggaagaccttcgtggaactcatgagacgaggggatctaccggtctggctcgcccacaaagtcgctagcgagggcatcaaatatactgaccggaagtggtgcttcgacggacaaagaaacaaccaaatcctagaagaaaacatggatgtcgaaatatggacgaaagaaggcgagaaaaagaaattacgcccgcgttggttagacgcaaggacctactcagaccccctcgcattaaaagagtttaaagactttgcagcgggaagaaagagcatagcactggatctcgtaacagaaatagggcgagttcccagtcatctagcccaccgaacacgcaacgctctagacaatctagtcatgctgcatacgagcgagcacggaggtaaggcgtaccgtcacgccgtcgaagaactaccagaaaccatggaaactctgctgctgctcgggctcatgattctgctaacagggggtgccatgctattcctaatcagtgggaaagggataggaaaaacgagcataggactgatatgcgtcattgcatcatcggggatgctatggatggcggaaatacccctgcaatggatagcctccgcgattgtcctcgagttcttcatgatggtcttactaataccagaacccgagaagcaaaggaccccacaagacaaccagctcgcatacgtggtaataggcatcttaacgttagcagctataattgccgcgaacgaaatgggtttactagagaccacgaaacgcgaccttggtatgagtaaggaacccggcgtagtaagtcctacgtcgtacctagacgtagacctacatcctgctagtgcctggacactgtatgcagttgcgacgacggtgatcaccccgatgctacgccacaccatagaaaactctaccgcaaacgttagccttgccgcaatagcaaatcaggcggtcgtactcatgggactagacaaaggctggccaatcagtaaaatggatcttggcgtcccgttactcgctctaggctgctacagccaagtgaaccccctcactttgacggcagccgtgctactactcataacccactacgccataataggacctggtctacaggcgaaagcaacacgggaagcccaaaagcggaccgctgccggcatcatgaagaatcctacagttgacggtatcatgacgatcgacctagacccggtaatctacgacagtaagtttgaaaagcaactaggacaggtaatgttattggtcttatgcgccgtacaactcctactcatgcgaaccagctgggcgctgtgcgaagcgcttacattagcgactggtccaataaccactttatgggaaggcagcccaggaaagttctggaacacgacgatcgcagtctcaatggccaacatattccgcgggagctatctagccggagccggcctggccttttcaattatgaaatcagtagggaccgggaaaagagggactgggtcgcaaggggagactctgggagagaaatggaagaagaaattaaaccaattgtcgagaaaagagtttgacctatacaagaaaagcggcataacagaagtcgaccgcaccgaggccaaagaaggcttgaaacgtggcgaaatcacccatcacgcggttagccgtggcagtgcaaaactccaatggttcgtagagaggaacatggtcatccctgaagggcgagtaatcgacctcgggtgcggacggggtgggtggagctattactgcgcaggcctaaagaaagtcacggaagtaagggggtatacaaaaggcgggcccggacacgaagaaccagtacctatgtcaacctacggctggaatatcgtcaaactaatgtccggcaaagacgtgttctatctgcctcccgagaagtgcgatacgctgctctgtgacataggcgaatcctcgccgtcgcccacggtcgaagagtcccgaacgattagagtcctgaagatggttgaaccctggctgaaaaacaaccaattttgtataaaggtactcaacccatatatgcctaccgtcatagaacacctggagaggctccaacgcaaacacggtggcatgctcgtacgtaacccgttaagcagaaactccacccacgaaatgtattggatctctaacggaacaggaaatatagttgcgagcgtgaatatggtctcgaggttacttctgaataggtttactatgacgcaccgccgcccaaccatcgaaaaggatgtggacctcggagcgggtacacgccacgttaacgccgagccagaaacaccaaatatggacgtgataggggagagaattaaaagaataaaagaagaacacaattcaacttggcattatgacgatgaaaacccctataaaacctgggcctaccatggttcgtatgaagtaaaggccaccggcagcgcctcgtccatgatcaacggagtggtcaagttgcttaccaaaccatgggatgtggtaccgatggtaacccagatggcaatgacagataccacaccgtttggtcagcaacgcgtcttcaaagaaaaggtagacacccgaaccccgagatcgatgccaggcacccgacgagttatgggaatcacggcggaatggttatggcgcacgctgggccgcaacaagaaaccgcgactctgtacacgtgaagagttcaccaaaaaggtccgaaccaacgccgcgatgggagcggtatttaccgaggagaaccaatgggactccgcaaaggcagccgtcgaagacgaagacttctggaagctcgtcgaccgcgaaagagagctgcacaaactcggaaagtgcggctcttgcgtttacaacatgatgggcaaaagggagaagaaactaggcgagttcggaaaagcgaaaggaagcagagccatatggtacatgtggctaggcgcgaggtacctcgagttcgaagcactaggattcctgaacgaggaccattggtttagcagggagaacagctatagcggtgtagaaggagaaggcctacataaacttggctacatactacgagacatcagcaagatacccgggggagccatgtacgcagacgacaccgctggatgggacaccaggatcacagaagacgatctgcacaacgaagagaaaataactcaccagatggatccggaacacaggcaattggcaaacgccatctttaaactaacatatcagaacaaggtagtaaaggtacaacggcccacgccaacaggcacggtgatggacatcatctccagaaaggatcagcgcgggtcaggccaagtaggcacctatggactgaatacgtttaccaacatggaggcacagctcatccgccaaatggagggtgaaggtgtactatcgaaagctgacctcgaaaatccccacctatcggagaaaaagatcacacagtggctcgaaacgaaaggggtcgaaagattgaaaagaatggccatcagcggtgacgactgcgtggtaaagccaatagacgacaggtttgcgaatgcgttactggccctcaacgatatgggaaaagtacgaaaggacataccacaatggcaaccatcgaagggatggcacgactggcaacaggtaccattttgtagtcaccacttccacgaactgataatgaaggacggccggaagctagtagtaccgtgcagaccccaggatgaattaataggccgagcgcgaataagtcagggagcgggttggtcactacgagaaaccgcgtgcctcggcaaagcatatgcgcaaatgtggagcctgatgtacttccacaggagagacttgcgtctagcaagcaacgcaatatgttcagccgtgccagtacattgggtccccacgagccgaacgacctggtctatacacgcacatcatcaatggatgaccactgaagacatgctaacagtgtggaaccgcgtatggatcgaggacaacccctggatggaagataagacccccgtgacgacctgggaaaatgtcccatacttgggcaaacgtgaggaccaatggtgcgggagtttgatcgggctaacatcccgcgcaacgtgggcacagaacatccctacagctatccagcaagtacgcagccttatcggaaatgaagagttcctagactacatgcccagcatgaagcggttccgaaaggaggaggagtcggaaggggcaatatggtaa

SEQ ID NO: 25977 - RNA, 9873 nt, synthetic construct
  misc_feature 1..9873: note = derived and/or modified CDS sequence (opt11) from DENV-3__FJ182038__SS-prME
  source 1..9873: mol_type = other RNA
acgagcttgtgcctcatgatgatcctacccgcagctctggctttccacctcaccagccgggatggcgaaccccggatgatcgtgggcaagaacgaaagaggcaagtcgctgctgttcaagaccgcgtccgggatcaacatgtgcaccttaatcgccatggacctgggagagatgtgcgacgacaccgtaacctacaagtgtccccacatcactgaggtggagcccgaggacattgactgctggtgcaacctgacgagcacctgggtcacctacgggacatgtaaccaggcaggcgagcacaggcgcgacaagcggtctgtcgccctcgcaccccacgtaggcatggggctggatacccgcacacagacctggatgagcgccgagggcgcctggcgccaggtggagaaggtagagacgtgggccctgcgccacccgggattcacaattctcgccctgttcctggcacactacatcggcacctccctcacccagaaggtcgtgatcttcatcctgctgatgctggtcacgcccagcatgaccatgagatgcgtgggggtgggcaatcgcgactttgtggagggcctttcgggcgcgacgtgggttgacgtcgtcctggaacacggcgggtgcgtcactacgatggccaagaacaagcccacgctagacatagagctccagaaaacggaggcaacccagctggcaacgctccggaagctgtgcattgagggcaagataactaacatcaccacggatagcaggtgccccacacaaggagaggccgttctaccggaggaacaggaccaaaactacgtctgcaaacacacctacgtcgaccggggttggggcaacgggtgcggcctcttcgggaaaggctccctagtgacctgcgccaagttccagtgcctggaacccatagagggtaaagtagtccagtacgagaacctcaaatacaccgtgatcatcacggttcatacgggggaccagcaccaagtcggtaacgagacccaaggtgtaactgcagagatcacgccgcaagctagcaccactgaggctattctgcccgagtacggcaccttggggctcgaatgcagccccaggacgggactggacttcaacgaaatgatcctgctcacgatgaagaacaaagcgtggatggtgcaccggcagtggttcttcgacttaccactgccctggacctcgggcgccacgaccgaaacgcccacctggaaccgcaaggagctcctcgtgacctttaagaacgcccacgccaagaagcaggaagtcgtggtgttagggtcgcaagaaggtgcgatgcacaccgccctcacgggcgccaccgaaatccagaactctggcggcacctccatcttcgccggccatttaaagtgccgcctgaaaatggacaaactcgagttgaaaggcatgtcttatgccatgtgcaccaacactttcgtcttgaagaaggaggtgtccgagacccaacacgggacaatcctcatcaaggtggagtataagggagaggacgccccctgcaagattcccttcagcaccgaggacgggcagggtaaggctcacaacggccgcctgatcacagccaaccccgtggtgaccaagaaggaagaacccgtcaatatcgaggccgaaccgcccttcggcgagagcaacattgtcatcggcataggggacaacgctctcaagattaactggtacaagaagggctccagcatcggtaaaatgttcgaggctaccgcccgcggcgcccgccggatggccatcctgggcgacacggcgtgggacttcggcagtgtgggtggtgtgctcaattcccttgggaagatggttcaccaaatattcgggtccgcctacacgactctattcagtggagtgtcctgggtgatgaagatcggcataggcgtcctacttacctggatcggacttaattctaagaacacttccatgtcattctcctgtattgccataggagtcatcacgctctacctaggagcggtggtccaggccgacatggggtgcgtaatcaactggaaaggcaaggagttaaaatgcggaagcgggatcttcgtgaccaatgaggtccatacctggactgaacagtataaattccaggcggacagtcccaagcgcctcgccacggccatcgcgggtgcctgggagaacggggtgtgtgggatccggagcaccacccgaatggagaaccttctgtggaagcagatcgccaacgagctcaactacatcctatgggagaacaacatcaaactgactgtggtggtaggagacatcattggagtcctcgagcagggcaagcgcacgcttacgccccagcctatggagctgaagtactcctggaagacctggggcaaggccaagatagtgactgccgagacgcagaactctagtttcatcatcgacggcccaaatacccccgagtgcccgagcgcctcacgggcgtggaatgtgtgggaggtggaggactacggctttggggtcttcaccaccaacatttggctcaagctgcgcgaggtgtacacccagctgtgcgaccaccggctcatgtcggccgccgtgaaagacgagcgcgccgtccatgccgacatgggctactggatcgagagccagaaaaacgggtcctggaagctggagaaggcgagcttgatcgaagtgaagacctgcacctggcccaagtcccacaccttgtggtctaacggggtgctggagtcggatatgatcattccaaagagccttgctgggcccatctcccagcacaactaccggccgggttaccacacgcaaacggccgggccttggcacctcggcaagttggaactggattttaattactgcgaaggcaccaccgtagtgataaccgagaactgcggaacgcgcggaccaagcctccggaccaccaccgtgtccgggaagctgatccacgagtggtgctgccgcagctgcacgctgccccctctccggtacatgggcgaggacgggtgctggtacgggatggagattcgccccataagtgagaaagaggagaatatggttaagagtctggtttccgcaggcagcggcaaggtggacaacttcacaatgggcgtcctgtgcctcgccatcctgttcgaggaggtaatgcggggtaagttcgggaagaagcatatgatcgcgggggtgttcttcactttcgtcctactcctgagtggtcagataacctggcgggacatggcgcacacgctgatcatgatcggctccaacgcatccgacaagatggggatgggcgtgacctacttagcactgatcgcaaccttcaagatccagccgttcctggcgctcgggtttttcctgcggaaacttaccagccgcgagaacctcctgctgggcgttggcctcgcaatggccacaacccttcagctgccggaggacatagagcagatggccaacgggatcgcgctcggcctgatggccctgaagctcatcactcagttcgagacgtaccagctgtggacggccctgatcagcttgacctgttctaacaccatgttcaccctgacggtcgcctggagaaccgccacccttatcctcgccggggtgagcctgctgccggtctgccagtcaagcagcatgcgcaagaccgactggctccctatggccgtggcagccatgggcgttccgccgctccctctgttcatctttagcctcaaggacacgctgaagcggcgttcctggccgctgaacgaaggggttatggccgtgggtctcgtgtccatcctggcgtcctcgctgctcagaaatgacgtccccatggccggacctctggtggctggtggccttctcatagcctgttacgtaatcaccgggacctctgctgacctcactgttgaaaaggcggccgacattacgtgggaggaggaggccgagcaaaccggagtgagccacaatctgatgatcaccgtggacgatgacgggactatgcggattaaggatgacgagacggagaatatacttacagtactgttgaagaccgcactcctaatcgtatcaggagttttcccgtacagtataccggcgacactgctcgtctggcacacctggcagaagcagactcaacgctccggcgtactgtgggacgtgcccagcccgcccgagacgcagaaagctgagctggaggagggggtctaccgtatcaagcagcagggcatcttcgggaagacccaagtaggcgtcggggttcagaaggaaggcgtctttcacacaatgtggcacgtgacgcgcggcgccgtcctaacctacaacgggaaaaggcttgagccaaactgggccagtgtcaagaaggacctgatcagctatggcgggggctggcgcctctcagctcaatggcagaagggggaagaggtgcaggtcatcgccgtagagcccgggaaaaatccgaagaacttccagacgatgccaggcaccttccaaacgaccacgggtgaaatcggcgccatcgccctggacttcaaacccggtacgagcggcagccccatcatcaaccgggaaggcaaggtggtcgggctatacggaaacggtgttgttactaagaacggaggatacgtctctggcatcgcacaaacgaacgccgagcctgacgggcccaccccggagttagaggaggagatgttcaaaaagcgcaaccttacgatcatggacctgcaccccgggagcggcaagacgagaaagtacctaccggctatcgttcgcgaagccatcaaacggaggctccggactctgatactggccccaacccgcgtggtggccgcagaaatggaagaagcgctcaagggcttacccatcagatatcagacaacggccaccaaatcggagcataccggacgcgagatcgtggatctcatgtgccatgccaccttcaccatgcggctcctgagccccgtacgggtcccgaactacaacctgatcataatggacgaagcccatttcaccgacccggcctccatagctgcccgtgggtacatcagcacgagagtggggatgggcgaagccgccgcgatctttatgaccgctacgccgcccgggaccgccgatgcctttccgcagagtaatgcccccatccaagacgaggagcgggacatccccgaacgctcatggaactccggcaatgaatggatcaccgattttgcggggaagacggtgtggttcgtcccctctatcaaggccggcaacgatatcgccaattgcctacgcaagaacgggaagaaggtgattcagttatcccggaagacgttcgacacagagtaccagaaaacgaagttaaacgactgggactttgtggtcaccactgacatctcggagatgggcgccaacttcaaggccgacagagtgatcgaccctcggaggtgcctcaagcccgtgatcctgaccgacggccccgagcgagtcatactggcggggcctatgccggttaccgccgcctccgccgcccaacgcagaggccgggtgggtcggaacccccagaaggagaacgaccagtacatattcatgggccagcctctcaataacgacgaggaccacgcgcactggactgaggcaaaaatgctgctggacaacatcaacacccctgaaggcattattccagccctcttcgagcccgagcgcgagaagtccgccgcaatcgacggcgagtaccggttaaagggcgagagccgcaagacgttcgtcgagctcatgagaaggggggacctgcccgtgtggctggcccacaaagtagcctcggagggcataaagtacaccgaccgaaaatggtgcttcgacgggcaaaggaataaccagatcctggaggagaacatggacgtggagatttggaccaaggagggcgagaagaaaaagctccggccccgctggctagacgcccgaacgtacagtgatccgttagccctcaaggagttcaaggatttcgccgccggccgcaagagcatcgccttggacctggtgacggagatcgggcgcgtcccctcgcacctcgctcacagaacaagaaatgcactggataacctagtaatgctccatacctcagaacacgggggccgggcttaccgccacgcagtcgaagaactgcccgagaccatggagacgctgctactgctgggtctcatgatcttacttaccgggggcgctatgctgttcctgatcagtggcaaggggatcggaaaaacaagcatcgggctgatctgcgtgatcgctagctccggcatgttatggatggccgagatcccgctgcagtggatcgcgagcgccatcgtgctcgagttcttcatgatggtgcttctgatccccgaacccgagaagcagcggaccccacaggacaatcagcttgcttacgtggtaatcgggatcctcactctggccgctaccatcgccgccaacgaaatgggactgctcgagaccaccaaacgcgacctgggcatgtcgaaagagccgggtgtagtctctcccacgtcatacttagacgttgacttacaccccgccagcgcatggaccctgtacgcggtggctaccaccgtcataacgcccatgctgcggcataccatcgagaatagtaccgcaaacgtgagcctcgccgccattgccaaccaggcagtggtcttgatgggcctggacaaagggtggcctatatccaagatggacttgggggtgcccctgcttgcgctcggatgctacagccaagtgaatcccttgacgttgaccgccgccgtccttttactgattacccattatgctattatcggcccgggcttacaggccaaggcaaccagagaggcgcagaagcgcacagcagcgggaatcatgaagaatcccacggtagacggcatcatgaccatcgatctggaccctgtgatctacgactccaaattcgagaagcagctgggacaggtcatgcttctggtgttatgcgccgtccagctcctactcatgcgcacctcgtgggcactctgtgaggcgctaacccttgcgacgggcccgatcaccacgctttgggagggcagtcccgggaagttctggaacaccacgatcgctgtcagtatggccaatattttccggggctcctatctagccggtgccggcctggcgttcagcataatgaagagcgtggggaccggcaaacgcgggactggcagccaaggtgagaccctcggggagaagtggaagaagaagctgaatcagctgtctagaaaggagtttgacctctacaaaaaatccggcatcaccgaggtcgaccgcacggaggccaaggaagggctgaagcggggcgaaacgacccaccacgccgttagccgcggcacagcgaagctgcaatggttcgtagagcggaacatggttatccccgaggggcgcgtcatcgacctcggctgcgggcgggggggctggtcctactactgtgccggcctgaaaaaagtgacggaggtacgcggctacactaagggcggacctgggcacgaagagcccgtccccatgagcacctacggctggaatatcgtgaagcttatgtcagggaaggacgtcttctacctccctccggagaagtgcgacaccctgctgtgcgacattggcgaatcctccccaagccccacagtcgaagaatccagaaccatccgcgtcctgaagatggtcgaaccgtggctcaagaataaccaattttgtataaaggtccttaacccctacatgcccaccgtgatagagcacctggagcgcctccagcggaagcacggtggcatgctggtgcgcaacccgctgagccgaaactccacccatgaaatgtactggataagcaatggtacgggcaacatcgtcgccagcgtgaacatggtgagtcggctcctgcttaacaggttcaccatgacccaccgccggccgaccatagagaaggacgttgatctcggcgccggcactcgccatgtgaacgccgaacccgaaacccccaacatggacgtgattggagagagaatcaagcgcatcaaggaggagcataactccacgtggcattacgacgatgagaacccatacaagacatgggcgtaccacggcagctacgaggtaaaggccaccgggtccgcatcctccatgattaacggcgtagtcaaattactcactaagccctgggacgtggtgccaatggttacacagatggccatgaccgacacgaccccctttgggcaacagcgggtgttcaaggagaaggtggacacccgcaccccgcggagcatgcccggaacgcgccgggtcatgggcatcacagcagaatggctctggcgcaccctggggcggaacaagaaaccccgcctgtgcacccgggaggagttcacaaagaaagtgcgcaccaacgccgcgatgggcgccgtgttcacggaggaaaaccagtgggacagcgccaaggctgccgtagaagacgaggacttttggaagctcgttgacagggagcgcgagttgcacaaactggggaagtgcggctcctgcgtgtacaacatgatgggtaaacgcgaaaaaaagttgggtgaattcggcaaggcgaaggggagccgagctatctggtacatgtggttaggcgctcgctacttggagttcgaagcgctcgggttcctaaacgaagaccactggttctcccgggagaatagctattcaggcgtagagggggaaggcctacacaaactcggctacatcctccgcgacataagcaaaatacccgggggtgccatgtacgcggacgacaccgccgggtgggatacgcggataacagaggacgacctgcacaacgaggagaagattactcaacagatggatccggaacatcggcagctcgcgaacgctatattcaagctgacgtaccaaaacaaagtggtgaaggtccagcggccgaccccgaccggaaccgttatggacataatttcccgcaaggaccagaggggctcgggccaggtcggcacttacggcttgaatactttcacgaatatggaggcccagcttatccgccagatggagggcgaaggggtcttatccaaggcggatcttgagaacccccatctcccggaaaagaagatcacccagtggctggagaccaagggcgtggagcggctacgccggatggcaatctcgggagacgactgtgtggtgaagcccatagatgaccgcttcgctaatgccctcctggccctgaacgacatggggaaggtgcggaaggatatcccccagtggcagcccagtaagggctggcatgactggcagcaggtcccgttctgcagccaccacttccacgagttaatcatgaaggatgggcggaagctcgtcgtgccctgtcggccccaggacgagctgatcggcagggcgcggatctcccagggggcaggatggagccttcgagagaccgcctgtctgggaaaggcctacgcgcagatgtggtccctgatgtactttcaccgtagggatctccgcctcgcgagcaacgccatctgctccgccgtccctgtccactgggtgccgacgtcccgaacgacctggtccatccacgcacaccaccagtggatgacgactgaggacatgctaaccgtttggaaccgcgtctggatcgaggacaatccctggatggaggataagacgccagttacgacctgggagaacgtgccctacctcgggaagagggaggaccagtggtgcggcagcctgatcggactgacttcacgcgcgacctgggcgcaaaatataccaacagccattcagcaggtccggtcgctaattggaaacgaggagttccttgactacatgcccagcatgaagcgatttcggaaggaggaagaatctgaaggagcaatctggtga

SEQ ID NO: 25978 - RNA, 9873 nt, synthetic construct
  misc_feature 1..9873: note = derived and/or modified CDS sequence (opt11) from DENV-3__FJ182041__SS-prME
  source 1..9873: mol_type = other RNA
accagcctgtgcctcatgatgattctgccagcggctctagcgtttcacctcacgagccgtgacggggagccccgtatgattgtggggaaaaatgagaggggtaagagcctgctgttcaaaactgcttccgggataaatatgtgcaccctcatcgccatggacctgggcgagatgtgcgacgacaccgtgacctataagtgcccccatattgctgaagttgagcccgaggacatcgactgctggtgtaacctaacaagcacatgggtgacctatggtacctgcaaccaagcaggcgagcacaggagggacaagcggagcgtcgcactagcaccccatgtcggcatggggctggacacgcgtacccaaacgtggatgagcgcggagggcgcctggcgccaggttgagaaggttgagacttgggccttgcggcacccgggtttcacgatcctagcccttttcctcgcgcactacattgggacctcccttacccaaaaggtggtaatctttatcctgctgatgcttgtcacgccgagcatgacgatgcggtgcgtcggcgtaggcaaccgagactttgtcgaaggcctgtcaggggccacctgggtggacgtggtgctggaacacggagggtgtgtgaccaccatggccaaaaacaagcccacgctcgacatcgaattgcagaaaaccgaggccactcagctggcaacactccggaagctgtgcatcgagggaaagatcacaaacataacaacagacagtcggtgccccacacaaggggaggctgtactgccagaggagcaagaccagaattatgtgtgcaagcatacgtacgtggacagggggtgggggaatggctgcggactgttcggtaagggaagcctggtaacatgtgcaaaattccaatgcctggagcctattgaagggaaggtagtacagtatgagaatctcaaatacacggtgataatcaccgtccacactggagatcagcaccaagtaggcaatgagactcaaggggtgacggcagagataacaccccaggcgtcgacgacagaggccatcctgcccgagtacgggacgctggggcttgagtgtagtccccgaaccggccttgacttcaatgagatgattctgcttaccatgaaaaacaaggcttggatggtgcacagacagtggttcttcgatctgcccctgccctggacctcaggcgcaaccaccgaaacacccacatggaaccgcaaagagctcttagttaccttcaaaaacgcacacgccaagaaacaggaagttgtggtgcttgggtcccaggaaggtgccatgcataccgctctcaccggcgccacggaaattcaaaactcaggagggacgtccatcttcgccggccacctgaaatgccggctcaaaatggacaaacttgaacttaagggcatgtcatacgcgatgtgcaccaacacgttcgtcctgaagaaggaagtgtccgagacgcagcatgggaccatcctcataaaggtagaatacaagggggaagacgttccgtgtaaaattcccttcagcacggaggatgggcagggcaaggcccacaatggtcggttgatcaccgccaatcccgtggtcacgaagaaggaagaacccgtcaacatcgaggcagagccacccttcggggagagcaatatcgtgatcggtatcggggacaatgcgcttaagattaactggtacaagaagggcagttcaatcggtaagatgtttgaggccaccgccagaggcgcaagacggatggccatcttaggggacaccgcgtgggacttcggcagcgtaggcggggtcctcaacagcctggggaagatggtccaccaaattttcgggtccgcatacaccgccctattcagtggagtgagctgggtcatgaaaattggaataggggtgttactgacgtggatcggcctgaatagcaagaacacctctatgtcgttttcttgcatagctataggaataattacgctctacttgggagccgtcgtacaagctgacacagggtgcgtcattaactggaagggtaaggaactgaaatgcggctcggggatcttcgtgacgaatgaagttcacacgtggactgaacaatacaagtttcaggcagattcccccaaacgattggcgactgccatcgccggcgcgtgggagaatggtgtatgcggcatacgttcaacgacccggatggagaacctgctctggaaacagatcgccaatgagctcaactacattctctgggagaacaacattaagctaacagtggtcgtcggggatatcatcggtgtactcgagcagggcaagcggactctgaccccgcagcctatggagctgaaatacagctggaagacatgggggaaggcgaagatagtaaccgccgagacccagaactcgtcttttatcatcgacgggcccaacactcctgagtgccccagcgcgtcccgtgcgtggaatgtctgggaagtggaggactatgggtttggcgtcttcactaccaatatctggctcaaactgcgggaggtgtacacacagctgtgcgaccatcgtctcatgagtgccgcggtgaaggacgagcgcgccgtccacgcggacatgggctactggatcgaaagccagaaaaatggaagttggaaactggagaaggcctccctaatcgaagtgaagacctgcacttggccaaaatcgcataccctttggtcgaatggggtgctcgaaagcgatatgatcattcccaagagcttggccgggcccatctcgcagcacaactaccgcccgggctaccacacacaaactgccgggccgtggcatctcggaaagctggaattggactttaactattgcgagggcaccaccgtcgtgataaccgagaactgtgggacccgcgggccaagcctgcggacaaccaccgtgtcgggaaagctgatccacgagtggtgctgtcgctcgtgcaccttaccgccgcttcggtacatgggcgaagacgggtgctggtatggtatggagattcgccctatctctgagaaggaggagaacatggtcaagagcctcgtttccgccggtagcgggaaggtggacaacttcaccatgggcgtgctatgtctcgctatcctgttcgaagaggtgatgcgggggaagttcggtaagaaacacatgatcgccggggtgttcttcaccttcgtcctgctcttatccggccagatcacgtggcgcgacatggcgcacaccctgatcatgattggcagtaatgcatccgaccggatggggatgggcgtcacgtacctcgccctgatcgccacgtttaaaattcagcccttcctggccctcggattctttttacggaaactgacatctcgcgaaaaccttctgcttggagtgggattggccatggcaacaacgctacaactgccagaggacattgagcaaatggctaacggcatcgccctcggcctaatggcactgaaacttataacgcagttcgagacctaccagttatggaccgcactcataagcctcacctgttcaaatactatcttcaccctgaccgtcgcctggcgcacggcgactttgatccttgccggggttagcctgttgcccgtctgccagtccagttccatgagaaagtccgattggctacccatgacggtggccgcaatgggagtgccgcctctccctctgttcatcttcagcctcaaagacaccctaaagcgccgctcttggcccctgaatgagggcgttatggcagtaggcctcgtatctatcctggcgagttccctcctacgcaacgacgtccctatggctggccccctggtggccggcggactactcatagcctgctacgtaataaccgggaccagtgcggacttaactgtcgagaaagcggcagacgtgacctgggaggaagaggccgaacagacgggagtgtcccacaacttaatgatcaccgtcgatgacgacggtaccatgcgaatcaaggacgacgagactgaaaacatcctaaccgtccttctaaagactgcgctgttaattgttagcggaatattcccgtactccataccggcgacccttctcgtatggcatacctggcagaagcagactcagcggtcgggtgtgctgtgggacgtgcctagtccgcctgagactcagaaagcggagctggaagagggggtatatcgtatcaaacagcaaggtatattcgggaaaacccaagtgggcgtaggcgtacaaaaagagggcgtgttccatacgatgtggcacgtgacgcggggcgccgtcctcacgtacaatgggaagcgtctggagcctaactgggcttctgttaagaaggacctaatatcgtacggcggaggatggcgactctcggcacagtggcagaagggggaagaagtccaggtcattgctgtggaacccggtaagaatcccaagaattttcaaacgatgcccggcacattccagaccaccacgggggagataggggcgattgccctcgactttaaacccggtaccagcgggtcgccaataatcaatcgagaaggcaaagtagttgggctgtacgggaacggggtggtgacgaaaaacggcggatacgtatccgggatcgcccagacaaatgccgagccggatgggcccaccccagaactagaggaagagatgttcaagaagcggaacctcacgatcatggacctacaccccgggagtggtaagacacgtaaatacctgcctgcgatcgtgcgggaggccatcaaacgaagactcaggactctgatcctcgcaccaacgcgggtggtcgccgccgagatggaggaggcgctgaaggggctgcctattcgctatcagactactgctacgaaaagcgagcacacgggacgggaaatcgttgatcttatgtgccacgcgaccttcaccatgcgtctcttatcgcccgtacgggtcccgaattacaatctgataatcatggatgaagcccactttacggacccagcttccatcgcggcgcgcgggtacatctccacccgggttggcatgggggaggccgccgcgatcttcatgactgctacgccgcccggaaccgcagatgccttcccgcagtcgaacgcccccatccaggatgaggaacgcgatatacccgaaagaagttggaatagcggcaacgaatggatcacagatttcgcaggcaaaacggtgtggtttgtcccctcaattaaagctggcaatgacatcgctaactgtctgcgcaaaaacgggaagaaggtaatacagttatcaagaaagacattcgacacggagtaccagaaaacgaaactcaacgactgggacttcgtggtcaccaccgacatctccgaaatgggcgccaacttcaaggctgaccgggtgatcgatccaagacggtgcctcaagcctgtcatcctgaccgacggtccggagcgcgttatcttagcggggccaatgccggtaacggcggcaagcgcagcccaacgcagaggccgggtgggccgcaatccccaaaaagagaacgaccagtacatcttcaccggccagccactcaacaacgatgaggatcacgcgcattggacggaggccaaaatgctgcttgacaatatcaacacgcccgagggaattatccctgccctcttcgagcctgagcgggagaaatctgccgctatagatggagagtaccgcctgaagggagaaagccgtaagacatttgtcgaacttatgcggcgcggcgatttgcccgtgtggctggcccacaaggtcgcatccgaggggatcaagtacactgatagaaaatggtgtttcgacgggcagagaaataatcagatactcgaagagaacatggatgtcgagatatggactaaggaaggcgagaagaagaagctcaggccccggtggcttgatgcacgcacatactctgacccgttggccttaaaggaatttaaggacttcgcagcaggcaggaagtccatcgcccttgatctggtgacagaaatcggtcgggttccctcacacctcgcccacaggactcggaacgcgctggacaacctcgtgatgcttcacaccagcgaacacggcgggaaagcctatcgccacgccgtggaggaactgcctgagaccatggagacgctgctacttctgggcttaatgatcctgttgaccggtggagccatgctgttcctaatctctggcaaggggatcgggaagaccagcatcgggctgatctgtgtcatagcgtccagcggcatgctctggatggccgagataccgctacagtggatagcctcagcaatcgtactggagttctttatgatggtcttactgattcctgaacccgagaaacagcgcacgccccaggacaaccaattagcctatgtcgttataggaatcctgacgttggccgcgatcattgccgcaaacgagatgggtcttctcgaaacgaccaagagagacctgggcatgagcaaggaaccaggcgtggtatcccccacctcttacctggacgtggacctccaccccgcctccgcctggaccctctacgcggtcgccacgaccgttataaccccgatgctgagacataccatcgagaactcaacagctaatgtgagtctcgccgccatcgcaaatcaggccgtcgttctgatgggccttgataagggctggcctatctcgaagatggacttgggagttcccctactggccctcgggtgctacagtcaagtaaatccgctcaccctgactgcagcggtgctcttgctgattacacactatgccatcatcggccccggcctgcaggccaaggccacccgggaggctcagaagcgtactgcagcaggtatcatgaaaaacccgaccgtcgacggcataatgacaattgacctggaccccgtgatctatgacagcaagttcgaaaagcaactggggcaagtcatgctactggttttatgcgccgtccagctcctcctaatgcgaacctcctgggctttatgcgaggccctcactctggccactggtcccatcactaccctttgggaaggcagtccagggaagttttggaacaccactatcgctgtctcaatggctaacatcttccggggcagctatctggccggggcgggcctcgctttctctatcatgaagtccgtgggaaccggcaaacgtggtaccggtacccagggcgagaccctcggcgagaagtggaaaaagaagctcaaccagcttagccggaaagagttcgatctgtacaagaagtccggaataacagaagtcgaccgaacggaggccaaggagggcctgaagcgcggagaaataacccatcatgcagtatctcgcggctctgccaagttacaatggtttgtggagcgaaacatggtcatccctgaaggccgcgtgatcgacctcggttgcgggagaggagggtggtcttactactgtgccggccttaagaaggtcacagaggttcgcggctacaccaaaggagggccagggcacgaggagcctgtgcccatgagcacatatggctggaatatcgttaaacttatgagcgggaaagacgtattctatttaccacccgaaaagtgcgacaccctactatgcgacattggggagtcctcgccgtcccctacggtagaggaaagcagaactatccgtgtgctgaaaatggttgaaccctggctcaaaaacaaccaattctgcattaaggtcctaaacccatacatgccaacagtgatcgagcacctcgagcgtttacagcggaaacacggcgggatgctggtacgcaaccccctgtcacgcaatagtacccacgaaatgtattggatctccaatggcaccggtaatattgtcgcttcggtgaacatggtgtcaaggctgctgctgaacaggttcactatgacgcaccgccgtccaacaattgaaaaggacgtcgacctgggagctggaaccaggcatgtaaatgccgaacccgagacccccaacatggacgttatcggcgagcggatcaaacgcataaaggaggaacacaactctacttggcactatgacgacgagaacccgtacaaaacgtgggcgtatcatggctcctacgaggtcaaggccaccgggagcgcttcgagcatgatcaatggcgtggtgaaattactgaccaaaccctgggatgtcgtccccatggtcacgcaaatggcgatgacagacaccacacctttcggccaacaacgcgtgttcaaggaaaaggttgacactaggaccccgcggagcatgcctggcacccgccgggtcatgggaatcactgccgaatggctttggaggacactggggcggaacaaaaagccacgcctatgcacccgggaggagttcacgaagaaggtgcgtactaacgcagccatgggcgcggtatttacagaagagaaccagtgggactcggcaaaggcggccgtagaggacgaggacttctggaagttagtagaccgcgaacgagagctgcataagttagggaagtgcggcagttgtgtgtataacatgatggggaagcgcgagaagaaactcggcgagttcgggaaggctaaggggtcccgggcaatctggtacatgtggttgggtgcacgctacctggaatttgaggccctcggtttcctcaacgaggaccattggttcagccgggagaactcgtacagtggagtggagggggagggcctgcataaattgggttatatccttcgcgacatctcaaaaatccccggcggcgccatgtatgcggacgacacggccggctgggatacccggatcaccgaggatgacctccataacgaggagaaaattacgcagcagatggacccggagcacagacagttagctaatgcaatcttcaaactaacgtaccaaaacaaggtggtcaaggtccagaggcccactcccactggcacggtgatggacatcatttcgagaaaggaccaacgggggtccggccaggtcgggacgtatgggttgaacacgttcaccaacatggaggcccaattaatcagacagatggagggagagggtgtcttgagcaaggcggacctagagaatccccaccttagcgagaagaaaatcacacagtggttggagacgaaaggcgtggaaaggttaaagcgcatggccatcagcggtgacgattgcgtggtcaaacctatagacgaccgattcgccaacgccctcctggcattgaacgacatggggaaggtgcggaaggatatcccccagtggcagccttccaagggctggcacgactggcaacaggtccccttctgcagtcaccatttccacgaattaattatgaaggacgggcggaaactcgttgtgccttgcaggccccaagatgaattaatcggccgggcccgcatcagccagggggctgggtggagcctccgtgagacagcctgcttaggcaaagcctacgcgcagatgtggtccctgatgtactttcaccgcagggacctgcggttagcctcgaacgccatctgctccgccgtgcccgttcactgggtgcctaccagccggaccacgtggtctatccatgcgcatcaccagtggatgacgacagaggatatgctgacggtgtggaacagagtctggattgaggataatccatggatggaggacaaaaccccagtcactacttgggagaacgttccctacctcgggaagcgcgaggaccaatggtgcggttctctaatcggactcactagccgtgcgacgtgggcgcaaaatatcccaaccgccatacaacaggtccggtctctcatcggtaacgaggaatttctggactatatgccatccatgaagcggtttcgcaaggaggaagagtccgaaggggcgatctggtga

SEQ ID NO: 25979 - RNA, 9873 nt, synthetic construct
  misc_feature 1..9873: note = derived and/or modified CDS sequence (opt11) from DENV-3__FJ390371__SS-prME
  source 1..9873: mol_type = other RNA
acgtctctgtgcctgatgatgatcttgcccgccgccttagcttttcatctcaccagccgggacggcgagccccggatgatagttggtaagaacgagaggggcaaatccctgcttttcaagactgcttcggggataaacatgtgcactctcatcgccatggacctgggggagatgtgcgacgacacggtgacctacaagtgcccgcacatagccgaggttgaacctgaggacatagactgctggtgcaatctgacctccacgtgggtgacctacgggacctgtaaccaggccggcgagcaccggcgggataagcggtccgtggcgctcgcgccacatgtgggaatggggcttgatacgcggactcaaacatggatgagcgccgagggcgcctggcgacaggtcgagaaggtggagacatgggcgctgcgccatcctgggttcacaatcctcgccctgttcctggcccactatataggtacctccctaacccaaaaggtcgtcatctttatcctgctgatgctcgttacccccagcatgacgatgcgttgcgtgggggttggcaatcgcgacttcgtcgaggggctgtccggggctacctgggtggacgttgtcctggagcatggtgggtgcgtgacaacaatggccaagaacaagccaacgctcgacatcgagctgcagaagaccgaggcgacccagttggcaacactccggaaattatgcatagagggcaagataaccaacatcactaccgacagccgctgcccgacccagggggaagccgtcttaccggaggagcaggaccagaactacgtctgcaagcacacctacgtggaccgtgggtggggcaacgggtgcggcctctttgggaagggctccctggtaacctgcgccaaattccagtgtctggagcccatcgagggcaaggtcgtccagtatgagaacctcaaatacaccgttatcatcaccgtccacacgggggaccagcatcaggtgggcaacgagacgcagggagtcaccgccgagatcacgccccaggcgtctacgaccgaggccattctgccggaatatggaacacttgggctcgagtgttcgccgcgcaccggcttagacttcaacgagatgattctgctcactatgaagaacaaggcctggatggtacacaggcaatggttcttcgatttgcccctaccctggacgagcggcgccaccaccgaaacccccacttggaatcggaaggaactcctggtgaccttcaagaatgcgcacgctaagaagcaggaggtagtcgtactagggtctcaggagggtgcaatgcataccgctctcaccggggcgacggagatccaaaacagcggagggacctccatatttgccggccacctgaagtgtcggctgaagatggacaagctcgaactgaagggcatgagctatgccatgtgcaccaacacctttgtcctgaagaaggaggtgtccgagacacagcatgggaccatcctcatcaaggtggagtacaagggggaggacgccccgtgcaagatccctttcagcaccgaagacggacagggaaaagcccacaacgggcggctgatcaccgccaaccccgtcgtgacgaagaaggaagaacctgtcaatatcgaggcggagccgcccttcggggagagcaacatcgttataggcatcggggacaacgccttaaagattaattggtacaagaaaggctccagcatcgggaagatgtttgaagccacagccagaggggcgcgcagaatggcgatactgggcgataccgcctgggacttcggatccgttggcggggttctcaattctctgggcaagatggtccaccagatctttgggtccgcgtacaccgccctgttcagtggcgtctcttgggtcatgaaaatcggcataggcgtcctgctcacttggatcggcctgaatagcaagaacaccagcatgtccttctcctgcatcgccatcgggatcatcaccctttacctaggcgcggtggttcaagccgacacggggtgtgtcatcaactggaaggggaaggagctgaagtgcggcagcgggatctttgtgaccaacgaagttcacacttggacggagcagtacaagttccaggccgactcccccaaacgcctcgccacggccatcgctggcgcctgggagaatggagtctgcggtattagatccacgaccaggatggagaaccttctgtggaagcaaatcgccaacgagctgaactacatcctgtgggaaaacaacatcaagctgactgtggtggtgggggacatcataggcgtcctcgagcagggcaagcgcaccttaacgccccagccgatggagctgaagtacagttggaagacgtggggtaaggcaaagatagtgaccgcggagactcagaactcatccttcatcatcgacggacccaacacgcctgagtgccccagcgcatcccgggcctggaacgtctgggaggtagaagactacggatttggcgtgttcaccaccaacatctggctcaagttgcgcgaggtctatacccagctgtgtgaccaccggctcatgtcggccgctgtcaaggacgagcgcgcggtgcacgccgacatgggctactggatcgagagccagaaaaatggttcctggaagctggagaaggccagcttgatcgaggtcaaaacttgtacgtggccgaaatcccacaccctctggagtaacggcgtactagagtccgacatgatcattcccaagtcgctggccggccccatcagtcaacacaactaccggccgggctaccacacccaaaccgcggggccctggcacctgggcaagttagagctggacttcaactactgtgagggcacgactgtagttatcaccgagaattgcgggacccgcggcccaagcctcagaacgacgaccgtgtcagggaagctgatacacgagtggtgctgccgatcctgtaccctgccgccgcttcggtacatgggcgaggacggttgctggtacggtatggagatacgccccatttccgaaaaagaagagaacatggtcaagagcctcgtctccgctggcagcggcaaggtggataactttacgatgggcgttctgtgcctcgcgattcttttcgaggaggtcatgcgcgggaagttcggtaagaagcacatgatcgccggggtattcttcacctttgtgctgctcctgtccgggcaaatcacgtggagggacatggcccacaccttaataatgattggcagcaacgcctccgaccggatggggatgggtgtcacgtacctcgcgctgatcgccaccttcaaaatccagcccttcctggccctcgggttctttctacgcaaacttaccagccgcgagaatctccttctgggtgttggcctcgccatggctactactctgcagttacccgaggatatcgagcagatggccaacgggatagctctcggcctgatggccctgaagctcatcacgcagttcgaaacgtaccagctgtggacggccttgatcagcttgacgtgctccaacacaatcttcacgctaaccgtggcgtggaggacggccacgctgatccttgccggggtcagcctgctgccggtatgccagtccagctccatgcggaagtccgattggctccccatgaccgtagcggccatgggcgttccacctctcccgctgtttatattctccctcaaggacaccctgaagcgccgcagctggcccctaaacgaaggtgtgatggcggttgggcttgtgtccatattagccagctcgctactcagaaacgacgtccccatggccgggcctctggttgccgggggtctgctcatcgcctgctacgtcataacagggaccagcgcggacctgaccgtggagaaggcagctgacgtcacctgggaggaagaggccgaacagactggtgtatcccacaacctgatgatcaccgtggacgacgacgggactatgcgaataaaggacgatgagaccgagaacatcttaactgtactgctgaagactgctctcttaatcgttagcggaatcttcccttactccatcccggcgaccctgctcgtatggcacacctggcagaaacagaccaggcgcagcggcgtcctatgggacgttcccagcccacccgagactcaaaaagccgagttagaggagggtgtctaccggatcaaacaacaaggaatctttgggaaaacacaggttggcgtgggggtgcagaaggagggggtcttccataccatgtggcacgttacccggggcgcagtgttaacttacaacggcaagcggctggaacccaactgggcttccgtaaagaaggacctgatctcctatggcgggggatggcgcctcagcgcgcaatggcagaagggggaggaggtccaggtcatcgccgtcgagccaggaaagaacccaaagaactttcagaccatgcccggcacgttccagacgacgactggggaaattggtgccatcgcacttgactttaagcccgggaccagcggctcccctatcatcaaccgggagggcaaggtcgtgggactgtacggtaacggagtcgttaccaagaatggcggctacgtgagcggcatcgcccagacaaatgccgagccggacggccccacccccgagcttgaggaggagatgttcaagaagcgcaatctcaccatcatggatctgcaccccgggtccggtaagacccgtaagtacctgccggccatcgtccgcgaggcgatcaaacgtaggctccggacgctcatactagcccccacccgcgtggtggctgcggagatggaagaggccctcaaggggttacccatccggtaccagactacagccactaaatcagagcacaccggccgcgagatcgttgacctgatgtgccacgccaccttcacaatgcggctcctgtctcctgtcagagtgccgaactacaatttaatcatcatggacgaagcccacttcacagacccagcgagcatagccgcccggggttacatatccacccgcgtcggtatgggcgaggccgccgccatcttcatgacggcgacgcccccgggcacggcagacgccttcccgcagagtaacgcgcccatccaggatgaagaacgcgacatacctgagcggtcctggaacagtggcaacgaatggatcaccgacttcgctgggaagacagtgtggttcgtgccctccatcaaggccggcaatgatattgcgaactgcctacggaaaaacgggaagaaggtaatccagctgagcagaaagacctttgacacggagtatcagaaaaccaagctgaatgactgggatttcgtagtgaccaccgacatcagcgagatgggcgcgaacttcaaagcggaccgcgtcatcgacccccggcgatgcctcaagcccgtgatcctaacggacggtcccgagagggtgatcctggccggtccaatgccggtcaccgcggccagcgccgcgcagcgccggggccgcgtcgggcgaaacccccagaaggagaacgaccagtacatcttcaccggccaacccctcaacaacgatgaggaccacgcccactggacggaggccaagatgctactggacaacatcaacacaccggagggaattataccggccctattcgaacctgagcgcgagaagtccgcggcgatcgacggcgagtaccggctgaagggagagagcagaaagacgttcgtagaacttatgcggcgtggggatctccccgtctggctcgcacacaaggtcgcctccgagggcatcaagtataccgaccggaaatggtgcttcgacggccagcgcaataaccaaatcttggaggagaatatggacgtcgagatctggaccaaggagggcgagaagaaaaagctgcggcctcgctggctggacgcaagaacctacagcgacccgctggcgctcaaagagttcaaggacttcgccgccggcaggaagagtatagctctggacttggtcactgaaataggacgcgtgcccagtcacctcgcccaccggacccgcaatgcgctggacaatctggtcatgctccataccagcgagcacggcggcaaggcctaccggcacgcagtggaggaactgcccgaaaccatggagacactactcctgctcggcctcatgatacttctgacgggtggtgcgatgctgttcctgatttccggcaaagggatcggcaagaccagcatcgggctgatctgcgtcatcgcatcctccggcatgctatggatggctgagattcctcttcagtggattgcctctgccatcgtactggagttcttcatgatggttctcctgatccctgagccagagaagcaacgcacaccacaagacaaccagctggcctatgtggtcattgggatcctgacgctggccgctatcatcgccgccaacgagatgggcctactcgaaaccaccaagcgcgacctgggcatgtcgaaggagccgggggtggtgtcccccaccagttacttggatgtggacctccatcccgcttctgcatggacgttgtacgccgtggccaccactgttatcacacctatgctgcgccacacgatcgagaatagcaccgccaacgtttccctcgccgcgatcgccaaccaagccgtggtgctgatgggcctggacaaaggttggcctatcagtaagatggatcttggtgtacctctgttggctctcgggtgctacagtcaggtgaacccactgaccctgaccgcggcggtgctccttctgataacgcactacgccatcatcggccccggcctccaagctaaggccacgcgggaggcccagaagcgaacagccgccgggatcatgaagaatcccaccgtcgatggtatcatgacgatcgatctggatcccgtcatctatgatagcaagttcgagaagcaacttggccaggtgatgctcctggttctgtgcgcagttcaactcctgctaatgcgcacctcctgggcactctgcgaagcgctgaccctggcgacgggcccaattacgaccctttgggagggctcgcccgggaagttctggaacacgaccatcgcagtgtccatggctaacatcttccgcggcagctacctggccggggcaggcctagccttttccattatgaaaagcgtcggcacgggcaaacgtggcaccggcagccaaggcgagaccctcggggagaagtggaagaagaagctcaaccagctgtcccgcaaggagttcgacctctacaagaagtccggcatcacagaggtggaccggaccgaggccaaggagggattgaagagaggcgagatcacccaccatgcggtgtcccgtggaagcgccaagctgcaatggtttgtcgaacgtaacatggtgatcccggaggggcgggtgatcgacttaggctgcggccgagggggctggtcctactattgcgcgggcctgaagaaggtcacagaagtgcggggatacacgaagggcgggccggggcatgaggaacccgtgcccatgagcacatacggctggaacattgtcaagctgatgtcggggaaggacgtattttacttgccacccgagaagtgtgacaccctgctgtgtgacataggcgagagctccccctcacccaccgtggaagagtcccgtactatccgcgttctaaagatggtggagccgtggctcaagaacaaccagttctgcatcaaggtgctcaacccatacatgcctaccgtaatcgaacacctagagcggctccaacgcaagcacggcgggatgctggtgcggaaccccctgagtcggaatagtacgcacgagatgtactggataagcaacggcacgggtaacatagtggcgtctgtaaacatggtgagccggctgcttctgaacagatttactatgacacaccgcaggccaacgatcgagaaggacgtcgacctcggcgcgggaaccagacacgtcaacgccgagcctgagaccccaaatatggatgtgatcggtgagcgcatcaaacgaataaaagaggaacacaactccacttggcactacgacgacgagaacccgtacaagacctgggcctatcacgggagctacgaagttaaggcgaccggttccgccagcagcatgataaacggcgtcgtgaagttactcaccaaaccctgggacgttgtccctatggtcactcagatggccatgacagacactacccctttcgggcagcagcgcgtcttcaaggaaaaggtggacacccgaacgccgcgatcaatgccaggcaccagacgcgtgatgggcatcaccgccgaatggctctggcgcaccctcgggcgcaataagaagccccgcctgtgcacgcgcgaggagttcaccaaaaaggtgcgtaccaatgcggcgatgggggcagtgttcaccgaggaaaatcagtgggactctgcgaaggccgcagtggaggacgaagacttctggaagctcgtagatagagaaagggaactccacaaacttgggaagtgcggctcctgtgtgtataacatgatggggaaacgcgagaagaagctcggcgagttcggcaaagccaagggaagccgcgccatctggtacatgtggctgggcgcccggtacctggagttcgaagccctcgggttcctgaatgaggaccattggttctccagggagaatagctacagtggcgtggagggtgaaggactgcacaagttaggctacatccttcgggacatcagcaagatcccaggaggggctatgtacgccgacgacacggccgggtgggacacccgcatcacagaggacgacctccacaacgaggagaagatcacccaacaaatggacccggaacaccgccaactcgccaacgcaatctttaagctaacgtaccagaacaaggtcgtgaaggtgcagaggcccacgcccacaggaaccgttatggatatcatctcccggaaggaccaacgcggaagcggccaggtgggcacctacgggctgaatacgttcacaaacatggaggcgcagctcatccgacagatggaaggtgagggggtgctgaccaaggccgacttggaaaacccccacctatccgagaagaagatcacccagtggctggagactaagggcgtggagcgcctgaaacggatggccatctctggtgacgactgcgttgttaagccgattgatgatcgcttcgccaacgcacttctggcgctgaacgacatggggaaggtccggaaggacatcccccagtggcagccctccaagggttggcacgactggcaacaggtgcccttctgcagtcaccactttcacgagctcattatgaaggacgggcgcaagctggttgtcccctgccggccccaggacgagctgatcggccgcgcccggatctcccaaggggccggatggagcttgcgtgagacggcctgtctcggcaaggcgtacgcccagatgtggagcctgatgtacttccatcgccgggacttgcgcctggcgagcaacgccatctgcagcgctgtgcccgtgcactgggtccccaccagtcggaccacatggtcgatccacgcgcaccaccagtggatgaccaccgaggacatgctaaccgtgtggaatcgagtttggatcgaggacaacccgtggatggaggacaagacgcctgtcacgacctgggagaacgtgccctacctcggaaagcgggaagatcaatggtgcggtagccttatcgggctgaccagccgagctacctgggcccaaaacatccccacagccatccagcaagtccggtctctcataggcaacgaggaatttctggattatatgcccagcatgaagcgcttccgtaaagaggaggagagtgagggggccatctggtga

SEQ ID NO: 25980 - RNA, 9873 nt, synthetic construct
  misc_feature 1..9873: note = derived and/or modified CDS sequence (opt11) from DENV-3__FJ390372__SS-prME
  source 1..9873: mol_type = other RNA
acgtccctgtgtctcatgatggtgctgcctgccgccttggcgttccacctcaccagcagggacggggaaccccggatgatcgtggggaagaatgaacggggcaagagcctcctgttcaagactgcctcggggataaacatgtgcaccctcatcgccatggacctcggcgaaatgtgcgacgacacagtaacatacaaatgtccccacatcacggaggtagagcctgaggacatagactgttggtgtaacctaacctcaacctgggtcacctacggcacttgcaaccaagccggcgagcaccgacgcgacaaacggtccgtggcgctcgcaccccacgtgggcatggggctggacacacgtacgcagacctggatgagcgccgagggtgcgtggaggcaggtcgaaaaggtggagacgtgggctctccgccatccaggttttaccatcctggcgctgttcttagcccactacattgggacctccctcacccagaaggtggtgatcttcatcctgctgatgttagtgacgcccagcatgaccatgcggtgcgtaggcgttggcaatcgcgacttcgtagagggcctgtccggggccacttgggtggacgtagtgctggagcacggcgggtgtgtgacgactatggccaagaacaagccaaccctcgatattgaactacagaagacggaggctacccaattggcaacgctccgcaaactgtgcatcgagggcaagatcacaaacatcacgaccgactcacggtgtcccactcagggagaggcggtcctgccggaggagcaggatcaaaactatgtatgtaagcacacgtacgtggaccgggggtggggcaacgggtgcgggttgttcgggaagggatccctggttacctgtgccaagttccagtgtcttgagcctatagaggggaaggtggtgcagtacgaaaacttgaagtacaccgtcatcatcacggtgcatactggggaccagcatcaggtcgggaacgagacccagggggtgaccgccgaaatcacgccccaagcgtcaacaaccgaggccattctgcccgaatacggaaccctgggcctcgaatgcagcccgcgcaccggccttgatttcaacgagatgatcctgctcacgatgaaaaacaaggcctggatggtccatcggcagtggttcttcgacctgccgctgccctggacctcgggcgccaccaccgaaaccccgacctggaatcgcaaagagctcctggtcaccttcaagaatgcccacgccaaaaagcaggaagttgtggttttaggttctcaagagggcgcgatgcacaccgccctgacaggggccaccgagatccagaatagcggtgggacctccatattcgcaggccaccttaagtgtcgactgaagatggacaaattggagctaaagggaatgagctacgccatgtgcaccaacaccttcgtgcttaagaaggaagtgtccgagacgcaacacgggaccattctcataaaagtcgaatacaagggagaggacgcgccgtgcaagatccctttcagcaccgaggatgggcaaggtaaagcgcataatggacgcttgattaccgccaaccctgtggtgacgaaaaaggaggagcccgttaacatcgaagccgagccacccttcggcgagtctaacatcgtgatcggcatcggggataacgcgcttaaaatcaactggtacaagaagggctccagcatcgggaagatgttcgaggccactgcccggggagcgcgccgcatggccatcctaggcgacaccgcgtgggacttcgggagtgttggcggggtattgaatagcctgggcaagatggtacaccagatcttcggttcagcttacacagcgctgttcagcggggtgtcgtgggtgatgaagatcggcataggggttctcctgacctggattggcctgaacagcaagaacacctccatgagcttctcctgtatcgccatcggtgtgataaccttgtacttgggagccgtagtgcaggccgacatggggtgcgtgataaactggaaagggaaggagctgaagtgcggcagcggaattttcgtcacgaacgaagtgcacacctggacagagcagtataaattccaggcggacagccccaaacgcctcgctaccgccattgcgggggcgtgggagaacggggtgtgtggcatccgcagcacgacacgaatggagaacctgctgtggaagcagattgctaacgagctcaattacattctgtgggagaacaacattaaacttactgttgtggtcggcgacatcatcggtgtgctagaacagggtaagcggaccctgacgccccagccgatggagctgaaatactcatggaagacatgggggaaggcaaagattgtaacagctgagacccaaaactcttccttcatcatcgacggccccaacactccagagtgtcccagcgctagccgggcctggaatgtgtgggaggtcgaggactatgggtttggtgtgttcaccacaaacatatggctcaaacttcgcgaggtgtatactcagttgtgcgaccaccggctcatgtctgcagccgtgaaggatgagcgcgccgtgcacgcggacatgggctactggatcgagagccaaaagaacgggagctggaaacttgaaaaggcctcactgatcgaggtcaagacctgtacgtggcccaaaagtcatacactttggagcaacggagtattagaatccgacatgatcatccccaaaagcctggccggtcccatcagtcagcacaaccaccggccgggttaccacacgcaaacggccgggccctggcacctcggtaaacttgaactggacttcaattactgcgagggcaccaccgtagtgattacagagaactgcggcacacgcggcccctcgctccggacaaccacggttagcgggaagctaattcacgagtggtgctgtcgcagctgcacactgcctcctcttcggtacatgggtgaggacgggtgctggtacggcatggagatccgcccaatctcagagaaagaggagaacatggttaagagcctggtgtccgccggcagcggcaaagtagataatttcacgatgggggtgctctgccttgcgatcttattcgaggaggtcatgcgggggaagtttggcaagaagcacatgatcgccggggtctttttcacttttgtattactcctgtccggtcagatcacctggagagacatggcccacacccttatcatgatagggagcaatgcctccgaccgaatggggatgggcgttacttatctagccctgatagcaaccttcaagatccagcctttcctggccctcgggttcttcctgcgtaagctgacttcgcgagaaaacctgcttctgggagttggcttagccatggcaaccacgctacaactgcccgaggacatcgaacaaatggcgaacgggatagctctcggcctgatggctctaaagctcataacacagtttgagacctaccaactgtggaccgctttaatcagcctcacatgctccaacactatgttcaccctaaccgtggcctggcggacggccacccttatattagccggcgtctccctgctgccggtgtgccaaagttcatccatgaggaagaccgactggctcccgatggctgtggccgccatgggcgttccgcctctcccgctgttcatattcagcctgaaagacaccctgaagcgccgtagctggccactgaatgagggagttatggcggtggggctcgtcagtatccttgcgtcaagcctgctcaggaacgatgtgcccatggcaggcccattggttgctgggggcctcctcattgcttgctatgtgataacggggaccagcgccgacttaacagttgagaaggccgcagacatcacctgggaggaggaggccgagcagacgggtgtcagccacaacctaatgattacggtggacgacgacgggaccatgcgcattaaggacgacgagactgaaaacatcctaaccgtcctactgaagacggccctcctgatcgtgtcgggcgtcttcccgtatagtatccccgcgacactgctcgtgtggcacacctggcagaagcaaacccaacggtccggcgtcctgtgggacgtccccagcccgcccgagacgcagaaggccgagctggaggagggggtgtatcgcatcaagcagcagggcatcttcgggaagacccaggtgggcgtgggagtgcaaaaggagggagtgttccacactatgtggcacgtcacccggggagccgtgctgacttataacggtaagaggctggagcccaactgggcatccgtgaagaaagacctgatcagctatggagggggatggcggctcagcgcccagtggcaaaagggggaggaggtccaagtgatcgccgtggagcccggcaagaatccgaaaaactttcagacgatgcctggcacttttcagaccacgaccggggaaatcggtgcaatcgccctggactttaagcccgggaccagcgggtcgccaataattaacagagagggtaaggtagtggggctttacggcaacggggtggtcaccaagaatggcgggtacgtgtcgggcattgcccaaacaaatgcagagccggatggccccacccctgagctggaggaagagatgttcaagaagagaaatctcaccatcatggacctccaccccgggagcggaaaaacccgcaagtacctgcccgccatcgtccgggaagccatcaagcgccggctaaggacactgatactggcgccaacacgggtagtagccgcggagatggaggaggccttgaaggggctccccatccgctaccaaaccaccgccacgaagtcggagcataccggccgggagattgtggacttaatgtgccatgccaccttcaccatgcgccttttaagccctgtgcgggtgcccaactacaatctcatcatcatggacgaggcgcactttacggaccccgcctccatcgccgcacgcgggtacatctcaacgagagtgggcatgggcgaggccgcggccatcttcatgaccgccacgccgcccgggacagccgatgccttcccgcaatccaacgcgcccattcaggacgaggagaaggacatcccagaaagatcctggaactcggggaatgaatggatcaccgacttcgcagggaagaccgtttggtttgtgccttcgatcaaggctggcaatgacatcgcgaactgcctcaggaagaacggaaagaaggtaattcagctctctcggaagacgttcgacacagagtaccaaaagactaaactgaacgactgggacttcgtcgtgactacggacatctctgagatgggcgccaacttcaaagcggaccgcgttatcgacccgcggcgctgcctcaaacctgtcatactgacggacggccccgagcgggtgatcctggctgggcccatgcctgtgaccgctgcgtcagccgcgcagcgccggggccgagtcggccggaacccgcagaaggagaacgaccagtatattttcaccggccagccacttaacaacgacgaggatcacgctcattggaccgaggccaagatgctgctggacaacataaacacccccgaggggattatcccggccctctttgagcccgagcgagaaaagtccgcggcaatcgacggtgagtaccggctgaagggagaatctcgcaagacgttcgtggagctaatgcggagaggcgacttacccgtctggctggcccacaaagtggccagcgaaggaatcaagtacaccgaccggaagtggtgcttcgacggacagcgcaataaccagatcctggaggagaacatggatgtggagatctggacgaaagagggcgaaaagaagaaattacgacctcgctggcttgacgcccggacttactccgacccgttagcgctcaaggagtttaaggacttcgccgccggaagaaagagcatcgccctcgacctggtaacagagatcggacgcgtgccgtcccacctcgcccatcgtaccagaaacgcgctggacaacctagtcatgctacacacctcagagcatggcgggcgggcctacagacacgccgtcgaagaactgccagagaccatggagacgctgctcttattggggctcatgatcctgctgacagggggcgctatgctattcctaataagcggaaaggggatcggcaagacctccatcgggctaatctgtgtgatcgctagttcaggaatgttatggatggcggaaatcccgttacagtggattgcgagtgcgatcgtactggagttcttcatgatggtgctcttaatccctgaacctgagaagcagagaacgccccaggacaaccagctggcctacgtggtgatagggatactcaccctggccgcgattatcgccgccaacgagatgggccttctcgagacaactaagcgcgacctgggtatgtccaaagagcccggtgtggtgtcgcccaccagctacctggacgtggatctccatcccgcctcagcttggacgctttacgccgtagccactacagtgataacaccaatgttgcggcatacgattgagaactctaccgccaatgtgagcctcgcagccatcgccaaccaggcggtcgtgctcatgggactggacaaggggtggccgatctccaagatggacctcggcgtgcctcttctggcccttgggtgctactcgcaggtcaacccgttgaccttgacggcagcggtgctacttctgataacgcactacgcgatcatcggtcccgggctccaggcgaaggccacccgggaggcccaaaaacggaccgcggctggcatcatgaagaatccgactgtggacggcatcatgacgatcgacctggacccggtgatctacgattccaaattcgagaaacagctgggacaagtcatgctgttagtactctgcgccgtccagctcctgctgatgcgcacatcctgggctctctgcgaggcgctgaccttagccaccgggcccataacaaccctctgggagggctcccccgggaagttctggaacaccaccatcgccgttagcatggccaatatcttccggggctcctacctggccggggcgggcctggctttctccataatgaagagtgtaggaacgggcaagcgaggcaccgggagccagggcgaaacccttggggagaaatggaagaagaagctgaatcagcttagccgaaaggagttcgacctatacaaaaagtccggtattacagaggtcgatcgcacagaggcaaaggaggggctgaagagaggggaaaccactcaccacgccgtatcccgtggcaccgcgaagctgcagtggtttgtggagaggaacatggtcatccccgaaggccgggtaatagacctcggctgcgggcggggcgggtggtcctactactgcgctggactgaagaaggtaaccgaggtccgagggtatacgaaaggaggccccgggcacgaggagcccgtacccatgagcacctacggctggaacatcgtgaagctgatgtccgggaaggacgtcttctaccttccgccggagaaatgcgacacgctactatgcgatattggcgaaagcagccccagccctaccgtggaagagtccagaactatacgcgtgttgaagatggtcgaaccgtggctcaagaacaaccagttctgcattaaagtgttgaacccctacatgcctaccgtaatcgagcacctggagcgcctccaacgtaaacatggtgggatgcttgtccgcaaccctctgtcacggaactccacccacgagatgtactggataagcaacggcacagggaacatcgtggcctccgttaatatggtcagccgcctcctgctcaaccggttcacgatgacccaccgacgcccgaccatagagaaagacgtggacctcggagcagggacccgccacgtgaacgcggaaccggagacgcccaacatggacgtcatcggggagcggatcaaaagaattaaagaggagcacaactccacgtggcactacgacgacgagaacccttacaagacctgggcttaccacgggagctacgaggtgaaggccaccggctctgcctctagtatgatcaacggcgttgtgaagttactaacgaaaccctgggacgtggtccccatggttacgcagatggccatgaccgataccacgcccttcgggcaccagcgggtcttcaaggagaaggtcgacactcgcaccccacggagcatgcctgggcctcgacgggccatgggcatcaccgcggaatggctctggcggacgttagggcggaacaagaagcctcgcctgtgcactcgagaggagtttaccaagaagggccgcacaaacgccgcgatgggggccgtgttcacggaggaaaaccagtgggacagcgccaaggcggcagttgaggacgaggacttctggaaactcgttgaccgcgaacgcgagctacacaaactgggcaaatgcgggtcctgcgtgtacaacatgatgggcaagcgggagaaaaagctcggcgagttcgggaaggccaagggcagccgggcaatatggtatatgtggctgggggcccgctacttagagttcgaggccctgggcttcttaaacgaggaccactggttttctcgggagaatagctactcgggggtggaaggtgagggcctgcacaagctcgggtacattctgagggatataagcaagatccctggtggggccatgtatgcggacgccaccgccgggtgggacacgcgcattaccgaggacgacctacacaacgaggaaaagattacgcagcagatggaccccgaccaccgccaactcgcaaccgccatcttcaaactcacctatcaaaacaaggtcgtgaaggttcaacggccgactcccactggtacggtcatggacatcatatcccgcaaggaccagcgggggagcggccaggtcgggacctacggtctaaacaccttcaccaacatggaggcccagctcatccgccagatggaaggggagggcgtgctgagcaaagctgacttagagaatccgcacctcccggagaaaaagattacgcagtggttggagacgaaaggtgtcgaaaggcttcgacgcatggcaataagcggagacgactgtgtcgtaaagccaatcgacgacaggttcgctaacgcactccttgccctgaacgacatgggcaaggtccgaaaggacatcccacagtggcagccttccaaggggtggcacgactggcaacaggtccccttctgcagccatcatttccatgagttaatcatgaaggacggccgcaaactggtcgtaccctgtcggccccaggacgagttaatcgggcgagctcggatatcccagggagcgggctggagcctccgcgagactgcctgcttagggaaggcctacgcgcagatgtggtcattaatgtacttccaccgccgagacctccgcctcgccagcaacgcgatctgctctgcggtaccggtgcactgggtccccacgagccggacgacctggtccatccacgcccatcaccaatggatgaccaccgaggacatgctgactgtttggaaccgagtgtggatagaggacaacccctggatggaggacaagacgcccgtaaccacctgggagaacgtcccgtacctcggcaagcgggaggaccaatggtgtggtagcctgatcggcctgacgtcacgcgccacctgggcccagaacatccctaccgccattcagcaagtcagatcactgatcggaaacgaagaatttttagattacatgcccagcatgaagcgcttccggaaggaagaggaatccgagggcgcgatatggtga

SEQ ID NO: 25981 - RNA, 9873 nt, synthetic construct
  misc_feature 1..9873: note = derived and/or modified CDS sequence (opt11) from DENV-3__FJ205870__SS-prME
  source 1..9873: mol_type = other RNA
acctcgctatgcctcatgatgatcctgcccgccgctctggcctttcacctcactagtcgggatggggagccgcggatgattgtgggcaagaatgagcgcggcaagagcctactgtttaagactgcatcgggcatcaacatgtgcaccctcatcgccatggatctgggcgaaatgtgcgacgacaccgtgacctacaaatgccctcacatcgctgaggtggaacccgaggacatagactgctggtgcaatctgacctcaacctgggtgacctacgggacttgtaaccaggccggcgagcaccggcgcgacaaacggtccgtggcgctcgcgccccacgtcggcatgggactggatacgcgcacccaaacctggatgagcgccgaaggcgcctggcgccaggtggagaaggtggagacctgggcgctgcgccacccaggattcactatccttgccctgtttctggcccactacatcggcacctccctcacccaaaaggtggtgatcttcatcttgctgatgctcgttaccccaagcatgaccatgcgatgcgtgggtgttggcaaccgcgacttcgttgagggcttgtccggggctacctgggttgacgtcgtgctggagcacggcgggtgcgtgaccacgatggccaagaacaagcccacgctcgacatagagcttcagaagaccgaggcgacacagctggccactctccggaagctgtgcatcgagggcaagatcacgaacatcaccaccgacagccgttgccccacacaaggagaggcggtactgccggaggagcaggaccagaattacgtctgcaagcacacgtacgtggaccgtgggtggggaaacgggtgcggcctcttcgggaaaggctccttggttacctgcgccaagttccagtgtctagagccgatcgaaggcaaagtcgtgcagtacgagaacctcaagtataccgtgatcatcaccgtccacacgggggaccagcaccaagtaggcaacgagacccagggtgtgaccgccgagataacgccccaagcaagcactaccgaggctatcttacccgagtacggcacccttgggctggagtgctccccgcgtactggcctggactttaacgaaatgatcctgctcacaatgaagaacaaggcgtggatggtgcatcggcagtggttcttcgatctcccactgccctggacgagcggcgccaccaccgaaactcccacgtggaaccgcaaggagctcctggtgaccttcaagaacgcccacgcgaagaagcaggaggtcgtggtgctgggctcccaagaaggcgccatgcacacagccctcactggggccacggagatccagaatagcggcgggaccagtatcttcgcaggccacctgaagtgccgactgaagatggacaagctcgagctgaaaggcatgagctacgcgatgtgcaccaacaccttcgtcctgaagaaggaggtgagtgagacgcaacacggcaccatactcatcaaagtggagtataagggcgaggacgtcccttgcaagatccccttctctaccgaggacggtcaggggaaggctcacaatgggcgcctgatcacagccaaccccgtggtgacgaagaaggaggaacccgtcaacatcgaggccgagccgccttttggggagagcaacatagtgatcggcatcggggacaacgcgctgaagatcaactggtacaagaaaggctccagcatcgggaagatgttcgaggccaccgcccgaggcgccaggcgaatggccatattaggggacacagcgtgggatttcgggtccgtgggcggggtgctcaactcgttaggcaagatggtacatcagatcttcggatccgcctacaccgccctgtttagcggcgtgtcttgggtcatgaagatcggtatcggggtactccttacgtggatcggcctcaacagcaagaacacctctatgagcttctcctgcatcgctatcgggatcatcaccctctacctgggggccgttgtccaggcggacacggggtgcgtaatcaactggaagggtaaggagcttaagtgcggcagcgggattttcgtgactaatgaggttcatacgtggaccgaacagtacaagttccaggccgatagccccaagcgcttggccacggccattgccggtgcgtgggagaacggggtttgtggcatccgtagcactacccggatggagaatctgctgtggaagcagatcgccaacgaactcaactatatactgtgggaaaacaacatcaagctgaccgttgtcgtaggggacatcatcggcatcttagagcagggcaagcgcaccctgacaccccagccgatggagcttaagtactcctggaagacctgggggaaggccaagatcgtcaccgccgagactcagaacagctccttcatcatcgacggccccaacacacccgaatgccccagcgcgtcccgggcctggaacgtctgggaagtggaggactacggattcggcgtgtttaccaccaacatttggctcaagttacgggaggtctacacccagctgtgcgaccaccggctcatgagcgccgccgtgaaagacgagcgcgccgtgcatgcggacatgggctactggatcgaaagccaaaagaacgggtcctggaagctggagaaggcctcactgatcgaagtaaagacatgcacgtggccgaagtcccacaccctctggagcaatggcgtgctggagtccgacatgatcatccctaaatcgctggcggggcccatcagtcaacacaactatagaccggggtaccacacccagaccgcgggaccctggcacttaggcaagctggagctggatttcaactactgcgagggcacgaccgtggtcatcaccgaaaactgcgggaccagaggccccagcctccggacgaccacagtgtcggggaagctaatccacgagtggtgctgccgcagttgtaccctgcccccgctccggtacatgggtgaggacgggtgctggtacggcatggaaatccgcccaatctccgagaaggaggagaacatggtcaaatcactggtatccgccggctccgggaaggtggacaacttcactatgggcgtgctgtgtctcgcgatcctgttcgaggaggttatgcgggggaagttcggtaagaagcacatgatagccggggtgttcttcacatttgtgctgctcctgtccgggcagattacctggcgcgacatggcccacaccctgattatgatcggcagcaacgcctccgaccggatggggatgggcgttacgtacctcgccttgatagcgacgtttaaaatccagccgttcctggcgctcgggttcttcctgcgcaagctgacttcacgggagaaccttctgctgggcgtcgggctggccatggccaccacgctgcagctgcccgaggacattgaacaaatggcgaatggaatcgccctcggacttatggctctgaaactcatcacccaattcgaaacctaccaattgtggaccgccctgatcagcctcacgtgttccaacaccatcttcaccctgacggtggcctggcgcacggcgaccctgattctcgcaggggtgtctatcctcccggtatgccagtcctcaagcatgcggaagtccgactggctccccatgaccgtcgccgccatgggcgtaccgccgttaccgctgttcatcttctccctgaaagacacgctcaagcgccgcagctggcccctcaacgagggggtgatggccgtcggccttgtgtcaatattagcgtcctccctgctgcggaacgacgtgcccatggcaggccctctcgtcgccgggggcctgctgatcgcctgttacgtgataacgggtacctcagctgacttaaccgtggagaaggcggccgacgtcacttgggaggaggaggccgagcagacgggcgtgagtcataacctcatgatcaccgtggacgacgacgggaccatgagaatcaaggacgacgagactgagaacatcctgaccgtcctcttgaagacggccttgctcatcgtgagcggaatcttcccatattccatcccggccacccttctggtgtggcacacctggcagaagcagacccggcgatctggcgtattgtgggacgtgccatcaccccccgaaacgcaaaaggcggaactggaggagggggtgtaccggataaagcaacaaggcatcttcgggaagactcaggtgggagtcggcgtgcaaaaggagggcgtcttccacaccatgtggcacgtgacgcgcggcgcagtcctgacgtacaacgggaagcggctggagcccaactgggccagcgtaaagaaggacctgatctcttacggcgggggctggcgcctgagcgcccagtggcagaagggggaggaggtccaggtgatcgcggtggagcccgggaagaacccgaagaacttccagaccatgcccggcaccttccagaccacgaccggggaaatcggcgccatcgccctggacttcaagcccgggaccagcggctcacccatcatcaatcgggagggcaaggtggtggggctctacggtaacggcgtggtgaccaagaacggcggctatgtgagcggcatcgcgcaaacaaacgccgagcctgatggccccaccccggagctagaagaggagatgttcaagaagcgcaacctaactatcatggaccttcaccccggatctggcaagactcgcaagtaccttccggcaatagtccgcgaggcgataaagcgacgattacggacgctaatcttagcccccactcgagtcgtcgcggccgagatggaggaggccctaaaggggctcccaatccggtatcagaccaccgccactaagagcgagcacactggaagggagatcgtcgacttaatgtgccacgctactttcaccatgcggctgctctcccccgtgcgggtcccgaactacaacttaatcattatggatgaagcccactttacggaccccgcctcaatcgcggccagaggatacatcagcacacgggtgggtatgggcgaggctgccgcgatatttatgaccgccacgccgcccgggaccgctgatgccttcccgcaatctaacgcccccatccaggatgaggaaagagacatccccgagcggagctggaacagcggcaatgagtggatcacagacttcgcggggaaaaccgtgtggttcgtgccctcaatcaaagccgggaacgacatcgcaaactgcctgcgcaagaacggtaagaaggtcatccaactctcccggaagaccttcgatacggaataccagaaaaccaagctcaacgactgggatttcgtggtgaccaccgacatctccgagatgggggcaaatttcaaggccgaccgcgttatcgacccgcggcgctgtctgaagccggtgatcctcacggatggtccggagcgggtgatcctcgctgggcccatgccggttactgcagccagcgcagctcagcgtcgtggccgcgtgggtcggaatccgcaaaaggagaacgaccagtacatcttcacgggccagccgctgaacaacgacgaggaccacgcccattggacggaggctaagatgctcctggacaacatcaacacccccgagggaatcatcccggccctgtttgaaccagagcgcgagaagtccgcggcgatcgatggcgagtaccggctcaagggcgagagccgaaagacctttgtggagctgatgcgaaggggggacctgcccgtctggctcgcccacaaggtggcctccgagggcattaagtatacagatcggaaatggtgcttcgacgggcagcggaacaaccagatcctggaggagaacatggacgtcgagatatggaccaaggagggagagaagaaaaagctgcgcccccgctggctggacgcccgcacctatagcgacccgcttgccctcaaggagttcaaggacttcgcggccgggcgaaagtcaatcgccttagacctggtcacggagattggccgcgtgccaagccacttagcccaccggacccgaaatgctctcgataatctggttatgctgcacacctcggagcatggcggaaaggcgtaccgacacgctgttgaggaactccccgagaccatggagacgctgctgctcctgggcctgatgatcctcctgacggggggcgccatgctgttcctaatctccggcaagggtatcggaaagaccagtatcgggctgatctgcgtaatcgcctccagtggcatgctgtggatggccgaaatccctctacagtggatcgcatccgctatagtcctggagttcttcatgatggtgctgttaatccccgagcccgagaagcagcggacgccccaggacaaccagctagcctatgtagtaatcggaatcctgaccctcgccgccatcatagcggccaacgagatgggattactggagaccaccaagcgtgatctcggcatgtcaaaagagccgggtgttgtgtcccccaccagctatctcgacgtcgacctgcaccccgcatctgcttggacactatatgcggttgccaccaccgtgatcactccgatgctgcgccacacgattgagaacagcaccgccaatgtctccctagccgccatcgcgaaccaagccgtggtgctcatgggcctggacaaggggtggccgatcagcaaaatggacttaggggtgccactcctggccctgggttgttactcccaagtgaaccccctcactctgaccgccgccgtgctgctcctgatcacgcactacgcaatcatcgggccaggtctgcaggcgaaggccacccgagaggctcagaaacgcaccgctgcggggatcatgaagaatccgaccgtcgacggcatcatgacgatcgacctcgaccccgtgatttatgatagtaagtttgaaaaacagttaggtcaggtgatgctgctcgtcctgtgcgcagtgcagttgctcttaatgcggactagctgggccctgtgcgaggccttaaccctggcgacgggccccatcacgaccctctgggagggtagccccggaaagttctggaacaccaccattgccgtgtccatggctaatatcttccgcggatcatacctcgccggggccggcctggcgttctccatcatgaaatccgtcggaacgggcaagcgcgggaccgggagccagggcgagaccctcggagagaagtggaagaagaagctcaaccagctgagccgaaaggagttcgacctgtataagaagagtggcattaccgaggtggaccggaccgaggccaaggaagggctcaaacgcggcgagatcacgcaccacgccgtgagccggggcagcgccaaactgcagtggttcgtcgaacgcaacatggttatcccggaggggcgggtaatcgacttaggatgtgggcggggtgggtggtcgtactactgcgccggcttgaagaaggtaacggaggtgcggggctacaccaaaggcgggcccgggcacgaggagcccgtgcccatgagcacctacggctggaacatcgtgaagctgatgtccgggaaagatgtgttctaccttccccccgaaaagtgcgatacgctcttgtgtgacatcggcgagtcatcccctagccccaccgtcgaggagtcccgcaccatccgcgtcttgaagatggtggagccgtggcttaagaataaccagttctgcataaaggtcctgaacccgtacatgcccactgtgattgagcacctggagcggctgcagcgcaagcacggcgggatgctcgtgaggaaccccttgagccgcaactccacccacgagatgtattggatcagcaacggcaccggtaatatcgtggcgtccgtcaacatggtgagccggctgctcctgaatcgtttcactatgacccaccgccgcccgacaatcgagaaggacgtagacttaggcgcaggcacccggcacgtaaacgcggagccggagacgcccaacatggatgtgatcggggagcgaatcaagcggatcaaggaagagcataactccacctggcattacgacgacgagaacccgtacaagacgtgggcataccacggaagctatgaagtaaaggccacggggtccgcgtcctctatgattaacggcgtggtgaagcttctgaccaagccctgggacgtcgtgcccatggtgacgcagatggccatgaccgacaccacccccttcgggcagcagcgcgttttcaaggagaaggtggacacgaggaccccacggtccatgcccggcacccggcgcgtcatgggcatcaccgccgagtggctgtggcggactctggggcgcaacaagaagccccgattatgcacgcgcgaagaattcaccaagaaggtccgcaccaatgccgcgatgggggcggtgttcaccgaggagaaccaatgggacagcgccaaggccgccgtagaggacgaggacttctggaagctagtcgaccgagagcgcgaactccacaagctggggaagtgcggttcctgcgtctacaacatgatggggaagcgggaaaagaagttaggtgagttcggcaaggcgaaagggtcgagggccatctggtacatgtggctcggtgcgcggtatttagagttcgaagccctgggattcctcaacgaggaccactggttcagccgcgagaactcatactcgggcgtggagggcgagggcctgcccaagttgggctacatcctccgggacattagcaagatccccgggggggctatgtatgcggacgacactgctgggtgggacacccgcatcactgaagacgacctgcacaacgaagaaaaaatcacccagcagatggaccccgagcaccggcaactggcgaacgcgatcttcaagctcacgtaccagaacaaggttgtgaaggtccaacgccccactcccaccggtaccgtcatggacatcatttcccggaaggaccagaggggcagcggccaggtgggcacctacggactgaacactttcaccaatatggaggcccaactgatccgtcagatggagggcgagggggtgctctccaaggcggacctggaaaacccgcacctgagcgaaaagaagatcacccagtggctcgaaacgaagggcgtcgagcgccttaagcggatggcaatctctggcgacgactgcgtggtgaagcccatcgacgaccgcttcgccaacgccctcctcgcactgaacgacatggggaaggtccggaaggacatcccgcagtggcagccgagcaagggctggcatgactggcagcaggtcccattctgctcccaccatttccatgagcttatcatgaaggatggccgcaagctcgtggtcccctgtcggccacaggatgagctgatcggcagagcacggatcagccagggagccggctggtccctgcgcgagactgcctgcctcggcaaggcctacgcgcagatgtggagcttaatgtacttccaccgccgggacctgcggctcgcgtctaacgccatctgcagcgccgtgcccgttcactgggtcccgaccagccggaccacctggtccatccacgcgcaccatcagtggatgacgaccgaggacatgctgaccgtctggaaccgagtgtggatcgaggacaacccctggatggaggacaagacccccgtcacgacctgggaaaacgtgccctacctgggaaaacgggaggaccagtggtgtggtagcctgatcgggctgacgtcacgcgcgacgtgggcccaaaacataccgacggccatccaacaggtccggagcctgatcggcaacgaggagttccttgattacatgcccagtatgaagcgcttccggaaggaagaggagagcgagggggcaatctggtga

SEQ ID NO: 25982 - RNA, 9873 nt, synthetic construct
  misc_feature 1..9873: note = derived and/or modified CDS sequence (opt11) from DENV-3__FJ390373__SS-prME
  source 1..9873: mol_type = other RNA
accagcttgtgcttaatgatgatactacccgcggccctggcattccacttaacaagccgggacggggagccccggatgatcgtggggaaaaacgagcggggcaagagcctgctgttcaagacggcgtccggaatcaacatgtgcactctcatcgccatggatctgggagagatgtgtgatgataccgtgacatacaagtgcccacacatcacggaagtggagcccgaagacatcgattgttggtgcaacctgaccagcacctgggtgacctacggtacgtgcaaccaagccggcgagcaccgtcgcgacaaacggagcgtcgcactcgctccccacgtcggcatggggcttgacacccgcacccagacctggatgagcgccgagggcgcctggcgccaagtggaaaaggtcgagacatgggccctgcgccacccggggttcaccattcttgccctgttcctggcccattacatcggcaccagtctcacccaaaaagtggtcatctttatccttctaatgctggtgacccccagtatgaccatgcggtgcgttggggtgggcaaccgcgatttcgtagagggcctaagtggggccacctgggtggacgttgtcctggagcacggaggttgcgtgaccacaatggcaaagaataagcccacgctcgacatagagctgcagaaaaccgaagccacccagctggcgacgcttcggaagctttgcatagagggcaaaataaccaatatcaccacagacagccgctgcccgacgcagggcgaggccgtgttgccggaggagcaggaccagaactacgtatgcaagcacacctatgtcgatcggggttggggcaacgggtgcggactcttcgggaagggctcgctggttacttgcgcgaagttccagtgtcttgagcccatcgagggcaaggtcgtgcaatacgagaacttgaaatatacagtgatcataactgtccacaccggggatcagcaccaagtgggcaacgagacccagggggtcaccgccgagatcacgccccaggccagcacgacggaggcaatcctgccggagtacggcactctggggctcgagtgctccccacgcaccggactcgacttcaatgaaatgattctgctcacgatgaagaacaaggcctggatggtgcaccgacagtggttcttcgaccttcccctgccctggaccagcggagccaccacggagacacccacgtggaacagaaaggagctcctggtgaccttcaagaacgcccacgccaagaaacaggaggtcgtggttctggggtcccaggagggggcgatgcacaccgccctcaccggggcaaccgagatccagaattcaggcgggacatccatttttgccggccacttaaaatgccggctaaagatggacaaactcgaactgaagggcatgtcatacgcgatgtgtaccaacacgttcgtcctgaaaaaggaggtatccgagacccagcacggtaccatcctcataaaggtggagtacaagggcgaagacgtaccttgcaagatacccttcagtaccgaagacgggcgcggcaaggcgcacaatggccggctgatcacggccaatcccgtggtaaccaagaaagaggaacccgtcaatatcgaggctgagccgccattcggagagagcaacatcgtgatcggaatcggggacaacgcgctgaagatcaattggtacaagaagggctcctcaatcgggaagatgttcgaggcaaccgcccgcggcgcccggcgaatggccatcctgggcgacacggcctgggacttcgggtccgtggggggggttctcaactcactgggaaaaatggtgcatcaaatcttcggttccgcgtacacggccctgttcagcggcgtgtcctgggtcatgaagatcggaatcggggtgctcctgacctggatcggtcttaatagcaagaacacctctatgagcttctcctgcatcgccatcgggataatcacactctacctgggcgccgtggtccaggccgacatgggatgcgtaattaactggaagggcaaagagctgaagtgcggctccgggatctttgtaacgaacgaggtccacacctggaccgaacagtacaagtttcaggcggactcccccaagcgcttagccacggccattgccggggcctgggagaacggggtgtgcggcattcgtagtacgacccggatggaaaacctgctgtggaagcagatcgcgaacgagctgaactacatcctttgggagaacaacataaagctgaccgtggtggtgggcgacacaatcggcgtgctggagcagggcaagcggacgttgacgccccagccgatggagctgaaatactcctggaagacttggggaaaggcgaaaattgtcaccgccgagacgcaaaactcatccttcatcattgacggacccaacacccccgagtgtcccagcgcctcccgcgcttggaacgtctgggaggtggaggactacggtttcggggtcttcacgaccaacatctggctcaaactgcgggaggtgtacactcagctgtgcgaccaccgcctcatgtctgccgccgttaaggacgagagggccgtccacgccgacatgggctactggatcgagtctcagaagaacgggtcctggaagctggagaaggccagcctgatcgaggtgaaaacgtgcacctggccgaagagtcacaccctgtggtctaacggcgtgctggaaagcgacatgataatccccaaaagcctcgcaggacccatttcgcagcacaactaccgcccgggctaccatacgcagacggcagggccctggcacctaggcaaactggagctggactttaactattgcgagggcaccaccgtcgtgatcaccgagaattgcgggacgcgcggtcccagcctccgtaccaccacagtgtccggcaaactcatccacgagtggtgctgccggagctgcacgctgccccccctccgctacatgggggaggacgggtgttggtacggcatggaaatccggccgatctccgagaaggaggaaaacatggtcaagtctctggtgtccgcaggatctggtaaagtcgacaacttcaccatgggcgtcctatgcctcgccatacttttcgaagaggtaatgcgcgggaagttcggcaagaagcacatgatcgcgggggtcttcttcaccttcgttttactcctgtcaggccaaattacgtggcgggacatggcccataccctcattatgatcggcagcaacgcctccgaccgcatgggcatgggagtgacctacctcgccctgatagcgacattcaagatccagccttttctcgcgttggggttctttcttcggaagcttacaagccgcgagaacttactgttgggcgtgggcctcgccatggccaccactctgcaactgcccgaggacatcgagcagatggcgaatgggatcgccctcgggctcatggcactgaagctcacaacgcagttcgaaacgtaccagctctggaccgccctgatcagcctgacctgctcaaacaccatcttcaccctgaccgtcgcgtggcggaccgccacactgatcctcgcgggggtgagcctgcttcccgtctgccagtccagctcgatgcgcaagacggattggttgcccatgacagttgctgctatgggcgtgccgcccctccctctgttcatcttcagcttgaaggacacgctgaagagacggtcctggcccttaaatgagggcgtcatggccgtgggtctcgtgtccatattggcctccagcctgctccgcaacgacgtccccatggcgggccccctggtcgctgggggtctgctcatcgcctgctacgttatcaccgggacgtccgccgacctgaccgtcgagaaagcagcggacgtgacatgggaggaggaggctgagcagaccggcgtaagccataacctgatgatcaccgtcgacgacgacgggaccatgcgtataaaggacgacgaaaccgagaacatcctcaccgtgctcctgaagaccgccctcctcatcgtgtcgggcattttcccctatagcatcccggccacgctgctcgtctggcacacctggcagaagcagacccaacgctccggcgttctgtgggacgtgcccagcccacccgagacccagaaggccgagctggaagaaggcgtctaccggatcaagcagcagggcatctttgggaagacccaggtgggtgtgggggttcagaaagagggtgtgttccataccatgtggcacgtaacccgcggagcagtactcacctacaacgggaagcggctggagccgaactgggcgtccgtgaagaaggacttgatttcttacgggggcggctggcggctctccgcccagtggcagaagggggaggaggtgcaggtcatcgccgtggagcccggaaagaaccccaagaactttcagaccatgcccggaacctttcagaccaccacgggcgagattggcgctatcgctctggacttcaagccaggaacctctggctcacccataatcaaccgggagggcaaggtagtcggtctgtatggaaacggggtagtgaccaagaacggcgggtacgtgagtggtatcgcccaaaccaatgccgagccggacggccccaccccggaactggaggaagagatgttcaagaagaggaacctcacaatcatggacctgcaccccgggtcggggaagacccggaagtatctgccggccattgtgcgcgaagcgattaagcggcgcctcagaaccctgatccttgcccccactagggtggttgccgccgagatggaggaagccttgaaggggctgcccatcaggtaccagacaaccgcgaccaagtccgagcacacgggtagagagatcgtggacctgatgtgccatgcgaccttcaccatgagactcctttccccagtgcgcgtcccgaactacaacttgatcataatggacgaggcccacttcaccgatcctgcatctatcgccgctcgcgggtacatctcaacccgcgtcgggatgggcgaggccgccgctatcttcatgaccgctaccccgcccgggacagccgatgcgtttccccagtccaacgccccaatccaggacgaagagcgcgacatccccgagcggtcctggaactccggcaacgaatggatcactgacttcgccgggaagacggtgtggtttgtcccaagcataaaggcggggaatgatatcgcaaactgcctgcgaaagaacgggaagaaggtgatccagctgtcacggaagaccttcgacaccgaataccagaagacgaagctgaacgactgggacttcgttgtcaccaccgatattagcgagatgggcgccaacttcaaggccgaccgcgtgatcgacccgcgacgctgcctcaagccggtgatccttaccgacggccctgaacgggtcatcctggcggggcccatgcccgtgaccgcggcctccgcagcacaacgccggggccgcgtgggtcggaacccccaaaaagagaacgaccaatacatctttacggggcagcccctcaacaacgacgaggaccacgcccactggaccgaggctaaaatgctcctagacaatatcaacacccccgagggaatcatcccggccctcttcgagcccgaaagagaaaagtccgccgcgatagacggtgaataccgactgaagggcgaatcccgcaaaacctttgtcgagctcatgcggcgcggggcactccccgtgtggctggcccacaaggtcgcgtctgaaggcataaagtacacggaccggaaatggtgcttcgacggtcagcgcaacaaccaaatcctggaggagaacatggacgtggagatctggaccaaagagggcgaaaaaaagaagctccggccccgctggctggacgcccgcacctactccgacccgctggccctcaaggagtttaaggatttcgcggccggccgcaagagcatcgccctggacctggtgaccgagatcgggcgcgtcccctcccacctcgcccaccgcacgcgaaacgcgctggacaatctggttatgctccacaccagcgaacacggcgggaaagcgtataggcacgccgttgaggagctgcccgaaaccatggagaccctgctcctgctggggctcatgattctgctgaccggcggggccatgttattcctgatcagcgggaaggggatcggcaagacctcgatcgggctaatatgcgtgattgccagctccggcatgttatggatggcagagatccctcttcagtggattgcgagcgccatcgtgctggagtttttcatgatggtgctacttattcccgagcccgagaagcagcgcactccccaggacaaccagctggcttacgtagtgatcgggatcctcaccttagccgccatcatagcggccaatgagatgggcttactcgaaacgaccaagcgggacctgggcatgtccaaggaaccgggggtggtcagccccacctcttatcttgacgtggacttacaccccgccagcgcctggaccctttacgcggtcgccacaactgtcattacgcccatgttgcgccataccatagagaactccacggcaaacgtgagcctcgccgccattgcaaaccaagctgtggtgcttatggggttagacaaggggtggccgatctccaaaatggatctaggggtgcccctactggccctcgggtgctactcccaggtgaatcccttaaccctgaccgcggccgtgctcctgctgatcacacactacgcgatcatcgggcccggcttgcaggctaaggccacgagggaagctcagaaacgcacagccgcggggatcatgaagaacccgaccgtcgatggtatcatgacgatcgatctcgaccccgtaatctacgattccaagttcgagaagcagctggggcaggtcatgctgctggttttgtgcgccgtgcagctcctgctcatgaggaccagctgggctctctgcgaagccctgaccttggcgaccggccccatcaccacgctctgggagggatcccccgggaaattttggaacacaaccatcgccgtaagtatggccaacatcttccgcggctcctaccttgccggggcgggtctggccttctccatcatgaaatccgtagggaccggcaagcggggcaccggtagccagggcgaaacactcggagagaagtggaagaagaagctgaaccagctatctcgcaaggagttcgacctctataagaaatccggcatcacagaagtggaccggaccgaggccaaggagggcctaaagcgcggtgagattacacaccacgccgtgtctcgggggtccgccaagctgcagtggttcgtggagcgcaacatggtgatcccggaggggcgggtcatcgatttgggctgcggcagaggcgggtggagctactactgcgcaggcctaaaaaaggtgaccgaggtgcggggctacacgaagggcgggcccgggcacgaggagcccgtccccatgtccacctacggttggaacattgtgaagctaatgagcgggaaagacgtgttctatctcccgccagagaagtgcgacaccctgttgtgcgacatcggcgagtccagcccttcccccacggtcgaggaatcgcgcactatccgcgtactgaagatggttgagccgtggcttaagaacaaccagttctgcatcaaggtcctgaacccttacatgcccacggtgatcgagcatttggagcggctccaacgtaagcacggcgggatgctggtgcggaaccccctttcaaggaacagcacccacgagatgtactggatctccaacgggactgggaatatcgtggcgagcgtgaacatggtgtcccggctacttctgaaccgcttcaccatgacccaccggcgccctactatcgaaaaggatgtagacctcggcgccggaacacggcacgtgaacgctgagccggagacccccaatatggacgtgatcggagaacgcatcaagcggatcaaggaggagcacaacagcacctggcactatgatgacgagaacccgtacaaaacctgggcctaccacggatcctacgaggtcaaggccacgggctctgcgtccagcatgatcaacggcgttgtcaagttactgaccaaaccgtgggacgtggtgcccatggtcacccagatggccatgaccgacaccaccccattcggccaacagcgtgtgttcaaggagaaggtggacacacggaccccgcgcagcatgcccggcacgcgacgcgtcatgggcatcactgctgagtggctctggcggaccctggggcgcaacaagaagccccggctgtgcacccgcgaggagttcacgaagaaggtgcgcacgaacgccgcaatgggcgccgtgttcaccgaggagaaccagtgggactccgccaaggctgccgtcgaggatgaggacttttggaagctagtagaccgggagcgtgaactgcacaaactggggaagtgcggcagctgcgtgtacaacatgatgggaaaacgagagaaaaaactcggcgaattcggcaaagcgaaggggagtcgcgccatatggtacatgtggctgggcgcccggtacttggagttcgaagccctcgggttcctgaacgaagaccattggttctcccgtgaaaactcttacagcggagtggagggagagggcctgcacaagctcgggtacatcctacgggacatctccaaaatccctggtggcgccatgtatgcggatgacaccgccgggtgggacacccggatcacggaggacgatctacacaacgaggaaaagattacccagcagatggacccggaacaccggcagctagccaacgccatcttcaagctgacctaccaaaacaaggtggtaaaggtccagcgccccacccccacaggcaccgtgatggacatcatatcgcggaaggaccagcgcggctccggtcaggtgggcacctacgggctgaatacgttcactaacatggaggctcagttgattcggcagatggaaggcgaaggggtacttagcaaggcggacctggagaacccccacctcccggagaagaagatcacccagtggctggagaccaaaggcgtagagcgtctgaagcggatggcaatctcgggggatgattgcgtggtcaagccgatcgacgacagattcgccaacgctctccttgccctcaatgacatggggaaggtccggaaagacattccccagtggcagcccagcaagggctggcacgactggcagcaggtcccgttctgctcccaccacttccacgagctcatcatgaaggacggtcgcaagctggtggttccctgccggccccaggacgagctaattgggagggcacggatcagccagggggccggctggtccctgcgcgagaccgcctgcctggggaaggcctacgcacagatgtggagcttgatgtacttccaccggagggacctacgcctggcctccaacgccatctgcagcgccgtgcccgtccactgggttccgacgtcccggacgacgtggtccatacacgcccaccatcagtggatgaccacggaagacatgctgaccgtctggaacagggtctggatcgaggacaacccctggatggaagacaagacgcccgtgacgacgtgggagaatgtcccctacctcgggaagcgggaggaccagtggtgcggcagccttatcgggttaacctccagggcgacctgggcccagaacatcccgaccgcgatccaacaggtgcggagccttatcggcaacgaggagttcctcgactacatgccctccatgaagagattccggaaggaggaggagagcgagggggccatctggtga

SEQ ID NO: 25983 - RNA, 9873 nt, synthetic construct
  misc_feature 1..9873: note = derived and/or modified CDS sequence (opt11) from DENV-3__FJ205871__SS-prME
  source 1..9873: mol_type = other RNA
acctcgctatgcttgatgatgatcttacccgccgccctggctttccacttgaccagcagggacggggagccccggatgatcgttgggaagaacgagcgggggaagtcgctgctgttcaagaccgcctccgggatcaacatgtgcaccctgattgctatggatctgggagagatgtgcgacgataccgtgacctacaagtgtccccacataaccgaggtggagcctgaggacatagactgctggtgcaacttaactagcacctgggtgacctatgggacgtgtaaccaggctggagaacaccgtcgggacaagcggagcgtagcgctcgcgccacacgtcggcatggggctcgacacacgcactcagacctggatgagcgccgaaggcgcctggcgccaggtcgagaaggtagagacatgggcactgcgccatccggggtttaccatcctcgcgttgttcctggcccactacatcggcaccagcctcacgcagaaagtggtgatcttcattctgctgatgctcgtgacgcccagcatgacgatgcgctgcgtgggagtgggcaaccgcgatttcgtcgagggcctctcaggtgccacgtgggtcgacgtggtcctcgagcatggcgggtgcgtaactaccatggctaagaacaaacccaccctcgacatcgagctccaaaagacagaagccacgcagctcgcgacgctccggaaactttgcatcgagggaaaaatcacgaatatcacaaccgacagccgctgccccacacagggggaggccgtgctacctgaggaacaagaccagaactacgtctgtaagcacacctacgtagacagggggtgggggaatggctgcggcctattcggaaaaggcagcctggtgacctgtgcaaagttccagtgcctggagcccattgagggtaaagttgttcagtatgaaaaccttaaatacaccgttattatcacagttcacaccggggaccagcaccaggttggtaacgaaacccagggggtcaccgccgagataacgccccaagcatctaccaccgaggcgatcctcccggaatacggcactttagggctagaatgctcaccgcgtactggcctggactttaatgaaatgatcctactcacgatgaagaataaggcctggatggtgcaccggcagtggtttttcgacctgcccctgccctggaccagcggtgcaaccaccgaaacgcccacctggaatcgcaaagaactactggtgacttttaagaacgcccacgccaagaagcaggaagtcgtggtgctggggtcgcaagaaggcgcgatgcacacggcgcttacgggcgcgaccgaaatccagaactcgggcggcacctccatatttgcaggccacctgaagtgccggcttaagatggacaaactggagcttaaaggtatgagctacgcgatgtgcaccaacacgtttgttttaaagaaagaggtgtcagagacccaacacgggaccatccttatcaaggtggagtacaaaggcgaagatgtcccgtgtaagatacctttttctacagaagacggccagggcaaggctcacaacgggaggctgattaccgctaaccccgtcgtgacaaagaaagaggagcccgtcaacatcgaggcggagcctccgttcggtgagagcaatatcgtgatcgggattggggacaacgcgctgaagatcaattggtacaaaaaaggctccagcattgggaagatgtttgaagccaccgcccggggcgcccgccggatggccattctgggggacaccgcctgggacttcggatccgtgggtggcgtcctcaactctctgggcaaaatggtgcaccaaatcttcggctccgcctatacggctttattcagcggtgtgtcctgggtaatgaagatcggcatcggagtgctcctgacctggatcggcttaaacagcaaaaacacatcaatgtcatttagttgcatcgctataggaataatcacgctctacctgggtgccgtcgtccaggccgacatggggtgcgttattaactggaagggcaaagagctgaagtgcgggagcggtatatttgtgacgaacgaggtacacacgtggaccgagcagtacaagtttcaagccgattcacccaagaggttagctaccgccatcgctggggcctgggaaaacggggtttgcggcatacgctcaacgacccggatggagaaccttctgtggaaacagatcgcgaatgaactcaactacattctctgggaaaataacataaagttgacggtggtcgttggagatacaattggcgtgctcgagcaaggaaaacgcacactgactccccagccgatggagctgaagtactcctggaagacctgggggaaagcgaaaatcgtcacggccgaaacgcaaaactcttcgttcattatcgatggccccaacacccccgaatgtcccagcgccagcagagcgtggaatgtgtgggaggtagaagactacggcttcggagtgttcaccaccaacatctggctcaagcttcgcgaggcgtacacccagctatgtgaccaccgactcatgtccgccgcggtgaaggatgagcgcgccgtgcacgcggacatggggtattggattgagagccagaaaaatggttcctggaagctggagaaggctagcctcatcgaagtcaagacatgcacttggcccaagagccatactttgtggtcaaatggtgtactggagtcggacatgataatacccaagagcctggccgggcccatctcccagcacaactaccggcccgggtatcacacccaaacggccgggccatggcacctcgggaaactggagctggacttcaactactgtgaaggcacgaccgtggttatcaccgaaaactgtgggacgaggggcccttcgctgcggactaccaccgtgtccgggaagctcatacatgaatggtgctgtagatcctgcacgctgccgcccctccggtacatgggcgaagacggctgctggtacggaatggagatcaggcccatttcagagaaggaagagaacatggtcaagagcttggtatcggcaggctccgggaaggtagacaactttaccatgggagtgctttgcctcgcaatccttttcgaggaggtcatgcgggggaagttcggtaagaagcacatgatagccggggtgttcttcacctttgtgctgctactgtcagggcaaatcacctggcgcgacatggcacacacgctgatcatgatcggaagcaatgcttcggaccggatgggcatgggcgtgacttatctcgctctaatcgcgacctttaaaatccaaccattcctggccctggggttcttcctgcgcaagttaaccagtcgtgagaacttactacttggcgttggtctcgccatggctacgaccctgcagctgccggaagacatcgagcagatggctaacgggattgccctcggcttaatggcccttaagctcaccacccaatttgagacttaccagctgtggactgctctgatctccctgacttgttccaacacaatcttcacattaaccgtggcctggcgcaccgcgaccctgattctcgcaggcgtcagtctgctgccggtgtgtcaatccagctccatgcgcaagacggactggctcccaatgacagtcgccgccatgggggtgcctcccctgcctctgttcattttcagcctgaaggataccctgaagcggcgctcctggcccctgaacgagggcgtgatggcggtcggcctcgtgagcatcctggcgtcgagcctactgcggaacgacgtgcccatggctggcccgttggttgccggtggcctcctcatcgcctgttacgtgatcaccgggacgtcagccgatttaaccgtggagaaggcagccgacgtcacctgggaggaggaggccgagcagacaggcgtgtcccacaatttaatgattaccgtggacgacgacgggacgatgcgcattaaggatgacgagaccgagaacatcctaaccgttctgctcaagaccgccctcctcatagtgtccggcatcttcccatacagcattcccgccacactgctagtgtggcacacatggcaaaagcagacccagcggagtggtgtcctctgggatgtgccctcccctcccgagacacagaaggcggaactggaagagggggtgtaccgcatcaagcagcagggaatcttcggcaaaacacaagtgggggtaggagtacagaaggaaggcgtcttccacacgatgtggcacgtgacccggggcgccgtcctcacgtacaacgggaagcgcttggagcccaactgggcatccgttaaaaaagatctgattagctacggcgggggctggcgtctcagtgcgcaatggcagaaaggtgaggaagtacaggtgatcgccgtggaaccggggaagaaccctaagaacttccagacgatgccgggcacattccagaccacgactggagagattggtgcgattgctctggacttcaagccagggacgagcgggagccccatcatcaaccgtgaggggaaggtggtcgggctgtacggcaacggggtcgtgacgaagaacggcgggtacgtatccggaattgcccagacaaacgctgagccagatgggccaacgcccgagttagaagaggaaatgttcaagaaacgtaatctcacaataatggacctgcacccagggagcggcaagacacgaaaatacctgcctgcgattgttcgggaggccatcaagaggagactcaggaccttaatactggcacccacacgtgtagtagccgccgaaatggaggaagcgctcaagggactgcccatccgttatcagaccactgccaccaagtccgagcacacgggccgagagatcgtcgacctgatgtgtcatgccacgttcacaatgcgccttctgtctcccgttcgggtcccgaattataacctgatcatcatggacgaagcccacttcaccgaccccgcctccatcgccgcccgcggttacataagtacccgggttggcatgggcgaggccgccgctatctttatgaccgcgacgccgcccggcaccgccgacgcctttccgcagtccaatgccccgatccaggatgaggagcgtgatatcccggagcgcagctggaactccggcaacgagtggatcacggactttgcagggaagaccgtgtggttcgtgcccagcataaaggccggcaatgacatcgcgaactgcctccgcaagaacgggaagaaggtaatccagctgtcccgcaagaccttcgacaccgagtaccagaagacgaaactgaacgactgggatttcgtagtgaccactgacatcagcgagatgggcgcaaacttcaaggcggaccgcgtcatcgatccgaggcggtgcttgaaacccgtgatcttaaccgacggacccgagcgcgtgatcttagcagggcccatgccggtcactgcggcttccgctgcccagcgacgcggccgggtggggcgaaacccacaaaaggaaaacgaccaatacatcttcacgggtcagccactcaacaacgacgaggaccacgcccactggaccgaggccaagatgctgctggacaacatcaatacccccgaggggataataccagccctctttgaacccgagcgggagaaaagcgccgcgatcgatggggagtataggctgaagggtgaatcccggaagacatttgtggagctaatgcgccgcggggacctcccagtgtggctggcacacaaggtggcttctgagggaatcaagtatacggaccgtaagtggtgcttcgacggacagagaaacaaccaaatcctagaggagaacatggacgtcgagatatggacaaaggagggtgagaagaagaagttgcgaccccgctggctggacgcccgcacctattccgatccactggccctcaaagagttcaaagacttcgccgccgggcgcaagtcgattgcgctcgacctggtgaccgagatcgggcgagtgccctcccaccttgcccatcgcactcggaatgccttggacaatctggtcatgctgcatacgtctgagcacggcggaaaggcgtaccgacacgcagtagaggaattgccagagaccatggagactctgcttctgttgggtctcatgattctgctaaccggcggggccatgctcttcctgataagcgggaaggggattggaaagacttccatcggactgatctgcgttatcgccagctccggcatgttgtggatggccgaaatcccgctgcaatggatcgcgtctgcgatcgtcctggaattctttatgatggtgctgctcatccccgaacccgagaagcagcggacgccacaggacaatcagctagcttacgttgtcatagggattttgaccctggcggctatcatcgcggccaatgagatggggctgctcgagacgaccaagcgcgatttaggaatgtccaaagaacccggcgtggtgtctcccactagttatctggacgtcgacctccaccctgcctctgcctggacgctgtacgcggtggccacgaccgttatcaccccgatgttacgccataccatcgaaaactccacggcgaatgtctcgttggccgccatagcgaatcaagccgtcgttcttatgggactggacaagggttggccgatctccaagatggatctcggcgtccccctgctggcactagggtgttactcacaggtgaatcccctgactctgacggcggctgtcttactactgataacccactacgctatcatcggacctggcttacaggcgaaggctacgcgcgaagcccagaagcggaccgccgcgggtatcatgaaaaacccgactgtcgacggcatcatgaccatagacctggaccccgtcatctatgactccaagttcgaaaaacaactcggccaagtgatgctccttgtactgtgtgccgtccaactcctgcttatgcggacgagctgggcactctgcgaggccttaaccctggcaaccggccccatcaccacgctctgggaggggtcccccggcaagttctggaacacgaccatcgcggtgtccatggctaacatctttcgcggctcctacttagcgggtgccggcctcgcgtttagcatcatgaagtccgtcgggaccggtaagcgcggcacgggttctcagggcgagacactcggcgagaagtggaagaaaaaactgaaccaattgagccggaaggagttcgacctctataaaaaatccggcatcacagaagttgaccgcactgaggccaaggagggattgaagcggggcgagatcacccaccacgccgttagccgtggatcggccaaactccagtggtttgtggaacggaatatggtgatcccggaggggcgcgtaattgacctcggctgtgggcgaggagggtggagctactactgcgccgggttgaaaaaggtaaccgaggtacgcggatatactaaggggggaccggggcacgaggagcccgttcccatgtccacctacggctggaacatcgtcaagctgatgtcagggaaggacgttttctacttgcctcccgagaagtgcgacaccctgctgtgtgacatcggcgagtccagcccctcgcccacggtcgaggaaagtcggactatcagggtcctgaaaatggtagaaccgtggctcaagaacaaccaattctgcatcaaagttctaaacccttacatgccgaccgtcatagaacacctggaacgcctgcagcggaagcacggcggcatgctggtccgcaatcccctctccagaaacagcacccacgagatgtactggatcagcaacggtacggggaatattgttgcgagcgtaaacatggtgtccagactccttctaaaccgcttcacgatgacccacagacggcctaccatcgaaaaagacgtagatctcggtgcagggacgcgtcacgtcaatgctgagcccgaaacccccaacatggacgtgatcggggagcgtatcaagcgcatcaaggaggagcacaacagcacctggcactacgacgacgagaacccgtacaagacttgggcctaccatggaagctatgaagtcaaggccacagggagcgcctccagcatgatcaacggcgttgtgaagcttcttaccaagccctgggatgtcgtgcccatggttacccagatggccatgaccgacacgactccgtttgggcaacagagggtcttcaaggagaaggtagacacccgcaccccgaggagcatgcccggcactagacgcgtgatggggatcacagcagaatggttgtggcgcactctggggcggaacaaaaagcctagactgtgtacacgagaggagtttacgaaaaaagtgcggacgaatgcggcgatgggagccgttttcacggaggaaaatcagtgggacagcgccaaggccgccgtggaggacgaagatttctggaagcttgtcgaccgggagcgagaactgcacaaattggggaaatgcggcagctgcgtctacaatatgatgggtaaacgagagaagaaacttggcgagttcggcaaggcaaaaggatccagagctatttggtacatgtggctaggcgcccgctatcttgagttcgaagcactcgggtttttaaacgaggaccactggtttagccgggagaactcctatagcggggtggagggggaaggcctgcacaagctcggctacatactgcgtgacattagtaaaattcccggcggagccatgtacgctgacgataccgctggttgggatacgcgcattaccgaggacgatttgcacaacgaggagaagattacacaacaaatggacccagagcaccgccagcttgccaacgccatctttaaactgacttaccagaacaaggtcgtgaaagtgcagcggcccacacccacgggcaccgtcatggacattatcagccgcaaggatcagcgggggagtggccaggtgggcacatacgggttaaacactttcactaacatggaggcccaactcatccgccagatggagggcgaaggggtactgtccaaagctgatctagagaacccccacctgccggaaaagaagatcacccagtggctcgagaccaaaggggtcgagcgactgaagcgcatggccatttccggtgacgattgcgtggtgaaaccgatcgatgaccggtttgccaacgccctcctggcattaaacgacatggggaaggtaaggaaggacataccgcagtggcaacccagcaagggctggcacgactggcagcaggtcccgttttgtagccaccactttcatgagctaatcatgaaggatggtcggaagctggtggtcccctgccgcccccaggatgagctcattggccgggcccgcattagccagggggcgggttggtccctcagggagaccgcatgcctgggcaaagcctacgcacagatgtggagcctgatgtactttcatcgcagggacctccgcctggcctccaacgccatttgcagtgctgtgcccgttcactgggtcccgacatcccgtaccacatggtcgatccacgcgcaccatcaatggatgacaacggaagacatgctaaccgtgtggaaccgggtttggatcgaagacaacccgtggatggaagacaagactcccgtcacgacctgggagaacgtgccgtacctggggaagcgcgaggaccagtggtgtggcagcctgataggattaacttcccgggccacatgggcccagaacatcccgactgccatccagcaggtcagaagcctcatcggcaatgaggagttcctggattacatgccttccatgaagcgatttcgtaaagaggaagagagcgagggggctatatggtag

SEQ ID NO: 25984 - RNA, 9873 nt, synthetic construct
  misc_feature 1..9873: note = derived and/or modified CDS sequence (opt11) from DENV-3__FJ390375__SS-prME
  source 1..9873: mol_type = other RNA
acctccctgtgcttgatgatgatcctaccggccgccctggcgttccacctaaccagccgtgacggcgagccccgtatgatcgtggggaagaatgaacggggcaagagcctgttgttcaagaccgccagcgggatcaacatgtgcaccctcatcgccatggacctgggggagatgtgcgacgacacggtcacctataagtgcccccacatcacggaggtggagccggaggacatcgattgctggtgcaatctgacgtcaacctgggtcacctacgggacgtgcaaccaggccggtgagcacagacgggataagcggtcagtcgccctcgcgccccacgtgggaatggggttggacacccgcactcagacctggatgtctgccgaaggcgcgtggcgccaggtggagaaggtcgaaacgtgggcccttcgccatccggggtttaccatcctcgcgctatttctggcccactatatcggcacctccctcacccagaaggtggttatcttcatactgctgatgttagtcacaccctccatgactatgcggtgcgtgggggtgggcaatcgcgatttcgtcgagggtctgtccggggcgacttgggttgacgtggtcctagagcacggcgggtgcgtaaccacgatggcgaagaacaagcccacactcgatatagaactgcagaagacagaagccacccaactggcgacgctgcggaagctgtgcatcgaggggaagatcacgaacatcacgacagacagccgctgtcccacgcaaggtgaggccgtgctcccggaggaacaggatcagaattacgtctgtaagcacacctacgtggacagggggtggggcaatgggtgcggcctattcggtaagggttcgctggtgacctgtgccaagttccaatgcctggagcccatcgaggggaaagtcgtgcagtacgaaaacctgaagtacaccgtgattataacggtccacaccggcgaccagcaccaggttggcaatgaaacccagggggtcaccgccgagataacgccccaagccagcaccaccgaggcgatcctcccggaatatggcaccctggggctggagtgctccccgcgcaccggcctggacttcaatgaaatgatcctgctcacgatgaaaaataaggcctggatggtgcaccggcagtggttcttcgacctgcccctgccctggacaagcggcgccacaacagagactccaacctggaatcgcaaggaactactggtaaccttcaagaacgcacacgcaaaaaagcaggaggtcgtggttctggggtcacaggagggcgcgatgcatacggcgctcacgggggccaccgagatccaaaacagtggcgggacctccatcttcgcaggccatctgaagtgccggttaaagatggacaagctcgaactgaagggcatgagctacgccatgtgcacaaacacgttcgtcctgaagaaagaggtcagtgaaacacagcacgggaccatcctcatcaaggtcgagtacaagggggaggacgtcccgtgcaagatcccctttagtaccgaagacgggcagggcaaagcgcacaacggccgtctgatcacagccaaccctgtagtgaccaagaaagaggaaccagtcaacatcgaggctgagccgccctttggggagagcaacatcgtgatcgggatcggggacaacgcgctaaagatcaactggtacaaaaagggctcctcgataggaaaaatgttcgaggctaccgcccggggcgcccgcagaatggccattctgggcgacaccgcatgggacttcgggtccgtgggcggggtcctcaacagtttaggcaagatggtgcaccagatattcgggtccgcatataccgcccttttctccggcgtatcctgggtcatgaagatcggaatcggggtcctcctgacctggatcggcctgaactccaaaaacacctccatgagcttttcctgtattgcaataggaatcatcaccctatatcttggcgccgtagtccaggccgacatggggtgcgtgatcaattggaaaggtaaggagctaaagtgtgggtcagggatcttcgtaacgaacgaggtccatacctggacggagcagtacaaattccaggcggattcccccaagcgcctagccactgcgattgctggcgcctgggagaacggggtttgcggaatacgcagtacaacccgaatggagaacctgctctggaagcagatcgcgaacgagctcaactacatcctgtgggagaacaacatcaagctgacagtggtagtgggggacaccatcggggtgcttgagcaaggcaagcgcacgctgacaccccagccgatggagctgaagtactcctggaagacgtggggaaaggcgaagatagtcaccgcggagactcaaaatagctccttcatcatcgacggccccaacacccccgagtgcccgtccgcaagtcgggcgtggaacgtttgggaagtggaggactatgggttcggcgttttcaccaccaacatttggctcaagctgcgcgaggtgtatacccagctgtgtgaccaccggctcatgagcgcagccgtgaaggacgagagagccgtccacgccgatatgggctactggatcgagagccagaagaatgggtcctggaagcttgaaaaggctagcctgatcgaagtgaagacgtgcacatggccgaagagccacacgctctggagcaacggtgtgctggagtccgacatgatcattcccaaatcgctagccgggcccatctcccagcataactaccggccgggctaccacacgcagacggccgggccctggcacttagggaagctggagctggatttcaactactgtgagggcacaaccgtcgtgattaccgagaactgcgggacgcgcggtccttcactccgtaccaccaccgtgtccgggaagctgatccatgagtggtgttgccggtcttgtacgctgcccccgctccggtacatgggagaggacggttgctggtacggaatggagattcgacctatatccgagaaggaggagaacatggtcaagagcctggtgtccgccggaagcgggaaggttgacaactttaccatgggcgtcctctgcctcgccatactgttcgaggaggtgatgagggggaagttcggtaagaagcacatgatcgcgggggtgttcttcacattcgtcctgctcctatccggccagatcacctggagagatatggcccacacgctgatcatgatcggttcgaatgcctctgatcggatggggatgggcgtgacctatctcgccttgatcgccactttcaagatccagcccttcctggcgcttgggttcttcctgcgcaaattgacgtcaagggagaacctcctgttgggcgtgggcctcgccatggccacgacgctgcagcttcccgaggacatcgagcagatggccaacggtattgcgctcggcctgatggccttgaagctcaccactcagttcgagacgtaccagctgtggactgctctgatcagcctgacatgctccaatacaatcttcacgctgacggtcgcctggcggaccgccaccctgattctcgcgggggtgagcttgctgccagtgtgtcagagtagctcaatgcggaaaacggactggctccccatgaccgtggccgctatgggcgtgccacccttaccgttgtttatcttcagcctcaaagacaccctgaagcgacgctcctggcccctgaacgagggcgtcatggccgtgggcctcgtgagcatcctggcctccagcctgctccggaacgatgtccccatggcgggcccgctggtggccggaggcctgctcatcgcctgctacgtgatcaccgggacgtccgccgacttgaccgtagagaaggccgcggatgtgacctgggaggaggaggccgagcagactggcgtgtcacacaacctgatgatcactgtcgacgacgacggaacgatgcgcatcaaggatgacgagaccgagaacatcttgaccgttctgctgaagaccgccctcttaatagtaagtggcatctttccttacagcattcccgccacactgttggtctggcatacctggcagaagcagacccagcggtccggcgtgctgtgggacgtgcccagcccgcccgagactcagaaagcagagctagaggagggggtctaccgcatcaagcagcagggcatcttcgggaagacccaggttggcgtgggggtacagaaggagggcgtgttccacaccatgtggcacgtaaccaggggcgcggtactcacgtacaacgggaagcgcttggaacccaactgggccagtgtaaagaaagacttaattagctatggcgggggatggcgactctccgcccagtggcagaagggggaagaggtgcaggtcatcgccgtggagcccggcaagaacccgaaaaacttccagacgatgccgggcaccttccaaactaccacaggggagatcggcgcgatcgccctggacttcaagcccgggactagcggcagccccatcattaaccgtgagggcaaggtggtcggtctgtacggcaacggggtggttaccaagaacggcgggtacgtctccggcattgcgcagaccaacgccgagccggatggccctacgcctgagctcgaagaggagatgttcaagaagcgtaacctcacaatcatggatctgcaccccgggtccggcaagacccgcaagtacctgcccgctatcgtgcgagaggcgatcaagcgccgtcttcgtaccctgattcttgcccccacccgggtggtcgcggccgagatggaggaagcgttaaagggactgccaatccgctaccagacgaccgcgaccaaatccgagcacacgggccgggagattgtggacctgatgtgccacgccacattcactatgcgcctcctgagccccgtgcgggtcccgaactacaacttaattatcatggatgaagcccacttcaccgatcccgcgtccatcgcagcgcgcgggtatatcagcactcgggtgggcatgggcgaggcggccgccatcttcatgaccgctacgccacccgggaccgccgatgccttcccgcagtccaatgcccccatacaggacgaggagcgcgatatcccggagcgtagctggaactccggaaacgagtggattacggatttcgccgggaagaccgtgtggtttgtccctagcatcaaggcgggaaatgacattgccaactgtctccggaagaacgggaagaaggtgatacagctctccaggaagacctttgacacggagtaccagaaaacgaaactgaacgactgggatttcgtggtcaccacggacatcagcgagatgggcgccaatttcaaagccgaccgagttatagacccgcgccgctgcttaaaacccgtgatcctgaccgacggccccgagcgcgtcatcctagcggggccgatgccggtgaccgcggcatccgccgcccagcggcgcggacgggtggggcgcaacccgcagaaagagaacgaccagtacatcttcacgggccagcccctcaataacgacgaggaccacgctcactggaccgaggcgaagatgctattggacaacataaacactcccgaggggatcatcccggcattattcgaacccgagcgggaaaagtccgccgccatcgacggcgagtaccgcttaaagggcgagagccgcaagacgtttgtcgaactcatgcgccgcggagacctcccagtgtggctggcgcacaaggtcgccagcgagggcatcaaatacaccgaccgcaagtggtgtttcgacggacagcgtaataaccagatactagaggaaaacatggacgttgaaatctggaccaaagagggtgagaagaagaagctcagaccccggtggcttgacgcgcgcacttactccgacccgctagcactcaaagagttcaaggacttcgcagctggccgcaagtcgatcgcactggacctggtgaccgagatcggcagagtccccagccacctagcacaccgcacccggaacgcccttgataacctagttatgttacatacttcagagcacggagggaaagcctacagacacgctgtggaggagctgcccgagaccatggagaccctgctccttctgggcttgatgatcctgctgacaggcggtgccatgctgttcctgatcagcgggaaggggatcggcaagacctccatcgggctgatctgcgtcatcgcgagctcgggtatgctctggatggccgagatcccgctgcaatggatcgccagcgcgatcgttctggagttctttatgatggtgctcctgatccccgaacccgagaagcagcggactccgcaggacaaccagctggcatacgtcgtaatcgggatactcaccctggccgccatcatcgccgccaacgagatggggctgctcgagacgaccaagcgagatctgggcatgtccaaggagccgggggtggtcagccccacctcctatctggatgtggacctccaccccgcctctgcctggaccctgtacgccgtggcgacgaccgtgatcacaccaatgctgcgacacaccatagagaactccacggccaacgtgtccctcgctgctatcgccaaccaggcggtggtgctgatgggccttgacaaggggtggccgatttcgaaaatggacttgggggtgcccctgctggccctcggctgctacagccaggtgaaccccctgacactgacagcggccgtcctattactgataacccactacgccatcatcggcccaggcctacaggcgaaagccacgcgcgaggcccaaaaacgtacagccgccgggattatgaagaacccgaccgtggacggcatcatgacaatcgatctagaccccgtcatctacgactccaagttcgagaagcagctggggcaggtcatgcttctggtgctatgcgcagtgcagctgctgctgatgaggacgagctgggctctctgcgaggccctgacgctggcaactggccccataaccacgctctgggagggctcccccgggaagttctggaacaccacaatagcggtcagcatggccaacatcttccgggggagttacctggcaggagccggcctggcgttctccatcatgaagtcagtggggaccggtaagcgcggcacggggagccagggagaaacgctcggggagaaatggaaaaagaagctgaaccagctgagccgcaaggagttcgacctctacaaaaagtccggcatcactgaggtggaccgcacagaggcgaaggaggggctgaagcggggcgagatcacccaccacgcggtgagcagaggctccgccaaactacagtggttcgtagagcggaacatggtgatcccggaggggcgagtcatcgacctgggctgcgggcggggcggttggagctactattgcgccggcctgaagaaggtgacggaggtacgcggctacaccaagggagggcccggacacgaggagcccgtgcccatgtccacctacggatggaatatcgtgaagctgatgtccgggaaagacgtcttctacctcccaccagagaagtgcgacaccctgttgtgcgacataggcgagtcatcgccctcgccaacggtcgaagagagccggaccatcagggtactgaagatggtggaaccctggctcaagaacaaccagttctgcatcaaagtgctgaacccgtacatgcccactgtgatcgagcacctagagcgcctccagcggaagcacggcggaatgctagtacgcaatcccctgtccaggaactccacccacgagatgtactggatctccaacgggacggggaacatcgtcgccagcgtgaacatggtgtcccgccttctgctgaaccggttcaccatgacccataggcggccgacgatcgagaaggatgtcgatctcggtgcgggcacgcgccacgtcaacgcagagcccgagacccccaacatggacgtgatcggggagcggatcaagcgcatcaaggaggagcacaacagcacctggcactacgacgacgagaacccgtacaagacgtgggcgtaccacggcagttacgaggtcaaagcaacggggtcggcctcaagcatgatcaacggggtggtcaagctcttaaccaaaccctgggatgtggtgccgatggtcacgcagatggcgatgacggacacgacccccttcggccagcagcgtgtgttcaaagagaaggtggacactcgcaccccgcggtccatgcccggcacgcgacgggtcatggggatcaccgccgagtggttatggcgcaccctggggcggaataagaagccccgcctgtgtaccagggaggagttcacgaagaaggttagaactaacgccgctatgggtgcagtattcaccgaagaaaaccagtgggactccgcaaaggcggccgtcgaagacgaggacttctggaagctcgtggaccgcgaacgggagctccacaaactggggaagtgcggctcttgtgtgtacaacatgatggggaagcgcgagaagaaactcggagagttcggcaaagccaaggggtcccgggctatctggtacatgtggttgggcgcccgctacctggagtttgaggccctcgggttcctaaacgaggaccactggttctcccgagaaaactcatacagcggcgtcgagggggaggggctgcacaagcttggatacatcctgcgcgacatttctaagatccccgggggcgccatgtatgccgacgataccgcggggtgggacacgcgtatcaccgaggacgacctacacaacgaggagaagatcacccagcagatggaccctgagcaccgacagctcgccaacgccatcttcaagctgacctaccagaataaggtggtgaaagtccagcggcccacccccacgggcaccgtgatggacatcattagtcgcaaggaccagcggggctccggccaggttggcacctacgggctgaacaccttcacgaacatggaggcccaactcattaggcagatggagggagaaggggtcctgtccaaagccgatctggaaaacccccacctcccggagaagaagatcacccaatggctggaaaccaaaggcgtggagaggctgaaaaggatggctatctccggcgacgactgcgtggtcaagcccatcgatgaccggttcgcaaacgccctcctggccctcaacgacatggggaaggtgcgtaaagatattccccagtggcaaccctccaagggatggcatgactggcagcaggtccctttctgctcccaccatttccacgagctcatcatgaaggacggtcggaaactggtcgttccgtgccgcccccaggacgagctgatcggccgcgcccgcatctctcagggggcgggctggtccctccgggaaaccgcttgcctgggcaaggcctacgcccaaatgtggagcctgatgtactttcaccgacgcgacctacggctggcgtcgaacgccatctgcagcgctgttccagtccactgggttccgacgtcccgcaccacatggtctatccacgcccaccaccagtggatgaccacggaggatatgctgacggtctggaaccgtgtctggatcgaggacaatccctggatggaggacaagacccccgtaaccacgtgggaaaacgtgccctatttggggaagcgcgaagaccagtggtgcgggagcctaatcgggctgacctcgcgagccacgtgggcgcagaacatcccgaccgcgatccaacaggtgcgaagcctcatcggtaacgaagagttcttggactacatgccatccatgaagcggttccgcaaggaggaggagagcgaaggggccatctggtag

SEQ ID NO: 25985 - RNA, 9873 nt, synthetic construct
  misc_feature 1..9873: note = derived and/or modified CDS sequence (opt11) from DENV-3__FJ390376__SS-prME
  source 1..9873: mol_type = other RNA
accagcttatgcctaatgatgatccttcccgccgccttagcgttccacctaaccagccgcgacggtgagccacggatgatagtggggaagaacgagcggggcaaatcgcttctgtttaagaccgcatccggtatcaacatgtgcaccttaatagccatggacctgggcgagatgtgcgacgacaccgtgacctataaatgcccccatatcaccgaggtggagcccgaggacattgactgttggtgcaacttgaccagcacctgggtgacctacgggacgtgcaaccaggccggtgaacaccgccgcgacaagaggtccgtcgccctcgcgccgcacgttggtatggggctggacacacgcacccagacctggatgtctgccgagggtgcctggcgtcaagtcgaaaaagtcgaaacgtgggccctgcgccacccggggttcaccatcctcgcgctgttcctggctcactacatcggcacctccctcacccagaaggtcgtgattttcacgctcctgatgctagtcacccccagcatgaccatgagatgcgtcggtgtcggcaaccgtgatttcgtcgagggactgtccggcgccacctgggtagatgtggtcctggagcacggaggttgtgtgacgactatggccaagaacaagcccacgctcgacatagagctgcaaaagacggaggccacgcagttggctacactgcggaaactgtgcatcgagggcaagatcaccaacatcaccacggacagccgttgccccactcagggcgaggctgtgttaccagaggaacaggaccaaaactacgtctgcaaacacacgtacgtcgaccggggctggggcaacgggtgcggcctctttgggaagggctctctggtgacctgcgctaagttccagtgcctggagcccatcgagggcaaggtcgttcagtacgagaacctaaagtacacggtgattataaccgtccacactggggaccagcatcaggtgggcaatgagacccagggggttacggccgagataaccccccaggcgagcaccaccgaggcaatcctgccagagtatggcaccctcgggctcgagtgctccccgcgtacaggccttgattttaacgagatgatcctactcaccatgaagaacaaggcatggatggtgcaccggcagtggttctttgacctgccattgccctggacatctggcgctaccacggaaacgcccacctggaatcgcaaggagctcttggtcacattcaagaatgctcacgccaagaagcaggaagtagtggtgctggggtcccaggagggggccatgcacacagccctgacaggtgcgaccgagatccaaaacagcggcgggacctcaatcttcgctgggcacctaaagtgccggctgaagatggacaaactcgaactgaagggtatgagctatgctatgtgcacgaacacctttgtactgaagaaggaggtttcggaaactcagcacgggactatcctcatcaaggtggagtacaagggcgaggacgtcccatgcaaaatccccttcagcactgaggatggccagggtaaggcgcacaacggtcgcctcattaccgccaaccctgtggtgaccaagaaggaggagcctgttaacatagaggcagaaccgccattcggggaaagcaacattgtcattggcatcggggataacgccctcaagatcaactggtacaagaagggctcatcgataggaaaaatgttcgaggccaccgcccggggtgccagaaggatggccatcctgggagacacggcctgggacttcgggtccgtcggcggcgtcctcaacagcctgggtaaaatggttcaccagatattcgggtccgcgtacaccgctttgttcagcggcgtgtcctgggtcatgaagattggcatcggggtgctcctgacctggattggtttaaactccaagaacacatccatgagcttttcctgcatcgccattggcatcatcactttatatctgggcgccgtggtccaggccgatatgggctgcgtgatcaactggaagggaaaggagctgaagtgcggaagcgggatcttcgtgaccaacgaagtccacacttggactgagcaatacaaattccaggcggactcgcccaagcggctcgccacagccatcgccggcgcctgggagaacggggtgtgtggaatccgaagcacaacccggatggagaacttgctgtggaagcagatagcgaacgagctcaattatatcctttgggagaacaacatcaagctgactgttgtcgtgggggacattataggcgtccttgagcagggcaagcgcacgttaacgccccagccgatggagctgaagtacagttggaagacatgggggaaggccaaaatcgtgactgccgagactcagaacagtagcttcatcatcgatggccccaacacccccgaatgcccctctgcctccagagcgtggaacgtgtgggaagttgaggactacggattcggcgtctttaccactaacatctggttaaagctgcgggaggtgtacacacagctgtgcgatcaccggcttatgagcgccgccgtaaaggacgagcgagccgtccatgctgacatgggctactggattgagagccagaagaacgggagttggaaactcgagaaagcgtcactgatcgaagtgaagacgtgcacctggcccaaatctcacaccctctggtcgaacggtgtgctggaaagtgacatgatcatccccaaaagcctcgctggtccaatctcccagcataactaccgaccgggctaccacacccagacggccggtccctggcatcttggcaagttggagctggacttcaactactgcgaagggaccacagtcgtgatcaccgagaactgtggtacgcgcggcccaagcctccggacaaccaccgtgtccggaaagctgattcatgaatggtgctgccgcagctgtacgctaccgccactccgatatatgggcgaggatgggtgctggtacggcatggagatccgccccatctccgagcgggaagagaatatggtcaagagcctggtgtccgccggttccggcaaggtggacaacttcaccatgggcgttctgtgcttggccatcctgtttgaagaggtgatgcgggggaaatttggcaagaagcacatgatcgctggggtgttcttcaccttcgtcttattactatccgggcaaattatttggagggacatggcccacaccctgataatgatcgggagcaatgcctcggaccgcatggggatgggcgtaacttatctcgctcttatagccacctttaaaatacagcccttcctggcacttgggttcttcctgcgaaagctaacctcgcgagagaatctcctactgggcgtcggcctagctatggccaccacgctccaacttcccgaggacatcgaacaaatggcaaacgggatagcgctcggcctgatggccctgaagctaatcacgcagtttgagacctaccagctgtggaccgcgctaatcagcctcacgtgctccaatactatattcacgcttacggtcgcatggcggacggccaccctgatcctcgcgggagtgagcctgttaccggtatgccagtccagctcgatgcgcaagaccgactggctccccatgaccgtggctgctatgggggtaccgccgctcccgctgtttatcttttctttgaaggacacgctgaagcgccgttcctggcccctgaacgaaggggttatggccgtgggcctcgtgagcatcctggcctcaagcctgctccgcaacgacgtccccatggcgggtcccctggtagccggcggcttgctcatcgcctgctacgtaatcaccgggacctcggccgacctgaccgtcgagaaggccgctgacgtgacgtgggaggaggaagctgaacagaccggcgtttcccataacctgatgatcaccgtcgacgacgacgggaccatgcgaatcaaagacgacgagacggagaatatactcacggtcctgctaaagaccgccctcctgattgtaagcggcatcttcccgtattccatccccgccacacttctcgtctggcacacctggcaaaaacagacgcagcgctccggcgtgctgtgggacgtgccctccccgccggagacacagaaggctgagctggaggagggtgtataccggatcaaacagcagggaatctttgggaagacccaggtaggagtgggggtccagaaggagggcgtattccacaccatgtggcatgtaacgcgtggcgcagtcctaacctataacgggaagcgcctggaaccaaactgggcatccgtgaagaaggatttgatctcatacggaggcgggtggcgtctctccgcccagtggcaaaagggggaggaggtgcaggtcatcgctgttgagcccggcaagaacccaaagaacttccagaccatgccgggcacattccagactaccaccggcgagatcggggcgatagccctagatttcaagcccgggacgagcggcagccccataatcaaccgggaaggcaaggtggtcgggctgtacggaaacggcgtggtgacgaaaaacggcgggtacgtctccggcatcgcccagactaacgcagagccggacggtcccacacccgaattagaggaggagatgttcaagaagcgcaaccttaccatcatggatctgcatcccggctctggcaagacgcgtaagtacctgccggccatcgtgcgcgaggcgatcaaacggcgccttcgcaccctcatcctggcccccactagggtcgtcgccgccgagatggaggaagccctaaaggggctgcctatccggtaccagaccacggcgacgaagtcagagcacacgggacgtgagatagtggatctgatgtgccatgccacctttacgatgcggctactcagcccggtgcgtgtaccgaattacaacctcattatcatggatgaggcgcacttcaccgaccccgccagcattgctgcacgcggctacattagcacccgcgttggaatgggcgaggccgcagcaatcttcatgacagcaacgccccctgggaccgccgacgcgttcccgcagtcaaacgcccccatccaggacgaggaacgcgacatccccgaacggagctggaactccggcaacgagtggatcaccgacttcgccgggaagacggtttggtttgtccccagcatcaaggcaggcaacgatatagcgaactgcctccgcaagaacgggaaaaaggtgattcagctgtctcgcaagacattcgacactgagtatcagaagacaaaactcaacgactgggacttcgtggtcaccacagacatcagcgagatgggcgccaacttcaaggcagaccgcgttatcgacccgcggcgatgcctgaagcccgtgattctcaccgacggtcctgagcgagtcatcctagccgggcccatgcctgtgaccgcggcctcggccgcccagcgccggggtcgcgtcgggcggaacccccagaaggagaacgaccagtacatctttaccggccagccactgaacaacgacgaggaccacgcccactggaccgaagcgaaaatgcttctggacaacatcaacacccccgagggaattatccctgctctctttgaaccggagcgcgagaagtccgcagccattgatggtgaataccgcctgaagggcgagtcccgcaagaccttcgtcgaactcatgcggcgcggggacctccccgtatggctggcgcacaaggtcgccagcgagggtatcaagtacaccgatcgtaagtggtgcttcgacgggcagaggaataaccagatcctggaagagaacatggatgtagagatctggaccaaggaaggcgagaagaaaaaactccggccccgatggttggatgcgcgcacatactccgacccgctcgccctcaaagagttcaaagacttcgccgcgggccgcaaaagcatcgccctggacctggtgacggagatcgggcgcgtcccatcccatctcgcccacagaacccgcaacgcgctggacaatctggtgatgcttcacaccagcgagcacggcgggaaggcctaccggcacgcggtggaggagctgcctgagacgatggagaccctgctccttctggggctcatgatcctcctaaccggcggagccatgctgttcctgatctccggcaaagggatcggcaagacctcaattggtttaatctgcgtcattgccagctcgggtatgctctggatggccgaaatccccctgcagtggatcgcaagcgcaatcgtgctggagttctttatgatggtgctcctgatccccgagccagagaagcagcgcacgccccaggacaaccagttagcctacgtagtgatcggtatcctcacacttgctgctatcatcgccgcgaacgagatgggcctgttagaaaccactaagcgagacctggggatgtccaaggagccgggggtcgtctcaccgacgtcctacctggacgtggacctccaccccgcgagcgcgtggaccctgtatgccgtggcaacgaccgtcatcacgcccatgctgcgccacacaatcgaaaacagcaccgccaacgtgtcactcgcagccatagccaaccaggctgtggtcttgatgggtctggataagggttggccgatatccaagatggacctaggcgtaccactgctggccttagggtgttacagccaggtgaaccctctgaccctgacggccgccgtactccttttaatcacacactacgccatcatcggccccggcctccaggcgaaagctacccgggaggcccaaaagcgtacggccgccgggatcatgaagaatccgacggtcgatggaatcatgacgattgacctggatcccgtaatatacgattcgaagttcgaaaagcagttgggccaggtcatgctactagtgctgtgcgctgtacagctgctgttgatgcggacctcgtgggccctctgcgaggcccttacgttagccacgggccccatcacaaccctctgggagggctcccccggtaaattctggaacaccacgatcgcggtgtcaatggccaatatcttccgcggcagctacctggccggggccggtttagccttcagcattatgaagtccgtggggaccgggaaaagaggcaccggctcccagggcgagaccctcggcgagaagtggaaaaagaaattgaaccagctgagccgcaaggagttcgacctttataagaagtccggcattacagaggtggaccggacggaggcgaaggaggggctgaagcgcggcgagatcactcaccacgccgtctcgcggggctccgccaagctgcagtggttcgttgagcgcaatatggtgatcccggaggggcgcgtcatcgatctcggatgcgggcgcggcgggtggagctattactgcgccggcctgaagaaggtcacagaggtccgcggatacaccaagggtgggccagggcacgaagagcccgtccccatgagtacgtacggctggaacatcgtcaaattaatgagcggaaaggatgttttctacttgccgcctgagaagtgtgacactctgctgtgtgacatcggggagtccagccccagccctaccgtcgaggagagccgcaccatcagggtgctgaagatggttgagccgtggctcaagaacaaccaattctgcatcaaggtactcaacccgtacatgcccacggtgatagagcacctggagcggctccagcgtaagcacggagggatgctggtccgaaatcccctgtccagaaacagcacccacgagatgtactggatttccaacggtactggcaacatcgtcgcaagcgtcaacatggtgagtcgtctcctgctgaaccgcttcaccatgacgcacagacgccccaccattgagaaggacgttgacctcggggcgggcacccggcacgtcaacgccgaaccagagacccccaacatggatgtgatcggtgagcgtatcaagcggattaaggaagagcacaactcgacctggcattacgacgacgagaatccctacaagacctgggcttaccatgggtcctacgaagttaaggccaccggtagcgccagctcaatgataaatggcgttgtcaagctgctgaccaagccctgggacgtggttccgatggttacgcagatggccatgaccgacaccaccccattcggtcagcaacgggtgttcaaggagaaggtggacacgcggacaccgcgcagcatgcccggcactcggcgcgtcatgggaatcaccgccgagtggctttggcgaacgctggggcggaacaaaaaaccccgtctgtgcacccgcgaggagttcaccaagaaggtgcgaaccaacgcagcgatgggcgcggtgtttaccgaggaaaaccagtgggactccgccaaggccgccgtcgaggacgaagacttttggaagctcgtggaccgggagcgagagctgcacaagctgggcaagtgcggcagctgcgtgtacaacatgatggggaagcgtgaaaagaagctgggcgagttcggaaaggctaagggatcccgagcgatctggtacatgtggttaggcgcccgctatctcgagttcgaagccctcgggttcctgaacgaggaccactggtttagccgcgagaacagctacagtggcgtggaaggtgagggtctgcacaagttaggctacatccttcgggatatctccaagatcccaggtggcgctatgtacgccgacgacaccgcggggtgggacacgcgcatcaccgaggacgacctgcacaacgaggagaagatcacgcagcagatggacccggagcaccggcagctcgccaacgccattttcaagttgacgtaccaaaacaaagtggtcaaggtgcaacgccctacccctaccggcaccgtgatggatattatctctcggaaggatcagagaggatctggtcaggtgggtacgtatgggctgaacaccttcaccaacatggaagcccaactcatcagacagatggaaggcgagggggtcctgagcaaggccgacttggagaaccctcatctcccagagaaaaagatcacccagtggctcgagacgaagggggtggagcgcctgaagcggatggcgatctccggcgatgactgcgtggtcaagcctatcgacgacagattcgccaacgctctgctcgccctgaacgacatgggaaaggtccggaaggacatcccccaatggcagcctagtaagggctggcatgactggcagcaggtcccgttctgcagtcaccacttccatgagctcatcatgaaggacgggaggaagttggtcgtaccctgtcggcctcaagacgagctgatcggaagagcccgcataagccagggggccggctggtccctccgtgagaccgcctgcttgggcaaggcctacgctcagatgtggtccctgatgtacttccacagacgggacctacggctggcgtccaacgctatttgcagcgccgttcccgtccactgggtgcccacctcccgaacaacgtggagcatccacgcccaccaccagtggatgaccactgaggacatgctaaccgtctggaaccgtgtctggatcgaggacaacccctggatggaggataaaacgcccgtgacgacgtgggagaatgtgccctatctcgggaaaagagaggatcagtggtgcggcagcctgatcgggctgacatcccgagccacgtgggcgcagaacattccgactgcgatccaacaggtacgaagtctcatcggaaatgaggagttcctggattacatgccatccatgaagcgattccggaaggaggaggagagcgagggagccatttggtga

SEQ ID NO: 25986 - RNA, 9873 nt, synthetic construct
  misc_feature 1..9873: note = derived and/or modified CDS sequence (opt11) from DENV-3__FJ390377__SS-prME
  source 1..9873: mol_type = other RNA
accagtctctgtctcatgatgatcctgcccgcggcactggcgtttcacctcacaagccgtgacggggagccccgaatgatcgtcggcaagaatgagcggggcaagagccttctgttcaagaccgcctccgggatcaacatgtgcaccctaattgccatggacctgggcgagatgtgtgacgacaccgtgacgtacaagtgcccacacatcaccgaggtggaacccgaggacatcgactgttggtgcaacctcaccagcacctgggttacctacgggacctgcaaccaagccggcgagcacagacgcgataaacggagcgtcgctctcgcgcctcacgtgggcatggggcttgacacacgcacccagacctggatgtcagccgaaggcgcctggcgccaggtcgaaaaggtcgagacctgggccctgcgccatccgggtttcaccatcctcgcgcttttcttagcgcactacatcggcacgtccctcacccagaaggtggtgatcttcaccctgctcatgctcgtcaccccaagcatgaccatgcgctgcgtgggggtggggaaccgcgatttcgtggagggcctgtccggggccacctgggtggacgtagttctggagcacggagggtgtgtgacaaccatggctaaaaacaaacccaccctcgacattgagttacagaaaaccgaggccacgcagctggctactctacggaagttatgcatcgaggggaagattacgaacatcactacggacagccgctgccccacacaaggcgaggccgtgctcccggaggaacaggaccaaaactacgtctgcaagcacacttacgtggatcgagggtggggtaacgggtgcggcctctttggtaagggcagcctggttacctgcgcgaaattccagtgcctggagcccatcgagggaaaggtcgtgcaatacgagaatctcaagtacactgtaataatcaccgtccacaccggggatcagcaccaggtaggtaacgagacacagggtgtcacggccgagatcacgccccaggccagcaccaccgaggcaatcctacccgagtacggcaccttagggttggagtgctcaccgcgcacggggctggacttcaacgagatgatactgttgacaatgaagaacaaggcgtggatggttcatcggcagtggtttttcgacctgcccctgccctggaccagtggcgccacgacggaaacgccgacctggaaccgcaaagagctcctggtgaccttcaagaacgcccacgccaagaaacaggaggtggtggtccttgggtcccaagagggcgcgatgcacacggccctaaccggcgccaccgagatccagaacagcggcgggacgtccatcttcgccggccacctgaagtgccggctgaagatggataagctcgagctaaaaggaatgagctacgccatgtgtacgaataccttcgtcttgaagaaggaggtgtctgagacgcagcacgggaccatacttatcaaagtggagtacaagggcgaggacgtcccgtgcaaaattccgttcagtacggaggacgggcagggcaaggcgcacaacggccgactgatcaccgctaaccccgtggtaaccaaaaaggaggagcccgtcaacatcgaggccgagccccccttcggcgagagcaatatagtgatcggcatcggggacaacgccctgaagataaactggtacaagaagggcagtagcatcgggaagatgtttgaggctactgcacggggcgcccgccggatggccatccttggcgacacggcctgggacttcgggtcggtgggcggggtcctcaacagcctgggcaaaatggtgcaccaaatcttcgggagcgcctataccgccttatttagcggcgtgtcgtgggttatgaagatcggcatcggggtgctcctgacttggatcggactgaacagcaaaaacacctccatgagcttctcctgcattgccatcgggatcatcaccttgtacttgggggcagtcgtccaagccgacatggggtgtgtgatcaactggaagggcaaagagctcaaatgtggcagcgggatcttcgtgactaacgaggtccacacctggaccgagcaatacaagttccaggctgattccccaaagcgcctagctacggccatcgcgggcgcatgggaaaatggggtgtgcggcatccggagcaccacgcggatggagaacctgctgtggaagcagatcgcaaatgagctcaactacatcctctgggagaacaacatcaaacttaccgtggttgtcggggacataataggcgtgctcgagcagggcaaacgcacgctgaccccccagccgatggagctgaagtacagttggaagacctgggggaaggcaaagatcgttaccgccgaaacgcagaacagctccttcatcatcgacggcccgaatacccctgagtgccccagcgcatcccgggcgtggaacgtgtgggaggtggaggactacggattcggcgtcttcaccaccaacatctggctcaaactgcgggaggtatacacccagttgtgcgaccaccggctcatgtcggccgcagtgaaagacgaacgcgctgttcacgccgacatgggctactggatcgagtcgcaaaagaacgggagctggaagctggagaaggcgtccctgatagaggtgaagacatgtacctggccgaagtcccacaccctatggagcaacggcgtgctggagtcagatatgattatacccaagagcctggcggggcccatttcccaacacaactatcggccggggtaccacacccagacggccggcccctggcacttgggcaagctagagttggacttcaactactgcgaggggactaccgttgtgatcaccgagaactgcgggacgcgcggccccagcctccgcaccaccaccgtgtcggggaagctgattcacgagtggtgctgtcgtagctgcacgctgcccccgctccgctacatgggggaggatggctgctggtatggcatggagatccgccctatcagcgagaaggaagaaaacatggtcaagagcctggtgtccgctggaagcgggaaggtggacaactttaccatgggcgtcctttgtctcgccatcctgttcgaggaggtgatgcgggggaagttcggcaagaagcacatgatcgcgggggtgtttttcacatttgtcctgctcctatccggacagataacctggcgcgacatggcccacacgctgatcatgataggcagcaatgcttcggaccgcatggggatgggagtaacatacttggccctgatcgccaccttcaaaattcagccattcctggcgctcgggtttttcctgcgcaagctgacctcgcgggagaacctcctgcttggcgtgggcctcgccatggcgacgaccttacagttgcccgaagatatcgagcagatggccaacgggatcgcgctcggcctgatggccctgaagctcataacccagttcgagacctaccagctctggacggccttgatcagcctcacctgctcaaacaccatattcaccctgacggtggcatggagaactgccacccttatcctcgcgggagtaagcctgctgccggtctgtcagtcaagctcgatgcggaagacggattggctccccatgacggtggccgcgatgggtgtgccccccctgccgctgttcatctttagcctcaaggacaccctgaagagacgctcctggcccctgaacgagggggtcatggccgtgggcctcgtcagcatcctggcctcaagcctgctgcggaacgacgtccccatggcgggccccctggtggccgggggcctgcttatcgcctgctacgtgatcaccgggacctccgccgacttgacggtagagaaggccgcggacgtcacgtgggaggaggaggccgagcagaccggtgtgagtcataacctgatgatcaccgtcgacgacgatggaaccatgcgtatcaaggatgacgagacggagaacattctcaccgttctgcttaaaaccgccctcttaatagtgtccggcatctttccgtatagcatccccgcgacattgctcgtctggcacacgtggcagaagcaaacccaacggtccggcgtactgtgggacgttcctagcccgccggagactcagaaggctgagctggaagagggggtctacagaatcaagcagcaaggcatcttcggcaaaacccaagtgggtgtgggtgttcagaaggagggagtgttccacacaatgtggcacgtgacacggggagcggtactcacctacaacgggaagcgcctggaacccaactgggcctccgtgaagaaggacctgataagctacggagggggctggagactctctgcccagtggcagaagggggaggaggtccaggtcatcgccgtggaacccggcaaaaatccaaagaacttccagaccatgcccggcaccttccaaaccaccaccggggagatcggcgcgatagccctggacttcaagccgggaacgagcggaagccccatcataaaccgcgagggcaaggtggtcgggttgtacggcaacggggtcgtcaccaagaacggcgggtacgtaagcggcatcgcccagaccaacgctgagccggacggcccaacccctgagctggaagaagagatgttcaaaaagcggaacttgactatcatggacctgcaccctggaagtggtaagactcgcaaatacctgccggccatcgtgcgggaggcgatcaagcgccggcttcgcaccctcatcctggcacccacgcgggtggtcgcagccgagatggaggaggctttgaaggggctgcccatccgctaccagacgaccgcgaccaagtccgaacacaccggccgggagattgtggacctgatgtgccatgccacgttcaccatgcgcctcctgagccccgtccgcgtcccgaactacaatctgatcattatggacgaagcacacttcaccgaccccgcgagcatcgccgcgcggggctacattagcactagagtgggcatgggtgaggcggcagccatcttcatgacggctacacctcccgggaccgccgatgccttcccgcagtccaatgcccccatacaggacgaggagcgtgatatccccgaacgcagctggaactccggcaacgagtggatcactgactttgccgggaagaccgtgtggttcgtccccagcatcaaggcgggcaacgacatcgcgaattgtctacggaagaacggtaagaaggtgatccagctgtcccgcaagacctttgacaccgaataccagaagactaaacttaacgactgggattttgtggtcacgaccgacatctccgaaatgggagccaatttcaaggctgaccgggtgatcgacccgcgccggtgcctaaagccagttatcctgaccgacggccccgagcgcgtcatcttagccgggcccatgccagtcaccgcggcctccgccgcccagcggcgaggacgggtcgggcgcaatccccagaaagaaaacgatcagtacatcttcactggccagcccctcaacaacgacgaggaccatgcccactggacggaggcgaagatgctgctggacaatatcaacacccccgaggggatcattccggccctcttcgagcctgagcgagagaagtctgccgccatcgacggggaataccgcctgaagggcgagtcccggaagacattcgtcgaactgatgcgcaggggggacttacccgtgtggttagctcataaggtcgccagcgagggcatcaagtacaccgaccgcaaatggtgcttcgacgggcagcggaacaaccagatcctggaggaaaacatggacgtggagatctggacgaaggagggcgagaagaagaagctccgccccaggtggctggacgcgcgcacctactccgacccgttggccctcaaggagttcaaagacttcgccgcgggccgtaagagcatcgccctagatctggtaaccgagatcgggcgggtcccctctcacctcgcgcatcggacgcggaatgccctagacaatctggtgatgctccatacgagcgagcacggtgggaaggcgtaccgccacgcggtggaggagctgcccgagacaatggagaccctgcttcttttaggcctcatgatcttgctgacgggtggcgccatgctattcctgataagcggaaaggggattggcaagactagcatcggactgatctgcgtcatagccagctcaggtatgctctggatggctgagataccgctccagtggattgcgtctgcgatagtgctggaatttttcatgatggtactactgatccccgagcccgagaagcagcgtacaccccaagataaccagctcgcctacgtggttatcggtatcctcacgcttgcagccattatcgccgcgaacgaaatgggcctgctcgagaccacgaaacgcgacctgggcatgtccaaggagccgggggttgtcagccccacctcttatctggacgtggacctacaccccgccagtgcgtggacactatacgccgtggcgaccacggtcatcacccccatgctacgacacaccatcgagaattccaccgccaatgtgagcctcgccgccatcgccaatcaggcggttgtcctgatgggcctggataaggggtggccgatctccaaaatggacctcggcgtgccactgctggccctcgggtgttacagccaagttaacccccttacgctgacggccgccgtcctcctgttgatcacccactatgccatcatcggccccggcctacaagcgaaggccacccgcgaagcccagaagcgaacggcggccggtatcatgaagaacccgaccgttgatggcattatgaccatcgacttagatcctgtgatctacgattccaagttcgagaagcagctgggacaggtcatgctcctggtgctatgcgccgtgcagctcctgctgatgcgcacaagctgggccctctgtgaggccctgacgctggccaccggccccattaccacactctgggaagggtcccccgggaaattctggaacacgaccatcgcggtcagcatggccaacatcttccggggatcctacctggccggagccggcctggcattttcgattatgaagagtgtggggaccggcaagcgcggcaccgggagccagggcgagaccctcggcgagaagtggaagaagaagcttaaccagctgagccgtaaggagtttgacctctacaagaagtctgggataactgaggtggaccgcaccgaggcgaaggaggggctcaaacggggcgaaataacacaccacgcggtcagccgcggctctgccaagttacagtggtttgttgagcggaacatggtgattccggaggggagagtcatcgatctcggatgcgggcggggcgggtggagttactactgcgcaggactgaagaaggtcaccgaagtaagaggctacacaaagggcggacccggtcacgaggagccagtgcccatgtccacctatggctggaacatcgtaaagctgatgagcgggaaagacgtgttctatcttccacccgagaaatgcgataccctgctctgcgacatcggcgagtccagccccagccctaccgtagaagagtcgcgcacgatcagggttctgaagatggtggagccgtggctcaagaataatcagttctgcatcaaggtcctaaacccctatatgccaaccgtgatcgagcatctggagcgcctccagcgtaaacatggcggcatgctggtgagaaacccgctatcccggaacagtacccacgagatgtattggatctccaacggcacaggtaacatagtcgcctctgtgaacatggtgtccaggctcctccttaaccggttcaccatgacccaccgccggcccactatagagaaggatgtcgatctcggcgcaggcacccgccacgtgaacgccgagcccgagacgcccaacatggacgtcatcggggagcggatcaagcgcatcaaggaggagcacaacagcacctggcactacgatgacgagaacccgtacaagacctgggcctaccacggctcctacgaggtcaaggcgaccgggagcgcctcaagcatgatcaacggcgtcgtcaagctgttgacgaagccctgggatgtggtgcccatggtcacccagatggctatgaccgacacaacgcctttcgggcagcagcgcgtgttcaaggagaaagttgacacccgcaccccacggagcatgcccggtacacgccgggttatgggcatcacggccgagtggctctggcgaaccctagggagaaacaagaaaccccgcctctgcacccgggaggagttcaccaagaaggtcagaacgaacgctgcgatgggcgctgtgttcactgaggagaatcagtgggactccgccaaggccgcggtggaggacgaggatttctggaaactcgtggacagagagcgggagctgcacaagctagggaagtgcggtagctgcgtctacaatatgatggggaagcgcgagaaaaagctcggcgaattcggcaaagcgaagggttctcgggccatctggtacatgtggctgggcgcccgctacttggagttcgaggccctcgggttcctgaacgaagatcactggttcagccgggagaactcatatagcggtgtagagggggagggcctgcacaagctcggctatatccttcgcgacatctccaagatccccgggggcgccatgtacgccgacgacaccgcggggtgggacacccgcattacggaggatgacctgcacaacgaggagaagatcacccagcagatggacccggagcaccgccagctcgccaacgcgatattcaagctgacataccagaacaaggtggtgaaggtccagcgcccgacccccaccggcacggtgatggacatcatctcacgcaaggaccagcggggctccggccaagtgggcacctatggtctgaacaccttcaccaacatggaagcccaactcatacgccagatggagggcgaaggggtcctgagcaaggccgacctggagaatccccacctcccagagaagaagattacgcagtggctggagactaagggcgtggagcggctgaaaagaatggcgatctccggcgacgactgcgtggtcaagccgatcgacgaccgtttcgccaacgccctcctggcactcaacgatatgggcaaggtgcgcaaggacattccccagtggcagccaagcaagggctggcacgactggcagcaggtcccgttctgctcccaccacttccatgagctcattatgaaggacgggcggaagctggtggtgccctgccgcccccaggatgagctgatcggacgggcaaggataagccaaggcgccggatggtcgctgcgggagacggcttgtctgggcaaggcctacgcccagatgtggagccttatgtacttccacagacgcgatctgagactggcgtccaacgccatctgcagcgccgtgcccgtccactgggtacccacctcacgcacgacctggagcatccacgcgcaccatcaatggatgaccaccgaggacatgctaacggtgtggaaccgtgtctggatagaggacaacccatggatggaggacaagacccccgtgaccacctgggagaacgttccttacctcgggaagcgcgaagaccagtggtgcggcagcctgatcgggctgacatcccgggctacctgggctcagaatatcccaaccgccatccagcaagtgcgctcattaatcggcaacgaagagttcctggactacatgccgagcatgaaacggttcagaaaggaggaggagagcgagggggctatctggtga

SEQ ID NO: 25987 - RNA, 9873 nt, synthetic construct
  misc_feature 1..9873: note = derived and/or modified CDS sequence (opt11) from DENV-3__FJ547069__SS-prME
  source 1..9873: mol_type = other RNA
accagcctgtgtctcatgatgatcctccccgccgcgttggcgttccacttaaccagccgcgacggtgagccgcggatgatcgtgggtaagaacgagcgcggcaagagcctactgttcaagaccgcctccgggattaacatgtgcacactcatcgcaatggatctgggcgagatgtgcgatgacaccgtgacttacaagtgcccccacattacggaggttgagcccgaagacatcgactgctggtgcaatctcactagcacctgggtgacctacgggacgtgcaaccaggccggcgagcacaggcgcgacaagcggagtgtcgccctcgctccccacgtgggaatggggctggatacgcgcacccagacctggatgtctgcagagggcgcgtggcgacaggtggagaaggtcgagacttgggcactgagacatcccgggttcaccatcctggcgctgttcttggcccactacatcggcacctcactaacccagaaggtggtgatctttatcctgctgatgctcgtcacgcccagcatgaccatgcggtgcgtaggagttggcaaccgcgacttcgtcgaaggcctgtccggggccacttgggtggacgtggttcttgaacacggcgggtgcgtgaccacgatggctaagaacaagcccaccctggacattgagctgcagaagaccgaggccactcagctggcaacgctccgaaaattgtgtatagagggcaagatcacaaacatcaccaccgacagccgctgccccacgcagggcgaggctgtgctcccagaggagcaggatcaaaactacgtctgcaagcacacctacgtggaccgggggtgggggaacggatgcggattgttcggaaaaggctccctggtaacctgcgccaaattccagtgcctggagccaatcgagggcaaggtcgttcagtacgaaaacctcaaatacaccgtgatcatcacggtccacacaggcgatcaacaccaggtgggtaacgagactcagggggtaaccgccgagataacgccccaggcctcaaccacggaagcgatcctgccggagtatggcaccctggggctcgaatgctccccgcggacgggtttggacttcaacgagatgatactgttaacgatgaagaacaaggcctggatggttcaccgacagtggttcttcgaccttcccctcccttggaccagcggggccacaaccgagactcccacctggaaccgcaaggagctcctggtgacatttaaaaacgcccacgccaaaaagcaggaggtagtggttcttgggtcccaagagggtgcgatgcacacagccctaaccggggcaacagaaatccagaacctgggagggacgagcatcttcgccggccacctgaagtgccggttaaagatggacaaactggagctgaagggtatgtcctacgcaatgtgcaccaacacgttcgtcctcaaaaaggaggtttcagagacccagcacgggactatactgatcaaggtggagtacaaaggcgaagacgtgccgtgcaagatccccttctccaccgaggacgggcagggcaaggctcacaatggccgcttgataacggccaaccccgtggtgaccaagaaggaggagccagtcaacatagaggccgagccgccgtttggggaaagcaacatcgttataggcatcggagacaacgccctgaagattaattggtacaagaaaggtagctcgatcgggaagatgttcgaggctaccgcccggggcgctcgacggatggccatactcggtgataccgcctgggatttcggcagcgtgggaggggttctaaactccctgggaaagatggtgcatcagatcttcggcagtgcatacactgctctcttctccggtgttagctgggtcatgaaaatcgggatcggagtgctattaacctggatcggcctgaactctaagaacaccagcatgtcctttagctgcatcgccatcgggatcatcacgctctacttaggagcagttgtccaggccgacatggggtgcgtgatcaactggaagggcaaggaactcaaatgcggctccgggatcttcgtgacgaacgaggtccacacatggaccgagcagtataaatttcaagccgatagccccaaacgcctggccaccgcaattgctggagcctgggagaacggagtatgcggcatccgctccactaccagaatggaaaacctgctgtggaagcaaatcgcgaacgagctgaactacatcttatgggaaaataatattaagctcaccgtcgtcgttggggacattatcggcgtgctggaacagggcaagcgcacgctgacgcctcagccgatggaattaaagtacagctggaagacttggggaaaagctaagattgtaaccgccgagacccaaaattctagcttcattatcgacggccccaacacgcctgagtgcccctccgccagcagggcctggaacgtttgggaggtggaagactacgggttcggcgtttttaccacaaacatctggctaaagcttcgagaggtgtatacccagctttgcgaccacagactcatgagtgcggctgtcaaagatgagcgcgccgtacacgccgatatgggatactggatcgagagtcagaagaacggaagctggaagttagagaaggcgtccctcattgaggtgaagacttgcacgtggcccaagagccacaccctttggtcaaacggggtattggagtctgacatgatcatccccaagtccctggccgggcccatcagccagcacaattatcggccgggctaccacactcagaccgccgggccctggcacctgggcaagctggagctcgacttcaactactgcgagggcactaccgttgtgatcacggagaactgcggaacccgcggcccttccctgcgaacgaccaccgtgtcaggaaagttaatccacgagtggtgctgtcgctcctgtacactaccgcccctgcgatacatgggcgaagacggatgctggtacggtatggagattagacccatcagcgagaaggaggaaaacatggtcaagtccctcgttagcgccggatccgggaaggtggataacttcacaatgggcgtcctctgcctagccatcctgttcgaggaagtgatgcgggggaagttcgggaagaagcacatgatcgcgggggtgttcttcacctttgtcctccttctgtcaggacagatcacctggcgcgacatggcccacaccctcatcatgatcggatcaaacgcctcggaccggatggggatgggcgtgacttacctggccctgatcgccaccttcaagatccagcctttcctcgcgctaggattcttcttacgcaagttaacctcccgggagaacttgctgctcggcgtcggcctggccatggccaccacgctacagcttcccgaagacatcgagcagatggccaacgggatcgcgttaggtctcatggccctcaagctgatcacacaatttgagacctatcagttgtggaccgcgctcattagccttacgtgctctaacaccatctttacattaacagtagcctggagaaccgccaccctcatactggcgggtgtctccctgctccccgtctgccaaagctccagtatgcggaagactgattggctgcccatgaccgtggccgccatgggggtaccgcccctacccctgttcattttctccctgaaggatacgctgaagcggcgcagctggcccctcaacgagggtgtcatggcggttggtttagtgtccatacttgccagctccctcctgcggaacgacgtccccatggcgggccccctggtggccgggggcctactgatagcgtgctacgtgatcaccggcacctccgctgacctgacagtcgagaaggccgcggacgtaacctgggaagaagaggccgagcagaccggcgtgtctcacaacctcatgatcacagttgacgacgacgggacaatgcgcatcaaggacgacgagaccgaaaatatccttacggtgctactcaagaccgccctcctgatcgtcagcggcatcttcccgtattccatacccgccaccctgctggtgtggcatacctggcagaagcagacgcaacggtccggagtgctgtgggacgtgccatctcccccagagacccagaaagccgagctcgaagagggggtctaccggataaagcagcagggcatcttcgggaagacccaggtgggcgtcggagtccagaaggagggcgtgttccacaccatgtggcatgtgacgcggggtgctgtgctgacctacaatgggaagcgcttggagcccaactgggccagcgtgaagaaggacctcatctcctacggcgggggctggcggctgagcgcccagtggcaaaaaggggaggaggtgcaggtgattgccgtggagccgggtaagaaccccaagaacttccaaaccatgccgggcactttccagacaaccactggggagatcggagccattgccctggactttaaacccgggacctccgggagcccgatcatcaaccgcgaaggcaaagtggttggactgtacggcaacggggtggtgacaaagaatggtgggtacgtcagcggcatcgctcagacgaacgcggagcctgacggcccgacacctgaactcgaagaggagatgtttaagaagcggaacctgaccatcatggacctgcaccccgggtccggcaaaacgcgcaagtacttgccggccatcgtgcgggaagcaataaaacgccggctgcgcaccctgatcctcgcccccacccgggtagtcgccgccgagatggaggaggccctgaaggggctgcccatccgctaccagacaacggcgaccaagagcgagcacaccggccgggagatcgtcgacctcatgtgtcatgccaccttcacgatgcgccttctgagtccagtgcgcgtcccgaattacaacctcatcattatggacgaggctcacttcacagaccccgcgagcatcgcggcccgcgggtacatctcaacgcgggtgggcatgggcgaagccgccgcgatttttatgaccgccactccgcccgggaccgccgatgccttcccgcagagtaatgcgcccatccaagacgaggaacgcgacatacccgagcgatcgtggaatagcggcaacgagtggataaccgacttcgccggtaagaccgtatggttcgttccctccataaaggctgggaacgacatcgcgaactgtctccggaagaacgggaaaaaggtcatccagctcagccgcaagacgtttgataccgagtaccaaaagaccaagctaaacgactgggacttcgtggtgacgacggacatctccgaaatgggcgcaaattttaaagccgaccgagtcatcgacccgcgccggtgcctgaaacctgtgatcctgaccgacggaccagagagagtaatactcgcagggccgatgcccgtgactgcggcctctgccgcccagcggagaggccgggtggggaggaacccacagaaagaaaacgatcagtacatattcacgggccagcctcttaacaacgacgaggaccacgcccactggaccgaggcgaagatgctcctcgacaacattaatacgcccgaggggatcatcccggccctgttcgaacccgagcgggaaaaatcagcggccatagacggtgagtaccgcctaaagggggagagcaggaagaccttcgttgaactaatgcggcgcggggacctgcctgtgtggctggcacacaaggtcgcctccgagggcatcaagtacacggaccggaagtggtgcttcgacggccagcggaacaatcagatcctcgaggagaacatggacgtggagatctggacgaaggagggtgagaagaagaaactgaggccccggtggctggatgcccgcacgtattccgacccgctcgccctgaaggagttcaaggacttcgcggccggccgcaaatcaatcgccctcgacttagtgaccgaaatcggacgggtccccagccacctggcccaccgcacccggaacgcgctggataacctcgtgatgcttcatacctcagaacacggagggaaggcgtaccgccacgcggttgaggagttgcccgaaacgatggagaccctcctactgctcggtctgatgattctgctgaccggtggtgccatgctgttccttatcagcgggaaaggcattggcaagacctccatcggtctcatctgcgtcatcgcatcaagtggcatgctttggatggccgagatcccgctccagtggatcgcctccgcaatcgtgctcgagttcttcatgatggtgctgcttattcccgagcccgagaagcagcgaacgccccaggacaaccaactggcctacgtcgttatcgggatcctaaccttagccgccatcatcgcagcgaacgaaatgggcctcctggaaaccaccaagcgcgatctgggtatgagcaaagagccgggggttgtctcccccacgagctacctcgacgtggacctgcatcccgcctccgcttggacactgtatgccgtggcaaccacggtcatcacgcccatgctccggcatactatcgagaacagcacagctaacgtgtcattggccgccatcgcaaaccaggcggttgtccttatgggactcgacaaagggtggccgatctctaagatggatctgggcgtcccactgctcgccctggggtgctactcccaagtgaaccccctaaccctcacggccgctgtcttgctgctcataacccactacgccatcatcggccccggtctgcaagcgaaagctacccgcgaggcccaaaagagaactgccgccgggatcatgaagaacccgacggtggacggcatcatgacaatcgacctggacccggtgatatatgatagcaagtttgagaaacagctcgggcaggttatgttgctggtgctctgcgcggtgcagctgctgctcatgcgcacttcctgggccctctgcgaggccctgacccttgccacaggccccatcaccactctgtgggaaggcagccctgggaaattctggaacactacgatcgcggtctccatggccaatatattccggggcagctacctggccggggccggcctagccttctccatcatgaagtccgttgggacaggcaaacgtggcactgggagccaaggtgaaaccctgggagagaaatggaagaaaaagctgaaccagctcagccggaaggagttcgacttgtacaagaagtccggaatcaccgaggtggacagaaccgaagcgaaggagggtctaaaaaggggagaaatcacccaccacgcggtctcccgcggttctgccaagctccagtggttcgtggagcgcaatatggtgatccccgaggggcgcgtcattgacctaggctgcggtcgcggcgggtggtcttactactgtgccggcctgaaaaaggtgactgaggtgaggggttacaccaagggcgggcccgggcatgaggaacccgtccctatgagcacgtatggctggaacatcgtaaagttgatgtccggaaaggatgtgttctatctgccacccgaaaagtgtgataccttactgtgcgacataggtgaaagctcccccagcccaactgtagaagagtcccggaccattcgcgtgctcaaaatggtcgagccgtggctgaagaacaaccaattttgtatcaaggtcctgaatccctacatgcccactgttattgaacatttagaacgcctccagcgaaagcacggcgggatgctggtgcgcaaccccctctcaaggaactccacacacgaaatgtactggatcagcaacgggaccgggaacattgtcgcttccgtgaacatggtgagcagacttcttctcaaccggttcaccatgactcaccgacggccgaccatcgagaaagatgtcgatctaggcgcgggcacccgccacgtgaacgccgagcccgaaacccccaacatggacgtcattggggagcgtattaaacgcatcaaggaagagcataactccacgtggcactacgacgacgagaatccttacaagacctgggcgtaccacggcagctacgaggtcaaagccactgggtcagcctcatctatgataaacggcgtggtcaagctcctcaccaagccctgggacgttgtacccatggtcactcagatggctatgaccgacacgacccccttcgggcagcagagggtgttcaaggagaaggtggacactcggacgccgcggagcatgcccgggacccgccgggtcatgggcatcacagccgagtggctgtggcgtacccttggtcggaacaagaagccacgcctctgcacgagagaagagttcactaagaaggtgcgcaccaatgccgccatgggcgcggtgttcacagaggagaaccagtgggacagcgctaaggccgcggtcgaggatgaggacttctggaagcttgtggaccgggagcgggagctgcacaagttgggcaaatgcggctcctgcgtctataacatgatgggaaagcgggagaagaagctgggagaattcggcaaggccaagggcagccgggcgatctggtacatgtggctgggcgcccgttaccttgagttcgaagcactggggtttctcaatgaggaccactggttctccagagagaactcttatagcggcgtcgaaggggagggcctccacaagctgggctacatactgcgcgacatcagcaagattccggggggcgccatgtacgcagatgataccgcgggctgggacacccgtatcaccgaggatgacctacacaacgaggagaagataacgcagcagatggacccagagcaccgccaactggccaacgccattttcaaactgacctatcaaaacaaggtcgtgaaggtccagcggcccacgcccaccggcaccgtcatggacataatctcaagaaaggatcagagaggcagcggccaggtaggcacgtacggactcaacaccttcaccaacatggaggcccaactcataaggcagatggagggcgagggggtcctgtccaaggccgacctcgagaacccccacctcccagagaaaaagatcacccagtggctggagacgaagggcgtggaacgtcttaaacgcatggcgataagcggcgacgactgcgtggtgaagcctatcgacgaccggttcgccaacgccctcttagcgttaaacgacatggggaaggtgcgaaaggacatcccccagtggcagccttctaagggatggcacgactggcagcaggtcccgttctgcagccaccacttccacgagctgattatgaaggacgggcggaagttggtggttccatgcaggccccaggacgagctcataggccgggcgcgcatctcccaaggggcgggttggagcctccgggaaaccgcctgcctcggcaaggcctacgcccagatgtggagcctcatgtattttcaccgccgtgacctgaggctggcctcaaacgccatctgctccgctgtgccagtccactgggtgccaaccagccgtaccacgtggtcgatccacgcccaccatcagtggatgaccaccgaggacatgttaaccgtttggaaccgggtctggatcgaggacaacccctggatggaggataaaacgccagttaccacatgggagaatgtaccatacctggggaagcgcgaggaccagtggtgcggcagtctgattggtctcaccagccgggccacgtgggcgcagaacatcccgacggccatacagcaggtccgctccctgattggcaacgaagagttcctggactacatgccctctatgaagcgatttcgaaaggaggaggagtccgagggggctatctggtga

SEQ ID NO: 25988 - RNA, 9873 nt, synthetic construct
  misc_feature 1..9873: note = derived and/or modified CDS sequence (opt11) from DENV-3__FJ562107__SS-prME
  source 1..9873: mol_type = other RNA
accagcctgtgcctcatgatgatcctgcccgcagcgctcgcttttcacctcaccagccgggatggcgagccccggatgatcgttgggaagaacgagcgcgggaagtccctgcttttcaagactgcaagcgggatcaacatgtgcaccctcatcgccatggacctgggcgagatgtgcgacgacaccgtgacctacaagtgtccccacatcacggaggtggagcccgaggacatcgactgctggtgtaacctgacgagcacgtgggtgacctacgggacgtgcaaccaggccggcgaacaccggcgcgacaagcggtccgtagccctcgcgccccatgtgggcatgggcctggacacccgtacccagacatggatgtcagccgagggtgcttggcggcaggtagagaaggtcgagacgtgggccctgcgccaccctgggttcacaatcctcgctctgttcctggcacactacatcggtacctccctcacccagaaggtggttatcttcatcctgctgatgctcgtcacgccctcaatgaccatgaggtgtgtcggggtgggcaacagggacttcgttgaggggctgtccggggccacctgggtggacgtggtcctggagcatggcgggtgcgtgaccacaatggctaagaacaagcccaccctcgatatcgagctgcaaaagaccgaagccacccaactggcgacgctccgcaaactttgcatagagggcaagataaccaacattaccaccgactcccggtgccccacgcagggcgaggccgtgttgcctgaggaacaggatcagaactacgtgtgcaagcacacctacgtcgaccgggggtggggcaacgggtgcggactcttcgggaagggatcgctggtgacctgcgccaaattccaatgtctggagcccatcgagggcaaggtcgtgcagtacgagaacctcaaatataccgtgatcattacggtacacaccggggaccagcaccaagtaggcaacgagacccagggggtcaccgccgagataacgccccaggcctcgaccaccgaagcgatcctgcccgagtatggcactctgggtctcgagtgctccccgcgcacgggtctggatttcaacgagatgatcctgctcacgatgaagaataaggcctggatggtgcaccggcagtggttcttcgatctgcccctgccctggaccagcggcgccacaactgagacgcccacctggaataggaaggaattactggtgaccttcaagaatgcccacgctaagaaacaggaggtggtcgtgttagggtcccaggagggggcgatgcacaccgcattgacgggggccaccgagatccagaactcgggcgggacctccatctttgccggtcacttaaagtgccggctgaaaatggacaaactcgagctgaaaggcatgagctacgccatgtgtaccaacacgtttgttctgaagaaggaggtgtccgagacccagcatgggaccattctcatcaaagtggagtacaagggcgaggacgtcccgtgcaagatcccgttcagtaccgaggacggtcagggcaaggcgcacaatggccgcctgatcacggccaaccctgtggtcaccaagaaggaagaaccggtcaacatcgaagccgagccacccttcggggagagcaacatcgtgattggaatcggggacaacgccctgaagatcaactggtacaaaaagggatcttccattggcaagatgttcgaggcaaccgcccggggcgcccgccggatggcaatactgggcgacaccgcctgggacttcgggtccgtgggcggggtcctaaatagcctgggcaaaatggtgcaccagatattcgggtcggcgtacactgccctgttctccggcgtatcctgggtaatgaagatcgggatcggagtcctcctgacctggatcggcctgaacagcaagaacacctccatgtcgttttcctgcattgttatcgggatcatcaccctctatttgggcgccgtagtgcaggccgacatgggatgcgttattaactggaaggggaaggagctgaagtgcggcagcggcatcttcgtgacgaacgaagtgcacacctggaccgaacagtacaagttccaggctgactcccccaagcgcttagcgaccgccatcgccggcgcctgggagaatggtgtgtgcggcatccgcagcacgacccggatggagaacctgctgtggaagcagatcgcaaacgaactcaactacatactgtgggagaacaacattaagctgactgtcgtggtgggggacatcattggcgtcctcgagcaaggcaagcgcaccctgacgccacagccgatggaactgaaatactcatggaagacctggggtaaggcgaaaatcgtgaccgccgaaactcagaactcgtcctttatcatcgacggccccaacacgccagagtgccccagcgcctcccgggcctggaacgtgtgggaggtcgaggactacgggttcggagtgttcaccaccaacatatggctcaaactgcgcgaggtgtacacccagctatgcgaccaccggctcatgtcggcggccgtcaaagacgagagagccgttcacgccgacatggggtactggattgagagccagaagaacggttcctggaagctggagaaggcgtcacttatcgaggtcaagacatgcacgtggccgaagtcccacactctgtggagcaatggagtcctcgagtccgacatgatcatccccaagagcctagcggggcccatctcccagcacaactaccggccgggttaccacacccagacggccggtccctggcacttgggcaaattggagctggacttcaattactgcgagggcacgaccgtggtgatcaccgagaactgcgggacccgcgggcccagcctccggacaaccaccgtctccgggaaactaatacacgaatggtgctgccgctcttgcactttgcccccgctccggtacatgggcgaggacgggtgctggtacggcatggaaatccgccccatctccgagaaggaggagaacatggtcaagagcctggtgtcagccggcagcggcaaggtcgacaactttacgatgggggtgctctgcctcgccatcctgttcgaagaggtaatgagggggaagttcgggaagaagcacatgatcgctggagtcttcttcaccttcgtgctgctactgtccggccagatcacctggcgcgacatggcgcataccctgatcatgattggcagcaacgcatccgaccggatgggtatgggcgtgacgtacctggccttgatcgccaccttcaagatccagcccttcttagcgctcgggttcttcctcagaaagctgaccagccgggagaatcttctactgggcgtcggcctcgcgatggccacaacactgcaactacccgaggacatcgagcagatggccaacgggattgccctcggcctgatggcgctgaagctcattactcagttcgaaacctaccagttgtggaccgcgctgatcagcctcacgtgttccaacacgatcttcaccctaaccgtggcgtggcgaacggcgaccctgatcctggccggggtctctctgctgccggtgtgccagtcgagctccatgcggaagaccgactggctccccatgaccgttgcggccatgggtgtgcctcccttgccgctgttcatcttctcgcttaaggacacgctgaagaggcgctcctggccactgaacgagggagtaatggccgtgggcctcgtcagcatcctcgcgtccagtctgctccggaacgacgtacccatggccggccctctggtggccggcgggctcctcatcgcctgctacgtcatcacaggaacctccgcggacctgacagttgaaaaggccgcggacgtgacgtgggaggaggaggcggagcagaccggggtcagccacaacttaatgattaccgtggacgacgacgggaccatgcgcatcaaggacgacgaaacagagaacatcttaaccgtgctgctgaaaacagccttgcttatcgtctccggcatcttcccatactcgatccccgccaccctgctggtgtggcacacctggcagaagcaaacgcagcggtccggcgttctgtgggacgtccccagcccgcccgagacccagaaggccgagcttgaggagggggtataccgcatcaagcaacagggcatattcgggaagacacaggtgggcgtaggggtgcagaaggagggcgtgttccacacaatgtggcacgtcacgcggggcgcagtgctaacttacaacgggaagcggctggagcccaactgggcgtccgtgaagaaggatctgatcagctatggcgggggctggcggctcagcgcccagtggcagaagggggaagaggtacaggtgatcgcagtggagcccggcaagaaccccaagaacttccagactatgccaggaacctttcagacgaccaccggagagatcggcgccatcgcgcttgacttcaagcccgggaccagcggcagcccgatcatcaaccgcgaaggcaaggtagtggggctgtacggcaacggggttgtaacaaagaatggagggtatgtgtcaggaatcgctcagaccaacgccgagccggacggccccacgcccgagctggaggaggagatgttcaagaaacggaatttgaccatcatggacctgcaccccgggtccggcaagacgcgcaagtacctgccggccatcgtacgcgaggctatcaagcgccggctccgcacactgatcctggcgcccaccagggttgtggccgccgagatggaagaggcactcaaggggctgcccatccgctaccagaccacggcgaccaagtccgagcacaccggccgggagattgtggatctaatgtgtcacgcaaccttcacgatgcgccttctgagccccgtcagggttcccaactataacctaataatcatggacgaggcccacttcaccgaccccgcctccattgccgcccgcgggtacatcagcacccgggtgggcatgggcgaagcggccgccatcttcatgactgccaccccgcccgggaccgcggacgccttcccgcagagtaacgcccccatccaggacgaagaacgcgacatccccgagcgcagctggaatagcggcaatgagtggatcaccgatttcgctgggaagaccgtctggttcgtgcccagcataaaggccggcaacgacatagcgaattgtttacggaagaacgggaagaaggtgatccagctgtcccgcaagacattcgataccgaataccagaagacaaagctgaacgattgggacttcgtcgtgaccacagacatcagcgagatgggcgccaacttcaaggccgaccgagtgatcgacccgcgccggtgcctcaagcccgtcattctgaccgacggccccgaacgcgtgatcctggcagggcccatgccggttacagcggcctccgccgcacagcggcgcggccgggtcgggcgcaaccctcagaaggagaacgaccagtacatcttcaccggccagcccctcaacaatgacgaggaccacgctcactggaccgaggccaagatgcttctcgacaacatcaatacacccgaggggatcatcccggccttattcgaacccgagcgggagaagtccgccgccatcgacggcgagtacagattaaagggcgagtcccggaagacattcgtcgagttgatgagacgcggggatctcccggtctggctggcatacaaggtggcgtccgagggcatcaaatacaccgaccgcaagtggtgctttgatgggcagaggaacaaccaaatcctggaggagaacatggacgtggaaatctggacgaaggagggagagaagaagaaacttcgcccccggtggctagacgcccgcacctactccgacccgctagccctgaaggagttcaaggacttcgccgccggccgcaagagcatcgcgctggacctggtcaccgaaatagggcgggtgccctcccacttagcccaccggacccggaacgccctggacaacctggtgatgttacataccagcgagcacggcgggaaggcttaccgccatgccgttgaggaactccccgagacgatggaaaccctgctcctgctcggcctcatgattctcctgaccgggggcgcgatgcttttcttaataagcggcaaagggatcggcaaaacctctatcgggctaatctgcgtgatcgccagcagtggcatgttatggatggcggagatccccctgcagtggatcgcctcagctatcgtgctggagtttttcatgatggtcctcctgatccccgagccggagaagcagcggacgccccaagacaaccagctagcatacgttgtgatcggtatcttaaccctggccgccatcatagccgccaatgagatgggcttactcgagaccacaaagcgcgacctgggcatgtccaaggagcccggggttgtcagccccacgtcctacctggacgtggacctccaccccgcgtcagcatggaccctctacgcagtcgccactaccgtgataacgcctatgctgcgacacaccatcgaaaactccaccgcgaacgtgtctttagccgccatcgccaaccaagctgtggtgctgatgggcctggacaaggggtggcccatctccaagatggacttgggcgtccccctcctggcactggggtgttacagccaggtcaatcccctgaccttaacggccgccgtgctcctcctgatcactcactatgccatcattggacccggcctccaggccaaggcgacccgcgaggcccagaagcggaccgccgccgggattatgaaaaacccgacggtggatggcatcatgaccatcgacctagaccccgttatctacgattccaagttcgagaagcagctaggccaggtgatgctcctggtgctgtgtgccgtccagctgctgctgatgcgcacgagctgggcgctctgcgaggcactgaccctggccacgggcccaatcaccaccctgtgggagggctcccccgggaaattctggaacactacgatcgccgtgagcatggcgaacatcttccggggctcctacttggccggggccggcctggccttctccatcatgaagtctgtggggacaggcaaacgcggtacggggagccagggcgagaccttaggggagaagtggaagaagaagctgaaccaactgagccggaaggagttcgacctctacaagaagtccggaatcaccgaggtcgaccgcacggaggccaaggaggggctgaagcggggcgagattacccaccacgcggtgagccgcggctcggcgaagctgcagtggttcgtggagaggaacatggtcataccggaaggtcgcgtgatcgacctcggctgtgggcggggagggtggagctactactgcgccgggctgaagaaggtgaccgaggtcagaggctacacgaaaggcgggcccgggcacgaggagccggtgccgatgtccacgtacggatggaacatcgtgaagttaatgagcgggaaggacgtcttctatctcccgcccgagaaatgcgacaccctgctgtgcgacatcggagagtccagcccctctccgaccgtggaggagagccggaccatccgtgtgctgaaaatggtcgagccctggctcaagaacaaccagttctgcatcaaggtgctgaacccctatatgcccacggtcatcgagcatctggagcgtctccagcggaagcacgggggtatgctggtacgcaaccccctgagtcggaacagcacccacgagatgtactggatctccaacggcaccggcaacatagtggccagcgtgaacatggtctcccgcctcctgttaaaccggttcaccatgacgcaccgccgaccaaccatagagaaggatgtggacctcggcgccggcacccgccacgtgaacgctgagcccgaaacccctaacatggacgttatcggggagcggatcaagcgcatcaaggaagaacacaactcaacgtggcactacgacgacgagaacccgtacaagacctgggcctaccatggctcctacgaggtgaaggccaccggcagcgcttccagcatgatcaacggcgtcgttaagctgctgaccaagccctgggacgtggtccccatggtgacgcagatggccatgaccgacacaaccccttttggtcagcagcgggtgttcaaggagaaggtcgacacgcgtaccccgcggagcatgcccggcactcggcgggtgatgggcattaccgccgagtggctgtggcgcacgcttggccggaacaagaagccccgcctatgcaccagagaagagttcaccaagaaggtgcgaacaaacgcagccatgggcgccgtcttcactgaggagaaccagtgggactccgcgaaggccgccgtggaggacgaggacttctggatcctcgtggaccgcgagcgggagctgcacaagctggggaagtgcggcagctgcgtctacaatatgatggggaagcgcgagaagaaactcggcgagttcggcaaggctaaggggtcgagggccatctggtatatgtggcttggcgcgcgctatttggagttcgaggctctcgggttcctgaacgaggaccactggttctcacgggagaactcctacagcggcgtggaaggggaaggcctgcacaaactaggctacatactgcgggacatctccaaaatcccagggggcgccatgtacgccgacgacaccgctggctgggacactcggatcacagaggacgacctgcacaacgaggagaagattactcagcagatggacccggagcaccgccaactcgcgaacgctatcttcaaactaacttaccaaaacaaggttgtcaaggtgcagcggcccacccccacaggtaccgtcatggacataataagccgcaaggaccagcgcggtagtgggcaagtcggcacgtacgggctgaacaccttcaccaacatggaggcccagctcatcagacagatggagggtgagggggtgctgagcaaggccgacttagagaacccccacctccctgagaagaagatcacccagtggctggagacgaagggggtggagaggcttaaacgcatggccatatccggcgatgactgcgtcgtgaagccaatagacgacagattcgcaaatgccctcctggccctgaacgatatggggaaggtgcgcaaggacatcccccagtggcagcccagcaagggttggcacgactggcagcaggtcccgttctgctctcatcacttccacgagctcataatgaaggacggccgtaaacttgtggtgccttgccgcccccaggatgagctaatcggccgggcccgcatcagccagggggctggatggtccctccgggagaccgcgtgcctggggaaggcctatgcacaaatgtggagcctgatgtacttccaccgccgcgatctccgacttgcgagtaacgcgatctgcagcgccgttcctgtgcattgggtgccgacctcgcgcaccacatggagcatccacgcgcaccaccagtggatgaccaccgaggacatgctgactgtatggaaccgggtgtggatagaggacaacccctggatggaggataagacgcccgtgaccacctgggagaatgtaccctacctcgggaaacgcgaggaccagtggtgcggcagcctgatcgggctgacttcccgagccacgtgggcccagaacatcccgaccgcgatccagcaggtccgcagcctaattggcaacgaggagttcctggattacatgccatccatgaagcggttcaggaaggaagaggagagcgagggcgcgatctggtga

SEQ ID NO: 25989 - RNA, 9873 nt, synthetic construct
  misc_feature 1..9873: note = derived and/or modified CDS sequence (opt11) from DENV-3__FJ547071__SS-prME
  source 1..9873: mol_type = other RNA
actagcttatgcctcatgatgatcctgccagcggccctggcgttccacctcaccagccgggatggagagccccggatgatcgtcggtaaaaacgagcgcgggaagagcctgctgttcaagaccgcctccgggatcaacatgtgcacactcatcgccatggatctgggcgaaatgtgcgacgacacagtgacctacaagtgcccccacatcaccgaggtcgagcccgaggacatcgactgctggtgcaacctgaccagcacgtgggtgacctatgggacttgcaaccaggccggcgagcaccggcgcgacaagcggtccgtggccctcgcgccccacgttggcatggggctggatacccgcacccagacttggatgagcgccgaaggcgcctggcgtcaggtggagaaggtcgagacgtgggccctgcgacacccggggttcaccatcctcgcgctgttcctggcgcactacatcggcacctccctcacccagaaggtggtgatcttcatcctgttgatgctcgtcacgcccagcatgacgatgcgctgcgtcggcgtgggcaaccgcgacttcgtcgagggcctgagcggggccacctgggtggacgtggtcctggagcacggtgggtgtgtgaccacgatggccaagaacaagcccactttagatatcgagctgcagaagactgaggcaacccagctggcgacgctccgaaagctgtgcattgagggcaagatcaccaacatcaccacggacagccgctgccccacgcagggcgaggccgtcctgccggaagagcaggaccaaaactacgtctgcaagcacacctacgtggaccgggggtggggcaatggctgcggcctcttcgggaagggctccttagtgacctgcgcaaagtttcagtgcctggagcccatcgagggcaaggtggtgcagtacgagaacctcaagtacaccgttatcatcacggtccacacaggggatcagcaccaggtgggcaacgagacccagggggtcaccgccgagatcaccccccaggccagcaccaccgaggccatcctgcccgagtacgggaccttagggctcgagtgctcccctcgcactggcctggacttcaacgagatgatactgctcacgatgaagaacaaggcctggatggtgcaccgacagtggttcttcgacctgccactgccgtggaccagcggcgccaccaccgagacgcccacctggaaccgcaaggagctcctggtgaccttcaagaacgcccacgcaaagaagcaggaagtcgtagtgctgggttcccaggagggcgctatgcataccgccttgacgggggccaccgagatccaaaacagcggcgggacctccatcttcgccggccatctcaagtgtcggctgaagatggacaagctcgagctgaagggcatgagctacgctatgtgtacgaacacgttcgtcttaaagaaggaggtgtccgagacccagcacgggaccatcctcatcaaggtggagtacaagggcgaggacgtcccgtgcaaaatccccttcagcaccgaggacgggcagggcaaggcgcacaacggccgcctgataacggcaaatcccgtcgtgacaaagaaagaggaacccgtcaacatcgaggccgaaccgcccttcggggagagcaacatcgtgattggcatcggggacaacgccctgaagataaactggtacaagaagggctccagcatcgggaagatgtttgaggcgacagccagaggcgcccgccggatggccatcctgggcgacaccgcatgggacttcgggtcggtgggcggggtcctcaacagcctgggcaagatggtgcaccagatcttcgggtcggcgtacacggccctgttctcgggcgttagctgggtcatgaagatcggcatcggcgtgctcctgacctggatcggcctgaacagcaagaacacctccatgagcttctcctgcatcgccatcgggatcatcaccttatacctgggcgccgtggtccaggccgacatggggtgcgtgatcaattggaagggcaaggaactgaagtgtggcagcgggatcttcgtgacgaacgaggtccacacctggaccgagcagtacaagttccaggcggatagccccaagcgcctcgccaccgccatcgccggcgcctgggaaaacggggtatgtggcatccgctctactacccggatggagaaccttctgtggaagcagatcgcgaacgagcttaactacatcctgtgggagaacaacatcaagctgaccgtagtcgtgggtgacatcatcggcgtgctcgagcagggcaagcgcacactgacgccccagccgatggaactgaagtactcctggaagacctgggggaaggctaaaatcgtcaccgccgagacccagaacagctccttcatcatcgatggcccaaatacgcccgagtgccccagcgcctcccgggcgtggaacgtgtgggaggtggaagactacgggttcggcgtcttcactaccaacatctggctcaagttgcgtgaggtgtatacccagctctgcgaccaccggctgatgagcgcggccgtgaaagacgagcgcgccgtccatgcagacatgggctattggatcgagagccagaagaacgggtcctggaagctggagaaggcgagcctgatcgaagtgaaaacatgcacctggccgaagtctcacaccctctggagcaacggcgtgctggagtccgacatgatcatccccaagagcctcgccgggcccatttcccagcacaactaccggccgggctaccacacccagacagccgggccctggcatctcggcaagctggagctggacttcaactactgcgaaggcacgaccgtcgtgatcacggagaactgcggaaccaggggcccctcactgcggacgaccaccgtttctgggaagcttatccacgagtggtgctgccgctcctgcaccctgcccccgctcagatacatgggcgaggacggttgctggtacggcatggagatccgccccatctcggagaaggaggagaacatggtcaagagtctggtgtccgccggcagcgggaaggtggacaatttcacgatgggcgtgctgtgcctcgcaatcctgttcgaagaggtgatgcgggggaagttcggcaagaagcatatgatcgccggggtattcttcaccttcgtcctgctcctgtccggccagatcacctggcgcgacatggcccacacactgatcatgatcggctccaacgcctccgatcggatggggatgggcgtgacgtacctagcactgatcgccaccttcaagatccagcccttcctggcgctcgggttcttcctgcgcaaactgaccagccgggagaacctcctgttgggcgtgggcctcgcgatggccacgacgctgcagctgcccgaggacatcgaacagatggcaaacgggatagcgctcggtctgatggccctgaagctcatcacccagttcgagacctaccagctgtggaccgcccttatcagcctaacgtgctctaacaccattttcaccctgaccgtcgcctggcgcacggccaccctgatcctcgctggggtgagtctgctgccggtgtgtcagtccagctccatgcggaagaccgattggctccccatgaccgtggccgccatgggcgtcccgcccctccctctgttcatcttcagcctcaaggacacgctgaagcgccgctcctggccactgaacgagggggtcatggccgtgggactcgtgagcatcttggcctccagcctactccggaacgacgtccccatggcgggacccttagtggccggaggcctgctcatcgcctgctacgttatcactgggacctccgccgacctgaccgtcgagaagaccgccgacgtgacatgggaggaggaggctgagcagaccggcgtgagccacaacctgatgatcactgtcgacgacgacgggaccatgcgcatcaaggatgacgaaacggaaaacatactaaccgtgctgctgaagaccgccctcctcatcgtgtccggcattttcccgtacagcatccccgccaccctgctcgtctggcacacatggcaaaagcagacccagcggtccggcgtgctgtgggacgtgccgtcaccgcccgagacccaaaaggccgagctggaggaaggggtctacagaatcaagcagcagggcatattcggcaagacccaggtgggcgtgggcgtccagaaggagggcgtgttccacacgatgtggcacgtgaccagaggggccgtcttaacgtacaacgggaagcgcctggagcccaactgggcgtccgtcaagaaggacctgatcagctacggcgggggctggcgactctccgcccaatggcagaagggggaagaagtgcaggtcatcgccgtggagcccggcaagaatcccaaaaatttccagaccatgcccggcacgtttcagaccaccaccggtgagatcggcgctatcgcgctggactttaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccggtagcggcaagacccgcaagtacctgccggccatcgtgagggaggccataaagcgccgcctccggacccttatcctggcgcccacccgggttgtcgctgcagagatggaggaggcactcaaggggctccccatccgctaccagacgaccgccaccaagtccgagcacaccggacgggagatcgttgacctgatgtgccatgcgactttcaccatgcgcctcctgagccccgtgcgggtccctaactacaacctaattatcatggacgaggcccactttacagacccggcctccatcgcagcccgtgggtatattagcacccgggtgggcatgggtgaggcggccgccatcttcatgaccgccacgccgcccgggaccgcggatgccttcccccagtccaacgccccaatccaggacgaggagcgcgatatccccgagcgcagctggaattccggcaatgagtggatcaccgacttcgccgggaagacggtgtggtttgtccctagcataaaagccggcaacgacatcgcgaactgcttacggaagaacgggaagaaggtgatccagctgtcccgcaagaccttcgacaccgagtaccagaagaccaagctgaacgactgggatttcgtggtcacaactgacataagcgagatgggcgccaacttcaaggccgaccgggtgatcgacccgcgccggtgcctgaagccggtcatcctaactgacggccccgagcgcgtcatcctggccgggcccatgccagtgacagccgcgtccgccgcccagcggcgcggccgggtggggcgaaacccccagaaggagaacgatcaatacatcttcaccggccaacccctcaataacgacgaggaccacgcacactggacggaagccaagatgctgctggacaacataaacacccccgaagggatcattcctgccttgttcgagcccgaacgggagaagtccgccgccatcgacggcgaataccgcctgaaaggcgagagccggaagaccttcgtggagctgatgcgccgcggagacctccccgtgtggctggcccacaaggtcgcgagcgagggcatcaagtacacagaccgcaagtggtgcttcgacgggcagagaaacaaccagatcctggaggagaacatggacgtggagatatggactaaggagggggagaagaagaaactccgcccccggtggttagacgcccgtacctactctgacccgcttgcactcaaggagttcaaggacttcgccgccggccgcaagagcattgcgctggacctggtgactgaaatagggagggtacccagtcacctcgcccaccgcacccggaacgccctggacaacctggtgatgctccacacaagcgagcacggcgggaaagcgtaccgacacgccgtggaggagctgccagaaactatggagaccctgctcttgctgggcctcatgatcctgctgaccggtggcgcgatgctgttcctgatctcgggaaagggaatcggcaagacgtccatagggctgatctgcgtcattgcctcgtccggcatgctctggatggctgagatcccgcttcagtggatcgccagcgccatcgtcctggagttcttcatgatggtgctcctaatccccgagcccgagaagcaacgtacgccccaagacaatcagctggcatacgtcgtgatcgggatcctcaccctggccgccataatcgccgcgaatgagatgggcctgctcgagactacgaagcgcgacctagggatgtccaaagagccgggggtggtcagccccacctcctacctggacgtggacttgcaccccgcgagcgcctggactctgtatgccgtggccactacggtcataacccccatgctgcggcacaccatcgagaactccaccgcgaacgtgagcctcgccgccatcgccaaccaggccgtggtcttaatgggcctggacaaagggtggccgatctccaaaatggaccttggcgtccctctgctggcgttaggctgctacagccaggtgaaccccctgacgctgaccgccgccgtcttactgctgataacccactacgccatcatcggccccggcctccaggcgaaggccacccgtgaggcccagaagcgaaccgccgccgggatcatgaagaacccgaccgtggacggcataatgaccatcgacctagaccccgtgatctacgacagcaagtttgagaagcagctggggcaggtcatgcttctgatcctgtgcgcagtgcagctcctgctgatgcgcacaagctgggccctctgcgaggcgctgacgctggccaccggcccgatcaccaccctctgggagggctctcccgggaagttctggaacactaccatcgccgtgagcatggcaaacatcttccggggctcctacctcgctggggccggcctggctttcagcatcatgaagtccgtcgggaccggcaagcgcggcaccgggagccagggcgagaccctcggggaaaagtggaagaagaagctgaatcagttgtcacggaaggagtttgacctctacaagaagagtggtatcactgaggtagaccgcaccgaggccaaggagggcctgaagcggggcgagatcacccaccacgcggttagtcgaggctccgccaagctgcagtggttcgttgagcggaacatggtgatcccggaggggcgcgtgatcgacctcggctgcgggcggggcgggtggagctactattgcgccggactgaagaaggtcacggaggtgcgcggctacacgaagggcggtcccgggcacgaagagcccgtgcccatgtcgacctacggttggaacatagtcaagctgatgagcgggaaagacgtgttctacctcccccccgagaagtgtgacaccttactgtgtgacatcggcgaatccagcccctcccccaccgtggaggagagccggacgatacgcgtgctgaagatggtggagccgtggctcaagaacaaccagttctgcatcaaggtgctgaacccatacatgcccaccgttatcgagcacctggagcgcctccagcggaagcacggcgggatgctggtgcgcaaccccctgtcccggaacagcacccacgagatgtactggatttccaacgggacagggaacatcgtggctagcgtcaacatggtgtcccgcctcctgctgaaccggtttacgatgacacacaggcggccgaccatcgaaaaggacgtggacctcggcgcaggcacccgccatgtgaacgcggagcccgagacgccaaacatggacgtgatcggggagcgtatcaagcgtatcaaggaggagcacaactccacctggcactatgacgacgagaacccgtacaagacctgggcctaccacgggtcctacgaagtgaaggcgaccgggagcgcctcgagcatgatcaacggcgtcgtgaagctgctgacgaagccttgggacgtcgtgcccatggtgacccagatggctatgacagacaccacgcctttcgggcagcagcgggtcttcaaggagaaggtggacactagaaccccgcggagcatgccgggcacccgccgggtgatgggcattaccgcggaatggctgtggcgcaccctggggcggaacaagaagccccgcctgtgcacccgggaggagttcaccaagaaggtccgcacgaacgccgcgatgggcgccgtgtttactgaggagaaccagtgggactccgcgaaggccgcagtggaggacgaggacttctggaagctcgtcgaccgcgagcgggagctgcacaaactggggaagtgcggaagctgcgtgtacaacatgatggggaagcgcgagaagaagcttggcgagttcggcaaggccaaagggtcccgtgctatctggtacatgtggctgggcgcgcgctacctggagtttgaagccttagggttcctcaatgaggaccactggtttagccgggagaactcctactccggcgtggagggggagggcctgcataagttaggctacatcctgcgcgacatctccaagatccccggtggcgccatgtacgcggacgacaccgccgggtgggacacccggatcacggaggacgacctgcacaacgaggagaagatcacccagcagatggacccggagcaccgccagttagcgaacgccatcttcaagctgacgtaccagaataaggtcgtcaaggtgcagcgccccacccccaccggcacggtcatggacatcatcagccggaaggaccaacggggatccggccaggtgggcacatacgggctgaacacctttaccaacatggaagcccagctcatccgccagatggagggcgagggggtcctgagcaaggccgacctggagaacccccacctcccggaaaaaaagatcacccagtggctggagaccaagggcgtcgagcgtctgaagcgcatggccatctctggtgacgactgcgtggtgaagcccattgacgacaggttcgcgaacgctctcctggcactgaacgacatggggaaggtccgcaaggacatcccacaatggcagcccagcaagggctggcacgattggcagcaagtccccttctgttcccaccactttcacgagctcatcatgaaggacgggcggaagctggtggtcccctgccgcccccaggatgagttgatcggccgggcccgcatcagccagggggccggctggtcactccgggagacagcgtgcctgggtaaggcctacgcgcagatgtggagcctgatgtacttccaccgccgcgacctccggctggcctctaatgcgatctgcagcgccgtgcccgtgcactgggtcccgaccagtagaaccacttggagcatacatgcccatcaccagtggatgaccaccgaagacatgctgacagtgtggaaccgggtgtggattgaggacaacccctggatggaggacaagacccccgtcactacctgggagaacgtgccctacttggggaagcgcgaggaccagtggtgcggaagcctgatcgggctgacgtcccgggccacttgggcccagaacatcccaaccgcaatccagcaggtccgctcacttataggcaacgaggaattcctggactacatgccgtccatgaagcggttccgcaaagaggaggagagcgagggggccatctggtga

SEQ ID NO: 25990 - RNA, 9873 nt, synthetic construct
  misc_feature 1..9873: note = derived and/or modified CDS sequence (opt11) from DENV-3__FJ410176__SS-prME
  source 1..9873: mol_type = other RNA
actagcctgtgcctcatgatgatactgcccgctgccctggcgttccacctcacctcccgggacggcgagccccgtatgattgtggggaagaacgagagaggcaagagcctgctgttcaagaccgccagcggtatcaacatgtgcacactcatcgccatggacctgggtgagatgtgcgacgacaccgtgacctacaaatgcccccacattaccgaggtggagcccgaggacatcgactgctggtgcaacctgaccagcacctgggtcacctacgggacgtgcaaccaggccggggaacatcggcgcgacaagcggtcggtagcccttgcgccccacgtgggcatgggcttggacacccgcacccagacctggatgagcgccgagggggcctggcgccaggtggagaaggtcgagacatgggctctgcgccaccccgggttcaccatcctcgctctgttcctggcccactacatcggcacctccctgactcagaaggtggtgatcttcatcctgctgatgctcgtcacgccctcgatgaccatgcggtgcgtcggggtgggcaaccgcgacttcgtcgagggattgtcaggggccacctgggtggacgtggtcctggagcacggggggtgcgtgaccacgatggccaaaaacaagcccaccctcgacatcgagctgcagaagaccgaggccactcagttagcgacgctccggaagctgtgcatcgagggcaagatcaccaacataaccaccgacagccgatgccccacgcagggcgaggccgtgttacccgaagagcaggaccagaactatgtatgcaagcacacctatgtggaccgggggtggggcaacggctgtggcctcttcgggaagggctccctcgttacctgcgccaagttccagtgcctggagcccatcgaggggaaggtcgtgcagtatgagaacctcaagtacaccgttatcatcacggtccacaccggcgaccaacaccaggtcggcaacgagacccagggggtcaccgccgagatcacgccccaggccagcaccaccgaagcgatcctgcccgagtacggcaccctggggctcgagtgctccccccgcaccggcttagacttcaacgagatgatcctcctcacgatgaagaacaaggcatggatggtgcaccggcagtggttctttgacctgcctctgccttggaccagcggcgcaaccaccgagacccccacctggaaccgcaaggagctcctggtgacattcaagaatgcccacgccaagaagcaggaggtcgttgtcctggggtcacaggagggcgcaatgcacacagccctcacaggggcaaccgagatccagaatagcggcgggacatccatcttcgccggacacctgaagtgccggctgaagatggacaagctcgagctgaagggcatgtcttacgccatgtgcaccaacacgttcgtactgaagaaagaggtgtccgagacccagcacggtaccatactcatcaaggtggagtacaaaggggaggatgtcccgtgcaagatcccctttagcacggaggacgggcagggcaaggcgcacaacggtcgcctgattacggccaacccagtggtgacaaagaaggaagagcccgtcaacatcgaggccgaaccgcccttcggagagagcaacattgtgatcggcattggcgacaacgctctgaagatcaactggtacaagaaaggctccagcatcgggaagatgttcgaggccaccgcccggggcgcccgccggatggccatcctgggagacacggcctgggacttcgggtccgttgggggtgtcctcaacagcctgggcaagatggtgcaccagatcttcgggtccgcgtatacggcattgttcagcggcgtgtcctgggttatgaagataggcatcggggtgctcctgacctggatcggactgaacagcaagaatacctccatgagcttctcctgtatcgccatcgggatcatcaccttatacctgggcgccgtggtacaggccgatatggggtgcgtgatcaactggaagggcaaagagctgaaatgcggcagcgggatcttcgtgacgaacgaggttcatacctggaccgagcagtacaagttccaggcagactcgcccaagcgcctcgccaccgctatcgcaggcgcctgggaaaacggtgtatgtggcatccgcagcacgactcggatggagaacctgctgtggaagcagatcgccaacgagctcaactacatcctttgggagaacaacatcaagctgaccgtagtcgtgggggatactatcggggtgctcgagcaaggcaagcggacgctgacgccacagccgatggagctgaagtacagctggaagacctgggggaaggccaagatcgttaccgccgagacgcagaacagctccttcattatcgacggccccaacaccccagaatgccccagcgcctccagagcgtggaacgtatgggaggttgaagattacgggttcggcgtgttcaccaccaatatatggctcaagctgcgcgaggtgtacacccagctctgcgaccaccggctgatgtcagccgccgtgaaggacgagcgagccgtccatgcggacatgggctactggatcgagagccagaagaacgggtcctggaagctcgagaaggcgagcttaatcgaggtgaagacgtgcacctggccgaagtcccacaccctctggtcaaacggcgtgctggagtccgacatgatcatccccaaaagcctggccgggcccatctcccagcacaactaccggccgggctatcacacccagacggccggaccctggcaccttggcaaactggagctggacttcaactactgcgaaggcaccaccgtcgtgatcaccgagaactgcgggacgcgtggcagctccctccggaccaccaccgtgagcgggaagctcatccacgagtggtgctgccgctcctgcacgctgcctcccctgcggtacatgggcgaggatgggtgctggtacggcatggagatccgcccgatctccgagaaggaggagaacatggtcaagtccctggtgtcggccggctccgggaaggtggacaactttaccatgggcgtgctatgcctcgccatcctgttcgaggaagtgatgcgggggaagttcggcaaaaagcacatgatcgcgggggtgctgtttaccttcgtactcctgctgagcggacagatcacctggcgagacatggcccacaccttgataatgatcggctctaacgccagcgaccggatggggatgggcgtgacctacctggcgctgatcgccaccttcaaaatccagcccttcctcgcgctggggttctttcttcggaagctcaccagccgggagaatctcctgctgggcgtaggcctggccatggccacgaccctgcagctcccggaggacatcgagcagatggccaacgggatcgcgctgggcctgatggcgctcaaactgaccacccagttcgagacctaccagctgtggaccgccctcatcagcctgacctgtagcaacacaatcttcaccctgaccgtcgcctggcgcaccgccaccctcatcttagcgggtgtgtccctgctccctgtttgtcagagctccagcatgcggaagacggactggcttccgatgaccgtggctgctatgggcgtgccgcccctacccttattcatcttctccctgaaggacactctgaagcgccgcagctggccgctcaacgagggtgtgatggccgtgggcctggtttccatcttggccagctcactcctgcggaacgacgtccctatggctggccccctggtggccgggggtcttctgatcgcctgctacgtgatcaccggtacgagtgccgatctgaccgttgagaaggccgcggacgtgacctgggaggaggaggcggagcagactggtgtgtcccacaacctaatgatcaccgtcgatgatgacggaacgatgcgcatcaaggacgacgaaaccgaaaacatcctgaccgtgctgctcaaaaccgccttactgatcgtgagcggcatcttcccgtactcaatcccggccacactcctggtctggcacacctggcagaagcaaacccagagaagcggcgtgctgtgggacgtacccagcccgcccgagacccagaaggccgagctcgaagagggggtctaccgcatcaagcagcaggggatcttcgggaagacccaggtgggcgtgggggtccagaaggagggtgtgttccataccatgtggcacgtaacccggggcgccgtcctgacctacaacgggaagcgcctggagccgaactgggccagcgtgaagaaggacctgatttcctatggcgggggttggcggctgagcgcccagtggcagaagggggaggaagtgcaagtcatcgccgtggaacccggaaagaaccctaagaacttccagacgatgcccggcaccttccagactaccacgggggagatcggggcgatcgccctggacttcaagccggggacaagcggctcccccatcatcaaccgcgaaggcaaggtggtcgggctctacggcaacggggtggtgaccaagaacggcggctatgtcagcggcatagcccagaccaacgccgaacctgacggaccgacgcccgagctcgaggaggagatgttcaagaaacggaacctgaccatcatggacctgcatccggggagcggcaagacccgcaagtacctacccgccatcgtgcgggaggcaatcaagcgccggctgcgcacccttatactcgcaccgacgcgggttgtcgccgccgagatggaagaggcgctgaagggcctgcccatacgctatcagaccaccgcgactaagagtgagcacacggggcgggagatcgtggacctcatgtgccacgccaccttcacgatgcgcttattgtcccccgtgcgggttcccaactacaacctcatcatcatggacgaggcccactttaccgacccggcctctatcgctgcgcgcgggtacatctccacgcgggtgggcatgggcgaggccgcagccatcttcatgactgcgacgccacccgggaccgccgacgccttcccgcagagcaacgccccgatccaggacgaggagcgcgacatccccgagcgctcgtggaatagcggcaacgagtggatcacggatttcgccggtaaaaccgtgtggttcgtcccctcaatcaaggcgggcaacgacatcgccaactgcctgaggaagaacgggaagaaggtgatccaactgagccgcaagacctttgacaccgagtaccagaagacaaagctcaacgactgggacttcgtagtcaccacggacatctccgagatgggcgccaacttcaaggccgaccgggtgatcgacccccgccggtgcctgaagccggtcatcctaactgacggcccggagcgcgtcatcctcgcagggcccatgcccgtgacggcggcaagcgccgcccagcggcgcggccgggtggggcgcaatccgcagaaggagaacgaccagtacatcttcaccggccaacccctgaataacgatgaggaccatgcgcactggaccgaggcgaagatgctgctcgacaacatcaacacacccgaggggatcatcccggccctgttcgagccggagcgggagaagtccgccgccatcgacggcgagtaccgcctgaaaggggagagccggaagaccttcgtcgaactcatgcgccgcggggacctgcccgtgtggctggcgcacaaggtagcctccgagggcatcaagtacaccgaccgcaagtggtgcttcgacgggcagcggaacaaccagatactcgaggagaacatggacgtcgagatatggactaaagagggcgagaagaagaagctgcgcccccggtggctggacgccaggacctacagcgaccccttggccctgaaggagttcaaggattttgctgcaggccgcaagtcgatcgccctcgatctcgtcaccgagatcgggcgggtaccgagccatctggctcatcgcacgaggaatgctctcgacaacctcgttatgctgcacaccagcgaacacggcgggaaggcctaccgccacgcggtggaggagctgcccgagacgatggagaccctcctgctgctcggcctgatgatcctgctcaccggcggggccatgctgttcctgatctccgggaaggggatcggcaagacttctattgggctcatctgcgtcatcgcctctagcggcatgctgtggatggccgagatccccctgcagtggatcgcgtccgcgatcgtgttggagttcttcatgatggtgctgctgatcccggagcccgagaagcagcgcacgccccaggacaaccagctcgcctatgtcgtgatcgggatcctgaccctggccgccatcattgcggcgaacgagatggggctcctggagacgacaaagcgcgacctcggcatgagcaaggagcccggagtggtctccccgaccagctacctcgacgtggacctgcaccccgcctcagcatggaccctctacgccgtggcgacgaccgttatcacacccatgctccggcacaccatcgagaacagcacggccaacgtgtccttggccgccatcgccaatcaggcggttgtgctgatgggcctcgacaaaggatggcccatcagcaagatggatctgggcgtgccgctgctcgccctggggtgctactcccaagtcaaccccctgaccctcaccgccgccgtcttactgctaatcacccactatgccatcatcggacccggcctgcaggcgaaagccacgcgcgaggctcaaaagcggaccgccgccgggatcatgaagaaccccaccgtggacggcataatgaccatcgacctggatccggtaatctacgacagcaagttcgagaaacagctcgggcaggtcatgctactggtgctgtgcgcggtgcagctgctgctcatgcgcacgagttgggccctgtgcgaggccctgaccctagccaccggccccatcaccacgctgtgggagggctctccggggaagttctggaacaccaccatcgcggtctccatggccaacatatttcggggcagctacctcgccggggccggcctcgccttctccatcatgaagtccgtggggaccggcaagcgcggcaccgggagccagggcgagactctgggggaaaagtggaagaagaagctgaaccagctctcccggaaggagttcgacctgtacaagaagtccggcatcacagaggtcgaccgcactgaggcgaaggaggggctgaagcggggcgagatcacccaccacgccgtctcccgcggcagcgccaagctccagtggttcgtggagcgtaacatggtgatccccgaggggcgcgtcatagaccttggctgtgggcggggtgggtggtcctactattgcgccggcctgaagaaggtgacagaggtgcgcggctacacgaagggcgggccggggcacgaggagcccgtccccatgagcacctacggctggaacatcgtgaagctcatgtccgggaaggacgtgttctacctgcccccggaaaagtgcgacactctgctctgcgacatcggcgaaagctccccctctcccacggtcgaggaatcccggaccatccgcgtgctcaagatggtggagccctggctgaagaacaaccagttctgcatcaaggtgctgaacccgtacatgcccaccgttatcgagcacctcgagcgcctgcagcggaagcacggcgggatgctcgtacgcaaccccctcagccggaactctacccacgagatgtactggatcagcaacggcactgggaacatagtcgcctccgtgaacatggtgagccgcctgttgctgaaccgtttcaccatgacccatcgccggcccacgatagagaaggacgtcgatctgggggccggcacgcgccatgtgaacgccgagccggagaccccgaatatggacgtgatcggagagcggatcaagcgcatcaaggaggagcacaactccacctggcactacgatgacgagaatccctacaaaacctgggcctaccacgggtcatacgaggtcaaggccacggggtccgccagcagcatgatcaatggcgtggtaaagctgctcaccaagccgtgggacgtggtcccaatggtcacccagatggcgatgaccgacactacccccttcgggcagcagagagtgttcaaggagaaggtggatactcgcacgccccgatcaatgccgggcacgcgccgggtgatgggcatcaccgccgagtggctgtggagaaccctggggcggaataagaagccccgtctctgcactcgggaggagttcacgaagaaagtgcgcaccaacgccgccatgggcgcggtgttcaccgaggagaaccagtgggatagcgccaaggccgccgtcgaggacgaggacttctggaagctggtggaccgcgagcgggagctgcacaagctcgggaagtgcggctcctgcgtgtacaacatgatgggtaagcgcgagaaaaagctgggcgagtttggcaaggccaaggggtcacgcgcgatctggtacatgtggctgggcgcccgctacctcgagttcgaggctctggggttcctaaacgaggaccactggttctcacgggagaacagttactccggagtcgagggcgaaggcctccacaaactgggctacattctgcgcgatataagcaagattcccgggggcgccatgtacgccgacgacaccgcgggctgggacacgcggatcaccgaggatgacctccacaacgaggagaagatcacgcagcagatggaccccgagcaccgccagctggcgaacgcgatcttcaagctgacctaccaaaacaaagttgtgaaggtacagcggccgacccccacgggcaccgtgatggacatcatctcccgcaaggaccagcgaggcagcggacaggttggcacctacgggctcaacaccttcaccaacatggaggcccagctgatacgccagatggagggcgagggggtcctgtccaaggcagatctcgagaacccccacctccccgagaaaaagatcacccagtggctggagaccaagggtgtggagcggctcaagcgcatggcgataagcggagacgactgcgtggtaaagccgatcgacgaccggttcgccaacgcgctgttggccctcaacgatatggggaaagtgcgcaaggacatcccgcagtggcaaccctccaagggctggcacgactggcagcaggtccccttctgttcgcaccacttccacgagctgatcatgaaggatgggcggaagctggtcgtgccgtgtcgcccccaagatgagctcatcggtcgggcccgcatctcccagggggcaggttggagcttgcgggaaaccgcatgcctgggcaaggcttacgcccagatgtggtccctcatgtacttccaccgccgggacttgcgcctggcgagcaacgccatctgctccgccgtgcccgtccattgggtgcccacgagccgcaccacctggtcaatccacgcccaccaccagtggatgaccacggaggacatgctcaccgtgtggaatcgggtctggatcgaggataacccctggatggaggacaagaccccagtgaccacgtgggagaacgtgccctacttagggaagcgcgaggaccagtggtgcggatccctgatcgggttgaccagccgagccacctgggcgcagaacatccccaccgccatccagcaggtccgctccctaatcggcaacgaggagtttctggactacatgccgagcatgaagcggttccgcaaggaagaggagtccgagggagccatttggtga

SEQ ID NO: 25991 - RNA, 9873 nt, synthetic construct
  misc_feature 1..9873: note = derived and/or modified CDS sequence (opt11) from DENV-3__FJ410177__SS-prME
  source 1..9873: mol_type = other RNA
acaagcctctgcctcatgatgatattgcccgccgccctggcattccacttaactagccgggacggcgaaccccggatgatcgtggggaagaatgaacgcggcaagagcctgctgtttaagaccgccagtgggataaacatgtgtaccctcattgccatggatctgggcgagatgtgcgacgacacggtgacctacaagtgcccgcatatcaccgaggtggaacccgaggacatcgattgctggtgcaaccttaccagcacctgggtgacgtacgggacttgcaaccaggccggcgagcaccggcgcgacaagcggagcgtcgctctcgccccccacgtgggcatgggtctggacacaagaacccagacttggatgagcgccgagggcgcctggcgccaggtggagaaggtggagacgtgggcactgcgtcacccggggttcaccattctcgcgctgtttttggcacactatatcggcacctccctcacccagaaagtggtgatcttcatcctgctgatgcttgtcacccctagcatgaccatgagatgcgtgggggtgggcaaccgcgatttcgtagagggcctgtccggggcaacctgggtcgacgtcgtcctggagcacggcgggtgtgtgaccacgatggccaaaaacaaacccaccttagacatcgaactgcagaagaccgaagccacccaactggcgacgctccggaagctgtgcatcgaaggcaagatcaccaacatcactaccgacagccggtgccccacgcagggcgaggccgtgctgccggaggagcaggaccagaactatgtctgcaagcacacgtacgtggaccgggggtggggtaacgggtgcggtcttttcggtaagggttccttagtcacctgcgccaagttccagtgtcttgagcccatagagggcaaggtggtccagtacgagaacttgaagtataccgttatcataactgtccacaccggggaccagcatcaggtgggcaatgagacccagggggtgactgccgagatcacgccccaggcctcaaccaccgaagcgatcctgcccgaatacggcaccctggggctagagtgctccccgcgcaccggcctggacttcaacgagatgatactgctcactatgaagaataaggcgtggatggttcaccggcagtggttctttgacttgcccctgccctggaccagcggcgccactaccgagacgcctacctggaacaggaaggagctcctggtgaccttcaagaacgcccacgccaagaagcaagaagtagtggtgctggggtcccaggaaggtgcgatgcacaccgcgctcacgggggccaccgagatccagaatagcggcgggacctccatctttgccggccatctgaagtgccggctaaagatggacaagctcgagctcaagggcatgagctacgccatgtgtaccaacacgtttgtcctgaaaaaggaagtgagcgagacccaacatgggaccatcctcatcaaggtggagtacaagggcgaagatgtcccatgcaaaatccccttctctaccgaggacgggcagggcaaagcgcataacgggcgcctgatcaccgccaaccctgtggttaccaagaaggaggagcccgtcaacatcgaggccgagccgcccttcggggagagcaacatcgtgatcggtatcggggataacgccctgaagatcaactggtacaagaagggctccagcatcgggaagatgttcgaagcgaccgctcgtggggcccgccgaatggctatcttaggagacactgcctgggacttcgggtctgtggggggggtcctcaactccctggggaagatggtacaccagatcttcgggtccgcttacaccgccctgttctccggtgtgtcctgggtcatgaagataggtataggggtgctcctgacctggatcggcctgaacagcaagaacacgtccatgagtttctcctgtatcgccatcgggatcatcaccctctacttgggggcggtggtccaggctgacatggggtgcgttatcaactggaaaggcaaggagttaaagtgtggcagcggcatcttcgtgactaacgaggtacacacctggacagaacaatataagttccaagcggactcccccaagagactcgccactgccatcgccggggcctgggagaacggggtctgcggcatccgcagcacgacccgtatggagaacctgctgtggaagcagatcgcgaacgagctcaactacatactgtgggagaataacatcaagcttactgtggtggtaggggataccattggagttctcgagcaagggaagcgcactctgacgccccagcctatggagttaaaatactcctggaagacctgggggaaggcgaaaatagtcaccgccgagacgcagaactcctcctttatcatcgacggccccaacacccctgagtgccctagcgcttcccgggcgtggaacgtgtgggaggtggaggactacgggttcggcgtcttcaccaccaacatctggctcaagctgagagaggtgtacacccagctctgtgaccaccgtctcatgagcgccgccgtgaaggacgagcgtgccgttcacgccgatatgggctactggatagagagccagaagaacgggtcctggaagctggagaaggcgagcctgatcgaggtgaagacgtgtacctggccaaagtcccataccctctggagcaacggcgtcctggaatcggatatgataatacccaagagcttagccgggcccatctcccagcacaactatcggcccggctaccatacccagacggccgggccttggcacctcggcaagctggaactggacttcaattactgcgagggcaccaccgtcgtcatcaccgaaaactgtgggacgggcgggccctccctccgcactaccaccgtgagtggcaaattgatccacgagtggtgctgccggagttgcacgctgcccccgctccgctacatgggggaagacggctgttggtacggcatggagatccggcccatttccgagaaggaggagaatatggtcaagtccctggtatccgccgggagcggcaaggtggacaacttcacaatgggggttctgtgcctcgccatcctgtttgaggaggtaatgcgcggcaagttcgggaagaagcacatgatcgctggcgtgttcttcaccttcgtcctcctcctgtccggccagataacttggcgggatatggcacacactctgatcatgatcgggagcaacgcctccgaccggatgggcatgggggtgacctatctcgctctgatcgccaccttcaaaatccagccgttcctggcgctcggcttcttcctgcggaaactgacaagccgcgagaacctcctgctgggcgtggggctggccatggccacgacgttacagctgccagaggacatcgaacagatggccaacggtatcgcgctcgggctgatggccctgaagctcaccacccagttcgagacgtaccaactgtggaccgccctaatcagtctgacctgctccaacacaatcttcactctgaccgtcgcctggcggaccgctacgctgatcttagcgggcgtgagcctgctcccggtctgtcagtccagctccatgcgcaaaacagactggctccccatgaccgtggcggccatgggggtgcctccactcccgctgttcatcttcagtctcaaagacacactgaagcggagatcctggccactgaacgagggcgtaatggccgtgggactcgtgagcatcctggcctccagcctgctacgcaatgacgtccccatggcggggcctctggtggccggcgggttactcatcgcctgttacgtgatcaccggcacgtccgccgacctgaccgtggagaaggccgcggacgtgacctgggaagaggaggccgagcagaccggggtgagccataacctgatgatcactgtagacgacgacggcacgatgcggatcaaagacgatgagaccgagaacatcctcaccgtgctgctgaagaccgccctcctgatcgtgtccggaatcttcccatactcaatccccgccaccctgctcgtctggcatacctggcagaagcagacccagcgctcgggcgtgctgtgggacgtgccgagcccgcccgagacccagaaggcagagctcgaggagggcgtctaccgtatcaagcagcaagggatcttcggcaagacccaggtgggggtgggagtccagaaggaaggcgtgtttcacaccatgtggcacgtaacccgcggggcggtcctaacctataacggcaaacgcctggagccaaactgggcctcagtgaagaaagacctcatcagctacggtggcggctggaggctatccgcgcagtggcagaagggcgaggaagtgcaggtcatcgccgtggagcccggaaagaaccccaagaacttccaaacgatgcccgggaccttccagaccaccacgggcgagatcggggcgatcgccctggatttcaagcccggcacaagcggcagccccattataaaccgggaggggaaggtggtcggactgtacgggaacggcgtcgtgaccaagaacgggggttacgtcagtggcatcgcccagactaacgccgagccggacgggccaacgcccgagctggaggaagagatgttcaagaagcgcaacctgaccatcatggatctgcaccccggtagcgggaagacccggaagtacctaccggccatcgtgcgcgaagcgatcaagaggcgcctccggaccctgatattggcccccacgcgggtggtcgcagccgagatggaggaggccctcaagggcctgcccatccgttatcagaccaccgcaaccaagtccgagcacacggggcgcgagatcgtggacttaatgtgccacgccaccttcaccatgcggctcctgagccccgtacgcgtcccgaactacaatttaatcatcatggacgaggcgcacttcaccgaccccgcgtccatcgctgctcggggctacatcagcacgcgcgtgggcatgggtgaagcggccgccatctttatgaccgcgaccccgcccggcaccgccgacgccttcccgcagtccaacgcgcccatccaggacgaggagcgggatatccctgagcgtagctggaactccgggaacgagtggatcacggacttcgccggcaagaccgtgtggttcgtccccagcataaaggcggggaacgatatcgccaattgtctccgcaagaacggcaagaaagtgatccaactgtcccggaagactttcgacaccgaataccagaagacgaagttgaacgactgggactttgtggtgaccactgacatcagcgagatgggagccaacttcaaggccgaccgcgtaatcgacccgcggcgctgcctcaagccagtgattctgaccgacgggcccgagcgggtcatcctggccggcccaatgccggtgaccgccgcctccgccgcgcagagacgggggcgcgtgggccggaacccgcagaaggagaatgatcagtacatcttcacggggcagcctctcaacaacgacgaagaccacgcccactggaccgaggctaagatgctgctagacaacatcaacacccccgagggcatcatcccggccttattcgagcccgagcgcgagaagtccgccgcgatcgacggcgagtaccggctgaagggggagtctcgcaagacgttcgtcgagctgatgcgccgcggcgacctccccgtgtggctggcgcataaggtcgccagcgagggcataaagtacacggaccggaaatggtgcttcgatggccagcgcaacaatcagatcttagaagaaaacatggacgtagagatttggaccaaggagggcgagaagaagaaactccggcctcgctggttagacgcccggacgtattctgacccgttagctctcaaggagttcaaagactttgccgcggggcgcaaaagcatcgccctggacctggtaaccgagatcggccgcgtcccatcccacctcgcccatcgcacgcgcaacgccttagacaacctggttatgctccacacctctgagcatgggggcaaggcctatcgccacgcggtggaggagctgcccgagaccatggagacactgctcttattagggctcatgatcctgctgacgggcggcgcaatgctgttcctgatctctgggaaaggcatcgggaagacctccattggcctgatctgcgtcatcgcaagctccgggatgctctggatggctgagatcccgctgcagtggatcgcgtctgctattgtcctggagttcttcatgatggtgctcctgatccctgagcccgagaaacagcgcacgccccaggacaaccagcttgcttacgtcgtgatcggcatcctcaccctcgctgcgatcatcgccgcgaacgagatgggcctgctcgaaacgaccaagcgggacctgggcatgtccaaggagccgggcgtggttagccccacctcatacttagacgtggacctccaccccgcttcggcctggaccctctacgccgttgccactacggtcatcacccccatgctgcgccacaccatcgagaattccacagccaacgtgtcgcttgccgccatagccaaccaggcggtggtgctgatggggcttgacaagggctggccgatctcaaagatggatctcggggtgcccctgctcgcactcggttgttatagtcaggtaaacccactgaccctcaccgccgccgtcctcctgctgattacccactacgccatcatcggccccgggctccaggcgaaagccacgcgcgaggcccagaagcgcactgcagccggcataatgaagaacccgaccgtggacggcatcatgaccatcgacctggatcccgtgatctacgactcaaagttcgagaagcagcttggccaggtgatgctgctggtgctgtgcgctgtgcagctgctactgatgagaaccagctgggccctctgcgaggccctgaccctcgccaccggccccatcaccacgctctgggaggggtctcccggcaagttttggaacacaacaattgccgtcagcatggccaacatcttccgagggtcctacctggctggcgccgggctggccttctctatcatgaagtccgtaggcaccggcaagagggggactggcagccagggggagaccctcggcgagaaatggaagaagaagctgaaccaactgagccgcaaggagttcgacctctataagaagtccggcatcaccgaagtggaccggaccgaggcgaaggagggcctgaagcgcggcgagatcacccaccatgccgtcagcagggggtccgccaagctacagtggttcgtggagcgcaacatggtaatcccggagggcagagtcatcgacctcgggtgcggccgcggcggctggtcatactactgcgctggcctgaagaaggtgacggaggtacggggttacacaaaaggcgggcccggccacgaggagcccgttcccatgtccacctacggttggaacatcgtgaaactgatgagcggcaaggatgtcttctacctcccgcccgagaaatgtgacaccctgctgtgcgacatcggcgagtcgagcccctcccccaccgtggaagagagccgcaccatccgggtactcaagatggtagagccttggctcaagaacaaccagttttgcataaaagtcctgaacccctacatgcccactgtcatcgagcacttagagcgtctccagcgcaagcacggcggcatgctggtgagaaatcccctgtcccggaacagcacccacgaaatgtactggatctccaatggcacgggcaatatcgtcgccagcgtgaacatggtctcacggctcttgctaaaccgtttcacaatgacccaccgccgccccaccatcgagaaggacgtcgacctcggcgcggggacccggcacgtcaacgccgagcccgagacccccaacatggacgtgatcggcgagcgcataaagcggatcaaggaggagcacaacagcacctggcattacgacgacgaaaatccgtataagacctgggcctatcacgggtcctacgaggtgaaggccactgggagcgcctccagcatgataaatggggtggtcaaactgctgacgaagccctgggacgtggtgcccatggtaacgcagatggcgatgactgacacgactcccttcggccagcagcgcgtgttcaaggagaaggtggacactagaactccgcgctcaatgcccggaacgcggcgcgttatggggatcaccgccgagtggctctggagaaccctgggccgcaacaaaaagccccggttgtgcacccgcgaggaatttaccaagaaggtgcggaccaacgccgccatgggggcagtgttcaccgaggagaaccagtgggactccgccaaggccgccgtcgaggacgaggacttctggaagctcgttgatcgcgagcgcgagcttcacaagctgggcaagtgtgggagctgcgtgtacaacatgatggggaagagagagaagaagttgggcgagttcgggaaggccaaaggctcccgcgcgatctggtacatgtggctgggcgcccggtacctggaattcgaggcgcttggtttcttgaacgaggaccactggttcagccgcgagaactcctacagcggggtcgagggcgagggtcttcataaactcgggtacatccttcgggacataagtaagatccccggcggggccatgtacgctgacgataccgcgggctgggacactcgcatcaccgaggacgacttacacaacgaggagaagatcacccagcagatggaccccgagcataggcagttggccaacgccatatttaagctgacctaccagaacaaggtggttaaggtccagcgccccacgcccacgggcaccgtgatggacatcattagccggaaggatcagcgaggctccggccaggtagggacttacggactcaacaccttcacgaacatggaggcccaactcatccggcagatggagggggagggcgtcctgtcgaaggccgacctggagaacccccacctcccggagaagaagatcacccagtggcttgagacaaagggcgtggaaagactgaagcggatggcgatctccggcgacgactgtgtggtcaaacccatcgacgaccgcttcgccaacgccctcctggccttaaacgacatgggcaaagtgcggaaggacatcccccagtggcagcccagcaaggggtggcatgactggcagcaggtcccgttctgttcccaccacttccatgagctcatcatgaaggacggccgcaagctggtcgtgccctgccggccacaggacgagctgatcggacgcgctcggatctcacagggtgcgggctggtccttacgcgaaaccgcctgcctggggaaggcctacgcccagatgtggagcttgatgtacttccaccgccgggacctccgcctggcgtccaacgccatctgcagcgccgtgcccgtccactgggtgcccacatcgcgcaccacctggagcatccacgcccaccatcagtggatgacaacggaggacatgctgaccgtgtggaatagagtctggatagaggacaacccctggatggaggacaagacccccgtgaccacgtgggagaacgtgccatatctcggcaaaagagaggaccagtggtgcgggagcttaatcggacttacctcccgcgccacctgggcacagaacatcccgaccgccatccagcaagtccggagcctcatcgggaacgaggagttcctcgactacatgccgtccatgaagcgcttcagaaaggaggaagagagcgagggcgccatctggtaa

SEQ ID NO: 25992 - RNA, 9873 nt, synthetic construct
  misc_feature 1..9873: note = derived and/or modified CDS sequence (opt11) from DENV-3__FJ547072__SS-prME
  source 1..9873: mol_type = other RNA
accagcctgtgcctcatgatgatactgccagcggcgctggctttccacctaacttcccgggacggcgaaccgcgtatgatcgtggggaagaacgagagaggccgtagccttttgttcaagacagcctcggggatcaacatgtgcacccttatcgccatggaccttggtgagatgtgtgacgataccgtgacctacaagtgcccgcacatcacggaggtcgagcccgaagatatagattgctggtgcaacctgaccagcacctgggtgacctacgggacctgtaaccaggccggcgagcaccgccgggacaaacgctccgtcgcgctcgcaccccacgtgggaatgggcctggacacccgaacccagacctggatgtctgccgagggcgcgtggcggcaggttgagaaggtggagacctgggccctgcggcatccggggttcaccatactcgccttattcctggcccactacatcggaacctccctaacacagaaggtggtgatcttcattctgctgatgctcgtcacgccctcgatgactatgcgctgtgttggggtgggtaaccgggacttcgtcgagggcctgtccggagctacctgggtggacgtagtcctagagcatggcgggtgcgtgacaaccatggccaaaaacaagcccaccctcgacatcgaactgcaaaagaccgaggccacccaactggcgacactccgcaagctgtgcatagaggggaaaatcacaaatattaccaccgacagccggtgccctacgcagggcgaggccgtcctgccggaggaacaggatcagaactacgtgtgtaagcacacctacgtcgaccgcgggtggggcaacggctgcggactcttcgggaaggggtccttagtgacctgcgccaaattccagtgcctggagcccatcgagggcaaggtcgtccagtacgaaaacctcaagtacactgtgatcatcacggtccataccggggaccagcaccaggtaggcaacgagacacaaggggtcaccgccgagattactccccaggcctccacaaccgaggcgattttgcccgaatacggcaccctggggctcgagtgctccccgcgtaccggcttagacttcaacgagatgatcctgctcacgatgaagaacaaggcgtggatggtgcatcggcagtggttctttgacctgcccctgccctggaccagcggcgccaccactgagacgccaacttggaaccggaaggaattgctggtaaccttcaaaaatgcccacgccaagaagcaggaggtcgtggttctcgggagccaggagggcgccatgcacactgctttaactggggctaccgagatccagaacagcggtgggacgtccatcttcgctgggcacctgaagtgccgcctgaagatggataagctcgagttaaaggggatgagctacgccatgtgtaccaatacatttgtgctgaagaaggaggtgtccgagacccaacacgggaccatcctcataaaggtcgagtacaagggcgaggacgtcccgtgtaagattccttttagcacggaagatgggcagggcaaggcgcacaacgggcggctgattacggccaaccctgtggtgaccaagaaagaggagccagtcaacatcgaggccgagccgcctttcggcgaatctaacattgtgatcggtatcggagacaacgccctgaagatcaactggtacaagaagggcagtagtatcggtaagatgttcgaggcgaccgcccgcggggcaaggcgcatggctatcctgggcgataccgcttgggacttcgggtccgtgggaggggtcctgaacagcctgggcaagatggtgcatcagatatttggttctgcttacacagccctgttcagcggcgtgagttgggtcatgaaaataggcatcggcgtactcctgacgtggatcggtctgaactcgaaaaacacctccatgagtttctcctgcatcgtgattgggataatcaccttatacctgggggccgtagttcaggccgacatggggtgcgtgataaactggaagggtaaggaacttaagtgcggtagcgggatcttcgtcacaaacgaggttcacacctggaccgagcaatataagttccaggcagactcgccaaaacgtctagcgacagccatcgcgggagcctgggaaaacggggtgtgcggcatccggagcactactcgcatggagaacctgctttggaagcagatcgccaatgagctcaactacatcctgtgggagaacaacattaagctgacggtcgtggttggggatattatcggcgtgctcgagcaaggcaagcgtaccttgactcctcaaccaatggagctgaagtactcgtggaagacctggggcaaggcgaagattgttactgccgaaacccaaaatagctcattcatcatagacggccctaacacacccgagtgtcctagcgcctcccgagcatggaacgtttgggaggtcgaggactacgggttcggggtgttcaccaccaacatctggctcaagctgcgggaagtatatacccagctgtgcgaccatcgcctcatgagcgccgccgtaaaggacgagcgggccgttcacgctgacatgggctactggatcgagtcgcaaaagaacgggagctggaagctggaaaaggcctcgttaatagaggtaaagacctgcacgtggccgaagtcccacactctttggtcaaacggcgtcttggaatctgatatgataatccctaagagcctggctgggcctatctcccagcacaactatcgcccggggtaccacacccagaccgcgggtccctggcacctcggaaagctggagctggatttcaactactgcgagggaacgaccgtggtgatcaccgagaattgtggcacccggggtccctcactacgcacgaccaccgtgtccggaaagttaatccacgagtggtgctgtcggtcgtgcaccctaccccctctaaggtacatgggcgaagatggctgctggtatggcatggaaatccggcccatctccgagaaggaggagaacatggtcaagtcactcgtaagtgcaggcagcgggaaggttgacaacttcacaatgggtgtgttgtgcctcgccatcctgttcgaggaggttatgcgcggcaagtttggtaaaaagcacatgatcgccggggttttcttcaccttcgtcctactcctgtccgggcagatcacctggcgggacatggcgcacaccctgataatgatcggcagcaacgcgtccgaccgcatgggcatgggcgtgacgtacctcgcactgatagccaccttcaagatccagccgttcttagccttggggttcttcctgcggaagctgacctctcgcgagaatctcctgctgggggtcggcctagctatggccactacgctgcaactccccgaggacatcgagcaaatggcgaatgggattgcgttggggctgatggcgctgaagctcatcacgcagtttgagacttaccagctatggacagccctgatatcgctcacgtgctccaacaccatattcacgctgaccgtcgcctggcgtacggccactctgattttagcgggcgtctctctcctgcccgtgtgtcagtccagctcgatgcgcaagaccgattggctccccatgactgtggcggccatgggcgttccgcccctaccactgtttatcttcagcctcaaggacacgctgaagcgccggtcctggcccctgaatgagggcgtgatggccgtgggcctcgtgagcatcctggcctcgagcctgctccgcaacgacgtgcccatggccggaccgctggtggcaggcggcctccttatcgcgtgctatgtcatcaccgggacatcggccgacctgactgttgagaaggccgctgacgtgacgtgggaggaggaggcggagcaaacaggggtcagccacaacctaatgattaccgttgacgacgacgggacgatgcggatcaaggatgacgagactgagaacatactcaccgtcctgttaaaaacagccctcctgatagtttccggaatctttccctatagcatccccgcaaccttactggtgtggcatacctggcagaagcaaacgcagcgctccggcgtgctttgggacgtacccagcccacccgagacccagaaggccgagcttgaggagggggtgtaccggatcaagcagcagggtatattcgggaaaacccaggtgggcgtaggggtccaaaaggaaggcgtgttccacaccatgtggcacgttacgcgcggcgccgtgctcacctacaatgggaagaggctggagcccaactgggcgtccgtgaagaaggacttgatctcgtatggcggaggctggagactctccgcgcaatggcaaaagggggaggaggtacaggtgattgccgttgagcccgggaagaaccccaagaacttccagactatgcccggcacattccagaccaccacgggggagattggggccatcgcgttggatttcaaacccgggacaagcggtagccccataattaaccgggagggaaaggtcgtgggtttatatggcaacggtgtggtcaccaagaatggcgggtacgtctccggcatcgcccagacaaacgccgagccggacggccccacccccgagctggaagaggagatgttcaagaagcgcaatctcaccatcatggacctgcacccgggaagcggaaagacgcggaagtacctaccggccatcgtgagagaggccatcaaacgtagactccgtaccttaattctggcgcccacgcgcgtcgttgccgccgagatggaggaggcactcaaggggctgcctatacggtaccagaccacggccacaaaatccgagcatacaggaagggagatcgtagatctgatgtgccacgcgacatttacgatgaggctcctgagccccgtcagggttcccaactataacctgatcatcatggacgaagcccactttaccgaccccgcatcaatcgccgcccgggggtacattagcacgcgcgtgggcatgggagaagctgccgcgatcttcatgaccgcaacgccgcccggtactgcggatgctttcccgcagtccaacgccccaatccaggacgaggagagggacatccccgagcggagctggaacagtggaaacgagtggatcaccgatttcgcagggaagacagtatggtttgtacccagcataaaagcaggcaacgatatcgccaattgcctccgtaagaatgggaagaaggtgatccagctctcccggaaaacgttcgacaccgagtatcagaaaaccaagctcaacgactgggactttgttgtgaccacggacatcagcgagatgggcgccaactttaaagccgaccgcgtaatagacccaagacgctgcctaaaacccgtcatcctaacagacggccccgagcgagtgattctggccgggcccatgccggtgaccgccgcttccgccgcccagcgccgaggcagagtagggcggaacccccagaaagagaacgatcagtacatcttcaccggacagcccctcaacaatgacgaggaccacgcccattggactgaggccaagatgctgctggataacatcaacacgcccgaggggatcatccccgccttattcgagcccgagcgggagaaaagcgctgccattgacggcgagtaccgcctgaagggggagtcacgcaagacctttgtggagctgatgcggagaggtgacctccccgtgtggctcgcccacaaggtggcctcagagggcatcaagtataccgaccggaaatggtgcttcgatgggcaacgcaacaatcagatcttagaggaaaatatggacgtggagatctggacaaaggagggcgaaaagaagaagctcagacctcgctggctggacgctcgaacgtattccgacccgttggcactcaaagagttcaaggacttcgccgccgggcgaaagagcatcgcgctagacctggtcacagagatcgggcgagtgccatcccacctcgctcaccggacgcgcaacgccctcgacaaccttgtaatgctccacacgagcgaacacggcgggaaggcctaccggcatgccgtggaggagctgcccgagacgatggagaccctcctcttactgggcctgatgatcctgctgaccgggggcgcaatgcttttcctaattagcggcaaagggatcggcaagacctccatcgggctgatctgcgtcattgccagcagcggaatgctctggatggccgaaattccgttgcagtggatcgccagcgccatcgtgttggagttcttcatgatggtcctcctgatacccgaaccggagaagcagcgcactccccaggacaaccagctggcgtacgtggtgattgggatcctcaccctggcagccataatagccgcgaacgagatgggcctgttagaaacgaccaagcgggacctaggcatgagcaaggagccgggggtcgtgagccccacgtcctatctggacgtggacctccaccccgcaagcgcatggaccctgtatgccgtggccacgaccgtaatcacgcccatgctgcgacacaccatcgaaaattcaaccgctaacgtcagcctcgccgcgattgccaaccaagccgtcgtgctcatgggcctggacaagggatggccgatttccaagatggatctaggcgtgcccctgttagcgctcggctgctactcacaagtcaaccccctaaccttaacggccgccgttctcctactcatcacccactatgcgataattggccccggcctccaggccaaagcaaccagagaggcccagaagcgcaccgctgccgggataatgaagaacccgacggtggatggcattatgaccatcgatctagaccccgtcatctacgactcaaagttcgaaaagcagctgggccaggtgatgctcctcgtgctgtgcgctgtccagctcctgctgatgcggacaagctgggcactctgcgaggcccttaccttggctacgggccccataacgaccctctgggagggatcccctggtaagttctggaacaccactatcgccgtcagcatggcgaacatcttccgcggctcctacctggcaggggccggcttggccttcagtataatgaagtccgtggggaccggcaagcgaggtaccggtagccagggcgagactctgggggagaaatggaagaagaaacttaatcagctgtcacgcaaggagttcgacttatataaaaagtctggcatcaccgaggtcgaccggacagaggccaaggaggggttgaagcgcggcgagatcacccaccacgcggtaagccggggctccgctaagctacagtggttcgtggagcgcaacatggtcatccctgaggggcgtgtcatcgacctcggctgtggtcgaggagggtggagctattactgcgccggcctgaagaaggtgaccgaggtccgggggtacaccaaaggagggcctggccacgaagaaccagtgcccatgtccacgtacggttggaacatcgtgaagctaatgtcagggaaggacgtcttctatctcccgcccgagaagtgtgatacactactgtgtgacataggtgaaagtagcccttcgcccaccgtggaggagagccgcaccatccgcgtgctgaagatggtggagccttggctcaagaacaaccaattctgcatcaaggtgctgaacccttacatgcctacggtcattgagcatcttgagcggctccaacgcaagcatggcgggatgctggtccggaacccattatcccgcaactcgacccatgagatgtactggattagcaacgggaccggcaatatcgtggccagcgtcaacatggtcagccgcctgctgctgaatcgcttcacgatgacgcaccggcggcccaccatcgagaaggatgttgacctcggcgccggcacaaggcacgtgaatgctgaacccgagaccccaaatatggacgtcataggggaaagaatcaaacggatcaaagaggagcacaactcgacgtggcactacgatgacgagaatccatataagacctgggcttatcacggctcctacgaagtgaaggccacagggagcgcctccagcatgatcaacggtgtagtgaaactcctgaccaaaccctgggacgttgtacccatggttacgcagatggccatgaccgacacgacgcccttcggccagcagcgggtgttcaaggagaaggtcgacacgcggaccccgcgctctatgccgggcacacgcagggtaatgggcataacagcggagtggttgtggcggacgctggggagaaacaagaaaccccgtctgtgcacacgcgaagagtttactaagaaggttcgcaccaatgctgccatgggcgccgtcttcacggaagagaaccagtgggactccgcgaaggcagcggtagaggatgaggacttctggatccttgtggaccgggagcgcgaattacacaaacttgggaaatgcggatcctgcgtgtataacatgatggggaaaagggagaagaagctgggagagtttggcaaggccaaaggctctcgcgcaatctggtatatgtggttaggcgcgcggtacctggagttcgaggccctcggattccttaacgaagaccactggtttagtagggaaaattcctacagcggcgtggagggggagggcctgcacaagttaggctatatcttgcgggacatctccaagatccccggaggcgccatgtatgccgacgacaccgcggggtgggacacccgcatcaccgaggatgacttgcacaacgaggagaagatcacgcaacagatggacccagagcaccggcagctcgcgaacgcgattttcaagctgacctaccagaataaggtggtgaaagtgcagcgccccactcctaccggcacggtaatggatatcatctcacgtaaggaccagagaggctccgggcaagtcggcacctatggcctgaacaccttcaccaacatggaggcacagctcataagacagatggagggggaaggagttctgagcaaggcagatctggagaaccctcacctcccggaaaagaagataacgcagtggttagaaacgaagggggtggagagattgaagcggatggccatatccggcgacgactgcgtggtgaagcccatcgacgaccgctttgcgaacgcgctcctggccctgaacgatatgggaaaggtgcggaaggacatcccccagtggcagcccagtaagggctggcatgactggcagcaggtcccgttctgcagccaccactttcacgaattgatcatgaaggacggacgcaaacttgtagttccctgtagaccccaggacgagctaattgggcgtgccaggatcagccagggggccggttggtccctccgcgaaaccgcgtgcctaggaaaggcctacgcccagatgtggagcctgatgtactttcaccggcgtgaccttaggctggcctccaacgcgatctgcagcgccgtccccgtgcactgggtaccgacctccaggaccacctggagcatccacgcccaccaccagtggatgactaccgaggatatgctgaccgtatggaaccgcgtatggatcgaggacaatccatggatggaggataagacccccgtgaccacttgggagaacgtaccctacctcggaaagcgagaggaccagtggtgtggctcgctgatagggctgacctcccgcgcaacgtgggcccagaacatcccaactgctatccaacaggtacggagcctcataggcaatgaagagttcctggactacatgccctccatgaagcgtttccggaaggaggaggagagcgagggggccatctggtga

SEQ ID NO: 25993 - RNA, 9873 nt, synthetic construct
  misc_feature 1..9873: note = derived and/or modified CDS sequence (opt11) from DENV-3__FJ547073__SS-prME
  source 1..9873: mol_type = other RNA
accagcctgtgtctgatgatgatcctgccggcggccctggctttccacctcacgtccagggacggggagccccgtatgatagtggggaagaacgagcgtggcaagagcttgctgttcaaaacggcctcagggatcaacatgtgcaccctcattgccatggacctgggcgagatgtgcgacgacaccgtgacctacaagtgccctcacataacggaagtagagcccgaggacatcgactgctggtgcaacctgacgagcacctgggtgacctatgggacgtgcaaccaggcaggcgagcaccggcgcgataagcggtccgtggcccttgcgcctcacgtgggcatggggctggacaccaggactcaaacctggatgagcgccgagggcgcctggcggcaagtagaaaaggtcgagacgtgggccctgcgccaccctgggttcaccatcttggcgctgtttctggcccactacatcggcacctccctgacccagaaggtagtaatcttcatcctgctgatgctcgtgaccccctctatgacaatgcggtgcgtgggcgtcggcaaccgcgatttcgtcgagggcttatccggggctacctgggtggacgtggtactggaacacggcgggtgcgtaaccaccatggcgaagaacaagcccaccctcgacatcgagttgcaaaagaccgaagctacacagctggcgacgctccggaagctgtgcatcgaaggtaaaatcaccaacatcaccacagacagccggtgcccgacgcagggcgaagctgtgctgcctgaggaacaggaccagaactacgtctgcaagcacacctacgtggatcgcggatggggcaacgggtgcggtctcttcgggaagggctccctggtcacgtgcgccaaattccagtgcctggagccaatagaagggaaggttgtgcagtacgagaacctcaagtacactgtgatcatcacggtccacaccggggaccagcaccaagtgggcaacgagacccagggggtcaccgccgagattacgccccaggccagcaccaccgaggcgatcctgcccgagtacggcactctggggctcgagtgctccccgcgaaccggcctggacttcaacgagatgatcctgctcacaatgaaaaacaaggcctggatggtacaccggcagtggttcttcgatctgcccttaccctggaccagcggcgccacaacggagacgccgacctggaaccgcaaggagctcctggtgaccttcaagaacgcccatgccaagaagcaggaggtcgtggtgctggggtcccaggagggtgcgatgcacaccgccctcacgggggctaccgagatccaaaatagtggggggacctccatcttcgccggtcacctcaagtgtcggctgaaaatggacaaactggagctgaaggggatgagctacgccatgtgtaccaatacgttcgtcctgaagaaagaggtgtccgaaacccaacacgggaccatccttattaaggtggagtacaagggcgaagacgtcccttgtaagatccccttcagcaccgaggacgggcagggcaaggcgcacaacggtcgcctgatcacggccaaccccgtggtgacgaagaaggaagagcccgtcaacattgaggccgagccgccgttcggcgagagcaacattgtgatcggcatcggggataacgccctgaagatcaattggtacaagaagggctcctcaatcgggaagatgttcgaggcaaccgccagaggcgcccgccggatggccattctgggcgataccgcctgggatttcggcagcgtgggcggagtcttgaacagcctgggcaaaatggttcaccagattttcggaagtgcgtacacagctctgttcagcggcgtgtcctgggtcatgaaaatcggcattggggtgctcctgacctggatcggcctcaactcaaagaatacctctatgagcttttcctgcatcgtgatcgggatcatcaccctctacctgggcgccgtcgtgcaggccgacatgggctgcgtgatcaactggaagggcaaggagctgaagtgcggcagcgggatcttcgttacgaacgaggtgcacacttggacggagcagtacaagtttcaggccgatagcccaaagcgtctagccaccgccatcgccggtgcctgggagaacggggtgtgcggcatcaggagtacgacacggatggagaatctgctgtggaagcagatcgctaacgagctcaactacatcctgtgggagaacaacatcaaattgaccgtagtggtgggggacatcataggcgtcctcgagcagggcaaacgtaccctgaccccacagccgatggagctgaagtattcctggaagacctgggggaaggcgaagatcgttaccgccgagacccagaacagctccttcatcatagacggccccaacacccccgagtgccccagcgcctcccgcgcctggaacgtgtgggaagtcgaagactacgggtttggcgtgttcaccaccaatatctggctaaagctgagggaggtgtacacccagttgtgtgaccacaggttaatgagcgcggccgttaaggacgaacgcgccgtgcacgccgacatgggttattggatcgagagccagaagaatgggtcctggaagctggagaaggccagcctgatcgaagtgaagacatgcacgtggccgaaatcccacaccctgtggagtaacggtgtactggagtcagacatgatcatccccaagagcctggcggggcccatatcccaacataactaccgcccgggctatcacacccagaccgccgggccctggcacctcggaaagctggagctggacttcaactactgcgaggggacgaccgtggtgatcaccgagaactgtgggacccgcggccccagcctccgaactacgaccgtctcgggcaagctaatccatgagtggtgctgccgaagctgtaccctcccacctctgcggtacatgggggaggatggctgctggtacggcatggagatccgccccatctcagaaaaggaggagaacatggtcaagtcactggtgtccgcgggcagcggcaaagtagacaactttacgatgggggtgttgtgtctcgccatcctgttcgaggaggtgatgcgggggaagttcggcaagaagcatatgatcgctggggtcttcttcacattcgtgctgctactgtccggacagatcacatggcgcgacatggcgcacaccctgatcatgatcggcagcaacgcatccgaccggatggggatgggcgtcacgtacctcgccctgatcgccaccttcaagatccagcccttcttagccctcgggttcttcctgcgcaaactgaccagccgggagaacctcttgttgggggtcggcctcgcgatggccaccacgctgcagctgcccgaggacatcgagcaaatggcgaacggcatcgcgttgggcctgatggcgctgaaactcatcacccaattcgagacataccagctatggaccgccctcatcagcttaacttgctccaacaccatcttcaccctgacagtggcctggcgcacggccaccctgatcctcgccggggtcagcctgctgccggtgtgccagtccagctccatgcggaaaaccgactggctccccatgaccgtggcggcgatgggtgttccgcccctcccgctgttcatcttcagcctcaaggacacactgaagaggcgctcctggcccctaaacgagggggtgatggccgtgggcctcgtgagcattctggcctccagcctcctccggaacgacgtgcccatggccggccccctggtggccggcgggctgctcatcgcttgctatgttatcacagggacctccgcagacctgaccgtagaaaaggccgccgacgtgacgtgggaggaggaggccgagcagaccggggtcagccataacctaatgatcaccgtggacgatgacgggaccatgcgaatcaaggacgacgaaaccgagaacatcttaaccgtgctgctgaagaccgccctcctgatagtcagtggcatcttcccgtacagcatccccgcaaccctactcgtatggcatacgtggcaaaagcaaacacagagatccggagtgctgtgggacgtcccctcgccgcccgaaacacagaaggccgagctggaagagggagtctaccggatcaagcagcagggaatattcggaaagacacaggtgggtgtcggggtgcagaaggagggcgtgttccacaccatgtggcacgtcacgcggggagccgtgctcacctacaacgggaagcgcttagagcccaactgggcgagtgtgaagaaggacctgatcagctacggcgggggctggcggctttccgcgcagtggcagaagggggaggaagtgcaggtgatagcagtggagccaggcaaaaatcccaagaacttccagaccatgcccggcacattccagacgaccaccggcgagatcggcgccatcgcgctggatttcaaacccgggacgagcggctctcccataataaaccgcgagggcaaggtggtggggctatacggcaacggggtggtcacgaaaaacggcggctacgtgtccggcatcgcccagaccaacgccgagccggatggtcccacccccgagctcgaggaggagatgttcaagaagcggaacctcaccatcatggacctgcaccccggatccggcaagacgcgcaagtacctgccggccatcgtgcgggaggccataaagcgccggctccgcaccctgatcctggccccgacacgggtcgtggccgcggaaatggaggaggccctgaaagggctgcccatccggtaccagaccacggccaccaagtcggaacacaccggccgcgagatcgtggacttaatgtgccacgctacctttacgatgcgcctcctgagccccgtccgggtcccgaattacaacctgatcatcatggacgaagcgcacttcaccgatcccgcctccatcgccgcccgcggatacattagcacccgggtgggcatgggcgaggcagccgcgatcttcatgaccgccacgccgcccgggaccgccgacgcctttccgcagtccaacgcccccatccaggacgaggaacgggacatccccgagcgcagctggaactccggcaacgagtggatcactgacttcgccgggaagacagtctggttcgtgccctcgatcaaggccggcaacgacatcgcaaactgcctccggaagaatgggaagaaggtcatccagctgtcccgcaagacgttcgacaccgagtaccaaaagacgaaactgaatgactgggacttcgtcgtcacaacggacataagcgagatgggcgccaacttcaaagccgatcgggtgatcgacccgagacgctgcctaaagcccgtcatcttaaccgacggccctgagcgcgtgatcctggccggacccatgccggtgacagccgcgtccgccgcccagcggcgcggccgggtggggcgcaatccacagaaggagaacgatcagtacatcttcaccggccagcccctcaataacgacgaggaccacgcccattggaccgaggccaagatgctgctggacaacatcaacacgcctgaggggattatcccggctctcttcgagcctgagcgggagaagtccgccgccatcgatggcgagtaccgcctgaagggcgagtctcggaaaaccttcgtggagctgatgcgtcgcggggacttgcccgtatggctggcccacaaggtggcgagcgagggaattaagtacaccgaccgcaagtggtgcttcgacggtcagcgcaacaatcaaatcctggaggagaacatggacgtcgagatctggaccaaggagggcgagaagaagaagctcagaccccggtggctggacgcccgcacgtactccgacccgctcgccctcaaggaattcaaggacttcgccgccgggcgcaagagcatcgcgctggacctggtcactgagatcgggcgggtacccagccatctcgctcaccgcacccggaacgccttagacaatctagtgatgctccacacctcagagcacggcgggaaggcctaccgatacgccgtcgaggagctgcccgagacgatggagaccctgctccttctgggtcttatgatcctgctgaccgggggcgccatgttgttcctgatcagcggcaaggggataggtaagacctccatcggtctgatctgtgttatcgctagctctggcatgctctggatggccgagatcccactgcagtggatcgccagcgccatagtgctggaattcttcatgatggtcctcctgatccctgagcccgaaaagcagcggacgccgcaggacaaccagctagcgtacgtggtgatcggcatactgaccctggctgctatcatagccgccaacgaaatgggcttactcgagaccaccaaacgcgacctgggcatgagcaaggagcccggggtcgtctcacccacgagttacctggacgtagatctccaccccgcgtcagcctggaccctgtacgccgtcgccactacagtgatcacgccgatgctgcggcacaccatcgagaattcaaccgcgaacgtgagcctcgccgccatcgccaaccaggccgtcgttttaatgggcctggacaaggggtggcctatttccaagatggacctaggcgtgcccctgctcgcgctcgggtgctatagccaggtcaaccccctgacattgacggccgccgtgctcctgcttataacccactacgccatcatcggccccggactccaggccaaggcgacccgcgaggcccagaagcggaccgccgccgggatcatgaagaacccgacggtggacggcattatgacgatcgatctggaccccgtgatctacgactcaaagttcgagaagcaactgggccaggtgatgctcctggttctgtgcgcggtccagctcctgctaatgcgcacctcctgggcgctctgcgaggccctgaccctcgccaccggacccataaccacgctctgggagggctcccccggtaaattctggaataccaccattgcggtaagcatggccaacatcttcaggggttcctacctggccggggccggcctggccttcagcatcatgaagtccgtggggaccggcaagcgcggcaccgggagccaaggcgagaccctcggggagaagtggaagaagaagctgaaccagctgagccgtaaggaattcgacctgtacaagaagtccggaatcaccgaggtcgaccgcacagaggccaaggaggggttgaaacggggcgagatcacccaccacgccgtgagccgcggtagtgccaagctgcagtggttcgtggaacggaatatggtcatacctgaggggcgcgtgatcgacctcggttgcgggaggggcgggtggagctactactgcgccggcctgaagaaggtgaccgaagtccgcgggtacactaagggcggtcccgggcacgaggagcccgtgccaatgtccacgtacgggtggaacatcgtgaagctgatgagcggcaaggacgtcttctacctcccgcccgagaagtgcgataccttattatgcgacatcggcgagtcctccccctcccccaccgtggaggagtctcggaccatccgcgtcctgaagatggtcgagccgtggctcaagaacaaccaattctgcatcaaggtgctgaacccatacatgcccacggtgatcgagcacctggagcgcttacagcgtaagcacggggggatgctggtgcgcaatcccttatcgcgaaacagcacccacgagatgtactggatctccaacggcaccggcaacatcgtggctagcgtgaacatggtgtcccgcctcttgctgaaccggttcaccatgacccaccgccggccgaccatcgaaaaggacgtggacctcggcgccggcacccgacacgtaaacgcggagcccgagacaccgaacatggacgtcatcggagagcggataaagcgcataaaggaggagcacaacagcacttggcactacgacgatgaaaacccgtacaagacatgggcctaccacggctcctacgaggtgaaggcgaccgggagcgcctcctcaatgataaacggagtagtgaagctgctgaccaagccctgggacgtggtacccatggtgacacagatggcaatgaccgacaccacccccttcgggcagcagcgggtgtttaaggagaaagtcgatacacgcaccccgcggagcatgccaggcacccgccgggttatgggtatcaccgcggagtggctctggcgcacgttagggcgcaacaagaagccccgcctgtgcacccgggaggagttcaccaagaaggtgcgcactaatgccgctatgggcgccgtcttcaccgaggagaaccagtgggactccgcgaaggccgcagtggaggacgaagacttctggatcctagtggaccgcgagcgggaactgcacaaactggggaagtgcggcagttgcgtctataatatgatggggaagcgcgagaagaagctcggcgagttcggcaaggccaagggttccagggccatctggtacatgtggctaggcgcaaggtacctggagttcgaggcgctcgggttcctgaacgaagaccactggtttagccgggagaactcctacagcggcgtagagggggaaggcctgcacaagctcggttacatcctgcgcgacatctccaagatccccgggggcgccatgtacgccgacgacaccgccgggtgggacacccggatcaccgaggacgacctgcacaacgaggagaagatcacgcaacagatggatccggagcaccgccagctcgcaaacgcaatcttcaaactgacctaccagaacaaggtggtgaaagtgcagcggcccacccccacggggaccgtgatggacatcatcagccgcaaggaccagcgggggtccgggcaggtcggcacgtacgggctgaataccttcacaaacatggaggcacagctcatccgccaaatggagggcgagggggtgctgtcaaaggccgacctggagaacccccacctgccggaaaagaagatcactcagtggctggagacgaagggcgtcgaacggttgaagcgcatggccatctccggcgacgattgcgtcgtaaagcccatcgacgaccggttcgcgaacgccctcctagccctgaacgatatggggaaggtgcgcaaggacatcccccagtggcagcccagcaaggggtggcacgactggcagcaggtccctttctgctcccaccacttccacgagttaatcatgaaggacgggcggaagctggttgtgccatgcaggccacaggacgagctgatcggccgggctagaatcagccagggtgccggctggtccctacgggagaccgcatgcctgggaaaggcgtacgcgcagatgtggagcctgatgtatttccaccgccgcgacttgcggctggcctccaacgcgatttgttcggccgttcccgtgcactgggtgccgacctcccgcaccacatggagcatccacgcccaccaccaatggatgaccaccgaggacatgctaaccgtgtggaaccgggtgtggatcgaggataacccctggatggaggacaagacgcccgtaaccacctgggagaacgtgccctacctcgggaaacgggaggatcagtggtgcggcagcctgattgggctgacgtcccgggcaacgtgggcccagaacatccccactgccatccagcaagtccgcagcctcattggcaacgaagagttcctggactacatgccgtccatgaaacggtttcgcaaggaggaggaaagcgagggtgccatctggtga

SEQ ID NO: 25994 - RNA, 9873 nt, synthetic construct
  misc_feature 1..9873: note = derived and/or modified CDS sequence (opt11) from DENV-3__FJ547074__SS-prME
  source 1..9873: mol_type = other RNA
acctccctatgtctcatgatgatcctgcccgcggcgctagcgtttcatctcaccagccgggatggggagcctcggatgatcgtggggaagaacgaacgcggtaagagcctcctgttcaagactgccagcgggatcaacatgtgcaccctcatcgcgatggacttaggagaaatgtgcgacgataccgtgacgtataagtgtccccacataacggaggtcgaacccgaggacattgactgttggtgcaacttaactagcacctgggtgacctacgggacatgcaatcaggcaggcgaacaccgaagagacaagcgcagtgtggccttagcgccccacgtcggcatggggctggacacgcgcacccagacatggatgtccgccgagggcgcatggcggcaagtagaaaaagtcgagacgtgggcgctacggcacccgggctttaccatccttgcgttgttcctggctcactatatcggcacatccttgacccagaaggtggtgatctttatattgctgatgctcgtaacgccctccatgaccatgcgatgtgtcggggtcggtaaccgcgacttcgttgagggcctgtccggggccacctgggtggatgtagtcttggaacacggggggtgtgtcacgacgatggccaagaataagcccaccctagacatcgagttgcagaaaactgaagcaacccaactcgcgacgctccggaagttgtgcatcgaaggtaagattaccaacatcaccactgacagcagatgccccacgcagggcgaggccgtgctgccagaggagcaggaccagaactacgtctgcaagcatacctacgtggaccgggggtggggcaacgggtgcggcctctttgggaagggttccctcgtgacgtgcgcgaagttccagtgcctagagcccatagagggcaaggttgtgcagtatgagaacctcaagtatacggtaatcataacggtgcataccggtgaccagcaccaagtgggcaacgagacccagggggttaccgcggagatcacgcctcaggcctccacgactgaggcgatcctgcctgaatacggcaccctggggctggaatgctccccgcgaacgggcttagacttcaacgagatgatcctgctaactatgaagaacaaagcttggatggtgcaccggcagtggttcttcgacctgcccctaccctggacctccggcgccaccaccgagactcctacgtggaacaggaaggaactcctggtgaccttcaaaaacgcccacgccaagaagcaggaagtcgtagtgctggggtcccaggagggcgctatgcacaccgcccttacgggggccactgagatccagaactcgggtggcacgtccatctttgccggacatctgaaatgtagactgaagatggacaaactcgaacttaaaggcatgtcgtacgccatgtgtaccaacacgtttgtgctgaaaaaggaggtatcagagacccaacacgggactatcctgatcaaggtcgagtacaaaggcgaggacgtcccgtgtaagattccctttagcaccgaggacgggcagggcaaggctcacaacgggcgcctaattacggccaatcccgtggtgaccaagaaggaggagcccgtaaacatcgaggcggaaccgccatttggggagtctaacatcgtgatcggcattggagataacgcactgaagattaattggtacaaaaaaggctcctcaatcggcaagatgttcgaagcgacggcccgcggcgcccgccgtatggccatcctgggcgacaccgcctgggatttcgggtccgtaggcggggtcctcaacagcctgggcaagatggtgcaccagattttcggctccgcgtacacggccctgtttagcggcgtgtcctgggtcatgaagatcggcataggggtgctcctaacgtggatcggcctgaatagcaagaacacctccatgagcttctcctgcatcgtgattgggatcattaccttatatttgggcgcagtcgtgcaggcagacatggggtgcgtgatcaactggaaaggtaaggaactgaagtgcggcagcgggattttcgtcacgaatgaggtgcacacctggacggagcagtacaagttccaggccgattcgcccaaaaggctcgcaaccgcaatcgccggagcctgggagaacggggtgtgcggcatccgctcaacgactaggatggagaacttactgtggaagcagatcgccaatgagctcaactatatcctgtgggagaacaatataaaactgaccgttgtggttggggacatcatcggcgtcttagagcagggcaagcgcacgcttacgccccaaccgatggagctgaagtactcctggaagacctggggaaaggcaaagatcgtgaccgcagagacacagaacagctccttcatcatcgacggccccaatacgcccgagtgccctagtgcctcccgagcctggaacgtgtgggaggtcgaggactacgggtttggcgtttttaccaccaacatatggctcaagctgcgcgaggtgtacacgcagctgtgcgatcacagacttatgagcgccgccgtcaaggacgagcgggccgtgcacgctgacatgggctattggatcgagagccagaagaacgggtcctggaaactggagaaggccagcctgatagaagtgaagacttgcacgtggccgaagtcacacactctctggtcaaatggcgtcctggaatccgacatgatcatccctaaatcgctggcggggcccatttcccagcacaactaccggcctggataccacacgcagaccgccgggccctggcacctgggtaagctggagttggacttcaattactgcgagggcacgactgtggtgatcaccgagaactgcggaacgcgcggccccagcttacggacgacgaccgtctccggaaagctgatccacgaatggtgctgccgtagttgcacgttgcccccgttgcggtacatgggtgaggatgggtgctggtacggcatggagatacgaccaatctccgagaaagaggagaacatggtcaagagcttggtctccgcgggttccgggaaggtcgacaactttacgatgggcgtactctgtctcgccatcctgttcgaagaggtgatgcgaggaaaattcggcaagaagcacatgatagccggggtcttcttcacctttgtgctgctcctatccggccagattacttggcgggacatggcgcacacactgatcatgatcggcagtaacgcttccgaccggatggggatgggcgtaacgtacctagccctgatcgccaccttcaaaatccagcccttcctggcattagggttcttcctgcgaaaactgacctcacgggaaaatctcctcctgggggtcggtttagcgatggcaacgacgctgcaactccccgaagacatagagcagatggccaacgggatcgccctcggcttgatggcgttgaagctcatcacccagttcgagacctaccagttatggaccgccctcatttctctgacatgctccaacacaatctttaccctgaccgtcgcctggcgcaccgccacactcatcctcgccggagtcagcctgctgccggtctgccagtccagctccatgcggaagacggactggctgcctatgactgttgcggccatgggcgtgccgcccttacctctgtttatattcagccttaaggacacgctgaaacggaggtcctggccactcaacgagggggtgatggccgtcggcttggtcagcatcttagcctccagtttactccggaacgacgtgccgatggcaggaccgctggtggccggtgggctgctcatcgcctgctacgtcataaccggcacctccgccgatctgaccgtcgagaaagccgctgacgttacatgggaagaggaagcagagcagaccggggtctcacacaacctgatgatcacggtggacgacgatgggaccatgcgcatcaaggatgacgagaccgagaacatcctaacggtgctgctgaaaaccgctctgctgatcgtctccggaatcttcccttacagcatccccgcgaccttactcgtgtggcacacctggcagaagcagacgcaacggtcgggcgtgctgtgggacgtccccagccctcccgagacccagaaagcagagttagaggagggggtgtacagaatcaagcagcaggggatcttcggaaagacgcaagtaggggtcggggttcaaaaggaaggcgttttccacacgatgtggcacgttaccagaggcgccgtactaacctataacggtaagcgtctggaacccaactgggcatctgtcaagaaggacctgatcagctacgggggcggctggcggctcagtgcccaatggcagaagggtgaggaggtccaggtgatcgcggtggagcctgggaagaatcccaagaactttcagaccatgcccggcacctttcagacgacgacgggggaaatcggcgccatcgcgctggactttaagcccgggaccagtggcagccctattatcaacagagagggtaaggtcgtgggcctgtacggaaacggggtcgtgacaaagaacggtgggtatgtgtccggcatcgcccagaccaatgccgaaccggacggtccaacccccgagctggaggaagagatgttcaaaaagcggaacctcaccatcatggacctgcacccagggagtggcaagacgcgcaaatacctgccggccatcgtgcgggaggccataaagcgccggttacgtaccctgatcctggccccgactcgtgtcgtggccgccgagatggaggaggcactcaaggggctcccgatacgctaccagaccacagccacgaagtccgagcataccggtcgggagatagtggacctgatgtgtcacgcgaccttcacgatgcggctgctgagccccgtacgggtgcctaactacaacttgattatcatggacgaggcccacttcacggacccggcaagcatcgccgcccgcgggtacatcagcacccgtgtgggaatgggcgaggcggccgccatatttatgacagcgaccccccccgggaccgccgacgcctttccacagtcgaacgccccaatccaggacgaagaacgcgacatccccgagcgcagctggaacagtggtaatgagtggatcaccgactttgccggtaaaaccgtctggttcgttccatcaatcaaagccggcaatgatatcgcgaactgtctacggaaaaatggcaagaaggtaattcagctgagtcgcaagactttcgacaccgagtaccagaaaaccaagctgaacgattgggacttcgtcgtaaccacagacattagcgagatgggcgccaatttcaaggcagatcgagtaatcgatccgcgacgctgcctcaagcccgtgattctgaccgatggccccgagagggtgatcctggccggtcccatgcctgtcacagcagcgtcggccgcccagcgtcggggccgggtcgggcgcaatccccagaaggaaaacgaccaatacattttcacaggccaacccctcaacaacgatgaggatcatgcccactggaccgaggcgaagatgctgctagacaatatcaatacccccgaggggatcatcccggccctcttcgagcccgagcgggagaagtcggccgccatcgatggcgaataccgcctgaagggcgagtcccggaagaccttcgttgaactgatgcgccgcggtgaccttcccgtctggctggcccacaaggtggcgagcgagggcattaaatacaccgaccgcaagtggtgcttcgacgggcagcggaacaatcagatcctggaggaaaacatggacgtagagatctggaccaaagagggcgagaagaagaaactccgcccccggtggctcgacgccagaacttactccgaccccctggccctcaaggagttcaaagacttcgccgccggccgcaagtctatcgccctggacttagttactgagatcgggcgggtaccctcccacctcgcccacagaacccggaacgcgctagacaacctagtgatgctccacacgagcgagcacggcggcaaggcctaccgccacgccgtcgaggagctgcccgagacgatggagacactgttgctgctcggcctaatgatactgctgacagggggcgctatgctgtttctgatcagcggcaaggggatcggcaaaacgtccatcgggctcatttgcgtgatcgccagttccgggatgctctggatggctgagatcccgctacagtggatcgcctcggctatcgtcctggaattcttcatgatggtccttctaatccccgagcccgagaaacaacgaacgccccaagataaccagttggcctacgtggtgatcggaatcttgacgctcgccgccataatcgccgcaaacgagatgggcctgctagagaccactaaacgggacctgggcatgtccaaggagccgggagtcgtgtccccgacgagttacctggacgtagacctccatcccgcgtcagcctggaccctatacgctgtagccaccacagtcatcacgcctatgctccggcacaccatcgagaactctaccgctaacgtgagcctggcagcgatcgccaaccaggcggtggtgctaatgggccttgacaaaggttggcctatatccaagatggacctcggcgtgccgttattagcgctcgggtgctacagccaagtgaaccccctgaccctgacggcagccgtattgctcctcataacccactacgccatcatcggccctggcctccaggccaaggcgactagggaggcacagaagcggaccgctgccgggatcatgaagaaccctacggtggacggtatcatgaccatcgacctggacccagtcatctatgactccaagttcgagaagcaactgggacaagtgatgctcttagtgctgtgcgccgtccagcttctactgatgcgcactagctgggctttatgcgaggcactgacccttgccacgggccccatcaccaccttgtgggaaggcagccccgggaaattctggaacacgacgatcgccgtcagcatggcgaacatcttccggggctcgtacttagccggagccggcctggccttcagcatcatgaagtccgtgggtaccggtaaaaggggcaccgggagccaaggcgagacccttggggagaagtggaaaaagaagctgaaccagctcagccggaaggagttcgacctctacaagaagtccggaattaccgaggtagaccgcacggaggcgaaggaggggctgaagcggggcgagataacccaccatgcggtgagccgcggttccgcaaagcttcaatggttcgttgaacggaacatggtcatcccggaagggcgcgtgatagacttggggtgcgggcggggggggtggtcctactactgcgccgggctgaaaaaggtgaccgaggtgaggggctacaccaagggcgggcccgggcacgaggagcccgtgcctatgtccacatacggctggaacatcgtgaaactgatgtcaggcaaagacgtcttctacttgccaccggagaaatgcgacactcttctttgtgacatcggcgaatccagtccctcccccactgtagaggaatccagaacaatccgtgtcctgaagatggtcgaaccgtggcttaagaacaaccagttctgtatcaaggttctgaacccctatatgcccacggtaatcgagcacctggaacgacttcagcgaaagcacggcggcatgctggtacgcaaccccctgtcccggaatagcacccacgagatgtactggatctccaacggcactgggaacattgtagccagcgtgaacatggtctccaggctcctgctgaaccggttcaccatgacttatagacggccgaccattgaaaaggacgtggtgctcggcgccggcacccggcacgtcaacgcggagccggagacccccaacatggatgtgatcggggagcggatcaagcgcatcaaggaggagcacaacagcacatggcactatgacgacgagaacccgtacaaaacctgggcctaccacgggtcctatgaggtgaaagccactggttcggcttccagcatgatcaacggcgtggttaagcttctgaccaagccctgggacgtcgtacctatggtaacgcagatggccatgaccgacaccactcccttcggccaacagcgggtcttcaaggagaaggtggacactcgcaccccgcggagcatgcccggcacccgccgggtgatggggattacggccgaatggctctggcgcacgcttgggcggaataagaagccccgcctgtgtacccgggaagagttcactaagaaagtccgcacaaacgccgccatgggagccgtattcacggaagagaaccagtgggattccgcgaaagccgcggtggaagacgaggacttttggatcctcgtggacagagagcgagaacttcacaagctgggcaagtgcggcagttgcgtgtataacatgatggggaagcgcgagaagaagctaggcgaattcgggaaggccaaggggtctagggccatctggtacatgtggttgggggcgcgctacctagagttcgaagctctcgggttcctgaacgaggaccactggttcagccgcgagaatagttactccggcgtcgagggagagggcctgcacaagctgggctacatcctgagagacatttccaagataccagggggcgccatgtatgctgatgacaccgccgggtgggacaccaggatcaccgaagacgacctgcacaacgaggagaaaatcactcagcagatggacccggaacaccgacagcttgcgaatgccatcttcaagttaacgtaccagaacaaggtcgtcaaggtgcagcgacccacccccacaggcacagtcatggatatcatatcgcgcaaggaccagcgcggctccgggcaggtgggcacgtacgggttgaataccttcaccaacatggaggcccagctaatccgccagatggaaggcgagggggtattaagcaaggccgacctggagaacccccacctaccagaaaagaagatcacccagtggttggaaacgaaaggcgtagagagactgaagcgcatggccatatccggcgacgactgcgtggtgaagccaatagacgatcggttcgcgaacgccctgcttgcactgaacgacatgggtaaagtccgtaaggatatccctcagtggcagcccagcaagggctggcatgactggcaacaagtccccttctgctcacaccactttcacgaactcatcatgaaggacggtcggaagctcgtggtcccttgccgacctcaggacgagctgataggcagggctcgcatctcccagggggccggctggtctctccgggagaccgcgtgcctagggaaggcctatgcccagatgtggagcctgatgtacttccacaggcgcgacctccggttggcctccaacgcgatctgtagtgcggttcctgtgcactgggtgccaacctcccgcacaacgtggagcatccacgcgcatcaccagtggatgaccacagaagacatgctgacagtgtggaaccgtgtgtggatcgaggacaacccctggatggaggacaagacgcccgtcacaacctgggagaatgttccctacctcggcaagcgagaggaccagtggtgcggcagcttaatcggactgacgagccgggccacgtgggctcaaaacattccaacagcgatccagcaggtccgaagcctcatcggcaacgaggaattcctggactatatgccatctatgaaacgattcaggaaagaggaggagtcagagggggccatatggtaa

SEQ ID NO: 25995 - RNA, 9873 nt, synthetic construct
  misc_feature 1..9873: note = derived and/or modified CDS sequence (opt11) from DENV-3__FJ547075__SS-prME
  source 1..9873: mol_type = other RNA
acgagtctctgcctaatgatgatacttcccgcagctctcgcattccatctcacctccagagatggagaacccagaatgatcgtcggcaaaaacgaaagaggcaagagcttgctatttaaaacggcctcaggaataaatatgtgcaccctgatagcgatggacctgggagaaatgtgcgatgacactgtgacgtataaatgtccccacataaccgaagtcgaaccagaagacatagactgctggtgcaacctgacaagtacctgggtaacatacggaacatgcaaccaggcgggggagcaccgacgagacaagaggtcggtcgcactcgccccacatgtgggcatgggcctagacactcgaacacagacttggatgtctgcagaaggcgcatggcgccaagtcgaaaaagtggaaacctgggccctcaggcaccccggttttacaatcctagcactcttcctcgctcactacatcggaactagcctaacacaaaaagtcgtgatctttattttgctcatgctcgtgacgccgagcatgacgatgcgatgtgtaggagtcggaaaccgcgatttcgttgaaggcctaagcggcgccacttgggtggacgtagtgctagaacatggtggctgtgtaaccacgatggcgaaaaacaaacccacgcttgacattgagctacagaaaaccgaggcaacacaactcgcaactttgcgaaaactgtgcatagaaggtaagatcacgaacataaccaccgacagccggtgccccacacagggcgaagccgtactgccagaagaacaggaccaaaactacgtatgtaagcacacatacgtagatcgggggtggggtaatggctgcggcctgttcggaaaggggtcgctagtcacgtgcgccaaatttcaatgtctagaaccaatcgagggcaaagttgtccaatacgagaacctaaaatacacggtcatcatcacagtccatacgggagatcagcaccaggtcggtaacgaaacgcagggggtaacagccgaaataactcctcaggcaagcaccaccgaagccatactaccagagtacgggacgctcggcctagagtgcagcccgcgaaccggcctggactttaatgaaatgatcctcctaaccatgaaaaacaaagcatggatggttcaccgccagtggttcttcgacctgccccttccgtggacgtcaggagctacgacagagaccccaacctggaatagaaaagagctcctcgtgacattcaagaatgcccatgcgaagaagcaagaggtcgtagtcctaggttctcaggaaggcgccatgcacacagcactcacaggtgccaccgagatccaaaactccgggggaacatcgatctttgccggtcacctcaaatgcaggttaaaaatggacaaactagagctaaaaggcatgagctacgcaatgtgcacaaatacgttcgttctcaagaaggaggtctcggagacacaacacggtacgatactgataaaagtggagtacaaaggagaggacgtgccatgcaagatacccttctcgacagaagacggtcaagggaaggcacacaacggaaggttgatcaccgccaatcccgtggtcaccaagaaagaagaacccgtaaacatcgaagctgaaccacccttcggagaaagtaacatcgtgatcggcattggggacaacgcacttaaaatcaactggtacaagaaaggcagctccattggcaagatgttcgaagcaacagcacgaggagcccgaagaatggcgatcctaggtgataccgcatgggacttcggatcggtaggcggagtgctcaatagcctggggaaaatggtacaccagatcttcggatctgcatacacagccttattctcaggggtttcgtgggtcatgaaaatcgggataggtgtcctgcttacctggatcgggttgaacagcaagaacacctccatgtccttttcatgcatagtcatagggataataacactatacctaggggcagtcgtacaagcagacatgggctgcgttatcaactggaaggggaaagagcttaagtgtggatccggtatcttcgtcaccaacgaagttcatacatggacagagcaatacaaattccaagctgactcccccaaaagactagccacagcaatcgcaggggcatgggaaaacggcgtatgtgggattagatccaccaccagaatggaaaatctgttgtggaaacagattgccaacgagctcaattatatactttgggaaaacaacataaaactaacggtagttgtgggggacattataggagttctagaacagggaaaacgcaccctaaccccacagcccatggagctcaagtatagttggaagacgtggggaaaggcaaagatagttaccgcggagacgcagaatagctcgttcataattgatgggccgaacacgccagagtgccccagcgcctcccgggcgtggaatgtgtgggaagtagaggactacggcttcggggtcttcactacgaatatttggctcaagctcagagaggtatacacacaactctgtgaccaccgactcatgagcgcagcagtaaaagacgaaagagcggtgcacgcggacatgggatactggatagaatcccagaaaaacggttcttggaaactcgagaaggcctcgctgatcgaagtaaaaacgtgcacatggcccaaaagccacactctctggagcaatggagtactcgaatcagatatgattataccgaaaagcctcgcaggtccaatctctcaacacaactaccgccccggataccatacccaaaccgccgggccttggcatctaggaaaactggaactagacttcaactattgcgaagggacgactgtagtcataacagaaaactgcggaactcgaggcccaagtctccgaaccaccaccgtctcaggcaagctaatccacgaatggtgctgtcgcagctgtactctacctcccttaagatacatgggggaagatgggtgttggtacggcatggagattcggcctatcagcgagaaagaggaaaacatggtcaaaagcctcgtgagtgccggcagcgggaaggtggacaattttaccatgggggtcctatgcctagcaatacttttcgaggaggtcatgcgtggcaagttcggaaagaagcacatgatcgcaggcgtattcttcacattcgtcttactacttagcggacagatcacctggcgggacatggcacatacgctgatcatgataggaagtaacgcaagcgacagaatgggcatgggagtaacctacctagctctcatagcgacattcaagattcagccgttcctcgctcttgggttcttcctgcgaaaacttacctctagggagaatctcctactgggcgtcggcctggcgatggccacgacgctacaacttcccgaggacatagagcaaatggcgaacggaattgcgcttggccttatggccctgaagctaataactcaatttgagacataccagttatggacagctctcatttccctaacctgtagcaacacaatcttcacgctgacggttgcatggcgtaccgccaccctaatattagccggagtctccctactacctgtgtgccagagcagttcaatgcggaaaaccgactggctacccatgacagttgcggcgatgggagtaccgccgctgccgctgttcatcttctcactaaaagatacgctaaaacgtcgatcctggcccttgaacgagggagtaatggcggtgggactcgtatccatactagcgagttccctcttgcgcaacgacgtcccaatggcagggcccctagtggcgggtgggctcctaattgcgtgttacgtgataacagggaccagcgccgatctaaccgtggaaaaagcggcggatgtaacatgggaagaggaggccgaacagacaggtgtaagccacaacttaatgattacagtagacgacgatgggactatgcgtataaaagatgatgaaacggagaacatcctgaccgtactgctaaaaacagcgctccttattgtaagcgggatattcccctactcaatacctgccactctactggtatggcacacatggcagaagcagacccagaggagcggagtgctatgggatgttccatcacctccagaaacacagaaagctgaactagaagaaggggtctaccgaatcaaacagcaagggatattcgggaaaacccaagttggcgtcggagtccaaaaggaaggtgtgtttcacacaatgtggcatgtcacccgcggagccgtactcacgtacaacgggaaacgactagaaccgaactgggcctccgtaaagaaagatctcataagttacgggggcggatggcgcctaagcgcacaatggcagaaaggggaagaagttcaggtgatagcagtggagcctggcaaaaacccgaaaaacttccagaccatgcccggaacattccaaacaactaccggcgaaattggcgcaatagctctggatttcaagccaggtacaagtggatcaccgataatcaacagggaaggaaaggtcgtgggactatacgggaacggcgtagtcactaagaatggagggtatgtatccggaatcgctcaaactaacgcagaatccgatggacccaccccagaactagaagaggaaatgttcaagaaacgaaatctaaccataatggacctgcacccgggcagcgggaaaactcgcaagtacctgcccgcgatagtgcgggaggcgatcaaaagacgactcagaacactaatcttagcaccaacaagagtagtcgccgccgaaatggaagaagcactgaaggggctacccatacggtaccagacaacagcgactaaaagtgaacataccgggagagagatcgtcgaccttatgtgccacgccaccttcactatgcgacttctctcgccagtgcgcgtaccgaactacaacctaattataatggacgaggcccacttcacagacccagcgagcatcgccgcacggggatatatatcgacccgtgtggggatgggggaagccgccgctatatttatgacggccaccccgcccggaacagcggacgccttcccgcaaagtaacgcaccgatccaagatgaggaaagagacatccccgagcgctcgtggaactcagggaacgaatggattaccgactttgcaggaaaaacagtatggttcgtgccaagcataaaagctggaaacgacatcgcaaactgcctgagaaagaatggaaagaaagtaatacaactatcacgtaagacattcgacacagaatatcaaaagacaaaactaaacgactgggatttcgtagtaacgaccgatatatccgagatgggagcaaactttaaagccgacagagtcatcgacccaaggaggtgcctaaaacccgtaattttaactgacgggcccgagcgagttatcttagcggggccaatgcccgtaacggcggcttccgcggcgcagagaagaggaagagtgggacggaacccgcagaaagagaacgaccaatacatctttacaggccagccgttgaacaacgacgaagaccatgcccactggaccgaggccaaaatgctcttggacaacattaacacccccgaaggaataatcccagctctcttcgagccggaaagggaaaaatccgccgcaattgacggagaatacagactgaagggcgaatcaagaaagaccttcgtagaactcatgcgccggggagatctccccgtatggcttgcgcacaaagtagcatccgaaggcataaaatacacagaccggaaatggtgctttgacggccaacgcaacaatcagatattggaagagaacatggatgtcgaaatttggacgaaggagggcgaaaagaagaaattgcgcccaagatggcttgatgcacgcacatactctgaccccctagctctaaaagaatttaaagacttcgccgccggacgaaagtcaatagcgctggacctagtgacggagataggccgcgttccgagccacctggcacaccgaacacgaaatgccctcgacaacctagtcatgttgcacacctccgaacacgggggcaaggcctaccgccatgccgtcgaagaactacctgaaacgatggagacactcctgctgttagggctcatgatcctattaacagggggcgcaatgctattcctcatctccggcaaaggtattggaaagacgtctataggcctaatttgcgtaatagctagttccggcatgctatggatggccgaaatcccgctgcaatggatagcgtccgcgattgtactagagttctttatgatggtcctgctaatccccgaaccagaaaagcaaaggacgccgcaggacaatcagttagcatacgtagtcattgggatcctgactctagcagcaataatcgcagcaaacgaaatgggactactcgagacaacgaaacgagatctcggaatgtccaaggagcccggcgtggtatctccaaccagctacttggacgtagaccttcaccccgcctcagcgtggacgctctatgccgtagcaacaacagttatcacaccaatgctacgccacacaatagagaactcaaccgcaaacgtttcactcgccgcgatagcgaaccaggcagtcgtcctcatgggactggacaaagggtggcccatcagtaaaatggacctaggggtaccgctcctcgccctggggtgttactcgcaagttaatcccctgacacttacagcagccgttctgctcctcattacccactatgccatcattggcccaggcttacaggccaaggcaacacgcgaggcccaaaaacgcacggctgccggcataatgaagaaccccacggtagacgggattatgacgatagacctagaccccgttatctacgatagcaaatttgagaagcaactgggccaagttatgctattagtgctgtgcgccgtccaattactactaatgagaaccagttgggcactatgtgaagctctaacactggcgaccgggcccattacaacattatgggagggcagtccgggaaagttctggaacacaacaatagcggttagtatggccaatatcttccgcggctcatacctggcgggagccggcttagccttcagcattatgaaaagtgttggcacgggaaaacggggcacagggtctcaaggcgaaacactcggagaaaaatggaaaaagaagctgaatcaacttagccgcaaagagttcgacctgtacaagaaaagcggcataacagaggttgacaggacggaggcaaaagaagggctaaaaagaggagaaatcacacatcacgccgtctcgcggggtagcgcaaaactacaatggttcgtggaacgaaacatggttatccccgagggcagagtaatcgaccttgggtgtggtagaggcggctggtcctactattgcgcaggccttaagaaggtcacagaagtaagggggtatacaaagggcggccccggacacgaagaacccgtcccgatgagcacttacggctggaacattgtgaaacttatgtctggcaaagacgtattttatctaccaccagagaagtgcgacaccttgctttgcgatatcggagaatcgtctccttccccaacagtggaagagtcaagaaccataagggtgctaaaaatggttgaaccctggctcaaaaataaccagttctgcatcaaagtgctgaatccgtatatgccaacagtaatcgaacacctagaacgcctacagcgaaaacatggcggaatgttagtacgaaacccgctgtcacgcaactcgacgcacgagatgtactggatcagtaacggaacagggaatatagtagcctcagtcaatatggtcagccgcctattactcaacagatttactatgacccatcgacggcctactatagaaaaagacgtagacctaggagcaggtactcgtcacgtcaatgcggagccagaaactccgaatatggacgtcatcggcgaaaggataaaaaggattaaggaagaacataatagcacgtggcattacgatgacgaaaacccctacaaaacatgggcgtaccacggaagctacgaagtgaaggcaacaggttcagcctcgagcatgattaatggtgtagtcaagctgctcaccaaaccctgggacgtggtacccatggtaacccaaatggcaatgacagatacgaccccattcgggcagcagagggtctttaaagaaaaggtcgacacgcgtacccctcgatccatgcccggtacgcgccgagttatgggaataacagcggaatggttgtggcgaacgctcggacgcaacaagaaaccccggctatgcaccagagaagagttcaccaaaaaggtgcgaacgaacgcggcaatgggggccgtcttcaccgaggaaaaccagtgggactcagcgaaagcagccgtagaggacgaagacttctggattcttgtagaccgggaacgagaactccacaagctagggaagtgcgggtcatgtgtgtacaacatgatgggcaaacgggagaagaaacttggggagttcggaaaagcaaaagggtcacgggcgatttggtacatgtggctgggagcgcggtacctagagttcgaagcgctgggcttcctaaatgaggaccactggttcagccgagaaaactcctacagtggcgtggagggggaaggcctccataaactggggtacatactccgcgacattagcaagatacccggcggggccatgtacgcagacgatacggccggctgggacacaaggatcaccgaggacgaccttcacaatgaggagaaaataacacaacaaatggaccccgaacatagacagttggcaaacgccatctttaaactgacataccaaaacaaagtagtgaaggtccagcggccaacaccaactggaaccgtgatggacattatcagtagaaaagatcagcgcggcagcgggcaagtcgggacctatgggctaaatacattcacaaacatggaagcacaactaataagacagatggaaggagagggagtgctaagcaaggcagatctcgaaaacccgcacctcccggaaaagaaaataacccaatggctcgaaacaaagggcgtcgaacgactaaagcgaatggcgataagcggggacgactgtgttgtgaagcctattgacgaccgctttgctaacgcactgcttgctctaaacgatatgggaaaagtcagaaaagacataccgcaatggcaaccctccaaaggctggcatgactggcaacaagtccctttctgcagccaccactttcatgagctcataatgaaggacggaaggaagctcgtagttccatgcagaccccaagatgaactgataggaagggccagaatcagccaaggggctggatggagccttagggagaccgcgtgcttggggaaagcatatgcgcagatgtggtcacttatgtacttccaccgacgagacctacgcctagctagcaatgccatatgcagcgcagtacccgtgcactgggtaccaacaagccggaccacctggagcatacacgcccatcaccaatggatgacaactgaggacatgctcactgtctggaaccgagtctggatagaagacaacccgtggatggaagataagacccccgtaaccacgtgggaaaacgtcccgtacctaggtaaaagggaagaccagtggtgtggctcactcatagggctaacttcacgtgccacatgggcccagaatattcccactgcgattcagcaagtaaggtcgctcatcgggaacgaggaatttctggactacatgccgtcaatgaaacgcttcagaaaagaagaagaaagtgagggagcaatctggtga

SEQ ID NO: 25996 - RNA, 9873 nt, synthetic construct
  misc_feature 1..9873: note = derived and/or modified CDS sequence (opt11) from DENV-3__FJ547076__SS-prME
  source 1..9873: mol_type = other RNA
accagtctttgcctcatgatgatcctgcccgccgcacttgcgtttcacctcaccagtcgggacggtgagccccggatgatcgtgggcaagaacgaacgcggaaagagtctgcttttcaagacggcctccggcattaacatgtgtaccttaatagccatggacctcggcgagatgtgcgacgacaccgtgacatacaagtgtccacacatcacggaggtggagcccgaagatatcgactgctggtgcaacctcactagcacctgggtcacctatggtacgtgcaaccaagccggcgagcaccggcgcgacaagcgatctgtcgctctagctccccacgtgggcatggggctggacacccgcacccagacctggatgagcgccgagggcgcctggcgtcaggtcgagaaagtcgagacgtgggccctgcgtcaccctggattcaccatcttggcgctctttctagctcactatatcggcacctcgctcacccagaaggtggtgatcttcatactgcttatgctagtcacgcccagcatgaccatgcgatgcgttggggtgggaaaccgcgactttgttgaaggtctatccggggccacgtgggtcgacgtggtcctggagcacggcgggtgcgtgaccacgatggccaagaacaagcccaccctcgacatcgagctgcagaaaaccgaggccacccagctggcgacgctcaggaagctatgcatcgaaggcaagattaccaatatcaccaccgatagtcgctgccccacgcagggagaggctgtgctgcctgaggagcaggatcagaactacgtctgcaagcacacctacgtagatcggggatggggtaacggctgtggcttgttcgggaagggctccctggtgacctgcgccaagttccagtgcctggagcccatcgagggcaaggtcgtgcagtacgagaacctcaaatacacagttatcattacggttcataccggggaccagcaccaggtgggcaatgaaacccagggggtgaccgccgagatcacgcctcaggctagcacaaccgaggcaatcctgcccgagtatggcaccctgggactcgaatgctcaccaaggacaggccttgacttcaatgagatgatcttgttaacgatgaagaacaaggcatggatggtgcaccggcagtggtttttcgacctgccgctgccctggacctcaggagccaccaccgagactcccacctggaaccgcaaagagctgctggtaaccttcaaaaacgcccatgccaagaagcaggaggtcgtggtgcttggcagtcaagagggcgccatgcataccgcacttacgggggcgaccgaaatccaaaacagcggcggcacctcaatcttcgctggccacttgaagtgccggctgaagatggacaagctcgaacttaaaggcatgagctacgccatgtgtaccaacacgttcgtcctgaagaaggaggtatccgagacccagcatggcaccatcctaatcaaggtagagtacaaaggcgaggatgtcccgtgcaaaattccctttagcaccgaggacgggcagggaaaggcgcacaacggtcgtctcatcacggcaaaccccgtggtaaccaaaaaggaagaacccgtcaacatcgaggccgagcctccctttggggaaagcaacatcgttatagggatcggggacaacgcgcttaagatcaactggtacaagaaagggagcagcatcgggaagatgttcgaggcgacggcccggggcgcccgccggatggcaattctaggcgacaccgcctgggactttggatctgtagggggcgtcctaaactcgctgggaaagatggtccaccagatctttgggtccgcgtacacggcccttttctctggcgtgtcgtgggtcatgaagatcggcatcggggtgctactaacctggatcggcctgaacagcaagaacacctccatgtcattctcctgtatagccatcgggatcatcacgctctacctgggcgctgttgtccaggccgacatgggctgcgtgatcaactggaaaggcaaggaacttaagtgtggcagcgggatcttcgtgacgaacgaggtccacacgtggaccgaacagtacaagttccaggcggactcccccaagcgcctcgccacagccatcgccggggcctgggagaacggggtatgcggaatccggtcaacgacacgtatggagaatctgttgtggaagcagatcgcgaacgagctgaactacatcctgtgggagaacaacatcaagctgacagtggtagtgggcgacatcattggagtgctcgagcaaggaaagcgcactctgacgccccagccgatggagctgaaatattcctggaagacctgggggaaggccaagatcgtcactgcggaaacccagaactcttcattcataattgatggccccaacacgcccgagtgtccaagcgcctcccgtgcgtggaacgtgtgggaagtggaggactacggttttggcgtcttcaccaccaatatctggctcaagctgcgcgaagtgtacacccagctgtgtgaccaccggctcatgagcgccgccgtgaaggacgagcgcgccgtccatgcggatatgggctactggatcgagagccagaagaacgggtcctggaagctggagaaggctagcctgatcgaggtgaaaacctgcacatggccgaagtctcacaccctctggagcaatggcgttctggagtccgacatgatcataccgaaaagcctggctgggcccatcagccagcataattaccggccgggctaccacactcagaccgccgggccctggcacctcgggaagctggagctggatttcaattactgcgagggcacgaccgtcgttatcaccgaaaactgtgggacccgaggccccagcctccggacgaccaccgtctccgggaagctgatccacgagtggtgctgccgcagttgtaccctgcccccgctacggtacatgggagaggacgggtgctggtacggcatggagatccgccccgtctcggagaaagaggagaacatggtaaagagcttggtttccgccggcagcggcaaggtcgacaacttcacgatgggagtgctgtgtctcgccatccttttcgaggaggtaatgcggggaaagttcggcaagaagcacatgatcgctggggtcttcttcacattcgtgctgctcctgagtggccagatcacctggcgcgacatggcccacaccctgatcatgatcggcagcaacgccagcgatagaatggggatgggtgttacgtacctcgctctgatcgccaccttcaagattcagccttttcttgctctcggatttttcttgagaaaattaaccagccgggagaatctcttacttggcgtcggtctggctatggccaccacgttgcagctgcctgaagacatagagcagatggccaacgggatcgcgctcggcttaatggccctaaagctcatcacccaattcgagacctaccagctgtggaccgccctgatcagcttaacgtgctccaacaccatcttcaccctgaccgtggcttggcggacggccacactgatcctcgcgggggtcagcctgttgccggtctgccagtcaagctccatgcggaagacggactggctccccatgaccgtggccgccatgggcgtgccgccactgccgctgtttatcttcagcctcaaggacactctgaagcgccgctcttggcccctgaacgagggggttatggcagtgggcctcgtcagcatcctggcctcctcactgctcaggaacgatgtgccaatggccggccccctggttgccgggggactgctcattgcgtgctacgttatcaccgggacctccgcagacctgaccgtggagaaggccgcggatgtgacctgggaggaggaggccgagcagaccggcgtctcgcacaacctgatgataaccgtggatgacgacgggacgatgcgaatcaaggacgacgagacagagaatatcctcaccgtgctcctaaagacggctctcctgatcgtctccgggatcttcccatactccattcccgcgaccctgctcgtgtggcatacatggcaaaagcagacccagcggtcgggcgtgctatgggacgtccccagcccgccagagacccagaaggccgaactggaagagggggtatacaggatcaagcagcaaggcatcttcggtaagacccaagtgggtgtcggtgtgcagaaggagggcgtgttccacaccatgtggcacgtcaccagaggcgcagtgcttacctataacggtaagcgcttggagccaaactgggcctcggtgaagaaggaccttatcagctacggtggcggctggcggttatccgcgcagtggcagaagggggaggaggtccaggtgatcgccgtggagcccggcaagaaccccaaaaactttcaaaccatgcccggcaccttccaaacgaccaccggggagatcggcgcgatcgcacttgactttaagcctggtacctcaggtagtcctatcatcaaccgcgagggcaaagtcgtggggctgtacggcaacggcgtggtcacgaagaacggtggctatgtgtccggcattgcccagactaatgccgagccggatggccccacgcccgagctcgaggaggagatgttcaagaagcggaacctaaccatcatggacctgcatcccgggtcaggcaagacacggaagtacctgccggccatcgtgcgggaggccatcaagcgccgtctccgcaccctgattctggcccccacccgggtagtggccgccgagatggaggaagcactcaaggggctgcctatacgttaccagaccaccgcgaccaagtccgagcacaccggccgggagatcgtggacctgatgtgtcacgccacttttaccatgcggcttctatcgcccgtccgggtgccaaattataacctgatcatcatggacgaagcccacttcacagatccggcctccatagccgcgcgtgggtacatcagcacccgggtgggcatgggcgaggccgccgccatcttcatgaccgctacgccgcccgggacggccgacgccttcccgcaatccaatgcaccgatccaggacgaggagcgcgacatccccgagcgcagctggaacagtggcaacgagtggatcaccgactttgccgggaagacggtctggttcgtacctagcatcaaggcgggcaacgacatcgccaactgcctgcggaaaaacggaaagaaggtgatccagctgtcccgcaaaacgttcgacacggagtaccagaagaccaagctgaacgactgggacttcgtcgtgaccacggacatctcggaaatgggtgccaacttcaaggccgaccgggtgatcgacccgcgccggtgcctcaagccagtaatcctgaccgacggccccgagcgcgtgatcctggctggacccatgccggtaaccgcggcctcagccgcccagcggaggggccgagtcggtcgcaacccccagaaggaaaatgatcagtatatcttcaccggacagcccctcaataatgacgaggaccacgcccactggaccgaagctaagatgctgctggacaatatcaacacgccggaggggatcatcccggctctcttcgaacccgagagagagaagtccgccgccatcgacggtgagtaccgcctgaagggcgaatcccggaaaacctttgtggagctgatgcgccgcggggacctccccgtctggctggcgcacaaggtggccagcgagggcatcaaatacaccgaccggaagtggtgttttgacgggcagcggaacaaccagatactggaggagaacatggacgtagagatctggacgaaagagggcgagaagaaaaagttgcgcccccgttggctggacgctcgcacatattccgacccgctggccctcaaggaatttaaggacttcgccgctggccgtaagagtatcgcactggatttggtcaccgagatcggccgggtgccatcccacctcgcccataggacgcgcaacgccctggacaatctggttatgctccacaccagcgagcatggcggcaaggcctacagacatgctgtcgaagagttgcccgagacgatggagaccctgctcctgctgggcttaatgatccttctgactgggggcgccatgctgttcctgatcagcggcaagggcatagggaagacctccatagggcttatctgtgttatagcatcaagtgggatgctctggatggcagagatcccgctccagtggatcgccagcgctatcgtcctggagttcttcatgatggtactcctaatacccgagcccgaaaagcagcgcactccccaggacaaccagctggcttacgtggtgatcgggatactcacattagctgctatcatagccgcgaacgaaatgggcctgttggagaccaccaagcgtgacctggggatgtccaaggagccgggggtcgtgagccccacgtcctatctggatgtggacttgcacccagccagcgcctggaccctgtatgcagtggcgaccaccgtgatcacgcccatgctgcgacacactatagagaactcaacagccaatgtgagcctcgccgcaatcgccaaccaggcagtcgttctgatgggattagataagggctggcctatcagtaagatggatctcggagtgcccctgcttgcgctcgggtgttactcgcaggtcaacccgctgacacttacggccgccgtgctgctgctgatcactcactacgccataataggccccggcctccaggcgaaggcgaccagggaagcccagaagagaacggccgccggaatcatgaagaaccctaccgtggacggcataatgaccatcgacctggaccccgtcatctacgactccaagttcgagaagcagctgggccaggtgatgttgctggtgctgtgcgcagtccagctcttgctgatgcgcacaagctgggccttatgcgaggccctgaccctagccacgggacccataacgaccctctgggaaggctccccagggaaattctggaataccactatcgcggtgagtatggccaacattttccgcggatcctacctggccggggccggccttgcattcagcattatgaagtctgtggggaccggaaagagaggtaccgggagccaaggagaaaccctcggggagaagtggaaaaagaagctgaaccagctatcacggaaggagttcgacctatacaagaagtccggcatcaccgaggttgaccgtacggaggcgaaggaagggttgaagcggggcgagatcacccaccatgccgtgagccggggctccgctaagctgcagtggttcgtggagcggaacatggtcatcccggagggtcgcgtgatcgacctcggctgcgggcggggcgggtggtcatactattgcgcaggcctgaagaaggtgaccgaggtgcgcggctacactaagggtgggcccgggcacgaggagcccgtccccatgtcaacatacggctggaacatcgtgaagctgatgagcggcaaggacgtcttttacctaccacccgagaagtgcgacaccctgctgtgcgacatcggcgaatccagcccctcacccaccgtggaagagagccggaccatcagagtgctgaagatggtcgaaccgtggctcaaaaataaccagttctgcatcaaggtgctgaacccctacatgcccacggtgatcgagcacctggagcgcctccagcggaagcacggcgggatgctggtccgtaaccccctctccaggaatagcacccacgagatgtactggatatccaatggcaccgggaatatcgtggcctcggttaatatggtctcgaggctgttactcaaccggttcaccatgacccaccgccggccgaccatcgagaaggacgtggacctcggggctggcacccgccatgtgaacgcggagcccgaaacccccaacatggatgtcataggggagaggatcaagcgaatcaaggaggagcacaacagcacatggcactacgacgacgagaacccgtacaagacctgggcctaccacggctcctacgaggtgaaagccaccggcagcgccagtagcatgataaacggtgtcgtaaagctgcttaccaaaccctgggatgttgtccccatggtgacgcagatggcgatgaccgacaccacacctttcgggcagcagcgggtgttcaaggagaaagttgacactaggacaccgcggtctatgcccgggacccggcgggtaatgggcatcaccgccgagtggctatggcgtacgctggggcgcaacaagaaaccccggctgtgcacccgggaggagtttaccaagaaagtgcgcaccaacgcagcaatgggggctgtcttcacggaggaaaaccagtgggactccgccaaggctgccgtggaggacgaggacttctggaagctcgtagaccgcgagcgggagctgcacaagctgggaaagtgcggcagctgcgtctacaacatgatggggaagcgggagaagaagctcggcgagttcggcaaagctaaggggtccagagcgatctggtacatgtggctgggcgcccgctatctggagttcgaggctctcgggttcctgaatgaggaccattggttcagcagggagaactcctacagcggcgtggagggggagggcctgcacaagctcggttatatcctgcgcgacatctccaagatccccgggggagcaatgtacgccgacgacaccgcggggtgggacacccggataaccgaggatgatctgcacaacgaggagaaaatcacacagcaaatggacccggaacatcgccagctcgcgaacgccatcttcaagctcacctaccagaacaaggtggtcaaggtgcagcggcctacaccgaccggcaccgtgatggacatcatcagccgcaaggaccaacgtggcagtgggcaggtcggcacgtatgggctgaataccttcacaaatatggaggcccagctaatccgccagatggaaggcgagggagttttaagcaaagccgacctggagaacccccatttaccggagaagaagatcacccagtggttggagacgaaaggtgtggagcgtctgaagcgcatggcgatcagcggggacgactgcgtagtgaagcccatagatgaccggttcgccaatgcgctcctagccctgaatgatatggggaaggtgcgcaaggacatcccccagtggcagcctagcaagggatggcatgactggcaacaggtcccgttctgttcgcaccacttccacgaactcatcatgaaggacgggcggaagctcgtggtcccctgccgcccccaagacgagctgatcggtcgggcgcgcatcagccaaggggcgggctggtcgcttcgggaaacagcgtgccttggcaaggcctacgcccagatgtggagcctgatgtactttcaccgacgcgacctcagactggctagcaacgcgatctgcagtgccgtccccgtacactgggtgccgactagccgcaccacgtggagcatccacgcacaccatcaatggatgacgaccgaggacatgctaaccgtctggaaccgggtgtggatcgaggacaacccctggatggaggacaagaccccggtgaccacctgggagaacgtcccatacctcgggaagcgcgaggatcagtggtgtggcagcctgatcggtctgacctcccgggccacgtgggcgcagaacatcccgaccgccatccagcaggtacgaagcctcatcggcaacgaggagttcctggactacatgccctccatgaaacggttcagaaaggaggaggagagcgagggggcaatttggtaa

SEQ ID NO: 25997 - RNA, 9873 nt, synthetic construct
  misc_feature 1..9873: note = derived and/or modified CDS sequence (opt11) from DENV-3__FJ547077__SS-prME
  source 1..9873: mol_type = other RNA
acctccctgtgtctcatgatgatcctgcccgccgccctggcgttccatctcactagccgggacggggaacccagaatgatcgtggggaagaatgaaaggggcaagagccttctgttcaagacggcttccgggattaacatgtgcacgctcatcgcaatggacctgggggagatgtgcgacgacactgtgacgtataagtgcccccacatcacggaggtagagcccgaggacatcgactgctggtgtaacctcacctcgacctgggtgacctacgggacgtgcaaccaggctggcgagcaccggcgtgacaagcggagtgtggccctcgcgccccatgtgggcatggggctcgatactcgcacccagacctggatgtctgccgagggtgcctggcgccaggtggagaaggtggagacgtgggctctacgccacccagggttcaccatattggccttattcctggcccactacattgggaccagcctcacccagaaggtggtgatcttcatcctgctcatgctagtaacgcccagcatgaccatgagatgcgtcggcgtgggcaaccgcgatttcgtcgagggtttgtcaggggccacatgggtggacgtcgttctcgagcacggcgggtgcgtaaccacgatggcaaagaacaagcctaccctggacatcgagctgcagaagaccgaggccacacagctagcgacattgcgtaaattgtgcatagagggcaagatcactaacataactactgacagcagatgccccacgcagggcgaggctgtgttgccggaggaacaagaccagaattacgtctgcaaacacacctacgtcgaccgggggtggggcaacgggtgcgggctctttgggaaaggaagtctggtgacctgcgccaaattccagtgcctggaacccatcgagggcaaggttgtgcagtatgagaacctcaagtataccgtgattataacggttcatacaggggaccagcaccaagtcggcaacgagacccaaggggtgacagcggagatcacgccccaagcgagcaccaccgaggcgattctgccggaatacggcactctggggctcgagtgcagtccgcgcaccggcctggacttcaatgagatgatactgctcacgatgaagaacaaagcatggatggtgcatcggcagtggtttttcgatctgccgctgccctggacaagcggcgccaccaccgagactcctacctggaaccgcaaggagcttctggtaaccttcaaaaatgcccacgctaagaagcaggaggtcgtagtgctggggtcccaggagggagcgatgcacaccgccctcacgggggccaccgagatccagaactccggcgggacctccatcttcgcgggccaccttaagtgccggctgaaaatggataagctcgaactgaagggcatgagctacgccatgtgtacaaacacgttcgtcctgaagaaggaagtgtctgaaacccagcacgggactatactaataaaagtggaatacaaaggcgaggacgcgccgtgcaaaatcccctttagcaccgaggacggccaaggcaaagcccacaacggccgactcatcactgccaaccccgttgtgaccaagaaggaggaaccagtgaacatagaggccgagccgccattcggcgagagcaacatcgtcatcggaatcggggacaacgcgctcaaaataaattggtacaagaaaggaagctcgatcgggaaaatgttcgaagccaccgcccggggcgcccgccgaatggcgatccttggagataccgcgtgggacttcgggtccgtgggaggggtgctcaacagcctgggtaagatggtccatcaaatcttcgggtccgcctacacagcactgttcagcggagtgtcttgggtgatgaaaatcggcattggggtactcctgacctggataggcttaaacagcaagaacaccagcatgagcttctcttgcatcgccatcgggatcatcaccctctacctgggcgccgtggtccaggcggacatgggctgcgtcataaattggaagggcaaggagttaaagtgcggctctgggatattcgtgaccaacgaggtccacacctggacggagcagtacaagtttcaggccgactctcccaagcgtctcgccaccgcgatcgctggcgcatgggagaacggggtctgcggcatcaggtcaactacgcggatggagaacctgctgtggaagcagatcgcgaacgagctaaactacatcctttgggagaacaacatcaagctgacagtggtggtgggggacatcatcggcgtactggaacagggcaagcgcacgttgacgccccaaccgatggagctgaagtacagttggaagacctgggggaaggccaaaatcgtcaccgcggagacacaaaacagcagtttcataatcgacggccccaacacgcctgaatgcccctcagcaagtagggcctggaacgtatgggaggtagaggactatggctttggggtgttcaccaccaacatctggctcaagctgcgcgaggtttacacacagctgtgtgaccaccggttgatgagcgccgccgtgaaggacgaacgcgccgtgcatgcagacatgggctactggatcgagagccagaagaacggctcttggaagttagagaaggcctcgctgatcgaggtgaagacctgcacgtggcctaagtcgcacaccttgtggagcaacggcgtgctggagagcgacatgatcatccccaagagcttggccgggccgatctcccaacataattaccggccgggttaccacacccagactgcagggccctggcatctcggaaagctggaactggacttcaactactgcgagggcacgactgtggtcatcaccgaaaactgcgggacgcgcggtccatcgctccggacgaccactgtcagcggtaagctgatacatgagtggtgctgccgcagctgcaccttacccccgctccgatatatgggcgaggacggatgctggtatggcatggagatccgccccattagtgaaaaggaggaaaatatggtcaagtcactggtgtcagccgggtctgggaaggtggacaacttcacgatgggcgtgttgtgcctcgcaatactgttcgaagaagtgatgcgggggaagttcggcaaaaagcacatgatcgctggtgtgttctttacctttgttctattactgtctggccagatcacatggagggacatggcgcacactctgatcatgattggcagcaacgcctccgaccggatggggatgggcgtcacgtacctcgcgctgatagcgaccttcaagatacaacccttcctggcactcgggttcttcctgcgcaagctgaccagccgggaaaacctcctgctgggcgtcggcctcgccatggccaccacgctgcagctgcccgaagacattgagcaaatggctaacgggatcgctttaggcctcatggccctgaaacttatcacccagttcgagacgtaccagctgtggaccgccctgatttctctcacgtgctccaacaccatcttcaccctgaccgtggcctggcgcacggcgaccctgatcctcgccggggtcagtctgctgccggtttgccagtccagctctatgcggaaaaccgattggcttcccatgaccgtcgccgccatgggcgtgccccctctcccgctgttcatattcagcctcaaggatacgctgaaacgccgatcgtggcccctgaacgaaggggtcatggccgtcggccttgttagcattttggcatctagcctcttacgcaacgacgtacctatggccggccccttagtagcagggggcctgctaatagcctgctatgtgatcaccggcacatccgccgacttgaccgtggagaaggccgcagacgtcacatgggaagaggaggcagaacagaccggggtgtctcacaaccttatgattaccgtggatgatgacgggaccatgcgcatcaaggacgacgaaaccgagaatatcctcacggtcctgctcaagaccgccctcctgatagtgtccgggatatttccgtacagcatcccagccaccttactcgtgtggcacacatggcagaagcagacgcagcggtccggcgtcctgtgggacgtgcccagcccgcccgagacccagaaggcggagctggaggaaggggtgtaccgtatcaagcagcaggggatctttgggaaaacccaggtcggcgtgggagtgcagaaggagggcgtattccacaccatgtggcacgtaacgagaggagccgtactcacctacaacggcaaacgcctggaacctaattgggcttccgtcaagaaggacctgattagctacggagggggctggcggctctctgcccagtggcaaaagggggaggaagtccaggtgatcgcggtcgagcccggtaagaacccgaagaatttccagaccatgcccggcaccttccagacgaccaccggggagatcggggccattgccctggacttcaagcccggtacctctgggagccccatcattaaccgggagggcaaggtggtagggctgtatggcaacggcgtagttacgaagaacggcgggtacgtgagcgggatcgcccagacaaacgccgagccggacggcccgacccccgagttagaagaggagatgttcaagaaacgaaacctcacaatcatggatctgcaccccgggtcaggcaagacgaggaaatacttgcctgcgatcgtccgggaggccatcaagcggcggctccgcacgctgattctggctcccacccgggttgtggccgctgagatggaggaggccctcaaagggctgcctatccgctatcaaaccacggccactaaatcagaacacacaggccgggagatcgtcgacctgatgtgccacgctacatttacgatgcgcctcctaagtcccgtgcgggtgcctaactacaatctgatcataatggacgaagcccatttcaccgaccccgcttctatcgcggccagagggtacattagcacgcgggtcggaatgggcgaggccgcagccatcttcatgaccgccacgccgcccgggaccgcggacgccttcccgcagtccaacgcccccatccaggacgaggagcgcgatatccctgagcgtagctggaactccggtaatgagtggatcaccgacttcgcagggaaaacggtgtggtttgtgccctcgatcaaagctgggaacgacatcgccaattgcctacggaagaacgggaaaaaggtaatccagctgtccagaaaaacattcgacaccgagtaccagaagaccaagctgaatgactgggactttgtggtaaccactgacatcagcgaaatgggcgccaactttaaagccgaccgggtcatcgatccccgccggtgcctcaagccggtgatcttaaccgacggcccagaacgcgtgatccttgcggggcccatgccggtcacagccgcctccgccgcccagcggcgcggccgggtaggccgcaacccccagaaagagaacgaccagtacatcttcaccggccagcccctaaacaacgatgaggaccacgcgcattggactgaggccaagatgctgttagacaacatcaacacaccggaggggatcattccggccctcttcgagcccgaacgggagaaatcagccgcgatcgacggcgagtaccgcctgaagggcgagtcacggaagaccttcgtcgagctgatgcgccgaggggatttgccagtctggctggcccataaagtagcctccgaaggcataaagtacaccgatcgcaagtggtgcttcgatgggcagcggaacaaccagatcctggaggagaacatggacgtggaaatctggaccaaggagggcgagaagaagaagctccgcccccggtggctggacgctaggacgtactcggacccgctggccctcaaggagttcaaggacttcgcggccggccgtaagagcatagccctggatctggtaaccgagattgggcgggtgccgtcccacctcgcccatcgcacccggaacgcgctggacaatctggtcatgttacacacatctgagcatggcgggaaggcgtaccgccatgccgtagaggaattgcctgagacgatggagacgctgctcctgctgggcttaatgatcctactgaccggaggagcgatgctgtttctgatcagcggcaaggggattggcaagacctccatagggttgatctgtgttattgccagctccggcatgctatggatggccgaaatcccgctgcagtggatcgcgtccgccatcgtcctggagttcttcatgatggtgctcttaatccccgagcccgagaaacagcggacgccccaggacaaccagctagcctacgtggtaatagggatcctcaccctggccgcgaccatcgcggccaacgagatgggccttctcgagaccacaaagcgcgacttaggcatgtccaaggagccgggggtggtcagccccacgtcctacctggacgtcgacttgcatccagcttcggcctggacattgtacgcagttgccaccacggtgatcacccccatgcttcggcatactatagagaactcaaccgccaacgtgtctctcgccgccatcgcgaatcaggccgtggtgctgatgggtctggacaaggggtggcctatctccaagatggacctcggcgttccccttctggccctcggttgttactcacaggtgaatcctctgacgttaaccgcggccgtactgctgctgatcacccactacgccatcatcgggcccggtctacaggccaaggccacccgcgaagcccagaagcggacagccgccgggataatgaagaacccgaccgtagacggaattatgactatcgacttggaccccgtgatctatgactccaagttcgagaagcaacttggccaagtgatgctcctggttctgtgtgccgtgcagctcttactgatgcgcaccagctgggccctatgcgaggccctcacgctggcgaccggccccataacgaccctctgggagggctcgcccggtaagttctggaacacgacgattgccgtgagcatggccaacatcttccggggctcctatctggccggcgccggcctggccttcagcatcatgaaaagcgtaggaacaggcaagcggggaactgggagccagggagagaccctcggcgagaagtggaaaaagaagctgaaccagcttagcagaaaggagttcgacctctacaagaagtccggcattacagaggtggaccgcactgaggccaaggagggcctgaagcgcggcgagatcacccaccacgccgtcagccgaggcagcgccaaacttcagtggttcgtagagcggaatatggttatacccgaggggagagtgatcgacttgggctgcgggcggggcgggtggtcctactactgcgccgggctgaagaaggtcaccgaggtacgcgggtacacgaaaggcgggccaggtcacgaggaacccgtgcccatgtccacctacgggtggaatatcgttaaactaatgtcaggcaaagacgtgttctacctccctccagagaagtgtgacaccctgctgtgcgacatcggcgagtcctcccccagccccaccgtggaggagtcgaggacgatccgggtcctgaagatggtagaaccgtggctaaagaataaccaattctgtataaaagtgcttaacccgtatatgccaaccgtgatcgaacatctggaacgtttgcagcggaagcacggcgggatgctggtccgcaaccccttatcccggaacagcacccacgagatgtattggatctccaacggcaccgggaacatcgtggcgagcgtaaacatggtttcccgcctcttactgaatcgattcacgatgacccacaggcggccgacaatcgagaaggacgtggacctcggcgccggcacccgccacgtcaacgcggagcccgagacccccaacatggacgtgatcggagaaaggatcaagaggatcaaggaggagcacaatagcacgtggcactatgacgacgagaacccgtacaagacctgggcctaccatggctcgtatgaggtcaaggccaccgggagcgcgtccagcatgattaacggcgtagtgaagctgctaaccaaaccctgggacgtcgtccccatggtgacccaaatggccatgaccgacactactccgttcgggcagcagcgggtcttcaaggagaaggtcgacacacgtaccccgagatccatgccgggcacccgcagagtcatgggcattacggccgagtggctgtggcgcacccttgggcggaacaagaagccccgcctgtgcacccgagaggagttcaccaaaaaggtaagaacgaacgccgcgatgggcgcggtgtttacagaggagaatcaatgggactcggctaaggccgccgtggaagatgaggacttctggaagctcgtcgaccgtgagcgggaattacataagctggggaaatgcggcagctgcgtatataacatgatggggaagcgagagaaaaagttaggcgagttcggcaaggcaaaagggagccgggccatctggtacatgtggttgggtgcccgctatctggagttcgaggcactcggcttcctgaatgaggatcactggttttcacgggagaactcctacagcggcgtggagggtgagggcctacacaagctcgggtacatactgagagacatcagtaagatccccgggggcgccatgtacgcggacgacacagccggttgggacacgcgaatcacggaggatgacttgcacaacgaggagaagattacccagcagatggacccggagcaccgccagcttgcaaacgccatcttcaagctgacgtaccaaaacaaggtcgtcaaggtgcagcggcccacccccaccggcacggtcatggacatcataagccgcaaggaccagaggggtagtggccaggtaggcacctacgggctgaacacattcacaaatatggaggcccaactcatccgccagatggagggagagggggtgcttagcaaggcggatcttgagaatccccacctcccggagaaaaagatcacgcagtggctggagaccaagggcgtagagcggctgaaacgcatggccatctccggcgacgactgtgtcgttaaacccattgatgatcgatttgccaacgcactattggccctgaacgacatggggaaggttcgcaaggatatcccgcaatggcagcccagcaaggggtggcacgactggcagcaagtcccgttctgctcccaccacttccacgagctcatcatgaaagacgggcggaagctggtggtgccatgccgcccgcaggacgagctgataggccgggcgcggatcagccagggggccggctggtctcttcgggagaccgcgtgcttagggaaggcatacgcgcagatgtggaaccttatgtatttccaccgtcgcgacctccggttggcgagcaacgccatctgttccgcagtgcccgtgcactgggtcccgaccagccgtacgacctggtccatccatgcccaccaccagtggatgactactgaggacatgctcacggtgtggaaccgggtttggatcgaggacaacccctggatggaagataaaaccccggtcaccacctgggagaacgtgccctacctagggaagcgagaggaccaatggtgcggctccctgatcgggcttacgagccgggcgacctgggcccagaacataccaaccgccatccagcaagtgcgctccctgatcggcaacgaggagttcctcgactacatgccgagtatgaagcgcttccgcaaagaagaggagtcagagggtgccatttggtag

SEQ ID NO: 25998 - RNA, 9873 nt, synthetic construct
  misc_feature 1..9873: note = derived and/or modified CDS sequence (opt11) from DENV-3__FJ547078__SS-prME
  source 1..9873: mol_type = other RNA
accagcctatgcctgatgatgatattgcctgcagcgctagcgtttcacctcacatcacgggacggggaaccaagaatgatagtcggcaaaaacgaacgaggtaaaagtttactattcaaaactgccagcgggataaacatgtgcacgctcattgcgatggacctaggagaaatgtgcgatgatacagtcacctataaatgtccacacatcacggaagttgaacccgaagacatagactgctggtgcaacctaacaagtacgtgggtgacctacggaacctgcaaccaagcaggggaacatcgccgtgacaaaaggagcgttgccctcgccccacatgtaggaatgggactggacacgagaacacaaacatggatgagcgccgaaggggcctggcgccaagtcgagaaggtagagacgtgggcactacgacacccagggttcaccatcctcgcgctgttcctcgcacactacatcgggacatccctcacacaaaaagtggtaatctttatactacttatgttagtcacgccgtcaatgacaatgcggtgtgtaggagtcggcaaccgagactttgtggaaggactttccggagccacgtggattgatgtggtcctagagcatgggggctgcgtaaccactatggccaaaaacaaaccaacccttgacatagaactccaaaagacggaagcgacccaactggccacattacgcaaactctgcatagaaggcaagatcacaaacatcacaacagactcgcgctgccccacgcagggggaagccgttctgccggaggaacaagaccaaaactacgtatgcaagcacacttacgtggaccggggatggggaaacgggtgtggactgttcggaaagggcagcctcgtaacatgcgcaaaatttcagtgcctcgaacccattgaaggtaaagtcgtccagtacgaaaatctaaaatacacagtcataatcaccgtgcacaccggagatcaacaccaagtcggcaacgaaacccagggagtaaccgcggaaatcacgccccaggcttcaaccacggaggcgatattaccggaatacggaacattgggactggaatgttcgccgagaacgggactggacttcaatgaaatgatactcctcaccatgaagaacaaggcatggatggtccaccgacagtggtttttcgacctcccacttccctggacatcaggcgccacaaccgagacaccaacatggaaccggaaggagctcctcgtcactttcaaaaacgcacacgctaagaaacaagaagtagttgtcttaggatcccaggaaggggccatgcatacggcactcaccggcgccaccgaaatacagaacagtggaggcaccagcatcttcgcagggcacctgaagtgtcgactcaagatggacaagctggagctcaagggcatgagctacgcaatgtgcacgaacacgtttgtgctcaagaaagaggtcagcgaaacacagcacggcacaatattgatcaaggtagaatacaaaggcgaggacgtaccatgcaaaatacctttctccacagaagacggacaaggcaaagctcacaacggaagactgattacggcgaatccagtagtaacgaagaaagaagaacccgtgaatatcgaagccgaaccacctttcggcgaatccaatatagtcataggcataggcgataacgcgttgaagataaattggtacaaaaagggatcatccataggaaaaatgttcgaggcaacagcacgaggcgcccggcgtatggctattctaggggacaccgcgtgggactttggcagcgtcggaggggtcctaaactctctcggcaaaatggtacaccagatcttcggatcagcatataccgctttgttctccggggtaagctgggtcatgaagatcggcatcggcgtcctcctcacctggattgggctgaacagcaagaacacatccatgagctttagttgcatcgccatcggcatcatcaccctgtatctcggggcagttgtgcaagcagatatggggtgcgtgatcaactggaagggcaaagaactaaaatgcgggagcggtatcttcgtgaccaacgaggttcacacctggactgagcagtacaagtttcaagccgactcacccaaacgactggcaaccgcaatagctggcgcgtgggaaaacggcgtatgcggaatccgcagcactactaggatggaaaacctgctttggaaacaaatcgcgaacgaactaaactatatattgtgggagaacaacataaaactgacggttgtagtaggcgacatcataggcgtcctagaacaagggaagagaaccctcacacctcaacccatggaactgaaatactcatggaaaacgtggggtaaggcgaagatagtaaccgcagagacccagaacagctcgttcataatagacggaccgaatacacccgaatgcccgagcgcaagcagagcgtggaatgtgtgggaggtagaagactacggcttcggggtgtttacgacgaacatatggttgaaactccgagaagtatacacccaactatgcgaccaccggctaatgagcgccgcagtcaaagatgaacgtgcggtgcatgccgatatggggtattggatagaatcacagaaaaacgggagctggaaactggagaaagccagtctaattgaagtaaaaacgtgtacgtggcctaaatcccacacgctttggtcgaacggggtcctcgagtcggatatgatcatacccaagtccctcgctggcccgatctcccaacacaattatcgcccaggctaccacacgcagacagcagggccgtggcatctaggaaaactagaactcgacttcaattattgcgaaggtacaaccgtcgttatcactgagaactgcggcacccgggggcccagccttcggacaacgactgtatctggaaagctgattcacgaatggtgctgccgatcatgcacgctgccacccctgaggtacatgggggaagatggatgctggtatgggatggaaataagaccgatcagcgagaaagaagaaaatatggtcaaatccctcgtaagcgcaggatccggtaaagtcgacaacttcacaatgggcgtactatgtcttgccatcttgttcgaagaggtcatgcgtggcaagtttgggaaaaagcacatgatagcgggggtgttcttcacgttcgtactccttctgagcggccaaatcacctggcgagatatggcccatacactaataatgattggaagtaatgcaagcgaccgcatgggaatgggtgttacgtaccttgcattaattgccacttttaagatacagccattcctagcacttggattcttcctccgtaagctaacaagcagggaaaatctactacttggagtggggctggccatggcaaccacgctccaactaccagaagacatcgaacagatggctaacggcatcgccctagggctgatggctctaaaacttataacccaattcgaaatctaccagctatggaccgccctgatatccttaacatgttcgaacacaatattcaccctcacagtggcatggcgaaccgccacgctaatattagctggcgtatcactgctcccggtttgccagtcaagctcaatgcgtaagaccgactggttaccgatgactgtagccgctatgggagtgccgccgctccctctctttatattctccctcaaagacacactcaaacggcgctcttggccgctcaacgagggagtaatggcagtaggtctcgtaagcatactggccagcagcctgctccgaaacgatgttcccatggcgggcccacttgtagcaggcggcctacttattgcatgttacgtgatcacaggcacctctgcagatctcacagtagagaaagcggccgatgtcacatgggaagaagaggcggaacagacaggcgtgagccacaacctgatgataactgtggacgacgacggcacaatgaggattaaggacgacgaaacggagaacattctcaccgtattactcaaaacagcgctgttgatcgtgagtgggatattcccgtactccatcccggcaaccctcttagtatggcacacttggcagaagcaaacccaacgatcaggagtcctatgggatgtaccgagcccgccggaaacccaaaaggcggaactggaggaaggagtctaccgaataaaacaacaaggcatattcggaaagacccaagtaggcgtaggcgtccaaaaagaaggggtcttccacaccatgtggcatgtcactcgaggtgctgtactgacctacaacgggaagcggcttgaacccaattgggctagtgtaaagaaagacctaatatcctatgggggcggatggcgtcttagcgcgcagtggcagaagggagaggaagtacaagtcatcgctgtcgagccgggcaaaaacccgaaaaatttccaaacgatgccgggaacgttccagacgacaacgggcgagataggagctatagccttggacttcaagccggggacatcaggcagccctataatcaaccgagagggaaaggtggtgggtttatacgggaatggcgtagttaccaagaacggaggctacgtctcgggtattgcccaaaccaacgcagagccagacggacctacacccgagctcgaggaagaaatgttcaagaaacgaaatctaacgatcatggatctacaccccgggtcgggaaaaacccggaaatacctgcccgctatagtacgcgaggcaataaagcgcagactacgaacgctaatactcgcacccacgcgggtcgtagcggccgaaatggaagaagctctgaaagggctaccaatccgttatcaaaccactgcaacgaaaagcgagcataccggcagggaaatcgtagatctcatgtgccacgctacattcaccatgaggctactgagccccgtcagggtaccaaactacaacctaatcatcatggacgaagcacatttcacagatcccgcctccatcgccgcccgcgggtacatctcgacccgggttggaatgggcgaggcagcagccatattcatgacggcaacgccgccgggcaccgcagacgcattcccccaatctaatgcacctatccaagatgaggaaagggatatcccggaaaggtcttggaacagtggtaacgagtggataaccgactttgcaggcaaaaccgtttggttcgtaccgagcatcaaagccggcaacgacattgctaactgcctaagaaagaatggaaagaaagtgatacagcttagccgaaaaacctttgataccgagtaccagaaaaccaaactcaacgactgggacttcgtggtcacaactgacattagtgagatgggagcaaatttcaaagcggacagggtaattgaccctcggaggtgcctcaagccggtaatactaacagacggtcccgaacgcgtcatactggccgggcctatgccggtgaccgcagcgagcgccgcacaaaggcgggggcgggtcggaagaaaccctcagaaagaaaacgaccaatacattttcaccgggcagccactgaacaacgacgaagaccatgcccactggactgaagcaaaaatgctactcgacaatataaatacgccagagggaataatcccagccctcttcgagccagagcgggagaaaagcgctgccatagacggggagtacagactcaagggcgagtcaagaaagacgttcgtcgaactaatgaggcgtggagacctcccggtatggcttgctcacaaagtcgccagcgagggaatcaaatacacagatcggaaatggtgttttgacggccagcgaaacaaccaaatcttagaagagaatatggacgtcgaaatctggacgaaagaaggagaaaagaagaaactgagaccccgatggctggatgctcgcacatattcggatcctttagctctcaaagagttcaaggacttcgcagcgggccgtaaaagcatcgccctggacctggtgaccgagattggtcgagtccccagccacttagcccatcgaacaaggaatgcactggacaacttagtaatgctccacacctcagaacatggaggtaaggcataccgccatgccgtcgaagaactgccagaaaccatggagactctcctattattagggttaatgatcctactcactgggggagcaatgctgttcttgataagcggaaaaggcattggaaagacgtcgatcgggctgatatgcgtaatagcaagtagcggtatgttatggatggctgagatcccactacaatggattgcctccgccatagtactggagttcttcatgatggttctcctgattccagagcccgaaaaacaacgaaccccacaagacaaccaactcgcttatgtagtcatcggaatactaaccctcgcggcaataatagccgccaatgagatggggctacttgaaactacgaaaagagacctcggcatgtccaaggaaccgggtgttgtcagccctacatcctatttggacgttgacctccacccggcaagtgcatggaccttgtatgcagtggcaacgacggtcataacgcctatgctgcgtcacaccatagagaactcgactgcaaacgtaagcctagccgccattgcaaaccaagcagtagttctcatgggcctcgacaaggggtggccgataagcaaaatggacctgggagtcccactgctagcccttggctgctactcacaggtaaacccactcacactcacagctgccgtcctactcctcattacccactacgctatcattggccccggactccaagctaaagcgacaagggaagcgcagaaacgcaccgcagccggtattatgaagaaccccaccgtcgatggaattatgacaatcgacttggatcccgtcatctacgattcaaagtttgagaaacagctcggccaagtgatgttactggtgctgtgcgctgtacagctactgctgatgcgaacatcctgggcactttgcgaagcgctaacgcttgcaaccgggcctataacaactctgtgggagggcagcccaggcaagttctggaatactaccatcgccgtaagtatggctaatatctttcgaggttcgtacttggccggcgcgggtctcgcgttctccataatgaaaagcgtgggcacggggaaacgcggtaccggcagccagggcgaaacactcggagaaaaatggaagaaaaagctaaaccaactctcgcgaaaggagttcgacctatacaagaagagtggcatcacggaagtagacaggacagaggcgaaagagggcctgaaaagaggagagattacacatcacgcggtatcgcgaggaagcgcgaagctccaatggttcgttgaaagaaacatggtcataccggaaggacgtgtgatcgacctcgggtgtggacggggcggatggagctactactgcgcaggtctcaagaaggtcacggaagtacgagggtacaccaaaggcgggcccggtcacgaggaaccggtaccaatgagcacttacggatggaacatcgtaaaactaatgtcagggaaggacgtgttctatctaccccctgaaaaatgcgacactctactatgtgacatcggagagagctcaccctcgccgacggttgaagaaagtcggacaatcagagtattgaaaatggtagagccttggctgaaaaacaaccagttttgcatcaaagtgctaaacccatacatgccgacagttattgagcacctagaacggctacaacgcaaacacgggggaatgcttgtgcggaatccactgagcagaaactcgacccacgaaatgtactggataagcaacggaacgggcaatatcgtcgctagcgtcaacatggtctcgcgtctccttctgaaccgattcacaatgacacacagaagaccgacgatagagaaagatgtggacctcggagcgggcacaagacacgtcaacgcggagcctgaaaccccaaacatggacgtgatcggggagagaatcaaaagaatcaaggaagaacacaactccacttggcactacgacgatgaaaacccatacaaaacatgggcgtaccatggaagctacgaagtcaaggctaccggctcggcatcatctatgataaacggtgttgtgaagctactgaccaaaccatgggacgtcgttccaatggtaacacaaatggccatgacagacacgacaccgttcggacaacaacgggtctttaaggagaaggtagacacaaggacaccaaaatccatgccaggaacaagacgcgtcatgggaatcaccgcagagtggctatggcgaactctcggacgcaataaaaagcctagattgtgcacgagagaggaatttaccaaaaaggtacgtacgaatgcggcaatgggtgcggtcttcacggaagagaatcagtgggactcggcaaaggctgccgttgaagacgaagacttctggaagctagtggaccgcgaacgagaactgcataaactgggcaagtgcggcagttgcgtatataacatgatgggcaagcgagagaagaaactaggcgagttcggcaaggctaagggctcgcgggcgatatggtacatgtggctcggggccagatacttggagtttgaggctctagggttcctgaatgaggaccactggttctcacgcgaaaactcatacagcggggtggaaggggaggggctacacaaactgggctacatactaagggacatctcgaagataccaggaggggcaatgtacgctgacgacacggcaggatgggatacgcgaatcacagaggacgacttacacaacgaagagaaaataacgcaacaaatggaccccgaacatagacaactagcaaatgccatcttcaagctaacataccaaaacaaggtagtgaaagtacagagacccactccaaccggaacagtgatggacatcatatctaggaaagaccagcgagggtccggccaggtcggcacatatggactgaacacgttcaccaatatggaggcccagctcatacgccagatggaaggagagggtgtcctcagcaaagcggacctcgagaacccccatctacccgagaagaaaatcacgcaatggctggagacaaaaggagtcgaaaggctaaaacgcatggccataagcggtgacgactgcgttgtcaaacccatagacgaccgatttgccaacgccttgctggcactaaacgacatgggaaaagtgcgaaaagacatcccgcagtggcagccgtctaaaggctggcacgactggcaacaagttccattttgttcacaccatttccatgaactcataatgaaggacggtcgtaaactcgtagtaccttgcagaccgcaagatgagcttataggtagagcacgcataagtcaaggagccggctggagtttaagagaaaccgcatgcctagggaaggcttacgcgcagatgtggtcactaatgtatttccaccggagagacttaagactggcaagcaatgcaatttgtagcgcagtcccagtgcactgggtcccgacaagtcgcacaacgtggtcaatccacgcgcaccatcagtggatgacaacagaggacatgctaaccgtgtggaaccgagtgtggatcgaagacaatccgtggatggaggacaaaacaccagttacaacttgggaaaacgtgccatacttaggaaagcgagaagatcaatggtgcggatctcttatcggactgactagcagggcgacatgggcgcagaacataccaacagccatacaacaggtacgaagcctcataggaaacgaagaatttctagactacatgcccagcatgaagcgattcagaaaagaagaggaaagtgaaggagcgatatggtga

SEQ ID NO: 25999 - RNA, 9873 nt, synthetic construct
  misc_feature 1..9873: note = derived and/or modified CDS sequence (opt11) from DENV-3__FJ547079__SS-prME
  source 1..9873: mol_type = other RNA
acgagcctctgcctcatgatgatactcccggccgccctggcgttccacttaacgtcgcgggacggggagccccggatgattgtggggaaaaacgaacgaggtaaaagcctgctgtttaagacggcgtccgggattaacatgtgtacactcatcgccatggacctcggcgagatgtgcgacgacaccgtcacctacaagtgcccccacataacagaagtggagcctgaggacatcgactgttggtgcaacctgacctcaacctgggtgacttatgggacgtgcaaccaggccggcgagcatcggcgagacaagcggtccgtcgccctcgcgccccacgtgggtatggggctggacacccgcacccagacctggatgagcgccgagggagcctggcgccaggtggagaaagtcgagacgtgggccctgcggcaccccgggtttaccatcctcgcgctgttcctggcgcactacatcggcacttccctgactcagaaggtggtgatcttcatcctgctgatgctcgtcacgcccagcatgacgatgcgctgcgtgggggtaggcaaccgcgactttgtcgagggcctgtcaggggccacctgggtggatgtagtcctggagcacggcgggtgtgtgaccactatggccaagaacaagcccacgttagacatcgaactacagaagaccgaagcaacgcagctggcgacgctccgaaagctgtgcatcgagggtaagatcacaaacatcaccaccgacagccgctgccccacgcagggcgaagccgtgctgcctgaagagcaggaccagaactatgtctgtaagcacacttacgtcgaccggggctggggcaacgggtgtggcttgttcgggaagggctcgctggtaacctgcgcgaaattccaatgtctggaacccatcgaaggcaaggtcgtgcagtacgagaacctgaagtacaccgtaatcatcacggtacacaccggggaccagcatcaggtcgggaacgagacccaaggggtgaccgcagagatcacgccccaggcctcgaccaccgaagcgatcttgccggagtacggcaccctggggctggagtgcagcccacgtaccggcctggacttcaatgagatgatcttactcacaatgaagaacaaggcttggatggtgcaccggcagtggttctttgatcttcccttgccctggacaagcggcgccacgactgagacgcccacctggaaccgcaaggagttactggtgaccttcaagaacgcccacgccaagaagcaggaagtcgtagtgctggggtcccaggagggcgcgatgcataccgccctcacgggggccaccgagatccagaactctggtggcacatccatctttgccggtcacctcaaatgccgtctgaagatggataagctcgagttgaagggcatgtcatacgctatgtgcaccaacacattcgtcctgaaaaaggaggtgtccgagactcagcacggtaccattctcataaaggtggagtacaagggtgaggacgtaccgtgtaagatccccttcagcaccgaggatggacagggcaaggcacacaacggacgcctcatcactgctaaccccgtggtgaccaagaaagaggagccagtcaacatcgaagccgaaccgcccttcggcgagagcaacatcgtgatcgggataggggataacgccctgaagatcaactggtacaagaaggggtcgagcatcgggaaaatgttcgaggctacagcacggggagcgcgacggatggccatcctgggcgacaccgcctgggacttcggaagtgttggtggagtgctcaattctctcggcaagatggtgcaccagatcttcgggtccgcgtacacagccctgttttcaggcgtgtcctgggtcatgaagatcggtattggagtgctcttaacctggatcggactgaacagcaagaacacctccatgagcttctcctgcatcgccatcgggattatcaccctctacctgggcgcggtggtacaggccgacatggggtgtgtgatcaattggaagggcaaggagttaaagtgcggaagcgggatctttgtgacgaatgaggtccacacgtggaccgagcagtataagttccaggcggactcccccaaacgcctggccaccgccatagccggggcctgggagaacggggtgtgcggtatccgctcgactacacggatggagaatctactgtggaagcagatcgcgaacgagttaaattacatcctgtgggagaacaacatcaagctgaccgttgtcgtcggggatatcatcggcgttctcgaacagggcaagcgcactctgacgccccagccgatggagctgaagtactcctggaaaacctgggggaaggcgaagatcgtcaccgcagagacgcagaacagctccttcataatagacggtcccaacactccggagtgccccagtgcctcccgggcatggaacgtgtgggaggtagaggactatgggttcggcgtcttcaccaccaacatctggcttaagcttagggaggtttacacccagctgtgcgatcatcggctcatgagtgcggctgtgaaggacgaacgagccgtccacgccgacatgggatactggattgagtctcaaaagaatggatcctggaagctggagaaggcgtcactgatcgaggttaagacgtgcacgtggccgaagtcccataccctctggagtaacggcgtactggagtccgacatgatcatccctaaatctctggccgggccaatctcccagcacaattaccggccgggctaccacacccagacggccgggccctggcacctaggcaaactagagctggactttaactactgcgagggtacgaccgtcgtgattaccgagaactgcggaacccgcggccctagcttacgaaccaccaccgtgtcagggaagctgatacatgagtggtgctgccgcagttgcaccctgcccccgctccggtacatgggcgaggacgggtgctggtatggcatggagatccgccccatctctgagaaggaggagaatatggtcaagagcctagtctccgccgggagcggaaaggttgacaacttcacgatgggcgtcttatgcctcgccatcctcttcgaggaagtgatgcgggggaagtttggcaagaagcatatgatcgcgggggtgttcttcactttcgttctgttgctgtccggacagataacctggcgcgacatggcccacaccttaataatgataggttccaatgccagcgaccggatgggtatgggcgtgacgtacctagccctgatagctaccttcaagattcagccattcctggcgcttgggttcttcctgaggaagctgaccagccgggagaacctcctgctgggcgttggactcgccatggccaccaccctgcagctccccgaggacatcgagcaaatggccaacgggatcgcgctcggcctgatggcacttaagctcatcacccagtttgaaacttaccaactgtggacagccctgatcagcctcacttgctccaacaccatcttcacgctgactgtcgcttggaggacggctacactgatccttgcgggggtgagcctcctgcctgtatgtcagtccagctccatgcggaagaccgactggctccccatgactgtggccgcgatgggagtgccgcccctccctctgttcatctttagcctcaaggatacgctgaagcgccgctcctggcccctcaacgaaggcgtcatggccgtggggctcgtgagcatcctggcttccagcctactccggaacgacgtccccatggcggggcccctggtggcaggcggactgctcattgcctgctatgtgataaccgggacctccgccgaccttaccgtcgagaaggccgcggatgtgacgtgggaggaggaggccgagcagacaggcgtttcccacaacctgatgattacagtcgacgatgacggcaccatgcgtatcaaggacgacgaaaccgagaatatcctaactgtgctactcaagaccgcgttgctgatcgtgagtggcatcttcccgtacagcatccccgccaccctgctcgtctggcacacttggcacaaacagacgcagcgctccggcgttctgtgggacgttcccagtccgcccgagacccagaaagccgagctggaagagggtgtctatcgtatcaagcagcagggaatattcgggaaaacccaggtcggcgtcggtgtacagaaggagggggtcttccacaccatgtggcacgtaacgaggggcgcggtcctcacctacaacgggaagcgcctggagcccaactgggcctctgtgaaaaaggacctgatctcgtatggcggcggttggcggttaagtgcccagtggcagaagggggaagaagtgcaggtgatcgccgtggagccgggcaagaaccccaaaaatttccagaccatgcccggcaccttccagacaaccacaggagagatcggtgcgatcgccctggacttcaagcctgggaccagcggctctcccatcatcaaccgcgaaggcaaggtggtcggactgtacggaaacggggtggtgaccaagaacggcgggtacgtcagcggcatcgcccagacgaatgccgaaccggacggcccaacccctgaactggaggaagagatgtttaagaagcgcaatctcaccatcatggatctgcatcccgggagcggcaagacgcgcaagtacctgccggctatcgtgcgggaggccatcaagcgccggctccgaaccctgatcctagcccccacgcgggtggtagccgcagagatggaggaggccctcaagggcctgcccattcgttaccagaccacggcgaccaagtccgagcacaccggccgggaaatcgtggacctgatgtgtcatgccaccttcacgatgagactcctcagccccgttcgggtcccgaactacaacctgattatcatggacgaggcccatttcaccgatcccgcctcaatcgcagcgcgggggtacataagcacacgcgtgggcatgggcgaagccgccgccattttcatgacggcgacgccgcccggaaccgcagatgccttcccacagagcaatgcccctatccaggatgaagagagagacattcccgaacgcagctggaattccggaaacgagtggatcaccgacttcgcagggaagaccgtgtggttcgtcccctcaattaaggctggcaacgacatagcgaactgcctccggaagaatgggaagaaggtgatccagttaagcaggaagacgttcgacactgaataccagaagaccaagctgaatgactgggacttcgtcgtcaccacggacatttcggaaatgggggccaactttaaagctgacagagtgatcgacccgcgaagatgcctcaagcccgtgatcctgaccgacggccccgagcgggtcatcctggcagggcctatgccggtaaccgcggcctccgccgcccagcggcgcggcagagtggggcgcaaccctcagaaggaaaacgaccagtacatcttcaccggccagcccctgaacaacgacgaggaccacgcacactggactgaggcgaagatgctgctggacaacattaacacgcccgaggggatcatcccagccctcttcgaacccgaacgcgagaagtccgctgcgatcgacggcgagtaccgcttgaaaggcgaatcccggaagacctttgtcgagctgatgcgccgcggggatctcccagtgtggctggcgcataaggtcgccagcgaggggattaagtacacagatcgcaagtggtgcttcgatgggcaacggaacaaccagatcctggaggagaacatggacgtagagatctggactaaggagggtgagaagaagaagctccgccctcggtggctggatgcccgcacgtactccgacccgctggctctcaaagagttcaaggatttcgcagcgggtcgcaagagcatcgccttagacctggtgacagagatcgggcgggtaccctcccacttggcccaccgcacgaggaacgccctagacaacctggtgatgctccacacaagcgaacatggcgggaaggcgtaccgccacgcggtggaggagctgccggagacaatggagaccctgttactgctgggcctcatgattctgcttaccgggggcgctatgctgttcctcatcagcggaaaagggatcggcaagacctctatagggctgatctgtgtcatcgctagttccggcatgctctggatggccgagatcccgctgcagtggattgccagcgcgatcgtactggagttcttcatgatggtgttgctgatccccgagcccgagaagcagcggactccccaggacaaccaactggcctacgtcgtcattgggatccttaccctagccgctataatcgccgcgaacgaaatgggcctgctcgagaccaccaagcgagacctgggaatgtccaaggagccgggggtagttagccctacgagctacctggatgtggatctccaccctgcaagcgcgtggacgctgtacgcggttgcgaccacggtcatcacgcccatgcttcgccacacgatcgagaactccaccgccaacgtgagcctcgcggccatcgcgaaccaggctgtggtcttaatgggcctggacaagggttggcctatcagcaaaatggacctcggggtgccgctgctggccctcgggtgttattcacaggtgaatccactgaccctcacggccgccgtcctcctgctgataacccattacgccatcatcggtcccggcttgcaggcgaaggccacacgcgaggcccagaaaaggaccgccgccgggataatgaagaacccaacggtggacggcatcatgaccatcgacctggatcccgtaatctacgatagtaagttcgagaagcagctggggcaggtcatgctcctggttctgtgcgcagtgcagctcctgcttatgcgcaccagctgggccctctgcgaggcccttacactggcgacgggccctatcaccactctctgggagggcagcccggggaaattctggaataccacgatcgcggtgagcatggccaatatattccggggctcctacctggccggggccggcctggcgttttccatcatgaagtccgtggggaccggcaagaggggtactggtagccaaggtgagactctcggggaaaagtggaagaaaaaactgaatcaactgtcccggaaagagttcgacctttacaagaagtccggcatcacggaggtggaccgcacggaggccaaggagggcctgaagcggggcgagatcacccatcacgccgtcagccgcggctctgccaagctccagtggttcgtggagcgcaacatggtgattccggagggtcgtgttatcgacctcggctgcgggcggggcgggtggagctactattgcgccggcctgaagaaggtgaccgaggtgcgcggctacaccaagggcgggcccggccacgaggagccggtccccatgtccacgtacggctggaatatcgttaaactgatgagcggtaaggatgtcttctacctcccgcccgagaagtgcgatacactgctgtgcgacatcggcgagtcaagcccctcccccaccgtcgaggaaagccggacgatcagggtgctgaaaatggtagaaccgtggctcaagaacaaccaattctgcataaaggtcctaaacccatatatgcccacggtgatcgagcacctggagcgcctccagcggaagcacggcgggatgctagtgcgcaaccccctgtcccggaacagcacccacgaaatgtactggatctccaacgggaccgggaatatcgtcgccagcgtgaacatggtatccaggctcttactcaacagattcaccatgacccaccgccggccgaccatagagaaggatgttgatctcggcgctggcacacgccacgtaaacgccgagcccgaaacgcccaacatggacgtgattggtgagcggatcaagcgcatcaaggaggaacacaacagcacatggcattatgacgacgaaaacccgtacaagacctgggcgtaccacggctcctacgaggtcaaggcaaccgggagcgcctccagcatgatcaacggcgtagtcaaactgttgaccaagccctgggacgtggtgcccatggtcacgcagatggcgatgaccgacaccacccccttcggacagcagcgggtgttcaaagagaaggtggacacgcgcactccgcggagcatgcccggcacccgccgggtcatgggcatcaccgccgaatggctctggcgcacactggggcggaacaagaagccccgcctgtgcacccgggaggaattcaccaagaaggttcgcacgaacgccgccatgggggcggtgttcacggaagagaaccagtgggattccgccaaagccgctgtcgaggacgaggacttttggaagctcgtggaccgcgagcgggaactgcacaaattgggaaagtgcggcagctgcgtgtacaacatgatggggaagcgcgagaagaaactgggcgagttcggcaaggcaaagggtagtagagcgatttggtatatgtggctgggcgctcgctacctggagtttgaggccctcggcttcctgaacgaggaccactggttcagccgggagaactcctacagcggcgtcgagggggaaggcttacacaagctcggatatatcctgcgtgatatatccaagatacccgggggggctatgtacgcagatgacactgcggggtgggatacgcggattaccgaggatgacctgcacaacgaggagaagatcacacagcagatggacccggaacacaggcagctcgccaacgccatcttcaagctaacatatcagaacaaggttgtgaaagtccagcggcccacccccaccggcaccgtaatggacatcatcagccgcaaggaccagcggggctccggccaggtgggtacgtacgggttgaacaccttcacgaatatggaggcccagctcatccgccagatggagggggagggtgtgctgtccaaggccgatctagagaacccccacctcccggagaagaaaatcacccagtggttagagactaagggcgtagagcgcctgaaacgcatggcgatcagcggcgacgactgtgtggttaagccaattgacgacaggttcgccaacgccctcctcgcactgaacgacatggggaaggtgcgcaaggatattccccagtggcagccttcgaagggttggcacgactggcagcaggtcccgttctgctcccaccacttccacgagctcataatgaaggacgggcggaagctggtcgtgccctgccgcccgcaggacgagctgatcggtcgcgcccgcatcagccaaggggctggctggtctctccgtgaaaccgcctgcctgggcaaggcctacgcccagatgtggagcctgatgtacttccaccggcgcgacctccggctggccagcaacgccatctgcagcgccgtgcccgtccactgggtaccgacttcccgcaccacgtggtcgatccacgcccatcatcagtggatgaccaccgaggacatgcttaccgtctggaacagggtctggatagaagacaatccctggatggaggacaagacgcccgtgaccacttgggagaacgtgccctacctcggaaagagggaggatcagtggtgcggctcgctgatcgggctgacctcccgtgcaacgtgggcacagaacatcccgaccgccatccaacaggtccgcagcctcatcggcaacgaggagttcctggactacatgccctcgatgaagcggttccgcaaggaggaggagagcgagggggccatctggtga

SEQ ID NO: 26000 - RNA, 9873 nt, synthetic construct
  misc_feature 1..9873: note = derived and/or modified CDS sequence (opt11) from DENV-3__FJ547080__SS-prME
  source 1..9873: mol_type = other RNA
acctcactgtgcctcatgatgatcctgcccgcggcgttagctttccacctcacatcgcgggacggcgaaccgcggatgatcgtgggaaagaacgagcgcggcaaatccctgttgtttaagacggcctcaggaattaatatgtgcaccctcatcgctatggacctgggagagatgtgcgacgacaccgtgacctataagtgccctcacataactgaggtggagcccgaggacattgactgctggtgcaacctgaccagcacctgggtgacctacggcacttgcaaccaggcaggcgaacataggagagacaaacgtagcgtggctcttgcaccccacgtgggcatggggctggacacccgcacgcagacctggatgagcgcggagggtgcctggaggcaggtcgagaaggtcgaaacgtgggccctgcggcaccccgggttcaccatcctcgccctgtttcttgcacactacatcggcacttccctcacccagaaagttgtgatctttatccttttgatgctcgttacgcccagcatgactatgcggtgcgttggggttggcaaccgcgacttcgtcgaagggttgagcggagccacatgggtggatgtggtcttggaacacggtgggtgtgttaccacgatggccaagaacaagcccaccttagacatcgagttacagaaaacggaggccacccagctcgcgacgctccgaaagctgtgcatagagggcaagatcaccaacattacgaccgactctcgatgccccacgcagggtgaggcagtgctgcctgaggagcaggaccagaattacgtgtgcaagcacacgtacgtggaccgcgggtggggcaacggctgcggcctcttcgggaaaggatccctggtaacctgcgccaagtttcagtgccttgagcccatagagggcaaggtggttcagcacgagaatctcaagtacaccgtgattatcacggtccacacaggggaccagcaccaggtgggcaatgaaacccagggggtaaccgccgagatcacgccacaggcctcgaccaccgaggcgatcttgcccgagtatggaacactcggcttagaatgtagtccccgcactggcctcgatttcaacgagatgatcctgctcacgatgaagaataaggcctggatggtgcaccgacaatggttctttgacctgccccttccctggaccagcggcgccaccaccgagacacccacttggaaccgcaaggaactcctagtcaccttcaaaaacgcccacgccaagaagcaggaggtcgtggtgctgggaagtcaagagggcgctatgcacaccgccctcacgggggcaactgagattcagaacagcggcgggacatccatcttcgccggccatttaaagtgccgtctcaagatggacaagttggagctgaagggcatgagctatgccatgtgtaccaacacgttcgtactcaaaaaggaggtgtccgagacacagcacggcaccatcctcatcaaagtcgagtataaaggcgaagacgtcccctgtaaaataccttttagcaccgaagacgggcagggaaaagcgcacaatggccgcctgataacggctaaccccgttgtcacgaaaaaggaggagccggtcaacatcgaggcagaaccgccattcggggagtctaacatcgtgatcggaataggggacaacgcactcaagatcaattggtacaaaaagggttcgtccatcgggaaaatgtttgaggcaaccgctcggggcgcccgccggatggcgatactgggcgacaccgcctgggacttcgggtccgtgggcggcgtgctcaacagcctgggcaagatggtgcatcagatctttgggtccgcgtatactgcgttgttcagcggggtgtcctgggtgatgaagatcggcatcggggtgcttctaacatggatcggcctgaactctaaaaacacctccatgtcgttctcctgcattgtgattgggatcatcactctctatctgggcgccgtcgtacaagccgacatggggtgcgtgatcaattggaagggcaaggagctgaagtgcggcagcgggatttttgtcactaacgaagtgcacacctggaccgagcagtacaagtttcaagcggacagccccaaacgcctggccacggcaatcgctggggcctgggagaacggtgtctgtggcataaggagcacgaccaggatggagaacctgctgtggaagcagatagccaacgagctcaactatatcctttgggaaaacaacattaagttgaccgttgtggtaggtgacataattggcgtcctcgaacagggaaagcgcaccctgacgccccagccaatggagctgaagtattcttggaagacctggggaaaagcgaaaatcgttaccgccgagacccagaacagttcattcatcatcgatggccctaacacacccgaatgccccagtgcctcacgggcgtggaatgtatgggaggtcgaggactacggtttcggagtgttcaccaccaacatctggctgaaattgcgcgaagtgtacacgcagctttgtgaccaccgtcttatgtccgctgcggtgaaggatgaacgtgccgttcacgccgatatgggctactggatcgaatcacagaaaaacgggagctggaagctggagaaggcttctctgatagaagtcaaaacctgcacttggccaaagtcccacaccctctggagcaatggcgtgctggagtccgacatgatcatccccaagtcactggcgggtcccatcagtcaacataattatcggcctggttatcacacgcagactgcgggcccctggcacttaggcaagctggagctggactttaactactgtgagggcacgaccgtggttatcaccgagaactgtgggacacgcggccccagcctcagaaccaccaccgtctccgggaagcttatccacgagtggtgctgccgcagctgcaccctgccaccgctccggtacatgggcgaggatgggtgctggtatggcatggagatccgtcccatctccgagaaagaggaaaacatggtaaagtcgttggtgagcgccggaagcgggaaggtcgacaacttcaccatgggcgtgttatgcctcgcgatcctatttgaagaggtgatgcgtgggaagtttggaaaaaaacatatgatagccggggtcttttttacgttcgtgctgctactgtccggacaaatcacttggcgcgacatggcgcacacgctgataatgatcggcagcaatgcctccgaccggatggggatgggggtgacgtacctagccctgatcgccaccttcaagatccagcccttcctggccctcggctttttcctgaggaagctgacctcgagggagaacttactactgggagttggcctcgcgatggccaccacgttgcagctgccggaggacatagagcaaatggccaacgggatagccttgggcctgatggcgctaaagctcatcacacaattcgagacttaccaactatggacagccctaataagccttacttgctccaacacaatctttaccttgaccgtggcctggcgcacggccaccttgatcctcgctggcgtcagccttcttcccgtatgccagagtagctcgatgagaaaaaccgactggctacccatgaccgttgcggccatgggggtgcctcccctcccgctgttcatcttcagcctcaaagacacgctgaagcgccgctcgtggccccttaacgagggtgtaatggccgtgggcctagtcagcattctggcatccagcttgctcagaaatgatgtgccaatggctggccccttggtggccggcggactgctcatcgcctgttatgtcataactgggacgagcgcagatttgaccgttgaaaaggccgccgatgtgacgtgggaggaggaggcggagcagactggcgtctctcacaacctgatgatcacagtggacgatgacgggacgatgagaatcaaagatgacgagacggagaatatcctcaccgtgctactgaagaccgcactcctgattgtctccggcatcttcccgtacagcatccccgccacattactagtgtggcacacctggcagaaacaaactcagcggtctggcgtgctttgggacgtcccgagcccccccgagacccagaaggccgaactcgaggaaggagtttatcgcattaagcagcaggggatcttcgggaaaactcaagtgggcgtcggtgtgcagaaggagggtgtgtttcacacgatgtggcatgtaacccggggcgcagtgctcacttataacgggaagcgcctggagcccaactgggcgagcgtcaagaaagacttgatcagttacggtgggggctggcgcctctccgcccagtggcagaaaggagaggaggtccaggtgatagcggtggagccgggcaagaatcccaaaaacttccagaccatgcccggtaccttccagaccaccactggagaaattggagccatcgcgctcgacttcaagcctgggactagcggcagccccatcatcaacagagagggcaaggtcgtggggttatatggcaacggcgtggtgacgaagaacggcgggtacgtgtccggcatagcccaaaccaatgccgaaccggacggcccgacgcccgagctggaggaggagatgttcaaaaaacggaatcttacaatcatggacctacaccccgggagcggcaaaacgcgcaaatatctgccggcgattgtgcgggaggccatcaagcgccggctccgcaccttgatcctggcgcccacgcgggtcgtggccgccgagatggaggaggccctcaaagggctgcccatccgctaccagacgacggccactaagtccgaacacacagggcgggagatcgtggacctaatgtgccatgcgactttcacgatgcgcctcctgagccccgtccgggtcccgaattacaacctgatcattatggacgaagcccactttaccgatcctgcctccatagccgcccgagggtacatcagcacccgggtgggcatgggagaggcagcggccatcttcatgaccgccacgccgcccggaacggcggacgccttcccgcaaagtaacgccccaatacaggacgaggagcgcgacatccccgaacgcagctggaactctgggaatgagtggataacggatttcgcagggaagaccgtctggttcgtgccgagcatcaaggccgggaacgacatcgcaaactgcctccggaaaaatgggaagaaggtaattcagctgtcacgcaagacgttcgacaccgagtaccagaagaccaagttgaacgactgggatttcgtcgttaccacggatatctctgagatgggcgccaactttaaggccgaccgggttatagacccgcgccggtgcctcaagcccgtgatactgaccgacggccccgaacgagtgatcctggccgggcccatgcctgtgaccgccgctagtgccgctcaaagacgcggccgggtcggccgcaacccccggaaagagaatgaccagtatatcttcacaggtcagcccctcaacaatgacgaggaccacgcccactggaccgaagccaagatgctgctggacaacatcaacacgcctgagggtatcattccagcattattcgagcctgaaagggaaaagagcgccgccattgacggtgagtaccgcctgaagggcgagtcgcgcaagaccttcgtggaactgatgcgccgcggggacctacccgtatggctagcccataaagtggcgagtgagggcatcaaatacaccgacaggaaatggtgcttcgacgggcagcgcaacaatcagatactggaggaaaacatggatgtggaaatctggacgaaggagggcgaaaagaagaagctaaggccgcgctggcttgatgcccgcacgtactccgacccgttagccctcaaggaattcaaggacttcgccgcggggcgcaagtctattgcgctggacctcgtgaccgagatcgggcgcgtgccatcccacctcgcccaccggactcgcaacgcactggacaacctggttatgctccatacctcggagcacggagggaaggcataccggcatgccgtcgaagaactgcccgagactatggaaaccctgctcctgctgggtctcatgatcctgttgacagggggtgctatgttattcctgatatctggcaagggcatagggaagacctccatagggctgatttgtgtgatcgcaagctccggcatgctatggatggccgagataccgctgcagtggattgcctcagccatcgtgctggaattctttatgatggtgctcctcatccccgagcccgagaagcaacgcacgccacaggacaaccagctggcgtatgtagttatcggtatcttgaccctagccgcaatcatagccgcaaacgagatgggcctgctcgagaccaccaagcgcgacctgggaatgtccaaagagccgggcgtcgtcagccctacgagctatctggacgtagacctccaccccgctagcgcttggacactctacgctgtcgccaccaccgtgatcacacccatgctgcgccacaccatagagaacagtacagcgaacgtgagcctggccgctatcgccaaccaagccgtcgttttaatgggcctggacaaagggtggccgatctcaaaaatggacttaggtgtacctctgctggcgttagggtgctacagccaagtcaaccccctcacgctgacggctgcggtcctcctgctcatcacccattacgccatcataggtccaggactccaggccaaggcgacacgtgaggcccagaagcgcacagcggccggcataatgaagaatcccactgtagacggaatcatgaccattgatctggaccccgtcatctacgacagcaagtttgagaagcagttaggccaggtgatgctcctcgtgctgtgtgccgttcaactcctgctgatgagaacctcctgggccctatgcgaggccctgaccctggccacaggcccaataaccaccctatgggagggctctcccggtaagttttggaataccacgatcgccgtctcgatggccaatatcttcaggggatcatatctcgccggggccggcctcgccttcagcatcatgaagtccgtggggactggcaagcggggcaccgggtcacagggagaaacactcggggaaaagtggaagaaaaagctaaaccaattaagccggaaggagttcgacctctacaagaagtccggcatcacggaagtcgatcggacggaggccaaagaagggcttaagcgcggggagattacccaccacgcagtgtcaagaggcagcgccaaactgcaatggttcgtggaacgcaacatggtcatcccagaggggagagttatcgacttagggtgcgggcgcggcgggtggagctactactgtgcaggcctcaagaaggtaaccgaggtccggggctacacgaagggaggccccggccacgaggagccagtgcccatgtcaacttacggttggaacatcgtgaagttaatgtccgggaaggatgtcttctatcttccgcctgagaagtgcgacacccttctgtgcgatatcggagagtccagcccttcacccaccgtggaagagagccgcaccatccgcgttctgaagatggtcgagccgtggcttaagaacaatcagttctgcattaaagtgctaaacccctatatgccaacggtcatcgagcacctggagaggctccagcgtaagcacggtgggatgctggttcggaatcccttatcccgcaatagcacacatgagatgtactggatctccaacggcaccgggaacattgtggcgagcgtgaatatggtctcccggttgctgctcaacaggttcaccatgacgcaccgtaggccgaccatcgagaaagacgtggacttaggcgccggcacccgtcatgtgaacgcggagcccgagacacccaacatggacgttatcggggaaagaatcaaaagaatcaaggaggagcacaactcgacgtggcactacgacgacgagaacccgtacaagacctgggcctaccacggcagctacgaagtaaaggccactgggagtgccagcagtatgataaacggcgtcgtgaaactcctgaccaagccctgggatgtggttcccatggtgactcagatggcaatgaccgatactacccccttcggacagcagcgcgtgttcaaggaaaaggtagatacccggacgccccgctctatgcccggtacccgcagggtgatgggcatcaccgctgagtggctctggcggacactgggccgcaataagaagccccggttatgcacacgcgaggagttcaccaagaaggtccgcaccaacgccgcgatgggcgccgttttcacggaggagaaccaatgggactcggcgaaggccgccgtggaagacgaggatttctggatcctcgtggatcgagagcgcgagctgcacaagcttgggaagtgcggaagctgtgtctacaacatgatgggcaaaagggagaagaagttaggcgagtttggcaaagccaaagggtccagagctatctggtatatgtggctcggcgcacggtacctggagttcgaggccttaggattcctgaacgaagaccattggttctcccgcgaaaattcctattcgggcgtggagggagaaggcctccataaactcggctacatcctacgagacattagcaagatccccggtggcgctatgtacgcggacgacacagctggatgggatacgcggatcaccgaggacgacttgcacaacgaagaaaagatcacgcagcagatggacccggagcatcggcagttagcgaacgccatcttcaagctgacctatcagaataaggtggtcaaggttcagcgaccgacgcctaccggcacggtgatggacatcatcagccggaaggaccagcgggggtccgggcaggtaggcacctacgggctgaataccttcaccaatatggaggcccagctaatacggcagatggagggcgagggggtgttgagcaaggccgacctggaaaacccccacctcccagagaagaagattacccagtggctggagacgaagggagtggaacgcttgaaacggatggccatctccggcgacgactgcgtggtgaaacccatcgacgatcgcttcgcgaacgcgctcctggccttaaacgacatgggcaaggttcgtaaggatatcccccaatggcagccgagcaaaggctggcatgattggcagcaggtaccgttctgctcccaccacttccacgagctcatcatgaaggacggacgcaagttggtcgttccctgcagaccccaggacgaactaatcgggcgcgcgcggatcagtcagggggctggctggtccctccgcgagaccgcgtgcctgggcaaagcatacgcccagatgtggtccctaatgtactttcacaggcgggatctccgcttagccagcaatgccatctgctcagccgtacctgtacactgggtgccgacatctcggaccacctggagcatccacgcacaccatcagtggatgaccaccgaagacatgctgaccgtctggaaccgcgtgtggattgaagacaacccctggatggaagataaaacccccgtgacgacttgggaaaatgtaccttacctaggcaaaagggaagaccagtggtgcggctccctgatcgggctcacctccagagccacgtgggcccagaacatccccaccgcgatccagcaagtgcgaagcctcatcggcaatgaggagttcctggactatatgccctccatgaagcgcttcagaaaggaagaggagtcggagggtgccatctggtag

SEQ ID NO: 26001 - RNA, 9873 nt, synthetic construct
  misc_feature 1..9873: note = derived and/or modified CDS sequence (opt11) from DENV-3__FJ547081__SS-prME
  source 1..9873: mol_type = other RNA
acgagcctatgtctcatgatgattctccccgccgcgttagcgttccacctcaccagccgcgacggcgagccgcggatgatagtgggtaagaacgagcggggcaagtcactactgttcaagactgcgagcgggatcaacatgtgcacccttatagccatggacctgggtgaaatgtgtgatgacaccgtgacttacaagtgcccacacatcaccgaggtggaacccgaagacatcgactgttggtgcaacttgaccagcacctgggttacatacgggacgtgtaatcaggccggcgaacaccggcgcgacaagcggtccgtcgccctagcgccacacgtgggaatggggcttgatacccgcacccagacctggatgagcgctgagggtgcctggagacaggtcgagaaagtggagacgtgggcgttgcgccacccggggttcaccatcctcgcgctgttcctggctcattatatcggaacttctttgacccaaaaggtggtgatctttattcttctgatgctcgtcacgccgagcatgacgatgcggtgcgtgggtgtgggtaatcgcgacttcgtagagggcctgtccggggccacctgggtggacgtggtccttgaacacggcgggtgcgtgaccacgatggccaagaacaagccgactctcgacattgagctgcagaagacggaggccacccagctagcgacgctccggaagctctgcatcgagggcaagattacgaacataaccacggatagccgctgtcccacgcagggcgaagccgtgctgccggaggaacaggaccagaactacgtgtgcaagcatacatacgtagacagggggtggggcaatgggtgcggcctgttcgggaagggcagtctggtcacctgtgccaagttccagtgcctggagcccatcgaggggaaggtcgtgcagtacgaaaacctgaagtacacagtgatcataacggtccacactggggatcagcaccaggtgggcaacgagacccagggcgtcacggccgagataacgccccaggcgtccaccaccgaagccatcctgcccgagtacggcaccctggggctcgagtgctcccctcgtaccggcctggacttcaacgaaatgattctgctcacgatgaagaacaaagcctggatggtgcaccgacagtggtttttcgatttacccttgccgtggaccagtggcgccaccaccgagacgcccacctggaaccgcaaggagcttctcgtcaccttcaagaacgcgcacgcaaagaagcaggaagtggtggtgttgggttcccaggagggcgcgatgcacaccgccctaacgggggcgacagagatccagaacagtggagggacctctattttcagcggccacctgaagtgccgtctcaagatggacaaacttgaactaaaggggatgtcctatgccatgtgcaccaacacgttcgttctgaagaaggaggtgagcgagacccagcatgggaccatacttatcaaagtagagtacaagggtgaggacgtcccgtgcaagatacctttcagtaccgaggacgggcagggcaaggcccacaatggccggctaataacggcgaatccagtagttaccaaaaaggaggagcccgtcaacatcgaggccgagccgcccttcggggagagtaacatcgtgatcggcatcggggacaacgccttaaagatcaactggtacaagaagggctcgagcatcgggaagatgttcgaggccacggcgcgtggcgcccgccgaatggcgatcctgggtgacaccgcatgggacttcgggagcgtcggcggggtgttaaacagcttaggtaagatggtccaccagatcttcgggagcgcttacacggcactcttctcgggggtcagctgggtcatgaagataggtatcggggtgctcctgacctggatcgggttgaactccaagaacacctctatgtcttttagctgtatcgccatcggtattatcacattgtacttgggcgccgtggtccaggccgacatggggtgcgtgatcaactggaaaggcaaggaactgaagtgcggatccggtatattcgtaacgaatgaggtccacacatggaccgagcagtataagttccaggctgacagcccaaagcgcctcgcgaccgcaatcgccggcgcttgggagaacggtgtgtgcgggatccgctcgacgacccggatggagaacctgctgtggaagcagattgcaaacgagctcaactacatcctgtgggagaacaacatcaaacttaccgttgtcgtgggggacatcatcggcgttctcgagcagggtaagcgcaccttgacgccacagccaatggagctgaagtatagttggaagacctgggggaaggctaagatcgtaaccgccgagacccaaaactccagcttcatcatcgacggcccaaacacgcccgagtgcccctctgcctctcgggcttggaacgtgtgggaggtggaggactacgggttcggcgtctttaccaccaatatctggctcaaactgcgcgaggtctacacccagttgtgcgaccaccggctaatgagcgctgccgtgaaggacgagcgcgcggtccacgcggacatgggctattggatcgaatcccagaagaacgggagctggaagctggaaaaggctagcctaatcgaagtgaagacctgcacgtggcccaagtctcacaccctctggtccaacggcgtgctcgagagcgacatgatcatccccaaatccctggcggggcccatttcgcagcataactatcggccgggctaccacacacagaccgcgggtccctggcatctcggcaagctggaactggatttcaactactgcgaaggcacgaccgtcgtaatcaccgagaactgcggaactagaggcccctccttgcggacgaccaccgtcagcgggaagctcatccacgagtggtgctgtcgctcctgtactctgcccccactccggtacatgggtgaggacggctgctggtacggcatggagattcgccctatcagtgaaaaggaggagaacatggtcaagtccctggtgagcgccgggagcggtaaggtggacaattttaccatgggcgtcttgtgcctcgctatactgtttgaggaagtgatgcgggggaaatttggaaagaagcacatgatcgccggggtgttcttcacgtttgtcctactgctaagcggccagatcacatggagggacatggcacacacactgattatgatcggctccaacgcctcggaccggatgggcatgggagtgacgtatctcgcattaatagccaccttcaaaatccagcccttcttggcgctagggttcttcttaagaaaacttaccagccgggagaacctactgctgggagtgggcctcgctatggccaccacgttgcagttacccgaagacatagaacagatggccaacgggatcgcgctgggcctcatgacacttaaactcatcacccaattcgagacctaccaactgtggacggcgctgatctccctgacatgcagcaataccatcttcaccctgacggtggcctggcggacggccaccctgatcttggccggggtgagtctgctcccggtctgccaaagcagtagcatgcgaaaaacggactggttgcccatgacggtggctgcgatgggcgtgccgccactcccgttattcatcttctctctcaaggacaccctgaagcgccgcagctggcccctgaacgagggggtaatggccgtgggcctcgtatccattctggccagctccctgctgagaaacgatgttcctatggccggcccgctggtggccgggggcctgctcatcgcgtgttacgtgatcacgggcaccagcgccgatctgacggtagagaaggccgccgacgtgacctgggaggaggaggccgagcagactggcgtgtcccacaacctgatgattaccgtcgatgacgatgggaccatgcgcattaaggacgacgagacggaaaacatccttacggtcctgctgaagaccgcgctcctgatcgtcagcggcattttcccgtatagtatcccagccactctgctagtctggcacacatggcagaagcaaacccagcgttcaggcgtgctgtgggatgtacctagcccgcccgaaacccagaaggccgagctggaggaaggggtctaccgcatcaaacagcaggggatcttcgggaaaacacaggtgggcgttggggttcagaaggaaggcgtttttcacacgatgtggcacgtgacccgaggcgccgtcctcacctacaacgggaagcgcctggagcccaactgggcaagcgtgaagaaggacctgatctcctacggcgggggatggcggttaagcgcgcagtggcagaagggcgaagaggtacaggtcatcgccgtggagcccggcaaaaaccccaagaatttccagacgatgccaggaacgttccagacaactaccggagagataggcgccattgccctggacttcaagcccgggacgagcggctcccccataattaatcgcgagggcaaagtggtcggcctgtacggaaacggggtggtgactaaaaacggcggttacgtgagcggtattgcacaaaccaatgccgagccggatggcccgacaccggagctggaagaggaaatgttcaagaagcgaaacctaacgatcatggatctgcaccccggctccggcaagacacgcaagtacctgcctgccatcgtgcgagaagctatcaagaggcgtctgcgtaccttgatccttgcgccgacccgcgtggtcgcggccgaaatggaagaggccctcaaggggctgcccattcgatatcagacgacggcaaccaagtctgagcacaccggccgtgagatcgtggacttgatgtgccacgccacgttcacgatgcgcctcctatccccggtacgggttccgaattacaacttaatcatcatggatgaagcgcacttcaccgaccccgcttctattgccgcccgtgggtacatctccacacgcgtcggcatgggcgaagccgccgccatattcatgacggccaccccgccagggacggccgacgcatttccgcagagcaacgccccgatccaggatgaggaacgagacatacccgagcgctcctggaacagcgggaacgagtggattaccgacttcgccggaaaaacagtttggttcgtcccctcaatcaaggcaggcaacgacatcgccaactgcttgcggaagaacggtaagaaagttatccagctgagcagaaagaccttcgataccgaataccaaaagacaaagctgaacgactgggatttcgtggtcacaaccgacatttccgagatgggcgccaatttcaaggccgaccgagtgatcgaccctcgacggtgcctcaagcccgtcatcctaaccgacggacccgagcgcgtcatactcgccgggcccatgcctgtgaccgccgcttccgccgcccaacggcgcggacgagtcggtcgcaacccccagaaggaaaatgatcagtatatcttcaccggccagcccctcaacaacgacgaagaccacgcccactggaccgaggcaaaaatgctgctcgacaacatcaacacccccgaggggatcatcccggccttatttgagcccgagcgggagaagtccgcggccatcgacggcgagtacaggctcaaaggcgagagccgaaagactttcgtcgagctgatgcggcgcggtgacttaccagtgtggttggcccataaagtcgcgtccgaaggcatcaagtacgcggaccgcaagtggtgcttcgacgggcagcggaacaaccagattctggaggagaacatggacgtggagatctggaccaaggagggcgagaagaagaagctccgcccacggtggctggacgcccggacatacagcgacccgctggccctcaaggagttcaaggacttcgcagccggccgcaagtcaatcgcgctggatttggtgaccgagattggtcgggtccccagccatctcgcccaccgcacacgaaacgctctggacaacctggtcatgctacacactagcgaacacggaggtaaggcctatcgtcatgcggtagaggagctaccagagacgatggagacacttctcctgctcggactcatgatcttactgacagggggcgcgatgctgtttctaatctcgggcaaggggatcggcaagacgtcgataggtttaatctgcgtcatagcctccagcggcatgctctggatggcggagatcccactgcaatggatcgccagcgctatagtgctggagtttttcatgatggtgctcttaatcccagagcccgagaagcagcgcacgccccaggacaaccagctggcttacgtggtgatcgggatcctcactctggccgctatcatcgccgccaacgagatgggtctgctcgagaccaccaagcgcgacttaggcatgagcaaggagccgggggtagtctcgtctacttcatacctagacgtcgacctccatcccgcctcagcttggaccctgtatgctgtggccaccaccgtcatcacacccatgcttcggcacaccatcgagaacagcaccgcgaacgtgtccttggccgccatcgccaaccaggctgtggtccttatgggcctggataagggttggcccatctccaaaatggatctcggcgtgccgctgctcgctctcgggtgctacagccaggtgaaccccctgactcttacggccgcagtgctcctcctgatcacccactacgccatcatcgggcccggcctccaggcgaaggcaacccgcgaggcccaaaaacggaccgccgcgggaatcatgaagaaccccacggtagatggaataatgactattgaccttgacccagtgatatacgacagcaagttcgaaaagcagctagggcaggtcatgctcctggtgttatgcgcagtgcagctgctattgatgcggaccagctgggcgttatgcgaggccttgactctggccacgggtcccataaccaccctctgggagggatcccccggaaagttctggaacactactatcgccgtcagcatggcgaatatcttccggggctcctacctagccggggccggcctggccttcagcataatgaagtcagtgggtactggtaagcgcggcaccgggtcccagggtgagacactcggggagaagtggaagaagaaactgaaccagctgagccggaaggagttcgacctctataagaaatccggcatcactgaggtggaccgaaccgaggccaaggaggggctaaaacggggcgagatcacccaccacgctgtgtcccgcggctccgccaagctgcagtggttcgtagagcggaacatggtgatccccgaggggcgcgtcatcgacttagggtgcggacggggcgggtggtcctactattgcgcggggctgaaaaaggtgaccgaagtgcgcggttacaccaaaggcgggcccgggcacgaggaaccagtccccatgtccacatacggctggaacatcgtgaagctgatgagcggtaaggacgtattctaccttccccctgagaagtgcgataccctgctgtgcgatatcggcgaatccagcccatcccccaccgtcgaggagtcacgtaccatccgtgtcctgaagatggtggagccctggctcaaaaataatcaattttgcatcaaggtccttaacccgtacatgccaacggtgatagaacacctggaacgcttgcagcggaagcacggaggaatgctggtacggaatcccctgtcccggaactcgacccacgagatgtactggatctccaacggcacagggaatatcgtcgcatcggtgaacatggtgtctagactgctgctgaaccggttcaccatgacgcacagaaggccaaccatcgaaaaggacgtggacctcggcgccggcacgcggcacgtcaacgcggagccagagacacccaatatggacgtgatcggggagagaatcaaacgcatcaaggaagaacataactccacgtggcactacgacgacgagaacccgtacaagacctgggcctaccatggctcctacgaggtcaaggccaccgggagcgctagctccatgatcaacggtgtcgtcaaactgctgaccaagccgtgggacgtggtgcccatggtcacacagatggccatgaccgacaccaccccgtttgggcagcaacgcgtgttcaaagaaaaggtggatacgcgcacgcctagaagcatgcccggtacccgccgtgtcatgggcattaccgcggagtggctctggcgcacgcttgggcgtaataagaaaccccgcctttgcacccgagaggagttcacgaagaaggtgcggactaacgccgctatgggggccgtgttcacggaggagaaccaatgggatagcgcgaaggccgccgtcgaagacgaagacttctggaagttagtggaccgcgaaagagagctgcataagctgggaaagtgcggttcctgcgtgtataacatgatggggaagcgggagaagaaactcggcgagttcggcaaggcgaaggggtcccgggccatctggtacatgtggctgggcgcgcgttacctagagttcgaggctctcgggttcctgaatgaagatcactggttctcccgggaaaattcttacagcggcgtcgaaggcgagggcctgcacaagctaggttacatactgcgcgacatctccaaaatccccggaggggccatgtacgccgacgacactgccggctgggatacccggatcaccgaggatgatctgcacaacgaagagaaaatcacgcagcagatggaccctgagcaccgtcagctcgcgaacgcaatcttcaaactgacgtaccagaacaaggttgttaaagtccagcggccgacaccgacgggtacagtgatggacatcatttcccgcaaagaccagcggggaagcggccaggtgggaacgtactctttaaacacattcaccaacatggaggcccagctcattcgacagatggagggggagggcgtcctatccaaggccgacctggagaacccccacctccccgagaagaagatcacccaatggctggagactaaaggggtggaacgattgaagcgtatggccatcagcggcgatgactgcgtggtcaagcccatcgacgaccggttcgcaaacgctctcctggccctgaacgatatggggaaggtgcgcaaggacatacctcagtggcagccctcaaagggttggcatgattggcagcaggttcccttttgcagccaccactttcacgagctcatcatgaaagacgggcggaagctagttgtgccgtgccgcccacaggacgagttaatcgggagagcgcgcatttcccagggggccggatggagcctccgggagaccgcgtgcctgggcaaagcctacgcccagatgtggtccctgatgtactttcatcgccgcgacctccgcctggccagcaatgcaatctgctccgccgtgccagtacactgggtacccaccagtaggaccacctggtccatccacgcacaccatcagtggatgacgaccgaggacatgctgaccgtgtggaaccgggtctggatcgaagacaacccgtggatggaggacaagacgcccgtgaccacctgggaaaacgtgccctatctcggcaagcgcgaggatcagtggtgcgggtccctgataggcctgaccagcagggcaacgtgggctcagaatatccccaccgccatccagcaggtacggagtctaatagggaacgaagagttccttgactacatgccgtcaatgaagaggttcagaaaagaggaggaatccgagggagcgatctggtga

SEQ ID NO: 26002 - RNA, 9873 nt, synthetic construct
  misc_feature 1..9873: note = derived and/or modified CDS sequence (opt11) from DENV-3__FJ547082__SS-prME
  source 1..9873: mol_type = other RNA
actagcttatgccttatgatgatcctgccggctgcccttgctttccacctcacctcccgggacggcgaaccccgtatgatcgtggggaaaaacgagcgcggcaagagcctgctgttcaagaccgccagcgggattaacatgtgcaccctcattgccatggacctgggcgagatgtgcgacgacacggtgacctataaatgtccccacatcgccgaggtggaacctgaggacatcgactgctggtgcaatctgactagcacctgggtgacatacgggacctgcaaccaagccggcgagcaccgacgcgacaagcggtcggtcgcgctggctccccacgttgggatgggactggacacgagaacccagacctggatgagcgccgaaggcgcctggcgccaggtggagaaggtcgaaacctgggcgctccgccacccgggcttcacgattctagccctgtttctggcccactacatcggaacctcccttacccagaaggtggtaatcttcatcctgctcatgctcgtcactccgtctatgacgatgagatgcgtgggcgtgggaaaccgcgattttgttgaggggctgtccggggccacctgggttgacgtggtcctggagcacggcgggtgcgttacaaccatggcaaagaacaaacccacactcgacatcgagttgcagaagaccgaggctacccagttagccaccctccgaaaactgtgcatcgagggcaagatcacgaatatcaccaccgattcgcgctgtcccacccagggcgaagccgtgctaccggaggagcaggaccaaaactacgtctgcaagcatacttacgtggaccgggggtggggcaatggttgcggcctcttcgggaagggctccctggtcacctgcgcaaagttccaatgccttgagcccatcgagggcaaggtcgtgcagtacgagaacctcaagtacaccgtgatcatcacagtccatacgggggaccaacaccaggtgggcaatgagacccagggggtcaccgccgagataactccccaggccagtacgaccgaggctatccttcccgagtacgggacactgggtctcgaatgctccccgcgcaccggcctagacttcaacgaaatgatcctgctgacaatgaagaacaaggcctggatggtacaccggcagtggttttttgacctgcccctgccatggacaagcggagccacaaccgagaccccgacgtggaaccgcaaggagctcctggtaaccttcaagaacgcccatgccaagaagcaggaggtcgtagtgctggggtcccaggagggtgccatgcacaccgcgctcaccggcgccacggagatacagaacagcggtgggacttccatcttcgccggtcacctgaagtgtcggctgaagatggacaagctcgagctgaagggtatgagctatgcgatgtgcaccaataccttcgtcctgaagaaagaggtgtccgagacgcagcacgggactattctcatcaaggtggaatacaaaggagaggacgtcccgtgcaagattccgttttcgacagaggatgggcaggggaaggcccataacggccgccttataaccgccaaccctgtggtgacgaagaaggaggagcccgtcaacatcgaggccgagccgcctttcggtgagagcaatatcgtgatcggcatcggcgacaatgcgctaaaaatcaactggtacaagaagggcagtagcatcgggaagatgttcgaggcaaccgcccggggcgcccgccggatggctatacttggcgacaccgcttgggatttcggttcagtgggcggggtgctaaacagcctaggcaagatggtgcaccagatctttgggtccgcctacactgccctgttctcaggggtgagctgggtcatgaagattggcataggggtgctcctgacgtggatcggcctgaactcgaaaaacacttccatgagcttttcgtgtatcgccatcgggattataactctctacctgggcgccgtggtacaggccgacaccgggtgcgtgattaactggaaaggcaaggagctgaagtgcggcagcgggatcttcgttacgaacgaggtccacacttggactgagcagtacaagttccaggcagattccccaaaacgcctggccaccgccatcgcaggagcgtgggagaatggggtgtgcggcattagatctacgactcgaatggagaacttattgtggaaacagatcgctaacgagctcaactacatcttgtgggagaacaacatcaagctgaccgtggtcgtgggcgacatcataggcgtgctcgagcagggcaagcgtaccctgacacctcagccgatggagcttaaatactcttggaagatgtgggggaaagccaagatcgtcaccgccgagacccagaatagctctttcatcatcgacggcccgaacaccccggagtgccccagcgcttcccgagcctggaacgtgtgggaggtggaggactacgggttcggcgtcttcacgaccaacatctggctgaaactgagagaagtgtacactcagctgtgcgaccaccggctcatgagcgccgccgtgaaggacgagcgagccgtccacgcggacatgggctactggatcgagagccagaagaacgggtcctggaagctggagaaagcctctctgatcgaggttaagacttgcacgtggccaaagtcccacacgctctggtctaacggcgtgctggagtccgacatgatcatccccaagagcctggcagggcccatctcccaacataactatcggcctgggtatcacacccagaccgcaggcccttggcacctcggtaagttagagctggactttaactactgcgagggaaccacggtcgtgatcaccgagaactgcggaaccagaggaccgagcctccggaccaccacagtgtccgggaagctgatccacgaatggtgctgccgttcgtgcacattacccccgctccgttacatgggcgaggatggatgctggtacggcatggagatccgccccatatctgaaaaagaggagaacatggtcaagtccctggtctcggccggcagcgggaaagtggacaacttcaccatgggggtcttgtgcctcgccatcctgtttgaggaggtgatgcgcggtaaattcggtaaaaagcatatgatcgcgggggtcttcttcacgttcgtcctgctcctgtccggacagatcacatggcgcgacatggcccacaccctcatcatgatcggtagcaacgcctccgatcggatggggatgggcgtcacctacctcgcactgatcgcgacgttcaagatccagcccttcctggccctcggattctttctgcgcaagctgaccagccgggagaatctcttactgggcgtcgggctcgccatggcgaccaccctgcagctgcctgaggacatcgagcagatggctaacggaatcgccctcggcctgatggccctgaagctcatcacgcagttcgagacctaccagctgtggacagccctgatcagcctgacgtgctccaatacgatattcaccctgacggtcgcctggcgcaccgcgacgctgatcctggctggggtttctctgttaccggtctgccagtccagctccatgcggaaaagtgactggctccccatgaccgttgccgccatgggcgtgccgcccctcccgttattcatattctccctgaaggacaccctgaagcgacggagctggcccctgaatgagggggtaatggcagtgggcctcgtatccatcctggcgagctccctgttgcggaacgatgtaccgatggccggcccgctggtggcggggggcctgctcatcgcgtgttatgtgattacagggacgagcgcggacctgacggtcgagaaggcggccgacgtgacctgggaggaggaggccgagcagaccggggtgtcccacaacctgatgataacggtcgacgacgacgggaccatgcgcattaaggacgacgagaccgagaacatcctcacagtgctactgaagaccgccttactgatcgtcagcggcatcttcccgtactccatcccagccactctactagtctggcacacttggcagaagcagacccggcgcagcggtgtgctgtgggacgttcccagcccgcccgaaacccaaaaggcagagctggaggaaggggtttaccggatcaagcagcagggaatcttcgggaagacacaggtgggagtaggggtccaaaaggagggcgtgttccacactatgtggcatgtgacccgtggcgccgttctcacctacaacgggaaacggctagagccgaattgggcctcagtgaagaaggacctaatatcctacggcgggggctggcgcctcagtgcccagtggcagaaaggcgaagaggttcaagttattgcagtggaacccgggaagaacccgaagaacttccaaacgatgcccggcaccttccagactaccaccggggagatcggtgctatcgccctggacttcaagcctgggaccagcggcagccccatcatcaatcgcgagggcaaggtggtcgggctgtacggaaacggggtggtgactaagaacggcgggtacgtcagcggaattgcccagaccaacgccgagccggacggtccaacgccagaactggaggaggagatgttcaaaaagcgcaacctcaccatcatggacttacaccccgggtccggcaagaccaggaagtacctgccggcaatcgtgcgcgaggctatcaagcgccggctccgaacactgatcctagcccctacgcgcgtggtcgccgccgaaatggaggaggcgctgaagggcctccccattcgatatcagacaaccgccaccaagagcgagcacactggacgcgaaatagtcgacttaatgtgtcatgccaccttcactatgcggctcttatctcccgtccgcgtcccgaactacaacctgatcatcatggacgaggcgcacttcaccgaccccgccagtatcgcggcccgtggatacatctcgacacgcgttggcatgggggaggccgccgcgattttcatgaccgcgacgccgcccggtaccgccgacgccttcccgcaatcaaacgcccctattcaggatgaggagcgcgacataccggagcgctcctggaattctggcaacgagtggatcacggacttcgcggggaagacagtgtggttcgtcccctcgatcaaggcaggtaacgacatagccaactgcctacgcaagaacgggaagaaagtgatccagctgagccggaagaccttcgacacggaataccaaaagacgaagttaaacgactgggacttcgtggtaacgaccgacatctccgagatgggcgccaacttcaaggccgaccgcgtgatcgaccctcggcgttgcctaaagcccgttatcctgacagacggccccgagcgcgtcatcctggcagggccgatgccggtgacagccgctagcgccgcccaacgccggggccgagtggggcggaacccccaaaaggaaaatgatcagtacatcttcaccggccagcccctcaacaacgacgaggaccacgcgcactggaccgaggccaagatgctgctcgataacatcaacacccccgaggggatcatcccggccctcttcgagcccgagcgcgagaagagcgcagcgatagacggcgagtaccggctcaagggagagagccgcaagactttcgtcgaactaatgagacgcggtgacctccccgtgtggcttgcacataaggtcgcctccgaggggatcaagtatacggaccggaagtggtgcttcgacgggcaacgcaacaaccagattctggaggaaaacatggacgtggagatctggaccaaggagggcgagaaaaaaaaactccggccgcgctggctggacgcccgcacttacagcgacccactggctctcaaggagttcaaggacttcgcggccggccggaagtccatcgccttggaccttgtgacagagataggtcgcgtccccagccacctcgcacaccggacgcgcaacgccttagataacctggtaatgctacacaccagcgagcacggcgggaaggcataccggcatgccgttgaggagctgcccgagaccatggagaccttgctccttctgggtctcatgatcctgctgaccggaggcgccatgctcttcctcatctccgggaaggggatcggtaagaccagcatcggtctgatctgcgttattgccagtagcggcatgctctggatggccgagatcccgctgcagtggattgcgtcagccatcgttctggagtttttcatgatggtgctgttgatccctgagcccgagaagcaacgcacaccccaggataaccagctggcttacgtcgtgatcggcatacttaccctagccgctatcatcgccgccaacgagatgggacttctagagacaaccaagcgggacctgggcatgtcaaaggagccgggggtggtcagccccaccagctatctggatgtggatctccatcccgcctccgcctggaccctatacgcagtcgccacgaccgtaatcacccccatgctgcgacacaccatcgagaactcgacggctaacgtctccctcgccgccatcgcgaaccaagccgtggtcctgatgggcctggataaggggtggccgatcagcaaaatggacctcggcgtgcccttactggccctcggctgctactcacaggtaaaccccctgaccctgacggccgccgtcctcctcctgatcacccattatgcgatcatcggcccgggcctacaagccaaggccactcgagaagcccagaaacgcaccgccgctgggatcatgaagaacccgaccgtggacggcatcatgaccattgacctagatcccgtaatatacgacagcaagttcgagaagcagctgggccaggtcatgctcctggttctgtgcgcggtgcagctcctactgatgcggacgtcctgggcgctctgtgaggccctgaccctggcgaccggtcccataaccactctgtgggaaggcagccctgggaagttctggaataccaccatcgccgtatccatggcgaacatcttccgcgggagctacctggcaggggcaggcttggcgttctccatcatgaagtccgtggggacgggcaaacggggcactgggagccagggagagaccttgggcgaaaaatggaagaagaagctgaatcaactatcccgcaaggagttcgacctctataagaagagcggcatcaccgaagtggaccgcaccgaggccaaggagggcctgaagcgcggtgagataacccatcatgccgtctcccggggaagcgccaagctgcagtggttcgtggagcgcaatatggtgatccctgaagggcgagttatcgacctcgggtgcgggagaggcgggtggtcctactactgtgccggcctgaagaaggtgacagaggtgcggggctacaccaagggcgggcccggtcacgaggaacccgttcccatgagtacttacggctggaatatcgtcaagctaatgagcggtaaagacgttttctacctcccgccggaaaaatgtgacacattgctctgcgatatcggtgagagcagtcccagccccacagtcgaggagtcccgtacaatccgcgtgctgaagatggtggagccatggctcaagaacaaccaattctgcataaaggtcttaaacccctacatgccaacggtgatcgagcacttagagcgcctacagaggaaacatggcgggatgctggtacggaaccctctgagcaggaactccacacacgagatgtactggataagcaacggcaccgggaacatcgttgcgtccgtgaatatggtgtcgcggttactgctgaaccgcttcaccatgacccaccggcgcccgaccatcgagaaggacgttgacctaggcgccggcacgagacatgttaacgccgagcccgagacccccaacatggacgtcatcggggagcgcataaagcggatcaaggaggagcacaattccacctggcactacgatgacgagaacccgtacaagacctgggcctaccacggtagctacgaggtcaaagccacaggctccgcgagcagcatgatcaatggcgtggtcaagctgctaacaaagccctgggacgtggtgcccatggtcacccagatggccatgaccgacacgactcccttcgggcagcagcgcgtcttcaaggagaaggttgatacccgaaccccgaggtccatgccgggcacgcggcgcgttatgggcattaccgctgagtggctctggcgaaccctgggacgaaacaaaaagccccgactatgcactcgcgaggagttcactaagaaggtgcggaccaacgccgcgatgggcgccgtgttcaccgaggagaaccagtgggacagcgctaaagctgccgtcgaggacgaggacttctggaagctcgtggaccgggagcgcgagctgcacaagctagggaaatgcggctcgtgtgtgtataacatgatggggaagcgagagaagaaactaggcgagtttggcaaggcgaaagggagccgcgccatttggtacatgtggctgggcgcacggtacttagagttcgaggccctcgggttcctgaacgaggaccactggttctcccgcgagaatagctactccggcgtggagggagaaggcctccataaattaggctacatcttacgggacatcagcaagattcccggcggcgccatgtacgccgatgacaccgcagggtgggatacgcgcatcaccgaggacgatctgcacaatgaagagaaaatcacccagcagatggacccggagcaccggcagttagcgaacgccatcttcaaactgacctaccagaacaaggtggtgaaagtccagagacccactcccaccggtaccgtgatggacatcatctcccggaaggaccagcggggcagcggccaggtgggcacctacgggctgaacaccttcacgaacatggaggcccagctcatccgccagatggagggcgagggagtactgtcgaaggcagaccttgaaaacccgcatctcagcgagaagaagatcacccagtggctggagaccaagggcgtagagcgccttaagcggatggccatctcgggagacgactgtgtggtcaagcctatagacgaccgcttcgccaacgctctcctcgccctgaacgacatggggaaggtgcgaaaggacatcccccagtggcagccctcaaagggctggcacgattggcagcaggtccccttctgctcccatcatttccacgagctcatcatgaaagacggtcgcaagctggtagtgccgtgtcggccgcaggacgagctgattggaagggcgcggatcagccagggggccggctggtcactccgcgagaccgcctgcctgggcaaggcctacgcgcagatgtggagcctgatgtacttccacaggcgggacctccgattagcttccaacgcgatttgctcagcagtgcccgtccactgggtgcccacctcgaggacaacgtggagtatccacgcccatcatcaatggatgaccactgaggacatgctgaccgtctggaaccgcgtatggatcgaagataacccgtggatggaagacaaaacccccgtgaccacgtgggaaaacgtaccctacctcgggaagcgtgaagaccagtggtgcggaagcctgattgggctgacttccagggcgacctgggcccaaaacatccccaccgccattcagcaggttcgcagcctcatcgggaatgaggagttcctggactacatgccgtcgatgaagcgcttccgaaaagaggaggagagcgagggggccatctggtga

SEQ ID NO: 26003 - RNA, 9873 nt, synthetic construct
  misc_feature 1..9873: note = derived and/or modified CDS sequence (opt11) from DENV-3__FJ547083__SS-prME
  source 1..9873: mol_type = other RNA
accagcctctgcttgatgatgatcctgccggcagccctggcgttccatttaacatcacgggacggggagccgcggatgatcgtggggaagaacgagcgcggcaagagcttgctgttcaagaccgccagcgggataaatatgtgcacactcattgccatggatctgggcgagatgtgtgatgacaccgtaacctacaagtgcccacatatcaccgaggtggagcccgaagacatcgactgctggtgcaaccttacctccacctgggtgacgtacggcacgtgcaatcaggctggggaacgacgccgggataagcgctccgtggcactcgccccacacgtgggaatggggttggacacccggacccagacctggatgagcgctgagggggcctggcgccaggtggagaaggtggagacgtgggcgttgcgacacccggggttcaccatcctagcgctgtttttagctcactacataggcacaagcctaacccagaaggtagtgatcttcattctccttatgctcgtcacgcccagcatgaccatgcgctgcgttggggtggggaaccgggacttcgtcgagggcctcagtggtgccacctgggtggacgtggtgctggagcacggtgggtgcgtgaccacgatggccaagaacaaacccaccctcgacatcgagttacagaaaaccgaagctacacagctggcaacgctccgaaagctgtgcatcgaggggaaaatcaccaacatcaccaccgactcccgttgccccacgcagggcgaggccgtgctgccggaggagcaggaccaatcctacgtttgcaaacacacctacgtggatcgcgggtggggaaacgggtgtggcctgttcgggaagggatccttggtgacctgcgccaaattccagtgtctggagcccatcgagggcaaggtcgtgcagtacgagaacttgaagtacaccgtaatcatcactgttcacaccggggaccagcaccaggttggcaacgagacccagggggtgacggcagagattacgccccaggcatctactaccgaggccatcttgccggagtacggcacccttgggcttgagtgctctccgcggacgggcctggacttcaacgagatgattctgctcacgatgaaaaacaaggcctggatggtgcaccgccagtggttcttcgacctgcccctgccctggacttccggagccaccaccgagacgcccacctggaaccgcaaagaattactggtgacctttaagaacgcccacgccaagaaacaggaagtcgtagtgctggggtcccaggagggcgcgatgcacactgccctcacaggggccactgagatacagaactccggcgggaccagcatattcgcgggacacctgaagtgccgcctgaagatggacaagctcgaactgaaggggatgtcctacgccatgtgcactaatactttcgtcctgaagaaggaggtttcagagacgcagcatgggactatactcatcaaggtggagtataaaggcgaggacgcgccgtgcaaaatccctttcagcacagaagacgggcagggcaaagcccacaatgggcgcctgatcacggctaatcccgtcgtgaccaagaaagaggagcccgtgaacatcgaggcggagccgccctttggcgagtccaatatcgtcataggcataggggacaacgcgttgaaaatcaactggtacaagaaaggcagctccatcggaaagatgttcgaggctaccgcccgaggcgcccggcgcatggccatcctgggcgacacagcgtgggactttggcagcgtgggcggtgtactcaacagcctcggaaagatggtccaccagatttttggttcagcatatacggccctgttttccggcgtgagctgggtgatgaagatcggcataggggtcctcctgacatggatcggtctgaactccaagaacacgtcaatgtccttcagttgtatcgccatcggcatcatcaccctctacctgggcgcagtggtacaagccgacatggggtgcgtcatcaactggaagggaaaggagttgaagtgtggctcagggatcttcgtcacgaacgaggtgcatacctggactgagcagtacaagttccaagccgactctcccaagcggctcgccaccgccatcgccggcgcatgggagaacggggtttgtggcatccggtcaaccactcgtatggagaacctgctgtggaagcagatcgccaacgaactcaattacatcctgtgggagaacaatataaagttaaccgttgtggtcggggatacaattggcgtgctagagcagggtaaacgcacgctgactccccagccgatggaattgaaatacagttggaagacgtgggggaaagccaagatcgtgaccgccgagacgcaaaactctagcttcatcatcgacggacccaacacccctgagtgcccctcggcgtctcgcgcctggaatgtatgggaggtggaggactacgggtttggcgtgttcactactaatatatggctcaaactgcgagaggtctatacgcagctgtgtgatcaccgtctgatgagtgccgccgtaaaggacgagcgggccgtacacgccgatatggggtactggatcgagtcccagaaaaacgggagctggaagctggagaaagcgagtctgatagaggtcaagacgtgcacctggcccaagtctcacacgctttggtccaacggcgtgctagagagcgacatgataatccccaagagcttagccgggcccatcagccaacacaaccatcgcccgggctaccatactcagactgctgggccctggcaccttgggaagctggagctggacttcaattactgcgaggggacgaccgtcgttatcaccgagaactgcggtacgcgggggccctccctccggaccacaaccgtgagcgggaagctgatccatgagtggtgctgccggtcttgcacacttccaccgttgcgctacatgggcgaggacgggtgctggtacggcatggaaatcaggcccatcagtgaaaaggaagagaatatggtaaagagccttgtgagcgcaggttctggtaaagtggataattttacaatgggcgttctgtgtctcgcgatcctgttcgaggaggtcatgcgcgggaaatttggcaagaagcacatgatagccggagtgttcttcacgttcgtgcttctcctttcaggccaaatcacgtggcgagacatggcgcatacgctgatcatgatcggctcaagcgcaagcgacaggatggggatgggcgtcacctacctcgcactgattgcgaccttcaaaatacagcccttccttgctctcggattcttccttcggaagctgacgtcccgcgagaatctcttgctaggcgtcggccttgcgatggcaaccaccctgcaactgcccgaggacatcgaacagatggcgaatggtattgcgttaggcctgatggccctgaagctcatcacccaattcgagacttatcagctttggacggctctgatatctctgacctgctccaacaccatgtttaccctgacagtagcttggcggaccgcgaccctgatcctggccggggtctcactcctaccggtgtgccaatcatcttccatgcggaaaacagattggctgcctatggccgttgccgcgatgggcgtcccacctcttccgcttttcattttcagcctcaaggacacgctgaagcgccgctcctggccgctgaacgagggggtaatggcggtcggcctcgtgagcatcttggcctccagtctgctccgcaacgacgtccccatggcaggccccctggtggccggtggcctactcatcgcctgctacgtgatcaccgggacctcagcggacctgactgtggagaaggccgcggacatcacgtgggaggaggaagcagagcagacaggggttagtcacaacttgatgatcaccgttgacgatgacgggacgatgcgtatcaaggacgatgagaccgagaacattctcacggtgctgctgaagaccgccctcctgatcgtctccggagtcttcccgtacagcatacccgcgaccctgctcgtttggcacacatggcagaaacagacgcagcgctcgggcgtcctatgggacgtccctagcccgccagagactcagaaagcagagctagaagagggcgtgtatcggatcaagcagcagggcatcttcgggaagacccaggtcggcgtgggtgtgcagaaggagggggtcttccacacaatgtggcacgtgacgaggggcgccgtgctcacctacaacgggaagcggcttgagccgaactgggcgtccgtcaagaaggacttaatcagctacggcgggggctggcgcctctcagcgcagtggcaaaagggggaggaggtccaagtgatcgctgtcgagcctggcaagaaccccaaaaacttccagaccatgcctggtaccttccagacaaccaccggcgagatcggcgccatagccctcgacttcaagcctggaaccagcggctcgcccatcatcaaccgggagggtaaggtggtggggctctacggcaatggggtggtgacgaaaaatggcggctacgtctctggtatcgcccagaccaatgcggagccggacggccccaccccagagctcgaggaggaaatgtttaagaagaggaaccttactatcatggacctgcaccccggtagcggcaagacgcggaagtacctgccggccatagttagagaggccatcaagcgcaggctccggaccctgatcctggcacccactcgcgtggtggctgcggaaatggaggaggccctcaaggggctgcccatccgttaccagacgacggccacaaagtccgagcacactggtcgggagatcgtcgacctgatgtgccacgcgaccttcactatgcggctgctgtcacccgtgcgcgtaccgaattacaacctgattatcatggacgaggcccatttcaccgaccctgcgagtatcgccgcccgagggtacatcagtacgcgcgtagggatgggcgaggccgcggccatcttcatgacggccacaccgcccgggaccgccgatgccttccctcagtccaacgcccccatacaggacgaggagcgcgacatccccgaacggtcgtggaactctggcaatgagtggatcacggactttgccgggaagaccgtttggttcgtccccagcataaaggctggcaacgacatcgccaactgcctacgcaagaacgggaagaaggtcatccagctgtccagaaagacgttcgacaccgagtaccagaagaccaagctgaacgactgggacttcgtcgtgacaacagacatcagcgaaatgggcgcaaacttcaaggcagaccgagttatcgacccgcgtcgctgcctcaagcccgtgatcttgactgatggcccggaacgtgtgatcctcgccgggcccatgccggtcaccgcggcctccgccgctcaacgccgcggtcgagtcgggcggaatcctcagaaggagaacgaccagtatatcttcacaggccagcctctcaacaatgacgaagaccacgcacattggaccgaggccaaaatgctgctggacaacatcaacacccccgagggcataattccggcactcttcgagcctgagcgggagaaatctgctgctattgacggcgagtacaggctgaaaggcgagtcccgcaaaacattcgtcgagttgatgcggcgcggggacctacccgtctggctggcgcacaaagttgccagcgagggcataaaatacacagatcggaaatggtgtttcgacggacagcgcaacaaccagattttggaggagaacatggacgtagagatttggaccaaggagggtgaaaagaagaaacttcggccccggtggctggacgccagaacgtattcggacccgttggcgttaaaggagttcaaagatttcgcggccggccgcaagagtatagccctggatctggtgaccgagatcgggcgcgtgcccagccacctcgcccaccggacccgcaacgccctggacaacctggtcatgctccacacctccgagcacggcgggcgggcctacagacacgcagtggaggagctgcccgagacgatggagaccctgctcctgctgggcctcatgatccttctgaccgggggcgctatgttattcctgataagcggcaagggaatcggcaagacctccatcgggttgatctgcgtcatcgccagcagcgggatgctctggatggcggagatcccgctgcagtggatcgctagcgccatcgtactggagtttttcatgatggtgctcctaatccccgagccagaaaagcagcggactccccaggacaatcagcttgcttacgtggtcatcggaatcttaaccctggccgcgatcatcgccgctaatgaaatgggcctgctcgagacaaccaagcgcgacctgggcatgtccaaagaaccaggagtggtgtctccgacgtcctacctggacgtcgacctccaccccgccagtgcgtggaccctgtacgcggtggccacaacagtgattacgccgatgttacgtcacaccatcgaaaattctaccgccaacgtcagcctcgccgcgatcgccaatcaggccgtggtgctgatggggctggacaagggctggccgatatccaagatggacctcggcgtccccctgctggccctcggttgctacagtcaggtcaaccccctgacgctgacggctgcggtactcctgctgatcacccactacgccatcatcggccccgggctacaggccaaggccacccgcgaggcccaaaaacggaccgcggccgggatcatgaagaacccgaccgtcgatggcatcatgaccattgacctggaccccgtcatttacgactccaaatttgaaaagcaattgggccaggtaatgctgctagtcctgtgcgcggtgcagctcttgctgatgcgcaccagctgggccttatgtgaggcgctgaccctcgccacgggccccatcaccactctctgggagggctcccctgggaagttctggaacaccacaatcgccgtaagcatggccaatatctttcggggctcatatctggccggggcaggcctggctttcagcatcatgaagtccgtcggtaccgggaagcgcggcaccgggtcccagggcgaaacactcggggagaaatggaagaagaaacttaaccagctcagcagaaaagagtttgacctctacaaaaagtccggtattaccgaggtggacaggacggaggccaaggaggggctgaaacgtggcgaaatcacccatcacgctgtcagccgaggctccgccaagctgcagtggtttgtcgagcgtaatatggttataccggaggggcgcgtcatcgacctcggctgcggtcggggagggtggagctactactgcgcgggcctcaagaaggtcaccgaggtacgcggctacacaaagggcggaccaggacacgaggagcccgtgcccatgagtacttacggctggaacattgtcaagttaatgagcggcaaagacgtcttttatctacctcccgagaagtgcgacacgctgctgtgcgacatcggcgagtccagcccctcccctaccgtggaggaaagcagaacgatccgggtcttaaaaatggtcgagccatggctcaagaataaccagttctgtatcaaagtgctgaacccctatatgcctacggtcatcgaacacctcgagcggttgcaaagaaagcatggagggatgttggtccggaaccccctgtcccgaaactccacgcacgagatgtactggatctccaacggaaccgggaacatcgtcgccagcgtcaacatggtgagccgcctcctgctaaaccggtttaccatgacgcaccgccggcccaccatagagaaggacgtagacctcggcgccggcacccgccacgtcaacgccgagcccgagacccccaacatggacgtgattggcgaacggatcaaacgcattaaggaggaacataacagcacgtggcattacgacgacgaaaacccgtacaagacttgggcctaccacggttcctacgaggtgaaggcgaccgggtctgcaagcagtatgatcaacggcgttgtgaagctgctgaccaagccctgggatgtcgtacctatggtaacgcagatggccatgacagataccaccccattcgggcagcaacgtgtcttcaaagagaaggttgacacgcgcacaccgcgtagcatgcctggcaccagacgggtcatgggcatcaccgccgaatggctctggcgcaccctcgggcgaaacaagaagccccgcttgtgcaccagagaggagttcaccaagaaagtccggaccaacgcggccatgggtgccgtgtttacggaggagaaccagtgggacagcgccaaggccgcggtcgaggacgaggacttctggaaactcgtcgaccgggaaagagagctgcacaagttagggaagtgcggcagctgcgtgtacaacatgatggggaaacgcgagaagaaacttggtgagtttggcaaagccaaggggtccagagctatctggtatatgtggctgggcgcccggtacctggagtttgaggccttggggttcctaaacgaggaccactggttcagccgggaaaattcgtacagcggagtggagggggaagggctgcacaaactcggctacatacttcgcgacatctccaagatcccgggcggtgcgatgtacgccgacgacaccgccggttgggacacacggattaccgaggacgacttacacaatgaggagaaaattacgcaacaaatggacccggagcataggcagcttgccaatgcaattttcaagctgacctatcaaaacaaggtcgtgaaagttcagcggcctaccccaaccggcactgtcatggacatcatctctcgaaaggaccagcggggctccggccaggttggcacatatggcctgaacacctttacaaacatggaggcgcagctgatcaggcaaatggagggcgaaggagtgctcagcaaagccgacttggagaacccccatctcccggagaagaagattacccagtggctggaaacgaagggcgtcgagcggctgaagcgcatggccatctcaggcgacgactgcgtggtgaagccaatagacgaccggttcgccaacgccctcctggcactgaacgacatgggcaaggtgcgcaaggacattcctcagtggcagccctcaaagggctggcacgactggcaacaggtccccttttgctctcatcacttccatgagctaattatgaaggatgggaggaagctggtggtcccctgccgcccccaagacgagctgatcggtcgtgcccggatcagccagggggcaggctggtccctccgtgagactgcgtgcctgggcaaggcgtacgcacaaatgtggagcctgatgtacttccaccgccgcgacctccgcctggcctcgaacgccatctgtagcgctgtccccgtgcactgggtaccgacaagccgtacaacctggtctatccacgcgcaccaccagtggatgaccaccgaggacatgctgaccgtgtggaatagagtctggatcgaggacaacccctggatggaagataagacgcccgtcactacttgggagaacgtgccatacttggggaagcgggaagaccagtggtgcggcagcctcatagggctgacatcccgggcgacgtgggcccagaacatcccgactgccatccagcaggttcgctctctcatcggcaatgaggagttcctggattacatgccgtccatgaagcggtttcgcaaggaggaagaatccgagggggcaatctggtag

SEQ ID NO: 26004 - RNA, 9873 nt, synthetic construct
  misc_feature 1..9873: note = derived and/or modified CDS sequence (opt11) from DENV-3__FJ547084__SS-prME
  source 1..9873: mol_type = other RNA
actagcttgtgtctaatgatgatcctgccagccgcgctagcatttcacctaacatcgagagatggcgaaccacgaatgatagtaggcaaaaacgaaaggggcaagagcttgctattcaagacagcctcaggtataaacatgtgcacactaatagccatggatcttggcgaaatgtgcgacgacacagtaacatacaagtgcccacacattacagaggtggaacccgaagacatcgactgctggtgcaacctcacaagcacttgggtaacatacggcacgtgcaaccaggccggagaacatcgcagagataaacggtccgtcgccctagccccgcatgtcggaatgggactagacacacgcacccagacatggatgagcgcggagggcgcatggcggcaagtggaaaaagtagaaacgtgggcactccgacacccgggtttcacgattttagccttgttccttgcgcactacattgggacgtctctcacccagaaggttgtaatcttcatactattgatgttagtaactcctagcatgaccatgcgttgcgtaggcgtcggcaaccgagacttcgtagaaggtctgagcggagcaacgtgggttgacgtcgttctagagcacggcggatgcgtgacaacgatggccaaaaacaaacctacacttgacatagaacttcaaaagacagaagccacgcagcttgccactctacgaaaactatgcatagaaggtaaaataacaaacatcaccaccgacagtaggtgcccaacacagggcgaggcagtcttgccagaagaacaggaccagaattacgtgtgcaaacacacatatgtagaccgaggatggggcaacggttgcggcctattcggcaagggctccctagtcacatgcgcaaaattccaatgtctagaacccatagaagggaaagtagttcaatatgagaaccttaaatacacagtaataataacggtacacaccggagaccaacaccaagtaggcaacgaaacacaaggagtaacagctgagatcactcctcaggcgtcgactacggaggccatactccctgaatatggaacccttggactcgaatgcagcccacgaacaggactagacttcaacgaaatgatcctactaaccatgaaaaataaagcgtggatggtccatagacaatggttctttgacttgccactcccgtggacaagcggagccactacagagacaccaacgtggaacaggaaagagctcttagttacgttcaaaaacgcacacgccaaaaagcaggaggtagtggtactcgggagtcaggaaggggcgatgcataccgcgctgacaggcgcaaccgaaatccagaatagcgggggcacttcaatatttgcgggacacctaaaatgcaggcttaaaatggacaagctagagctgaaaggcatgagttacgccatgtgcactaataccttcgtactaaagaaagaagtatcggaaacacagcatgggacaattcttatcaaagtggaatacaagggagaagacgtcccatgtaagatacccttcagcacagaggacggacagggtaaggcacacaacgggcggttaataacggccaacccggtcgtgaccaagaaagaagaacccgtaaacatagaagcagaaccacccttcggggaatcaaacatcgtaattggaatcggcgacaacgcgttgaagataaactggtacaaacgcggaagcagtatcggcaaaatgttcgaggccacagctagaggcgctcggcgaatggccatcctgggagacactgcatgggactttggctccgtcggcggggtcctgaactccctcggcaaaatggtccaccaaatcttcggctcagcgtacacggcgctgttcagcggcgtaagctgggtcatgaagataggcatcggggtgttactgacgtggatagggctcaacagcaagaacactagcatgtccttctcatgcatagcaatagggataataacattatacctcggagcagtagtgcaagccgacatgggctgtgtgatcaattggaaaggaaaggaactaaagtgcggctcgggcatcttcgttacaaacgaagtacatacctggacggaacaatataaattccaggcagactcacccaaacgactcgcaacagccatagcaggcgcatgggaaaacggagtgtgtggcattcggtcgaccacccgaatggagaatctgctatggaaacaaatagcaaacgaactaaactatatcctttgggaaaacaatatcaaactcactgtggttgtaggggacacgataggagtcttagagcaggggaagaggaccctgacaccgcaacctatggagctcaagtatagttggaaaacatggggcaaagcaaaaatcgtgaccgcggagacgcaaaattcttcgttcatcattgacggcccaaacacccccgagtgcccttccgctagcagggcatggaacgtgtgggaggtggaagactacggcttcggcgtattcacaaccaacatatggctgaaattgagggaagtctacacccaactgtgtgaccaccgcctaatgagcgcagcagtcaaagacgagagagcagtacacgcggatatgggatactggatcgagagtcaaaagaatggtagctggaagctcgaaaaggcgagcctaattgaagtgaaaacatgcacgtggcctaaatcccacacgctatggagcaacggtgtgctagaaagcgacatgataataccgaagtctctcgctggtcccatcagccagcataactaccgacccggatatcacacacagaccgcggggccctggcacctcggcaaattagaattggacttcaactactgtgaggggacaaccgtcgttataacggagaactgtgggactcgtggcccttcgctacgcacgactaccgtctccgggaaattgatacacgagtggtgttgcaggtcgtgcactctcccacctcttcggtacatgggggaggacggctgctggtatggcatggagattcgcccgatctcagagaaggaagagaacatggtaaaaagtttagtgagcgcaggctccgggaaggttgacaacttcacaatgggggttctatgcctagccatactattcgaagaagtcatgcgaggaaagttcgggaagaaacatatgatcgtaggtgtctttttcaccttcgtattactactctccggacaaatcacctggagagacatggcgcacacgcttatcatgataggcagcaatgcatcggatcgtatgggtatgggagtcacatatctcgcactaatagcgacgttcaaaatacagcccttcctagctctaggtttcttcctacgtaaactgacgtcgcgcgaaaacctgctcctcggggtaggattggcgatggcaacgaccctgcaattgccggaagacatcgagcagatggcaaatggaatcgctctcggactcatggcgttgaaactcacaacccaatttgaaacttatcagctctggaccgcccttataagcctaacctgcagtaacaccatcttcaccttaacagtggcctggcggacggctacactaattctcgcgggggtgtcattactaccggtctgtcaaagttccagcatgagaaaaacggattggctccctatgaccgtggcggcgatgggagtcccgcccctaccacttttcatattttccctcaaagacaccctaaaaagacgttcctggcccctaaacgaaggagttatggcggtggggctcgtgagcatccttgcaagctccctactacgtaacgatgtaccaatggccggacctctggtagctggaggactgctcatagcgtgctacgtaataacaggcacaagcgcggacctaaccgtcgaaaaagcagcagatgtcacctgggaggaagaggccgaacagaccggcgtttcacacaacctaatgatcaccgtcgacgacgacggaacgatgcgcataaaggacgacgaaacagaaaacatactaaccgtactcctcaagacagcgcttcttatagtcagcggaatctttccttacagcataccggccaccctgctcgtatggcacacgtggcaaaagcaaacgcaaaggagcggggtcctctgggatgtaccgtcaccaccggaaacgcagaaagcagagctcgaagaaggggtataccgaatcaaacagcagggtatattcggtaaaacacaagttggcgtcggcgtacagaaagaaggagttttccacacgatgtggcacgtgacacggggtgcagtactaacctacaacgggaagcgactagaaccgaactgggcgagcgtgaaaaaggacctcatttcctacggaggtgggtggcggctctcagcacagtggcaaaagggggaggaggtacaggtcattgcggttgaacccggcaaaaaccccaaaaacttccagactatgccagggaccttccaaacgaccacgggagagatcggtgcaatagccctggacttcaaacccgggacaagcggcagtccgataataaacagagaagggaaagtcgtggggctgtacgggaatggagtcgtcactaaaaacggcggctacgtgtccggtatagcgcagactaacgcggaaccagacgggccaactcccgagctcgaagaagagatgtttaaaaagaggaacttgactataatggacttacaccctggtagcggtaaaaccaggaagtaccttcccgcaatcgtgcgcgaagcgataaagcgacggctccggaccctaatacttgcacccacccgagtcgtcgctgctgaaatggaagaggccttgaaggggctccctattaggtaccagacaactgctacaaaatctgaacacacagggcgcgaaatcgtagacctcatgtgccacgccactttcacaatgcgcttattaagccctgtacgtgtcccaaattacaatctaatcatcatggacgaagcccacttcaccgaccccgcttcgatcgccgccagaggatacataagtacgcgcgtaggaatgggcgaggcagctgcaatcttcatgaccgcaacaccacctgggacagccgacgctttcccacagtccaatgccccgatccaagacgaggaacgagatataccagagcgttcctggaactccggcaatgaatggatcacagatttcgcgggaaaaacagtatggttcgttccgagcataaaagcaggtaatgacatcgccaattgcctccgaaagaacggcaaaaaggtaattcaactgtcaaggaaaaccttcgacacagaataccaaaagaccaaacttaacgattgggatttcgtggtgacaaccgacatctcagaaatgggagccaacttcaaagcagaccgagtaatcgacccgagacgctgccttaagccagtgatactaacggacggtccagaacgcgtaatacttgccgggccgatgcccgtgactgccgcgtcggcggcgcagcgacggggccgggtaggccgcaacccccaaaaagaaaatgaccaatacatcttcacaggccaacccctaaacaacgacgaggaccacgcccactggacagaagccaaaatgctgctagacaacatcaacacacctgagggcataattcccgcactatttgagccagaacgagagaaaagcgcagcaatagacggagaatacaggctaaaaggtgagtcacgaaaaacatttgtcgaactcatgcgtaggggtgacctcccagtctggctcgcccataaggtagcctctgaaggaataaaatacaccgatcggaagtggtgcttcgacggccaacgtaacaatcaaatactggaggaaaatatggacgtagaaatttggacgaaagaaggagagaagaagaaactacgaccccgctggctggacgcgcgaacgtacagcgacccactcgccctaaaagagttcaaggatttcgcggcgggccgcaagtctatcgccctagacctagtcacagagatagggcgggttcccagccacctggcccatcgaacgcgaaacgcactggataatctggtaatgctgcacacgtcagagcacggagggaaggcataccgccacgcggtagaggagctaccggagacgatggagaccctactcctgctcggtcttatgatattactcaccggcggggccatgctttttctaatatcagggaaaggcataggaaaaacgagtatcggtctaatttgcgtcatagcaagcagcggcatgctgtggatggctgaaatcccacttcaatggatcgcttctgctatcgtattggagttcttcatgatggtgctgctcattccagagcctgaaaagcaaagaacaccccaggacaaccaactagcatatgtggtaataggtatcctgacgctcgctgcaattatagcagccaacgaaatgggacttctagaaacgaccaaaagagatcttggtatgtccaaggagccgggcgtagttagcccaaccagctacctcgatgtggacctacaccccgcaagtgcgtggaccctctatgcggtcgcaacaacggtcattacacctatgcttcgccacacaatcgaaaactccactgccaacgtgtcactagccgcaatcgcaaatcaagcggttgtcttgatgggattagacaaaggatggcctataagcaaaatggacctcggcgtcccgcttttagccctcggatgctactcccaagtaaatccccttactctaacggcggccgtgctactattaattacccattacgcaattattggcccaggattacaggcaaaagcaacgcgcgaagctcaaaagaggacggcagcaggcataatgaaaaacccgacagtggacggaataatgacaatcgaccttgacccagtcatctacgacagcaaattcgaaaaacaactaggtcaagtcatgctcctagttttgtgcgccgtccagcttctgctaatgaggaccagttgggctctgtgcgaagcactcaccttagcaacaggtcccatcacaactctatgggaaggctcacccggaaaattctggaacacgacaatagcagtgagcatggccaatatattccgtggatcctatcttgccggagccggactagccttctcaataatgaaaagcgtaggcacggggaagcgcggcactggttctcaaggtgaaacattgggtgagaaatggaaaaagaaactgaatcaactaagtagaaaggagttcgacctctacaagaaaagtggcatcaccgaagtcgaccgcaccgaagccaaagaggggctaaaacgaggcgaaataactcaccatgcggtttcccgagggagcgccaagctgcaatggttcgtcgaaagaaacatggtgatcccggaaggccgcgtgatcgacctcggatgcgggcggggcgggtggtcatattactgtgcagggctaaagaaagtaacagaagttagagggtataccaaagggggaccaggccacgaagaacccgtgcccatgtcaacctacggctggaacatagtcaaactcatgtcgggaaaagacgtgttctacctaccgccggaaaaatgcgacacactcttgtgcgacatcggggagtcttcaccctcccccacagtcgaagagtcacgcacaattagggttctgaaaatggttgaaccatggctcaagaacaaccaattctgcatcaaagttctcaacccttacatgccgacggtgatcgaacatctagagcggctccaacgaaaacatgggggcatgctcgtccgaaaccccctgagtcgaaactctactcatgaaatgtactggatcagcaacggcactggtaacatcgtagccagcgtgaacatggtaagccgcctactcttgaatcgattcacgatgacgcaccgaagaccgacaatcgaaaaagacgttgacctcggagcaggcacgaggcacgtaaacgccgagcctgagacaccgaacatggatgtgataggcgagcgaatcaaacgaataaaggaagaacacaacagcacatggcattacgatgatgaaaacccatacaaaacatgggcataccatggatcctatgaagtcaaagcgacaggctctgctagtagcatgataaatggcgtcgtaaaactacttacaaagccctgggacgtcgtacctatggtaacacagatggcaatgaccgacacgacgccattcggccagcaacgagtattcaaagaaaaagtcgacacaagaaccccaaggagcatgcccggtacacggcgcgtgatgggaatcacagccgaatggctttggcgcaccctaggccgaaacaagaaacccaggctctgcacgcgagaagagttcaccaagaaagtacgcacaaacgctgccatgggcgccgtgtttactgaagaaaaccaatgggatagcgcaaaagccgccgtagaggacgaggacttctggaagctagtcgaccgggagcgcgaactgcataagctcgggaagtgcggttcatgcgtgtacaacatgatgggcaaacgcgagaagaaactgggggagttcggaaaagcaaaaggatcaagagccatatggtatatgtggctaggcgcgcgatacctggagttcgaagcgttaggcttcctgaacgaggatcactggttctcacgagaaaattcgtattcaggagttgagggcgaaggactccacaaactcggctacatactccgggacataagcaagattccaggaggggcaatgtacgcggacgataccgcaggttgggacacacgcataaccgaagacgacctgcacaacgaggagaagataacacaacaaatggacccggagcaccgtcaacttgctaacgcaatatttaagctcacgtatcaaaataaggtagtaaaggtacagcgacccaccccgactggcacagtgatggacattatcagtcgaaaggaccaaaggggttcaggccaagtaggtacatacgggttaaacacatttacgaatatggaagcacaactaattcggcagatggaaggtgaaggagtgctatcaaaagccgacctcgagaatccacacttacccgaaaagaaaatcacccagtggctagaaacaaaaggtgttgaacgcctgaaacgcatggccatatcgggagacgactgcgtagtcaagcccatagacgaccgctttgcgaacgcgctgctagcactcaacgacatgggaaaagtacgtaaagacatacctcagtggcaaccaagcaaagggtggcacgactggcaacaagtcccattttgctcacaccacttccacgagctcataatgaaagacggacgcaagctagtagtcccatgtcggcctcaggacgagctgatcggccgagccagaatctcgcaaggggcgggttggtccttgagagagaccgcctgcctcgggaaagcatacgcgcaaatgtggagcctgatgtacttccaccgcagagacctcagactggcgtcgaacgccatatgctcagcggttccggtacattgggttccgactagccgaacgacgtggagcatacacgcacaccaccagtggatgaccacggaggacatgctaacagtgtggaatcgagtctggattgaagacaacccctggatggaagacaaaacccccgtcacaacatgggaaaacgtcccgtatctgggaaaaagggaggaccaatggtgcgggtcccttataggactcacgagtcgggcgacttgggcccaaaacatcccgactgcgattcaacaggttcgatctctgatcggaaacgaagagttcctggactacatgccctcgatgaaacggttcagaaaggaggaagaatcagagggagccatatggtaa

SEQ ID NO: 26005 - RNA, 9873 nt, synthetic construct
  misc_feature 1..9873: note = derived and/or modified CDS sequence (opt11) from DENV-3__FJ478456__SS-prME
  source 1..9873: mol_type = other RNA
accagcctctgcctcatgatgatcctaccggccgccctggccttccacttgaccagcagagacggggagccccgaatgatcgtggggaagaacgagaggggcaagagcttactgtttaagaccgcgagcgggatcaacatgtgcaccctcatcgccatggacctaggcgagatgtgcgacgacaccgttacatacaagtgcccccacatcgccgaggttgagcctgaagacatagattgctggtgtaacctgaccagcacctgggtgacctacgggacctgcaaccaggccggcgagcacagacgcgataagaggtcggttgcactcgcgccccacgtgggcatgggtcttgacacgcgcacccagacctggatgagcgccgagggcgcctggcgccaggtggagaaggtcgagacctgggcgctgcgccacccggggttcacgatcctcgccctcttcctggcccattacatcggcacctccctcactcaaaaggtggtgatcttcatccttctgatgttagttacccccagcatgaccatgcggtgcgtgggggtgggtaacagggactttgtcgaaggcctgtccggggccacctgggtcgacgtggtcctggagcatggcgggtgcgtgacgaccatggccaagaacaagcccacgttggacatagagctgcagaagaccgaggccacacagctggccacgctcaggaagctgtgcatcgagggcaagatcacgaacataacaaccgacagccgctgtcccacccagggagaggcggtgctgccggaggagcaggaccaaaattacgtctgcaagcacacgtacgtggatcgggggtggggcaatggttgcggcctcttcgggaaaggctccctggtgacctgtgcgaaattccagtgcttggagcccatcgagggcaaggtggtgcagtacgagaacctcaagtacaccgtaatcatcactgtccatacgggggaccaacaccaggttggcaacgagactcagggtgtcaccgccgagatcactcctcaggccagtacgaccgaggccatcctgcccgaatacggcaccctggggctcgagtgcagcccccgcactggattggacttcaacgagatgatcttattgaccatgaagaacaaggcgtggatggtgcatcggcagtggttcttcgacctgccactgccctggacgtccggcgccaccaccgagacccccacgtggaacagaaaggagctcctggtgactttcaaaaacgctcacgcgaagaagcaggaggtggtggtgctggggtcccaggagggggccatgcacaccgcgctcactggggccacggagatacagaacagcggcgggacctcgatcttcgccggtcacctgaagtgccgtctgaagatggacaagctcgagttaaagggtatgtcctacgcgatgtgcaccaacaccttcgtacttaagaaggaggtgtccgaaacgcagcacgggaccatcctcatcaaggtggagtacaagggcgaggacgtgccttgtaaaatccccttcagcacggaggacggtcagggtaaggcccacaacggccgcttaatcaccgccaaccccgtggtcacgaagaaagaggagcccgtcaacatagaagccgagccgcccttcggggaaagcaacatcgtgatcggcatcggggataacgctctaaagattaactggtacaagaagggaagctcaatcggtaagatgttcgaggccaccgccaggggtgctagaagaatggccatcctgggggacaccgcatgggacttcgggtccgtgggtggggtccttaatagcctgggcaagatggtccaccagatcttcgggtccgcctacaccgctctgttcagcggtgtgagttgggtcatgaagatcggcatcggagtgctcctgacgtggattggcctgaacagcaagaatacctccatgtcgttttcctgtatcgcaatcgggattattaccctctacctcggcgccgtggtccaggcggacaccgggtgcgtgatcaactggaagggcaaggagctgaagtgcggcagcgggatcttcgtgacgaatgaggtccacacctggaccgagcagtataaatttcaagccgactcccccaagcgcctcgccaccgccatcgccggtgcgtgggaaaacggggtgtgcggcatacgcagcacgacccggatggagaacctgctgtggaagcagatcgccaatgagctcaattacattctgtgggagaacaacatcaagctgacggtggtcgtgggagacatcatcggcgtcctcgagcagggcaagcgcaccctaacgccccagccgatggagctgaagtactcctggaagacctgggggaaggccaagatcgtcacagccgagactcagaacagctccttcatcatcgacggacctaacacgcccgagtgccccagcgcgtcccgggcgtggaacgtatgggaggtggaggactacgggtttggcgtctttaccaccaacatatggttgaaactgcgtgaggtttacacccagctatgcgaccatcggctgatgagcgccgcagtgaaggacgagcgcgcggtccacgcggacatgggctactggatcgagagccagaagaatgggtcctggaaactagagaaggccagcctcattgaggtgaagacctgcacgtggccgaagtctcacaccctttggagcaacggcgtgctagagtccgacatgattatccccaagtctctggccggtccaatctcccagcacaattaccggccgggctatcacacccagaccgcgggtccctggcacctaggcaagctggagctggatttcaactactgcgaggggacaacagtcgtgatcacagagaattgcgggacccgtggcccttcactccggactaccactgtgtccgggaagctgatacatgaatggtgctgccggagctgcaccctgcccccgcttaggtacatgggcgaggatgggtgctggtacggcatggagatccgccccatatccgagaaggaggagaatatggtcaagagcctggtttccgccggctccgggaaggtggacaacttcacgatgggcgtcctgtgcctcgcgatcttattcgaggaggtgatgcgggggaagttcggcaagaagcacatgatcgccggggtatttttcacattcgtcctgttgctgtccggccagattacatggcgtgatatggcgcataccctgatcatgatcggctctaacgcctccgaccggatgggtatgggcgtgacgtacctcgccctgatcgcgaccttcaagatccagcccttcctggccttgggattcttcctgagaaagctaaccagccgcgaaaacctccttctgggcgtgggcctcgccatggccacaacgctgcagctgcccgaggacatagagcagatggcgaacgggatcgccctcggcttgatggctctgaagctcattacccagttcgagacctaccaactgtggacagccctgataagcctaacgtgctccaacaccatattcactttaaccgtcgcctggcgcactgcgacattgatcctcgccggtgtgagcattctgccggtctgccagagtagcagcatgcggaaatccgattggctgccaatgaccgtggccgccatgggcgtgcctccccttccgttatttatcttctcccttaaagataccctcaagcgtcggtcatggcccctgaatgaaggcgttatggcggtgggtctggtgtccatattggcgagctccctgctgcggaacgacgtacccatggccggtcctctagtggctggagggctgttaatcgcgtgttacgtgatcacgggcacgagcgccgacttaaccgtcgagaaggcagcggatgttacttgggaggaggaggccgagcagacgggcgtgtcccacaacctgatgatcaccgtcgacgacgacgggacaatgcgcatcaaggacgacgagacagagaacatcctgaccgtactcctaaagacggccttacttatcgttagcggcattttcccgtacagcatccccgccacactgctggtctggcacacctggcagaagcaaacgcgtcgctcaggcgtgctctgggacgtgcccagcccacccgagacgcagaaggcggagctggaggaaggggtctaccggattaagcagcaaggcatcttcggaaagacgcaggtcggcgtgggggtccagaaggagggggtgtttcataccatgtggcacgtgacccgcggagcagtcttaacttacaacggaaaacggcttgaacccaactgggcctcggtaaagaaagacctgatctcctacggcggaggctggcgcctgagcgcccagtggcagaaaggggaagaggtacaggtcatcgcggtggaacctgggaagaaccccaagaacttccaaactatgcccggaaccttccagaccacgaccggggagattggcgccatcgccctcgactttaagcccgggaccagcggctcgcccatcatcaacagggaggggaaggtggtcgggctctacggcaacggggtggtgaccaagaacggagggtatgtcagcggcatcgcccagacgaacgcagagccggacggccccacccccgagctggaggaagaaatgtttaagaagagaaacctgacaatcatggacctccaccccggatccggcaagacccggaagtacctaccggccatcgtgcgtgaagccattaagcggcgtttgcggacgctcatcctggcccccacccgcgtggtcgccgccgagatggaggaggcgctgaaggggctccccatccggtatcagaccaccgcaaccaagagcgagcataccggccgcgagatcgtggacctgatgtgccatgccaccttcaccatgcggctcctttcccccgtgcgagtcccgaactacaacctgatcataatggacgaggcccacttcacagatcccgccagcatcgcggcccgggggtatatctccaccagggtgggaatgggtgaggccgccgcgatcttcatgaccgccacaccacccgggacagccgacgccttcccgcagtcgaacgcccccatacaagacgaggagcgagacatcccggagcggtcctggaacagcggtaacgagtggatcaccgacttcgcggggaaaacagtgtggttcgtcccctccatcaaggccggtaacgatattgccaactgcctgcgcaagaacgggaagaaggtgatccaactctctaggaagaccttcgacaccgaatatcagaagaccaaactgaacgactgggacttcgtggtcaccaccgatatctccgagatgggcgccaacttcaaggccgaccgcgttatcgacccgcggcgctgcttaaagcccgtgatcctcactgacggccccgagcgggtcatcctcgccgggcccatgccggtgaccgcagccagcgcagcacaacgccggggccgcgtggggagaaatccccagaaggagaacgaccagtatatattcaccggccagccacttaacaacgacgaggaccatgcgcactggaccgaggccaagatgcttctggacaacattaacacgcctgagggcatcataccggccctttttgagcccgagagagagaaatccgccgcgatcgacggcgagtaccgcttgaaaggcgaaagccgcaagacattcgtcgaactaatgcgtcgcggggacctgcccgtgtggctggcacacaaagttgcgagtgagggcatcaagtataccgatcggaagtggtgcttcgacgggcagcgcaacaaccaaatcctggaggaaaatatggacgtggaaatctggaccaaggagggtgagaaaaagaagctgcgaccccggtggctagacgctcggacatatagtgacccactggcattgaaggagttcaaggacttcgcagccggtagaaagtccatcgccctcgacctggtgacggagatcggccgcgtccccagccacctcgcacaccgaacccgcaatgccctcgacaacctggttatgctgcacacctcagagcacggcgggaaggcctaccgacacgctgtggaggaattgcctgaaaccatggagactctgttgttgctcggcttgatgatcctccttaccggaggggccatgcttttcctcatctccggcaaagggataggcaagacgagcatcgggctgatctgcgtcatcgcctcctccggcatgctgtggatggccgaaatccctctccagtggatcgcgtccgccatcgtactggagttcttcatgatggtgctgctcatccccgagcccgagaagcagcggacgccgcaggacaaccaacttgcatacgttgtgatcgggatcctgacgctcgccgccatcatcgcggccaatgagatgggcctgctggagaccacaaagcgcgatctcggcatgagcaaagagccaggggtggtatcacccaccagctatttagacgtggacctccaccccgcctccgcctggacgctctatgctgtggcgaccaccgtgatcaccccgatgctgcgccatacgatcgagaacagcactgcaaacgtgtccctcgcggccatcgcgaaccaggctgtggtactcatgggcctcgacaaggggtggccgattagcaagatggacctgggggtccccctcctggcattaggatgctacagccaggtgaatcctttaaccctgacagcagcggtcctgctcctgatcacgcactacgcgatcatcggacccggcctgcaggccaaggcgacccgggaggcccagaagcgcaccgctgccggtataatgaagaacccgaccgtggacggcataatgactatcgacctcgaccccgtgatttacgacagcaaatttgaaaagcagctggggcaggtcatgctgctcgtcctgtgcgccgtccagctgctcctgatgaggacctcctgggccctgtgcgaggcattgaccctggcgaccggccccatcacgactctgtgggagggaagccccgggaagttctggaacactacaatcgcggtcagcatggccaacatcttccgtggcagctacctcgccggggccggtctggctttttccatcatgaagtccgtggggacggggaagcggggcaccgggagccaaggagagaccctgggagagaagtggaagaagaagctcaatcaactgtcccgcaaggagtttgacctgtacaagaagagtgggatcaccgaggtggaccggaccgaggctaaggaggggcttaagcggggagaaatcacgcatcacgccgtctcccggggctcggccaagctgcagtggttcgtggagcgcaacatggttatcccggaggggcgagtcatagacttgggatgcggccgcggcggatggtcctactactgcgccggcctcaagaaggtcaccgaggtgcggggctatacaaagggcgggcccgggcacgaggagcccgtccccatgtcaacctacggctggaacatcgtaaaactgatgtccgggaaggacgtgttctacctgccgccagagaaatgcgatacactcctgtgcgacataggcgagagctccccctcacccactgtcgaggagtcccgcaccatcagagtgctgaagatggtggagccgtggctgaagaacaaccagttctgtatcaaagtcctcaacccctacatgccgaccgtcatcgagcacctagagcggttacagagaaagcatggtggcatgctcgtgagaaaccccctgagtcgcaactccacgcacgagatgtactggatctcaaacggcaccggtaacatcgtcgcgagcgtgaacatggtaagccggctgctcctgaaccgctttaccatgacccaccggcggccgacgatcgagaaggacgttgacctcggagccggcacccggcatgtgaacgccgagcccgagacccccaacatggacgttatcggtgagcgaatcaagcggatcaaggaggagcacaatagcacatggcactacgacgacgagaacccgtacaagacatgggcgtaccacggcagctacgaggtaaaggctaccgggtccgcgagcagcatgataaacggcgtggtgaagctcctgacaaagccgtgggatgtcgtgcccatggtgacccaaatggccatgacggacacgacgccatttgggcagcagcgagtcttcaaggaaaaggtggacacccggacgccgcgttctatgcccggcacacggcgcgtgatgggcatcaccgccgaatggctgtggcggaccctcgggcgcaacaagaagccccgcctgtgtacgcgcgaggagttcaccaagaaggtgcgcaccaacgccgccatgggcgccgtgtttacggaggaaaaccagtgggattcagctaaggccgcggttgaggacgaggacttctggaagctggtggaccgggaaagggaactgcacaagctgggcaagtgcggcagttgcgtgtacaacatgatggggaagcgggagaagaaactgggtgagttcgggaaggcgaaagggagcagagccatctggtacatgtggctcggcgcccggtacttggaatttgaggcccttgggttcctaaatgaagaccactggttctccagagagaacagctactcaggcgtcgaaggggagggcctgcacaaactgggctacatcctccgggacatcagcaagattcctggcggcgccatgtacgcggacgacacggccgggtgggatacccgcatcacagaagatgacctgcacaacgaggagaagatcacccagcagatggatcccgagcaccgtcagttggccaatgccatcttcaagctcacgtaccagaataaggtggttaaagtgcagcgtccgacgccgaccggcaccgtgatggacatcatctcccggaaggatcagcgtggcagcggccaagtgggcacatacggccttaatacattcaccaacatggaggcccagctcatccggcagatggaaggcgagggggtgctgtccaaggcagatcttgagaatccccacctgtctgagaagaagatcacgcagtggctcgagaccaagggagtcgagcggctcaagcggatggctatctccggagacgactgcgtggtgaaaccgatcgacgaccgatttgccaacgccctgctcgccctgaacgacatggggaaggtccgtaaagacattccccagtggcagcccagcaagggctggcacgactggcaacaggtccccttctgctcccaccattttcacgagctgatcatgaaggacgggcgcaagctcgtcgtaccgtgtcggccccaggacgagttaatcggccgcgcgcggatctctcagggggccggctggtccctgcgcgagacggcctgcctgggcaaagcctacgcacagatgtggagcctgatgtacttccaccgccgggacttgcgcttggcctccaacgccatatgcagcgcagtgcctgttcactgggtgcccacctcacggacgacctggtccatccatgcccaccaccagtggatgacgacggaggacatgcttaccgtatggaatcgcgtctggatcgaggacaacccgtggatggaagacaagacccccgtgactacctgggaaaacgtgccatacttgggtaagcgggaggatcagtggtgtggctcactcattgggcttacctcccgcgcgacctgggcccagaatatcccgacggccatccaacaggtccgaagcctgattggaaacgaggagttcctcgactacatgccgtcgatgaagcgcttccggaaggaggaggagagcgagggcgccatttggtga

SEQ ID NO: 26006 - RNA, 9873 nt, synthetic construct
  misc_feature 1..9873: note = derived and/or modified CDS sequence (opt11) from DENV-3__FJ547085__SS-prME
  source 1..9873: mol_type = other RNA
acctccctctgcctcatgatgattctgccagccgcactggcgttccacctcaccagccgcgacggcgagccgcggatgatcgtggggaagaacgagcggggcaaatcgctgctgttcaaaaccgcctcggggatcaacatgtgcaccctaatcgccatggatctgggagagatgtgcgacgacactgtgacctacaaatgtccccacatcaccgaggtggagcccgaagacatcgactgctggtgcaacttgaccagcacctgggtaacttacgggacatgcaaccaggccggcgagcaccggcgcgacaaacgttccgtagctctcgcgccccacgtgggcatggggctggacaccagaacgcagacctggatgagcgccgagggcgcctggcgccaagtagagaaggtagagacgtgggcgctgcgccacccggggttcaccattctcgcgctatttctggcccactacatcggcacctccctcacccagaaggtcgtgatttttatcctcctgatgttggtcacgcccagcatgaccatgcggtgcgtcggcgtgggcaaccgtgacttcgtcgagggcctgagcggggccacatgggttgacgttgtcctggagcacggcgggtgcgtgaccacgatggcaaagaacaagcccactttagacattgagcttcagaagaccgaagccacccagctggcgacactccggaagctatgcatcgagggcaagatcactaatatcaccaccgatagccgctgccctacgcagggcgaggccgtgctacccgaagagcaggaccagaattacgtctgcaagcatacctacgtggaccgggggtggggcaatgggtgcgggctctttggaaagggctcactagttacctgcgcaaagtttcagtgcttggagcccatcgaaggaaaagtcgtgcagtatgagaacctcaagtatactgtgataatcaccgtccacaccggtgaccagcatcaggtgggcaacgagactcagggggtcaccgccgaaatcacgccccaggcctctaccacggaggctatcctccccgaatacggcactctagggctagaatgctccccgcgcaccggtctggacttcaacgagatgatcttactcaccatgaagaataaggcatggatggtccatcggcagtggttcttcgacttgcctttaccctggactagcggcgccaccaccgagacacccacctggaaccgcaaggaactgttagtgaccttcaagaatgcccacgccaaaaagcaagaggtcgtggtacttgggagtcaagagggcgccatgcataccgctctcacgggggccaccgagatccagaactcgggcggaaccagtatctttgcgggccacctgaagtgccggctgaagatggacaagctagagttgaaaggcatgagctatgccatgtgcaccaacactttcgtccttaaaaaggaggtctccgagacccaacacgggaccatcctcatcaaggtggagtacaaaggagaggacgtcccatgcaagatccccttcagcaccgaggacgggcagggcaaagcgcacaacggccggttaatcacggccaaccccgtggtaaccaagaaagaggagcccgtaaacatagaagccgagccgcccttcggggagagcaacatagtgatcggaatcggggacaacgcactgaagatcaactggtacaagaagggctccagcatcggcaagatgttcgaggccacagctcggggcgcccgccggatggcaattctgggtgacaccgcctgggacttcgggagcgtgggcggtgtactcaactcgctaggcaaaatggtgcaccagatattcggaagtgcatacacggctctcttcagcggcgtcagttgggtgatgaagatcggcatcggggtgctcctgacctggataggtctcaactctaagaacacctccatgagcttctcctgcatcgccatcggcattattacgctctacctgggagccgtggtccaggcagacacggggtgcgtgatcaactggaaggggaaagagctgaaatgcggcagcgggatcttcgtgaccaacgaggtacacacctggaccgagcaatacaaattccaggcggacagccccaagcgcctagccacagcaatcgcaggtgcctgggagaatggggtttgtggcatccgcagcaccacacggatggagaacctgttatggaagcagatcgcgaacgagctcaactacattctatgggagaacaacatcaagctgacagtggtcgtgggggatatcatcggggtcctggagcagggcaagcggacgctaacacctcagccgatggagctgaaatactcgtggaagacttggggaaaggcccgtatcgttacagccgagacgcagaactcgtcctttatcatcgacggacccaacacacccgaatgccccaacacgagtagagcctggaatgtgtgggaggtggaggactatggtttcggggtcttcaccaccaacatatggctcaagctgagagaggtatatactcagctatgcgaccaccgccttatgagcgccgccgtgaaagacgagcgggccgtccacgcggacatgggctactggatcgagagccagaagaatggaagctggaagctggaaaaggcttccttgatcgaggttaaaacctgcacctggcccaagagccataccctctggagtaacggcgtgctggagagtgacatgatcatccccaagtctctggcggggccaatctcacagcacaactaccgaccgggatatcatacgcagacggcggggccctggcacttggggaagctcgaactggatttcaattactgcgagggcaccaccgtagttatcactgaaaactgcgggacacggggtccctcgctccgcactaccacggtcagcgggaaactgattcacgaatggtgctgccggtcctgtactctgcccccgctccgctacatgggcgaggacgggtgctggtacggcatggagatccggcccatttctgagaaagaggagaacatggtcaagtccctggtgagcgccggctccggggaggtagacaactttaccatgggcgtcctgtgcctggccatcctgttcgaggaagtcatgcgcggaaagttcggtaaaaagcacatgatcgccggcgtgttttttaccttcgtcttattactgagcggccagataacgtggcgggatatggcgcacactttaatcatgatcggcagcaacgccacagatcgcatgggcatgggcgtgacctacctcgccttgatcgccacctttaagatccagccgttccttgccctcgggtttttcctgcggaagctgacctctcgcgagaatctcctgctgggggtaggcttagctatggccaccacactccagctgcccgaggacatcgaacagatggccaacgggattgccctcggcctgatggccctgaagctcatcacgcagtttgagacctaccaactgtggaccgccctaatctccctgacctgctcgaacacgatcttcacgcttacagtagcatggcggaccgccacgctgatcttagccggagtgagcctgctcccagtctgtcagagtagctccatgcgcaaaacagactggcttcccatgactgtggcagccatgggcgtgccccccctcccgctgttcatcttcagcttgaaggacaccctgaagcgccggtcctggccccttaacgagggtgtcatggcggtgggcctagttagtatactggcctccagcctcctgcgcaacgacgtccccatggccggtcccctggtggccggtgggctgttaatcgcctgctacgtgatcactgggacctccgctgacctgaccgtcgagaaagccgccgatgtgacttgggaggaggaggcggagcagaccggggtgagccataacctgatgatcacggtcgacgacgacgggaccatgcggatcaaagacgacgagacggagaatatcctcaccgtgctgctgaagacggccttgttgatcgtgtcaggcattttcccgtatagcatccccgctactcttctcgtctggcacacctggcagaagcaaacccagcggtccggggtgttatgggacgtgccctcaccgcccgagacgcaaaaagcggagctggaggaaggggtataccgcatcaagcagcagggtatcttcgggaagacccaggtgggcgtcggggttcagaaggagggcgtgtttcacacaatgtggcatgtgaccagaggtgccgtcctcacgtacaacggcaaacggctggagccaaactgggcgtctgtgaaaaaagatctgatcagctacggcggaggctggcggctctccgcccagtggcagaagggagaggaggtgcaggtcatcgccgtggaacccggcaagaatcccaagaacttccaaactatgcccggcacattccagactacgacaggggagatcggggcaatcgcgttagacttcaagcctgggaccagcggctcgcccatcataaaccgggaaggcaaggtcgtcgggttgtatggcaacggggtggtgaccaaaaacggcggttacgtgagcggcatcgctcagactaatgccgaaccggacggtcctacaccggagctagaggaggagatgttcaagaagcgcaacctcaccatcatggacttgcaccccgggtccggcaagacccgtaagtaccttccagctatcgtgcgcgaggccattaagcgacgcctccggacgttgattctcgcgcctacccgtgtcgtagcggccgagatggaggaagccctcaagggactgccaatccgttaccaaaccaccgctacaaagtccgagcacacaggccgcgagattgtggatctgatgtgccatgcgaccttcaccatgcggctccttagcccggtacgcgtcccgaactataacctaatcatcatggatgaagcacactttacggacccagcctccatagccgcccgggggtacatcagcacccgcgtgggcatgggcgaggcggccgccattttcatgactgccacaccgcccgggactgctgatgcatttccgcagtccaacgcccccattcaggacgaagagcgcgatatcccagagcgcagctggaactccggcaatgaatggatcaccgattttgccgggaagaccgtgtggtttgttccatccatcaaggccggaaacgacatcgcaaactgcctccgcaagaacggaaagaaggtcatacagctgtcccggaagacctttgacaccgagtaccagaaaactaagctgaatgactgggacttcgtggtcaccaccgacatcagcgagatgggcgccaacttcaaggccgaccgcgttatagacccacggcgctgtctaaagcccgtgatcctgaccgacggccccgaacgggtcatcttagccgggcccatgccggtgacggcagcttccgccgcccaacgtaggggccgcgtggggcggaacccccagaaagagaacgaccagtacatcttcacaggccagcccctcaacaatgacgaggaccatgcacactggaccgaggccaagatgttactcgacaacataaacacccccgaaggtatcattccagcattattcgagccggagcgcgagaagtccgccgccattgacggagagtaccggctgaagggcgaatcccgcaagacgttcgtcgagctgatgcggagaggtgatctacccgtttggctggctcacaaggtcgcgagcgagggcattaaatataccgatcggaagtggtgcttcgacgggcaacgcaataatcagatcctggaggagaatatggacgtagagatctggaccaaggaaggcgagaagaaaaagttacgcccacgctggctggacgcccgcacctacagtgacccgttagccctcaaggagttcaaggactttgcggccggacgcaagagtatcgcactggacctggtaacggaaatcgggcgcgtccccacccacttggcccaccgaacccgaaatgcccttgataacctagtgatgttgcatacttccgagcacggaggtaaggcctaccgacacgccgtggaggagttgcccgagacgatggaaaccctccttctactgggcctcatgatcctgctgacagggggcgctatgttatttctgatttcaggcaaaggcatcggtaaaacgtccatcggcttaatctgcgtcatagccagcagcggcatgctctggatggccgaaatcccgctgcaatggatcgcgtccgcaatcgttttggaattcttcatgatggtgcttctcatccccgagcccgagaagcaacgcacgccccaggataaccagttagcgtacgtcgtgatagggatcctcacactggccgcaatcatcgccgccaatgagatgggcctgctagagacaaccaagcgggacctgggcatgagtaaggagccgggggtggtcagccccacgtcgtacctggacgtggacctacaccccgcctctgcgtggaccctgtacgctgtagcgaccaccgtcatcacgcccatgttacgacacaccatcgaaaattccacagctaatgtgtccctcgccgccatcgccaatcaggccgttgtcttaatgggacttgacaagggatggccgatcagcaaaatggacttaggcgtgcccctcttagcgctcgggtgctattcccaggtgaaccccctgaccctgacagctgccgtcctgctgctgataacccattacgccattattgggcctggccttcaggccaaagcgacccgcgaagcccaaaaacgcaccgctgccgggataatgaagaatccgacggtagacggcatcatgaccatcgacctggaccccgtgatctacgactccaagttcgagaagcagctagggcaggtcatgctcctggtgctgtgcgccgtgcagctcctgctgatgcggacctcctgggcgctctgtgaagccctgacactggctacaggccccatcaccaccttatgggagggctctcccggtaagttctggaatacaaccatcgccgtatcaatggctaatattttccgcggtagctacttggccggggccggcctggccttctctatcatgaagtccgtgggaacgggcaagcggggcaccgggtcccaaggcgaaacccttggcgagaaatggaaaaaaaaactgaaccaactgagccgcaaggagttcgacctctacaaaaagtccggcatcaccgaggtggaccggactgaggccaaggagggactgaagcgcggcgagataacccaccacgcggtcagccgtggcaccgccaagttgcagtggttcgtggagcgcaacatggtgatcccggaagggcgggtcatagatctcggctgcgggaggggcgggtggagctactactgcgctggactgaaaaaggtgacagaggtgcggggctacacgaagggcggaccagggcacgaagagcccgtccccatgtccacctatggctggaacatcgtgaagttgatgagcggaaaggacgtgttctacctgccgcccgagaaatgcgataccctgttatgcgacatcggcgagtccagcccatcccccaccgttgaagagagccgcaccatccgcgtattgaaaatggttgagccgtggctcaagaacaaccagttctgtatcaaggtcctgaacccctacatgcccgctgtgatagagcacctggagcggttgcagcggaagcacggaggaatgctggtgcggaaccccctgtcccgcaatagcacccacgagatgtactggatttccaacggcacagggaacatcgtcgcgagcgttaacatggtgagccggctcttgttaaaccgctttaccatgactcatcggcggccgactatcgaaaaagacgtcgacctcggggcgggcacccggcacgtaaacgccgagcccgaaacacccaacatggacgtgattggggaacgtatcaaacggataaaggaggagcacaactctacgtggcactatgacgacgaaaacccgtacaagacctgggcttaccacggatcgtacgaagtcaaggccactggtagcgcttccagcatgatcaacggagtggttaagttactgacaaagccttgggacgtggtaccaatggtcacgcaaatggcgatgacggacaccacaccgttcgggcagcaacgcgtattcaaggagaaggtggacactcggacccctcgctccatgcccggcacacggcgcgtcatggaaattacagccgagtggctctggcgcacgctgggccgcaataagaagccgcgtctgtgtacccgcgaagagttcaccaagaaggtgcgcaccaacgccgccatgggtgcagtcttcacggaagagaaccagtgggacagcgccaaggccgctgtcgaggacgaggacttttggaagctcgtggaccgagagcgggagcttcataagctgggcaaatgcgggtcctgcgtatacaacatgatgggcaagagggagaagaagctcggggaattcggcaaagccaagggcagccgggcgatttggtacatgtggctcggggcgcggtacctggaattcgaggccttaggattcctcaatgaggaccactggttctcccgcgagaactcctatagcggggtcgagggcgaagggcttcacaagctcggctacatcctgcgggacatctcgaagattcccggtggggccatgtacgcagacgataccgccgggtgggacacccgcatcaccgaggacgacttacataacgaagagaagattacccagcagatggacccggagcaccgtcagctcgctaacgcgatcttcaagctgacgtaccagaacaaagtggttaaagtccagcggccgacgcccaccggcacagttatggacatcattagccggaaggatcagcgcggctcgggccaggtagggacgtatggcttaaacacgttcaccaatatggaggctcagctcatacggcagatggaaggggagggcgtcctgagcaaagccgaccttgagaatcctcacttgccggaaaagaagatcacccagtggctggagacgaaaggcgtggaacgccttaagcggatggcgatctccggggacgactgcgtggtcaagcccatcgacgatcgcttcgccaacgcgctcctggccctgaacgacatgggcaaggttcggaaggacatcccccaatggcagcccagcaaagggtggcacgactggcagcaggtcccgttctgctcgcaccactttcacgagctcatcatgaaggacggccggaagcttgtcgtaccctgtcggccccaggacgagctgatcgggcgcgccaggatcagccagggcgcggggtggtccctccgcgagaccgcctgcctgggcaaggcttatgcgcagatgtggagtctgatgtacttccatcgccgggacctgcgccttgcttccaacgccatctgcagcgccgttcccgtgcattgggtgccaacctcgcgtaccacgtggtctatccacgcgcatcaccaatggatgaccacggaggacatgttaaccgtgtggaaccgagtttggatcgaggataacccttggatggaggacaagacgccggtgaccacctgggaaaacgtgccctacctcggtaagcgggaggatcagtggtgcgggtctcttatcggcctgacgagccgggctacgtgggcgcagaacataccgaccgccatccagcaggtccggtccctcatcgggaacgaagagttcctggactacatgcccagcatgaagcgcttccgcaaagaggaggagagtgagggagccatctggtga

SEQ ID NO: 26007 - RNA, 9873 nt, synthetic construct
  misc_feature 1..9873: note = derived and/or modified CDS sequence (opt11) from DENV-3__EU482595__SS-prME
  source 1..9873: mol_type = other RNA
acgagcttatgtctgatgatgatgctgcccgctgctttggcgtttcacttaaccagccgggatggggagccgcggatgatcgtcgggaagaatgagcgggggaagagcctgctgttcaagacggccagcgggatcaatatgtgtaccctcatcgccatggacctgggcgagatgtgcgacgacaccgtgacttataagtgtccccacatcactgaggtggagcccgaagacattgactgctggtgcaacctgacctctacctgggttacctacgggacgtgcaatcaggccggtgagcaccggcgagacaagcggtccgtggcgctcgcaccccatgtgggcatgggccttgacacccgcacacagacctggatgagcgccgagggagcgtggaggcaagtagagaaggtcgagacgtgggccttgcgccatccggggtttaccatactggcgttgttcctggcccactatgtaggcacttccctgacccaaaaggtggtcatcttcatattactgatgctcgttacgcccagcatgacgatgcggtgcgtgggggttggtaatagggacttcgttgagggcctttccggggccacctgggtagacgttgtgttggagcatggcgggtgcgtgaccacgatggccaagaataagcccaccttggacatcgagctgcaaaagaccgaggccacccagttagcaacgctccggaagctatgcatcgagggcaaaatcaccaacatcaccaccgacagccgctgtccgacgcagggggaggccgtcctgccggaagagcaggatcagaattacgtgtgtaagcacacctacgttgaccgagggtggggaaatgggtgtggcctcttcgggaaaggctccctggtgacctgtgcaaagttccagtgcctggagcccatcgagggcaaagtggtgcagtacgagaaccttaaatacaccgtcatcatcaccgtgcacaccggagaccagcaccaggttggaaacgaaacacagggggtgactgccgagatcacaccacaagcctctaccaccgaggcgatccttccagagtacggtaccctggggctcgaatgctccccgcgtacaggactcgacttcaacgagatgatactgctgacgatgaaaaacaaagcctggatggtccaccgccaatggttctttgacttaccactaccctggaccagcggtgccaccaccgagactcccacctggaaccgcaaggagctcctggtcacattcaagaacgcccatgccaaaaagcaggaagttgtggtcctcgggtctcaagaaggcgcaatgcataccgccctcacaggggccaccgagatccagaatagcggcgggacctccatctttgccggtcacctgaaatgccggctgaagatggacaagttggagctgaagggcatgtcatatgccatgtgcactaacacgttcgtgttgaagaaggaggtctccgagacccagcacgggaccatcttgataaaggtcgagtacaagggcgaggacgtgccatgcaaggtgcccttctctaccgaagacgggcaaggcaaggctcacaacgggagactgatcacggctaaccccgtcgttaccaaaaaggaggagccagtaaacatcgaggccgagcctcccttcggggagtctaacatcgtcataggtatcggggacaacgccctgaagatcaactggtacaagaaaggttcaagcatcgggaagatgttcgaggcgaccgcccggggagcacgccggatggccatactcggggacaccgcctgggacttcgggagcgtgggcggggtgctcaacagcctgggcaagatggtccaccagatctttgggtccgcgtacacggccctgttctccggggtgtcctgggtgatgaagatcggcatcggggtcctactgacctggatcgggctgaactcgaagaacacctctatgagcttttcatgcatcgtgatcgggatcatcaccctctacctcggcgccgttgtccaagcagatatggggtgcgtgatcaactggaagggaaaggaactgaagtgcggctcagggatctttgtgaccaacgaggtccacacctggacggagcagtacaaatttcaggcggattccccaaagcgactcgcaaccgccatagccggggcctgggaaaacggggtgtgcggaatcaggagtacgaccaggatggagaacctgctgtggaagcaaatcgctaacgagttgaactacatcctgtgggaaaacaacatcaaactgactgtagtcgtgggggatatcatcggcgtgttagaacagggcaagcgcatcctgactccccagcctatggagctgaagtatagttggaagacgtggggcaaggcgaagatagtcaccgccgagacccagaattcctctttcatcatcgacggccctaacacccccgagtgcccaagcgcctccagggcctggaacgtatgggaagtagaggattacgggttcggcgtcttctccactaacatctggctcaaactgcgggaggtatacactcagctgtgcgaccaccggctcatgagtgcggctgtgaaggacgaacgcgccgtccacgccgacatgggctattggatcgagtcccagaagaacggtagctggaagctggagaaggcgtccctgatcgaggtgaagacgtgcacgtggccaaaatcccacaccctttggtcaaacggcgtactggaaagtgacatgatcatccccaagtccctggctgggccgatctcacagcacaactatcggccgggctaccacacccagacggccgggccctggcacctaggcaagcttgagctggacttcaactactgcgaaggtaccaccgtggtaatcacggagaactgcgggacccgagggccttccttgcggaccacgacggtgagtgggaagctgatccacgagtggtgctgccggtcctgcactctgcctccgctccggtacatgggcgaggatgggtgctggtacggcatggagatccgcccaatcagcgaaaaagaagagaacatggtcaagtccctagtgtcggcgggcagcgggaaggtggacaattttacaatgggcgtcttgtgcctcgccatcctgtttgaagaggtgatgcggggtaagttcggcaagaagcatatgatcgccggggtcttctttacatttgtcctgttattgagcggccaaatcacgtggcgcgacatggcacacaccctgataatgataggctcgaatgccagcgatcggatgggtatgggagtcacctacttggccctaatcgcgaccttcaagatccagcccttcctggccttagggttcttcctgcgcaagctcacgagccgcgagaatctcctgctgggggttggactcgcgatggccaccaccttgcagctgcctgaggatatcgagcagatggctaacggcatagccctcgggctgatggcgctgaagctcataacgcagttcgagacgtaccaactatggaccgccctgatcagtctcacatgcagcaacaccattttcactctgaccgtggcctggcgtaccgcaacccttatcctcgctggggtgtccctgcttccggtctgccagagcagtagtatgcggaagacagactggttgcctatgaccgtggcggcaatgggcgtgccgccgctccccctgtttatcttctccctcaaggacaccctgaagcgccgctcttggcccctgaacgagggggtaatggccgtgggcctcgtgtcaatcctggccagcagccttttgagaaatgatgtccccatggccggtccactggtggccggcgggctgctcatcgcctgctacgtgatcaccgggacctcagcggacttgaccgtagagaaggcggccgacgtgacctgggaggaggaggcggagcaaaccggcgtatctcacaacctgatgatcacggtcgacgacgacgggaccatgcgcatcaaagacgacgagaccgaaaacatcctcaccgtgctgctgaagaccgccctcctgatcgtgagcggcattttcccgtactccatccccgccacgctgctcgtctggcatacctggcaaaaacagacgcagcggagcggcgtgctgtgggatgtgccaagcccgcccgagactcagaaagccgagctggaggagggagtgtaccgcatcaagcagcagggcatctttgggaagacgcaagtgggagtgggcgttcagaaggaaggcgtcttccataccatgtggcacgtgacccgcggcgcagtcctcacgtacaacgggaaacgactcgagcccaattgggcgagtgttaagaaagacctgatctcctacggcggggggtggcgactgagcgcccagtggcaaaaaggggaggaggtgcaagtcatcgccgtagaaccaggcaagaacccgaaaaatttccagacaatgcccggcacctttcagaccactacgggcgagatcggagccattgcactggacttcaaacccgggaccagcgggagtcccattatcaaccgcgagggcaaggtggtcgggctgtacggcaacggggtggttaccaagaatggcggttacgtcagcggtatagcccagaccaatgctgagccggacggccctgcccccgagctggaggaggagatgtttaagaagagaaacttaactatcatggatctgcaccctgggtctggcaaaacccgcaagtacttaccggctattgtgcgagaggcgatcaaacgccgtctcagaaccctgatactggcacccacccgggtcgtcgctgcagagatggaggaagcgctcaaaggcctgcccatacgctaccaaaccaccgccaccaagagcgaacacacgggccgggagatcgtggacctgatgtgtcatgccacgttcaccatgcgcctcttatcccccgtgcgggtcccgaactacaatctgataatcatggatgaggcccatttcaccgaccccgcctccatcgccgctcgcgggtacattagcacccgggtggggatgggtgaggcagctgccatcttcatgacggcgacgccgccagggacggcggacgcctttccgcagagcaacgctcccattcaggacgaggaaagggacatcccggagaggtcctggaacagcggcaacgaatggatcaccgacttcgccggcaagaccgtctggttcgtcccatccatcaaggcgggtaacgatattgccaactgtctccggaagaacgggaagaaagttattcagcttagccgcaagacgtttgacaccgaataccagaagaccaagctgaacgattgggacttcgtggtcaccaccgacatctccgaaatgggggccaatttcaaagccgacagagtgattgaccctcgccggtgcttgaagcccgttatcttaaccgatggccccgagcgcgtcatactggcgggccctatgccggtgaccgccgccagcgcagctcagcggcgtggtcgagtcgggcgcaatccccagaaggagaacgatcagtatatttttacaggccaaccgctcaataacgatgaagaccacgcccattggaccgaggcgaagatgctgctggacaacatcaatacccccgagggcattatcccggccctcttcgagcctgaaagggagaagagcgccgcaatagatggggagtaccgcctgaagggcgagagccgcaagaccttcgtggagctgatgcgcaggggggacctacccgtgtggctggcgcacaaggtagcgtccgagggcatcaagtacaccgatcgcaagtggtgcttcgacgggcagcggaacaaccagatcctggaggagaacatggacgtggagatctggaccaaggagggcgaaaagaagaagcttcgcccccggtggctggatgcccgcacctatagcgacccgctggctctcaaggagtttaaagacttcgccgctggacgcaagtccatcgccttagatctggtgactgagatcgggcgggttccatcccacctagcccaccgcacccgtaatgccctggacaacctggtgatgctccatacaagcgagcatggcggaaaggcctatcgtcacgcggtggaagaactgcccgagaccatggagaccctgttactgctgggcctgatgatacttctgaccgggggagccatgctgttcctaattagtggcaagggaatcggcaagacgtcgatcgggctgatatgcgtcatcgctagcagcggaatgctatggatggccgagataccgctgcaatggatcgcctccgcgatcgtgttggagttcttcatgatggtgctcctgatccccgagcccgaaaagcagcggacaccccaggataatcagctcgcctacgtcgtgatcggtatcctcaccctggccgcgatcattgctgcgaacgagatgggcctgctcgagaccacgaagcgagacttgggcatgagcaaagagccgggagttgtatctcccacctcttacctggacgtggacttgcaccccgcctccgcctggactctttatgccgtggcgacgacggtcattacgcctatgctgcggcataccatagaaaatagcacagccaacgtgtcgctcgctgccatagcgaaccaggcagtagttttgatgggactggacaagggctggccaatcagcaagatggacctcggcgtgcctctgctagcactggggtgctactcccaggtaaatcccctgaccctgaccgccgccgtcctcttgctgattacccactacgccatcatcggccccggccttcaggctaaggctacgcgcgaggcccagaagcgaacggccgcagggatcatgaagaacccgaccgtggacggaatcatgaccatcgacctggaccctgtaatatacgacagcaagttcgagaagcaactggggcaggtcatgttgctggttctgtgcgcggttcaactcctgctaatgcggaccagttgggcgctctgcgaggctctgacgttagccaccggcccaattaccacgctctgggagggcagccccgggaagttctggaacactacaatcgccgtctccatggcgaacatctttcggggctcatacctggcgggggccggcctggcgttctcaatcatgaagagcgtggggaccggcaaacgcgggactgggagccagggagagaccctgggggagaagtggaaaaagaaactgaaccagctgtcccgtaaggagttcgacctctacaagaaatccggcattaccgaagtggaccggaccgaggctaaagaggggttaaaacggggcgagatcacccatcatgccgtctcccgcggtagcgccaagctgcaatggttcgtagagcggaacatggttatcccggaggggcgcgtgattgaccttggctgtgggcggggggggtggtcttattactgcgcaggcctaaagaaggtgaccgaggtgcgcggctacacgaaaggcggaccagggcatgaggagcccgtcccgatgtccacatacgggtggaatatcgtgaagctgatgtccgggaaagatgttttttacctaccgcccgaaaagtgcgacaccctcctgtgcgacatcggcgaaagctccccctcgcccaccgtcgaggagtccaggacgatacgcgtgcttaagatggtcgaaccgtggctgaagaacaatcagttctgcatcaaagtcctcaatccttacatgcccaccgttatcgagcacctggagaggctccagcgcaagcacggcggaatgctggtgcgcaaccccctgtcccggaactccacccatgagatgtattggataagcaacggaactggcaatatcgtagcctccgtgaacatggtgtcacggctcctgttaaaccgtttcacgatgacccacaggcgaccgaccatcgagaaggatgtcgacctcggcgcgggcacccgacacgtaaacgccgagcccgagacgcccaacatggacgtcatcggggagcggatcaaacgcatcaaggaggagcacaattccacctggcactacgacgacgagaacccttacaaaacctgggcttaccatgggagctacgaggtgaaggcaactgggtccgcatccagcatgatcaatggtgtcgtcaagctattgacgaagccctgggacgtggtgcccatggtcacccagatggccatgaccgacactacgcccttcggacagcagcgggtgttcaaggagaaggttgacacccgcaccccgcggagcatgccaggcacccgcagagtcatgggcatcacggccgagtggctctggcgcacccttgggagaaacaagaagccccgcctgtgcaccagagaggagttcactaagaaggtgcgcacgaatgccgccatgggcgctgtcttcaccgaggaaaaccagtgggactcagccaaggccgccgtcgaggacgaggatttctggatcttagtggaccgcgagcgggagctgcacaaattgggaaagtgtggctcctgcgtctacaatatgatgggaaagcgcgaaaagaaactcggtgagttcggaaaggctaaggggtcccgggcgatctggtacatgtggctgggtgcccggtacctggaattcgaagctttgggcttcctgaacgaggaccactggttctcccgggagaacagttactccggggtcgagggtgagggcctgcacaagctaggctacattttgcgcgacatctccaagatccccgggggtgccatgtacgcggatgacactgcagggtgggacactcggatcacggaggatgacctgcacaacgaggagaagatcacccaacagatggaccccgaacaccggcagctcgctaacgccatcttcaagttgacctaccagaacaaggtggtgaaggtacagcggcccacccccacgggcaccgtgatggacataatcagccgcaaggatcagcggggcagcggccaggtaggcacctacgggcttaacaccttcaccaacatggaggcccagctcattcgccagatggagggagagggggtactgtccaaggccgacctagaaaacccccacctcccagagaagaagatcacgcagtggctggagaccaagggggttgagcgtttaaaacggatggcgatcagcggcgacgactgcgtggtgaagcccatcgacgacagattcgccaacgccctcctggctctgaacgatatggggaaggtccgcaaggacatcccccagtggcagccctctaagggctggcacgactggcagcaggtcccgttttgtagccaccactttcatgagctcatcatgaaagacggccggaagctggtagtcccctgccgcccacaggacgagctgattggccgggcccgtatctcccagggggcaggctggagcctccgggaaaccgcctgcctgggcaaagcctatgcccagatgtggtccctgatgtacttccaccgcagagatctccggctggcgtcgaacgccatctgtagcgccgtgcccgtacactgggtgcctaccagccgcacgacgtggagcattcacgcccatcaccagtggatgaccactgaggacatgcttacggtatggaaccgggtctggatcgaggacaacccttggatggaagacaagacccctgttaccacttgggaaaatgtgccttacctcgggaagcgcgaggaccagtggtgcggctccctgatcgggctgacgagccgggctacctgggcacagaacatcccaacagcaatacagcaggtccgcagcctcatcggcaatgaggagttcttagactacatgcccagcatgaagaggttccgcaaggaggaggagtccgagggggcaatttggtga

SEQ ID NO: 26008 - RNA, 9873 nt, synthetic construct
  misc_feature 1..9873: note = derived and/or modified CDS sequence (opt11) from DENV-3__EU482596__SS-prME
  source 1..9873: mol_type = other RNA
accagcttatgcctcatgatgattctgcccgccgccttggccttccacttgacctcacgggatggagagccccggatgatagtgggcaagaacgagcgggggaaaagcctgctgtttaaaacggcctccgggatcaacatgtgcaccctcatcgccatggatttaggcgagatgtgcgacgacacagtaacctacaaatgcccccatatcactgaggtcgagcccgaagacatcgattgctggtgcaaccttaccagcacctgggtgacttacgggacttgtaaccaagccggagagcacagacgcgataagcgatccgtcgccctcgctcctcacgttggtatggggctcgacactcgtacccagacctggatgtcggccgagggcgcgtggcgccaggtggagaaggttgagacgtgggccctgcgccacccaggtttcaccatcctcgctctgttcctggcccactacatcgggacctccctgacccagaaggttgtgatcttcattctgttgatgttggtcacccccagcatgaccatgcggtgcgttggggtggggaaccgtgacttcgtcgagggcctaagcggggctacgtgggtggacgtggtcctggagcacggcggttgtgtgacgactatggccaaaaataagcccaccctcgacattgagctacagaagaccgaggccacccagctggcgacgctcaggaagctgtgtatcgaaggcaagatcaccaacataaccaccgatagccggtgccccacacagggcgaagcggtgctgccggaagagcaagatcagaactacgtctgcaagcacacatacgtggatcgaggatggggtaatgggtgtggtctctttgggaagggctcgttagtaacctgtgctaagtttcaatgcctggagccgatcgagggcaaggtcgtgcagtatgagaacttgaagtacactgtaatcatcacggtacacactggggatcagcaccaggtgggcaacgaaacacagggggtaaccgccgagatcacgccccaggcctccaccaccgaggcgatcctgcccgaatacggcactcttgggcttgaatgttccccgcgcaccggcttagacttcaacgagatgatccttctcacaatgaagaacaaggcctggatggtacaccggcagtggttcttcgacctgccgttgccctggaccagcggcgcgacaaccgagacgcccacctggaaccgcaaagagctactggtaaccttcaagaacgcccacgccaagaagcaggaggtcgttgtgctggggtcccaggaaggcgcgatgcacaccgctctgacgggggcaaccgaaatccagaatagcggcggcacctccatcttcgccgggcatctgaaatgccggctgaaaatggacaaactcgaattaaagggcatgagctacgccatgtgtacgaacacgttcgtcctgaagaaggaagtgtccgagacccagcacgggactatcctcatcaaggttgagtacaagggcgaggatgtgccgtgcaagattcctttcagcacagaggacgggcaggggaaggcgcacaacggacgtctgatcacggccaatcccgtggtgacgaagaaggaggagcccgtcaacatcgaggcggaacctcccttcggagagagcaacatcgtgatcgggatcggtgacaacgcactgaaaatcaactggtacaaaaagggctccagcatcgggaagatgttcgaggcgaccgcccggggcgcccgccggatggcaatcctgggcgataccgcatgggacttcgggtcagtgggcggggtcctcaactcactgggcaagatggtgcaccagatcttcgggagcgcctacacagccctgtttagcggcgtgtcctgggtcatgaagatcggcatcggggtgctcctgacctggataggcctgaacagcaagaacaccagcatgagcttctcatgcatcgccatcgggatcatcaccctatatctaggcgccgtcgtccaggccgatatggggtgcgtgatcaattggaaaggcaaggagctgaaatgcgggagcgggatcttcgtgaccaacgaggtgcatacctggaccgagcagtacaaattccaagccgacagccccaagcgactcgccacggcgattgcaggggcctgggaaaacggggtctgcggcataagatctacgactcggatggaaaacctgttgtggaagcagatagcgaacgagctcaattacatcttatgggagaacaacatcaagctgaccgtagtagtgggggacatcataggcgtgttagagcagggcaagcgcaccctgacgccccagccgatggagctgaagtactcctggaagacttgggggaaggccaaaattgtcaccgcagagacccaaaattcctccttcatcattgacggccccaacacgcctgagtgcccgagcgcctccagagcgtggaacgtgtgggaagtggaggactacggtttcggcgtatttaccaccaacatctggttaaagttacgcgaggtgtatacgcaactgtgcgaccatcggctcatgagcgccgcggtcaaggacgagagggctgtccacgccgacatgggctattggatagagagccagaagaacgggtcgtggaaactggagaaagcgagccttattgaggtcaagacatgcacgtggccgaagtcccacaccctctggtcaaacggagtgctcgagagcgacatgatcattcccaagagcctcgccgggcccatctcccaacacaactaccggccgggctaccacacccagaccgcggggccctggcacctcggcaagctcgagctggactttaactactgcgaggggacaacggtggtgattaccgagaattgcgggacgcgcggccccagcctacggacgacgacagtgtccggcaagctgatccacgagtggtgttgccgcagctgtaccctgcctccgctccggtacatgggcgaggacgggtgctggtacggcatggagattcgcccgatctccgagaaggaggaaaacatggtcaagagtctggtgtccgcaggctccggtaaggtcgacaacttcacgatgggcgtcctctgcttggccatactgttcgaggaggtgatgagagggaagttcggtaagaagcacatgatcgcgggggtatttttcaccttcgtcctgctcctatccgggcagatcacctggcgcgatatggcccacactctcatcatgatcggaagcaacgcctccgaccggatggggatgggcgtcacgtacctcgccctgatcgctaccttcaagatccagccctttctagcgttaggattctttctgcgcaagttaacgagccgtgagaatttactgctgggcgtaggcctcgctatggccactacgctgcagctgcccgaggacatcgagcagatggccaacggcatcgcgctcggcctgatggccttgaagctcatcacccaattcgagacctaccagctgtggaccgccctgatcagccttacatgctccaataccatattcaccctgacagtcgcatggcgcactgccaccctgatcctcgctggtgtgagcctgctgccggtctgccagtcctcatccatgcgtaagaccgactggctccccatgacggtagctgctatgggcgtgccgcccttgccgctcttcatcttcagcctcaaggacacgttgaagcggcgctcctggccactgaacgagggggttatggccgtgggcctcgtgtcaatcctggcctcaagcctgctccggaacgacgtgcccatggcgggccccttggtggcgggaggcctgctcatcgcatgctacgtaatcaccggaacctccgccgacctgaccgtcgagaaggccgcagacgtgacttgggaggaggaggccgagcaaactggcgtgagccacaacctaatgatcaccgttgacgacgacggaacgatgcgcatcaaggacgacgagaccgagaacatactaactgttctgctgaagaccgcgttactgatcgtttccggcatcttcccctatagtataccggcaaccctgctagtctggcatacgtggcagaaacagacccagcggtccggcgtgttgtgggatgtgcccagcccgcccgagacccaaaaggccgagcttgaggagggggtttaccgcatcaagcaacagggaatattcgggaagactcaagtcggagtcggagtacaaaaggagggagttttccacaccatgtggcacgtgacgcgcggcgcggtactcacctacaacggaaagcgcctagaacccaattgggcctccgttaaaaaggacctgataagctacgggggaggctggcggctctccgcccagtggcagaaaggggaggaggttcaagtcattgccgtcgagcccggcaaaaaccccaagaactttcagaccatgcccggcaccttccagacaaccactggggagatcggcgcgatcgcattagacttcaagcccggtacctcaggcagccccataatcaaccgcgaaggcaaagttgtcgggctgtatggcaacggggtggtgacaaagaatggcggctacgtatccggcatcgcccagaccaacgccgagccagacggccccacccccgagctggaggaggagatgttcaagaagcggaacttgaccatcatggatctgcaccccgggagcgggaagacacgcaaatacctgccggccatcgtacgggaggcaatcaaacgccggctccgcactctaatcctggccccaacgcgagtggtcgcagccgagatggaggaggccttaaaggggttacccattcgctaccagaccacggcgacgaagtccgagcataccggacgcgagatcgtggacctgatgtgccatgccacctttacgatgcggctcctgagccccgtccgggtaccgaactacaacctgatcatcatggacgaggcacacttcaccgatccggcatccatagccgcgcgcggatacatatcgacccgggtggggatgggcgaggccgcggctattttcatgaccgcgacaccgcccgggaccgccgatgccttcccgcagtctaatgcgccgatccaggacgaggagcgtgacatccctgagaggagctggaactccggcaatgagtggatcacggacttcgcggggaagaccgtgtggttcgtgcccagcatcaaggcgggcaacgacatcgccaactgcctccggaagaacggtaagaaggttatccagctctcccgcaagacgttcgacactgagtaccaaaagaccaagctcaacgactgggacttcgtggtcacgacggatattagcgagatgggcgctaacttcaaggctgaccgtgtaattgacccccgccggtgcttaaagccagtgatactaaccgatggccccgagcgcgtcatcctggccggtcccatgccggttaccgcggcctccgccgcccaacggcgcggtagggtggggcggaacccacagaaggagaacgaccagtacatcttcaccgggcagcccctcaacaatgatgaagaccatgcccactggaccgaggcgaagatgctgttagacaacatcaacacgcccgagggtattatcccggccttattcgaacctgagcgggagaaatctgccgccatagacggcgaataccgccttaagggtgagtccagaaagacgtttgttgaactgatgcgccgtggcgacctccccgtctggctggcgcacaaggtagcaagcgagggaatcaagtataccgaccgcaagtggtgcttcgacggtcaacggaacaaccaaatcctggaggagaacatggacgtggagatctggaccaaagagggcgagaagaagaagctccgcccccggtggctggacgccaggacttactccgatccgctggcgctcaaggagttcaaagacttcgctgcgggcagaaagagcatcgcgcttgatctggtgaccgagatagggcgggtaccgtcacacctcgcacaccggacccggaatgctcttgataatcttgtgatgctccacaccagtgagcatggtgggaaagcttatcggcacgcggtggaggaactgccggagacgatggagaccctgttactgctcggcctcatgatcctgctgactgggggcgccatgctcttcctgatcagcggcaaggggatcggcaagacctccatcgggttgatctgcgttattgcctcgtccggcatgttgtggatggcggagattccgctgcagtggatcgccagcgctatcgtgctcgagttcttcatgatggtgctcctaatccccgagcccgagaagcagcgtacgccccaagacaaccagctggcatacgtcgtgatcgggatactcaccctcgctgctatcatcgcagcaaacgagatgggcctgttagagaccaccaaacgcgacctgggcatgtccaaggagccgggggtggtcagccccacatcatatctggatgtcgacctccatccagccagcgcctggaccctctatgccgtggccaccaccgtgattacgccgatgctgagacacaccattgaaaattccaccgcaaacgtaagcttagcggccatcgccaaccaggcggttgttctgatgggtttggataaggggtggccgatctccaagatggaccttggtgtacccctgctcgccctcggctgctacagccaggtgaatcctttaaccctaacggccgccgtcctcttgctgataacccactacgccatcatcggacctggtctccaggcgaaagccactcgcgaggcccagaagcggaccgccgccgggataatgaagaacccaactgtcgacggcatcatgacaatcgatctggatcccgtcatctacgactcaaagttcgagaagcaattagggcaggttatgctcctggtgctgtgcgctgtgcagctcttgctaatgcgcacctcatgggcgctctgtgaggctttgaccctggctacgggccccatcaccaccctctgggagggctcccccgggaagttctggaacactacgatcgcagtcagtatggccaacatcttcagaggtagttatctggccggcgctggcttagccttcagcatcatgaagtccgtggggaccggcaaacgcggcaccgggagtcagggcgagaccctgggggagaagtggaaaaagaagcttaaccagctgtcccggaaggaattcgatctttataagaaatccggcatcaccgaggtcgaccggacggaggcgaaggagggactgaagcgaggcgagattacccaccacgccgtcagccgcgggtcagccaagttgcagtggttcgtggagcggaacatggtgataccggagggtcgcgtgatcgatttagggtgcgggcgcggcgggtggagttattactgcgccggtctgaagaaggtgaccgaggtgcgcggctacactaaaggtgggcccggccacgaggagcccgtccccatgagtacgtacggctggaacatcgtgaaactgatgagcgggaaggacgtgttttaccttccgcccgagaagtgcgacaccctcttgtgcgacatcggtgagtccagcccctccccgaccgtcgaggagagccgtaccatccgcgtgctcaagatggtggagccgtggctcaagaacaaccagttctgcatcaaggtcctaaacccctacatgcccacggtcatcgagcaccttgagagactccagcgtaagcacggcgggatgttagtccgcaaccccctgtcccgcaattcgactcacgagatgtattggatctccaacggaacgggaaatatcgtggcatcagtgaacatggtgtcccgcctccttctgaaccggtttaccatgacgcaccgccggcctacaatagagaaggacgtcgacctcggcgcaggcactcgccatgtgaacgccgagcccgagacccccaatatggacgtgattggggagcggatcaagcgaatcaaggaggagcacaatagcacgtggcactacgacgacgagaacccgtataagacttgggcgtaccacggctcctacgaggtgaaggcaaccggaagcgcctcgagcatgataaacggcgttgtcaaactgctgaccaagccctgggatgtagtgcccatggtcacacagatggctatgaccgacacgaccccctttgggcagcagcgggtattcaaggagaaggtggacacgcgcacaccccggagcatgcctggcacgaggcgcgtcatgggcattaccgccgagtggctgtggcgcacgctgggacggaacaagaagccccgtctgtgtacccgggaggagttcaccaagaaagtacgcaccaacgccgcaatgggcgcggtgttcacggaggagaaccagtgggactcggccaaggcggccgtcgaggacgaagacttctggaaactcgttgaccgcgagcgggagcttcacaaactgggtaaatgtggcagctgcgtctacaacatgatggggaaacgcgagaagaagttaggcgagttcggcaaggccaaggggtctcgagcgatttggtacatgtggctaggcgcacgctacctggaatttgaggccttggggtttctgaacgaggatcactggttcagccgggagaactcctacagcggcgtcgagggggagggcctgcataagctcggctacatcctgagggacatctccaaaattcccggaggtgctatgtacgccgacgacactgcagggtgggacacccggatcaccgaggacgatctgcacaacgaggagaaaataacgcagcaaatggacccggagcaccgccagctcgcaaacgccatcttcaaactgacctatcagaacaaagtggtgaaagtacagaggcctaccccaacaggcacagtgatggatatcataagccgcaaagaccagcgcggttccggccaagtgggcacgtacggtctgaacacattcaccaatatggaggcgcagctcatccgacagatggagggcgaaggggtcctgtcgaaggccgacctggagaacccacacctaccggagaagaagatcacacagtggctggagacgaaaggtgtcgagcgtttgaagcgcatggcgatttcgggagacgactgcgtggtcaagcccatcgacgaccggtttgccaacgccctcctagcgctgaacgatatggggaaagtgcgcaaggacatcccccaatggcagccctctaagggctggcacgactggcaacaggtccccttttgctctcaccacttccacgaactcatcatgaaggacggcaggaaactggtcgtgccctgccgcccacaggacgagctgataggccgagcccgcatcagccagggggcgggatggagtttgcgggaaacggcttgcctgggcaaagcctacgcccaaatgtggagcctgatgtacttccatcgccgtgaccttcgtttagcgtccaacgcgatttgcagcgctgtgcctgtccactgggttccgacctcccgcaccacatggtcaatccacgcacaccaccagtggatgaccaccgaggacatgctcaccgtgtggaatcgggtgtggatcgaagacaacccttggatggaggacaagacgccggtgaccacctgggagaacgtgccctacctagggaaacgcgaggaccaatggtgcggctcactgatcgggctgaccagccgggcgacgtgggcccaaaatatcccaaccgccatccagcaggtccgcagcctcatcggcaatgaagagttcctagactacatgccatcgatgaagcggttccgcaaggaggaggagtctgaaggggccatctggtga

SEQ ID NO: 26009 - RNA, 9873 nt, synthetic construct
  misc_feature 1..9873: note = derived and/or modified CDS sequence (opt11) from DENV-3__JQ922554__SS-prME
  source 1..9873: mol_type = other RNA
accagcttgtgcctgatgatgatgctgcccgccaccctggccttccacctcacctcccgcgacggcgagccccggatgatagtggggaaaaatgaacgcggcaagagcctgctgttcaagaccgcgtctgggatcaacatgtgcaccttgatcgccatggacctgggcgagatgtgcgacgacaccgtcacctacaaatgcccccacatcaccgaactggagcctgaggacatcgactgctggtgtaacctcacctccacctgggtgacgtacgggacgtgtaaccaggcgggcgagcaccggcgcgacaagcggtctgtggctctggcaccccacgtgggcatgggtctggatacccgcacccagacgtggatgtctgcggagggcgcctggagacaggtggagaaagtggagacctgggcgctccgacacccagggtttacgatactggccctgttcttagcgcactacatcggcacctctttaacgcaaaaggtggtgattttcatcctgctcatgctcgtgacccccagcatgaccatgcggtgtgttggggtgggcaaccgcgacttcgtggaaggcctgtccggcgccacctgggtcgacgtggtgctcgagcacggcgggtgcgtaaccaccatggccaagaataagcctaccctcgatatcgagctgcagaagaccgaggcgacgcagctcgcaaccctgcggaagctctgcatcgagggcaagataaccaacattaccactgattccaggtgccctacccaaggcgaagcgatcctcccggaggagcaggaccaaaactacgtgtgcaagcacacctacgttgaccgcgggtgggggaacgggtgcggtctgtttgggaaggggagcctggtaacctgcgctaagttccagtgcctagagagcatcgagggcaaggtggtacagcacgagaacctgaagtacaccgtgatcatcacggttcacactggtgaccagcaccaagtggggaatgagacacagggcgtaacggcggagatcaccagtcaggctagcaccgctgaggcgatactaccggagtacggcaccctggggttggagtgctcccctcggaccgggcttgacttcaacgagatgatcctcctgacgatgaagaacaaggcctggatggtgcaccggcagtggttctttgatctgcccctcccgtggaccagcggcgccaccaccaaaacgcccacctggaaccgcaaggagctgctggtcaccttcaagaacgcccacgccaaaaagcaggaagtagtagtcctcgggtcccaagagggtgctatgcacacggctctgacgggtgcgaccgaaatccagacgagcggagggacctctatattcgccggccacctgaagtgccggctcaagatggacaagctggaactgaagggcatgtcatacgccatgtgcctcaacacgttcgtgctgaagaaggaggttagcgagacccagcacggtaccatccttatcaaggtagagtacaaaggcgaggacgcgccctgtaagatcccgttttccactgaggatgggcagggcaaggctcacaacggccgccttatcacggcaaacccggtggtgaccaagaaggaagaacccgtcaacatcgaggccgagcccccgttcggggagtccaacatagttattgggatcggggacaaggctctcaagatcaactggtaccggaagggctcgagcatcggaaagatgttcgaggcaaccgcccgtggtgcccggcgcatggctatactgggagacaccgcatgggacttcgggtccgtcggcggggtcttaaactcactcggtaagatggtacaccaaatctttgggtccgcttacactgcactgttcagcggagtgtcgtggattatgaagattggcatcggggtccttctcacctggatcgggttgaatagcaagaacacttccatggcattctcctgcatcgccatcggcatcataaccctgtacgtgggcgtggtggtgcaggcggacatggggtgcgtgattaactggaagggcaaggagctcaagtgcggctccgggatcttcgtgacgaacgaggtacatacatggaccgagcagtacaagttccaggccgacagcccgaagcgccttgccaccgccatcgccggagcgtgggagaacggtgtgtgtggcattcggtccacgacccgcatggagaacttgctctggaagcagatcgctaacgagctgaactacatcctctgggagaacaatatcaagttgacagtcgtggttggggacatcacgggcgtgctagagcagggcgaacggacgctgacaccccagcccatggagttgaagtactcgtggaaaacctgggggaaggcgaagatcgtgaccgcggagacccagaactcatccttcatcatagacggcccatccaccccggagtgcccctctgctagccgagcctggaacgtgtgggaagtcgaggactacgggttcggcgtgtttaccaccaacatctggctgaagctgcgcgaggtatatacccagctctgcgaccaccgcctgatgtccgctgccgtcaaggatgaaagggccgtgcacgccgacatgggctactggatcgagagccagaagaacgggtcctggaaactggagaaggcctccctcatagaggtgaagacgtgcacctggcctaagtctcacacgctgtggtccaacggcgtactggagtcggacatgatcatccccaagtcgctcgccgggccgatctcccagcacaaccaccgccccggctaccacacccaaacagccggcccctggcacctaggtaaactggagctcgactttaactattgcgagggcacgaccgtggtgatctccgagaactgcggtacccgggggccgtccctgcgcacgaccaccgttagcggtaagttaatccacgagtggtgctgtcggtcctgcacgctgccacccctgcgctacatgggcgaggacggttgctggtatggcatggagatcaggcccatcaacgagaaggaggagaacatggtgaaatcactggcctcggcgggaagcgggaaggtagacaacttcaccatgggagtcctctgcctcgccatactgttcgaggaggtgatgcgcggaaagttccgtaagaagcacatgatagccggtgtcctgttcaccttcgtgctgctactctccgggcagatcacctggcgcgacatggcccataccctcatcatgattggcagcaatgccagcgaccggatggggatgggggtgacgtacctggcgctcattgctaccttcaaaatacaaccgttcctggcccttggattcttcctccgaaagctgacctcccgggagaacctgttgctgggagtcggcctggccatggcggccaccctccgcctgcccgaagacatcgaacagatggccaatggcattgcccttgggctcatggccctgaaactgatcacccagttcgagacctaccagctctggaccgccctggtctctctgacctgttccaacactatattcaccctcaccgtggcctggcgcacggctacgctgatactggcagggataagcctcctgcccgtgtgccagtccagttccatgcggaagaccgactggctgcccatgacagtagccgcgatgggggtgcctcccctccccctgttcatattcagcctgaaagacaccctcaagcgaaggtcttggcccctgaacgagggagtaatggcagttgggctggttagcatactcgcctccagcctgctgcgcaacgacgtgccaatggccgggcccctcgtagccggcggcctactgattgcgtgctacgtgattactggcacctccgcggacctcaccgtcgagaaggcagccgacgtgacctgggaagaggaggctgagcagacgggggtgagccacaacctgatgatcaccgttgacgacgacgggaccatgcggatcaaggatgacgaaaccgagaatatcctgaccgtgctcctgaagacggcgcttctcatcgtgtccgggatcttcccctacagcatccccgccacactactggtttggcacacctggcagaagcagacacagcgctccggggtgctgtgggatgtcccgtcgcccccggagacgcagaaagccgagctggaggagggcgtctaccgcataaagcagcaggggatcttcggcaaaacccaggtgggggtgggcgtgcagaaggagggggtcttccacacaatgtggcacgtcactcgcggcgccgtcctgacgcacaacggtaaacgtctcgagccaaattgggcgagcgtgaagaaggacctgatcagctatgggggaggttggcgcctgagcgcccaatgggccaaagggggagaaacccaggtgattgccgtcgagcctggcaagaaccccaagaactttcaaacaatgcccggcatcttccagaccacgaccggggagatcggcgcgatcgcccttgacttcaagcccggtacatccggcagcccgataataaaccgcgagggcaaggtggtagggctctacggcaacggggtcgtgaccaagaacggcgggtacgtgtccggcatcgcccagacgaacgcggagctggacggccccacccccgagctggaggaggagatgtttaagaagcgcaacctcaccatcatggatctgcacccggggagcggtaagacccggaaatacctgcccgccattgtccgagaggccatcaagaggcgcctccgcacgctgatcctggcccccacccgagtggtcgccgccgagatggaggaggcccttaaggggctgcccatccgctaccagaccaccgccacaaagtcagagcacaccggccgcgaaatcgtcgacctgatgtgccatgcgaccttcacgatgaggctcctgtcaccggtgcgcgggtcgaactacaacctgatcataatggacgaggcccatttcactgaccccgccagcatcgccgcgatcggctacatttccacccgcgtaggcatgggcgaagccgccgcgatcttcatgaccgccacacccccggggacggtcgacgctttcccgcagagcatcccacccatccaggacgaagaacgggatatcccggagcgctcctggaacagcggaaatgagtggatcactgacttcgtaggcaagaccgtttggttcgtcccgtccatcaaggccgggaacgacattgccaactgcctccggaagaacggcaaaaaggtgatccaactgagccgcaaaacgttcgacacagagtatcagaagaccaagctgaacgactgggacttcgtggtcaccaccgacatctccgagatgggcgcgaacttcaaggcagaccgtgtgatctacttgagaaggtgcctgaaaccagtgatcctgacaaacgggcccgagcgcgtcatcctcgcgggccccatgccggtgaccgtggcatcagccgcccagcggagggggcgggtcggccgaaatccccagaaggagaatgaccagtacatttttatggggcaacccctgaacaacgacgaggatcacgcccactggaccgaggcgaaaatgctgctggacaatatcaacacccccgagggtatcatcccagcactcttcgagccagaacgggagaagtccgccgccatcgacggcgagtaccgcttgaagggggagagcagaaagaccttcgtggaactcatgcgccgaggtgaccttccagtttggctagcgcacaaggtcgcctccgaagggatcaagtacacggatcgcaaatggtgttttgacggcgagcggaataatcagatccttgaggagaacatggacgtggaaatatggaccaaggagggtgagaagaagaactggcgcccgcggtggctggacgcccggacctatagcgatccgttggccctcaaggagttcaaggactttgctgcggggaggaaaagcatcgcactggacttggtcaccgagatcggccgagttccctcccacctcgcccataccgtgcgcaacgcccttgacaacctggtgatgttgcacaccagcgagcacggtggccgggcctatcgccatgcggtggaggaactccccgaaaccatggagaccttactcctgctgggcctcatgatcctgctgaccgggggagccatgttattcttgatttccgggaaaggcataggcaaaaccagcatcggcctgatctgcgtgatcgcctcgagcgggatgctctggatggccgatgtccccctccagtggatcgcctccgccatcgtgctggagttcttcatgatggttctcctgatcccggagcccgagaaacagcggacaccccaggacaaccaactggcctatgtcgtgataggcatactcacgctggccgcgatcgttgccgcgaacgagatggggctgctcgagacgaccaagcgcgacctggggatgtctaaggagcctggcgtcgtttcccccaccagctacctggacgtggatctccaccccgcctccgcctggaccctgtacgcggtcgcaacgcctgtgattacaccgatgttacggcacaccatcgagaacagcaccgccaacgtgtcgctggcagcgatcgccaaccaggcggtcgtactgatggggctggacaagggctggcccattagtaaaatggacctcggtgtgcccctgctcgccctgggctgttactcccaagtcaaccccctgaccctagccgccgctgtcctcctgctggtgacccattacgcgatcatcggccctggtctccaagccaaggcaacccgtgaggcgcagaagcgaaccgcggcgggcataatgaagaatcccaccgtagatggtatcatgaccatcgatctggaccccgtgatttatgacagcaaattcgagaaacagctgggccaggtgatgctgctggtcttgtgcgcggtgcagctcctgttaatgcgcaccagttggcccctctgcgaggtgcttgccctggccaccggtccgataacgacactctgggaggggagccccggcaaattctggaacaccacgatcgctgtctccatggccaatatcttccgggggagttatctggccggtgctggactggccttcagcattatgaagtccgtgggtacgggaaagcgcgggaccggcagccagggggagactctcggcgaaaagtggaagaagaagctaaaccagttatcccggaaggagtttgatctctacaaaaagagcgggatcacggaggtggaccggacggaagcgaaggagggcctgaaacggggcgaaatcacccaccacgccgtatcccgcgggagcgccaagttgcagtggttcgtggagcggaacatggtgtttccggagggccgcgtcattgacttagggtgcggcagaggtgggtggtcctactactgcgccgggctgaagaaggtaaccgaggtgcgcgggtacaccaagggcggtcctggacacgaggagcctgtccccatgagcacctacggctggaacatagtgaagctgatgtccggcaaggacgtgttttacctgccccctgagaaatgcgacactctcctgtgcgacatcggcgagagctccccgagccccaccgtcgaggaatcccgcactatccgggtgctgaagatggtggagccctgggtcaagaacaaccagttctgcatcaaggtgctcaacccctacatgccgtcggtgatcgagcacctggagaatctgcaacgcaagcatgggggtatccttgtccggaaccccctgtcccgcaacagcacccacgagatgtactggatttccaacgggactggcaacatcgtgagttccgtgaacatggtgagccggctgctcctcaaccgcttcacaatgacccatcggcgacccaccattgagaaggatgtagaccttggcgccggaacgcggcacgtcaacgccgagcccgagacaccgaacatggatgtgattggcgagcgcataaaaagaatcaaggaagaacacagctccacctggcactacgacgacgagaacccctacaagacctgggcctatcatgggagctacgaggtgaaggccacgggctcggcgagttccatgatcaacggggtagtgaaactcctgaccaagccctgggacgttgtcccgatggtgacccagatggcaatgaccgatacgaccccattcgggcagcagcgcgtgttcaaggagaaggtagacacccggacaccccgcccaatgcctggcacgcggaaggtgatggagataaccgccgaatggttgtggcgcaccctggggcggaacaagcgcccccgtctttgtactcgggaggagttcacaaagaaagtgcgtaccaacgccgcgatgggcgccgtctttaccgaggagaaccagtgggacagcgcgcgggccgccgtggaggacgaggagttttggaagctggtggatcgcgagcgggagcttcacaagctggggaagtgcggctcctgcgtatacaacatgatggggaagcgcgagaaaaagctgggcgagttcggcaaggccaaggacagccgggccatctggtatatgtggctcggggcgcgctacttggagttcgaggcccttggcttcttaaacgaggatcactggttctcccgagaaaattcttacagtggggtggagggcgaggggctgcacaagctgggctatatcttgcgcgacatcagcaagatcccgggcggggccatgtacgccgatgacaccgccggctgggatacacggatcaccgaggatgatctgcacaacgaggagaaaatcacccagcagatggcgcgcgagcaccgccagctggcgaacgcaatcttcaagctcacctaccaaaacaaggtggtcaaggtgcagcgcccaacgccaaagggcaccgtgatggacattatatcccgaaaggatcaacgcggcagtggacaggtcgggacctacgggctgaacaccttcacgaacatggaggcccagctaatccggcaaatggagggggaaggcgttctctcaaaagcagacctcgagaatccccacccgctggagaagaagatcacccagtggctcgagaccaagggagtggaacgcctgaagcggatggcgatcagcggcgacgattgtgtcgtgaagcccatagacgaccgttttgccaacgccctgctcgccctgaatgacatgggcaaggtgcggaaggacatcccgcagtggcagccatccaaggggtggcacgactggcagcaagtccctttctgtagccatcacttccatgagcttatcatgaaagacggccggaagctagtggtgccctgtcggccgcaggacgagctgctggggaaggccaggatatcccagggcgctgggtggagcttaagagaaaccgcgtgcctcggcaaggcctacgcccagatgtggaccctgatgtatttccaccggcgtgacttgcggttagcgagtaacgcgatttgctccgccgtacccgtgcactgggtccccacttctcgcaccacctggagcatccatgcccaccatcaatggatgaccacagaggatatgctgacggtctggaaccgagtatggatcgaggacaatccctggatggaggataagacaccggtaacgacgtgggaggacgtcccctacctcggcaaacgcgaggaccagtggtgcgggtcgctgatcggactcacttcccgagccacctgggcgcagaacatcctcacggccatccaacaggtgcgcagcctgattggtaacgaggagtttctggactacatgccctccatgaagcggttccgcaaggaggaagagagcgagggcgcaatctggtag

SEQ ID NO: 26010 - RNA, 9873 nt, synthetic construct
  misc_feature 1..9873: note = derived and/or modified CDS sequence (opt11) from DENV-3__EU529683__SS-prME
  source 1..9873: mol_type = other RNA
acctcgctttgcctaatgatgatactcccggccgccctggcgtttcaccttacctcacgggatggggaaccgagaatgattgtgggcaaaaacgaacgcggaaaaagccttctgttcaaaactgccagcggaataaacatgtgcaccctcatagccatggatctgggtgaaatgtgcgacgacacggtaacatacaaatgtccccacataaccgaagtggaacccgaagacatcgactgctggtgtaacctgacatccacttgggtcacgtacggaacgtgcaaccaagcaggagaacatcgaagagacaagcggagcgtggccctcgcaccccatgtcggaatgggactagacacccgcacgcaaacgtggatgagcgcggaaggagcgtggaggcaagtagaaaaggttgagacttgggccctccgccaccccggcttcactatattggctctatttttggcacactatataggaacatccctaacccaaaaggtcgtaatattcatactactaatgctagtcacgccatcaatgacaatgcgatgcgtaggggtgggaaacagagacttcgtggaggggctgagtggagcgacgtgggttgacgtggtgctggagcacggaggatgcgtcaccacaatggccaaaaacaaaccgacattagatatagaactccagaaaaccgaggcaacacaactagcgacacttcggaagctgtgcatcgaggggaagatcacaaacataacaacagactcacgatgccctacacaaggcgaagcagtgctacccgaagaacaagaccaaaattatgtctgcaaacatacgtatgtagaccgagggtgggggaatgggtgcggactgtttggcaagggcagcctagtaacgtgcgcgaagtttcaatgtctagagccgatcgaagggaaggtggtccaatatgaaaatctcaaatacacagtcataatcaccgtccacacaggcgaccaacatcaagtagggaatgaaacccaaggagtaacagcggagatcactccacaagcgagcacaaccgaggcaatactccccgaatatggaaccttaggactagagtgctcaccgaggacaggattggactttaacgaaatgatactactaacaatgaaaaacaaggcctggatggtacaccgacaatggtttttcgacttaccactgccgtggacctccggagcgacaaccgaaacgccgacgtggaatcgaaaagaattactggtcacatttaagaatgcgcacgcgaagaagcaagaggtggtggtcctgggcagccaagaaggcgcaatgcacaccgccttaacaggagcaacagaaatccagaatagcggaggaacgagtatattcgccggccaccttaaatgccgactcaaaatggataaactggaactgaagggaatgagctacgctatgtgcacaaacactttcgtattgaagaaagaagtcagcgagactcaacacggaaccattcttatcaaagtcgaatataagggagaagacgtcccctgcaagattccatttagtaccgaggacggacaaggcaaggcacacaacggcagactaataactgcaaaccccgtcgtaacaaagaaggaagaacccgtcaacatcgaagccgaaccaccatttggtgaaagtaacattgtgatcggaattggcgacaatgccttaaaaatcaattggtacaagaaaggctcgtcgataggcaagatgttcgaggccacagcacggggagcacgccggatggcaatactgggagacactgcgtgggactttggatccgtaggaggggtactaaatagtctaggaaaaatggtgcatcagatttttggcagcgcgtatacagccctcttctccggcgtatcatgggtcatgaaaataggcatcggagttctgctcacctggataggactcaacagcaagaacactagcatgtccttcagttgcatcgcaataggaattatcacactgtacctcggggccgttgtccaagctgacacgggatgcgtgatcaactggaaagggaaagaattgaaatgcggatcgggcatattcgtcactaacgaggtgcacacgtggacagaacaatacaagttccaagcggattcaccaaagaggctagccacagcaatcgctggagcatgggaaaacggggtatgcggtatcaggagcacgactcgcatggaaaacctcctctggaaacagatagccaatgaacttaactatatcttatgggagaacaacattaaactaacagttgtagtaggcgacatcatcggcgtactagaacaaggaaaaaggacgctcacgcctcagcccatggaactcaagtattcatggaaaacctggggaaaagcaaggattgtaacagcagagacccaaaacagttccttcatcatcgacggccccaacacacccgaatgcccaaacaccagcagggcatggaatgtatgggaagtggaagactatgggtttggggtgttcacaacaaacatatggctgaaacttcgcgaggtgtacacgcagctgtgtgaccaccggttaatgagtgcagcagtcaaagatgaacgtgcagtgcatgcggacatgggatactggatagagtcccagaaaaacggcagctggaagctcgaaaaagcgtccctgatagaggtaaaaacctgtacctggccaaaatcacataccctctggagcaacggtgtactggaatctgacatgatcatccctaaaagcctagctggaccgatcagccaacacaactaccggcccgggtaccacactcagacagcgggaccgtggcatctaggcaaactagagttggatttcaactactgcgagggtaccacagttgtgataacagaaaactgcggcacacggggtccgagcctacgaacgactaccgttagcggcaaattgatccacgagtggtgctgccgcagctgcacactaccacccctgagatacatgggagaagacggctgctggtacggcatggaaatacgccccatatccgagaaagaagagaatatggtgaagtcattggtatcagccggaagtggagaggtagacaattttaccatgggggtactgtgcctagccatcttattcgaagaagtcatgcgagggaaattcggcaagaagcatatgatagcaggagtcttcttcacattcgtactgctacttagcggccaaataacgtggcgcgacatggcgcacaccctcataatgatagggtccaacgcaaccgaccgaatgggcatgggggtgacgtacttggcactaatagcgacctttaaaattcaaccgttcctggcacttgggttctttctaagaaaactaacgtccagggaaaacttactcctaggagttggactagcaatggccaccactctccaactcccagaagacatagaacaaatggcgaacggaatagccctcggattaatggccctcaagctcatcacacaattcgaaacctaccaactgtggaccgcgctcatatcattaacatgtagcaacacgatttttacactaacggtagcctggaggacagcgactttgatcctagcaggcgtatcgctcctaccagtatgccaatcgtccagtatgcgcaaaactgactggcttcctatgacagtggcagccatgggggttccacccctacctcttttcatattctcgctaaaggacaccctgaaaagacgcagttggcccctcaacgagggggtaatggcggtaggcctcgtaagcatcctcgcttcatcgctcctccgcaacgatgtcccaatggcaggccccctggtagctggtggcctattaatcgcatgctacgtcataactggcacttcggcggacttaacggtcgagaaagcagcagacgtcacgtgggaagaagaagcagaacaaacgggtgtcagtcacaatctgatgatcaccgtggacgatgacgggacgatgcggataaaagacgacgaaaccgagaacatcctcacggtgctacttaagacggcccttctcatagtttcagggatcttcccctacagcatcccagcaacactcctggtgtggcacacatggcaaaagcaaacccagaggtcgggcgtactttgggacgtcccctcaccgccagagacgcaaaaggccgaactggaggagggcgtctaccgcatcaaacaacagggaatctttggcaagacgcaggtcggcgtgggcgtacaaaaggaaggcgtctttcacaccatgtggcacgtcacaagaggtgcggtactcacgtacaacggaaaacgattagaacccaactgggcaagcgtcaaaaaggacctgatctcctatggaggtggttggagactttccgcgcagtggcagaaaggagaagaagtccaagtcattgcagtggaaccggggaaaaatcccaaaaactttcaaacaatgccgggcacgttccagacgacgacgggcgaaatcggcgctatagccctggactttaaaccggggactagcggatcacctattatcaacagagaggggaaagtggtgggactgtacggcaacggtgtggtgaccaagaacgggggatacgtttccgggattgcccaaacaaacgccgagccggatggcccgacgccggagctcgaagaggagatgtttaagaaacgcaacctaacaatcatggatcttcacccagggtcgggaaaaacccgtaagtacttaccagctatcgtgagggaggcaataaaacgccggttacggacactaatattagccccgacaagggtcgtagcagccgagatggaggaagcattaaagggactaccaattcgctaccaaacaacggctaccaaatcagaacacacaggccgggaaatcgtggaccttatgtgccacgccacctttaccatgcgattactgagccccgtgcgcgtcccaaactataatctgataatcatggacgaggcccacttcaccgatccagcatcaatcgccgcccgcggatacatctccacgagagttggaatgggagaagcggcggcaatattcatgaccgcaacgccacccggtacggcagacgcgtttccacagtccaacgcaccgatacaagacgaagagagggacataccagagcgcagctggaactccggaaacgagtggatcacagattttgcgggaaagacagtatggttcgtacccagcatcaaggccggcaacgatattgcgaactgcctacggaagaatggaaagaaggttatccagctgagcagaaagactttcgacacagaataccagaaaaccaagctaaacgactgggatttcgtagtgacgacggatatctcagaaatgggagcaaatttcaaagccgaccgagtgatcgacccgcggaggtgcctgaaacccgtaatccttacggacggacccgaacgtgtaatcctcgccgggccaatgccagtcacggccgcatcggcggcgcagcggcgggggagggtaggaaggaacccgcaaaaagaaaacgaccagtatatatttacgggacaaccactcaacaacgacgaggatcatgcacactggacagaggccaaaatgctattggataacatcaacacacccgaaggaataataccggccctcttcgagcccgagagagaaaagtcagcagcaatcgatggggaataccgcctgaaaggagagagtcgcaaaaccttcgtcgaattgatgagaagaggagaccttccagtatggctggctcacaaggtggcttccgaaggcataaaatacaccgaccggaagtggtgcttcgacggacaaagaaacaaccagattctagaggaaaatatggatgtagaaatatggacaaaagagggagagaaaaagaaacttagaccacggtggctggacgccaggacctactcagatccactcgccctcaaagagtttaaagattttgcagcaggtcgaaaaagcatcgcactcgacctagtcacggaaatcgggcgagtcccaacccatctagcgcatcgcacccgcaacgccctcgacaacctggtaatgctccacaccagcgagcacggaggcaaggcctaccgccacgcagtggaagaactaccagagaccatggaaaccctcctacttctggggttaatgatactactcacagggggagcaatgttgtttctaatatctggaaagggaataggcaaaacctcaataggtttaatctgcgtaatagcgtccagcggcatgctctggatggcagaaattccactccaatggattgcgagcgcgatagtactcgagttcttcatgatggtactactcataccggagccggagaagcaaagaacaccccaagacaaccaattggcttatgtggttatcgggattctgacattagctgccataatcgccgctaatgaaatggggctactcgagacgacaaagcgcgacctcggcatgtctaaggaacccggggtggttagtccaacaagctatctcgacgtagacctccacccggcgtcagcatggacattgtacgcagtagctactactgtcatcacgccaatgctcagacacaccatagagaactcaactgcaaacgtatccctagcggcgattgcaaatcaagccgtagtcctcatgggtctagataaaggctggccgatcagtaaaatggacctcggtgtgccacttctggcgctcggatgctattcgcaagtcaaccctctgacgttaacagcagcagtactgttgttaatcactcactatgcaataatcggccccggcttgcaagcgaaggcaactcgcgaggcacagaagcgcacggcagcaggcataatgaagaatcccaccgtagacgggataatgactatcgacttagatcccgttatatacgatagcaagtttgaaaaacaactcggacaggtcatgctactggttttatgcgcggtccaactgctcctaatgaggacgagctgggcactatgtgaagcactaacactggcaacggggccgatcaccacgctctgggaaggaagcccgggtaaattctggaacacgactatcgcggtgtcgatggcaaacatattccgaggcagttatcttgcaggcgcagggctcgcgttctcaataatgaaaagtgtaggcaccgggaaacgcggaacggggtcccaaggcgagaccctcggagaaaaatggaagaagaaactcaatcagctttcccgcaaggagttcgacctttataagaaaagtggtataacagaagtggaccggacagaagccaaggagggcctaaagcgaggagagattacccaccatgccgttagcagaggctcggcgaagctacaatggtttgtagaacgcaacatggttatcccggaaggcagagtgatagacttgggatgcgggaggggcgggtggtcgtattactgcgcgggccttaaaaaggtcacggaagtccggggatacacaaagggcggacctgggcacgaggaacctgtccctatgtcgacgtacggttggaacatagtgaagctaatgtcgggcaaagacgtcttctatctgccaccagagaagtgcgacactctgctctgcgatataggcgagagcagcccttcgccaacggtcgaagaaagccgcacaatacgcgttctaaagatggttgagccatggctcaaaaataaccaattttgtattaaggttctaaatccctacatgccggccgtcatcgagcacctcgagagactgcaacggaagcacgggggcatgctcgttcgcaatcccttgagtcgcaactccacccacgaaatgtactggataagcaacgggacaggtaacatcgttgcaagcgtcaacatggtgtcaaggctacttttgaaccgcttcactatgactcacaggaggccaacgatagaaaaggacgtggacctgggggctggcacaagacacgtaaacgcggagccggagaccccgaacatggatgtaattggcgaacgtatcaagcgcatcaaagaagaacataacagcacctggcactacgacgacgaaaatccgtacaaaacgtgggcctaccacggatcgtatgaagtcaaagcgactggtagtgcttcatctatgatcaacggggtagtgaaattgctaactaagccgtgggacgtggtaccgatggtaacgcaaatggcaatgacggacacaaccccgttcgggcagcagcgcgtattcaaagagaaagtagacacccgaaccccgcgatcaatgcccggaaccaggcgcgtcatggaaataaccgctgaatggctgtggcggaccctcggcaggaataagaaaccgaggctatgtacgagggaagagttcacgaaaaaggttagaacgaacgccgcaatgggcgcagtcttcacggaagaaaaccagtgggattcggctaaggcagccgtcgaagacgaagacttttggaaacttgttgaccgggagcgggagttgcacaaattggggaaatgcgggtcatgcgtttacaacatgatgggcaagcgtgagaagaaactgggagaatttggcaaagccaagggatcacgagccatatggtatatgtggctcggagccagatacttggagttcgaagcactggggttcctaaacgaagaccattggttctcacgagaaaactcttactccggggtagaaggtgaaggcctacataaattgggatatatcctcagggatataagcaaaataccgggaggcgccatgtacgcagacgacacggccgggtgggacacccgcataacggaagacgacctccacaacgaggagaaaatcacccaacaaatggaccccgagcatcggcaactagcaaacgcgatattcaaactgacctaccaaaacaaagtggtaaaggtacaacggcctacgcctaccggaacagtaatggacataatctcccgcaaagaccaacgtggaagcggccaagttggaacatacggactaaatacattcaccaatatggaggcccaactaataagacagatggagggagagggagtgctgagtaaagcagatctcgagaacccccatttacccgaaaagaaaataacccaatggctcgaaaccaaaggagtcgaaaggctcaaaaggatggcaatatcaggcgacgactgtgtcgtcaaaccaatcgacgaccggttcgcgaatgccctgcttgcgctgaacgacatgggaaaggtgcgaaaagacataccccagtggcagccctccaaaggctggcacgattggcagcaagtaccgttttgtagccaccatttccacgaactaatcatgaaagacgggcgaaagctagtagtaccctgccggccccaagatgagttaataggtcgtgccagaatatcccaaggggcgggttggagcctccgggagacggcgtgcttaggaaaggcctacgcccaaatgtggtccctgatgtatttccacaggagagatctacgccttgcaagcaacgcaatttgcagtgcagtacctgttcactgggtgcctaccagcagaaccacgtggtccatacacgcccaccaccagtggatgactacagaggacatgctcacggtgtggaaccgagtttggatcgaggacaacccctggatggaggacaagaccccagtgaccacatgggaaaatgtcccatacctaggaaagcgggaggaccagtggtgtgggtcactgatcggacttacctcgagagcaacatgggcccagaacatccccactgcaatccagcaagtgcgctcgttaatcgggaacgaagagttcctagattacatgccctcgatgaaacggttccgaaaagaggaagaaagtgaaggggccatctggtga

SEQ ID NO: 26011 - RNA, 9873 nt, synthetic construct
  misc_feature 1..9873: note = derived and/or modified CDS sequence (opt11) from DENV-3__EU529684__SS-prME
  source 1..9873: mol_type = other RNA
accagcctgtgcctgatgatgatcctgcccgccgccctggcgttccacctcacctcccgggacggggagccccggatgatcgtggggaagaacgagcgcggcaagagcctgctgttcaaaaccgccagcgggataaacatgtgtaccttgatagcaatggacctgggtgagatgtgcgacgacacggtgacctacaagtgcccccacatcacggaggtagagcccgaggacatcgactgctggtgcaatctgaccagcacttgggtgacctacgggacgtgcaaccaggccggagagcaccggcgcgacaagaggagcgtggccctcgcgccgcacgtgggcatggggctggacacccgcacgcagacctggatgagcgccgagggtgcctggcgccaggtggaaaaggtcgagacctgggccctgcgccacccgggtttcaccatcctcgcgctgttccttgcccactacatcggcacctccctcacccagaaggtggtaattttcatcctgctgatgctcgtcacgcccagcatgaccatgcggtgtgtgggggtgggcaaccgcgacttcgtcgagggtctgtccggggcaacctgggtggacgtggtcctggaacacggcgggtgcgtgactacaatggccaagaacaagcccaccctcgacatcgagctgcagaagaccgaggccacccaactggcgacactccggaaactgtgcatcgaaggcaagattaccaacatcaccacggacagccgctgccccacccagggcgaggccgtgctgccggaggaacaggaccagaactatgtctgcaagcacacatacgtggacagagggtggggcaacggatgtggcctcttcgggaagggctccctggtgacatgcgccaagttccagtgtctggagcccatcgagggcaaggttgtgcagtacgagaacctcaagtataccgtgatcatcaccgtccataccggggaccaacaccaggtggggaatgagacccagggggtcacggccgagatcacgccccaggccagcaccaccgaggcgatcctgcccgagtacggtaccctggggctcgagtgctccccgcgcaccgggctggactttaacgagatgatcctgctcacgatgaagaacaaggcctggatggtgcaccggcagtggttcttcgacctgcccctgccctggactagcggtgccaccaccgagacgcccacttggaacagaaaggagctcctggttacattcaagaacgcccacgccaagaaacaggaggtcgtggtgctggggtcccaggagggcgcgatgcataccgccctcacgggagccacagagatccagaatagcggggggacctccattttcgcaggccacctcaagtgcaggctgaagatggacaagctcgagctgaagggcatgtcatacgccatgtgcaccaacactttcgtcttgaagaaggaggtgtccgagacccagcacgggaccatactcatcaaggtggagtacaagggcgaggacgtcccgtgcaagatccccttcagcaccgaggatggtcaggggaaggcgcacaacgggcgcctgatcacggcgaaccccgtggtgaccaagaaagaggagcccgtcaacatcgaggcggagccaccctttggggaaagcaacatcgtgattggtatcggggacaacgccctgaagatcaactggtataagaagggctccagcattgggaagatgttcgaggccaccgcccggggagctcgacggatggccatcctgggcgacaccgcgtgggacttcgggagcgtgggcggggtactaaacagccttggcaagatggtgcaccagatcttcgggtccgcgtacacggccctgttcagcggcgtctcctgggtcatgaagatcggcatcggggtgctcctgacctggatcggtctgaacagcaagaacacctccatgagcttctcctgcatcgccatcgggatcattaccctctacctgggcgcagtggtccaggccgacatgggttgcgtgataaactggaagggcaaggagcttaagtgcggcagcgggatcttcgtgacgaacgaggtacacacctggaccgagcagtacaagttccaagcggactcccccaagaagctcgcaaccgccatcgccggcgcgtgggagaacggagtgtgtggcatacgcagcacgacccgaatggagaacctgctgtggaagcagatcgcgaacgaattaaactacatcctgtgggagaataacataaagctgacagtggtcgtgggggatatcattggggtgctcgagcagggaaagcggaccctgacaccccagccgatggagctcaagtactcctggaagacctgggggaaggcaaagatcgtaaccgccgagacccagaacagctcctttatcatcgacgggcccaacacgcccgagtgtcccagcgccagccgagcgtggaacgtgtgggaggtggaggactacggcttcggcgtcttcaccaccaacatctggttgaagttgagggaggtgtacacccagctgtgcgaccaccgcttaatgagcgctgccgtgaaggacgagcgggccgtccacgccgacatgggctactggatcgagagccagaagaacgggtcctggaagctggagaaggcaagcctgatcgaggtgaagacctgcacgtggcccaagtcccacacgctctggagcaacggcgtgctggagtccgacatgatcatccctaagagcctggccgggcccatctcccagcacaactaccgccccggataccatacccagactgcggggccctggcacctcggcaagctcgagctggacttcaactactgcgagggcacgaccgtcgtgatcacggagaactgcgggaccaggggcccttcgctccgcacgactacggtgtccgggaagcttatccacgagtggtgctgccggagctgcaccctgcccccgcttcgctacatgggcgaggacggctgctggtacggcatggagatcaggcccatatccgagaaagaggagaacatggtcaagagcctggtttccgccggatccggggaggtggacaacttcaccatgggcgtcttatgtctcgccatactgttcgaggaggtgatgcgcgggaaattcggcaagaagcacatgattgcgggggtgttcttcaccttcgtcctgctcctgtccggccagatcacctggcgggacatggcccacaccctgatcatgatcggaagcaacgcctctgacagaatggggatgggcgtgacgtacctcgccctgatcgccacctttaagatccagcccttcttggcgctcgggttcttcctacgcaagctgaccagccgcgagaacctcctgcttggcgtgggcctcgccatggccactacgctgcaactgcccgaggacatcgagcagatggccaacgggatcgccttgggcctgatggccctgaagctcatcacccaattcgagacctaccagctgtggaccgcgctaatcagcttaacgtgctctaacaccatattcacccttaccgtcgcctggcgcacggcgaccctgatcctcgcaggggtgagcctgctgccggtctgccagtccagctccatgcgcaagacagactggctccccatgaccgtggccgccatgggagtgccgccgctcccgctgttcatcttcagcctcaaggacacacttaagcggcgctcctggcccctgaacgagggagtcatggcggttggcttggtgagcattctggcctccagcttgctcagaaacgacgtccccatggcgggccccctggtggccgggggcctgctcatcgcgtgctacgtgatcaccgggacatccgccgacctgaccgtcgagaaagccgcggacgtgacgtgggaggaggaggccgagcagacaggcgtttcccataacctgatgataaccgtcgacgacgacggcaccatgcggatcaaggacgacgagaccgagaacatcctcacggtgctgctgaaaaccgccctcctgattgtgtccggcatcttcccgtacagcatcccagccaccctgctcgtctggcatacctggcagaagcagacccagcgctcgggcgtgctttgggacgtgccctccccgcccgagacccagaaggccgagttagaggagggagtctaccggatcaagcagcagggcatcttcgggaagacccaggtgggcgtgggggtccagaaggagggcgtgttccacaccatgtggcacgtgacgcgcggcgcagtcctcacctacaacgggaagcggctggagcccaactgggcatctgtaaagaaggacctgatcagctatggcggggggtggcgcttatcggcccagtggcagaagggggaggaggtgcaagtcatcgccgttgagcccggcaagaaccccaagaacttccagactatgcctggcactttccagacgaccaccggggagatcggagcgatcgcactggacttcaagcccgggaccagtggatcacccatcattaatcgggaaggcaagatcgttgggctgtacggcaacggcgtcgtgacgaagaacggcgggtacgtatccggcatcgcccaaaccaatgccgagccggacggccccaccccagagctggaggaagagatgttcaagaaacgcaacctcaccatcatggacctgcaccccgggagcggcaagacacgaaaatacctgccggccatcgtcagggaggcgatcaaacggcgactccggacccttatcctggccccaacccgcgtggtggccgccgagatggaggaggccctcaaggggctgcccatccggtaccagaccacagcgacgaagtccgagcataccggtcgcgagattgtcgacctgatgtgccacgccactttcacgatgcgcctcctgagccccgtgcgcgtgccaaactacaaccttatcatcatggacgaggcccacttcaccgaccccgcctccatcgccgcgcgggggtacatatccacccgcgtcggcatgggcgaggccgccgccatctttatgactgcgacgccgcccgggaccgccgacgccttcccgcagtccaacgcccccatccaggacgaggagcgggacatccccgaacgctcttggaactccggcaacgaatggattaccgacttcgccggaaagaccgtttggttcgtgccgagcatcaaggcaggcaacgacatcgccaactgcctccgcaagaacgggaagaaggtcatccagttgtccagaaagacgttcgacaccgagtaccagaagacgaagctgaacgactgggacttcgtggtgaccacagatatcagcgagatgggcgccaacttcaaggccgaccgagtcatcgacccgcggcgctgcctcaagcccgtgatccttaccgacggtcccgagcgggtgattctggcggggcccatgccggtcaccgcggcctccgccgcccagcgccggggccgcgtgggtcggaacccccagaaggaaaacgaccaatacatcttcaccggccagcccctcaacaacgacgaagaccacgcccactggaccgaggcgaagatgctgctggacaacatcaacacgcccgaagggatcatcccggccttattcgagcccgagcgagagaagtctgccgcaatcgacggcgagtaccggctgaagggcgagtcccgcaagaccttcgtggagttaatgcggcgcggggacttacccgtctggctcgcgcacaaggttgccagcgagggcataaagtataccgaccggaagtggtgtttcgacgggcagcgcaacaaccaaatcctggaggagaacatggacgtcgaaatctggaccaaggagggcgagaagaagaaactccggccccgctggctggatgcacggacttactccgaccccttagcactcaaggagttcaaggactttgcggcgggccgcaagtcaatcgccctggacctggtcaccgaaatcgggcgcgtgcccacccatctcgcccaccggacccgcacggctctggacaacctggtcatgctacacacctccgagcacggcgggaaggcctaccgacacgccgtggaggagctgcccgaaaccatggaaaccctgctcctgctgggcctcatgatcctgctgacaggtggggccatgctgttcctgatcagcgggaaggggatcggcaaaacctcaatcggacttatctgcgtgatcgcctcgagcggcatgctctggatggccgaaataccgctgcaatggatcgcctccgcgatcgtcctggagttcttcatgatggttctcctgatccccgagcccgaaaagcagcgcacgccccaggacaaccagctggcctacgtggtcatcgggatcctcaccctggcagccatcattgccgcgaacgagatgggcctgctcgagacgaccaagcgcgacctcggcatgagcaaagagccgggtgtggtgtcccccaccagctacctggacgtcgacctccaccccgcgtcggcttggaccttatacgccgtggcgacgaccgtgatcacccctatgctgaggcacaccatcgagaacagcacggccaacgtctccctcgccgcaatagcgaatcaggctgtggttttgatgggtctggacaaggggtggcccatcagcaagatggacctcggagttcccctgctggcactcgggtgctactcccaggtgaaccccctgactctgaccgccgccgtgctgctgctgattactcattacgccatcataggccctggcttacaagcgaaggccacgcgtgaggcccagaagcgcaccgccgcagggatcatgaagaacccaaccgtcgatggcatcatgactatcgatctggatcccgtaatctatgacagcaagttcgagaagcagctgggccaggtgatgctcctggtcttatgcgcggtacagctcctgctgatgagaacgtcctgggccttatgcgaggccctgaccctggccaccggccccatcaccacgctctgggaaggaagccccgggaagttttggaacactaccatcgcggtgtccatggccaatatcttccgcggcagctacctggccggggccggccttgctttctctatcatgaagtccgtcggcaccggcaagcgtggcaccgggtcccagggcgagacgctcggggagaagtggaaaaagaagctaaaccagctgtctcgcaaggagttcgatctctataagaaaagtggcatcaccgaggtggaccggaccgaggcgaaggaagggctgaagcgcggcgagatcacccaccacgccgtgtcccggggcagcgccaagctgcagtggttcgtggagcgcaacatggtgatcccggaggggcgggtgatcgacctaggctgcggacgcggcggttggtcctactattgcgctggcctgaaaaaggtcacggaggtgagaggctataccaagggcgggcccgggcatgaggagcccgtgcccatgagcacgtacggctggaacatcgtcaagcttatgtccgggaaggacgtgttctatctcccgcccgagaagtgcgacaccctgctgtgcgacatcggggagagctcccccagccccacggttgaggaaagccgcaccatacgggtcctgaagatggtggaaccgtggttgaagaacaaccagttctgcatcaaggtgctgaacccctacatgcccacggtcatcgagcacctggagaggctccagcgcaagcacggtgggatgctggtgaggaaccccctgagccgcaactccacccacgagatgtactggatcagcaacggcacgggtaatatcgtggcgtccgtcaacatggtgagccgactcttgttgaaccgcttcacgatgacccaccggcgcccgaccatcgaaaaggacgtggatctcggcgcgggcacgcggcacgttaacgccgagcccgagacccccaacatggacgtgataggggaaaggatcaagcggatcaaggatgagcacaactccacctggcactacgacgacgaaaacccgtacaaaacctgggcctaccatggcagctacgaggtaaaggccacggggtccgccagcagcatgatcaacggcgtcgtgaagctgctgaccaaaccctgggacgtcgttcccatggtaacccagatggcgatgaccgacacgaccccctttgggcagcagcgcgtattcaaggagaaggtggacaccagaaccccgcgcagcatgcccggcacgagacgggtgatgggcatcaccgctgaatggctctggagaaccctggggcgaaacaagaagcctcggctgtgcacccgcgaggagttcacgaagaaggtccggaccaacgccgctatgggcgccgtgttcaccgaggaaaaccagtgggactccgccaaggcggccgtggaggacgaggacttctggaagctcgtcgacagagagcgcgaactgcacaaacttggaaagtgcggctcctgcgtgtacaacatgatggggaagcgggagaagaagctaggcgagttcggcaaggccaagggaagccgcgcgatttggtacatgtggctgggggccagatacctcgagttcgaggcactcggattcctgaacgaggaccactggttctcccgcgagaacagttactccggcgtagagggggaaggcttgcacaagctgggctatatcctgcgggacatcagcaagatccctgggggcgccatgtacgccgacgacaccgccgggtgggacacccgcatcacggaggacgacctgcacaacgaggagaagatcacccagcagatggacccggaacaccggcagcttgccaacgccatcttcaagctgacgtaccagaacaaggtcgtgaaagtgcaacgccccactcccacgggcaccgtcatggacatcatctcccggaaggaccagcgcggctcgggccaggtgggcacctatgggctgaatacgttcactaacatggaagcgcagctcatccggcagatggagggcgagggggtgctgtccaaggccgatctggagaatccccacctcccagagaagaagattacccagtggctggagaccaagggcgtcgagcgcctgaagcggatggcgatcagcggcgacgactgcgtggtgaagcccatcgacgaccgattcgccaacgccctcctggccctgaatgacatggggaaggtccggaaggacatcccccagtggcagccatccaagggctggcacgactggcaacaggtcccgttctgtagccaccacttccacgagctcatcatgaaggacgggcgcaagctggtagtcccgtgccggccccaggacgagctgatcggccgcgcccgcatttcccagggggcgggctggagcttacgcgagaccgcctgcctgggcaaggcctacgcccagatgtggtccctcatgtacttccatcgccgcgacctccgcttggcgagcaacgcgatctgctctgccgtgcccgtgcactgggtcccaacttcgcggaccacatggtccatccacgcccaccatcaatggatgactacagaggacatgcttaccgtgtggaatcgcgtgtggatcgaggacaacccctggatggaggataagacgccggtcaccacgtgggagaacgtgccctacctcgggaagcgggaggaccagtggtgcggcagcctgatagggctgaccagccgcgccacctgggcgcagaacataccgaccgccatccagcaagtccggtccctcatcggtaacgaggagttcctggactacatgccctcgatgaaaaggttccggaaggaggaggagtccgagggtgctatctggtga

SEQ ID NO: 26012 - RNA, 9873 nt, synthetic construct
  misc_feature 1..9873: note = derived and/or modified CDS sequence (opt11) from DENV-3__FJ182015__SS-prME
  source 1..9873: mol_type = other RNA
acgtcactctgcctgatgatgatcctgccggccgccctggcttttcaccttacaagtcgggacggcgaaccccggatgattgtggggaaaaatgaacggggcaagtccctacttttcaaaaccgctagcgggatcaatatgtgtacattgatcgccatggacctaggcgaaatgtgcgacgacacggttacgtataagtgcccccacatcactgaggttgagccagaggacatcgattgctggtgcaacctgacgtcaacctgggtaacttatgggacatgcaatcaagccggcgagcaccggcgcgataagcggtcggtagcgcttgcgccgcacgtaggcatgggtctggatacccgcacgcagacatggatgtcggctgaaggcgcgtggcgccaagtagagaaggtagagacctgggccctgagacacccggggttcacaatcctcgcgctgttcctcgcccactacatagggaccagtctaacccagaaagtagtgatcttcatactgctgatgcttgtcacgccgagcatgactatgagatgcgtgggcgttggaaacagggacttcgtggagggcctgagcggagccacctgggttgacgtggtactggagcacgggggttgcgtgacaaccatggccaagaacaagccgactcttgacatagagctgcagaagaccgaagccacacagcttgcgacgctcaggaagctgtgcatagaaggaaaaatcactaacataacgaccgattctcgctgccctacccagggggaggccgtgctcccggaggaacaagaccagaattacgtatgtaagcatacatacgtggaccgggggtggggaaacgggtgcggcttattcggtaagggctcgctcgtgacctgcgcgaaattccaatgcctcgaacccatcgaaggcaaagtagtccaatacgaaaatttgaagtacaccgtgataataacggtccacacaggggaccagcatcaggtgggcaatgaaacccagggggtcaccgcggagatcacaccccaagccagtacgaccgaggcgatcctcccggaatacggaaccctagggttggagtgttccccacgcaccggcttggatttcaacgagatgatcctgcttacgatgaagaacaaagcctggatggtgcaccggcagtggttcttcgacctacccctgccgtggacgagcggcgccacaactgagacgccaacgtggaacagaaaggaactcctggtgacattcaagaacgcccatgccaagaagcaagaggtcgtggtgctggggtcacaggaaggcgcgatgcacactgccctcactggggcgactgagattcagaacagcgggggcacgtcgatatttgccggacacctgaagtgccgtttaaagatggacaagctcgagctcaagggcatgtcctacgccatgtgcacgaacacgtttgtactcaagaaggaggtctccgaaacccagcacggcaccatattaatcaaggtggaatacaagggcgaggatgtgccgtgcaaaatccccttctcaaccgaagatgggcagggaaaggcccataatggtagattaattacggccaacccggtggtaaccaagaaggaagaaccagtcaacatcgaggccgagcctcctttcggggagtcgaatatcgtgatcgggattggggataacgcattaaaaattaactggtacaaaaagggcagcagtatcggcaagatgttcgaagcgaccgctagaggagcgcgccggatggcaatcctgggcgacacagcttgggacttcgggtccgttggaggcgtcctcaatagcctgggcaagatggtgcatcagatatttgggtccgcgtatacggcgttgttcagcggcgtgtcctgggtcatgaagatcggcattggtgtgctattaacctggatcggcctcaacagcaagaacaccagtatgtcgttctcctgcatcgccatcggtatcatcaccctatacctgggcgccgtcgtgcaggccgacatggggtgcgtcatcaactggaaagggaaggagctgaagtgtggcagcgggatatttgtgacgaacgaagtccacacctggaccgaacagtacaagttccaggcggactcacccaaacgcctcgctactgcaatcgccggggcctgggagaacggggtgtgcggtatcaggagcacgacccggatggagaaccttctatggaagcaaatcgcaaatgagctcaattatattctgtgggagaacaacataaagttaaccgtagttgttggtgatataattggcgtcttggagcagggcaagcgaactctcacgccccagccgatggaactgaagtattcctggaagacctgggggaaggcgaagatcgtcaccgctgaaacccagaactcttcgttcatcatagacggacccaacacgcccgagtgtcctagcgccagccgggcgtggaatgtatgggaagtagaagactacggtttcggggtctttacaaccaacatctggctaaagctgcgcgaggtgtacacccaactctgcgaccaccggctgatgagcgcagccgtcaaggacgagcgcgccgtgcatgcggacatgggctactggatcgaatcccaaaagaacgggagctggaagctggagaaggcgagcctgatcgaggttaagacctgcacatggccgaagtcccacaccctgtggagtaatggcgtcctggagtcagatatgattataccgaaaagcctggccgggccaatctcccagcataactatcgacctggataccatacacagaccgccgggccctggcacctaggaaaactggaactggacttcaactactgcgaggggacgacagtcgtgatcacagagaactgcggaacacgcggaccatcgctccgcacgaccaccgtgagtggaaaactcattcacgagtggtgttgcagatcatgtaccttgcccccgttgagatacatgggcgaagatgggtgctggtacgggatggagattcgccccatctctgagaaggaggagaacatggtcaaatcgcttgtgagtgccggctcaggggaagtcgataacttcaccatgggcgtcctgtgcctcgccatactgttcgaggaggtaatgcgggggaaattcggcaaaaagcacatgattgccggggtgttcttcaccttcgtccttcttctatccggccagataacctggcgcgacatggcccacaccctgatcatgatcggttccaacgcgtccgaccggatgggaatgggcgtgacctatttggccctgatcgccacctttaagatacagccattcctggcgcttgggttcttcctgcgcaagctaaccagccgtgagaacctcctgcttggcgtcggcctggccatggccacgacattacagctacccgaggacatcgaacagatggccaacgggatagcgctcggcctgatggcattgaagctcataacccagtttgagacctaccagctgtggaccgccctaatttcgctaacgtgcagcaacaccatctttaccctgactgtcgcctggcgcacggccaccttaatcctggcgggggtgtcgctcctgcccgtctgccagtcgtcttccatgcgcaagacagactggctcccaatgaccgtggccgccatgggcgtgccgccccttccactgttcatattttcccttaaagacacactgaagagacggtcctggcccctcaatgagggggtaatggcggtaggtctagtaagcatcctggcctcaagcctgctgcgcaatgacgtccccatggcaggcccgcttgtggccggcggccttctcatagcgtgctacgtgatcactgggacctccgccgaccttaccgtcgagaaggccgcagacgtgacatgggaggaggaggctgagcagaccggggttagtcacaatctgatgatcaccgtcgacgacgacggcaccatgaggatcaaggacgacgaaaccgaaaacattctcaccgtgcttctgaagaccgctctccttatcgtgtcaggaattttcccgtacagcatccctgcgacactgttggtctggcacacctggcagaagcaaacccaaagatcaggcgtactgtgggacgtaccctccccgcctgagacacagaaagcggagctagaggaaggtgtgtaccgcatcaagcagcaaggcatcttcggaaagacgcaagtaggcgtcggggtccagaaggaaggcgtattccacaccatgtggcatgtcacgcgtggtgccgtcctcacatacaacgggaagagactcgagcctaattgggcgtccgtgaagaaggacttaatctcctatggcgggggctggaggctcagtgctcagtggcagaagggggaggaggtgcaggtcatagccgtagagccaggaaagaatcccaagaatttccaaaccatgcccggcaccttccagaccaccaccggggagatcggcgccatcgccctcgacttcaagccagggacgtctggtagccccattatcaaccgcgagggcaaggtggtagggttatatggtaacggtgtggttacgaaaaacggtgggtacgtctccggcattgcgcagacaaacgccgagcccgatggcccgacgccagagttagaggaagaaatgtttaagaagcggaacctcaccatcatggatctgcaccccgggagcggaaaaacgcgcaagtaccttccggccattgtacgtgaggcaatcaaacggcggctgagaactctgatcctagcgcccacccgcgtggtagccgcggagatggaggaagccctcaaaggattgcccatccgctatcaaacaactgctactaagtccgaacacaccggccgggaaatcgtggacctgatgtgccacgcaaccttcacgatgcgtctcctgtcccccgtacgggtgccgaattacaacctgatcatcatggacgaggcccatttcaccgaccccgcctccatcgccgcgagggggtatatatcaacacgggtgggtatgggcgaggcggccgccatcttcatgaccgcgacgccaccggggacggcagacgcatttccacagtccaacgcccccatccaggatgaagaacgggacatccctgaacgctcgtggaactcgggcaacgagtggattactgacttcgccgggaagacagtgtggtttgtgccctctattaaggcaggcaacgacattgccaactgtctccggaaaaacgggaagaaggtgatccaattatctcgcaagacgtttgatacagagtaccagaaaaccaaactgaacgactgggacttcgtagtcaccaccgatataagtgaaatgggagccaatttcaaggccgatcgggtcatcgacccgcgccggtgcctcaagcccgtcatcctgactgacggccccgaacgcgtcatcctggccggccccatgccggtgacagcagcctcagccgcccagcggcgcggtcgggtgggacgcaatccgcagaaggagaatgaccaatacattttcactggccagcccctaaataacgacgaggaccatgcacactggacagaggcgaaaatgcttctggacaacataaatacgcccgagggaatcataccggcactcttcgagcctgagcgggagaagtccgccgccatcgatggcgagtatcggctgaaaggagaatccaggaagactttcgttgagctgatgcgtcgcggagaccttcctgtgtggctagcgcataaggtcgccagcgagggaataaagtacaccgaccgaaagtggtgctttgacgggcagcgcaataaccagatcctagaagaaaacatggacgtggagatttggacaaaagagggcgagaagaagaagttgcggccccgctggctggacgctcgaacttatagcgacccgcttgcactcaaggaatttaaggactttgctgcgggacgcaaaagtatcgctctggatcttgtaacggaaatcggacgggtccccacccacttagcccatcgcactcggaacgccctggacaacctagttatgctccatacgagtgagcacgggggtaaggcttaccggcatgccgtcgaggagttacctgagaccatggagactctgttattgctgggcctcatgattctgctcacagggggcgctatgctattcttgatcagcggcaaaggtatcggcaagaccagcatagggctcatttgcgtaatcgcctccagcggaatgttatggatggccgagattccgctgcagtggatcgcctccgcgatcgtgctggagttctttatgatggtgctgttaatacccgagcctgagaagcaacggactccacaggataatcaactcgcctatgtagtaatcgggatcctcaccctggcggccatcatagcagcgaatgagatgggcctgctcgaaacgacgaagcgtgacctgggcatgagcaaagagccaggggtggtgtccccgacgtcttacctcgatgttgacctacacccagcatccgcctggaccttatacgccgtcgccacgacggttatcacccccatgctacggcataccatcgaaaatagcaccgccaacgtcagcttggccgccatcgccaatcaggccgtggttctcatgggcctggacaaggggtggccgatcagcaagatggacctcggcgtgcccctgctggctctgggatgttactcacaagtaaacccgctgactctcacagccgccgtgctgctgctcatcacccactacgccatcataggacctgggctccaggctaaggccacgcgagaggctcaaaagcggactgccgcagggatcatgaaaaaccctaccgtagacggcatcatgaccatcgacttggaccccgtgatatacgattctaaattcgagaaacagctggggcaggttatgctcctggtgctgtgcgctgtgcaactcctgctgatgcgcacatcctgggccctgtgtgaagcgttgacgttggctaccggacccattactacattatgggagggctccccggggaagttctggaacacgactatcgccgtctcaatggcaaacatcttccgcggaagctacctggccggggcaggcctggcctttagcatcatgaagtccgtcggaactggtaagaggggaaccggaagccagggagaaaccttgggggaaaagtggaagaagaaacttaaccagctctcgcggaaagagttcgacctctacaagaagtcgggcatcacggaagtggaccgcactgaggccaaggaggggctgaaaaggggcgagatcacccaccacgcggtaagtcgcggcagtgccaagttgcagtggttcgtggaacggaacatggtgatcccagagggaagggttatcgatctaggctgtgggcggggcgggtggtcctattactgtgccggcttaaagaaagtgaccgaagtccggggctacactaagggcggacctgggcatgaggaaccggtccccatgagcacttacggttggaacatcgtgaagctcatgtcagggaaggatgtgttctacttaccacccgaaaagtgcgacaccctgctatgtgacatcggcgagagctcaccctcccccacagtcgaagagtcccggaccatccgagtcttgaagatggtggagccgtggttaaagaataaccagttctgcattaaggtactgaacccttacatgcccaccgtgatcgagcacctggagcggctccagcgtaagcacggcgggatgctggtgcgcaaccctctgtcgcgaaactccacccacgagatgtattggatcagcaatggaacagggaacatcgtcgcttccgtgaacatggtcagccggttactgctaaaccgtttcaccatgacccaccgccggccaacaatcgagaaagatgtcgacctcggcgcggggaccagacacgtgaacgccgagccagagactcccaacatggacgttataggggagcgaataaagcgcattaaggaggagcacaactcaacgtggcattacgatgacgagaacccgtacaagacgtgggcttaccacggctcatatgaggtcaaggccactgggagtgcatcatccatgatcaacggagtggtcaaactgttgacgaaaccctgggacgttgtccccatggtcacacagatggcgatgactgacaccacgcccttcggccagcagcgggtatttaaggagaaggtggacaccagaacaccccgtagcatgccaggcaccaggcgcgttatgggtattaccgcggaatggttgtggcgcaccctggggaggaacaagaagcctcgtttatgcacccgtgaggagttcaccaaaaaggttcgaacgaacgccgccatgggcgcggtgttcacggaggaaaaccagtgggactctgcgaaagctgccgtcgaagacgaggacttctggaagctcgttgaccgcgagagagagctgcacaagctggggaagtgcggcagttgcgtctataacatgatgggcaaacgcgagaaaaagctgggcgagttcggcaaagccaaaggttcacgtgcgatatggtacatgtggctcggagcacgctacctggagttcgaggccctcggcttcttgaatgaggaccactggttcagtcgggaaaatagctactccggggtagaaggggagggcttgcataaattaggctatatccttcgcgacatcagcaagattcccgggggtgccatgtacgccgacgacaccgcgggttgggacacccggattacggaagacgatcttcacaacgaagagaagattacccagcagatggatccggaacacagacaactcgcgaatgccatattcaagctcacctaccagaacaaggttgtgaaggtccagcggcccacgccgaccggcacggtgatggatatcatctcaagaaaggaccaacgtggaagcggacaggtgggcacctacggtctgaataccttcaccaacatggaggctcagctaatacgccagatggaaggcgagggcgtcctgtccaaggccgacctggagaaccctcatctgccggagaagaagatcacgcaatggctggaaaccaagggtgtcgaacgtctgaaacgcatggcgatctcaggggacgactgcgtcgtgaaacccatcgatgaccgattcgcgaacgccctccttgccctaaacgacatgggcaaagtacgcaaggacattccgcagtggcagccctccaagggctggcatgactggcagcaggtaccattctgttcacaccactttcatgagctcataatgaaagacgggagaaaactggtcgtgccctgtcgtccgcaggatgagctcatcggccgggcacgaatatcgcagggggctggctggagcctgagagagactgcatgtctgggcaaggcctatgcccagatgtggtccttgatgtactttcataggagggatctcaggctggcatcaaacgccatatgttccgccgttccggtgcactgggtgccaacttcacggactacctggtccatccacgctcatcaccagtggatgacgaccgaggacatgttgacagtgtggaatcgggtctggatagaagacaacccttggatggaggataaaacgccagtgaccacatgggaaaacgtgccatacctcggcaaacgcgaggaccaatggtgcggcagcttaatagggctaacgagccgtgctacctgggctcagaatattccgacagccatccagcaggtccgctcactaatcggaaacgaagagttcctggactacatgcccagtatgaagcgctttcgcaaagaggaggagtccgagggcgcaatctggtag

SEQ ID NO: 26013 - RNA, 9873 nt, synthetic construct
  misc_feature 1..9873: note = derived and/or modified CDS sequence (opt11) from DENV-3__EU569688__SS-prME
  source 1..9873: mol_type = other RNA
accagcttgtgtctcatgatgatcctgcccgccgctctggccttccacctcaccagccgagacggggaaccccggatgatcgtggggaagaatgaacgtggaaagagcctgctgtttaagaccgcatctgggataaacatgtgtaccttaatagccatggacctgggagagatgtgcgacgacacggttacatacaaatgcccacacatcaccgaggctgaacccgaggacatcgactgctggtgtaacttgaccagtacctgggtgacctacgggacgtgcaaccaagcgggagagcaccggcgcgacaagcggtcggtcgccctcgcaccccacgtgggcatggggctggacacgcgcacccagacgtggatgtcagctgagggcgcctggaggcaggtcgagaaagtggagacgtgggcgctgcgccatccaggtttcaccattctcgccctgttcctggcacactatatcggcacctccctaacccagaaggtcgtgatatttatcctgctgatgttagtgacgcccagtatgacgatgcgttgcgtgggggtgggcaaccgtgattttgtggagggcctgagcggggccacctgggtagacgtggtcctggagcacggcgggtgcgtcaccacgatggcgaagaacaagcccaccctagatatagagctacagaagacggaagcgacccagctagccacgctccgcaagctgtgtatagagggaaaaataacaaacataaccaccgactctcgctgtccgacgcagggcgaggctgtgctaccggaggagcaagaccagaactacgtgtgcaagcacacctacgtagaccgggggtggggcaacggttgcggcctcttcgggaagggatcgttggtgacctgcgcaaaattccaatgtctcgagcctattgagggcaaggtggtccagtatgagaacctcaaatacaccgtgatcatcactgtgcacactggggaccagcaccaggtcggtaacgagactcaaggggtaaccgctgagatcactccccaggcatccaccaccgaggctatcctgcccgagtatggcaccctgggcctcgagtgctccccgcgcaccggactggacttcaatgagatgatcctgttaacgatgaagaacaaggcctggatggtacacagacagtggttctttgatcttccgcttccctggacctccggcgccaccacagagacgccaacgtggaaccgcaaggagctactggtgaccttcaagaacgcccacgcgaagaagcaggaagtggtagtgttgggttcccaggagggggcgatgcacacggcgctaacgggggccactgaaatccagaacagcggcgggacctccatctttgcaggccacctcaagtgcaggctgaaaatggacaagctcgaactgaagggcatgagttacgcgatgtgcaccaacacgttcgtgcttaagaaggaggtctccgagacccagcatgggaccatactcatcaaggtggagtataagggtgaggacgtgccgtgcaagatccctttcagcactgaagacggccagggcaaggcgcacaacggccgcctgatcaccgccaaccccgtcgtgaccaagaaggaagaacccgtgaatatcgaggcggagccgccattcggtgaatctaacatcgtcatcggcattggggacaatgccctgaagatcaattggtacaagaagggctccagcatcgggaagatgttcgaggccaccgccaggggcgccagacggatggctatcctgggcgacaccgcgtgggacttcggatccgtgggcggggtgctcaacagccttggcaagatggtccatcagatcttcggctccgcctacacggcgctgttcagcggcgtgtcctgggtgatgaagatcgggatcggagtcctcctgacctggataggcctgaacagtaaaaacacctccatgagcttctcctgcatcgcgattgggattataaccctctacctgggcgccgtggtgcaggcggacatgggttgcgtcataaactggaagggcaaggagctgaagtgcggtagcgggatcttcgtaacgaacgaggtgcacacctggaccgagcagtacaagttccaggccgactcccctaaacgattagcaaccgcgattgccggtgcctgggagaacggagtctgtggcattcgctcaacgactagaatggagaacttgctatggaagcagatcgccaacgagctcaactacatcttgtgggagaataatatcaagctgactgtggtggtcggtgacaccataggcgtcctggagcagggtaagcgtactctgacgccccagccgatggaactgaagtactcctggaaaacgtgggggaaggccaaaatcgtgacggccgagacgcaaaacagctccttcataatcgacggcccaaacaccccagagtgcccctccgcgtcccgggcgtggaatgtctgggaagttgaggattacgggttcggcgtgttcaccaccaacatctggttaaagctgcgcgaggtctacacacaactgtgcgaccatcggctcatgtccgcggccgtgaaggatgagcgcgccgtccacgcggatatgggctactggatcgagagccagaaaaacggcagctggaagctggagaaagccagcctgattgaggtcaagacgtgtacatggccgaagtcccacacactctggtcgaacggggtgctggagtctgatatgatcatacccaagagcctggccggacccatatcccagcataattaccggccgggttaccatactcagacggccggtccctggcatctcggcaaactcgagctggactttaactactgtgagggcaccaccgtggtcataaccgagaattgcgggacgcgcggccctagcctccggaccaccaccgtgtccgggaagctgatacacgaatggtgctgccggagctgtacgctgccgccgctcaggtacatgggcgaggacggctgctggtatggtatggaaatccgtcccattagtgagaaggaggaaaacatggtaaagagcctggtctccgccggtagcggggaagtggacaacttcaccatgggagtgctctgcctcgccattctgttcgaggaggtaatgagaggaaagtttggaaagaagcacatgatagccggggtgttcttcaccttcgtgttgctcctatcgggacagatcacctggcgcgatatggcccacacgctcatcatgatcggtagcaacgcctccgaccggatggggatgggcgtcacatacctcgccctcattgccaccttcaaaatccaaccgttccttgccttagggttcttcctgcggaagctgacgagccgggagaacctccttctgggtgttggtctcgcaatggccacgacgctacagctccccgaagacatcgaacagatggcgaacgggattgccctcggcctgatggcccttaagctcataacccaattcgagacctaccagctgtggacggccctgatcagcctgacgtgctccaacactatcttcaccttaacggttgcctggcgcactgcaaccctgattttggccggggtcagtctgctgcccgtgtgccagtccagcagtatgcgcaaaaccgactggctgcccatgacggtcgcagccatgggggtgccgcccctcccactgttcatcttcagcctcaaggatacgttaaaacgccggagctggcccttaaacgagggggtcatggcggttggccttgtgtcgatactggcgtccagcctgctccggaacgacgtgcctatggccggccccttagtggccggaggactgttgatagcgtgttatgtgatcaccgggacttccgccgaccttacggtggagaaggcggccgacgtcacctgggaggaggaggccgaacagaccggcgtgagccataacctgatgatcaccgtggacgacgacgggacgatgagaatcaaggatgacgagacggagaatatcctcacggttctcctaaagaccgccttgctgatagtgtccggcatcttcccgtacagcatccccgccaccctactcgtgtggcacacgtggcaaaagcagacccagcggtccggcgtcctgtgggacgtgccctccccgcccgagacacagaaggcggagctggaagagggtgtgtatcggatcaagcagcagggcatctttgggaagacgcaagtcggcgtgggggtgcagaaggagggcgtcttccacacgatgtggcatgtgacgaggggcgccgtgctcacctacaacgggaagaggctggagccgaactgggcctccgtcaagaaagacctgatctcttacggcggagggtggcggctgtccgcgcagtggcagaaaggtgaggaggtccaggtcatagcggtcgagcccggcaaaaaccccaaaaattttcagaccatgcccggcacgttccagactacaaccggtgagatcggtgctattgccttagacttcaagccagggacgagcgggtcacccattatcaaccgcgaagggaaggtggtcgggttgtatggcaacggggtggttaccaagaacggcggttacgtgtccggcatcgcccagacaaacgccgagcctgacggcccaacccccgagctagaggaggaaatgttcaagaaacggaatctcactataatggacctccaccccgggagcggcaagacccgcaagtacttgccggcgatagttcgggaggccataaagcgccggctccgcacgctgatactggctcccacccgggtcgtggccgccgagatggaggaggcgctcaagggtctgcccattcgctaccagacgaccgccaccaagtccgagcataccggccgggagatcgtcgacctcatgtgccacgcaacgttcacgatgcgcctcctgtcgcccgtgagagtgccgaactataacctgatcatcatggacgaggctcattttacagaccccgcctccatcgcggcacgcgggtatatttccacccgggtgggcatgggcgaggccgccgcgatcttcatgacagccacaccgccagggaccgccgacgccttcccgcagtcgaacgcccccatacaggacgaggagcgcgacattccagagcggtcatggaactctggcaacgagtggataacggacttcgccgggaagacagtatggtttgtgccctccattaaggccggcaacgacatagcaaactgcctccggaaaaatggcaagaaagtaattcaactgtcccgcaaaaccttcgacactgagtaccagaagaccaagttgaatgactgggattttgtggtcacgaccgacatcagcgagatgggcgccaatttcaaggccgaccgggtcattgacccacgccgctgcctcaagcccgtgatcctcaccgacggccccgagcgcgtgatcctggcgggccctatgccggtgactgccgcctctgccgcccaacggcgtggccgggtggggcgcaacccccaaaaggaaaatgaccaatacatcttcaccggccagccactcaataacgacgaggaccatgcgcattggacggaggccaaaatgctgctggacaacatcaacacccccgaagggatcataccggctctctttgagcccgaacgagaaaagagcgccgctatcgacggcgagtaccgccttaagggcgagtcccggaagacctttgtggagctgatgcgccgcggggacctccccgtctggctggcccacaaagtcgccagcgagggcataaagtacaccgaccgcaagtggtgcttcgacgggcagcggaacaaccagatcctggaggagaacatggatgtggagatttggaccaaggagggcgagaagaaaaagctccgccccaggtggctggacgcccgaacgtactcggaccccctggctctgaaggagtttaaggactttgcggccggcagaaagagcattgcactggacctggttaccgagatagggcgggttcccacacacctcgcccaccgcacgcggaatgcactggacaacctggtcatgctccacaccagtgagcacggaggaaaggcgtaccgccacgccgtagaggagctgccggagaccatggagacgctgttactgttgggtttgatgatcctgctgaccggcggggcaatgctctttctgattagcggaaaggggataggcaaaacgagcatcgggctgatctgcgtgattgcctccagcggcatgctctggatggcagagatcccgctgcagtggatcgcgtccgccattgtcctggagttcttcatgatggttctcttaattcccgagcccgagaagcagcgtacgccgcaggacaaccagcttgcatacgttgtcatcgggatcctcactctggcagccattatcgcggctaacgagatggggctgttagagacgaccaaacgcgacctgggcatgagcaaggaaccgggtgtggtctccccgacgtcgtacctcgacgttgacctacaccccgcctccgcttggaccctgtacgcggtcgcaacgaccgtgatcactcctatgctgcggcacaccatagagaacagcacagccaacgtctccctagccgccatcgcgaaccaggccgttgtactgatggggctggacaagggatggccgatcagcaaaatggacttgggcgtccccctgctggccctcgggtgctactcccaagtaaatcccctgaccctcaccgcagccgtgttactgctgattacccactatgcgatcattggacccggcctccaggcaaaggccacacgcgaggcccagaaacggaccgcagcggggatcatgaaaaacccgaccgtcgacggtataatgaccatcgacctagatcccgttatttacgacagtaagttcgagaaacagctgggccaggttatgctcctggtcctgtgcgcagtgcagctgctgctgatgcgcacctcctgggccctctgcgaggcgctaaccctcgcgaccggccccataacgaccctctgggagggtagcccggggaagttttggaacaccactatcgctgtctccatggccaacatcttccggggcagttacctggcgggggccggcctcgcgttctctatcatgaagtccgtggggaccgggaagcgaggcaccgggtcccagggtgagacgctgggtgaaaagtggaagaagaaactgaaccagctgtcccgtaaggagttcgatctgtacaagaaatcgggcatcacggaggtggaccgaaccgaggcaaaggaggggctgaagcggggtgaaatcacccaccacgccgtgtcccgtggctcggcaaagctgcagtggttcgtcgagcgaaatatggtcataccggaggggcgtgtgattgacctcggctgcggccggggcgggtggtcctactactgcgccggcctcaagaaggtaacggaggtgcgcgggtacaccaagggtgggcccgggcatgaagaacccgtgccgatgagcacctatggctggaacatcgtcaagctgatgtccggcaaggacgtgttttacctcccgcctgaacggtgcgacacgctgctgtgcgacatcggcgaaagctccccatcacccacggtggaggagtcccggaccatacgtgtcctgaaaatggtggagccgtggctcaagaataaccaattctgtatcaaggtgctaaacccctacatgcccaccgtcatcgaacacctggagaggctccaacggaaacatggcgggatgctcgtgcgaaaccccctcagcagaaactccacgcacgagatgtactggatcagcaacggcacggggaatatcgtggcgagtgtcaacatggttagccggctgctgctgaaccgcttcaccatgacccaccggcgcccgactatcgagaaagacgtggacttaggcgccggcacgcggcatgtcaacgccgagcccgagacccccaacatggacgttatcggggagcgcataaagcggatcaaagaagaacataactccacctggcactacgacgacgagaacccgtacaaaacgtgggcctatcacggcagctatgaggttaaggcaacggggtccgcgagctccatgatcaacggcgtcgtgaagctgctgacaaaaccatgggacgtagtgcccatggtaacccagatggcgatgaccgacacgacaccgttcgggcagcagcgtgtcttcaaggagaaggtggacacccgcaccccgcgctcaatgcccggcacgcggcgcgtgatgggtatcaccgccgagtggctctggcggaccctgggacgcaacaagaaaccacggctctgcacccgcgaggagtttaccaagaaagtccgcactaacgccgcaatgggcgccgtgtttaccgaggagaaccagtgggatagcgccaaggccgccgtggaggacgaagacttctggaagctcgtggaccgggagcgtgaattacataaactggggaagtgcggctcctgcgtgtacaacatgatggggaaacgggagaagaagctcggcgagttcggcaaggcgaagggctcgagagccatctggtatatgtggctgggcgcgcggtaccttgagttcgaggccctcgggttcttaaacgaggatcactggtttagtcgcgaaaacagttactccggggtggaaggcgaaggcctgcataagttaggctacatcctgcgggacattagcaagatccccggcggggccatgtacgcggatgacacggcaggctgggacacgagaatcactgaggatgacctgcacaacgaggaaaagatcacccagcagatggatccggaacacagacagctcgccaacgccatcttcaagctgacctatcagaataaagtcgtgaaggtacagcgtcccaccccgacgggcacagtcatggacatcatatccaggaaggaccagcgcggcagcggccaggttggcacctatggcctgaacaccttcacgaacatggaggcccagcttatccggcagatggagggcgagggggtcttgtccaaggcggacctagagaaccctcacctccctgaaaagaagataacacaatggctggagactaagggcgtcgaacgcctgaagaggatggccatcagcggcgacgactgcgttgttaaacccattgatgaccgttttgccaacgctctcctcgccttaaacgatatggggaaggtccggaaggacatcccccagtggcagccctcaaagggctggcatgactggcagcaggtcccgttttgcagccaccactttcacgaactcatcatgaaggacgggcgcaaactggtggtcccctgcaggccccaggatgagctgatcggacgcgcacggatctcccagggggccggctggagcctcagggagaccgcatgccttggcaaggcctatgcccagatgtggtccctgatgtacttccaccgccgcgatctccgcctggccagcaatgccatctgctcagccgtgcccgtacactgggtcccgacgagcagaaccacatggagtatacacgcccaccaccagtggatgacgactgaagacatgctgaccgtgtggaatcgcgtctggatcgaagacaacccctggatggaagacaaaacacccgtcacgacgtgggagaacgtaccctaccttgggaaacgggaagatcagtggtgcggttccctgatcgggttgaccagcagggcgacctgggcacagaacatcccgaccgccatccagcaggtacggtccctcatcggcaacgaagaatttctggactacatgcccagcatgaagcgattccggaaggaggaggagtccgaaggtgccatctggtag

SEQ ID NO: 26014 - RNA, 9873 nt, synthetic construct
  misc_feature 1..9873: note = derived and/or modified CDS sequence (opt11) from DENV-3__EU529686__SS-prME
  source 1..9873: mol_type = other RNA
acaagcctgtgtctaatgatgatcctgcccgcggccttagcgttccacctcaccagccgggatggtgagccgcggatgatcgtgggcaagaacgagcgcggtaaaagcctgttattcaagaccgcgagcgggataaacatgtgtactctcattgcaatggacctcggcgaaatgtgcgacgacaccgtgacctacaaatgcccccacatcactgaggtcgagccagaagacatcgactgctggtgcaacctaacctcaacctgggtcacgtatggaacgtgcaaccaggctggcgagcacagacgcgataagcggagcgtcgcactagcaccccacgtcggtatgggactggacacccgcacccaaacgtggatgagtgcagagggcgcctggcgtcaggtggagaaggtcgagacgtgggccctgcgccacccggggttcaccatcctcgcgctgttcctggcccactacataggaacctccctgacgcagaaagtggtgatcttcatcctactgatgctagtcacgccctcaatgacaatgagatgtgtcggggtcggcaatcgagacttcgtcgagggtctgtctggtgccacctgggtggacgtcgtcctggagcatggcggttgcgtgaccacgatggccaagaacaaacccaccctcgacatcgaactacagaagaccgaagccacacagctggcgaccctccggaagctgtgcattgagggcaaaatcacaaacatcaccaccgacagccgctgccccactcaaggcgaggcagtgctgccggaggagcaggaccaaaactatgtctgcaagcacacttacgtggaccgggggtggggtaacgggtgcggcctctttggtaagggctcgctcgtgacctgcgccaagttccagtgcctggagcccatcgaaggcaaggttgtgcaatacgagaacctcaagtacaccgtgatcatcacagtccacaccggggaccagcaccaggtcggcaatgagacgcagggtgtcaccgccgagatcacgcctcaggcttcgaccacggaggcgatcctgcctgagtacggcactcttgggctcgagtgcagtccacgtacaggcctggacttcaatgagatgatactcctcacgatgaagaacaaagcctggatggtccaccgtcagtggttctttgaccttcccctgccctggacctctggcgccaccacagagacgccaacatggaaccgcaaagagcttctggtgaccttcaaaaacgcccacgcgaagaagcaggaggttgtggtgctgggttcccaggagggagcgatgcacacggctctcacgggtgctaccgagatccagaacagcggcgggacgagcatcttcgctggccatctgaagtgccggctgaagatggacaagctcgagctgaagggcatgtcgtacgccatgtgtacaaacacctttgtcctgaagaaggaggtgtccgaaacccaacacgggaccatactaatcaaggtggaatacaagggtgaggacgtcccgtgtaagatccccttcagcacagaggacggccaaggcaaggcgcacaacggccgtctgataactgccaaccccgtggtgactaaaaaagaggagcccgttaacattgaagccgagccgcccttcggggaaagtaacatcgtgatcggtatcggggataacgccctcaagataaactggtacaaaaagggatccagcataggcaagatgtttgaagcgaccgctcgaggagcacgccggatggccattctgggcgacaccgcctgggacttcggttccgtaggtggagtcttaaacagcttaggaaaaatggtacaccagatcttcgggtccgcgtacaccgccctgttctccggcgtctcttgggttatgaaaattggcatcggggtcctcttgacctggatcggtttgaactccaagaacacctccatgtcgttctcctgcattgctatcgggattatcacgctatacctgggcgccgttgtccaggccgacatggggtgcgtaatcaattggaagggcaaggaactgaagtgcgggagcggtattttcgtgacgaacgaagtccacacctggaccgagcagtacaaattccaggctgactctcccaagcgcctcgccaccgccatcgccggggcttgggagaatggggtgtgcggcatccgctctactacccggatggaaaaccttctatggaagcagatagcgaacgagctcaactatatcctgtgggagaacaacatcaagctgaccgtggtcgttggggacatcattggggtgcttgaacagggcaagcgaaccctgactccgcagccgatggaactgaagtattcctggaagacctggggaaaagcaaagatcgtcaccgccgagacccaaaacagctccttcatcatcgatggaccgaacacgcccgaatgcccctctgcctcccgtgcatggaacgtctgggaagtggaggactacggtttcggcgtattcaccaccaacatctggctcaagctgcgcgaggtgtacactcagttgtgcgaccacaggctcatgagcgccgcagtcaaagatgagcgggccgttcatgcggacatgggctactggatcgagagccagaaaaacgggtcatggaagttagagaaagcgagcctgatcgaggtgaagacctgcacgtggccgaagtctcacacactctggtcgaacggagtgttggagtcagatatgataatccctaagagcctggccgggcccatctcccagcacaactaccggcctggttaccacactcagaccgcggggccctggcacctcggcaagctggagctggattttaactactgcgagggcacgacagttgtgatcaccgaaaactgcgggacgcgcgggcccagcctccggacgacgaccgtttccgggaaactgatccatgagtggtgctgccgcagctgcaccctgcctccgctcaggtacatgggtgaagacgggtgctggtacggcatggagatcagaccaatttccgagaaggaggagaatatggtcaaaagcctggtgtccgctgggtccggggaggtggacaactttacaatgggcgtcctatgcctggccatcctattcgaggaggtaatgagggggaagttcggtaagaagcacatgatcgccggggtcttcttcacatttgtcctgctcctgtccgggcagatcacctggcgcgatatggcccatacgctgatcatgatcggctcaaacgcttccgaccggatggggatgggcgtgacgtacctcgcgctgatagcgaccttcaagatccaacccttcctagcgctcgggttcttcttacgcaagttaacaagccgggagaacctcctgctgggcgtcggcctcgctatggctacgacgctgcagctgccggaggatatcgagcagatggccaacgggatcgcgttgggactgatggccctaaaactgatcacccagtttgaaacctaccaactgtggaccgccctgattagcctcacgtgttccaacaccatcttcaccctgactgtcgcctggcggacagccaccctcatcttagccggcgtttccttgttaccggtctgccaatccagctccatgcggaagaccgactggctcccaatgacggtggccgccatgggggtgccgcctctcccactgtttatattcagcctcaaggacacgctgaagcgccgctcttggccgctgaacgagggagtcatggccgttgggctagtgagcatactggcctccagcctgcttcggaacgacgtccccatggcaggccccctggtcgccggtggcctactcatcgcgtgctacgtgatcaccgggacgtccgccgacctgaccgtcgagaaagccgccgacgtgacgtgggaggaggaagccgagcagaccggcgtcagccacaacctgatgatcaccgtcgacgacgacggcaccatgaggatcaaggatgacgagaccgagaacatcctcactgtgctgctgaagaccgctctcctgattgtgagtggcatcttcccttacagcatccccgctacactgctcgtgtggcacacctggcagaagcagacgcagcggtccggcgtgctctgggacgttcccagcccccccgagacccaaaaagcagaactggaagagggggtctatcgcattaagcagcaaggcatctttggaaagacccaggtaggcgtgggagttcaaaaggagggcgtgttccataccatgtggcacgtaacccggggagcggtcctcacttacaacggcaaaagactcgagcccaactgggccagtgtgaagaaggatctgatatcgtacgggggcggctggcggctctccgcccagtggcagaaaggggaggaggtacaggtgatcgccgtggaaccaggcaaaaacccgaagaattttcagaccatgcccgggactttccagacgaccaccggggaaatcggggcgatcgccctggactttaaaccggggacctctggaagccccatcatcaaccgcgagggcaaggtggtcgggctgtacgggaatggggtggtgacaaagaacggcgggtacgtgagcggcatcgcccagaccaacgccgagccggacggccccacccccgagctggaggaagaaatgttcaagaagcggaacctcacgatcatggacttacatcctgggagcggcaaaacgcgtaaatacctgccggctatcgtgagggaggcgatcaagcgccggctccgtactctgatcctggccccaactcgtgtggttgccgctgagatggaggaagccctcaaggggttacccatccggtaccagacaacggcgaccaagtcggaacacacaggcagggaaatcgttgacctgatgtgtcacgccaccttcacgatgcgcttgctgagcccggtgcgggtcccgaactacaacctgatcataatggacgaggcccacttcaccgaccccgcctccattgccgctcgtggttacatcagcacaagggttggaatgggcgaggccgccgccattttcatgactgctacgccgcccgggaccgctgacgccttcccgcaatccaacgcgcccatccaggacgaggaaagggatatcccggagcgcagctggaactccggcaacgagtggatcaccgactttgccgggaagaccgtgtggttcgtccccagcatcaaggcgggcaatgacattgcaaactgcctccggaaaaatgggaagaaagtgatccagctttcccgcaagacgttcgatactgagtaccaaaagacaaagttgaacgactgggactttgtggtcaccacggatatcagcgagatgggcgcgaacttcaaggccgatcgggtgattgaccctcgccggtgcctcaagcccgtgatcctcactgacggccccgaacgcgtcatacttgccggccccatgccggttacagcggcctccgcagcccagcggagaggcagagttgggcgcaacccccagaaggagaacgaccagtatatcttcacaggccagcccctcaacaacgacgaggaccacgcccattggaccgaagcaaagatgctgctggacaacatcaatacgcccgaggggatcatcccggccctcttcgagcccgagcgggagaagtccgccgctatcgacggcgaataccgcctgaaaggcgaatcacgaaagacattcgttgagctgatgcgccgcggcgacttgcccgtgtggctggcccacaaggtcgcctcagagggcatcaagtacaccgaccgcaaatggtgcttcgatggccagcggaataaccagatcctggaggagaacatggatgtagagatctggaccaaggaaggtgagaagaaaaagctccgccccagatggctagacgcccgcacgtactccgacccgctggcgctcaaagagtttaaagacttcgccgcaggccgtaagagtatcgccctcgacctggttaccgagattgggcgagtaccaacccaccttgcccaccgaaccagaaacgccctggacaaccttgtaatgctgcatacgtcagagcacggcgggaaagcttaccgccacgcggtggaggagctgcccgagaccatggaaaccctgctcctgctgggcttgatgatcctgttgaccggtggcgccatgctttttctgataagcggcaaggggatcggcaagacgagcattggactgatttgcgtcatcgcctcctccggcatgctgtggatggcggagatccctctgcagtggatcgcctcagcgatcgtgcttgagttcttcatgatggttctcctgatcccagagcccgagaagcagcgaacgccccaagacaaccaactggcctacgtagtcatcgggatcctcaccctcgcggccattatagccgcgaatgagatgggcctgctcgaaactacgaaacgcgatctgggcatgagcaaggagcccggggtcgtctccccaacgagttacctagacgtggacctccatccagcctcagcctggaccttgtacgccgtagcaaccacggtcattacccccatgctgcgacacaccattgagaactcgaccgccaacgtgtctcttgctgcgatcgccaaccaggccgtcgtcctgatgggcctcgacaaggggtggcccattagcaaaatggaccttggtgtgcccctgctggccctcgggtgttactcccaggtgaaccccctaactttaaccgccgcagttctactcctgattacccactacgctatcatcggccccggcctccaggcgaaggccactagagaggcccagaagcggacggccgccgggatcatgaagaacccgacggtggatggcatcatgaccatcgacctggacccagtgatctacgacagcaaattcgagaaacagctggggcaagtcatgctcctggtcctgtgcgcggtgcaactcttgctgatgcgcacgtcctgggcactctgcgaggcactcacgttggccacaggtccgatcaccaccctctgggagggcagccccgggaagttctggaacacgaccattgcagtttccatggcgaacatattcagagggagctacctggccggggctggcttggcgttctccatcatgaagtccgtggggaccggcaagcgcggcactgggagtcagggcgagaccctcggtgagaagtggaagaaaaagctgaaccaactgtcgcggaaggaattcgacttatacaagaagtctggcatcacggaggtggaccgcactgaggcgaaagaagggttgaagcggggagagatcacccatcacgcggtctcccgcggcagcgccaagctgcagtggtttgtcgaacggaacatggtaataccggagggcagagtcatcgacctcgggtgtgggagaggcgggtggtcctactactgcgccggcctgaagaaggtgaccgaggtgcggggttacacgaagggggggcctggtcacgaagagcccgttcccatgtctacctacggctggaatatcgtaaagctcatgagtgggaaggacgtgttttacctcccgcccgaaaagtgcgacaccctgctgtgtgatataggcgagagctcccccagccccaccgtcgaggagtcacggacaatacgtgtcctgaagatggttgagccgtggttgaagaacaatcagttctgtattaaggtcctgaacccctacatgcccaccgtgatcgagcacctggagcgcttgcagcggaaacacggtgggatgctggtacgcaatcctctgtcacggaactccactcacgaaatgtactggatctctaacgggacggggaacatcgtcgcatccgtgaacatggtgtcgcgcctcctgctgaaccgcttcacgatgacccaccgccggccgacaatcgagaaagacgtcgacctcggcgcgggtaccagacacgtaaacgctgagcccgagacccccaacatggacgtgatcggcgaacggataaagcgcatcaaggaagagcacaattcaacctggcactacgatgacgaaaacccttataagacctgggcctaccacggctcgtatgaggtcaaggccacagggtcagcctcatcaatgattaacggtgtcgtaaagctcctgacaaaaccctgggacgtggtgccaatggttacccaaatggcaatgaccgataccacgccattcggacagcagcgggtgttcaaggaaaaggtggacacccgcaccccgcggtcgatgcccggcacaaggcgtgtcatgggcatcacggccgagtggctctggcgcaccctggggcggaacaagaagcccagactgtgtaccagggaggaatttacgaagaaggtgcgcacgaacgccgctatgggcgctgtgttcaccgaggagaatcaatgggacagcgccaaagctgccgtcgaggacgagaatttctggaagctggtggatcgcgagcgagagttacacaagctggggaagtgtggctcttgcgtgtacaacatgatggggaaacgagagaagaagctcggcgagttcggcaaggccaagggtagccgggcgatatggtacatgtggctcggcgcccgctacctggagttcgaggctctcgggttcctgaacgaggaccactggttttcccgcgagaactcttactccggggtcgagggggagggcttgcacaagctcggctacattctgcgcgacatctccaagatacccgggggtgccatgtatgccgacgataccgctggatgggacacccggattacggaggacgacctgcacaacgaggagaagatcactcagcagatggacccggagcatcgtcagctcgcaaacgcaatctttaaactgacctaccagaacaaggtggtgaaggtccagcggccaacccccaccggcactgtgatggacattatctcccgcaaggaccaaagaggttccggccaggtcggcacctatggactaaacaccttcactaacatggaggcgcagctcatccgccagatggaaggcgagggcgttctgtccaaggccgacctggagaacagccatctacccgagaaaaagatcacccagtggctggaaaccaagggcgtggagcggctaaagcgtatggcgatctctggagacgactgcgtagtcaagcctatcgacgacagatttgccaacgcattactcgctctaaacgacatggggaaggtgcgcaaggacattccccagtggcagcccagcaagggttggcacgactggcagcaggtcccgttttgttcccatcacttccacgagctcatcatgaaagacggccgcaagctggtggtgccgtgtcgccctcaggatgaactgatcggcagagccagaatcagccaaggggcgggctggtccctcagagagaccgcctgcctgggcaaggcctacgcccaaatgtggagcttgatgtacttccaccgccgcgacctccggctagcgtccaacgcaatctgcagcgcagtgcccgtccactgggtgcccacttcccgcacgacctggagcattcatgcccaccaccagtggatgactaccgaggacatgctgaccgtgtggaaccgggtctggattgaggacaacccatggatggaggacaagacacccgtgaccacctgggagaacgtgccctatttggggaaaagagaggaccagtggtgcggaagcttaatagggctgacgagtcgggccacctgggcgcaaaacatcccaaccgctatccagcaggtccgcagcctcatcggcaacgaagagttcctggactatatgccgtctatgaagcgattccgcaaggaggaggaaagcgaaggcgccatatggtga

SEQ ID NO: 26015 - RNA, 9873 nt, synthetic construct
  misc_feature 1..9873: note = derived and/or modified CDS sequence (opt11) from DENV-3__EU529687__SS-prME
  source 1..9873: mol_type = other RNA
acctcattatgcctcatgatgatacttcccgccgcgctggcgttccaccttaccagtcgtgacggggagccccggatgatcgtggggaaaaacgagcgcggtaagagcctgttatttaagacggcctccgggatcaatatgtgcaccctcatcgccatggacctgggcgaaatgtgcgacgacactgtaacctacaagtgcccccacattaccgaggtggaacccgaggacatcgactgctggtgtaacctgaccagcacatgggtgacatacgggacgtgtaaccaagccggcgagcaccgccgcgataagcggtccgtcgccctcgcgccccacgttggcatggggctggacacacgcacccagacttggatgagcgccgagggggcctggcgccaggtcgagaaggtcgagacttgggcactgcgccacccggggttcaccatcctcgcgctgttcctggcgcactacatagggacttccttgacccaaaaagtggtaatattcatcctgttaatgctcgttacgcccagcatgacaatgcggtgcgtgggggtgggcaaccgcgactttgtcgagggtctgtcgggggcgacttgggtggacgtggtcctggagcacggagggtgcgttaccacgatggccaagaacaagccgactctcgacatcgagctgcaaaagactgaggccacgcagctggcgacgctccgtaagttatgtatagagggcaagattaccaacataaccaccgacagccgctgtcccacgcagggcgaggcagtgctgcccgaggaacaggaccagaactacgtgtgcaaacacacctacgtggatcggggctgggggaacgggtgtggcctcttcgggaaggggagcctagtaacctgcgctaagttccagtgtcttgagcccatcgagggtaaggtcgtacagtacgaaaacttgaaatatacggtcatcattacggtccacaccggggaccagcaccaggtgggcaacgagacccagggggtcactgccgagattactccccaggctagcaccaccgaagcgatactgccggagtacggaaccctggggttagaatgctccccgcggaccggcctggacttcaacgagatgattctgctcacgatgaaaaacaaggcttggatggtgcaccggcagtggttcttcgatttacccttgccctggaccagcggtgccactaccgaaacacccacctggaaccgcaaggaactcctggtgacctttaagaacgcccatgccaagaagcaggaagttgtagtactggggtcccaggagggcgcgatgcacaccgcgctcacaggcgcgaccgagatccagaacagcggcgggacatccattttcgccggccacctgaagtgtcgtctgaaaatggataagctagagctgaagggcatgtcctacgccatgtgcaccaacacgttcgtcctaaagaaggaggtgtccgaaacccaacacgggaccattctgatcaaagtggagtacaagggcgaggacgtcccgtgcaaaatcccttttagcacagaggatgggcagggaaaggcgcacaacggccgcctgatcacggccaaccccgtggtgaccaagaaggaagaacccgtcaacatcgaggccgagccgcccttcggagagagcaacatcgtgatcggcataggagacaacgcccttaagatcaactggtacaagaagggctccagcattgggaagatgttcgaggcgaccgccaggggtgcccgccggatggcgatcctgggcgacaccgcctgggactttgggtccgtgggtggggttcttaatagcctgggaaagatggtgcaccagatcttcgggagtgcgtacactgccctcttcagcggcgtatcctgggtcatgaagatcggcatcggtgtgctactgacttggattggtctgaacagcaagaacacctccatgagcttctcctgcatcgccatcgggatcataaccctttacctgggtgccgtggtacaggccgacatggggtgtgtgatcaactggaagggcaaggaactcaagtgcggcagcggtatctttgtgacgaacgaggtccacacctggaccgagcagtacaaattccaggccgattcccccaagcgcctggccaccgccattgccggcgcctgggagaacggtgtgtgcggtatccgcagcacgacccggatggagaacctgttgtggaaacagatcgcaaacgaactcaactacattctatgggagaacaacatcaagttgaccgtggtcgtgggggacatcatcggcgtgctcgaacaggggaagcgtaccctgacgccccagcccatggaactgaaatattcctggaagacctggggcaaggcgaagatagtcaccgccgaaacccaaaattcatcctttatcatcgatggccccaacacgcccgagtgccccagcgcctcccgggcgtggaacgtgtgggaggtggaggactacggattcggggtcttcaccaccaacatatggctcaagctgcgcgaggtgtacactcagctgtgcgaccaccggctcatgagcgcagccgttaaggatgagagggctgtccacgccgacatggggtactggattgagagccagaagaacgggtcctggaagctggaaaaggcgagccttatcgaggttaagacctgtacgtggccgaagtcgcacaccctctggagcaacggcgtgctggagagtgacatgattatccctaagagccttgccgggcctatctctcaacacaattaccggcctggctaccacacccaaactgcagggccctggcacctcggtaaacttgagctggactttaactactgcgaaggcacgaccgtcgtgattaccgagaactgcgggacccgcggcccgagcctcagaacgaccaccgtgtccggaaaactgatccacgaatggtgttgccgctcctgtaccctgcctccgctgcgctatatgggggaggacgggtgctggtacggaatggagatccgccccatatccgaaaaagaggagaacatggtcaagagcctagtttccgccggctcgggggaggtcgacaacttcacaatgggggtcttatgtctggcaattctgttcgaggaggtgatgcgggggaagttcggcaagaaacacatgatcgcgggcgtattcttcacgttcgtcctgttattatccggccagatcacctggcgcgacatggcccacacactgatcatgataggcagcaatgcctcagaccgaatgggtatgggagtgacgtacctcgccctgatcgccaccttcaaaatacaaccgttcctcgcgctcggtttcttcctccgcaagctgaccagccgggagaacctcctgcttggcgttggcctcgccatggccactacgctgcagctgccagaagacatcgagcaaatggccaacgggatcgcattggggctgatggccctgaaacttatcacccaattcgagacctaccaattatggaccgccctgatctccctcacttgctccaacaccatcttcaccctcaccgtagcgtggcggacggccaccctgatattggcgggggtgagcttacttccggtatgccagtccagctccatgcgaaagaccgattggcttcccatgaccgtggccgctatgggtgtgcctccccttcccctgttcatcttcagcctcaaggacacgttgaagcggcgctcctggcctctgaacgagggggtcatggccgtaggcctcgtgagcatcttagcgtctagcctgctacgtaacgacgttcccatggcgggccctctggtcgcaggagggctcttaatcgcctgttacgtgatcaccgggacctccgccgacctcaccgtcgaaaaggccgcggacgtgacgtgggaggaagaggctgagcagaccggggtgtcccataatctgatgataaccgtcgacgacgacgggacgatgcgcatcaaggacgacgagaccgagaacatcctcacggtgctgctcaagacggcactcttaatagtcagcggcatcttcccgtacagcatcccagccacgctgctcgtctggcacacctggcagaagcaaacgcagcgatccggcgtgctgtgggacgtgcccagcccacccgagacccagaaagccgagctggaggaaggtgtctaccgcataaagcagcaaggaattttcgggaagacgcaagtaggagtgggggtccagaaggagggcgtgttccacacaatgtggcacgtgaccagaggcgcggtcctcacctacaatggtaagcgcctggagccgaactgggcttccgtgaaaaaggacctcataagttatggtggaggctggcgactctccgctcagtggcagaaaggcgaagaggtgcaggtcatcgccgtagagcccggcaagaaccccaagaacttccaaacaatgcccggtacattccagaccaccaccggggagatcggagcgatcgcgctggactttaagcccggtacctctggctcgcccatcatcaaccgcgagggcaaggtggtcgggctgtacggcaacggggtggtgacgaaaaacggcggctacgttagtggcatcgcacagaccaacgccgaaccggacggccccacacctgaactggaggaggagatgttcaagaagcggaatttgaccatcatggatctgcaccccggttctggcaagacccggaagtacctgccggctatcgtacgggaggccatcaagcgtcggctccggaccctcattctggctccaactcgggtggtagccgcagagatggaggaggccctcaaagggctgccgatcaggtaccagaccacggcgaccaagtcggaacacaccggccgggagatcgtggacctgatgtgccacgccaccttcacgatgcgcctcctgagccccgtgcgcgtcccgaattataacttaatcatcatggacgaggcgcacttcaccgaccccgcttcaatcgccgcgcgcgggtacatcagcacccgggtcggcatgggtgaagcggccgccatattcatgaccgcgacgccgcccgggaccgccgacgcgttcccgcaaagcaacgcccccatccaggacgaggagaaggacatcccggaacgcagttggaacagtggcaacgagtggatcaccgacttcgctggcaagaccgtttggttcgtcccctcgattaaggccggcaatgacatcgccaactgcttacgcaagaatggaaagaaggtgattcagctgagtcgcaagactttcgatacagagtaccagaaaaccaagctgaacgactgggacttcgtggtcaccacggacataagcgaaatgggcgccaacttcaaggcagacagggtgatcgacccgcggcgctgcctgaagccagtgatccttaccgacggccctgagagggtcatcctcgccgggcccatgccggttacagcagcctcagctgcacagcgccggggccgcgtcgggcggaacccccagaaggaaaacgaccaatacatcttcaccggccaacccctcaacaacgacgaggaccacgcccactggaccgaggccaagatgctgctggacaatatcaacactcccgaggggatcatcccggccctcttcgaacccgagcgggagaagtctgccgctatcgacggcgagtaccggctgaaaggcgagtcccgcaagaccttcgtcgagctgatgcggcgtggggacctccccgtgtggttagcgcacaaggtcgccagcgagggaatcaagtacaccgaccggaagtggtgttttgacgggcagcgcaacaatcagatcctggaggagaacatggacgtggagatatggactaaggagggcgagaagaagaaattgcggccccgctggttagacgcacggacgtactccgacccgctggccctcaaggagttcaaagacttcgccgcgggacgcaagagcatcgccctggacttggtgaccgagataggccgtgtaccctcccacctcgcccaccggaccagaaacgctcttgacaatctggtgatgctccacactagcgaacacggagggaaggcctaccggcatgcggtcgaggagctgcccgaaacgatggagacactgctcctgctgggcttaatgatcctgctgaccggcggcgccatgctgttcctgatcagcggcaagggtatcggcaagacttccatcgggctgatctgcgtcatcgcgagctccggcatgttgtggatggctgagatcccgctgcaatggatcgccagcgcaatcgttctagagttcttcatgatggtgctcctgatccccgaacccgaaaagcagcgtacgccccaagacaaccagctcgcctacgttgtgatcgggatcttaaccctcgccgccatcatcgctgcgaacgaaatgggcctgctcgagaccaccaagcgggacctggggatgtccaaagaacctggggtggtatctcccacgagttatctagacgtggacctacaccccgccagcgcatggaccctgtatgcagtggcgaccactgtcatcacacccatgctgcgccacacaatcgagaactccaccgcgaacgtgagcctcgccgccatcgccaaccaggcggtggtgctgatgggcctggacaaagggtggccgatctccaaaatggacttaggcgtgcccctgctggcactaggctgctattcccaggttaaccccctcacattgacggccgctgtactacttctgattacgcattatgcaatcataggcccaggactccaggcgaaggccacacgggaggctcagaagcgcaccgcagctggaatcatgaagaatccgacagttgacggaatcatgaccattgacttggaccccgtgatctacgactccaagttcgaaaagcagctggggcaagttatgctcttagtgctgtgcgcggtgcagctgctgctgatgcggacctcctgggccctctgtgaggccctgacccttgcgacgggccccatcactaccttatgggagggatccccggggaagttttggaacaccacgatcgcggtcagcatggcgaacatcttcaggggatcctacctggccggcgccggcctggccttcagtatcatgaaatccgtggggaccggcaagaggggcactgggagccagggtgagacgctcggtgaaaaatggaagaagaagctgaaccagctgagccgcaaggagttcgacctctacaagaagtccggcataaccgaggtggaccggacggaagctaaggagggcctgaagcgcggcgagatcacgcaccacgccgtcagccgaggctccgcgaagctgcagtggttcgtcgagcgaaatatggtgatccctgagggacgggtcatagacctcggctgtgggcgcggagggtggagctactactgcgccggcctgaagaaggtcacagaggtgcgcggctacactaagggcgggcccgggcacgaggagcccgtccccatgtccacgtatggctggaatatcgttaagctgatgagcgggaaggacgtgttttacctaccacccgaaaagtgcgacacgctgctgtgtgatatcggcgagtccagcccatcccctaccgtcgaggagagccgcaccatccgggtactgaagatggtggaaccctggctcaagaacaatcaattttgcatcaaggttcttaacccctacatgcccacggttatcgagcacctggaacgcctacagaggaagcacggtggcatgttggtccgcaaccccctctcccgcaacagcacccacgagatgtactggatctccaacggcacgggcaacatcgtcgccagcgtaaacatggtgtcccggctcttactgaaccgcttcaccatgacgcaccgtcgcccaacgatcgagaaggacgtcgatctaggcgcgggcacccgacacgttaatgcagagcccgaaacccccaacatggacgtgattggggagagaattaagcggataaaggaggagcacaacagcacgtggcactacgacgacgagaacccctacaaaacctgggcctaccatggctcatacgaggtcaaggctacagggagcgcgagcagcatgatcaatggagtcgtcaagctgctgaccaagccctgggatgtggtacctatggtcacccagatggccatgaccgacaccaccccattcggccagcaacgcgtgttcaaggagaaagttgacacccggactcctaggagcatgccaggcaccagacgcgtcatgggtatcaccgccgagtggttatggcgaacgctggggcgtaacaagaagccccggctatgtacccgcgaggagttcaccaagaaggttcggacgaacgccgccatgggagcagtattcacggaggagaaccagtgggacagtgccaaggccgccgtcgaggacgaggacttttggaagctcgttgaccgggagcgcgagctgcacaagctggggaaatgcggcagctgcgtctacaacatgatgggaaagcgggagaaaaagttaggcgagttcggcaaggccaaggggtcccgcgcgatctggtatatgtggctgggcgcccggtacctggagttcgaggcccttggcttcctgaatgaggaccactggttcagccgcgaaaactcctacagcggcgtcgagggagagggcctgcacaaactcggctacattctgcgggacatctccaagatccctggaggcgccatgtacgcggatgacaccgcgggctgggacactaggatcaccgaggacgacctgcacaacgaagagaagatcacgcagcagatggacccggagcaccggcagctcgccaatgccatcttcaaactgacctatcaaaacaaagtggtgaaagtacagcgaccgacccccacaggcaccgtgatggacatcatcagccggaaggaccaaaggggatccggtcaggtgggaacgtatgggctgaacaccttcaccaacatggaggcccagctcatacggcagatggagggcgaaggggtgttatcgaaagccgacctggagaacccccaccttccggagaagaagatcacccagtggctggagaccaagggggtggagagacttaagcggatggcgatctccggcgacgattgtgtggtcaagcccatcgacgaccgcttcgccaatgccctactggccctgaacgacatggggaaggtacggaaggacatacctcagtggcagccctccaaagggtggcacgactggcagcaggtcccattctgcagtcaccacttccacgagctcatcatgaaagatgggagaaaactggtcgtgccctgccggccccaggacgagttaatcgggcgcgcccggatcagccagggggccggctggtccctccgcgagaccgcctgcctaggaaaggcctacgcacagatgtggagcctgatgtacttccaccggcgggacctccgcctggcctctaacgcgatctgcagcgccgtgcccgttcactgggtgccgaccagtcggaccacgtggagcatccacgcccaccaccagtggatgacaactgaagacatgctgaccgtgtggaacagggtctggattgaggacaacccgtggatggaggacaagacgcccgttacgacctgggagaacgtgccataccttgggaagagggaggatcaatggtgcggtagtctgatagggttaacaagccgcgccacctgggcgcaaaacattccgaccgccatccagcaggttcggagcctcatcggcaacgaggagttcctggactacatgcccagcatgaaacgctttcggaaggaggaggaaagcgaaggggccatatggtga

SEQ ID NO: 26016 - RNA, 9873 nt, synthetic construct
  misc_feature 1..9873: note = derived and/or modified CDS sequence (opt11) from DENV-3__KF955449__SS-prME
  source 1..9873: mol_type = other RNA
accagcttgtgcctgatgatgatcctgcccgctgccctggcgttccacctcacctcccgggacggtgagccgcggatgatcgtggggaagaatgagcgcggaaagagcctgttgttcaagacggcctccgggataaatatgtgtacgctcatcgctatggacctgggggaaatgtgcgacgacaccgtgacttacaagtgtccccacatcacggaagttgagccggaggacattgactgttggtgcaacctgaccagcacctgggtgacttacggaacgtgtaatcaggccggagaacaccggcgcgacaagcggtccgtcgccctcgcgccccacgtgggcatggggctggataccagaacccaaacctggatgtccgccgagggggcatggcggcaggtcgagaaggtcgagacttgggccctgcgccacccgggatttaccattttagcgctgtttctggcccattacatcggcacctccctcacgcagaaggtggttatcttcgtcctgctgatgctcgtgactcccagcatgaccatgcggtgcgtaggggtggggaaccgcgacttcgtggaggggctgtccggggctacctgggtagatgttgtgctagaacacggtgggtgcgtcaccacgatggcgaagaacaagccaactctcgacatcgaactgcagaagaccgaggccacccagctggcgacgcttcgaaaactgtgcatcgagggcaagatcaccaacataaccaccgactcacgctgccccacgcagggcgaggccgtgttgccggaggagcaggaccagaactacgtgtgcaagcacacttacgtggaccggggttgggggaacggctgcggactcttcgggaagggctccttggtgacctgcgctaagttccagtgcctggagcccatcgagggtaaggtggtgcagtatgagaacctcaaatacaccgtcatcataacagtgcacaccggggaccagcaccaagtcggcaacgagacccagggggtcaccgccgagatcacgccgcaggcctcgaccaccgaggctatcctgccagagtacggcaccctggggctcgagtgtagcccgcgcaccggcctcgacttcaacgaaatgatccttttgacgatgaagaacaaagcctggatggtgcaccggcagtggttcttcgacctgccgctgccctggacctctggtgccaccaccgagacgcccacctggaaccgcaaagagttgttagtcactttcaagaacgcccacgccaagaaacaggaggtggtggtcctcggctcccaggagggcgcaatgcacaccgctcttacgggggctaccgagatccagaacagcggcgggacctccatattcgcgggccacctgaagtgtcggctgaaaatggacaaactcgagttgaaagggatgagctatgccatgtgcacgaacacgttcgttttaaagaaggaggtgtccgagacccagcatgggaccattctcatcaaggtcgagtacaagggcgaggacgtgccgtgcaagatccctttcagcacagaggacgggcagggaaaggcgcacaacggccgcctgatcaccgctaaccccgtggtcacaaagaaagaggagcccgttaacatcgaagctgagccgcccttcggggagtcaaacatcgtgatcggcatcggggacaacgctctgaagatcaactggtacaaaaagggctctagcatcgggaaaatgttcgaggcgaccgcgaggggcgccagacgaatggccatcctgggcgacacagcctgggacttcggctccgtgggaggagtgcttaatagtctgggtaaaatggtgcaccagattttcggaagcgcatacacggccctgttcagcggcgtctcctgggtcatgaaaattgggatcggggttcttttgacctggataggactcaattcgaagaacacttccatgagcttctcctgcatcgccatcggcatcatcacgctctacctgggcgccgtcgtgcaagcggacatggggtgcgtgatcaactggaagggcaaggaattaaagtgtggcagcgggatattcgttacgaatgaggtgcacacgtggaccgagcagtacaaattccaagcggattctcccaagcgtctcgccaccgccatcgccggcgcgtgggagaacggggtgtgcggtatccgcagcacgacccgtatggagaacctgctgtggaagcagatcgcgaacgagctcaactacatcctgtgggagaacaacatcaaactgaccgtcgtggtcggggacatcatcggggtactcgagcagggcaagcgcacgctgacgccgcagccgatggaactaaaatactcctggaagacctgggggaaggccaagatcgtgaccgcggagacccagaacagctccttcatcatcgacggccccaacacgcccgagtgcccctcagcctcaagggcgtggaacgtgtgggaggtcgaagactacgggttcggcgtgtttacgaccaacatttggcttaagctgcgcgaggtctacacccagctgtgcgatcaccggttgatgagcgccgccgtgaaagacgaacgggctgttcacgcggacatgggctattggatagaatctcagaaaaatgggtcgtggaagctcgagaaggcgtcgctgatagaagtgaagacgtgtacatggccgaagtcacataccctctggagcaacggcgtgctggaatccgacatgatcattcctaagagcctggccggccccatctcccagcacaactaccggccgggctaccatacccaaacagccgggccgtggcacctcggcaagttggaactggacttcaactactgcgagggcactaccgtagtgatcaccgagaactgcggtacacgcggccccagcctgcggacgactaccgtctcggggaagctgattcacgagtggtgctgccgcagctgtactctgcccccactccggtacatgggcgaagacgggtgctggtacggtatggagattcgccctatatccgagaaagaagagaatatggtcaagagcctagtgtccgctggatctggggaggtcgacaacttcacaatgggcgttttgtgcctcgcaatcttattcgaggaggtgatgcgggggaagttcggaaagaaacacatgatcgcgggggtcttcttcaccttcgtactgctcctgtcaggccaaatcacctggcgagatatggcacatacactgatcatgataggcagcaacgccagtgaccggatgggtatgggcgtgacgtacctagccctgatcgccacgttcaagatccagccctttctggcgctcggcttcttcctgcgcaaactgaccagccgggagaacttgttgctgggcgtcggcctcgcaatggccaccacgctgcagctgcccgaggatatcgagcagatggcgaacgggatcgcactcgggctgatggcgcttaaacttatcacccagtttgagacctaccagctgtggaccgcgctaatcagcttaacgtgctcgaacaccatctttaccctgactgtggcctggcgcacggccacgctgatcttggctggggtaagcctgttgccagtgtgccagtcctcctccatgcggaagaccgattggctccccatgaccgtcgctgccatgggcgtgccgcccctcccgcttttcatcttctcattgaaagacacgctaaagcgccgctcctggcccctcaacgaaggggtcatggctgtgggcctagtgagcatcctagcttccagcttgctccggaacgacgtgcccatggctggccccctggtggccgggggactcctcatagcctgctacgtgatcactgggacttcagccgaccttactgtggaaaaagcagcagacgtgacgtgggaggaggaggcggagcagactggggtcagccacaacttgatgatcacggtggacgacgacgggaccatgagaatcaaggacgacgagaccgagaacatcctcacggttctgctgaaaaccgctctcctgatcgtctctggcattttcccgtacagcatccccgcgaccctgttagtgtggcacacttggcagaagcagacgcagcggtccggtgtgctgtgggacgtccccagcccgcccgagacccagaaggccgagttggaggagggggtgtaccgtatcaagcaacagggcatcttcggtaagacccaggtgggcgtcggggttcagaaggagggcgtttttcacaccatgtggcacgtcacgaggggcgcggtactcacatacaacgggaagcgcctggagcccaactgggcctcggtgaaaaaggacctgatcagctacggaggtggctggcgactttccgcccagtggcagaagggggaagaggtccaggtaatcgccgtggagcccggcaagaaccccaagaacttccagaccatgcccggcaccttccagaccaccacaggggagatcggtgcgatcgccctggacttcaagcccgggacctccggctcaccaatcatcaatcgtgagggaaaggtcgtggggctgtacggtaacggggtggtcactaagaacggcgggtatgtctccggcatagcccagaccaacgccgaaccggatggccccacccccgagctggaggaggaaatgttcaagaagcggaacctcaccatcatggaccttcaccccgggagcggcaaaacgcgcaaatacctgccggccattgtgcgggaggcgatcaagcgcagactccggaccctgatcctggcccccaccagagtggttgcagctgagatggaggaggccctcaaggggttacccatccgctaccagaccacggcgaccaagagtgagcacacaggcagggagatcgtggacctcatgtgccatgccacattcacgatgcgcttgctcagccccgtccgggtgccaaattacaacctgattatcatggacgaggcccactttacggaccctgcctcgatcgccgcgcgcggttacatcagcacgcgcgtgggcatgggagaggccgcagccatctttatgaccgcgactccgcccgggacagctgacgccttccctcaatccaacgcgcccatccaggatgaggagcgtgacatcccagaaaggagttggaactccggcaacgagtggatcacggactttgccgggaagaccgtctggttcgtgccaagcatcaaggcgggcaacgacatcgccaactgtctccggaaaaacggaaagaaggtgattcagttgtcccgcaaaacgttcgataccgagtaccaaaagaccaagctgaacgattgggatttcgtcgtaaccactgacattagcgagatgggcgccaatttcaaagccgaccgggttatagacccgcgccgttgcctcaagccggtcatattaactgatggccccgagcgcgtgatcttggccgggccgatgcctgttacagcggcttccgcggcccagcggcgcgggcgggtgggccgcaacccccagaaggagaacgaccagtacatatttaccggccagcccttaaacaacgacgaggatcacgcccattggaccgaagcgaagatgctgctggacaatatcaacacgccggagggaatcatcccggccctcttcgaaccggagcgggaaaaatctgccgccatcgatggcgagtaccggctgaaaggcgagtcccggaagaccttcgtggagctgatgcgccgcggcgacctccccgtctggctggcgcacaaagtggcctcagaaggaatcaagtacaccgaccgcaagtggtgtttcgacgggcagcgtaacaaccagatcctagaagagaacatggacgtcgagatatggaccaaggagggagagaagaagaagctccgccccaggtggttagacgcccgcacatactccgatccactggccctcaaggagttcaaggacttcgccgcgggaagaaaaagcatcgctctggacctggtcacagaaatcgggcgggtaccctcacacctcgcgcatcgcacccggaacgccctggataacctggtgatgctccacacgagcgagcatggagggaaagcataccgccacgccgtcgaggagctgcccgaaacgatggagaccctgctcctcctgggcctcatgatcctgctgactggtggcgctatgctattccttatcagcggcaaggggatcggcaagacctccatcgggctgatctgcgtcatcgccagctccggaatgctctggatggccgagatcccgcttcagtggatcgccagcgcgattgtgctcgagttctttatgatggtactcctgatccccgagcccgaaaagcagcggacgccccaggacaaccagctcgcatacgtggttatcggcatcttaaccctggccgccatcattgccgcaaacgagatggggctgctcgaaacgactaagcgcgacctgggcatgtccaaggagccgggtgtcgtgagccccacgtcctacctggacgtcgacctccatcctgcgagcgcatggacgctgtacgccgtcgcgaccacggtgattacgcccatgttacggcacaccattgagaactccacagccaacgtaagcctcgccgccatcgcaaaccaagcggtcgtgctgatgggcctggacaaggggtggccgatcagcaagatggacctcggtgtcccgctgctggccttaggttgctatagccaggtcaaccccctgacgttaacagccgccgtgctgctgctgatcacccattacgccataataggaccaggcttacaagcgaaggccacacgcgaggcccagaagcgtaccgccgccgggattatgaagaacccgactgtggacggcatcatgaccatcgacttggatcccgtcatatacgactccaagtttgagaagcagttaggccaggtgatgctcctggtgctgtgcgcggtccagctcctactgatgcgcaccagctgggcattgtgcgaggccctgacgctcgccacgggccccatcaccaccctctgggaaggctcccccgggaagttttggaacaccacgatagcggtgagcatggccaacatctttcgaggatcctatctggccggggccggcctggcgttctcaatcatgaagtccgtcgggaccggcaagcgcggcaccggatcgcagggagagacgctcggtgagaagtggaaaaagaagctgaatcagctgagccggaaggagtttgacctctacaagaagtccggtatcaccgaggtcgaccgtacggaggcgaaggaagggctgaagcggggagagattacccaccacgccgtaagccgcggctccgccaaactacagtggttcgtggagcggaacatggtcatcccggaggggcgcgtgatagacctcggctgcgggaggggcgggtggtcctactattgcgccggcctgaagaaggtgaccgaggtaagaggttacaccaagggcgggcccgggcacgaggaacccgttcccatgtccacgtacggctggaacatagtcaagctgatgagcgggaaggacgtcttctacttaccgcccgaaaagtgcgacaccctgctgtgtgacatcggggagtccagtccctccccgaccgtggaggagagccggaccatccgcgtgttgaaaatggtcgagccatggcttaagaacaaccagttctgcatcaaggtgctcaacccatatatgcctacggtgatcgaacacctggagcgcctccaacggaagcacggcggtatgttagtccgcaaccccctgtctcgcaacagcacccacgagatgtactggatctcaaacgggaccgggaacatagtcgcgagcgtgaatatggtgtcccgcctcttactgaatcggttcacaatgacgcaccgccggcctaccatcgaaaaggacgtcgacctcggcgcgggcacccgccacgttaacgcggagcccgagactcccaacatggatgtaatcggggaacggattaagcgcatcaaggaggaacacaacagcacgtggcattatgacgacgagaatccgtacaaaacctgggcctatcacggctcctacgaggtgaaggccaccgggagcgcttcatccatgataaatggggtcgtgaagctacttaccaagccctgggacgtggtcccaatggtgacgcagatggcaatgaccgacacaacccctttcgggcaacagcgggtgttcaaggaaaaggtggacacgcggacacccaggtcgatgcccggcacccgccgggtgatgggcatcaccgccgagtggctctggcgcacgctgggccggaacaaaaagccccgcctctgcacgcgggaggagttcacgaagaaggttcgcaccaatgccgcaatgggcgcggtattcacggaggaaaaccagtgggactccgcgaaggcagccgtagaggacgaagatttttggaagctcgtcgaccgcgagagagagcttcacaagctggggaagtgcggaagctgtgtttataatatgatgggcaaacgcgagaagaagctcggcgagttcggcaaggccaaggggtcgcgggcgatctggtatatgtggctgggcgcccgatacctggagttcgaggctctcgggtttctgaacgaggaccattggtttagtcgagaaaactcctacagcggcgttgagggggagggcctgcacaaattgggctacatcctgcgcgacatctccaagattcccggcggcgccatgtacgccgacgacaccgcggggtgggacacccggattaccgaggacgacctgcacaacgaggagaagatcacccagcaaatggacccggagcatcgccagctcgccaacgccatcttcaaactgacctaccagaacaaagtggtcaaagtgcagcgacccacccccaccggcaccgtcatggacatcatcagccgcaaggatcagcgtggctccgggcaggtcggtacttacgggcttaataccttcaccaacatggaagcccaactaatcagacagatggagggcgagggggtgcttagtaaggccgacctggagaacccccacctccctgagaaaaagatcacccagtggctcgagacgaagggggtcgagcgcctgaaacgtatggcgatatccggcgacgactgtgtagtaaagcccatcgacgaccggttcgccaacgctctcctggcgctgaacgatatggggaaggttcgcaaggacatcccccagtggcagccctccaagggctggcacgattggcagcaggtccctttctgctcgcaccacttccacgagctcatcatgaaggacgggcgcaagctggtggtgccctgccgcccccaagacgagttgatcgggagagcccgaataagccaaggagcgggttggtccttgcgggagaccgcctgtctgggcaaagcctacgcccagatgtggagcctgatgtacttccaccgccgcgacctccgactggcgagtaacgccatttgcagcgccgttcctgtgcactgggtgccgacttcccgcaccacgtggagcatacatgcccaccatcagtggatgaccacggaggacatgctgaccgtttggaaccgagtgtggatcgaggacaacccatggatggaggacaagacgcccgttaccacctgggagaacgtcccctacctaggtaaacgcgaggaccagtggtgcggcagccttatagggctgacgtcccgagcgacttgggcgcagaacatcccgaccgctatccagcaggtccgcagcctcatcggcaacgaagagttcctggactatatgccatccatgaagagattccgcaaggaggaggagtcggaaggggccatctggtga

SEQ ID NO: 26017 - RNA, 9873 nt, synthetic construct
  misc_feature 1..9873: note = derived and/or modified CDS sequence (opt11) from DENV-3__FJ373303__SS-prME
  source 1..9873: mol_type = other RNA
actagcctgtgcctaatgatgatcctgcccgcagcgttggcgttccacctcaccagcagggatggggagccgcggatgatcgtaggtaagaacgagcgcgggaagagcctgctgttcaagactgcctccgggattaacatgtgcaccctcatcgccatggaccttggggagatgtgcgacgacaccgtcacctacaagtgcccccacatcacggaagtagagccagaggacatcgactgctggtgcaacctgaccagcacctgggttacctacgggacttgcaatcaggccggcgagcaccggagagacaagcggtccgtcgccctcgccccccacgtgggcatggggttggatacccgtacccagacctggatgagcgccgagggcgcctggcggcaggttgagaaggtggaaacgtgggccctgcggcaccctgggttcactattctcgcgctgttcctggcccactacatcggcacctccctcacacagaaagtggtgatattcatcttgctgatgctcgtcacgcctagtatgaccatgcggtgtgtgggggtgggtaaccgcgacttcgtcgagggtctgagtggggccacatgggtggacgtggtcctggagcacggcggatgcgtgacgacgatggccaagaacaaacccacgctcgacattgagctgcaaaagaccgaggccacccagctggcgacgctccggaagctgtgcatcgagggcaagatcaccaacataaccacggactcccgctgtcccacccagggcgaggccgtgctgcccgaggaacaggaccaaaactatgtctgcaagcacacctacgtggaccgggggtggggaaacgggtgcggcttgtttggcaagggctccctggtgacttgcgccaagttccagtgcctggagcccatcgagggaaaggtcgtgcagtacgagaacttaaagtacacagtgatcatcacggtccacaccggggatcagcaccaagtgggcaacgagacgcaaggggtcaccgccgagatcacgccccaggccagcaccacagaggctatcctgcccgagtacggcacgctgggactggagtgctccccgcgaaccggcctggacttcaatgaaatgatcctgttaacgatgaagaacaaggcgtggatggttcaccggcaatggtttttcgacctgccgctgccctggacgagcggagccactaccgagacacccacttggaaccgcaaggagctcctagtgacatttaagaacgcgcacgccaagaagcaggaggtcgttgtactggggtctcaggagggcgcgatgcacaccgccctcacgggggccactgagatccagaacagcggggggacatccatattcgcaggccacctgaagtgccggctgaagatggacaaactcgagctgaagggcatgagctacgccatgtgcaccaacacgttcgtcttaaagaaggaggtgtctgagacacagcatggcacgatcctcattaaggtggagtacaaaggcgaggacgtcccgtgcaagatccccttcagcacagaggacgggcagggcaaggcgcacaatggccgcctgatcaccgccaaccccgtcgtcaccaagaaagaggaacccgtcaacatcgaggccgagccgcccttcggggagagcaacattgtgatcgggatcggggacaacgcgctgaaaatcaactggtataagaagggctcctccatcggtaagatgttcgaggccactgctcggggcgcccgaaggatggccatcctgggggacaccgcctgggacttcgggtccgtgggaggagtcctcaacagcttgggtaaaatggtgcatcagatctttgggtccgcgtacactgccctgttctcaggcgtgtcctgggtcatgaaaatcggcataggggtcctactgacctggatcggcctgaactccaagaacacctccatgagcttttcctgcatcgcaatcgggatcatcaccttatacctgggcgccgtggtccaggcagacatggggtgcgtgatcaactggaagggcaaggagctgaagtgcggctccgggatcttcgtgacgaacgaggttcacacctggaccgagcagtacaagttccaggcggactcccccaagcgtctcgcaaccgccatcgccggcgcctgggagaacggtgtctgcggaatcagaagcacgacccggatggagaatctgctgtggaagcagatagcgaacgagctcaactacatcctgtgggagaacaacgtgaagctaacagtggtggtgggagacatcataggcgtactcgagcagggcaagcgcacactgacgccgcagccgatggagctgaagtactcctggaagacctgggggaaggcgaagatcgtaaccgccgagactcagaatagctcctttataatcgacggccccaacacgcccgagtgccccagcgcctcacgggcgtggaatgtgtgggaggtcgaggactacgggttcggggtgttcaccaccaacatctggctcaaactgcgcgaagtatacactcagctatgtgaccaccggctcatgagcgccgccgtcaaggacgaacgtgccgtgcacgccgatatgggctactggatcgagagccagaaaaacgggtcctggaagttagagaaggctagcctgatcgaggtgaagacctgcacgtggccgaagtcccacacactctggagcaacggcgtcctggagtccgacatgatcatacccaaaagcttagccggacccatcagtcagcacaactaccgcccgggctatcatacccagaccgccgggccatggcacctcggtaagctggagctggatttcaactactgtgagggtacgaccgtggtgatcaccgagaactgcggcacccgcggcccaagcctccggacgaccacggtctccgggaagttgatccacgagtggtgctgccgcagctgcaccctgcccccgctccggtacatgggcgaagacgggtgttggtacggaatggaaatccgacccatctccgagaaggaggagaacatggtcaagagcctggtctcagccggcagtggggaagtcgacaacttcacgatgggcgtgctgtgcctcgccattctattcgaagaagtgatgcggggaaagttcggcaagaagcacatgattgcaggagtcttctttactttcgtgctgctcttatctggccagattacctggagagacatggcccacaccttaatcatgatcggcagcaacgcctcggaccggatgggtatgggcgtgacgtacctggccctgatagccactttcaagatccagcccttccttgcgctcgggttcttcctgcgcaagctgacctcccgggagaacctcctgctgggggtcggcttggccatggcgaccaccctgcagctgcccgaggatatcgagcaaatggccaatgggatcgcgcttgggctgatggcactgaagctcatcacccagttcgagacttaccagctgtggaccgccctgatctctctcacctgctccaacaccattttcaccctgacagtggcctggcgcacggccactctgatcctcgcgggtgtcagcctgctgccggtttgccagtccagtagtatgcggaagacagactggctccccatgaccgtggccgccatgggcgtaccgccactcccgctgttcatcttcagcctcaaggacaccttaaaacgccggagctggcccctgaacgagggggtgatggccgtgggcctagtctcgatcctggcctccagcctgcttcggaacgacgtacctatggctggccccctggtggcggggggcctgctcatcgcctgttacgtaattactgggacctcagccgacttaaccgtggagaaggccgcagatgtgacgtgggaggaggaggcggagcagaccggcgtcagccacaaccttatgatcaccgtggacgacgacgggaccatgcgcatcaaggacgatgagaccgagaacatcctcacggtgctgctgaagaccgccctgttgatagtatccggcatcttcccctacagcatccccgccaccctgctcgtgtggcacacctggcagaagcagactcaacggtctggtgtgctttgggacgtccccagcccgcccgaaacgcagaaggccgaactggaggagggcgtatacagaatcaagcagcaggggatctttgggaagacccaagttggagtcggggtgcagaaggaaggcgtgttccacactatgtggcacgtaacgcgtggcgcggtgctaacctataacggtaagcgcctggagccgaactgggcctccgtgaagaaggacctgatcagttatggcgggggttggcggctctccgcccagtggcagaagggggaggaggtccaggtgatcgccgtggaacccgggaagaacccaaagaacttccagactatgcccggcacgttccaaacgaccactggggagatcggtgcgatcgccctggacttcaagcccgggaccagcggctcacccataatcaaccgcgaaggcaaggtcgtggggctgtacggcaacggggtggtcacgaagaacggcgggtacgtgtctggcatcgcccagaccaacgccgagccggacggccccacccccgagctggaagaggagatgttcaagaagcggaacctcaccatcatggacctgcacccggggagcggaaagactcgtaagtacctgccggccatagtgcgtgaggctatcaagaggcggttacgcaccctgatcctggcccccaccagagtcgtggccgccgagatggaggaggccctcaaggggcttcccatccgctaccagaccacggcgaccaagtcggagcacaccggcagggaaatcgtggacctgatgtgtcacgccaccttcacgatgcgcctgctgagccccgtaagggtgccaaactataacctgatcatcatggacgaggcccacttcaccgaccccgctagtattgccgcgcgcgggtacataagcactcgggttgggatgggcgaggccgcggccatattcatgaccgcgacgccgcccggaaccgccgacgccttcccgcagtccaacgcccccatccaggacgaggaacgggacatcccggagcgcagctggaactccggcaatgagtggatcaccgacttcgccgggaagaccgtctggtttgtgccctccataaaggcgggcaacgacatcgcgaattgcctccggaagaacgggaagaaggtgattcagctgtccaggaaaacgttcgacaccgaatatcagaagaccaagctgaacgactgggattttgtcgtgaccacggacatcagcgagatgggcgccaacttcaaggccgaccgggtgatcgacccccgccggtgcttaaagcccgtcatcctgaccgacggcccggagcgcgtcattctggcggggcccatgccggtgaccgctgcgtccgccgcccagcggcgcggccgggtcgggagaaacccacagaaggagaacgatcagtatatcttcacaggtcagccattaaacaacgacgaggaccacgcccactggaccgaggcgaaaatgcttctggataacattaacacgcctgaggggatcatcccggccctctttgagcccgagcgggagaagtctgccgccattgacggcgagtatcgccttaagggggagtcgcggaagacgttcgtggagctgatgcgccgcggggacttacccgtctggttggcgcacaaggtggccagcgaggggatcaagtatacggaccgcaagtggtgcttcgacgggcagcggaacaaccagatcctcgaggaaaacatggacgtggagatctggaccaaggagggcgagaagaaaaaactccgcccacggtggctggacgcccgaacatactccgacccgctggctctcaaggagttcaaggacttcgccgctggacggaagagcatcgccttggacctggtcacggaaatcgggcgggtgccctcccacctcgcccaccgcacccggaacgcgctggacaacctggtgatgctccacaccagcgagcatggcgggaaggcctaccgacacgcggtcgaagagctgcccgaaacgatggagaccctgctcttactggggctcatgatcctgctcaccggcggagccatgttattcctgataagcggcaaggggatcggtaagacgtccatcgggctgatctgtgtgatcgccagctccggaatgctctggatggcggaaatccccctgcaatggatcgcctcagcgatcgtactggagttcttcatgatggtcctcctgatacccgagcccgagaagcagagaacgccccaagataaccagctggcttacgtggtgatcgggatactgaccctggccgccatcatcgccgcgaacgaaatgggcctactcgagaccaccaagcgcgacctgggcatgtccaaggagccgggggtcgtgtctcccacaagctatctggatgtggacttacaccctgcctctgcctggaccctgtacgccgtcgcgaccactgtgattacgcccatgctgcggcacaccatcgagaactccaccgccaatgtatcgctggccgccatcgccaaccaggcggtcgtgctgatgggactggacaaggggtggccgatctcgaagatggatctcggcgtgcccctgctggccctcgggtgctacagccaggtcaaccccctgaccctgactgccgccgtgctcctgctgatcacccactacgccatcatcggccctggcctccaagcgaaggcaacccgtgaggcccaaaagcggaccgccgctggaatcatgaagaatccgacggttgacggcatcatgaccatcgatctggatcccgtaatctacgactccaagttcgagaaacaactgggccaggtaatgctcctggtgctgtgcgcggtccagctcctgctgatgcgcaccagctgggccctctgcgaagccctgaccctcgccacgggtccaatcaccaccctgtgggagggctccccaggaaagttctggaacacaacgatcgctgtgagcatggccaacatattccggggctcctacctagccggtgccggtctggccttcagcatcatgaagtcagtggggacgggcaagcgcggcaccgggagccagggcgagactctcggggagaagtggaaaaagaaactgaaccagctgagcagaaaggagtttgacctctacaaaaagtccggcatcaccgaggtggaccgtacggaagcgaaggaagggctgaaaaggggcgagatcacacaccacgccgtgagccgcggctccgccaagctgcagtggtttgtggaacggaacatggtcatcccagagggccgcgttatcgaccttggctgcggacggggcgggtggtcttactactgtgccggactgaagaaagtaaccgaagtacgcggctacaccaagggcgggcccgggcacgaggagcccgtgcccatgtccacttacggctggaacgtggtcaagctgatgagcgggaaagacgtgttctatctcccgcctgagaagtgtgacaccctgctgtgcgacatcggtgagtcctcgccctcccccaccgttgaagagagcaggaccatccgcgtcctgaaaatggtggagccgtggctcaagaacaaccagttctgcattaaagtgctgaatccctacatgcccacggtcatcgagcatctggagcgcttgcagagaaagcacggcgggatgctggtaaggaaccccctgagtcggaacagcacccacgagatgtactggatctccaacggcaccggtaacatcgtggccagcgtcaacatggtgtcccgcctgctgctgaaccggttcaccatgactcatcgacggccgaccatcgagaaggacgtcgacctcggcgctggaaccagacacgtcaacgccgagcccgagacccccaacatggacgtgatcggggagagaatcaaacgcataaaggaggagcacaattccacgtggcactacgatgatgaaaatccgtacaagacctgggcctaccacggttcctacgaggtcaaggccaccgggagcgcctccagcatgatcaatggcgttgtgaagctgttaaccaagccctgggatgtcgtgccaatggtgacgcagatggcaatgaccgacaccacacccttcgggcagcagcgggtcttcaaagagaaggtggacacgcggaccccgcggtcgatgcccggcacccgccgggtgatgggcatcacagccgagtggctgtggcgcacgcttggccggaacaagaagccccgcctgtgcactcgggaggagttcaccaaaaaggtccgcaccaacgcagcgatgggcgccgtctttacggaggagaaccagtgggactccgcaaaagccgccgtggaggatgaggatttctggaagctggtcgaccgagagcgggagctccacaagctggggaagtgcggcagctgcgtgtacaacatgatggggaagcgcgaaaagaagctcggtgaattcggcaaggccaaagggtccagagcgatctggtacatgtggctgggcgcccgctacctggagttcgaggccctgggttttctgaacgaggatcactggttcagccgggaaaactcctacagcggcgtggaaggggaggggctgcacaagctcggatacatcctgcgcgacatctccaagattcccgggggcgcgatgtacgccgacgacaccgctgggtgggatacccggataaccgaggacgacttacacaatgaggaaaagatcacgcagcagatggatccggagcaccgccagctcgccaacgccattttcaagctgacttaccagaacaaggtcgtgaaggtgcagcggcccacccccaccggcaccgtcatggacataattagccgcaaagaccagaggggcagtggccaggtgggaacgtacgggttaaacaccttcaccaatatggaggcccagctcatccgccaaatggagggcgaaggggtgctctcaaaggcagatctggagaacccccatctcccggaaaagaagatcacccagtggctggagaccaagggcgtcgagcggctgaagcgcatggcgatctccggcgacgactgcgtagtgaaacccatcgatgaccggttcgccaacgctctactggccttaaacgacatggggaaggtccgcaaggacattccccagtggcagccctccaaaggctggcacgactggcaacaggtcccgttctgctcccaccacttccacgagctcatcatgaaagatgggcggaaactggtggtcccttgtcgccctcaggacgaactgataggccgggcccgcatttcccaaggggccggttggtccctccgggagaccgcctgcctggggaaggcttacgctcaaatgtggtccctgatgtactttcaccgcagggacttacggctagcgtccaacgccatctgcagcgccgtgccggtgcactgggtacccaccagccgcaccacgtggagcatccacgcccaccaccagtggatgaccaccgaggacatgctgaccgtgtggaaccgggtgtggatcgaggacaacccctggatggaggacaagactccagtaaccacatgggagaacgtcccctacctcggtaagcgcgaggaccagtggtgcggcagcctgatcgggctgaccagccgggccacgtgggcccagaacatacccactgccatccagcaggtacgcagcctaatcggcaacgaggagtttcttgattacatgccctccatgaagcggttccgcaaggaggaggagagcgagggggccatctggtga

SEQ ID NO: 26018 - RNA, 9873 nt, synthetic construct
  misc_feature 1..9873: note = derived and/or modified CDS sequence (opt11) from DENV-3__KF955451__SS-prME
  source 1..9873: mol_type = other RNA
acctctctgtgcctcatgatgattctgccagcggcgctagcgttccacctcacctcacgggacggcgagccgcggatgatcgtagggaaaaacgagcggggcaagagcctgctgttcaagaccgccagcgggatcaacatgtgcaccctcatcgccatggacctgggcgagatgtgcgacgacaccgtcacctacaagtgcccccacatcacagaagtggagcctgaggacatcgactgttggtgcaacctgactagcacatgggtaacttacggcacgtgcaatcaggcgggggagcatcggagagataaacggtccgtggccctcgccccacacgtcggcatggggctggacacccgtacccagacctggatgtccgccgaaggtgcctggcgccaggtggagaaggtcgagacctgggccctacgccacccgggattcacgattctcgcgcttttcctggcgcactacatcggaacctctctcactcagaaggtggtgatcttcatcttactgatgctagtcacgcccagcatgaccatgcggtgcgtgggggtgggcaaccgcgacttcgttgagggcctgtccggggccacctgggtagacgtggttctggagcacggcggatgcgtgaccacgatggccaagaacaagcccaccctcgacatcgaactgcagaagactgaggccacgcaactggcgacgctccggaagctgtgcatagaaggcaagatcacaaacataaccaccgacagccgctgcccgactcagggcgaggccgtgctgcccgaggagcaggatcagaattacgtttgcaagcatacctacgttgaccggggctggggcaatgggtgcggtcttttcgggaaaggctctctggtgacttgcgccaagttccagtgcctggagcccatcgaaggcaaggtcgtgcagtacgagaacctcaagtacaccgtgatcatcacggtccacactggggaccagcaccaggtgggcaacgagacccagggggtgactgccgagatcacgccccaagccagcaccacagaggccattctccctgagtacggcaccttagggctcgagtgttccccgcgcaccggcctggacttcaacgagatgatcctgctcacgatgaagaacaaggcctggatggtgcaccggcaatggtttttcgacctgccgctgccatggaccagcggcgccacgaccgagacccccacctggaacaggaaggagctcctggtgaccttcaagaacgcccacgccaagaagcaggaggtcgtggttctggggtcccaggaaggggcgatgcataccgccctcacgggggccaccgagattcaaaacagcggcggaacctccatctttgccggccacctgaagtgccggctgaagatggacaagcttgagctgaagggcatgagctacgccatgtgtaccaacacgtttgtcctgaagaaagaggtttccgagacccagcacgggaccatcttgatcaaggtggaatacaagggtgaagacgtcccgtgcaagataccgtttagcaccgaagacgggcagggcaaagcacacaacggtcgcctgatcacggccaatcccgtggtgactaagaaggaggaacccgtaaacatcgaagccgagccgccctttggggagagcaatatcgtaatcggcgtgggggacaacgctctgaaaatcaactggtataaaaagggctccagtatagggaagatgtttgaggcgaccgcccggggcgcccgccgcatggccatcctgggcgacaccgcctgggacttcgggtccgtcggcggggtgctcaactctctgggaaagatggtgcaccaaatctttgggtccgcgtacacagccctgttctccggggtcagctgggtgatgaagattggcatcggtgtcctcctcacctggatcggcctgaactctaagaacacctccatgtccttttcttgcatcgccatcgggattatcaccctctacctgggcgtcgtggtgcaggccgacatggggtgtgtcataaactggaagggcaaggagttaaagtgcgggagcggcatcttcgtgacgaacgaggtgcacacctggaccgagcagtacaaattccaggccgactcccccaaacgcctcgcgactgccatcgccggcgcctgggagaacggggtctgcggcattcgaagcacgacccggatggagaacctgctttggaagcagatagccaatgaactcaactacatcctgtgggagaacaacataaagctgaccgtggttgtaggggatatcatcggcgtgttagagcagggtaagcgcaccctgacgccccagcctatggagctgaagtactcctggaagacctggggtaaggcgaagattgttaccgccgagacccagaacagctcattcataatcgacggcccgaacacgccggagtgccccagcgccagtcgcgcctggaacgtatgggaggtagaggactacgggttcggcgtgttcaccaccaacatatggctcaagctgcgcgaagtctacactcaactgtgcgaccaccggttgatgagtgcggccgtgaaggatgagcgcgccgtgcacgccgacatgggctactggatcgagtctcagaagaacgggagttggaaactggagaaggcctcgttgatagaggtcaagacctgcacgtggccgaagtcacataccctttggtccaacggcgtgctggaatctgacatgatcatccccaagagcctggcggggcccatctctcagcacaactatcggcccggctaccacacccagaccgccggaccctggcacctcggcaaactggagctagattttaactactgtgagggcacgaccgtggtcatcacggagaactgcgggacccgcggccccagcctccggaccactaccgttagcgggaagctcatccacgagtggtgctgccgcagctgcaccctgcccccgctccgctacatgggcgaggacgggtgctggtatggcatggagattcgccccatctccgagaaggaagagaatatggtcaagtctctggtctcagcgggcagcggcgaggtggacaacttcacgatgggagtgctgtgcctcgccatcctgttcgaggaggttatgcgggggaagttcggcaagaaacacatgatcgccggtgttttcttcactttcgtgctgctccttagtggccagatcacctggagggatatggcgcacacgctgataatgatcggcagcaacgcgtccgaccggatggggatgggcgttacgtacctcgcactgatcgccaccttcaaaatccagccttttctggccctcggcttcttcctccggaagctgactagccgggagaacctcctgctgggcgtgggcctcgcgatggccacaacactgcagctacccgaggacgtcgagcagatggccaacgggatcgccctcgggctgatggccctgaagctcatcacccaattcgagacctatcagctgtggaccgccttgatcagcctcacgtgctccaataccatcttcaccctgaccgtggcctggcgcactgccaccctgatcctcgccggggtgagcctgctgccggtctgccagtccagctccatgcggaagaccgattggctccccatgactgtggcggccatgggggtacctcctctaccattattcattttcagcctcaaggacacgctgaagcgccgctcctggccactgaacgagggggtgatggccgtgggcctagtgtcgatcctggccagcagtctgttgcggaacgacgttcccatggccggccccctggtggccgggggcctgctcatcgcctgctacgtgatcaccgggacatcagccgacctgaccgtggagaaggccgccgatgtgacatgggaagaggaggctgagcagaccggggtgtctcacaaccttatgatcaccgtcgacgacgacgggaccatgcgcataaaggacgacgagaccgagaacatcctcacggtgctgctgaagaccgccctcctgatcgtgtccggcatcttcccgtatagcatcccagcgaccctgctcgtctggcacacctggcagaagcagacacagaggagcggcgtgctgtgggatgtgccaagcccgcccgagacccagaaagccgagctggaggagggggtctaccgaattaaacaacagggcatcttcgggaagacccaggtgggcgtgggggtacagaaggagggcgtgttccacaccatgtggcatgtgacgcggggtgccgtcttgacctataacgggaagcgcctggagcccaactgggcgtccgtgaagaaggacctgatctcttacggcggcggatggcggctcaacgcgcagtggcagaagggggaggaggtgcaggtcatcgccgtggagccgggcaagaaccccaagaacttccagacaatgccaggcaccttccagactaccaccggagagatcggcgccattgcgctggacttcaagcccggcacctccggctcccccatcataaaccgcgaggggaaagtggttgggctgtacggcaacggtgttgtgacgaagaatggcgggtacgtcagcggcattgcccagaccaacgccgagccggacggtccgacccccgaactggaggaggagatgttcaagaagcggaatctcacgatcatggacctgcaccccgggtccggtaagacccgcaaatacctgcccgccatcgtgcgcgaagccatcaaacggcgcctccgcaccctaatcctggcgcccacccgggtggtcgccgccgagatggaggaggcactcaaggggctgcccatccggtaccaaaccacagctaccaagagcgagcacactggccgggaaatcgtggatctgatgtgccacgcgaccttcacgatgagactcctgtcccccgtgcgggtcccgaattacaatctgattatcatggacgaggcacacttcacggaccccgccagcatcgccgcgcgcgggtacatctccacgcgggtggggatgggggaggccgccgccatcttcatgaccgccacgccgcccggtacggcggacgccttcccgcagagcaacgcccccattcaagacgaggaacgcgatatccccgagcgctcctggaacagcggcaacgagtggataacagatttcgccgggaagacggtatggttcgttccttccatcaaagccggtaacgacatcgcgaactgcttgcgtaagaacgggaagaaagtaatccagctgtcacgcaagaccttcgacaccgagtaccagaagaccaagctgaacgattgggatttcgtggtcacgacggacatctccgagatgggcgccaatttcaaggcggaccgggtgatcgatcctcgccgttgcctgaagcccgtgattctgaccgacggacccgagagagtcatcctggccggacccatgccggtgaccgccgcgagcgccgctcagcgccgcggaagagttgggcgcaacccccagaaggagaatgaccagtacatctttactggccagcctctcaacaacgacgaggaccacgcccactggaccgaagccaagatgctgctggacaacataaatacgcccgaaggaatcatcccggccctgttcgagcccgagcgggagaagtcggccgccatcgacggtgagtaccgactaaagggcgagagccggaagacctttgtggaactgatgcggcgcggggacctacccgtgtggctggcccacaaggtcgcaagcgaggggatcaagtacaccgatcgcaagtggtgtttcgacggacagcgaaacaaccagatcctggaggagaatatggacgtggagatctggaccaaggaaggagagaaaaagaaactacgccctcggtggctggacgcccgcacatacagcgacccgttggccctcaaggagttcaaagacttcgcagcaggccgcaagtccatcgcgctggacctggtgaccgagatcgggagagtgcccacccacctcgctcaccgcactcgtagcgccctggataatctggtgatgttgcacacgtcggagcacggcggtaaggcctaccgccacgccgtggaggagctgcccgagaccatggagacgctactcctactgggcctcatgatcctgctgaccgggggcgcaatgctgttcctgatcagcggcaagggcatcggcaagacaagcatcgggctgatctgcgtcatcgcctccagcgggatgctctggatggccgagatcccattacagtggattgcctccgccatcgtgctggagttcttcatgatggtgctcctgatcccggagccagagaagcagcggacgccccaggacaaccagctggcttacgtcgtgatcgggattctcaccctggccgccatcatcgccgccaacgaaatgggactgctggagactacgaagcgcgacttgggcatgagcaaggagccgggggtggtctccccgacaagctacctggacgtggatctccatccagcatccgcgtggaccctgtacgccgtggctaccacggtcattacccccatgctgcgccacacgattgagaacagcaccgcaaatgtatccctagccgccatcgccaatcaggcagtggtcctgatgggcctggacaaggggtggccgatcagcaagatggacctcggtgtgccccttctggcgctcgggtgctactcccaggttaaccccctgacgctgacagcggccgttttactgcttatcacccactacgccatcatcggccccggcctccaggctaaggcgacccgcgaggcccagaagaggacggccgccggcatcatgaagaaccctaccgtggatggcatcatgaccatcgacctggaccccgtgatctacgactcgaagtttgaaaaacagctggggcaggtaatgctccttgttctatgcgccgtccagcttcttctgatgcgcacctcctgggcgttatgtgaggccctgacgctggccaccgggcccatcaccaccctctgggagggaagccccgggaagttctggaatacgaccatcgccgtgtccatggcgaacatcttccgggggagttacctggccggggcgggcctggcattctcgatcatgaagtccgtggggaccgggaagcgcggcactgggtcccagggcgagaccctcggtgaaaagtggaagagaaagcttaaccagctgagccgcaaggagttcgacctctacaagaagtccggcatcacggaggtggaccgaacagaggccaaggagggcctgaagcggggggagatcacccaccacgcggtctcccggggctcggcaaagcttcaatggttcgtagagcggaacatggtgattccggaggggcgggtcatcgacctcggttgcgggcggggcgggtggagctactactgcgccggcctgaagaaggttaccgaggtccggggatacacgaagggcgggcccgggcacgaggagcccgtgcccatgagcacgtacggctggaacatcgtgaaactgatgtccgggaaagacgtgttctatctcccgcccgagaagtgcgacaccttactttgcgacatcggagagagctcccccagccccacggtcgaggagtcccgcacgatccgcgtgctgaagatggtggagccgtggctcaagaacaaccagttctgcatcaaggtcctgaacccctatatgcctactgtgatagagcatctggagcggctccagaggaagcacgggggaatgctggtgaggaaccccctgagccgcaacagcacccacgagatgtactggatcagcaacggcaccgggaatatcgtcgcctccgtgaacatggtgagccggctcctgttaaaccgtttcacgatgacccaccgccgcccgactatcgagaaagacgtcgacctaggcgccggcacccgtcacgtgaacgccgagccggagacgcccaacatggacgtcataggggagcgaatcaagcgtataaaagaggagcacaactccacctggcactacgacgatgagaatccgtataagacctgggcctatcacggaagctacgaggtgaaggccacgggatccgcaagctccatgatcaacggtgtcgtcaagctgctgacgaagccctgggacgtggtccccatggtcacccagatggccatgaccgacaccaccccctttggccagcagcgtgtgtttaaagagaaggttgacacccggaccccgcgtccaatgccgggaactcggcgcgtcatgggcatcacggcggagtggctctggcggaccctggggcgcaacaagaaaccgcggctgtgcacccgcgaggagttcaccaagaaagtacgaacgaatgctgccatgggcgctgtattcacagaagagaaccagtgggactccgcgaaggccgccgtcgaggatgaggacttttggaagctcgtggaccgggagcgcgagctgcacaagctgggaaagtgcggcagctgcgtgtacaacatgatggggaagcgggagaagaagctcggcgagtttggcaaagctaaggggtcgagagccatctggtacatgtggttaggcgcgcggtacctggagttcgaggcccttgggttcctgaacgaggaccactggttcagccgcgagaactcctattctggtgtcgagggggagggcctgcataagctcggctacatactgcgggatatctccaagatccctgggggcgcaatgtacgccgacgataccgcaggctgggatacacgcatcacggaggatgatctgcacaacgaggagaaaatcacccagcagatggacccggagcaccggcagctcgcgaatgccatcttcaagttgacctaccaaaacaaggtggtgaaggtccagcgcccaacacccaccgggactgtgatggatatcatctccagaaaagaccaacgcggctccggccaggtcggtacctatgggctgaacacctttacaaacatggaggcccagcttatccggcagatggagggcgagggggttctgagcaaggccgatctggagaacccgcacctctccgagaagaagataacgcagtggctggagactaagggcgtggaacgcttgaaacggatggccattagcggcgacgactgcgtggtcaagccaattgacgaccgcttcgcgaacgctctccttgcgctgaacgacatggggaaggtgcggaaggacatcccgcaatggcagccctcgaagggctggcacgactggcaacaggtgccgttctgcagccaccacttccacgaactcataatgaaggacggccgcaagctggtagtgccctgccggccccaggacgaactgattggcagggcacggatctcccaaggggcaggctggtccctccgcgagaccgcctgtttaggaaaggcctacgcccaaatgtggtccttaatgtatttccacagacgggacctccgcctggcttcgaacgccatttgctccgccgtccccgttcactgggtgccgaccagccggacgacctggtccatacacgcccatcaccaatggatgaccaccgaggacatgctgacggtatggaaccgcgtatggatcgaggacaacccttggatggaggacaagacccccgtgacgacctgggagaacgtcccctacttggggaagagggaggaccagtggtgcggctctttaattggtctgactagccgcgcgacatgggcccagaacatcccgaccgcgatccagcaggtccggtccctcatcggcaacgaggagttcctggactacatgcccagcatgaagcggttcaggaaagaggaggaatccgaaggggctatctggtga

SEQ ID NO: 26019 - RNA, 9873 nt, synthetic construct
  misc_feature 1..9873: note = derived and/or modified CDS sequence (opt11) from DENV-3__KF955453__SS-prME
  source 1..9873: mol_type = other RNA
acctctctgtgtctaatgatgattctccccgcgaccctggccttccacctcaccagccgggacggggaaccgcggatgatcgtagggaagaacgagcgtggcaagagcctgctgttcaagaccgcgtccgggatcaacatgtgtaccctcatcgccatggacctgggcgagatgtgcgacgacaccgtgacctacaagtgtccccatatcaccgaagtggagccagaggacatcgactgctggtgcaacctgacgtccacctgggtgacctacgggacgtgtaaccaggcaggcgagcatcggcgcgacaaacggtccgtggcactcgcgccccacgtgggcatggggcttgacacccgcacccagacctggatgagcgcggagggtgcctggcgccaggtggaaaaggtcgaaacctgggcgctccgccaccccgggtttacaatcctcgccctgttcctggcgcactacatcgggacatccctaacgcagaaggtggtgatctttatcctactgatgttagttacccccagtatgaccatgcggtgcgtgggtgtgggaaatcgcgacttcgtcgagggcctgtccggagcgacctgggtggacgtggtcctcgaacatggaggatgcgtgacgaccatggccaagaacaagcccaccctcgatatcgaattgcaaaagaccgaagccactcagctggctaccctccggaaactgtgtatagagggtaagatcaccaacatcaccaccgacagccgctgccctacccagggcgaggctgtgctgcccgaagagcaggatcaaaattacgtctgcaagcacacctacgtggacaggggctggggcaacgggtgtggcctcttcgggaagggctccttggtaacatgcgcaaagttccagtgcctggagcccatcgagggaaaggtggtgcagtatgagaacctcaagtacacggtgatcatcaccgtccacaccggggatcagcaccaggtgggtaatgagacacagggagtaacagccgagatcactccccaggccagcaccaccgaggccaccctgcccgagtacggtacgctggggctcgaatgttcccctcgcaccggtctggacttcaacgaaatgattctccttacgatgaaaaacaaggcgtggatggtacatcggcagtggttcttcgacctgcctttaccctggaccagcggcgccacgacagagacccccacctggaaccgcaaagagctcctggtgacattcaaaaacgcccacgcaaaaaagcaggaggtcgtagtgctgggcagtcaggaaggcgccatgcatacggcgctcaccggggcgactgagatccagaactctggagggacgtccatatttgctggccacctgaagtgccggctgaagatggacaagctagagctcaaaggcatgagctacgcaatgtgcaccaacacgttcgtcctgaaaaaggaggtgagtgagactcagcacgggacgatcctgatcaaggtggaatataagggcgaggacgtaccgtgcaagattccttttagcaccgaagacggccagggcaaggctcacaatggccgcctaatcaccgcgaaccccgtagtgacaaagaaggaggagcccgtcaacatagaggccgagccgcccttcggggagagcaatatcgtgataggcatcggggacaatgccctgaaaatcaattggtataagaaaggttcctccatcgggaagatgttcgaggccacggcgcgaggagcccgccgaatggccatcctgggcgacaccgcttgggacttcgggtccgtgggaggagtattaaatagcctgggcaagatggtgcaccagatcttcgggtccgcctacacagcgctgtttagcggggtatcctgggtcatgaagatcggcatcggggtgctcctgacatggatcggactgaactccaagaacacgtccatgagcttctcctgcatcgcaatcgggataatcaccttgtacttgggcgccgttgtccaagccgacatggggtgcgttatcaactggaaggggaaggagctaaaatgcgggagcgggatcttcgtgaccaacgaggtccacacctggacggagcagtacaagttccaagccgactcccccaaacgcctcgcgaccgcgatcgctggtgcgtgggagaacggggtttgtggcatacgttctaccactcggatggagaaccttctttggaaacaaatcgccaacgaactcaactatatcctgtgggagaacaacataaagctgacggtggtcgtaggcgacatcatcggcgtcctcgagcagggcaagcggactctgacgccccagcctatggagctgaagtacagctggaagacctgggggaaggcgaagatagtcacggctgaaacccagaacagctccttcatcatagacggccccaacacccccgagtgtcccagcgccagccgggcctggaacgtttgggaggtggaggactacgggttcggggtctttacaaccaacatctggctcaagcttagagaggtgtacacgcagctttgcgatcaccgactcatgagtgctgcggtgaaagacgagcgggccgtccacgccgacatgggttactggatagaatctcagaagaacggatcctggaagctggagaaggccagcctgatcgaggtgaagacttgcacctggccgaagtcccatacactctggtcaaacggcgtgctggagtctgatatgataatacccaagagcctggcaggtcccatttctcagcacaactaccgtccgggctaccacacgcagaccgctgggccgtggcacctcggcaagctagagctggatttcaattactgcgagggcaccaccgtcgtaatcacggagaactgcgggactcgcggccccagccttcgtacaaccactgtgtccggaaagctgatccacgagtggtgctgccgcagctgcaccctgccgccgctccggtacatgggcgaagacgggtgctggtacggcatggagatccgccccatcagtgagaaggaagagaacatggtcaagtccctggtgtccgccggatctggggaggtggacaacttcaccatgggcgttctgtgcctcgccatactgttcgaggaggtgatgcgggggaagttcggcaagaagcacatgatcgccggggtgttctttaccttcgtgctgcttctgtccggccagataacgtggcgcgacatggcgcacaccctgatcatgataggttcaaacgccagtgacaggatggggatgggcgttacctaccttgccctgatagcgaccttcaaaatccaacccttcctggccctcgggttcttccttcgcaagctgacgagccgcgagaacttgttgctcggtgttggcctcgcaatggccaccaccctgcagctgcccgaggacatcgagcagatggcgaacgggatcgccctgggcctgatggcgctgaagctcatcacccagttcgagacgtaccagctgtggaccgctctgatcagcctcacctgctccaacaccattttcactttaaccgttgcgtggcgcaccgccaccctgatcctcgcaggagttagcttactgccggtctgccagtccagctccatgcggaagaccgattggctccccatgaccgttgcggccatgggcgtgcctcccctcccgttgttcatatttaatttgaaggacactctgaaacgtaggagctggcccctgaacgagggagtcatggccgtcggcctcgtttccatcctggcctcttccctgcttcgcaacgatgtgcccatggctggccctctggtggccggcgggctgctcatcgcatgctacgttatcaccggaacgagtgcggacctgactgtggagaaggccgccgacgtgacctgggaggaagaagcggagcaaaccggggtgtcccacaacctgatgatcactgtggacgacgacggaacgatgcgaattaaggacgacgaaaccgagaacattctcaccgttctgctgaagaccgccctcttgatcgtctccggcatattcccgtactccatccccgccacacttctcgtctggcacacctggcaaaagcaaactcagagaagcggcgtgctgtgggacgtgccctctccgcccgagacacaaaaagccgagctagaggagggagtctaccgcatcaagcagcagggcatattcgggaagacccaggttggcgtgggggtccagaaggagggggtgtttcacaccatgtggcacgtgacccgaggcgccgtcctcacctataacgggaagagattggagcccaattgggcgagcgtgaagaaggacttgatcagttacggcggggggtggaggctgagcgctcagtggcaaaagggcgaggaggtgcaggtcattgcagttgagcccggcaagaaccctaagaacttccagaccatgccgggcacctttcaaaccaccacgggggagatcggcgccatcgcgctggacttcaagcctgggacctccggtagcccaatcatcaaccgcgagggcaagattgtagggctgtacggcaacggagtcgtgaccaagaacggtggatacgtctcagggattgcacagaccaacgccgagccggatggacccacacctgagctagaagaggagatgttcaaaaaacggaacctaacaattatggacctccaccccgggtccgggaagacccgcaaatacttgccggccatcgtccgggaagctatcaagagaagattgcgcaccctgattctggcgcccacgcgtgtggtggccgccgagatggaggaggccctcaagggtctgcccatccgctaccagactaccgccaccaagagcgagcacacgggccgggaaattgtagacctgatgtgccacgcgaccttcaccatgcgcctcctgtccccggtgcgcgtgccgaattacaaccttatcataatggatgaggcccacttcaccgacccagccagcatcgccgcgcgggggtacattagcacgcgggtcggcatgggtgaggcggccgccatcttcatgacagccacgccgccgggaacggccgacgccttcccgcagtctaacgcccccatccaggatgaagagcgcgacatacccgagcgctcctggaacagtggaaacgagtggatcacggacttcgccgggaagaccgtgtggtttgtgccctccattaaggccggtaacgacatcgcgaactgtctccggaagaacgggaagaaggtcattcagctatcccgcaagaccttcgataccgagtaccagaagacgaaactgaatgactgggacttcgtcgtaaccaccgacatctccgagatgggcgcgaatttcaaggcggaccgggtgatcgacccccgccggtgcctcaagccggtgatcctcaccgacggccccgaacgagtgatcctcgccggaccgatgccggtcaccgccgcgtctgcagcccagcggcgtggccgggtgggcaggaacccccagaaggagaatgaccagtacatcttcactggacagcccctcaataacgacgaagaccacgcccattggacggaggccaagatgctgctggataacatcaatacccccgagggtatcatcccggccctgtttgagccagaacgcgagaagagcgccgccatcgacggcgagtatcgcctgaaaggcgagagccggaaaaccttcgtggagctgatgagacgcggggacctccccgtgtggctggcccacaaggtggcgtccgagggtatcaagtacacagaccgcaagtggtgcttcgatgggcagcggaacaaccagatattggaggagaacatggacgtcgagatctggacgaaggagggcgagaagaagaagctccgtccccggtggttggacgcccgtacctacagcgaccctctggctctcaaggagttcaaagacttcgccgccggccgcaagtccatcgcgctggacctggtgaccgagatcgggcgggtgcctacgcacctagcacatcgcacccggaatgccctggacaacttagtcatgctacacaccagcgagcacggcggaaaagcctaccgccacgcagtggaggagctgccagaaaccatggagacgttactccttctggggctcatgatctccctgacggggggggcgatgctcttcctcatctcaggcaaggggatcggcaagaccagtatcgggctcatctgcgtgatagcctcctcgggcatgctgtggatggccgagatcccgctacagtggatcgcttctgccatcgtcctggagttcttcatgatggtcctgctcatcccagagcccgagaagcagcgtacccctcaggacaaccaactggcttacgtggtcattgggatcttgacgcttgcagctatcattgccgccaacgagatgggcctgctggagactaccaaacgcgacctcggcatgtcgaaggaaccaggggtggtctcccccaccagctacctggacgtcgacctgcaccccgcctccgcctggaccctctacgccgtggcgacaaccgtgatcacccccatgctgcggcatacaattgagaactcgaccgcgaacgtctccctggcagcaatagcgaaccaggccgtcgtgctcatgggcttagacaaagggtggcccatcagcaagatggacctgggcgtccccctcctggcgctgggttgctattcccaggtgaacccccttacactgaccgccgccgtgctgcttctaatcacgcactacgcaatcatcggccctggcttacaggctaaggctacccgcgaggcacagaagcgaacagccgccgggatcatgaagaacccgaccgtggacggcattatgacgatcgacttggatcccgttatttacgacagcaagttcgagaaacagctaggccaagtgatgttactcgtcctgtgcgccgttcagctgcttctgatgcgcacctcctgggctctgtgcgaggccctcacgctggccactggtccaataacgaccttgtgggaaggctcgcccgggaagttctggaacaccaccatcgccgtgtccatggcgaacatcttccgaggcagctacctcgccggggcgggcttggccttctccataatgaaatctgtcggaactggcaagcgcggcacgggttcccagggtgagaccctgggggagaagtggaagaaaaagctcaatcagctgtcccgtaaggagtttgacttatataagaagtccggaatcaccgaggtggacagaaccgaggccaaggaggggctcaaaaggggcgagatcacccaccatgcggtctcccgcggcagcgccaagctacagtggtttgtagagcggaacatggtgatcccggaggggcgcgtgatagatctggggtgtgggcggggcgggtggtcctactactgcgcaggactcaaaaaggttaccgaggtgaggggttacaccaagggtgggccggggcacgaggaacccgtgcccatgagcacctacgggtggaacatcgtcaagctaatgtccggaaaggacgtgttctacctgccacctgagaagtgcgacacgctcctttgcgacatcggcgaatcttcgcccagcccaacagtggaggaatctcggaccatcagagtcctgaagatggtggagccgtggctcaagaacaaccagttctgcatcaaggtgctcaacccctatatgcccactgtcatcgagcacctggaaaggctgcaaaggaagcacggcgggatgctcgtgcgcaaccccctgagccggaacagcacgcatgagatgtactggataagcaacggcactgggaacattgtcgcctccgtaaacatggtgagccgcctactccttaaccgcttcaccatgacccaccggagaccgacgatcgaaaaggacgtggacttaggtgccggaactcgccatgtcaatgcggagcccgaaacccccaacatggacgtgatcggggaacggatcaagcgcatcaaggaggagcacaactcgacttggcactacgacgacgagaacccgtacaagacgtgggcttaccacggcagctatgaggttaaggccaccgggtcagctagctccatgatcaacggcgtcgtcaagctcttaactaaaccctgggacgtagtgcccatggtgacgcaaatggccatgacggacaccacccccttcggacagcagagagtcttcaaagagaaggtggacacccgtactccgcgaagcatgcccggcacccgacgggtgatggggatcactgcggaatggctgtggcggaccctcggtcggaacaagaagccccggctgtgcacacgggaggagttcaccaagaaggtccgcacaaacgccgccatgggggccgtgtttaccgaggagaatcaatgggatagcgcgaaagccgccgtggaggacgaggatttctggaaactggtcgaccgcgagcgggagctccacaagttggggaagtgcggctcctgtgtctacaacatgatgggaaagcgtgaaaagaagttgggcgaattcggcaaggccaaagggagcagagccatctggtacatgtggctcggggcgcgctacctagagttcgaggcactggggttcctcaacgaagaccactggttttcacgggagaacagttacagtggcgttgagggtgagggcctgcataagctgggctatatcctccgcgacatctccaagatacccgggggtgccatgtacgccgatgacacggccggatgggacacccggattacagaggacgaccttcacaacgaggagaagatcacgcagcagatggacccggagcaccgccagctggcgaacgcgatcttcaagctcacctaccagaacaaggtcgtcaaggtccagcgacccacgcccacgggcactgtcatggacattatctcccgcaaggaccaacggggcagcggccaggtggggacctacgggctgaacacatttaccaacatggaagcccagctgatccgacaaatggagggggagggggtgctctccaaggccgacttggagaatccacacctccccgagaagaaaataacacaatggctggagaccaagggagtggagcggctgaagcgcatggccatcagtggcgacgactgcgttgtgaagcccattgacgaccggttcgcaaacgcgctgctcgccctaaacgacatggggaaagtccgaaaggacatcccacagtggcaaccctcaaaaggctggcatgactggcagcaggtaccattctgcagccaccacttccatgagctgatcatgaaggacggtcggaagttggtggtgccctgccgcccccaagacgagctgatcggccgggcccgcatcagtcaaggggctggctggagcctgcgggaaacggcctgcctcggcaaggcctacgcccagatgtggtccctgatgtacttccaccgcagagacctgcggctcgccagcaacgctatctgctccgccgttcccgtgcactgggtccccaccagccggaccacctggtccatacatgcacaccaccagtggatgacgaccgaagatatgctgaccgtgtggaaccgggtgtggatcgaggacaacccctggatggaggacaagacccccgttacaacctgggagaatgtgccctacttaggaaagcgcgaggaccagtggtgtggcagcctcattgggctgaccagccgggccacatgggcccagaacatcccgacggccatccagcaagtcagatccctgatcggcaacgaggagttcttggactacatgccttcaatgaagcggtttcggaaggaggaggagtcagagggggcaatctggtga

SEQ ID NO: 26020 - RNA, 9873 nt, synthetic construct
  misc_feature 1..9873: note = derived and/or modified CDS sequence (opt11) from DENV-3__FJ373304__SS-prME
  source 1..9873: mol_type = other RNA
accagcctctgcctaatgatgatcctgcctgccgccctcgcgttccatttgacctcccgggacggcgaaccacggatgatcgtggggaaaaacgagcgcggcaagagcctgttgttcaagaccgccagcgggataaacatgtgcaccttaatagccatggacctgggggagatgtgcgacgacacggtgacctacaaatgcccacacataaccgaggtagagcctgaagacatcgattgctggtgtaatctcacatctacatgggtcacctacggtacgtgcaatcaggcgggcgagcaccgccgcgacaagcggtcggtcgccctggcgccccacgtaggcatgggcctggatacccgcacccaaacctggatgtcggccgagggcgcctggcgtcaggtcgagaaagttgaaacgtgggcgctgcgccacccggggttcaccatcttagcgttattcttagcccattatataggcacctccttaacacagaaggtggtgatcttcatccttctaatgcttgtcacgccctcgatgactatgcggtgtgtgggtgtcggaaaccgcgacttcgtcgagggtctgtcgggagcgacctgggtggacgtggtactggaacatggcgggtgcgtcaccacgatggccaagaacaagcccaccttagacatcgagttgcagaagaccgaggccacccagctggccacgctccgaaaactatgcatagagggaaagattaccaacataaccaccgatagccgctgtcccactcagggcgaggctgtgctgccagaggaacaagaccagaactacgtctgtaagcacacctacgtggaccgcggctggggcaacggttgcggcctcttcggaaagggcagtctggtgacctgcgccaagttccagtgccttgaacccatcgaaggcaaagtcgtgcagtatgaaaacctcaagtacaccgtgattatcacggtccacaccggggatcagcatcaagtgggaaatgaaacccagggggtaactgccgagatcacgccccaggcaagtaccaccgaagcgatacttcccgaatatggcaccctgggtctcgagtgctccccgcgcaccggactagacttcaatgagatgattctgctcacaatgaagaacaaggcctggatggtgcacagacagtggtttttcgacctgccactgccctggaccagcggcgctaccaccgagacgcccacttggaacaggaaggagttacttgttaccttcaagaacgcacacgcaaaaaagcaggaggtcgtcgttctgggctcacaggaaggggcgatgcacacggccttgacgggtgcaaccgagattcagaacagcggcgggacctccatcttcgcaggtcacctcaagtgccgactaaagatggataaactcgaactgaagggcatgagctacgccatgtgcacgaacacattcgtgctgaagaaggaggtgtcagagacccagcacgggaccattctaatcaaggtcgagtacaagggcgaggatgtcccttgcaagatacccttctcgaccgaggacgggcagggaaaagcccacaacgggcgcctaatcacggctaaccccgtcgtgaccaagaaggaggagcccgtcaacatcgaggcagaaccgccattcggagagagcaatatcgtgatcggcatcggggacaacgctctgaagataaactggtacaagaagggctctagcatcgggaagatgttcgaggcgacagcgcggggcgctcgccggatggccatcctcggcgacaccgcgtgggattttggttccgtgggaggtgtcttgaatagtctggggaaggtagtgcaccaaattttcggatccgcgtacaccgccttattctcaggcgtaagttgggtgatgaagatcggcatcggagtgctattaacttggatcggacttaactccaaaaacacttccatgagcttcagttgtatcgccattgggatcattaccttatacttgggtgcagtcgttcaggccgatatgggttgcgtgatcaactggaagggcaaagagttaaaatgcggcagtgggatcttcgtcacgaacgaggtacacacctggacagagcaatacaaattccaggcggactcccccaagcgcctcgccaccgctatagccggagcctgggagaacggggtgtgcggcatccgttccacgacccggatggagaatctcctgtggaagcaaatcgcgaacgaactcaactacatcctgtgggagaataacatcaagctgaccgtcgtggtgggggacaccattggcgtgctcgaacagggtaagcgcaccctgacgccgcagcccatggagctaaagtattcgtggaagacgtggggtaaagccaagatcgtgaccgccgagacgcaaaacagctccttcatcatcgatggcccaaacacccccgagtgcccgagcgcctcgcgggcttggaacgtatgggaggtggaggactatgggtttggcgtcttcaccaccaatatctggctcaagctgcgagaggtgtacactcagttgtgcgatcaccggttaatgtcggccgctgtaaaggacgagcgcgccgtgcatgctgacatgggctactggatcgaaagccagaaaaacgggtcctggaaactggaaaaggcgagcctcattgaggtgaaaacgtgtacgtggccgaagagccacaccttgtggagcaacggcgtcctggagtccgacatgatcatacccaagagtctcgccgggcccatctctcaacacaattaccggcctggataccatactcagacggccgggccctggcatcttggcaagctggagctggacttcaactactgcgagggcacgaccgtcgtgatcaccgagaactgtggcacgcgcggccctagcctccgtaccacgaccgtctccgggaagctgatacacgagtggtgttgccgctcatgcacgctgccgccgctgaggtacatgggtgaggacggctgctggtacggcatggagatccgccccatatccgaaaaagaggagaacatggtcaagagcttagtgtccgctggctcgggagaggtagataacttcaccatgggcgtgctgtgtttagccattcttttcgaggaggtaatgcggggcaagttcggcaaaaaacacatgatagcgggggtcttcttcacattcgtgctactcctgtccggccagatcacctggcgggacatggcccacaccttgatcatgataggcagcaacgcctccgaccgaatggggatgggagtaacgtaccttgcgctgatcgccaccttcaagatccagcctttcctggcattagggttctttctgcgaaagctgacatctagggagaacttgctgctgggcgtaggcctcgcaatggccacgaccttacagctaccggaggacatcgaacagatggcaaatgggatcgcgctcggcttgatggccctgaagctaatcacccaatttgaaacctatcagctgtggacggccctaattagcttgacgtgttccaatacaatcttcacactgacggtggcctggcggaccgccacgttaatccttgcgggggtcagcctgctgcctgtctgccagtcaagttcaatgcggaagaccgattggttgccgatgacggtggcggccatgggcgtgccgcccctccctctctttatcttcagcctcaaagacaccctcaaaaggcgatcctggccactgaacgaaggtgtgatggcggtaggcctcgtgagcatcctcgcttcctcactgttaaggaatgacgttcctatggcgggccctctggtagccggagggctactaatcgcatgctacgtaatcaccgggacctccgccgacctgaccgttgagaaggccgcggacgtgacctgggaggaggaggccgaacaaaccggcgtcagccacaacctcatgatcacagtggacgacgacgggaccatgcgcatcaaggatgacgagacagaaaatatcctcaccgtgctgctaaagaccgccctcctgatagttagcggcatcttcccgtacagcatcccagccaccctacttgtgtggcatacctggcaaaagcagacgcagcggagtggcgtgctgtgggatgtccccagccctccggagacccaaaaagctgagctggaggaaggggtgtaccgtatcaagcaacagggcatatttgggaagacccaggttggggtcggcgtgcagaaagaaggcgtctttcacacgatgtggcacgtcacccgcggcgcggtgcttacctataacgggaagcgcctggaaccaaactgggcttccgtgaagaaggatttgattagctatggcggcggctggcggctttccgcacaatggcagaaaggcgaggaggtccaggtgatcgcagtggaacccggcaagaacccaaagaacttccagaccatgcccggcacgttccagactacgacaggggagatcggggcaatcgccctcgacttcaagcccgggacctccggaagccccatcatcaaccgcgagggcaaggtcgtggggctgtacgggaacggggtggtcacgaagaacggagggtacgtctccggtatcgcccagacaaacgccgagccggacggccccacaccagagctggaggaggagatgttcaagaagagaaacttgacaattatggacctgcaccccggcagcgggaagacccgcaaataccttccagccatagtccgcgaagcgatcaagcgccggctccgtaccctgatcctagcccccacccgggtcgtagccgccgagatggaggaggccctcaaggggctgcccatccggtatcagacaaccgcgaccaagtccgagcacacaggtcgggagatagttgatctcatgtgtcacgccactttcaccatgcgcctcttaagccccgtccgagtgcctaactacaacctaattatcatggacgaagcccacttcaccgacccggccagcatcgccgcccgcgggtatatcagtacccgggtggggatgggcgaggccgctgcgatcttcatgacggcaacgcctcctgggacggcagacgcatttccacagagcaacgccccaattcaggacgaagagcgcgacattcccgagaggagctggaactccggtaatgagtggatcaccgacttcgccgggaagacggtctggttcgtacccagcatcaaggcaggcaacgacatcgccaactgcttaagaaagaatggaaagaaggttattcagctcagtcgaaagacctttgataccgagtatcagaaaaccaagttaaatgactgggactttgtcgtgacgaccgatatatcggaaatgggcgccaacttcaaggccgaccgggtgatcgacccccgccggtgcctcaagccagtaatcctgacagacggccccgagcgcgtaatactggccgggcccatgccggtcacggcggcctcggccgctcagcggcgcgggcgggtcgggcgcaacccccagaaggaaaacgaccagtacatcttcacgggccagcccctcaacaatgacgaggaccacgcacactggacggaggcgaagatgctgcttgacaacatcaatacccccgaggggatcatcccggcactcttcgagcccgagcgtgagaaatcagccgccatcgacggagagtatcgcctgaagggcgagtccaggaagacgtttgtggagctgatgcgccgcggtgacctacccgtgtggctggcgcacaaggtagccagcgagggcatcaagtataccgaccgcaagtggtgtttcgacggccagcggaacaaccagatcctggaagagaatatggacgtggagatctggaccaaagagggggagaagaaaaagctccgtccgcggtggctagatgcacgaacctacagcgaccctctggcactgaaggagttcaaggactttgccgcgggccgcaaaagcatcgccctggacctggtaacagagataggtcgggtacccacccatcttgcccaccgcacccggaacgcgctggacaacttggtgatgctacacacctccgagcacggcgggaaggcctaccgccacgcggtcgaggagctgcccgaaaccatggagaccttattactcttaggactcatgatcctactgactggcggggccatgctgttcctgatcagtgggaaagggatcggtaaaacaagcatcgggctgatctgcgtgatcgcgtccagcggcatgctttggatggccgaaatccctctacagtggatagccagcgcaattattcttgaattcttcatgatggtgttactgatccccgagccggagaagcaaagaactccccaggataaccaactggcctacgtcgtgatcgggattctcactctagcggccattatcgcggcgaacgaaatgggcctgctcgagaccaccaagagggacctaggcatgagcaaagagccgggggtagtctccccgacctcgtatctagacgtcgatttgcaccccgcctcagcgtggacactatatgccgtcgcgacgacggtcatcaccccaatgctccggcacaccatagagaacagtaccgccaacgtgtccctcgcagcgatcgcgaatcaggccgtagtcctgatgggcctggacaaggggtggccaatctccaaaatggacctcggtgtgcctctgctggccctcgggtgctactcacaggtaaaccccctgaccctgacagcagccgttctcctgctcatcacccactacgccatcattggccccgggctccaggcgaaagcgacgcgcgaggctcagaagcggaccgcagccggcatcatgaagaaccctaccgtggatggtatcatgacgatcgacctggatcccgtgatctacgacagcaaattcgagaagcagctggggcaggttatgctcctagtgttgtgcgctgttcagttactgttaatgcgaacgtcctgggcactctgcgaggctctaacgctggctacaggccccatcaccaccctctgggaaggcagccccggtaagttctggaacaccaccattgcggtctccatggcaaacatctttcggggaagctacctggccggggccggcctggcattttcgatcatgaagtccgtagggaccggcaagcgaggtaccgggagccaaggcgagacattgggggagaagtggaagaagaagcttaaccagctgtcgcgaaaggagttcgatctctataagaagtcgggcatcactgaagtggatcggacggaggctaaggagggactaaaacgcggagaaatcacacaccacgcggtctcccggggcagcgctaagctacagtggttcgtagagcggaatatggtgatcccagagggtcgcgtcatcgaccttggctgtggacggggcggctggtcctactattgcgccgggctaaagaaagtgactgaagtgagaggctacacaaagggcgggcccggacatgaagagcctgtccccatgtcgacctacgggtggaacatagtgaagctgatgtctgggaaagatgtattctacctcccaccagagaagtgcgataccctgctgtgcgacatcggtgagagttcccccagccccacggtggaggagtcacggactatccgagtgctgaaaatggtagagccgtggctcaagaacaaccagttctgcatcaaagtcttaaacccctatatgcccaccgtcatagaacacctagagaggctccagcggaagcacggcgggatgctggtgcgcaacccattgtcacggaactccactcacgaaatgtattggatcagcaatggaacgggtaacatcgtcgccagcgtgaatatggtaagccgcctgctattgaaccggttcacaatgacccaccgccggcctactattgagaaagacgtcgacctcggcgcgggcacgcgccacgtaaacgctgagcccgagaccccaaacatggacgttataggtgagcgcataaagagaataaaggaagagcacaactccacttggcactatgacgacgagaacccgtacaagacctgggcttaccacggctcttacgaagtcaaggcgactggttcagcctcatcgatgattaacggggtggtgaagttgttgaccaaaccctgggacgtagtgcctatggtcacccaaatggcgatgactgatactacccccttcggccagcagcgtgttttcaaggaaaaggtggataccagaacaccgcgtagcatgcccggcacgcgccgggttatgggcatcaccgccgagtggctctggcgaaccctggggcggaacaagaagcctagactgtgcacccgggaggagtttacgaagaaggtgcgcacaaacgccgcaatgggagcggtctttaccgaagagaatcagtgggactccgcaaaggccgccgtcgaagatgaggatttttggaagctcgtagaccgtgagcgagaactgcacaaactgggaaaatgtggcagttgcgtgtacaacatgatggggaagagagagaaaaagctcggcgagtttggaaaggcgaaagggtctcgggccatctggtacatgtggctgggtgcgaggtatctggagttcgaggccctaggcttcctgaacgaagaccactggttcagtcgggagaacagctattccggggtcgagggagagggcctgcataagctgggctatatcttaagagacatttcaaagatccccgggggtgccatgtacgccgacgacactgctgggtgggacacgcggattaccgaggatgacctccacaacgaggagaaaatcacccagcagatggaccctgaacacaggcagctcgccaacgccatcttcaagctgacctaccagaacaaagtggttaaggtccagaggcccactccgacggggaccgtgatggacatcatcagtcgaaaggaccagaggggcagcggacaggtaggtacatacgggctgaacaccttcacgaacatggaggcccaactcatccgccagatggagggcgagggtgtcctgtccaaagccgatctggagaatccacatcttcctgagaagaagataactcagtggctcgagaccaagggcgtggagcggctgaagcgaatggcgatcagtggcgacgactgcgtggtcaagcccatcgacgatcggttcgccaacgccctactggcccttaacgacatgggcaaggtacgtaaggatattccccagtggcagccgtccaaaggctggcacgactggcaacaagtccctttctgtagccatcacttccacgagttaataatgaaggatgggcggaagctggtcgttccctgtagaccccaagacgaactgatcggacgggccaggatctcccaaggggcaggctggagcctccgggaaaccgcgtgtctaggcaaggcctacgcgcagatgtggtccctgatgtacttccatcgcagagacctccgacttgctagtaacgcgatatgtagcgccgtgcccgtacattgggtgcctacgtcgcgcactacctggtccatccatgctcaccaccaatggatgaccacggaagatatgctgaccgtttggaacagagtttggatcgaggacaatccgtggatggaggacaaaacccccgtgaccacgtgggaaaacgtcccctatttggggaagagggaagaccagtggtgtggcagcctgataggcttaactagccgggccacgtgggcgcagaacatcccgacggcgatccagcaggtacgatccctcatcggcaatgaagagttcttagattatatgccgtccatgaagcgattccgcaaggaggaggagtccgagggcgccatatggtag

SEQ ID NO: 26021 - RNA, 9873 nt, synthetic construct
  misc_feature 1..9873: note = derived and/or modified CDS sequence (opt11) from DENV-3__EU854291__SS-prME
  source 1..9873: mol_type = other RNA
accagcctctgcttgatgatgatcctgcccgccgccctggcattccacttgacctccagagacggcgagccgcggatgattgttgggaagaatgagaggggcaagtctctgcttttcaagactgcctccgggatcaacatgtgcaccctcatcgctatggatctgggagaaatgtgcgacgacactatcacctacaagtgcccccacatcaccgaggtggagcccgaggacatcgattgctggtgcaacctgaccagtacatgggtgacctacgggacctgcaaccaggccggcgagcaccggcgcgacaagcggtccgtagccttggctccccacgtcggcatggggcttgacacccgcacccagacctggatgagcgccgagggggcctggcgccaggtggagaaggtggagacttgggctctgcggcacccggggttcaccatcttagcgctgtttttagcccactacataggcacctccctcacccaaaaggtcgtgatcttcattctgctgatgctcgtgactccgtccatgacaatgcggtgcgtcggggtgggcaaccgcgacttcgtggaaggcctgtccggggccacctgggtcgacgtagtgctcgagcatggcgggtgcgtcaccacaatggccaagaacaagccaaccctcgacatcgagctgcagaagacagaagccacccagctggcgacgctccggaagttgtgcatagagggcaagatcacgaacatcacgacggactcgcgttgccccacgcagggcgaggccgtgcttccggaggagcaggaccagaactacgtgtgcaagcacacctacgtcgatcgggggtgggggaacgggtgcgggctttttgggaagggctccctagttacctgtgcgaagttccagtgcctggaacccatcgagggaaaggtggtccagtacgaaaacctcaagtacaccgtgatcatcacggtgcacaccggggaccagcaccaggtggggaacgagacccagggggtgaccgccgagatcactccgcaggcgagcacaaccgaagcgatcctgcccgagtatggcacacttgggctagagtgctccccgcgcaccggcctggactttaacgagatgatcctgctcacgatgaaaaataaggcctggatggtccaccgtcagtggttcttcgacctacctctgccttggaccagcggcgcaaccaccgagacgcccacatggaaccgcaaggagctcctggttacattcaagaacgcccacgccaaaaagcaagaggtggtcgtgctggggtcccaggagggcgcgatgcatacagccctcacgggagcaaccgagatccaaaactccggcggcacctccatcttcgccggccacctaaagtgccgactgaagatggacaagttagagctgaagggcatgtcctacgccatgtgcaccaacacattcgtcctgaagaaggaggtctccgagacccagcacgggaccatcctcatcaaagttgagtacaagggcgaggatgtgccgtgcaagatcccattctcgaccgaggacggccagggcaaggcgcataatggtaggctcatcacagccaatcccgtggtcacgaaaaaggaggagcccgtgaacattgaagccgagccgcccttcggggagtccaacatagtcatcggcatcggagataatgccctgaaaatcaactggtataagaaaggctctagcatcgggaagatgttcgaagctacagcccggggcgcccgccggatggccatcctgggcgacaccgcctgggacttcggctccgtgggcggggtgctcaacagcttagggaagatggtccaccagatcttcggcagtgcgtacacggctctgttttcgggcgtgtcctgggtgatgaagatcggcatcggggtcctcctgacctggatcggcttaaacagcaagaacacctccatgagcttctcctgcatcgccatcggaatcattacactgtacttaggcgctgtggtgcaggccgacatggggtgtgtaatcaactggaagggcaaggagctgaagtgcggtagcgggatcttcgtgacgaacgaggttcacacctggaccgagcagtacaagttccaggcggactcccccaagaggcttgccaccgccatcgcaggcgcctgggagaacggggtttgcggcatcagaagcacgacccggatggagaacctgctgtggaagcagattgcgaacgagctcaactacatcctgtgggagaataatatcaagctgaccgtagtggtcggggacaccatcggcgtgctggagcagggcaagcgcacgctaacgccccagccgatggagctgaaatacagctggaagacctgggggaaggcaaagatcgtgaccgcagaaacgcagaactcgtcctttatcatcgatggccccaacacccccgagtgtcccagcgccagccgggcgtggaacgtatgggaggtagaggactacgggttcggcgtgtttaccaccaacatctggctcaagctgcgcgaggtctacacccagctgtgtgaccaccggctaatgagcgccgcagtcaaggatgagcgcgccgtccacgccgacatgggatactggatcgagagccagaagaacgggtcctggaagctggagaaggcgagcctgattgaggtcaagacctgcacgtggccgaagtcccacaccctctggtctaacggcgtgctggagtccgacatgatcatcccaaagagcctggccgggccgatctcccagcacaactaccggccaggctaccatacccagacggccgggccgtggcacctcggcaagctggagctggacttcaactactgcgagggcaccaccgtagtcatcaccgagaactgcgggacgcgcggcccctccctccggaccaccacggtgtccgggaagctgatccacgagtggtgctgccgcagctgcactctgccccctctccggtatatgggcgaagacgggtgttggtacggcatggagatacgccctgtgagcgaaaaggaggagaacatggtcaagagcttggtgtccgcaggaagcggcgaggtggataattttaccatgggcgtcctgtgcctcgcaatcctgttcgaggaggtcatgcgggggaaatttggcaaaaagcacatgatcgcgggtgtcttctttaccttcgtactgctcctgtccggccagatcacctggcgcgacatggcccacacgctgatcatgatcggcagcaacgcctccgaccggatggggatgggcgttacatacctcgctctgatcgccaccttcaagatccaacccttcctggcgctcggtttctttctccgcaagctgacctctcgggaaaacctcctgttgggcgtgggattggctatggccacgaccctgcagctgcccgaggacatcgagcagatggcgaacgggatagccctgggcctgatggccctgaaactcatcacccagttcgagacctaccagctgtggacggccctgatcagcctgacctgctccaacaccatcttcaccctgacggtcgcctggcgcaccgcgaccctcatcctcgcgggggtgagcttactgccagtgtgccagtcctcctcgatgcggaagaccgactggctccccatgacggttgccgccatgggcgtgccgcccctcccgctgttcatcttcagcctcaaggacaccctgaagcgccgctcctggccacttaacgaaggggtcatggccgtgggccttgtgagcatcctggctagcagcctgttacggaatgacgtccccatggccggccccctggtggccgggggcctcctcatcgcctgctacgtgatcacagggacctccgccgacctgacggtggagaaggccgcagacgtgacgtgggaagaggaggcggagcagaccggcgtgagccataacctgatgatcaccgtagacgacgacgggaccatgcgtatcaaagatgatgagacggagaacattctcacggtgctgcttaagaccgccctcctgatcgtgtccggaatctttccgtactccatccccgccaccctgctcgtctggcacacgtggcagaagcagacccaacggagcggggtgctttgggacgtcccgagcccgcccgagacccagaaggccgagctggaggagggggtctacaggatcaagcagcagggcatctttgggaagacccaagtgggcgtgggggtccagaaggagggtgtattccacactatgtggcacgtgacccggggcgcggtcctgacctacaacggcaagcgcctagagcctaattgggcatccgtgaagaaggacctaatcagctacggcgggggctggcggttatctgcccagtggcagaagggagaggaggtacaggtcatcgccgtggagcccggcaagaacccaaagaacttccagaccatgcccggcacgttccagaccactactggggagatcggtgcgatcgccctggacttcaagccggggacgtccggcagccccatcattaaccgcgagggcaaagtagtcgggctgtatggcaacggggtggtgaccaagaatggcggatatgtctccggcatcgcccagaccaacgccgagccggacggtccgacccccgagctggaagaggagatgtttaagaagcggaaccttacgatcatggacctgcatcctgggtccggcaagacccggaagtatctgccggccatcgtgcgggaggccattaagcgccgactccgcactctgatcctggcccccactcgggtggtcgccgccgagatggaggaggccttgaaggggctgcccatcaggtaccagaccacagcgaccaagtccgagcacacaggccgcgagatcgtggacttaatgtgccacgccacgttcacgatgcgcctcctgagccccgtgcgggtcccgaattacaacctaatcataatggacgaggcccacttcaccgaccccgcctccatcgctgcgcgcgggtacatcagcacgcgggtggggatgggcgaagccgcggcgatcttcatgacggcgacaccgcccggaaccgcggacgccttcccgcagtccaacgcacccatccaggacgaggagagggacatccccgagagaagctggaactccggcaatgagtggatcactgacttcgcggggaagacggtgtggttcgtccctagcatcaaggcgggcaacgacatcgcaaattgtctccggaaaaacgggaagaaggtgatccagctttcaagaaagacgttcgacaccgagtatcagaagaccaagctgaacgattgggacttcgttgtcacgaccgatatcagcgagatgggcgccaatttcaaggcggaccgggtaatcgacccgagacggtgcctcaagcccgtgattctgaccgacggctccgagcgcgtcatactggcggggcccatgcccgtgaccgcagcctcagcagcgcagcggaggggccgggtggggcgcaacccgcaaaaggagaacgaccagtatattttcaccggccaaccattgaataacgacgaggaccacgcccattggacggaggcgaagatgcttttggacaatattaatacccccgaggggatcatccccgccctcttcgagccggagcgggagaagtccgccgccatcgacggagagtaccgcttgaagggtgagtcccggaagaccttcgtcgaactgatgcgccgcggagacctccccgtgtggctggcgcataaggtcgcgtccgagggcattaagtacacagaccgcaagtggtgcttcgatgggcagcggaacaaccagatcctggaagagaacatggatgtggagatctggacgaaggagggtgagaagaagaagcttcgcccccgttggctggacgcccgcacctacagcgaccccctggccctcaaggagttcaaggactttgccgcgggccgcaaaagcatcgccctcgatcttgttactgagatcgggcgggtgccgacgcatctcgcccatcgcactcggaacgccctggacaacctggtgatgctccacacctccgagcacggtggaaaggcatatcgccacgcggtggaagaactgcccgagaccatggagaccctgctcctcctggggctcatgatcctgctgaccggcggtgccatgctgttcctgatcagcgggaaggggatcggaaagacctccatcggccttatctgtgtcatcgcaagctctggcatgctctggatggccgaaatccctcttcagtggatcgccagcgcgatcgtcctggagtttttcatgatggtactcctgatcccggagcccgagaagcagaggacgccgcaggacaaccagctcgcctacgtcgtgatcgggattctcactctagctgccacgattgccgccaatgagatgggcctgctggagaccaccaagcgcgacctgggcatgtccaaagagcccggtgtggtcagcccgacctcatacctggacgtggacctccaccctgcctcggcgtggacgctgtacgccgtggcaaccaccgtcatcacccccatgctgcggcacacgatcgagaactccaccgccaacgtgagcctcgccgccatcgccaaccaggcggtggtcctgatgggcttggacaaggggtggcccatcagtaaaatggacttgggcgtgccgctgctggccctcgggtgctacagccaggtgaaccccctgaccctgaccgcggccgtgcttctgttgatcacgcactacgccatcatcggccccggcctccaggcgaaggccaccagagaggcccagaagaggaccgccgccggaatcatgaagaaccccaccgtggacggcatcatgacaatcgaccttgacccggtgatctacgactccaagttcgagaagcagctggggcaggtaatgctactggttctatgcgcggtacagcttctgctgatgcgcaccagctgggccctctgcgaagctctgaccctggccaccggccccatcacgaccctttgggagggctccccgggtaagttctggaacaccaccatcgcggtaagcatggccaacatcttccggggatcctacctcgccggcgcaggcctagcattcagcatcatgaagtctgtggggaccggaaaaagaggcacggggagccagggcgaaaccttgggggagaaatggaagaagaaactcaaccaactgagcagaaaggagttcgacctctacaagaagtccggcatcaccgaggtggatcgcaccgaggcgaaggagggactgaagcgcggcgagatcacgcaccacgccgtcagccgcgggtccgccaaactgcagtggttcgtagagagaaacatggtcatccccgaggggcgcgtcatagacctcggctgcgggcggggcgggtggagctactattgtgccggcctaaagaaggtgactgaggtgcgtggctacacgaagggcggcccggggcacgaggagcccgtccctatgtccacctacggctggaacatcgtaaaactgatgagcggaaaggacgtcttctacctcccccccgagaagtgcgacacgttgctgtgcgacatcggagaatcaagcccttcccccaccgtagaggagagccggacaatacgtgtgctgaagatggtggagccctggctcaagaacaaccaattctgcatcaaggtcctaaacccctatatgcccaccgtgatcgaacacctggagcggttgcagcggaaacatggcgggatgctggtacgcaacccactgtcccggaactcgactcatgagatgtactggatctccaacggtaccgggaacatcgtcgcctctgtgaacatggtgtcgcgcctcctgttaaacagattcaccatgacgcaccgcagacccacgatcgagaaggacgtcgacctcggagcgggcacccgccacgtgaacgccgagccggagacccccaacatggacgtgatcggagagcggataaagcgcatcaaagaggagcacaacagcacctggcactacgacgatgaaaacccgtacaagacgtgggcctaccacggctcctatgaagtcaaagccaccgggtcagcctctagcatgataaacggcgtggtcaagctgctgaccaagccgtgggacgtggtgcccatggtgacccagatggcgatgacggacaccacgcccttcgggcagcaacgggtgttcaaggagaaagtggacacacgcacgccccggccgatgcctggaacccgtagagtcatgggcataaccgccgagtggctctggcgcacgctggggcggaacaaaaagccccgactgtgcacgcgggaggaattcaccaagaaggtccgcacaaatgccgccatgggcgcggtgttcacagaagagaatcagtgggacagcgccaaagcagccgtcgaggacgaggacttctggaaactcgtggacagagaacgggagctgcacaagcttggtaagtgtggctcctgcgtgtataacatgatggggaagcgcgagaagaagctcggcgagttcggtaaggcaaaagggagccgggcgatctggtacatgtggctgggcgcccgctacctggagttcgaggcacttgggtttctgaacgaggaccactggttttcacgggagaactcttactccggagtcgaaggggagggactgcacaagctcggctacatcctgcgcgacatcagcaagatccctgggggcgccatgtacgccgacgacacggcggggtgggacactcgaatcaccgaagacgacctgcacaacgaggagaagatcacccagcagatggacccggagcacaggcagctagccaatgcgatcttcaaattaacctaccagaacaaggtggtgaaggtccagcggcccacgcctaccggcacggtgatggacatcatctcccgcaaggaccagcggggctccggccaggtgggtacttacgggctgaacacatttaccaacatggaggcccagctcatccgccagatggagggggagggggtcctgtccaaggccgacctagagaacccccacctcccggagaaaaagattactcaatggctggaaaccaagggcgtggagaggctgaagcgcatggcgatcagcggcgacgactgcgtggtcaagcccatcgacgatcgattcgctaacgccctcctcgccctgaacgacatggggaaagtgcgcaaggacataccccagtggcagccctcaaagggctggcacgactggcagcaggtcccgttctgcagccatcactttcacgaactcatcatgaaggacggtcggaaattagtcgtgccttgccgaccccaagatgagctaatcggccgggcccgcatctcccagggggcgggctggagcctccgggagacggcgtgcctggggaaagcctacgcccagatgtggtccctgatgtacttccaccgcagagatctccggctagcgagcaacgccatctgctcggccgttcctgtgcactgggtgccgacctctcgcacgacctggtccatacacgcccaccaccagtggatgacgaccgaagacatgctgaccgtgtggaaccgggtctggatcgaggataacccctggatggaggacaaaacccccgtgacgacctgggaaaacgtaccctacctcgggaagcgcgaggatcagtggtgcggcagccttatagggttgacctcgcgggcgacctgggcgcagaacatcccgacggccatccagcaagtccgctccctaatcggcaacgaggagttcctggactacatgccaagcatgaagcggttccgcaaggaagaggaatccgagggggccatttggtga

SEQ ID NO: 26022 - RNA, 9873 nt, synthetic construct
  misc_feature 1..9873: note = derived and/or modified CDS sequence (opt11) from DENV-3__KF955454__SS-prME
  source 1..9873: mol_type = other RNA
accagcctgtgcctcatgatgattctgcccgccgccctggcgttccacttaaccagccgggacggcgagcccaggatgattgtggggaagaacgagcgaggcaagagcctgctattcaagacagccagcgggataaacatgtgcaccctgatcgctatggacctgggcgaaatgtgcgatgataccgtgacttacaagtgcccccacatcacggaggtggagcccgaggacatcgactgctggtgcaacttgaccagcacatgggtgacatacgggacgtgtaaccaggcaggcgagcatcggcgtgacaagcggtccgtggccctcgctccccacgtggggatggggctggataccagaacccagacctggatgtctgctgagggcgcctggcgccaggtcgaaaaggtcgagacttgggccctgcgtcaccccgggttcaccatcttagccctgttcctggcgcactatatcggcacaagcttgacgcagaaggtggtgattttcatcttgctgatgctcgtcacgccctccatgacaatgagatgcgttggcgtaggaaacagggacttcgtggagggattgagcggggctacctgggtggacgtggtactggagcacggcgggtgcgtaactacgatggccaagaataaaccaaccctcgacatcgagctgcagaagaccgaggccacccaactggctacactccggaaactttgtatcgagggcaagattaccaatataaccactgacagccggtgcccaacgcagggcgaagcagtgctaccggaggagcaggaccagaactatgtctgcaagcacacatacgttgatcgggggtggggcaacggttgcggcctcttcgggaagggctcccttgttacctgcgccaaattccagtgcctggagcccatcgaggggaaggtcgtgcagtacgaaaacctcaagtacaccgtgatcataactgtccataccggtgaccagcaccaagtgggcaatgagactcaaggggtcaccgccgagattacgcctcaggctagcaccacggaggcaattctgccggagtacggcacattgggactcgagtgctccccgagaacgggcctagatttcaatgagatgattctgttgacgatgaaaaacaaggcctggatggtccaccggcaatggttcttcgacctgccactgccctggacgtcgggcgccacgaccgagacgcccacgtggaaccgcaaggagctcttagtgaccttcaagaacgcccatgccaagaaacaggaggtcgtggtgctggggagccaggagggcgcgatgcacaccgcgctcaccggggccaccgaaattcagaacagcggcgggacctcaatcttcgccggacacctgaagtgccggctgaagatggacaagctagagctcaaaggcatgagctacgccatgtgcaccaacactttcgtcttgaagaaggaggtatccgagacccagcatgggaccatcctcatcaaagtggagtacaaaggcgaggatgtcccgtgcaagatccccttcagcacagaagatgggcagggcaaggcgcacaacggccgcttgatcacagccaaccccgtcgtgaccaagaaggaggagccggtcaatatagaggccgagcccccgtttggggagagcaacatcgtgattggcatcggggataacgccctgaagatcaactggtacaagaagggctcctcaatcgggaagatgttcgaggcgaccgcccgcggcgccaggcggatggccattttaggcgacaccgcctgggatttcgggtccgtggggggggtcttgaacagcctgggcaagatggtgcaccaaatcttcgggtccgcatatacagcgctgttcagcggcgtatcctgggtcatgaaaataggcatcggagtcctcctgacctggatcggcctgaacagcaaaaatacctccatgagcttcagttgcatcgccatcgggattatcactctctatctgggcgccgtggtacaggccgatatggggtgtgtgatcaattggaaaggcaaggagctgaagtgtggcagcgggatcttcgtaacgaacgaggtccacacctggactgagcagtacaagtttcaggcggattcccccaagcgcttggccaccgccatcgccggcgcctgggagaacggggtctgcggcatccgctccactacccgcatggagaaccttctgtggaaacagatcgccaatgagctcaactacatcctgtgggagaacaacatcaagctgaccgtagtcgtgggagacatcatcggcgtgcttgagcagggcaagagaaccctgaccccgcagcccatggagttgaagtattcgtggaagacctgggggaaggccaagatcgtcaccgccgagacccagaattcctcattcattatcgacggccccaatacgcctgagtgtcccagcgccagtcgggcatggaacgtgtgggaggtggaagattacgggttcggggtctttaccaccaacatctggttgaagctgagagaggtctacacccagctgtgtgatcacagactgatgtcagccgccgtaaaggacgagagggccgtacacgcagacatgggttactggatcgagagccaaaagaacggctcctggaaactggaaaaggctagcctaatcgaagtgaagacctgcacgtggccgaagtcccataccctctggagcaacggcgtgctggagggtgatatgatcatccccaagagcctggctggtcccatcagccagcacaactaccgtccggggtaccacacccagacggctggcccctggcacctaggaaagcttgagttggatttcaactactgtgaggggacaaccgtcgtgatcaccgagaactgcggcacccgcgggccctccctcagaacgaccactgtaagcggcaagctgattcacgagtggtgttgtcgctcctgcaccctgccgccgctccgatatatgggcgaggatggttgctggtatggcatggagatcagaccaattagcgagaaggaggagaatatggtcaagtccttggtgagcgccgggtccggcgaggtggataacttcacaatgggggttttatgtctcgccatccttttcgaggaggtgatgcggggcaagtttgggaaaaagcacatgatcgcgggggtgttcttcacattcgtgctgctccttagcggccaaatcacctggagggatatggcccacacactcatcatgatcgggagcaatgcaagcgaccggatgggcatgggggtgacgtaccttgcactgatcgccaccttcaagatccaacccttcctggcgttaggcttcttcttgcgcaagctgacgtcccgcgagaaccttctcctgggcgtggggctcgccatggccaccacactgcagttgcccgaagacatcgagcagatggccaacggcattgccctcgggctaatggcactgaagctcataacgcaatttgagacctaccagctgtggaccgctttaatctccctcacgtgcagcaacacgatttttaccctgactgtggcctggcgcacggccaccctgatcctcgcgggcgtgtccctgctgccggtctgtcagtcctccagcatgcgcaaaaccgactggctgccgatgaccgtagcagccatgggggtgccgcccctgccgctgttcatcttctccctcaaagatacgctcaagcgccgaagctggcccttgaacgagggcgtaatggccgtgggcctcgtgtccatcctggccagctccctgctacgcaacgacgtccccatggcggggcccctggtcgccggggggctgctcatagcctgctacgtgattaccggcactagcgccgacctgaccgtcgagaaggccgcagacgtgacgtgggaggaggaggcagaacagaccggggtgtcccacaacctgatgatcaccgtagacgatgacggcacgatgcgaatcaaggacgacgagaccgagaatatcctcaccgtcttactgaaaaccgcccttctgattgtgagcggcatattcccttattcaatccctgccaccctgctcgtctggcacacctggcagaagcagacgcagcgaagcggggtgctgtgggatgtgcccagcccgcctgaaacccagaaggcagagctggaggagggagtataccggatcaaacaacaggggatcttcggcaagacccaggtgggtgttggcgtccagaaggaaggcgtgttccacactatgtggcacgtgacgcgcggtgcggtgctcacctacaacggcaaacgcctggagcccaattgggctagcgtgaagaaggatctcatatcctacggggggggttggcgcctatcggcccagtggcagaaaggcgaggaagtgcaggttattgccgtggagcctgggaagaatcccaagaacttccagaccatgcccggcaccttccagacgaccactggcgaaatcggggcaatagccctcgacttcaagcccggtacctcaggtagccctatcatcaaccgcgaggggaaagtcgtcggcctgtacggcaacggcgtggtgacgaagaacggaggctacgtcagcggcatcgcccaaactaacgccgagccggatgggcccacccccgaactcgaggaggagatgttcaagaagcggaacctcacgataatggacctgcatcccggatccgggaaaacgcgaaagtatctgccggccatcgtgcgggaggcgatcaagcgccgtttgcgcaccctgatactggccccaacgcgtgtggtcgccgccgagatggaggaagcattgaagggactgcccattcgttaccagacgacggcgaccaagagcgagcacaccgggcgggaaatcgtggacttgatgtgtcacgccaccttcacgatgcgtctcctgtctcccgtcagggttccgaactacaatctgatcatcatggacgaggctcattttactgaccccgcaagcatcgccgcgcgagggtacatctccacccgagtaggcatgggggaagccgccgcgatcttcatgaccgcgactccaccgggcaccgcagatgccttccctcagtcaaacgcccccatccaggacgaagagcgcgacatccctgagcgttcctggaacagcgggaacgagtggatcaccgattttgcgggcaagaccgtgtggttcgtcccctccattaaggcggggaacgacatcgccaactgcctcagaaagaacggcaagaaagtgatccagcttagccgtaaaacgttcgacaccgagtaccagaaaaccaagctgaacgattgggacttcgtcgtcaccacagacatctccgagatgggcgccaacttcaaggcggatcgggtgatcgacccacgccggtgcctcaagcccgtgatcttgaccgacgggcccgaacgcgtcatcttagccggcccaatgccggtgactgcagcttcagccgcccaacggcgcgggcgggtaggccgcaatccccagaaagagaatgatcagtacatattcactgggcagcccttaaacaacgacgaggaccatgcgcattggaccgaggctaaaatgctgctggacaacatcaacacgcccgagggcatcatccctgccctcttcgagcccgagcgtgagaagtccgccgccatcgacggcgagtaccgcctaaagggggagtcccggaagacctttctggagttgatgcgcaggggcgatctacccgtttggctggcgtataaagtggcctccgaggggatcaagtacactgaccggaagtggtgcttcgacggccagcggaacaaccagattttagaagagaacatggacgtcgagatctggactaaggagggcgagaagaagaagctgcgcccgcggtggcttgacgcccgcacgtatagcgacccgcttgctctgaaggagtttaaggacttcgctgcggggcgcaagtccatcgccctggatctcgtaaccgagatcggccgggtgcccactcacctggcccatcgcacccggaacgccctggataacctcgtcatgcttcatacaagcgagcatggcggcaaggcctaccgccatgcggtggaggagctgcccgagaccatggagaccctgctgctgttagggctaatgatcctacttactggtggcgctatgctattccttatctccgggaagggcatcggaaaaacgtcgatcggcctcatatgcgtgattgctagctccggtatgttgtggatggcggagattccgctacagtggatcgcaagcgcgatagtcctcgagttcttcatgatggtgctgctgatccctgagcccgagaagcaacggaccccccaagacaaccagctcgcctacgtggtcatcggtatccttaccctggccgctatcattgcagcgaacgagatgggattgctagagaccacgaaacgcgacctggggatgtcaaaggagccgggcgtggtgtcgccaacctcctacttagacgtcgacctgcaccccgccagcgcctggaccctgtacgccgttgcgacaacggtcataacccccatgcttagacacaccatcgagaactcaactgctaacgtcagtctggccgcgatcgctaaccaggccgtcgttctgatggggttagacaagggctggccgatctccaagatggacctgggggtgccactcctggccttgggctgctactcgcaggtaaaccccctgacgctcaccgcggccgtactgctgctcatcactcactacgccatcatcggacccgggcttcaagcgaaagccactcgagaggcacagaagcgtacggcagccggaatcatgaagaaccccaccgtcgacgggattatgacaatcgacctggatccggtgatctacgactccaagttcgagaaacagctcggccaggtgatgctactggtcctctgcgcggtacagctgctgctgatgcgcacttcttgggccttatgcgaagccctcacactcgctacgggacccataaccaccctgtgggaagggtcccccggcaagttctggaacacgaccatcgcggtaagtatggcgaacatctttcgggggtcctaccttgccggcgccgggctcgctttctctatcatgaaatccgtcggcaccggaaagcgcgggaccggcagccagggagagaccctcggcgagaagtggaagaagaagctaaatcaactctcccgaaaggagttcgacctgtataagaagtcggggatcacggaggtggacagggcggaggctaaggagggtctgaagcggggcgaaatcacccaccacgcggtgagccgggggtccgccaaactccaatggttcgtagagcggaacatggtgatccctgagggcagagttatcgacctagggtgcggcagggggggctggagctactactgcgccggcttaaagaaggtcaccgaggtgcgaggatacaccaagggcggtcccggccacgaggagccagtgccgatgtccacttacgggtggaacattgtaaagttaatgagcggcaaagacgtcttctatctgccccccgagaaatgcgacaccttgctgtgcgacatcggggagtcaagcccatcgcccaccgtggaggagagccggacaattcgggtcctcaagatggttgagccgtggctaaagaacaaccagttctgcattaaggtgctgaatccctacatgccgacggtcattgagcacttggagcgactgcagcggaaacacgggggcatgctggtgcgaaaccccttatcacgtaacagcacgcacgaaatgtactggattagcaacggcaccggcaacatcgtggcgtcagtcaacatggtgtctcggttactgctcaaccggtttacaatgacgcatcgccgaccgacgatcgagaaagacgtcgatctgggcgccgggacccgccacgtcaacgccgaacccgagactcccaacatggacgtgatcggcgaacgaataaaacgcatcaaggaggagcacaacagcacctggcactacgacgacgagaacccctataagacctgggcctaccatggctcctacgaggtgaaggctaccggctcagcgtcttccatgattaatggtgtcgtgaaactgctcacgaagccctgggacgtagtccccatggttacgcagatggccatgaccgataccaccccctttggccaacaacgagtcttcaaggaaaaggtagatacacgcacacctcggtccatgccaggtacccgccgggttatggggatcaccgctgagtggctgtggaggacgctgggcaggaacaagaagccccgcctctgcacacgggaggaattcaccaaaaaggtgcgcaccaacgctgcgatgggggccgtattcacggaggagaaccaatgggacagcgccaaggccgccgtggaggacgaggatttctggaagctggtcgatcgcgaacgggagctgcacaagctcggcaagtgcggctcctgtgtgtacaacatgatgggtaaaagggaaaagaagctgggcgagttcgggaaggcgaaaggctcccgtgccatctggtacatgtggcttggggcgcgctacttggagttcgaggccctggggttcttaaatgaggaccactggtttagccgggaaaattcctactctggagtggagggcgagggccttcacaagctgggatacatcctgcgcgacatctccaagatccccggaggggccatgtacgcggacgataccgccggctgggacacccgtattaccgaggatgacttgcacaacgaggagaagataacgcagcaaatggacccggagcaccggcagttggccaatgcaatcttcaagttgacctaccagaacaaggtcgtcaaagttcagcggcctacccccactgggaccgtcatggacataatatcacgcaaggatcagagagggtccggacaggtggggacttacggacttaacaccttcaccaacatggaggcccagcttatccgccagatggagggtgaaggagtgcttagcaaggcggacctcgagaacccgcacccgccagagaagaagataactcagtggctggagaccaagggcgtcgaacggctgaagcgcatggccatctccggggacgactgtgtagtaaagcccatcgacgatcggttcgccaacgccctcctggccctgaacgacatgggtaaggtccgcaaggacattccccagtggcagccaagcaaggggtggcacgattggcagcaggtccccttctgctcccaccacttccacgaactcattatgaaagacggcaggaagctggtggtaccctgccgccctcaagacgagctgatcggacgggcgcgcatcagccagggcgccggatggtccttgcgtgaaactgcctgccttgggaaagcctacgcccaaatgtggtccctgatgtactttcaccgtcgtgacctccggctagcctccaacgccatctgtagtgccgtccctgtgcattgggtccctacctcccggaccacgtggagcatccacgctcaccaccagtggatgaccactgaggatatgctgaccgtgtggaatcgggtatggatcgaagacaacccctggatggaggacaagacgcccgtcaccacctgggagaacgtgccctacctcggcaaacgagaagatcaatggtgtgggtccctgatcgggctgaccagccgggccacgtgggcccagaacatccccactgccatccaacaggtcaggtcactcattgggaatgaagagttcttggactacatgcccagcatgaagcggttccgcaaagaggaggagagcgagggcgccatttggtaa

SEQ ID NO: 26023 - RNA, 9873 nt, synthetic construct
  misc_feature 1..9873: note = derived and/or modified CDS sequence (opt11) from DENV-3__EU854292__SS-prME
  source 1..9873: mol_type = other RNA
acctctctgtgcctaatgatgatcctgcccgcagcactggccttccacctcacctcacgtgatggggagccgcggatgatcgtgggcaaaaacgaacgcggcaagagcctgctgttcaagaccgccagcggtattaacatgtgtactctcatcgccatggacctgggcgaaatgtgcgacgacacggtgacctacaaatgcccccacatcaccgaggtagagcctgaggacatcgattgctggtgcaacctgaccagcacgtgggtgacctacggaacgtgcaatcaggccggcgagcacaggagagacaagcgctccgttgccctcgcgccccacgttggcatgggactggacacccgcacccagacttggatgagcgccgaaggcgcgtggcggcaggtcgagaaggtggaaacgtgggccctcaggcatccgggttttaccatcttggcgctgttcctagcccactacatcggcacctccctcacccagaaggtggtgatcttcatcctgctgatgctcgtcacgcccagcatgaccatgcgttgcgtggggatcggcaacagggatttcgtggagggcttgtccggggccacttgggtcgacgtggtgctagagcacggcgggtgcgtcaccacgatggccaagaacaagcccacccttgacatagagctgcaaaagactgaggccacccagctggccacactccgtaaactgtgcattgagggcaagatcaccaacatcaccaccgacagccgctgccccacgcagggcgaagccgccttacctgaggagcaggaccagaactacgtctgcaaacacacctacgtggacagagggtggggcaatggatgcggcctattcgggaaggggtccctggttacatgcgccaagttccagtgcctggagcccatcgagggcaaggtggtgcagcacgaaaacctcaagtacaccgtcatcatcacggtgcatacgggcgaccagcaccaggttgggaacgagacccagggtgtcactgccgagatcacgccccaggcgagcaccaccgaggcgatcctgcccgagtacggcacactgggtcttgaatgttccccgcgaaccggcctggacttcaacgagatgatcctgctcacgatgaagaacaaggcctggatggttcaccggcagtggttcttcgatctgcccctgccctggacgagcggcgccacgactgagacgcccacctggaaccgcaaggagctcctggtcaccttcaagaacgcccacgcgaaaaagcaggaggtggtggtcctggggtcgcaggagggggctatgcacaccgccctgacgggggccaccgaaatacaaaacagcggcgggacctccatcttcgccgggcatctgaaatgccgtctgaagatggacaagctcgaactgaagggcatgagctacgcgatgtgcaccaatacgttcgttctgaagaaggaggtgtctgagacacagcacgggaccatactcatcaaggtggagtacaagggcgaggacgccccgtgcaagattcccttcagtaccgaagacgggcaggggaaggcccacaacggtcgcctgataacggccaatcccgtggtgaccaagaaggaggagccggttaacatagaggcggagccccccttcggagagagcaacattgttatcggcatcggtgacaacgccctcaaaataaattggtataagaagggatccagcatcgggaagatgttcgaggccaccgcccgaggcgcccgccggatggcgatcctgggcgacacggcctgggacttcgggtccgtgggcggagtcttgaacagcctgggcaagatggtgcaccagatcttcggaagcgcctacacggctctgttctccggggtgtcctgggtcatgaagatcggcataggggtgctcctgacctggatagggctgaacagcaaaaacacctccatgagcttttcttgcatcgccatcgggatcatcaccctctacctgggagccgtagtccaggccgacatggggtgcgtgatcaactggaagggcaaggagctgaagtgtggtagcgggatttttgtgacgaacgaggtgcacacgtggaccgagcaatacaaatttcaggccgactcccccaagcgcctcgccaccgcgatcgcgggggcctgggagaatggagtgtgcggcatccgcagcaccacccgcatggagaaccttttatggaagcagatcgccaacgagctcaactacatcctgtgggagaacaacatcaagctgaccgtggtagtgggggacatcattggcgtactcgagcagggcaagcgaacccttacgccccagccgatggagctgaagtattcctggaagacctgggggaaagccaaaatcgtcaccgcggagactcagaatagctcgtttatcatcgacggccccaatacaccagaatgtccaagcgccgctcgggcctggaacgtgtgggaggtggaggactacgggtttggcgttttcaccaccaacatctggcttaagctgcgcgaggtgtatacgcagctgtgcgaccaccggttgatgtccgcagcggtgaaggacgagcgcgccgtccacgccgacatgggctactggattgagagccagaagaatgggtcctggaagctggaaaaggcatccctgatcgaggtgaagacctgcacgtggcccaagtcacacaccctctggagcaacggcgtgctggaaagcgacatgatcatccccaagtcgctggccgggcccatcagccaacacaaccaccgcccgggctaccacacccagacggcggggccatggcacctcgggaaactggagttggactttaactactgcgaaggcacgaccgtcgtgatcaccgagaactgcgggaccaggggcccctccctccgcacgacaaccgtgtcggggaagctgatccacgagtggtgctgccgctcgtgcaccctgccaccgctccggtacatgggcgaagacgggtgctggtacggcatggagatcagacccatcagcgagaaggaggagaacatggtcaagtccttggttagcgccgggagcgggaaagtggacaacttcacgatgggcgtcctgtgcttggccatcctgttcgaggaggtgatgcgggggaagttcggtaagaagcatatgattgccggggtcttcttcaccttcgtcctgctcctgagcggccagatcacctggcgcgacatggcccataccctgatcatgattgggtctaatgcgtctgatcggatggggatgggcgtgacgtacttggccctgatcgccaccttcaagatccagcccttcttagcgctcgggttcttcctacgcaagctgaccagtcgagagaatctcctcctgggagtcggcctcgctatggcaaccacgctacagctgcctgaggacatcgagcagatggctaacggaatagctctcggcttaatggccctgaagctcatcacccagttcgagacctaccaactgtggaccgcgctgataagcctcacgtgcagcaataccatcttcaccttgaccgtcgcctggcgaacggccaccttaatcttagcgggagtctccctgctgccggtgtgccaaagttccagcatgcggaagacagactggctccccatggccgtcgcggccatgggcgtgccgcccttaccgctgtttatcttctgcctcaaggacaccctgaagcgccgctcttggcccctgaacgagggggtaatggccgtgggcctcgtgagcatcctggcatccagtctgctccggaacgacgtccccatggccggccccctggtggccggggggctgctgattgcctgctacgttatcacggggaccagtgctgacctaacagtcgagaaggccgccgacattacatgggaggaggaggcggagcagacgggggtgagccacaacctgatgatcaccgtggatgacgacgggaccatgaggatcaaggacgacgagaccgaaaatatcctcaccgtcctgctgaagacggcactccttatcgtgtccggcatcttcccctacagcatccccgccacccttctcgtgtggcacacgtggcaaaagcagacccagcggtccggcgtcctgtgggacgttcccagcccgcccgagacgcagaaggccgaactagaggagggggtctaccgcatcaagcagcagggcatcttcgggaagacccaggtcggcgtgggggtgcagaaggagggcgtcttccacaccatgtggcacgtgacccggggcgcggtgttgacgtacaacgggaaacgcctggagcccaactgggcctccgtcaagaaggacctgatttcctacggggggggctggcggctctccgcgcagtggcagaaaggggaggaggtccaggtgatcgccgtcgagcccggaaagaaccccaagaatttccagacaatgcctggcaccttccagaccacaaccggggagatcggcgccatcgcgctggacttcaagcccgggacttctggctcccccatcatcaaccgcgagggcaaggtggtggggttgtacggcaacggggtcgtgaccaaaaacggcggatacgtgtccggcatcgcccaaacgaacgccgagccggatggccccacccctgagctggaggaggaaatgttcaagaagcggaacctcaccatcatggacctgcaccccggaagcggcaagacccgcaagtacctgccagcgatcgtccgggaggctataaagcggaggcttcgaacgttaatcctggcccccacccgggtggtggccgccgagatggaggaggccctcaagggtctgcccataaggtatcagaccactgccacgaagtccgagcataccggacgggaaatcgtcgacctgatgtgccacgcgaccttcacgatgcgcctgctctcgccggtgagagtgccaaactataacctaatcatcatggacgaagcccacttcacagaccctgccagcatagccgcgcgcgggtacatcagcacacgggtcggcatgggggaggccgccgccatattcatgactgctacaccaccggggactgctgacgccttcccacagtctaacgcccccatacaggacgaagaacgcgacatacctgagcgctcatggaactccggtaacgagtggatcaccgattttgccgggaaaactgtgtggttcgttcccagcatcaaggccgggaacgatatcgcgaactgcctccggaagaacgggaaaaaggtcatccagctatcccgcaaaaccttcgacacggaataccagaagaccaagctgaacgactgggactttgtcgtgaccaccgacatcagcgagatgggcgctaacttcaaggccgatcgggtcatcgacccgcgccggtgtctcaagcccgtcatcctgacggacggccccgagcgcgtgatcctggccgggcccatgccggtaaccgccgcgtccgccgcccagcgtcgaggacgggtgggccgcaacccgcataaggagaacgatcaatatatattcacaggccaaccactcaacaatgacgaggaccacgcccactggaccgaggcgaagatgctgctggacaacatcaacacccccgaggggatcatacctgccctcttcgagcccgagcgtgagaagtccgccgccatcgacggcgaataccgcctgaagggcgagagtcggaagacatttgtggaactcatgcgtcgcggggacctgcccgtctggctggcccataaagtggcgagcgagggcatcaaatataccgaccgcaagtggtgcttcgatgggcagcgtaacaaccagatcctggaagagaacatggacgtggagatctggaccaaggagggcgagaagaagaagctccgcccgcggtggctcgacgcccgcacatactccgaccctctggcactcaaagagttcaaggactttgccgccggccgcaagagcatcgccctggacttggtgacggagatcgggcgggttccgtcgcacctcgcccaccgaactcggaacgccctggacaatctggtgatgcttcacaccagcgaacacggcgggcgggcctaccgacatgcggtggaggagctgcccgaaaccatggaaacgctgctcctgctgggtctcatgattctgctgaccgggggggcgatgctgtttctgatctccggcaagggaatcggcaagaccagcatcggcctgatctgcgttatcgccagctcgggcatgctctggatggccgagatcccgctgcaatggatcgccagcgccatcgtcctagagtttttcatgatggtgctcctaattcccgagccggagaagcagcgcacgccccaagataaccagctggcgtacgtggttatcgggatcctgacgctagcggccatcatcgccgccaatgaaatgggactgctcgagaccaccaagcgggacctgggcatgtccaaggaaccaggagtggtgagcccgacctcctacctggacgtcgacctacaccccgctagcgcctggacgctatacgccgttgcaaccacggtgatcacccccatgctgcgacacacgatcgagaactccaccgcgaacgtctctctcgccgccatcgcgaaccaggccgtggtgctcatgggtttagataagggatggcctatttccaagatggatttgggcgtacccctgctggcgcttgggtgctatagccaggtgaaccccctgacgctgaccgccgccgtgctcctgttaataacgcactacgccatcatcgggcccggtctccaggcgaaggcgacccgggaggcccaaaagcgtaccgccgccggcatcatgaagaacccgaccgtcgacggtatcatgacgatagacctggaccccgtgatctacgattccaagttcgagaagcagctgggccaagtgatgctcctcgtcctgtgcgcggtgcagctcctgctgatgcggaccagctgggccctgtgtgaagccctaaccctggccactggccctatcactactctgtgggagggttcccccgggaagttctggaacaccaccattgccgtgagcatggcgaatatcttccgcggctcctacctggccggggctggtctggccttcagcatcatgaagtccgtaggcactggtaaaaggggcaccgggagccagggcgagacgctcggagagaagtggaaaaagaagctgaaccagctgtcccgcaaggagttcgacctctacaagaagtcgggcattaccgaggtggatcggaccgaggccaaggaggggctgaagaggggcgagatcacgcaccatgcggtgagccggggctctgccaaacttcagtggttcgtagagcgcaacatggtgatcccggaggggcgggtgatcgatttgggctgcggccgcggcggatggtcgtactactgcgctgggctgaagaaggttaccgaggtcagaggctacaccaaaggcgggcccgggcacgaggagcccgtacccatgtcgacctacggctggaacatcgtcaagctgatgagcggcaaggatgtgttctacctcccaccggagaaatgcgataccctgctgtgcgatataggcgagtccagccccagcccaaccgtggaggagagccgcaccatccgcgtccttaaaatggtggaaccgtggctcaagaacaaccagttctgcatcaaggtgctgaacccgtacatgcccaccgtaatcgaacacctggagcgactccaacgcaagcatggcgggatgctggttcggaatcccctgtcccgcaacagcactcacgagatgtattggatctccaacggcaccggtaatatagtagcgagcgtcaacatggtgtcccggctcctgttgaaccgcttcaccatgacccaccggcgcccgacgatcgagaaggacgtggacctcggtgccgggacccggcatgtcaacgcggagcccgagacccccaacatggacgtgatcggggagcgcatcaaacggatcaaggaggagcataatagcacctggcactacgacgacgaaaacccgtataagacgtgggcctaccatggctcctacgaggtgaaagccaccgggagcgcctcaagcatgatcaacggcgtcgtgaaactgctgaccaagccctgggatgtggtccccatggtgacccagatggcgatgacggacactacccccttcggacagcagcgggtcttcaaggaaaaagtagacacccggacgccgcgctccatgcccggaaccagacgcgtgatgggtatcacggccgagtggctctggcggaccttggggcgcaacaagaagcccaggctctgcacgcgcgaggagttcaccaagaaggtccgcaccaacgccgccatgggcgcagtgttcaccgaggagaaccagtgggatagcgcaaaggccgccgtggaagacgaggacttctggaaactcgtcgacagggagcgcgaactacacaagctggggaaatgcggaagctgcgtgtacaacatgatggggaagcgggaaaagaagctcggagagttcgggaaggctaaggggagtcgcgccatctggtacatgtggctgggcgcacggtacctggagttcgaggccctcgggtttctgaacgaggaccactggttcagccgcgagaactcgtacagcggcgtggagggggagggtttacacaagctcggctacattctgcgcgacatatccaagatccccgggggcgccatgtacgccgacgatacggccgggtgggacacccgcatcacagaggacgacctgcacaacgaggagaagatcacccagcagatggacccggagcaccgccaactcgcaaacgccatcttcaagctgacgtaccagaacaaggtagtgaaggtgcagagacccacccccaccgggaccgtcatggacatcatcagccggaaggaccagcgcggctccggacaggtgggcacatacgggctgaacacttttaccaacatggaggcccagctcatccggcagatggaaggcgagggggtgctcagcaaggccgatctggagaacccccacctcccggagaagaagattacccagtggctggagaccaagggcgtggagaggcttaagcggatggccatctccggcgacgactgcgtggtgaagcccatcgacgaccgcttcgccaacgccctcctcgccctgaacgacatggggaaggtccgaaaggacatcccccaatggcagcctagcaaaggctggcacgattggcagcaggtcccgttctgtagtcaccatttccacgagctgatcatgaaggacgggcgcaagctggtggtcccctgtcggccccaggacgaactgatcggccgcgcgcggatctctcagggagctggctggtcccttaaggagacggcctgcctgggcaaggcctacgcccaaatgtggagcctgatgtacttccaccgccgcgacttacggctggcatccaacgcgatctgcagcgccgtgcccgtgcactgggtccccacctcccgcactacctggagcatccatgcccaccaccaatggatgactaccgaggacatgcttaccgtttggaaccgggtgtggatcgaggacaacccctggatggaggacaaaacccccgtcacgacatgggagaacgtgccgtacctcgggaagcgcgaggaccaatggtgcggctccttgatcgggctaaccagccgggccacctgggcgcagaacatcccgacggcgatccagcaggtgcgcagtctcattggcaacgaggagtttctggattacatgcccagtatgaagcgcttcagaaaggaggaggagtcagagggggccatatggtga

SEQ ID NO: 26024 - RNA, 9873 nt, synthetic construct
  misc_feature 1..9873: note = derived and/or modified CDS sequence (opt11) from DENV-3__FJ639746__SS-prME
  source 1..9873: mol_type = other RNA
acctcactgtgcctcatgatgatcctgcccgccgcactggcattccacttaaccagcagggatggcgagccacggatgatcgtcggcaaaaacgaacggggtaagagcttgctctttaagaccgcctccggaattaacatgtgcaccctcattgctatggatctgggggagatgtgtgacgacaccgtaacctataagtgccctcacatcaccgaggtggaacccgaggacatcgattgttggtgcaaccttacgagcacttgggtcacctatggtacttgcaaccaggcaggggagcaccgccgtgataaacggtcagtagcccttgcaccccacgtcggcatggggctggacacccgcacccaaacctggatgagcgccgagggcgcatggcgccaggtcgagaaggtcgaaacgtgggctctccgacatcccgggttcaccatccttgcgcttttcctagcacactatatcggcaccagtctcacccagaaagtcgtaatcttcatcttattaatgctcgtaacaccgagcatgaccatgcggtgcgtaggggttggcaaccgcgacttcgtggagggcctttccggggctacctgggtggacgtggtcctggagcacggcgggtgcgtgactacgatggcgaagaacaagcccaccctcgacatcgagctgcaaaagacagaggccacacagctggcgacgttgcggaaactctgcatcgagggcaagatcaccaacattaccaccgactcgcgctgcccgacgcagggcgaggctgtgctgccggaggagcaggatcagaactacgtatgcaaacacacatacgtggacaggggctggggtaacgggtgcggcctcttcgggaagggttcactggtgacctgcgccaagttccagtgcttagagcccattgagggcaaggttgtgcagtacgaaaacttaaagtacaccgtgataattacggtccacaccggggaccagcaccaggttggcaacgaaacccagggggtgactgcagagatcacgccccaggccagcaccaccgaggcgatactgccggagtacggcaccctcggactcgagtgctcaccacgcaccggcttagacttcaacgagatgatcctcctcactatgaagaacaaggcctggatggtgcaccggcagtggtttttcgatctgcccctgccctggacgtccggtgccaccacggagacgccgacctggaaccgcaaggaattacttgtgaccttcaaaaatgcccacgccaagaagcaggaggttgtggtgctggggtcccaggagggggcgatgcacacagcattaacgggggccaccgagatacagaacagcggtgggacctcaatcttcgccggccacctcaaatgccgactgaaaatggacaaactcgagctgaagggcatgagctacgcgatgtgcaccaatacgttcgtactgaagaaggaggtgtccgagactcaacatgggaccattctaatcaaagtggagtacaaaggagaagacgttccgtgcaagatcccattcagcaccgaggatgggcaaggcaaagcgcacaacggcagactgattacggcaaatcccgtagtaactaagaaagaagaacccgtaaacatcgaggccgagccccccttcggggagagcaatattgtgatcggcatcggcgacaacgccctgaagatcaattggtacaagaaggggtcatcgattgggaagatgttcgaggcgacagcccggggcgcgcgcagaatggccatcctcggtgacactgcttgggacttcgggtccgtgggcggggtgctcaactcactcggaaagatggtccatcagatttttgggagtgcttacacagcactgttctctggggtatcttgggtgatgaaaatcggcatcggtgtcttgttgacgtggatcggccttaacagcaaaaacacctccatgagcttctcatgcatcgccataggtattatcaccttgtacctgggcgctgtggtccaggccgacatggggtgcgttataaactggaaaggcaaggagctgaagtgcggcagcgggatctttgtgactaacgaagtccacacctggaccgaacagtacaagttccaggctgactcacccaagaggctcgccaccgcgatagccggcgcatgggagaatggcgtgtgcggcattcgcagcacgacgcggatggagaacctactctggaagcagattgcgaacgagctcaactatatcctctgggaaaacaatattaaactaaccgtggtcgtaggagacatcatcggagttctcgagcaaggcaagcgcaccttgaccccccagccgatggagctgaagtactcctggaaaacctgggggaaggccaagattgtcacagccgaaacccagaacagctctttcatcatcgacgggcccaacacaccggagtgtcccagcgcctcccgggcatggaacgtgtgggaggtggaggactacggtttcggcgtctttaccaccaacatctggctgaagcttcgcgaggtgtacacccaactgtgcgatcatcggttgatgagtgctgccgtgaaggacgaacgcgccgtccatgccgacatgggctactggatcgagagccagaaaaatgggtcctggaagcttgagaaggcgtcactgatagaggttaaaacctgcacgtggccgaagtcccataccctctggagcaacggcgtgctagagtccgacatgatcattcccaagagcctggcagggcccatttcccagcacaactaccggccgggctaccacacccagacggccgggccctggcacttaggcaagctcgagctggacttcaactactgcgagggcaccaccgtagtcatcactgagaattgcgggacgcggggaccatcattacggaccacaactgtctccgggaagctgatccacgagtggtgttgcagaagctgcaccttgccaccgttgcggtatatgggcgaggacggttgctggtacggcatggagatacggcccatctccgagaaagaggagaacatggtgaagagcctggtgtctgccggcagcggggaggtggataatttcacgatgggcgtcctgtgcctggccatactgtttgaagaggtaatgagagggaaattcgggaagaaacacatgatcgcgggggtgttctttaccttcgtcttgctcctgtccggtcaaatcacctggagggacatggcccacacccttatcatgatcggcagcaatgcctcggataggatggggatgggcgtgacgtacttagccctgatcgctacattcaagatccaaccatttctggccctcgggtttttcttacgcaagctcacgagccgagagaatttgctgctgggcgtgggtttagcaatggccaccacgctgcagctgcccgaggacatcgagcaaatggctaacggcatcgcgttaggccttatggccctcaagctcattacccaattcgagacctatcaactgtggacagccctgatcagcctgacgtgctccaacactatattcaccctgaccgtagcctggcgcactgctaccctgatcctagcaggggtgtccttactaccggtatgccagtccagctccatgagaaagacagattggctcccaatgaccgtggcggcgatgggcgtgccgccgctccctttgtttatcttcagcctcaaagacacgctgaagcgccgctcctggccccttaatgagggggtcatggctgtgggccttgtttcaattctggcgtcaagcctgctccggaacgatgtccccatggccggccccctagtggcagggggcctgctcatcgcctgttatgtaatcaccgggacctccgccgatctgaccgtcgagaaggccgctgatgtaacctgggaggaggaggccgagcagacaggcgtgtcgcacaacctaatgattactgtcgacgacgacggcacgatgcgcatcaaggatgacgagaccgagaacatactcaccgtgctgctgaagaccgccctccttatagtgtcaggtatcttcccgtactctatccccgctacactgttggtctggcacacctggcagaagcaaacacagcggtccggcgtcctgtgggacgttccgagcccgcccgaaacccagaaggcagagctggaggaaggggtctatcgtatcaagcagcagggcattttcgggaagacgcaggttggcgtgggggtgcagaaagagggcgtattccacacgatgtggcacgtgacgagaggcgcggtcctcacctacaacggaaaacgcctggagcctaactgggcgtccgtcaaaaaggacctgatcagttacgggggcggctggcggctctccgcccagtggcagaaaggagaggaagtgcaggtcatcgccgtagagccaggaaagaaccccaagaacttccagaccatgcccggcaccttccagaccactaccggggaaatcggtgcgatcgccctggactttaagccagggaccagcggctcccccatcattaaccgcgagggaaaggtcgtcgggctctacggcaacggtgtcgtgaccaagaacggcgggtacgtctcggggattgcccagaccaacgccgagcccgacggtcccacccccgagctggaggaggagatgttcaaaaagcggaacctcaccattatggacttgcacccaggtagcggtaagactcgcaagtacctgccggccatcgtgcgggaggcgatcaagcgccggctccgcaccttaatcttagcccctacccgagtggtcgccgcagagatggaggaagctttaaaggggctgcccatccgataccagactacggcgacgaagtccgaacacaccggccgggagatagtcgacctgatgtgccacgctaccttcaccatgcgcctgctgtcacccgttcgggttccgaactacaacctgatcatcatggacgaggcccatttcaccgaccccgcctcgatcgctgcacgcgggtacataagcacccgtgtgggcatgggcgaggccgcagccatcttcatgaccgcgacgccaccaggtaccgccgacgcctttccgcagtccaacgcccccatccaagacgaggaacgcgacatccccgaacgcagctggaactccggcaacgagtggataaccgatttcgctgggaagaccgtttggtttgtccccagcatcaaggcgggcaacgacatcgctaactgtctcaggaagaatgggaaaaaggttatccagctctcccgcaagacgttcgataccgagtaccaaaaaactaagctgaacgactgggatttcgtggttacaacggacatctcagagatgggtgccaacttcaaggccgaccgtgtaatcgaccctcgtcggtgcctcaaaccagtgatacttacggacgggcccgagcgtgtaatcctggccgggcccatgcccgtgactgcggccagcgccgcgcagcggcgcggccgggtaggaagaaacccccaaaaggagaacgaccagtacatattcaccggccaacccctcaacaacgatgaggatcatgcccactggaccgaggcgaagatgctgctagacaacatcaacacgcccgagggtatcatccccgccctctttgagcccgagcgggagaagtccgccgccatcgacggagagtaccgactaaagggcgagagcagaaagacttttgtcgagctcatgagacgcggggacttaccggtctggctggctcacaaagtagccagcgagggcataaagtacacggaccgtaagtggtgcttcgacggtcagaggaataaccagatcttggaggagaatatggacgtggagatctggaccaaggagggcgagaagaagaaactcagaccacgttggctggacgccagaacgtacagcgacccactggctctgaaggagttcaaggacttcgcagccggcaggaagagcatcgccttagatctggtgaccgagatcggccgggtccccagtcatttggcccaccggacccgaaacgccctggataacctagtgatgctgcacacaagcgagcatggagggaaagcgtatcggcacgccgtggaggaactgccagagacgatggagaccctgctgctgctgggtttaatgatcctgctgaccggtggcgccatgctcttcctgatcagcggaaagggaatcggcaagacatcaattggattaatctgcgtcattgctagcagtggcatgctgtggatggccgagattcccctgcaatggatcgccagcgctatcgtgcttgaatttttcatgatggtgttattgatccccgagcccgagaagcagcggacgcctcaggataaccaactggcctacgttgtaatcggaatcttgaccctggcggccatcatcgctgccaacgagatgggcttactcgagaccacaaagcgcgatttaggcatgagtaaggagcctggggtggtcagcccaacctcgtacctggacgttgacttacaccctgcgtcggcatggacactgtacgccgtggcgaccaccgtcatcacgccaatgctgcggcacacaattgagaactccaccgccaatgtgtctttagccgctatcgcgaaccaggcggtagtcctcatgggcctggacaaagggtggccaatatcgaaaatggacctcggggtgcccttgctggccctggggtgctactcgcaagtgaaccccctgaccttgaccgcagccgtactcctgctgatcacccattacgctattatcggcccgggtcttcaggcaaaggcaacgcgcgaggcccaaaagcggaccgccgctggtatcatgaaaaacccgaccgtggacgggatcatgaccatcgacctggatcccgtgatctatgactccaaattcgagaagcagctgggccaagtaatgctcctggtgctgtgtgcggtgcaactcttgctaatgcgcacctcatgggccctctgcgaggcgttgaccctggccaccggacccatcacgaccctctgggaaggctcccctggtaagttctggaacaccactatcgcggtctctatggccaacatctttcgaggctcctacctggccggggcaggactggcattcagcatcatgaagtccgtggggaccggcaagcgtggcactgggagccagggcgagacgctcggggaaaagtggaaaaagaagttaaaccaactgagccggaaggagtttgacctctacaagaaatccggcatcaccgaagtggaccgtacggaggcgaaggaaggattaaagcggggcgagatcacgcaccatgccgtctctcgcggctccgctaagttacaatggtttgtggaacggaacatggtgatcccggaggggcgagtcatcgacctcgggtgcggtagagggggttggagctattactgcgcaggcctgaaaaaggttaccgaggtgcgcgggtacacgaagggagggccagggcatgaggagcccgtccccatgtccacgtacgggtggaacattgtgaagctcatgagcgggaaggacgtgttttacctcccgcctgaaaagtgcgacactctgctgtgcgacatcggggagagttctccgagccccaccgtcgaggagagtcggactatacgcgtgcttaagatggtagagccctggctcaaaaacaaccagttctgcatcaaagtccttaacccctacatgcccacggtggtggagcacctcgaaaggctccagaggaagcacggggggatgctggtccgcaaccccctgagccgaaattcgacccacgaaatgtattggatatccaacggcacgggaaacatcgttgccagcgtgaatatggtcagccgcctcttactgaataggttcacgatgacgcatcgacggccaaccattgaaaaggatgttgacctgggtgctggtacccgccacgtgaacgccgagcccgagactcccaacatggacgtaatcggggaaagaataaagcgcatcaaggaggagcacaactctacctggcattatgacgacgagaatccttacaaaacctgggcctaccacggatcctatgaggtgaaagccacagggagcgcctcctcgatgatcaacggtgtcgtgaagctgctgactaaaccgtgggatgtagtacccatggtgacgcagatggcgatgaccgacactacaccctttgggcaacaacgggtcttcaaggagaaggtagacacgcgcaccccgcggagcatgcccggcacccgacgcgtgatgggcatcaccgcggagtggctctggcggacgctggggcggaacaagaaaccccgcctgtgcaccagagaggagttcacaaaaaaggtaagaacaaacgccgccatgggggcggtcttcaccgaggagaaccaatgggatagtgcgaaagcggccgtggaagacgaagacttttggaagctagtcgaccgcgaacgtgagctccacaagctaggaaaatgcggctcgtgcgtctacaacatgatggggaaacgggaaaagaagttaggagaattcggcaaagccaaggggtctcgggccatatggtacatgtggctgggtgcacgctacctggagttcgaggccctaggttttttgaacgaggaccattggttcagccgcgagaactcgtacagcggcgtggagggggagggcctgcacaagttaggctacatcctgcgggacatatccaaaatccccgggggagctatgtacgccgatgacactgcgggttgggacacgcgaatcaccgaggatgacctgcacaacgaggagaagatcactcagcagatggatccggagcatcggcagctcgcgaacgccatcttcaagcttacttaccagaacaaggtggtcaaagtgcagcggcccaccccgacaggcaccgtaatggacatcatcagccggaaggaccagcgaggctccgggcaggtaggcacttacggcctgaatacctttaccaatatggaggcccagctcatccgtcagatggaaggggagggcgtactttctaaggctgacctggagaacccacgccttcccgagaagaagattacccaatggcttgagacgaagggcgttgagcgcttgaaacggatggcgatttccggcgacgactgcgttgtgaaacccatagacgaccgtttcgccaacgcattactcgccctgaacgacatggggaaggtccgtaaggacatcccacaatggcagccaagcaaggggtggcacgactggcagcaggttccgttctgttcccaccacttccacgaactaatcatgaaggacggacgcaagctggtggtgccttgccggccacaggacgagctgatcgggcgcgcccggatcagccagggcgccgggtggtcactccgcgagaccgcatgcctcgggaaggcgtatgcccagatgtggagcctaatgtactttcaccgccgggacctccgcctggcgagcaacgcaatttgcagtgccgtcccggtccattgggtgccgacctcacggaccacttggagcatccacgctcaccaccagtggatgaccaccgaggacatgctaaccgtctggaaccgcgtgtggattgaggacaatccttggatggaggacaagacccccatcaccacctgggagaacgtgccctatctcggtaagcgggaggaccagtggtgcggttcactgatcgggttaacctcccgcgccacgtgggcgcaaaacattccgaccgccatccagcaggtcagaagcctcatcggcaacgaagaattcttagactacatgccctctatgaagcgcttccgcaaggaagaggagtcggaaggtgcaatctggtga

SEQ ID NO: 26025 - RNA, 9873 nt, synthetic construct
  misc_feature 1..9873: note = derived and/or modified CDS sequence (opt11) from DENV-3__FJ639750__SS-prME
  source 1..9873: mol_type = other RNA
accagcctgtgcctcatgatgatcctgcccgccgccctggctttccatctcacctctcgagacggggaacccagaatgatcgtgggcaaaaacgaacggggcaaaagcctactgttcaagaccgcctccgggatcaacatgtgcaccctaatcgccatggatctgggagagatgtgtgacgacacagtgacgtacaagtgcccccacatcacggaggtggagcccgaggacatcgactgctggtgcaacctgaccagcacctgggtgacctacgggacgtgcaaccaggccggggaacaccggcgagacaagcggtccgtcgcactcgcgccccacgtggggatggggctggacacccgcacccagacctggatgagcgccgagggggcctggcgccaggtggagaaagtagagacgtgggccctgcgccacccgggattcaccatattagcgctgttcttggcccactacatcggcacctccttgacacagaaggtggtcatctttatcctgcttatgctcgtcactcccagcatgaccatgcggtgcgtgggggtgggcaaccgcgacttcgtcgagggcctgagcggggccacatgggtggacgttgtcttagagcacggcggttgcgtgaccactatggctaagaacaagccaaccctcgacatcgagctgcagaagactgaggccacccagctggcgactctccggaaactgtgcatagagggtaagatcactaacatcaccactgacagccgctgccccacgcagggtgaggctgtgctgccggaggagcaggaccagaactatgtctgcaagcacacctacgtggaccgggggtggggcaacgggtgcggcttgttcgggaagggctccttggtgacctgcgccaagttccagtgcttggagcccattgagggcaaggtagtgcagtacgagaacctcaagtacaccgtcatcataacggtccacaccggggaccagcaccaggtaggcaacgagacacagggggtgaccgccgagatcacgccccaagccagcaccaccgaggcgatccttcccgagtacggcaccctggggctcgagtgctccccgcgcaccggcctggactttaacgagatgatcctgctcacgatgaagaacaaggcctggatggtgcaccgacagtggttcttcgatctgcccttgccctggacctcaggcgccaccaccgagacgcccacctggaaccgcaaggagctcctggtgaccttcaagaacgcgcacgccaagaaacaggaggtcgtagtcctgggctcccaggagggcgccatgcataccgccctgacgggggccaccgagatccagaacagcggcgggacctccatctttgccggtcacctgaagtgccgcctgaagatggataagctcgagctgaagggcatgagctatgctatgtgtaccaacacgttcgtcctgaagaaggaggtatccgagacccagcacgggacaatcctcatcaaggtagagtacaaaggcgaggacgtcccgtgcaagatccccttcagcaccgaagatggacagggcaaggctcacaacggacgcctgatcacggccaaccccgtggtgaccaaaaaggaggagcccgtcaacatcgaggctgagccgccctttggggagagcaacatcgtgatcggcatcggggacaacgccctgaaaatcaactggtacaagaaaggaagcagcatcgggaagatgttcgaagcgactgcccggggcgcacgccggatggccatcctgggcgacaccgcctgggacttcgggtccgtgggcggggtcctcaactcactaggcaagatggttcaccagatctttggttccgcctacacggccctgttcagcggcgtgtcctgggtcatgaaaatcggcatcggggttctcctgacatggatcggactgaacagtaaaaacaccagcatgagtttctcttgcatcgccatcggcatcatcaccctctacctgggcgccgtggtccaggccgacatggggtgcgtgatcaattggaaggggaaggagctgaagtgcggctcagggatcttcgtgacgaacgaggtccacacctggaccgagcagtataagttccaagcggattctcccaagcgcctcgccaccgcgatcgcaggcgcgtgggagaacggtgtgtgcggcatccgcagcacgacccgtatggagaacctgctgtggaagcagatcgctaacgagctcaactatatcctctgggaaaacaacatcaagctgaccgtggtcgttggtgacatcataggtgtgttagagcaaggcaagcgcaccctgacgccgcagccgatggaactgaagtactcatggaagacatgggggaaggccaagatcgttacggccgagacccagaacagcagcttcatcatcgacggccccaacacgcccgagtgtccctctgcctcccgggcgtggaatgtttgggaggtggaggactacgggttcggcgtcttcaccaccaacatctggctcaagctgcgcgaggtgtacacccaactctgtgaccaccggctcatgagcgccgccgtgaaggacgagcgcgccgtccacgccgatatgggctactggattgagagccaaaagaatgggtcttggaagctggagaaagctagcctaattgaggtgaagacctgcacgtggccgaagtcccacaccctctggtcgaacggcgtgctggagtccgacatgatcatccccaagagcctagccgggcctatctcgcagcacaattaccgaccgggttaccacactcagaccgctggcccatggcacctcggcaagctggagttagacttcaactactgcgagggcacgaccgtcgtgatcaccgagaactgcgggacccgtggccccagcctccggacgaccaccgtgtccgggaaacttatccacgagtggtgctgccgcagctgcaccctgcctcccttaaggtacatgggcgaagacgggtgctggtacgggatggagattcgcccgatctccgagaaggaagagaacatggttaagagcttagtttccgccgggtcaggggaggtggacaacttcacgatgggcgtcctctgcctcgccatcctgttcgaggaggtgatgcgggggaagttcggcaagaagcacatgatagcgggggtgttcttcaccttcgtcctgctcctttccggccaaatcacctggcgcgatatggcccatactctgatcatgatcggcagcaacgcctccgaccggatggggatgggggtgacgtacttggctcttatcgccaccttcaagatccagcccttcctggcgctcgggttcttcctgcgcaagctgacctcccgggagaatctcctgctgggcgtaggcctcgccatggccacaacgctgcagctgcccgaggacatcgagcagatggccaatgggatcgcgctcggcctgatggcgctgaagctcatcacgcaattcgagacctaccagttgtggacagccctaattagccttacgtgctccaacaccatcttcaccttgaccgtcgcctggcgcactgcgaccctgattctcgcaggcgtgagcttgctgccggtctgccagtccagctccatgcgcaagaccgattggctccccatgaccgtggccgctatgggtgtgccgccactccccctgttcatcttcagcctcaaagatactctgaagcgccgcagctggcccttgaacgagggggtcatggctgtgggcctcgtgagcatcctggcctccagcctgctccggaacgatgtgcccatggcgggccccctggtagccgggggactgctcatcgcctgctacgtgattaccggtacctcggctgatctcaccgtcgagaaggccgcggatgtgacgtgggaggaggaagccgagcagaccggcgtgagccacaacctgatgataaccgttgacgacgacggcactatgcgcatcaaagacgacgagaccgaaaacatcctcacggtgctgctgaagaccgccctcctgatagtgtccggcatcttcccgtactcgatccccgctacactgctcgtctggcacacatggcaaaagcagacgcagcgcagtggagtgctttgggacgtgcccagtccacccgagacacagaaggccgagctggaggagggggtctatcgcatcaagcagcagggcatcttcggaaagacccaggtgggcgtgggggtccagaaggagggcgtgttccacactatgtggcacgtaacgcggggcgcggtcctcacctataacgggaagcgcctggagcccaattgggcgtccgtgaagaaagacctgatcagctacggaggtggatggcggctctccgcacagtggcagaagggtgaggaggtgcaggtcatcgccgttgagccaggcaaaaaccccaagaatttccagaccatgcccggcaccttccagacgaccacaggtgagatcggcgcaatcgcactagatttcaagcccgggactagcggcagccccatcatcaaccgggagggtaaggtggtcgggttgtacggcaacggggtggtgacgaaaaatggcgggtatgtctcaggaatcgcccagacaaacgctgagccggacgggcccacccccgaactggaggaggagatgttcaagaagcggaacttgaccatcatggacctgcaccccggctcagggaagacgcgcaagtatctacccgccatcgtgcgtgaagctatcaagcgccggctccgcacactgatcctagctccaacccgggtggtcgctgccgagatggaggaggccctcaaggggctgcccatccgctaccagacaacggcaaccaagtccgagcacaccggccgggagatcgtggacctgatgtgccacgccaccttcacgatgcgcctcctcagccccgtgcgggttccgaattacaatctgatcatcatggacgaagcccacttcaccgaccctgccagcatagccgcgcgcggatatatcagcacaagagtgggcatgggcgaggccgccgccatcttcatgaccgcgacgcctcccgggaccgccgacgccttcccgcagtccaacgcacccatccaggacgaggagcgcgacatccccgagcgctcatggaactccggaaacgagtggatcacggacttcgcagggaagaccgtgtggttcgtacctagcatcaaggcaggcaacgacatcgccaattgcctcaggaagaatgggaagaaagtgatccagctgtcccggaagactttcgacaccgagtaccagaagaccaaactgaacgactgggatttcgtggtcaccacggacataagcgagatgggcgccaacttcaaggccgacagagtgattgatccgcgccggtgcctcaagcctgtgattctgactgacggccccgagcgtgtgatcttagccgggcccatgccggttacggcggcctccgccgcccagcgtcgcggccgggtggggcgcaacccccaaaaggagaacgaccagtacatcttcaccggccagcccctcaacaacgacgaggaccacgcccactggaccgaggcgaagatgctgctggacaacatcaacacgcccgaggggatcattccagccctcttcgagcccgaacgggaaaagtccgccgcgatcgacggagagtaccgcctgaagggcgagtcccggaagactttcgtggagctaatgcgccgcggggacctccccgtatggctggcacacaaggtcgcctccgagggcatcaagtataccgaccgcaagtggtgcttcgatgggcagagaaacaaccagatcctggaggagaacatggacgtggagatttggaccaaggagggggagaaaaagaaactccgcccacggtggctggatgcccgcacgtactcagaccctctggccttgaaggagttcaaggatttcgccgcgggccgcaagagcatcgctctggatttggtgaccgagatagggcgggtgccctcccatctcgcccatcgaacccggaacgctctggacaaccttgttatgctgcacaccagcgaacatggaggtaaggcctaccgccatgcggtggaggagctgccggagacgatggagaccctactcctactgggcctcatgatcctgctgaccggaggtgcgatgctgttcctgataagcggcaagggaatcggcaagacctccatcgggctcatttgcgtcatagcctcctccggcatgctctggatggccgagatcccgctgcagtggatcgccagcgccatcgtcctagagtttttcatgatggtgttactgatccccgagccagagaagcagcggacgccccaggacaaccagttagcctacgtggtgatcgggatcctcacacttgccgccatcatcgccgcgaacgagatgggcctgctcgagaccaccaaaagagacctgggtatgtccaaagagccgggggtggtcagcccgacgagctatctggacgtcgacctccaccccgccagcgcctggaccctgtacgccgtggcgacaacggtaatcacgcccatgctgcggcacaccatcgagaactctaccgccaacgtgagcctagccgccatcgctaaccaggccgtggtcttaatgggcctggataaggggtggccgatctcgaagatggacctcggcgtgcccctactagcgcttgggtgctactcccaagtgaatcccctgaccctgacagccgcagtcctcctactgatcacccactatgcaataatcggacctggcctccaggcgaaggccacgcgcgaggcccagaagcgcaccgccgccgggatcatgaagaacccgacggtggacggcattatgaccatcgacctggaccccgtgatctacgactccaagttcgagaagcagctggggcaggttatgctcctggtgctatgcgcggtgcagctcctgctcatgcgcacgagctgggccctctgcgaggccctgaccttagccacgggccccatcaccacgctttgggagggttcaccaggcaagttctggaacaccacgatagcggtcagcatggccaacatcttccgaggcagttatctggccggggctggcctggccttcagcatcatgaagtccgttggtaccggcaagcgcggcaccggatcccagggcgaaaccttaggcgaaaagtggaagaaaaagctgaaccagctgagccggaaggagttcgatctttacaaaaagtccggcatcactgaagtggaccgcacagaggcgaaggaggggttgaagcggggagagatcacccaccacgccgtctcccggggctccgccaagctgcagtggtttgtcgagcggaacatggtgatacctgagggtcgggtcatcgacctcggctgcgggcgcggcggctggagctactactgcgccggcctgaagaaggtgacggaagttcgcgggtatacaaagggaggacccgggcacgaggaacccgtccccatgagcacgtacggctggaatatcgtgaaactgatgagcggtaaggacgtcttctacctcccacccgagaagtgtgacacactgctgtgcgacatcggtgagtccagcccctcccctaccgtcgaggagagccggaccatccgcgtgctgaagatggtggagccatggctcaagaataaccagttctgtatcaaagtcctgaatccctatatgcccacggtgatcgagcacctggagcgcctccagcggaagcacggagggatgctggtccgcaacccgctgagccggaacagcacccatgagatgtactggatctccaacggtaccgggaacatcgtagccagcgtgaacatggtgtcacgcctactgctgaaccggttcaccatgacgcaccgccggccgaccatcgagaaggacgtcgacctcggcgcgggcacccgccacgtgaacgccgaaccagagaccccaaacatggacgtgattggggagcggatcaagcgcataaaggaggagcacaacagcacgtggcactatgacgacgagaatccgtacaagacgtgggcctaccacgggtcctacgaggtcaaggcaaccgggagcgcttccagcatgatcaacggagtggtcaagctattaaccaagccttgggacgtggtgccaatggtcacgcagatggcgatgactgacacgaccccctttgggcagcagcgggtgttcaaggagaaagtggacacacgcaccccgcggagcatgcccggcacccgccgcgttatgggcatcaccgctgagtggctctggcgcacgctggggagaaacaagaaaccacgcctgtgcacccgggaggagttcaccaaaaaggtcaggacaaacgcggccatgggcgcggtatttacggaggagaatcagtgggactcggccaaggccgcagtggaggacgaggacttttggaaactcgtggaccgcgagcgggagctgcacaagttagggaagtgcggctcgtgtgtgtacaacatgatggggaagcgcgagaagaagttgggcgagttcggcaaagccaaagggtcccgagcgatctggtacatgtggctgggcgcccgctacctggagttcgaagccctcgggttccttaacgaggaccactggttcagccgagagaactcctatagcggtgtcgagggggagggcctgcacaagctcgggtacatcctgcgcgacatatccaagatccccggaggcgctatgtacgccgacgacaccgcggggtgggacacccggatcaccgaagacgacctgcacaacgaggagaagatcacgcagcagatggatccggagcatagacagctcgcgaacgccatcttcaagctgacctatcagaacaaggtggtaaaggttcagcggcccacccccaccggcaccgtgatggacatcatatcgcgtaaggaccagcggggctccggccaggtgggcacgtacggcctgaacaccttcaccaacatggaggcccagctcatccgccagatggagggcgagggggtactgagcaaggccgacctggagaacccccacctcccggaaaagaagatcacccagtggctggagacgaagggcgtagagcggctgaaacgcatggccatctccggagacgactgcgttgtcaagcccatcgacgatcggttcgccaacgccctccttgccctaaacgacatggggaaggtacgcaaggatatcccccagtggcagccgtctaagggctggcacgactggcagcaggtcccgttctgttcccaccacttccacgagctcattatgaaagacgggcggaaactggttgtgccctgccgcccccaggatgagctgatcggacgggcgagaatcagccaaggggcgggctggagcctccgagagaccgcctgcctgggaaaggcctacgcccagatgtggagcctcatgtacttccaccgccgcgacctccggctggcgtcgaacgctatttgttccgctgtgcccgtccactgggttccgacctcccgcaccacctggagcattcacgcccaccaccagtggatgaccaccgaagacatgctgaccgtttggaatcgggtctggatagaggacaacccctggatggaggacaagacgcccgtgactacctgggaaaatgtgccttacttggggaagagggaggaccagtggtgtggcagccttatcgggctgacctcccgggccacttgggcgcaaaacattccgaccgccatccaacaggtgcgctcactgatcggcaacgaggagttcctggactacatgccctcaatgaaacgcttccgcaaggaggaggagagcgaaggggctatctggtga

SEQ ID NO: 26026 - RNA, 9873 nt, synthetic construct
  misc_feature 1..9873: note = derived and/or modified CDS sequence (opt11) from DENV-3__FJ639754__SS-prME
  source 1..9873: mol_type = other RNA
accagcctgtgcctcatgatgattttgcccgccgccctagcgttccacctcacctcgcgcgacggtgaaccacggatgatcgtgggtaagaacgaacggggcaagagcctgctgttcaagacggccagcgggatcaacatgtgcaccctcatcgccatggacctaggggagatgtgcgacgacaccgtgacctacaagtgccctcacatcacggaggtggagcctgaggatatcgattgctggtgcaacctgaccagcacctgggtgacctacgggacgtgcaaccaggccggcgagcatcggcgcgacaagcggtccgtcgccctcgcgccgcacgtgggcatggggctagacacccgcacccaaacatggatgagcgccgagggcgcctggcgccaggtggagaaggtcgagacgtgggccctgcgccacccggggttcaccatcctcgcgctgttcctggctcactatatcggtaccagcctcacccagaaggttgtgatcttcatcctgctgatgctcgtcactcccagcatgaccatgaggtgcgtgggggtgggcaaccgcgacttcgtcgagggtctgtccggggccacctgggtggacgtggtcctggaacacggcgggtgcgtgacgacgatggcaaagaacaagcccaccctcgacatcgagctgcagaagactgaggccacgcaactggcgaccctccggaagttatgcattgaggggaagatcaccaacatcaccaccgacagccgctgcccgacccagggcgaggccgtgctcccggaagaacaggaccagaactatgtttgcaagcacacctacgtggaccgggggtggggcaacgggtgcggactcttcgggaaggggtctctggtgacttgcgccaagttccagtgcctggaacccatcgagggcaaggtagtgcagtatgagaacctaaagtacactgtgataatcacggtccacactggggaccagcaccaggtcggcaacgagacccaaggggtcaccgcggagatcactccccaagccagcaccacagaagcgatcctgcccgaatacggcaccctggggctcgagtgcagtcctcgcaccggcctggactttaatgagatgatcctgctcacgatgaaaaacaaagcctggatggtacaccggcagtggttcttcgaccttccattgccctggacctccggtgccaccaccgagacgcccacgtggaaccgcaaggagctccttgtgactttcaaaaacgcccacgccaagaagcaggaagtcgttgtgctggggagtcaggagggcgcgatgcacaccgccctgacgggggccaccgagattcaaaacagcggcggcacctccatcttcgccggccacctgaagtgccggttgaagatggataagctcgaactgaagggaatgagctacgccatgtgcaccaacacgttcgtcctgaagaaggaggtctccgagacccagcacgggaccatcttaataaaggtcgagtacaagggcgaggacgtcccctgcaagatccccttcagcaccgaggacgggcagggcaaggcgcacaacggccgcctgatcacggcgaatcccgtggtcaccaagaaggaggagcctgtcaacatcgaggccgagccgcccttcggcgagagcaacattgtgatcggcatcggcgacaacgccctgaaaatcaactggtacaagaaggggtcctcaatcggtaaaatgttcgaagcgaccgcacgtggagcccgccggatggccatcctgggcgatacagcctgggacttcgggagtgtgggcggggtccttaacagcctaggcaagatggtgcaccagatcttcgggtctgcgtacacggccctgttcagcggcgtgtcttgggtcatgaagatcggcatcggggtgctgctgacctggatcggtctgaacagcaagaacacgtccatgagctttagctgcatcgccatcgggatcattactctctacctgggcgctgtcgtacaggccgacatgggctgcgtgattaactggaagggcaaggagctgaagtgcggcagcggtattttcgtgacgaacgaggtccacacctggaccgagcaatacaagttccaggcggactcccccaagcgcctcgccactgccatcgcaggcgcgtgggagaacggggtctgcgggatccgcagcacgacccggatggaaaacctgttgtggaaacagatcgccaacgagctcaattacatcttgtgggagaacaacatcaagctgaccgtggtcgtgggcgacatcatcggcgtgttggagcagggcaagcgcaccctgactcctcaaccgatggaactgaagtactcctggaagacctggggaaaggccaagatcgtcaccgccgagacccaaaacagcagcttcatcatcgacggccccaacacgcccgagtgccccagcgcctcccgagcgtggaacgtgtgggaggtggaggactatgggttcggcgtcttcaccaccaacatttggctaaaactgcgcgaggtctacacacagctgtgcgaccatagattgatgtccgctgccgtgaaggacgagcgcgccgtccacgccgacatgggctactggatcgaatcacagaagaatgggtcttggaagctggagaaggcgagtctgatcgaggtgaagacctgcacgtggccgaagagtcacaccttatggtctaacggcgtgctcgaatccgatatgattatccccaagagcctggccgggcccatctcccagcacaactacaggccgggctaccacacccagaccgccggcccatggcacctcgggaagctggagctggacttcaactactgcgagggcaccactgtcgtgatcactgagaactgcgggactcgcggccccagcttgcggaccaccaccgtgtccgggaagctgatccacgaatggtgctgtcgtagctgcaccctgcccccgctccggtacatgggcgaagacggatgctggtacggcatggagatccggccgatcagtgagaaggaggagaacatggtaaagagcctggtgagcgcaggcagcggggaggtggacaacttcacgatgggcgtcctgtgcctcgccatattgttcgaggaggtgatgcgggggaagttcggcaaaaagcacatgatcgcgggggttttctttacgttcgtcctgctcctgtccggccagattacatggcgggacatggcccacaccctcatcatgatcggatcaaacgcctccgaccggatgggtatgggcgtcacttacctggcactgatcgccacattcaagatccagccctttctggcgctcgggtttttcctgcgaaagctgaccagccgagagaacttactgctgggcgtgggcctcgccatggccactactttacagctgcccgaggacatcgagcagatggccaacgggattgcgttaggactgatggccctgaagctcattacccagttcgagacctaccagctgtggaccgccttgatctcactcacatgctccaacaccatcttcaccctgacagtcgcctggagaacggccaccctgatcctcgcgggggtgtcactactaccggtctgccagtcaagctcgatgcgaaagactgactggttacccatgaccgtggctgccatgggcgtgccgcccctcccgttgttcatcttcagcctgaaggacacgctgaagcgccgctcctggcccttgaacgagggtgtcatggctgtgggcctcgtgagcatcttggcctccagcctgctccggaacgacgtacccatggcaggcccgctggtggcaggagggctgctcatcgcctgttacgtgatcaccggaacctccgccgacttgaccgtcgagaaggccgctgacgtgacgtgggaggaggaggccgagcagaccggagtgagccataatctgatgattacagtggacgacgacgggaccatgcgcattaaagacgacgagacggagaacatcctaacggtgctgctgaagaccgccctcctgattgtgtccgggattttcccgtacagcatacccgccaccctgctcgtctggcatacctggcaaaagcagacgcagcggtctggcgtgctgtgggacgtacccagcccgcccgaaacccagaaggccgagttagaggagggggtctaccgcatcaagcaacagggcatattcgggaaaacacaggtgggcgtgggggtccaaaaggagggcgtgtttcacaccatgtggcacgtgacacggggtgcggtcttgacctacaacgggaagcgcctggagcccaactgggcttccgtgaagaaggacctgatcagttatggcgggggctggcggctctctgcacaatggcagaagggtgaggaggtgcaggtcattgccgtggagcccggcaagaaccccaagaacttccagacaatgccaggtaccttccagacgaccacaggggagataggagcgatcgcccttgatttcaagcccgggacaagcggcagccccatcattaacagggagggaaaggtggtcgggctgtacgggaacggggtggtgacgaaaaacggcgggtacgtctccggcatcgcccagaccaacgccgagcctgacggccccacgcccgagttggaggaggagatgttcaaaaagcggaacctcaccatcatggacctgcaccccgggagcggcaaaacgcgcaagtacctgccggccattgtgcgtgaggcgatcaagcgccggctccgcaccctgatccttgccccgacccgggtggtcgccgccgagatggaggaggccctcaaggggctgcccatccgctaccagaccacggccaccaagtccgaacacactggtcgggagatcgtggacctgatgtgccacgccaccttcactatgcggttgctgtcgcccgtgcgcgtcccgaactacaacctgatcatcatggacgaggcccacttcaccgaccctgcttccatcgccgcccgggggtacatctcaacccgcgtgggcatgggcgaggccgccgccatcttcatgaccgcgacgccgcctggaaccgcagacgcctttccgcagtccaacgccccaatccaggacgaggagcgcgacatccccgaacgcagctggaactctggcaatgagtggatcaccgatttcgccgggaaaaccgtgtggttcgtccccagcatcaaggcgggcaacgacatcgccaattgcctccggaagaacggcaagaaggtgatacagctctcgagaaagacattcgacacagagtaccagaagaccaagctgaacgactgggacttcgtggtcaccacggacatcagcgagatgggcgccaacttcaaggccgaccgggtgatcgatccgcgccggtgcttaaagcccgtgatcctgaccgacggccccgagcgcgtcatactagccgggcccatgccggtgaccgcggcctccgcagcgcagcggcgcggccgggtggggcgcaacccccaaaaggagaacgatcagtacatcttcactggccagcccctcaacaacgatgaggaccacgctcactggaccgaggcgaaaatgctcctggataacatcaacacgcctgaggggattatcccggccttattcgagcccgagcgggagaagtccgccgcaatcgacggcgagtacagactcaagggcgagtcccgtaagaccttcgtcgagctgatgcgacgaggggacctccccgtgtggctggctcacaaggtcgcttcagagggcatcaagtatacagatcgcaagtggtgcttcgacgggcagcgcaataaccagatcctggaggagaacatggatgtggaaatctggaccaaggagggtgagaaaaagaagctacggccccggtggctggacgcccgcacttactctgacccgctggcgctcaaggagttcaaggatttcgccgcaggcagaaagagcatcgctctggacctggttaccgagatcgggcgggtaccctcgcacctcgcacaccgaacccggaacgccctagacaacctggtgatgctgcacaccagcgagcacggcggcaaggcctaccgccacgcggtggaggagttgcctgagacgatggagaccctattgctcctgggcctcatgatcttactgaccggcggcgccatgctgttcctgatctcaggtaaggggatcggcaagacctccatcgggctcatctgcgtcatcgccagttccgggatgctctggatggccgagattccgttacagtggatcgcttcggcgatcgtgctggagttcttcatgatggtgctcttgatcccagagccagagaagcagcggacgccccaggataaccaactggcctacgtcgtgatcgggatactgaccctcgccgccatcattgcagctaacgagatgggcttgctagaaacgaccaaacgcgatctgggcatgtcaaaggagcccggggtggtcagccccacgagctacctggatgtagacctccaccccgccagcgcctggaccctgtacgccgtggcgacaaccgtcatcacgcccatgcttcgtcataccatcgagaactccactgccaacgtgagcctcgccgccatcgccaaccaggctgtggtcctgatgggcctggacaaggggtggcccatatccaagatggacctcggcgtgcctctgctggcgctcgggtgctatagccaggttaaccccttgacgctgacggccgccgtcctcctgctgatcactcattacgccatcatcggccccgggctccaggcgaaggccacccgcgaggcccaaaagcggaccgccgccgggataatgaagaacccgacggtggacgggatcatgaccatagacctggaccccgtgatctacgattccaagttcgagaagcagctgggtcaggtcatgctcctggtgttatgcgcggtgcagctcctgctgatgcggaccagctgggccctctgcgaggccctaaccctggccacgggacccattaccaccctctgggagggctccccaggcaagttctggaacacgacgatcgcggtcagcatggccaacattttccggggcaattacttagccggggccggcctggccttctccatcatgaaaagcgtggggaccggcaagcgcggcaccgggtcccagggcgaaacactcggggaaaagtggaagaagaagttgaaccaattgagccggaaagagttcgacctctacaagaagtccggcataaccgaggtggatcgcacggaggcgaaggaggggctgaagagaggcgagatcacccaccacgccgtctcccgcggcagtgccaagttacagtggtttgtggagcggaacatggtgataccggaggggagggtcatcgacctcggctgcgggagaggagggtggtcctattactgcgccggcctgaagaaggtgaccgaggtgcgcggctacaccaagggcgggcccggtcacgaggagcccgttcccatgtcgacctatggctggaacatcgtgaagctgatgtccgggaaggacgtattctacctaccgcccgaaaagtgcgacaccctgttgtgcgacatcggcgaaagctccccgagccccaccgtagaggaatctcgcactatccgcgtgctgaaaatggtggagccgtggctcaagaacaatcagttctgtatcaaggtcttaaacccatacatgcccaccgtgatcgagcacctggagcggctccagagaaagcacggcgggatgctggtgcgcaatcccttgagccggaactccacccacgagatgtactggatcagcaatggcaccggcaacatagtggcctccgtgaacatggtgagccgcctcctgctgaacaggttcaccatgacgcaccgccggccgaccatcgagaaggacgtcgacctcggcgcaggcacgcgccacgtaaacgccgaacccgagacccccaacatggatgtgatcggagagcggataaagcgcatcaaggaggagcataactcgacgtggcactacgatgacgagaacccgtacaagacctgggcctatcacggctcgtatgaagtcaaggccaccggttccgcgagctccatgatcaatggcgtggtgaagctgctcaccaagccctgggacgtggtgcccatggtcacgcagatggcaatgaccgacaccaccccgttcgggcagcagcgggtatttaaagagaaggtagacacccgcaccccgcggtcgatgcccgggacccgccgggtcatgggcatcaccgccgagtggttgtggcgcacgctggggcggaacaagaagccccgcctgtgcacacgagaggagtttaccaagaaggtgcgcaccaatgccgcgatgggggcggtgttcacggaggagaaccagtgggacagcgccaaggccgccgtcgaagacgaagacttttggaagctcgtggaccgcgagcgggagctgcacaagctgggaaagtgcggctcctgcgtctacaacatgatggggaagcgcgagaagaagctcggcgagttcggaaaggccaaggggagccgagcgatctggtacatgtggctgggagcccgctacctggagttcgaggctctcgggtttctgaacgaagaccactggttcagtcgggagaacagctattccggtgtggagggagagggtctgcacaagctcggctatatccttcgcgacatcagcaagatccccgggggcgccatgtacgcggacgacactgcggggtgggacacccggataaccgaggacgacctgcacaacgaggaaaagataacgcaacagatggacccggagcaccgccagctcgccaacgcgatctttaagctgacctaccagaacaaagtggtgaaggtccagcggcctacccccaccggcaccgtgatggacatcatttcgcgaaaggaccagcgtgggagcggtcaggtcgggacctacgggctgaacaccttcacgaatatggaggcccagttgatccgacagatggagggcgagggggtcctgtccaaggccgacctggagaacccccacctcccggagaagaagatcacccagtggctggagacgaagggcgtggagcggctgaagcgcatggcgatcagcggcgacgattgcgtggtcaagcccatcgacgatcgcttcgccaacgccctgctggccctgaacgacatgggaaaggtgcgcaaggacatcccccagtggcaaccctccaagggctggcacgattggcaacaggtccccttctgcagccaccactttcacgagctcatcatgaaggacggtcggaaactggtcgtgccctgccgcccacaggacgagctgatcggccgggcgagaatcagccagggggcaggctggtcactacgggagaccgcctgcctaggaaaggcctatgcccagatgtggtccctgatgtactttcaccgccgcgacctccggctggctagcaacgccatatgcagtgccgtgcccgtccattgggtgccgaccagccgcaccacgtggtcgatccacgcccaccaccagtggatgaccaccgaagacatgctgaccgtatggaaccgggtctggattgaggacaatccctggatggaggacaagactcccgttacgacatgggagaatgtgccgtatctggggaagcgcgaggaccagtggtgcggcagcctcatcgggctgaccagccgggctacctgggcgcaaaacatcccgaccgcaatccagcaggtccgctccctcatcggcaacgaggagttcttagattatatgccttcgatgaagcgtttccgcaaggaagaggagtccgagggggcaatctggtga

SEQ ID NO: 26027 - RNA, 9873 nt, synthetic construct
  misc_feature 1..9873: note = derived and/or modified CDS sequence (opt11) from DENV-3__FJ639757__SS-prME
  source 1..9873: mol_type = other RNA
accagcctgtgtcttatgatgatcctgcccgccgctctggcattccacctcacctcccgggacggggaaccgcggatgatagtggggaagaacgagcgggggaagagcctgctgtttaagaccgcatcagggatcaacatgtgcaccctcattgcgatggacctgggcgagatgtgcgacgataccgtgacttacaagtgtcctcacatcacggaagtggagccggaggacatcgattgttggtgcaacttaacaagcacctgggtcacctacgggacctgcaaccaggccggcgaacaccggcgcgacaagcggagcgtcgcccttgcgccccacgtgggcatggggctggacacgcgaacacagacctggatgtcagccgagggcgcctggcgccaggtggagaaggtcgagacgtgggccctgcgccacccggggtttaccatattggcgttgttcctggcccattacattggcacctccctcacccagaaggtggtaatcttcatcctgctgatgctagtcacgccgtccatgaccatgcggtgcgtgggggtgggtaatcgcgactttgtcgagggcctgtccggcgccacctgggtggatgtggtcctggagcatggcgggtgtgttaccacgatggccaagaacaagccaaccctcgacatcgagctgcagaagacagaggccacacagctggcgacgctcagaaagctctgcatagagggcaagatcaccaacatcaccaccgacagccgctgccccacgcagggcgaggcagtgcttccggaggagcaggaccagaactacgtctgcaaacacacctacgtagaccgggggtggggcaacgggtgcggcctcttcgggaagggctccttagtgacctgcgcgaagttccagtgcttagagcccatcgagggcaaagtagtccagtacgagaacctcaagtacaccgtgatcatcacggtccacaccggggaccagcaccaagtgggcaacgagacccagggcgtcaccgccgagataacgccccaagccagcaccaccgaggcgatcttacctgaatacggcaccctggggctcgaatgttccccgcgcaccggcttggacttcaacgagatgatcctgctcacgatgaagaacaaggcctggatggtccaccggcagtggttcttcgacctgccgctgccctggaccagcggcgccaccactgagacgccaacttggaaccgcaaggagttactggtgaccttcaagaatgcccatgccaagaagcaagaggtcgtggtgctggggtcccaggagggtgcgatgcacaccgccctcacgggggcgaccgagatacaaaacagcggcgggacctccatctttgccggccacctgaagtgccggctaaagatggataagcttgagctaaagggcatgagctacgccatgtgcaccaacacgttcgtcctgaagaaggaagtgtccgaaacccagcatgggactatcctcatcaaggtggaatacaagggagaagacgtcccgtgcaagatccccttcagcacagaggacggccaagggaaagctcacaacggccgcctgatcacggcgaaccccgtggtgaccaagaaggaggaaccagtcaacatcgaggcagagccgcccttcggggagagcaacatcgtgatcggtataggggactccgcgctgaaaatcaactggtataaaaagggcagcagtatcgggaagatgttcgaggcaaccgctcggggcgcacgcagaatggccatcttaggggacacggcctgggatttcgggagcgtgggcggcgtcctcaactccctgggcaagatggtgcaccagatcttcgggagcgcgtacacggccctgttctccggcgtgagctgggtcatgaagatcggcatcggggtgctcctgacctggatcggcctgaactccaagaacaccagcatgagtttctcctgcatcgccattgggataattaccctctaccttggcgccgtggtccaggccgatatgggatgcgtgatcaactggaagggcaaagagctgaagtgtggctccgggatcttcgtaacaaacgaggtccacacctggaccgaacagtacaagttccaagcagacagccccaagcgcctcgcaacagccatcgccggcgcttgggagaacggggtgtgcggcatccgcagtacgacccggatggagaacctgctgtggaagcaaattgcgaatgagctcaactacatcctgtgggagaacaacatcaagctgaccgtggtcgtcggggacatcatcggtgtgctcgaacagggcaagcgcaccctgacgcctcagccaatggagctgaagtacagctggaagacctgggggaaggccaagatcgtcaccgccgagactcagaactccagcttcatcatcgatggccccaacacgcccgagtgcccctccgccagccgggcgtggaacgtttgggaggtggaggattacggctttggcgtcttcaccaccaacatctggctcaagctgcgcgaggtgtatactcagctgtgcgaccacaggctcatgagcgccgccgtgaaggacgagcgtgccgtccacgccgacatgggctactggatcgagtcccagaagaacgggagctggaagctggagaaggcgtccctgatcgaagttaagacctgtacgtggcccaagtcgcatacgctctggtccaacggcgtgctggagagcgacatgatcatccccaaaagcctggccgggcctatcagccagcacaactatcgcccgggctaccacacccagaccgcggggccctggcacctcgggaagctggagctggacttcaactactgcgagggaacgaccgtcgtgatcacagaaaactgcgggacccgcggcccgtccctgcggacgaccaccgtttccggtaagctgatccacgagtggtgctgccgatcctgtaccttgcccccgctccggtacatgggagaggatggatgctggtacggtatggagatccgcccaatcagcgagaaggaggagaacatggttaagtccctggttagcgccgggtccggggaggtggacaacttcacgatgggagtcctgtgcctcgccatcctgttcgaggaggtgatgcgggggaaattcggcaagaaacacatgatcgcgggtgtgttcttcaccttcgtactgctcctgagcggtcagatcacatggcgcgatatggcccacaccctgatcatgatcggctcaaacgcctcggaccggatgggtatgggtgtgacctacctcgcactgatcgccaccttcaagattcagcccttcctggcccttggtttcttcctccgcaagctgacgagcagagagaacctcctgttaggcgttggcctcgccatggccaccacgctacagctgcccgaggatattgagcagatggcaaacgggatcgcgcttgggctgatggccctgaagctgatcacccagttcgaaacataccagctgtggacggccctgatctccctcacttgtagcaataccatattcaccctgacagtcgcctggcgcacggccactctgatcctcgcgggggtttccctgctgcccgtctgccagtcctccagcatgcgcaagaccgattggttgcccatgaccgtggccgctatgggcgtgccgcccctgccactgttcatcttctccctcaaggacacactgaaaaggcgtagctggcccctgaacgagggcgtcatggccgtggggctcgtgtctatcctggccagcagcctactccggaatgacgtccccatggcgggccccttagtggccggtggcctgctcatcgcctgctacgtgatcaccggtacctccgcggaccttaccgtagagaaggccgcggatgtgacgtgggaggaggaggccgagcaaacgggcgtctcccacaacttaatgatcaccgtcgacgatgacgggactatgcgcatcaaggacgatgagaccgaaaacattctcacagtgctgctgaagaccgccctcctgattgtgagcggtatcttcccgtacagcatccccgccactctgctcgtctggcacacctggcagaagcagacccagagaagcggcgtgctgtgggacgtgcccagcccgcccgagacacagaaggctgagctggaggaaggagtctaccgcatcaaacagcagggcatcttcgggaagacccaggtgggggtaggtgtccagaaagagggcgtcttccacaccatgtggcacgtgacgcggggcgcggtactcacctacaacgggaagcgcctggagccgaactgggcgagcgttaagaaagacctgatatcctacggtggcggctggcggctcagcgcccaatggcagaagggggaagaggtgcaggtcatcgcggtggagcccggcaagaacccaaaaaacttccagaccatgcccggcaccttccagacgaccactggtgagataggcgcgatcgccctggacttcaagcccggcaccagcgggtcccccatcatcaaccgcgagggtaaggtggtaggcctgtacggaaacggcgtggtgaccaagaacggcgggtacgtcagcggcatcgcacagaccaatgccgagccggacggccccaccccagaactggaggaggagatgttcaagaagcggaacctcaccatcatggacctgcaccccgggagtggtaagacgcgcaagtacctgccggccatcgtgcgggaagcgatcaagcgccggttacgcaccctgatcttagcgcccaccagggtggtagccgccgagatggaagaggctctcaaaggcctgcccatccgctaccagaccacggcgaccaagagcgaacatacaggccgggagatcgttgacctgatgtgccacgctaccttcacgatgagactcctgtcccccgtgcgggtcccgaactataacctgatcatcatggatgaggcccacttcaccgatcctgcctctatcgccgcgcgcggctacatatccacccgggtgggcatgggcgaggccgccgccatctttatgaccgcaactccgcccgggaccgcggacgccttccctcagtcgaacgcccccatccaggacgaggagcgcgacatccccgagagatcctggaacagtggtaacgagtggattaccgacttcgccggtaagaccgtgtggttcgtcccgtccatcaaggcgggcaacgacatcgccaactgcctccggaagaacggcaagaaagtaatccagctgagtcgcaaaacatttgacaccgagtaccagaagactaaactgaacgactgggacttcgtggttaccacggacatttccgaaatgggcgccaattttaaggccgacagagtgatcgatccgcgccggtgcctcaagcccgtaatcctgaccgacggccccgagcgcgtgatcctggctgggccgatgccggtgaccgctgcctcggccgcacagcggcgcggacgggtcgggcgcaacccgcagaaagaaaacgaccagtacatcttcaccgggcagcccctaaataatgacgaggaccatgcacactggaccgaggcgaagatgttattagacaacatcaatacgcccgagggaatcatcccagccctcttcgagcccgagcgggagaagtcagccgcaattgacggcgagtacagacttaagggcgagagccgtaagacctttgtcgagttgatgcgccgcggggacctccccgtgtggctggcgcacaaggtcgcctccgagggcatcaagtacaccgaccgcaagtggtgtttcgacgggcagcggaataaccagatactggaggagaacatggacgttgagatctggaccaaggagggcgagaagaagaagctccgcccacgatggctggatgcgcgtacgtacagcgacccgcttgcgctcaaggagttcaaagacttcgccgcgggccgcaagagtatcgctctcgacctggtgaccgagatcggccgcgtccccacccacctcgcccaccgcacccggaacgctctggataatctggtgatgctccatacgagcgaacacggcgggaaggcctaccgccacgcagtcgaagagctgcccgagaccatggagacactgctccttttgggactcatgattctgctcaccgggggcgctatgctgtttctgataagcggcaaggggatcggaaaaacgtcaatcggactgatctgcgtcatcgctagctccggtatgctttggatggctgaaatcccgctacagtggatcgcctcggcgatcgtactggagttcttcatgatggtgctccttatcccggagcccgagaagcagcggacgccccaggacaaccagctggcctatgtcgtgatcgggatcctcaccctggccgccatcattgccgcgaacgagatgggcctgctcgaaacgacgaagcgcgacctgggcatgtccaaggagccgggggtggtcagccccacctcctatctggacgttgatctccaccctgccagcgcctggaccctgtacgcagtggctaccacggtcatcaccccgatgctgcggcacaccattgagaactccaccgccaatgtgagcttagccgctatcgccaaccaggcggtggttttaatgggcctggacaagggttggccgatctccaaaatggacctcggtgtgccactgttggccctcgggtgctacagccaggtgaatcccctgacgctgacagccgccgtcttattacttatcacccactacgcgatcatcggccccggcctccaggccaaggccacccgcgaagcccagaagcggacggctgccgggattatgaagaaccccaccgttgacggcatcatgactatagacctggacccggttatctacgactctaagttcgaaaagcagctggggcaagtcatgctcctggtgctgtgcgcggtgcaactgctgctcatgcgcactagctgggccctttgcgaagccctgacgctggccaccggccccatcaccacgctctgggagggctcccccggcaagttctggaacacgaccatcgcagtcagcatggccaacatcttccggggctcctacctcgccggcgccggcctcgccttcagcatcatgaagtccgtggggaccggcaaacgcggcaccgggtcgcagggcgagaccctcggagagaagtggaagaagaagctgaatcagctgagccggaaggagttcgacctctacaagaagtcggggatcacggaggtagaccgcaccgaggccaaggagggactaaagaggggcgagatcacccatcacgctgtctcgcgaggctccgccaagctgcagtggtttgtggagcggaacatggtaataccggaagggcgcgtcatcgacctcggatgcgggcggggcgggtggagctactactgcgccggcttgaagaaggtgacagaggtccgcggttacacgaagggcggccccggccacgaggagcccgtccccatgtccacctacggctggaacatcgtgaaattaatgagcgggaaagacgttttctacctgccgcccgagaagtgcgacactctgctgtgcgacatcggcgagtccagcccctcccccaccgtcgaggaaagccgaacgatccgtgtgttgaagatggtggagccgtggttaaagaacaaccagttctgcatcaaggtccttaacccttatatgcccaccgtgatcgagcacctggagcgcctccagcggaagcacggcggaatgctggtgcgcaaccccctgtccagaaactccacccacgaaatgtactggatctccaacggcaccgggaacatcgttgccagcgtgaacatggtgagccgcctcctgctgaaccgattcacgatgacccatcgccggcctaccattgagaaggacgtcgacctcggagcgggcaccaggcatgtgaacgccgagccggagacgcccaatatggacgtcatcggagagcggatcaagcgcatcaaagaggagcacaacagcacctggcactacgatgatgagaacccttataagacctgggcctaccacggttcctacgaagtcaaagccaccgggagcgcctccagcatgatcaacggtgtggtcaagctgctgactaagccctgggacgtggtgccaatggtgacgcagatggcaatgaccgacaccacgccgttcgggcagcagcgagttttcaaagagaaggttgatacccgcaccccgcggagcatgcccggcacccgtcgggtcatgggcatcacggccgaatggctctggaggaccctagggcggaataagaagccacgcctttgcacccgcgaggagtttaccaagaaagtgcgcacaaacgcggccatgggcgccgtgttcaccgaggagaaccagtgggactccgccaaggccgccgtcgaggacgaggacttctggaagctagtggatcgcgaacgggagctgcacaagctcggtaagtgcggcagctgtgtgtacaacatgatggggaagcgcgagaagaagctcggcgagttcggcaaggccaaggggtcccgggcgatctggtacatgtggttaggcgcccgctacctggagtttgaggccctcgggttcctgaacgaagatcactggttctcgcgggagaattcctacagcggcgtcgagggagagggcctgcacaaactcggctacatcctgcgcgacatctccaagatccccgggggtgccatgtatgcagacgacaccgcggggtgggacacccggatcacggaggacgatctccacaacgaggagaagatcactcagcagatggacccggagcaccgccagctagccaacgccatcttcaagcttacgtatcagaacaaggtggtgaaggtccagcggcccacccccaccggcactgtgatggacatcatatcccgcaaggaccagcggggctccggccaggtagggacctacggcctgaacactttcaccaacatggaagcccagctcatcaggcagatggaaggtgagggggtcctgagcaaggccgacctggagaacccccatctcccggagaagaagatcacacagtggctggaaaccaagggcgtagagcggttaaaaaggatggcgatcagcggcgacgattgcgtcgtcaagcccatcgacgaccggttcgcgaacgccctcctggccctgaacgacatggggaaggtgcgcaaagacatcccccagtggcagcccagcaagggatggcatgactggcagcaggtcccgttctgctcccatcactttcacgagctcatcatgaaggacgggcggaagctagtcgtcccctgccgcccgcaggacgagctcatcggaagggcccgcatcagccagggggcagggtggtccctccgtgagaccgcctgcctgggtaaggcctacgcccaaatgtggagccttatgtacttccaccgccgcgacctccggctggcctccaacgccatctgcagcgccgtgcccgtccactgggtcccgacctcccgcacgacctggtcaatccacgcccaccatcagtggatgaccaccgaggacatgctgacagtgtggaacagagtctggatcgaggacaacccctggatggaggacaagacccccgtgaccacctgggagaacgtgccctacctggggaagcgcgaggaccagtggtgcggtagcctgatcggtctgacttcgcgggccacctgggcgcagaacatcccgaccgcgatccagcaagtccgcagcctcataggcaatgaagagtttctggactacatgccctccatgaaacggttccgcaaggaggaggagagcgagggggctatctggtag

SEQ ID NO: 26028 - RNA, 9873 nt, synthetic construct
  misc_feature 1..9873: note = derived and/or modified CDS sequence (opt11) from DENV-3__FJ639758__SS-prME
  source 1..9873: mol_type = other RNA
accagcctgtgcctcatgatgatcctgcccgcggccctggcgtttcacctcaccagtagggacggtgagccccggatgatcgtagggaaaaacgagcgcggcaagagcctcctgttcaagacggcctccgggatcaacatgtgcaccttgatcgccatggatttaggggagatgtgcgacgataccgtgacctacaagtgcccacacatcacggaggtggagcccgaggacatcgactgctggtgcaacctgaccagcacctgggtgacctacggcacttgcaaccaggccggggagcaccgtcgcgacaagcggagcgtggccctcgcgccccacgtgggcatgggcctggacacccgcacgcaaacctggatgagcgcggagggcgcctggcggcaggtcgagaaagtggagacttgggccctgcgccatccgggcttcaccatactggcgctgttcctggcccattatatcggcacctcgctcacccagaaggtggtgatcttcatcctgctgatgctcgtcacgcccagcatgaccatgcggtgtgtgggggtgggcaaccgtgacttcgtcgagggcctgtccggggccacttgggtggacgtggtcctggagcatggaggctgcgtgaccacgatggccaagaacaagcccacgctcgacatagagctgcagaagaccgaagcaacccagctcgcgacgcttcggaagctatgcatcgagggaaagatcaccaacatcaccactgactcgcgctgccccacgcaaggcgaagccgtgctgccggaagaacaggaccagaactacgtctgcaagcacacctacgtggaccggggatggggcaacgggtgcggcctcttcgggaagggctccctggtgacctgcgctaaattccaatgtttggagcctatcgagggcaaggtcgtgcaatacgagaacctcaagtacaccgtgatcatcacggtacacaccggggaccaacaccaagtgggtaacgagacccagggggttaccgcggagatcacaccccaggcctcaaccaccgaggctatcttgccggagtacggcaccctggggctagaatgctccccgcgcaccggactagattttaacgagatgatattactcactatgaagaataaggcctggatggtgcacaggcagtggttcttcgacctacctctcccgtggaccagcggcgccacgaccgagacgcccacctggaaccgcaaggagttactggtgaccttcaagaacgcccatgccaagaagcaggaagtcgtggtgctggggtcacaggagggcgcgatgcacaccgccctcactggtgcgaccgaaatccaaaatagcggtgggacgtccattttcgccggccacctgaagtgccggctgaaaatggacaagctcgaactcaagggcatgagttacgccatgtgcaccaatacctttgttctgaagaaggaagtgtccgagacccagcacggtaccatactcatcaaggtagagtataagggggaggacgtcccgtgcaagattccctttagcactgaggacgggcaaggcaaggcccacaacggacgtctgataactgccaacccagttgtgaccaagaaggaagaacccgttaacatcgaggccgagccgccattcggggagagcaacatcgtgatcggcatcggtgacaacgccctgaagatcaactggtacaagaagggatccagcatcgggaagatgttcgaagcaaccgcccggggtgcccggcggatggccattctgggcgacaccgcctgggacttcgggtccgtgggtggggtcctcaacagcctgggtaagatggtccaccagatcttcgggtccgcgtacacggccctcttcagcggagtttcctgggtcatgaagatcggcatcggtgtgcttctgacgtggatcggactgaacagtaagaacacctccatgagcttctcctgcattgccatcgggatcatcacattgtatttaggcgccgtggtccaggcagatatggggtgcgtgatcaactggaagggcaaggagctgaagtgcggcagcgggatcttcgtgacgaacgaggtccacacctggaccgagcagtataagttccaggcggattcccccaagcgcctagccacagccatcgcaggagcctgggagaacggggtgtgcggcatcagaagcacaacccgaatggagaacctgctgtggaaacagatcgcgaacgagctcaactacatcctgtgggagaacaacatcaagctgactgtggtcgtgggggacgtgatcggcgtactcgagcagggcaagcgcactttaacaccccagccaatggaattgaagtattcctggaaaacctgggggaaggccaagatcgtcacagccgaaacccaaaattcctccttcatcatcgacggccccaatacgccggagtgcccttcggccagtcgggcttggaacgtgtgggaggtcgaggactacgggttcggcgtgtttaccactaacatctggctcaagttacgcgaggtgtacacccagctgtgcgaccaccggctcatgagcgccgccgttaaggacgagcgcgctgtgcatgccgacatgggttattggatcgagagccagaaaaacggttcctggaaacttgagaaggcaagcctgatcgaagtgaagacctgcacgtggccgaagtcacacaccctctggagcaacggcgtcctcgaatccgacatgatcatccccaagagcctggccggacccatctcccagcacaattaccggccgggctaccacacccagaccgccgggccctggcacctcggcaagctggagctggacttcaattactgcgagggcactaccgtagtgataactgagaactgtggcacccgcggaccctcactccggacgaccaccgtctccgggaagctgatccacgagtggtgctgccgcagctgcaccctgcccccgctccgatacatgggtgaggatgggtgctggtacggcatggagattcgcccgatctccgagaaggaagagaacatggttaaaagcctggtgtccgccggcagcggggaggtcgacaacttcacgatgggtgtgctgtgtcttgccatcctgttcgaggaagtgatgagggggaagttcggcaaaaagcatatgatcgcgggggtctttttcaccttcgtgctgcttctgtccggccagatcacctggcgcgacatggcccacaccctaatcatgatcggctcaaacgccagcgaccgaatggggatgggcgtgacctatctcgcactgatcgcgaccttcaagatacagccattcctggcgctcgggtttttcctgaggaagctgaccagccgggagaacctcctgctgggcgtcgggttagctatggccaccacgctgcagctgccggaggatatcgagcagatggccaacgggatcgcgctcggcctgatggcccttaagttgataacacagttcgaaacctaccagctgtggaccgccctgataagcctcacgtgctccaacactatcttcactttaacggtggcctggcgcaccgccaccctgatcctcgcgggggtcagcctgctcccggtctgccagtccagctccatgcggaaaaccgactggctccccatgacggtggccgccatgggcgtgccgcccctcccgctgtttatattcagtctcaaagacacgctgaagcgcaggtcctggcccctgaatgagggggttatggctgtcggtctcgtaagcatcttggcgtccagcctactccggaacgacgtgcccatggcgggccccctggtggccggcggcctgcttatcgcctgctacgtcattacggggacatccgccgacctgaccgtggagaaggccgccgacgtaacgtgggaggaggaggccgagcagaccggagtaagccacaaccttatgattaccgtggacgacgatgggacgatgcgcatcaaggacgacgaaacggagaatatcctcacggtgcttctgaagaccgccctcctgatcgtctctggcatcttcccgtactccatccccgcgaccctgctcgtgtggcacacctggcagaagcaaacgcagcggtccggcgtgctgtgggacgtacccagtccgcccgagacccagaaggccgagctggaggagggggtgtaccgcatcaagcagcagggcatcttcgggaagacccaggtgggcgtaggggtacagaaggagggcgtgttccataccatgtggcatgtcactcgtggcgcagtgttaacctacaatgggaagcgcctggagcccaactgggcctccgtgaagaaggacctcatcagctacggcggtggctggcggctctcagcccaatggcagaaaggagaggaggtccaggttatcgcggttgaacccgggaagaaccccaagaacttccagacaatgcccggcaccttccagacgaccaccggtgagataggcgcgatcgccttggacttcaagcctgggaccagcggcagccccattatcaaccgcgagggcaaagtcgtcggactgtacggcaacggggtggtcacgaagaatggcgggtacgtgtccggcatcgcccagaccaacgcggagccggacggccctactcccgagctggaggaggagatgttcaagaagcggaacttaaccatcatggacctgcaccccgggagcggtaagactcgcaagtacttgccggcaattgtgcgcgaggcgatcaagcgccggttacgcaccctgatcttggcccccacacgagtcgtagccgccgagatggaggaagccctcaaggggctgcctatacgctaccagaccacggcgaccaagtccgagcacaccggccgggaaatagtcgacctgatgtgtcacgccaccttcacgatgcgcttactgtctcccgttcgggtgcccaactacaacctgattattatggacgaggcgcactttaccgatcccgcctccatagccgcgcgcgggtacatcagcacccgggtgggcatgggcgaagccgccgccatcttcatgactgcgacgccgcccgggactgctgacgccttcccgcagagcaacgctcccatccaggacgaggaacgcgacatccctgagcgcagctggaactccggcaatgagtggatcaccgacttcgccgggaaaaccgtctggttcgtaccttcaatcaaggcgggcaatgacatcgccaactgcctccggaagaacgggaagaaggtgatacagctgagtcgaaagacgttcgataccgagtaccagaagaccaagttaaacgactgggacttcgtcgtgacgacggacatctcagagatgggcgcaaacttcaaagccgaccgggtgatcgacccgcgccggtgcctcaagcctgtcatcctgactgacggccctgagcgcgtgatcctggctgggcccatgcccgtgaccgcagcatccgccgctcagcggcgcggccgggtcgggcgcaacccccagaaggagaacgatcaatatatcttcacaggccaaccactcaacaacgacgaggaccacgcccattggactgaagccaagatgctgctggacaacattaacacgcctgagggcatcatcccggccctattcgagcctgaacgggaaaagtccgccgccatcgacggggagtaccgcttgaagggcgagagtcggaagaccttcgtggagctcatgcgcagaggggacctgcccgtttggctggcgcataaggtggcctctgagggcatcaagtacaccgaccgcaagtggtgctttgacgggcagcggaacaaccagatcctggaggagaacatggacgtggagatctggaccaaggaaggcgagaagaagaagctacgcccccggtggctggacgcccgcacatactccgacccgctggccttgaaggagttcaaggacttcgccgcgggacgaaagagcatcgccctcgacttagtcaccgagatcgggcgagtcccctcccacctcgcgcaccgcacccggaacgccctggacaatctggtgatgctccacacaagcgagcacggcgggaaagcgtaccgccacgccgtcgaggagctgcctgagacgatggagaccctgctcctgctgggcctcatgatcctgctaacagggggcgccatgctgttcctgatcagcggcaaggggatcggcaagacatcaatcgggttaatttgcgtgatcgcctcctccggcatgctctggatggcggagatcccgttgcagtggatcgccagcgcgatcgtgctggagttcttcatgatggttctcctaatcccagagcccgagaagcagcgcacgccccaggataaccagctggcttacgtggtgatcgggatcctcaccctggcggccataatcgcagcgaatgagatgggcctactcgagaccacaaaacgcgacttaggcatgtccaaggagccgggtgtggtgagtccaacgtcctacctggacgtggacctacaccccgctagcgcttggaccctgtacgccgtcgcgaccaccgtgatcacgcccatgctgcggcacaccattgagaacagtaccgccaacgtgagcttagccgccattgctaaccaggccgtcgttctgatgggcctggacaaggggtggccgatttccaagatggacttaggcgtgcctctgctggccctcgggtgttactcacaggtcaaccccctgaccctgacggccgccgtcctcttgctgattacacactacgctattatcgggccgggcctccaggcgaaggccacccgcgaagcccagaagcgtaccgccgccgggatcatgaaaaacccgacggtggacggcatcatgaccatagacttggaccccgtaatctacgactccaagttcgagaagcagttgggtcaggtgatgctcctagtgctgtgcgcggtccagcttcttctgatgcgcaccagctgggccctctgtgaggccctgaccctggccacgggccccatcaccaccttatgggagggttcgccggggaagttttggaacaccactattgcggtgagcatggcgaacattttccggggctcctatctggcaggggccggcctggcttttagcataatgaagtccgtggggacaggcaagcgcggcaccgggagccaaggcgagactctcggtgaaaagtggaagaagaaactgaaccaacttagccggaaagagttcgacctctataagaaatccggcataaccgaagtcgaccgaaccgaagcgaaggaggggctgaagcggggcgaaatcacgcaccacgccgtcagccgcggctccgccaagctgcagtggttcgtggagcggaacatggtcatcccggaggggcgcgtgatcgacctcggctgcgggaggggcgggtggagctactactgcgccggcctgaaaaaggtgacggaggtccggggttacacaaagggcgggcccgggcacgaggaacccgtgccaatgtccacgtatggttggaacatcgtgaagctgatgagcgggaaagacgtcttctacctcccgcccgaaaagtgcgacaccctgctgtgtgacatcggcgaaagctctcccagtcccaccgttgaggagagcaggaccatacgcgtgctgaagatggtcgagccgtggctcaagaacaaccagttctgcatcaaggtgctgaatccctatatgcctacggtggttgagcatctggagcgcctccagagaaagcacggcgggatgctcgtccgcaaccccttgtcccggaacagcacccatgagatgtactggatctctaacgggaccggaaacatcgtcgccagcgtcaacatggtttcgcgcctcctgctgaatcggttcacgatgacccaccgccgaccgaccatcgagaaggacgtggacctcggcgcgggcacccgccacgtcaacgccgagccagagacccccaacatggacgtgatcggggaacggataaagcgcatcaaggaggaacacaacagtacgtggcactacgacgatgagaacccgtacaaaacctgggcatatcacggcagttacgaggtcaaggccaccgggagcgcctccagcatgatcaacggcgtggtgaaactcctgaccaagccctgggatgtcgtgcctatggtgacgcagatggccatgactgacaccacccccttcgggcagcagcgggttttcaaggaaaaggtggacacgcgaacgccgcggagcatgcccggcacccgccgggtcatgggcattaccgccgagtggctttggaggacgctcgggcggaacaagaagccccgactgtgtactcgggaggagttcaccaagaaagtccgcaccaacgcagccatgggagctgtgttcacggaggagaaccagtgggactccgcgaaagctgccgtggaggatgaggacttctggaagctcgtcgaccgcgagcgggagctgcacaagctgggccgctgcgggagctgtgtgtacaacatgatggggaagcgggagaagaagctaggcgagttcggaaaggcaaagggttcccgcgctatctggtacatgtggctgggcgcccggtacctagagttcgaggcccttgggttcctgaacgaggaccactggttcagccgtgaaaactcctacagcggtgtcgagggggagggcctgcacaagctcggctacatcctacgggacatctccaagatccccgggggcgccatgtacgcggacgacaccgcggggtgggacacccgcatcacagaggacgacttacacaatgaggagaagatcacgcagcagatggacccggagcaccggcagcttgccaatgccatctttaagctgacctaccagaataaggtcgtgaaagtgcagaggcccactcccacaggaaccgtcatggatatcatctctcggaaagaccaacgcggctccggccaggtgggcacgtacgggctgaacaccttcacgaacatggaagcccaactcatccggcagatggagggcgagggcgtgctgtcgaaggccgatctggagaacccacgcctcccggagaagaagataacccaatggttggagacaaaaggcgtcgagcgtttaaaacgcatggcgatctccggcgacgactgcgtggtgaagcccatagacgaccggtttgccaatgccctactggccctgaacgacatggggaaagtccgcaaggacatcccccagtggcagcccagcaagggctggcacgactggcagcaggtcccgttctgctcccaccacttccacgagctcatcatgaaagacgggcggaaactggtggtcccctgccgcccacaagacgagcttatcggcagggcccggatcagccagggggcgggctggtccctccgcgagactgcctgcctgggaaaagcctacgcccagatgtggagcctgatgtacttccacaggagggatttaaggctggcttctaacgccatctgttcggccgtgcccgtccactgggtcccaacctctcgcaccacctggagcatccacgcccaccaccagtggatgaccaccgaagatatgctaaccgtgtggaaccgggtgtggatcgaggacaacccctggatggaggacaagacccccgtcactacctgggagaacgtgccctacctcgggaagcgcgaggaccagtggtgcggctcgctgatcgggctgacctcccgggccacgtgggcgcaaaatatccctacagcaatccagcaggtcagatcgctcatcggcaacgaggagttcctggactacatgccctccatgaagcggttccgcaaggaggaggagagcgagggtgccatctggtga

SEQ ID NO: 26029 - RNA, 9873 nt, synthetic construct
  misc_feature 1..9873: note = derived and/or modified CDS sequence (opt11) from DENV-3__FJ639759__SS-prME
  source 1..9873: mol_type = other RNA
acttcactctgcttaatgatgatcttacccgccgccttggcgttccatctcaccagtcgggatggagagcctcggatgattgtggggaagaacgaacggggcaagtcgctgctgttcaagaccgcctccgggatcaacatgtgcacactcattgccatggatctgggggagatgtgcgacgacaccgtgacctacaaatgcccccatatcaccgaggtggagcccgaggatatcgactgctggtgcaacttaacttccacctgggtgacctacgggacgtgcaaccaagccggcgaacaccgccgcgacaagcgttccgtggcattagcgccccacgtgggcatgggacttgatacccgcacccaaacgtggatgagcgccgagggcgcctggaggcaggtcgaaaaggtcgagacgtgggccttgcgccacccgggattcaccatcctcgctctgttcctggcgcactacataggaaccagtctcactcagaaggtggtgatcttcatccttctgatgctcgtaacacccagcatgaccatgcggtgcgtgggggttggcaatcgcgacttcgtcgagggactgtccggggccacatgggttgatgtggtcctggagcatggcgggtgcgtaaccactatggcgaagaacaagcccaccctcgacatcgaactccaaaagaccgaggccacccagctggcgacgctccggaaactgtgcatcgaggggaagatcaccaatattaccaccgacagccgctgcccaacccagggcgaggccgtgctgccagaagagcaggaccagaactacgtttgcaaacacacgtacgtcgatcgggggtggggcaatgggtgcggcctgttcgggaagggcagtctagtgacctgcgccaagttccagtgcttggagcccatcgagggaaaggtcgtacagtatgagaacctcaagtatactgttatcatcacggtgcacaccggagaccaacaccaggtcggcaatgagacccagggggtcaccgccgagataactcctcaggccagcaccaccgaggcgatcctgcccgagtacggcacgctgggcctggagtgctccccgcgcaccggcctcgacttcaacgagatgatcctgttaacgatgaagaacaaggcctggatggtgcaccggcagtggttcttcgacctgcccctgccctggacgagcggcgccacaaccgaaacacccacctggaaccgcaaggagctcctggtgaccttcaagaacgcccacgccaagaagcaggaggtcgtggtactggggtcccaggaaggggcgatgcacactgccctcacgggggccaccgagattcagaacagtggcgggacctccatcttcgccggacatctgaagtgccggctgaaaatggacaagctcgagctaaaagggatgagctatgcgatgtgcaccaacacattcgtcctgaagaaagaggtctccgagacccagcacgggacgattctcatcaaggtggagtataaaggggaagacgtcccttgcaagatccccttcagcaccgaggatggacagggcaaggcacacaacggccgcctgatcaccgcgaaccccgtggtgacaaagaaggaggagccggtcaacatcgaggccgagccacccttcggggagagcaacattgtaatcggcattggggacaacgccctgaagatcaactggtacaaaaaggggtcctcgatagggaagatgttcgaggcgactgctcggggagcccgccggatggccatcctgggcgacacggcctgggacttcggatctgtcggcggggtcctcaacagcctcggcaagatggtacaccagatattcgggtctgcttacacagctttgttcagcggcgtgtcctgggtcatgaagatcggcatcggggtgctcctgacctggatcggcttaaacagcaagaatacctccatgagtttcagttgcatcgccataggtatcatcaccctctacttgggcgccgtggttcaggcagacatgggatgcgtgatcaactggaagggcaaggagttgaagtgcggaagcgggatttttgttactaacgaggtccatacctggaccgagcaatataagttccaagccgactcccccaagcggttagccaccgccatcgccggcgcctgggagaacggggtatgcggcatacgcagcacgacccggatggagaatctgctgtggaagcagatcgcgaacgagctcaactacatactgtgggagaacaacatcaagctgacagtggtcgtgggggataccatcggcgttctagagcagggcaagcgcacgctgacgccccaaccgatggagctgaagtattcctggaagacctgggggaaggctaaaatcgtcactgccgagacccaaaacagctccttcatcatcgacggccccaacacccccgagtgccccagcgcgtcccgggcttggaacgtgtgggaagtcgaggactacgggttcggcgtcttcacgacaaacatctggctcaagctgcgcgaggtgtacacgcagctgtgcgaccatcggctcatgagcgctgccgtgaaagacgagcgagcagtccacgccgacatgggctattggatcgagagtcagaagaacgggtcctggaaactcgagaaagcctccttgatcgaggtgaagacgtgcacctggccgaaatcccacaccctttggagcaacggcgtgctggagagcgacatgataatccccaagagcctggccgggcccatctcccagcacaactaccggccgggctaccacactcagactgccggtccatggcacctcggtaagctagagctggacttcaactactgcgagggcaccaccgtggtaatcaccgagaactgcgggacccgcggccccagcctcagaacgaccacagtgtccgggaagctaatccacgaatggtgttgtcgcagctgcacgctgcccccgctccggtacatgggcgaggacgggtgctggtacgggatggagatccgcccaattagtgagaaggaggagaacatggtcaagagcctggtgagcgccggatccggggaagtggacaatttcaccatgggcgtcctgtgcctcgccatccttttcgaggaggtgatgcgtgggaagttcggcaaaaagcacatgatcgcgggggttctcttcacatttgtcctcctgctatcgggacaaatcacctggcgcgacatggcccacacgttgatcatgatcggtagcaacgcgtccgaccggatggggatgggcgtcacctatcttgccctgatcgcgaccttcaagatccaaccattcctcgccttgggtttcttcctgaggaagctcaccagcagagagaatctgctcctcggcgtgggcctagccatggccacgaccctgcagctccctgaggacatcgaacagatggccaatgggatcgcactgggtctgatggcccttaagctgatcacccagttcgagacgtaccagctgtggactgccctcatctcactaacgtgctccaacacgatcttcaccctgacggtagcgtggcgcaccgccaccctgatcctggcgggggtgagcctgctcccagtctgccagtccagttccatgcgtaagactgactggatacccatgacggtggccgccatgggcgtgcctcccctgccactcttcatctttagccttaaggacaccctgaagcgccgctcctggcctctgaacgagggcgtcatggcggtgggcctcgtttccatcctggcctccagcctactccggaacgacgtccccatggcgggccccttggtggctgggggcctgctcatcgcatgctacgtgatcaccggtacctccgcggacctgaccgtcgaaaaggccgccgacgtgacctgggaagaggaggcagagcagaccggggtaagccacaacctgatgatcaccgtagacgacgacgggaccatgcgcataaaggacgatgaaacggagaacatcctcaccgtgctgctgaagaccgctttgctgatagtatccggcatcttcccctacagcatccccgccaccttgttagtttggcacacttggcagaagcagacccaacggtccggcgtgctgtgggacgtgcccagcccgcccgagacccaaaaggccgaactggaagagggggtctaccgcattaagcaacagggaatattcggtaaaacacaggtgggcgtaggggtccaaaaggagggcgtattccataccatgtggcatgttacccggggcgccgtccttacctacaacgggaagcgtctggagccgaactgggcctcagtgaagaaggacctgataagttacggagggggctggcggctctccgcccagtggcagaagggggaagaggtgcaggtcatcgctgtggagccgggcaaaaaccccaagaacttccagactatgcccggaacgttccagaccaccaccggggagatcggcgcgatcgccctggacttcaaaccaggcactagcggcagccccatcattaaccgcgagggaaagatcgtgggtctctatggcaacggggtcgttaccaagaatggtggttacgtttccggcatcgcccagacgaacgccgagccagacggcccaacgcccgagctggaggaggagatgttcaagaagcgaaatctcacgatcatggacctgcatcccgggtcaggcaagacccgtaagtaccttccggccatcgtcagagaagccatcaagcgccggctccgcaccctaatactggcccccacccgcgtggtggccgccgaaatggaggaggctctcaaggggttacccatccgataccagaccagtgctaccaagtcagagcacacgggccgggagattgtcgacctgatgtgtcacgcaacgttcacgatgcggttgctgtctcccgtgcgggtgccgaactacaatctgatcatcatggatgaggcccacttcaccgatcctgcaagcatcgccgcgcgcggatatatctccacccgggtaggcatgggagaggccgccgccatcttcatgacagcgacgccgcccgggaccgccgacgccttcccgcagagcaacgcacccatccaggacgaggagcgcgatatccccgagcgctcctggaactcgggtaacgagtggatcaccgacttcgccgggaagaccgtatggttcgtgccctcgatcaaggcgggcaacgacatcgcgaactgtctccggaagaacgggaagaaagtcatccagctaagccgcaagacgttcgacacagagtaccaaaagaccaagctgaacgattgggacttcgtcgtgaccacagacatctccgagatgggagccaacttcaaggccgacagagttatcgatccgaggcggtgcctcaagcccgtgatcctgaccgatgggcccgagcgcgtaatcttggctgggcctatgccggtcaccgcggccagcgcggcccagcggcgcggccgggtggggcgtaatccccagaaagagaacgaccagtatatctttaccggccagcccctcaacaacgatgaagatcacgctcactggaccgaggcgaagatgctgctggataacatcaacacgcccgagggaatcatcccggccctattcgaaccagaacgggagaagtcagccgccatagatggtgagtacagattaaagggagagtcacggaaaaccttcgtggagctgatgcgccggggggacttgcccgtctggctggctcacaaggtggcctccgagggtatcaagtataccgaccgcaagtggtgttttgatggtcagcgcaacaaccagatactggaggagaacatggacgttgagatttggaccaaggagggcgaaaagaagaagctccgcccccggtggctggacgcccgcacatacagcgacccgctggccctcaaagagttcaaggacttcgccgcgggccgcaagtccatcgccctggacctggtgaccgagattgggcgtgtgcccacacacctcgctcaccgcactcggaacgccctagataacttagtaatgctccacacgagcgagcacggcggtaaggcctatcgccacgcggtagaggagctgcccgagacaatggagaccctgctcttactgggcctcatgatcttacttaccgggggagccatgttattcctcataagcggcaaggggatcggcaagacgtctatcgggctgatctgcgtgatcgccagctccggtatgctctggatggcggagatcccgcttcaatggatcgccagtgcgatcgtactggagttcttcatgatggttctcctgattcccgagcccgagaagcaacggacgccgcaggacaatcaattggcttacgtggtaatcgggatactcaccctagcagccatcatagccgcgaacgagatgggcctgctcgaaaccacaaagcgtgacctgggcatgtctaaggagcctggggtggtgagccccaccagctacctggatgtcgatctccatcccgccagcgcctggacactgtacgcggtggcgaccacggtgatcacgccaatgctgcgccacacaatcgagaactccaccgccaacgtcagcctcgccgccatcgccaaccaggcggttgtgctgatgggcctggacaagggttggccgatctccaagatggacctcggcgtccccctgttggctctcgggtgctatagccaggtgaatcccctgacgctgaccgctgccgtgttgctattaatcacccattacgccataatcggccccggcttacaggcgaaggccacccgcgaggcccagaagcggacggccgcggggatcatgaaaaacccgaccgtcgacggcatcatgaccatcgacctggaccccgtgatctacgacagtaagttcgagaagcagcttggccaggtgatgctcctcgtcctgtgtgcggtgcagctccttctgatgcgcaccagctgggccctctgcgaggccttaactttggccacaggcccgatcacgaccctctgggagggttcccccgggaagttctggaacacgaccatcgcggtgagcatggccaacatatttcggggctcctaccttgctggggccggcctggcattcagcatcatgaagtcagttgggaccggcaaacgcggcaccggaagccagggcgagaccctcggtgagaagtggaagaaaaagctaaaccagctgtcgcggaaggagttcgacctctataagaagtccggcataacggaggtggaccgcaccgaggcgaaagaggggctcaagcgaggtgaaatcacccaccacgccgtgagccgcgggtctgccaaactgcagtggtttgtcgaaaggaacatggtgattccagaggggagggtgatcgacctcgggtgtgggcgggggggatggagctactactgcgccggcctgaagaaggtcaccgaggtccgcggatacacgaagggcggccccggtcacgaggagccagtgcccatgtcaacttacggctggaacatcgtcaaactgatgagcgggaaggacgtattctacctccctccggaaaaatgcgacaccctgctgtgcgacatcggcgaatctagcccttcccccaccgtggaggaaagccggacgatccgcgtcctgaaaatggtggagccgtggctcaagaacaaccagttctgtatcaaggtactgaatccctacatgcccaccgtcatcgagcatctggaacgcctccagaggaagcacggcgggatgctggtgcgcaaccccctgtctcgcaatagcactcacgagatgtactggatctccaatggtaccggtaatattgtggccagtgtcaacatggtgtcccgcctcctgctgaaccggttcacgatgacgcataggcgcccgaccatcgagaaggacgtggacctcggtgcgggcaccaggcacgtcaacgccgaacccgagacgcccaacatggacgtcataggggagagaatcaaacgcattaaggaggaacacaatagcacctggcactacgacgacgagaacccgtataagacctgggcctaccacggctcctacgaagtaaaggccacagggagcgcctcctctatgatcaacggcgtcgtaaagctgctgacgaaaccctgggatgtcgtgcccatggtgactcagatggcgatgaccgacaccacgcccttcgggcaacagcgcgtcttcaaggaaaaagtcgacacccgcaccccgagatccatgcccggcacccgacgggtgatgggaattactgccgagtggctctggcgcaccttggggcggaacaagaaacccagactgtgcacccgagaggaatttaccaagaaagttcgcacaaacgcggccatgggggcggtattcacggaggagaaccagtgggactctgccaaggccgccgtcgaagatgaggacttctggaaactcgttgacagagagcgggagctgcataagctggggaaatgcggcagctgcgtgtacaacatgatggggaagcgcgagaagaagctaggcgaatttggcaaggccaagggatcccgggcgatttggtacatgtggcttggcgctcgctaccttgaattcgaggccctcgggttcctaaacgaggaccactggttctcacgggagaactcctattccggcgtggaaggggaaggactgcacaagctcggctacatcctgcgcgacatctccaagatccccgggggcgccatgtacgccgacgacaccgcggggtgggatacgcggatcacggaggacgacctgcacaatgaggagaagataacccagcagatggacccggagcatcgccagctagccaacgccatattcaagctgacgtaccaaaacaaggtcgtgaaggtgcagcggcccactccaaccggaacggtgatggatatcatcagccgcaaggaccagcgcggctccggccaggtgggcacctacggcctgaacacctttaccaacatggaagcccagctcatacgccagatggagggcgagggggtgctgagcaaggccgacctggagaacccccatctcccggagaagaagatcacacagtggctggagaccaagggcgttgaaaggcttaagcgcatggcgatctccggcgacgactgcgtggtcaaacccatcgacgaccggttcgccaacgccttgctggccctgaacgacatggggaaggtccgcaaggacattccccagtggcaacccagcaaaggctggcacgattggcagcaggtgccgttctgctcccatcacttccacgagctcatcatgaaggacgggcggaagctggttgtcccctgcaggccccaggacgagctgatcggtcgggcccggatcagccagggggcgggctggtcgctccgggagactgcctgcctgggcaaggcctacgcgcagatgtggtcactgatgtacttccaccgccgcgacctcagattagcgagcaacgctatctgtagcgctgtgccggtacactgggtcccgaccagtcgcacaacttggagcatccatgctcaccaccagtggatgaccaccgaggacatgctgacggtgtggaaccgggtctggattgaggacaacccttggatggaggacaaaacccccgttaccacatgggagaacgtgccttacctcgggaagcgcgaggaccagtggtgcggatcactgatcgggctgacgagtcgggccacttgggcgcagaacatcccgaccgcaatacagcaggtccgcagcctcatcggcaacgaggagttcttagactacatgccctccatgaaaaggttcagaaaggaggaggagagcgagggcgccatctggtga

SEQ ID NO: 26030 - RNA, 9873 nt, synthetic construct
  misc_feature 1..9873: note = derived and/or modified CDS sequence (opt11) from DENV-3__FJ639761__SS-prME
  source 1..9873: mol_type = other RNA
accagcttatgtttaatgatgatactgccggcggccctggccttccacctgacctctcgtgacggagaacctcgtatgatcgtggggaagaatgagcggggtaagagcctgttattcaagaccgccagcgggatcaacatgtgcacattaatcgccatggacctcggagagatgtgcgatgacaccgtaacctataagtgcccccatataacggaggttgagcccgaagacatcgactgctggtgcaaccttacgtctacctgggtgacctacggcacatgcaaccaggccggagagcaccgccgcgacaaaagatcagttgccctcgcaccccacgtagggatgggtctggataccagaacgcaaacctggatgagcgccgagggagcctggcgccaggtggagaaggttgagacgtgggcgctgaggcatccgggcttcacgatactcgccttattcctggcccactacatcggcaccagcctcacccagaaggtggtgatcttcatcttgctgatgctggttacgcctagcatgaccatgcggtgtgtgggggtaggcaaccgcgactttgtcgaggggttatccggcgcgacatgggtggacgtggtcctggagcatggcggttgcgtcaccacgatggccaagaacaaacccaccctggacatcgagctccaaaagaccgaggccacccagctggctaccctccgtaagctgtgtatcgagggtaaaatcaccaacatcaccacagactcgcgctgccctacgcaaggcgaagcggtgctgccggaggagcaggaccagaattacgtttgtaagcatacttacgtagaccggggatggggtaacgggtgcggactcttcggaaaaggctccctggtcacctgtgccaagtttcagtgcttgcaacctatagagggcaaagtcgtccagtacgagaacttgaagtacacggtcatcatcacagtccatacgggggaccagcaccaggttggcaacgagacccagggggtcacggctgagataacgccccaagcttctacgaccgaagctatcctgccagaatacgggacgctggggctcgaatgctccccccgtacgggccttgacttcaacgagatgatcctgttaacgatgaagaacaaggcctggatggtccaccggcagtggttcttcgaccttcctctgccatggacgagcggcgccactaccgaaacgccaacctggaatagaaaggagctccttgtcacgttcaaaaacgctcacgccaagaagcaggaggtggtggtactggggtcccaggagggagccatgcacaccgcgctcacgggcgccaccgaaatccaaaacagtggcgggacatccatcttcgccggacacctgaagtgtagactaaaaatggacaagctcgagcttaagggcatgagctacgccatgtgcacgaacacgtttgtcctaaagaaggaggtcagcgagacgcagcacgggaccatcctcataaaggtggaatacaaaggtgaggacgtcccgtgcaagatcccgttttccacagaggacgggcagggcaaggcgcataacggtcgtctgattacggccaatcctgtggtaaccaagaaggaggagcccgtaaacattgaggccgaaccgccctttggggaaagcaatatcgtgatcggcatcggcgataacgccctgaagattaactggtacaaaaaggggtctagtatcgggaagatgttcgaggcgaccgcaaggggtgctcgccggatggccatcctgggtgacacggcctgggacttcggatcggtcggcggtgtcctcaactcgctgggcaaaatggtgcatcaaatcttcggatccgcttacacggctctattcagcggtgtgtcctgggtaatgaaaatcggcatcggggtgctcctaacctggattgggttgaattccaagaacacgagcatgagtttctcctgtatagcaatcggcatcataacgctgtacctgggcgccgtggtacaggctgacatggggtgcgtgataaactggaagggaaaggagctaaaatgcggctcagggatttttgtgacgaacgaagtccatacctggaccgagcaatacaaattccaagcggactccccgaaacgcctcgccacagcgatcgccggggcgtgggagaacggcgtgtgtggcattcgctcgacaacacggatggagaatctgctctggaagcagattgcgaatgagctcaactatatcctgtgggaaaataacataaagctgaccgtagtcgtcggggacatcatcggcgtgctcgaacagggcaaacgcacgcttaccccccagccgatggagctgaaatactcctggaaaacttggggaaaggccaagatcgtcacagccgagacccaaaactcaagcttcatcatcgacgggcccaacacccccgagtgtccgagcgccagtcgagcgtggaatgtctgggaagtggaagactatggctttggcgtattcacaacaaatatctggctcaagctgcgagaggtgtacacccagctctgcgaccaccggcttatgagcgcagccgtgaaggatgagcgcgctgtccacgctgacatgggctattggatcgaaagccagaaaaacgggtcctggaagctggagaaggcgagcctcatcgaggtgaagacctgcacttggcccaagtcccatactctctggtctaatggcgtgctggaatccgacatgataatccccaagtcactggccgggcccatcagccagcacaactacagaccgggctaccacacccagaccgcggggccctggcacctcggtaagctggagctggattttaactactgcgagggtaccaccgtcgtgatcaccgagaactgcggaacgcggggcccgtcgctccggacaaccaccgtcagcgggaaactgatacacgaatggtgctgcagatcatgtaccctgccgccgttgcgatacatgggcgaggacggatgctggtatggaatggaaattcgaccaatctcggagaaggaggaaaatatggtaaagtctctggtgagtgccggctccggggaagtggataacttcacgatgggagtcctctgcctcgccatcctctttgaggaagtcatgcgggggaagtttggcaagaagcacatgattgcaggtgtgttttttaccttcgtcctgctcctgtccggtcagatcacatggcgcgacatggcgcacaccctgataatgattggcagcaacgcatccgacaggatggggatgggcgtcacgtacctcgcactgatcgccacgttcaaaattcagccgttcctggcgttagggttcttcttgcgcaaacttaccagccgtgaaaacctgctcctgggagttggcctcgccatggcgacgacgttacaattgcccgaagacatcgagcaaatggcaaacgggatcgcgctagggttgatggctctgaagctcatcacccaatttgagacctaccaactctggaccgccttgatcagcctaacctgtagcaacacgatttttaccttgaccgtggcctggcgcacggccacccttatcctagcaggcgtgagcttactaccagtatgccagagtagctccatgcgcaaaaccgactggctccccatgacagtggccgccatgggcgtgccgcccctccccctatttattttctccttgaaggacacactgaagcgccgctcctggcctctgaacgaaggtgtaatggccgtgggcctcgtgagtattctggcgagcagcctcctccgcaacgacgtcccaatggcgggaccccttgtggcagggggcctgttgatcgcatgttacgtgatcaccgggacatccgccgacctgaccgttgagaaggccgctgacgtaacctgggaggaggaggccgaacagaccggtgtgagccataatctcatgatcacagtggacgacgatgggacgatgcgtatcaaggatgacgaaaccgagaacatactcactgtgctacttaagaccgccctcttaatagtgtccggcatattcccctatagtatacccgccaccctgttagtctggcacacctggcagaagcagacgcaacggtccggcgtcctgtgggacgtgccttctccgcccgagacccagaaggctgagctggaagaaggggtctatcgcataaagcagcagggcatcttcggaaagacgcaggtgggagtgggggtccaaaaagagggcgtgttccatacgatgtggcacgtcacacggggcgcagtactcacctacaacggtaagcgactggagccgaactgggcatccgttaagaaggacctaatctcgtacggaggtgggtggcggttatccgcccagtggcagaagggggaggaagttcaggtcatcgccgtcgaaccaggcaaaaaccccaagaatttccagaccatgcctggcacattccagactaccaccggggagatcggagcaatcgccttagacttcaagccggggacgtcaggaagcccaatcatcaacagggaaggcaaggtggtagggctttatggcaacggagtggtgacgaaaaacggcggatatgtctccgggatcgcccagactaatgccgagccagatggccccaccccggaactggaggaggagatgttcaagaagcggaacctcactattatggacttgcaccccgggagcggaaagacaagaaagtacctcccagccatcgtccgagaggcgataaagcgccggctacgcactctgatactggcacccacccgggtggtagccgcggagatggaggaagccctcaaggggctacccattcggtaccagaccactgccacaaagtccgagcacaccggacgggagatcgtggatttaatgtgtcatgccacatttacaatgcgcttgctgtcacccgtgagggtcccgaattacaacttaatcatcatggatgaggcccactttactgaccccgcctccatcgcagcacgcggatacatatccacccgggtggggatgggcgaggccgccgccatctttatgacggcgacgccgcccgggaccgccgacgctttcccgcagtccaacgccccaatacaagacgaggagcgcgacatccccgagcgctcttggaactccggcaacgagtggatcaccgatttcgccgggaagaccgtgtggttcgtccccagcatcaaagctgggaacgacatcgccaactgcctccggaagaacgggaagaaggtgatccagctctctcgcaaaacattcgacaccgagtaccaaaagaccaagcttaacgactgggacttcgtcgtcacaacggacatcagcgagatgggtgccaacttcaaagcagatcgagttatcgacccgcgcagatgcttgaaaccggttatactcacggacggcccggagcgcgtaatattggcaggcccgatgccggtgaccgcggcctccgccgcacaaaggcgcggccgggttgggagaaatccccagaaggagaacgaccagtatatcttcacagggcagcccctcaacaacgacgaggaccacgcgcactggaccgaggcgaagatgctgttagacaatataaacacgccggagggtattattccagccctgttcgagcccgaacgggagaagtccgccgccatcgacggcgagtatagactgaagggcgagtccaggaagaccttcgtcgagctgatgaggcgaggggaccttcccgtctggttagcgcacaaggtcgcaagcgaggggatcaagtataccgacaggaagtggtgctttgacgggcagcggaataatcagatcctggaggaaaacatggacgtggagatctggactaaggagggcgaaaagaagaagctacgtcccagatggttagatgcccgcacttattccgatcctctggccttaaaagaatttaaggattttgccgctggccgtaagagtatcgcgctggacctagtgaccgagatagggcgcgtgcccacccacttggcacatcgtaccaggaacgccctggacaatctggtgatgctccatacgtccgagcacggggggaaggcataccgccacgcggtagaagagctgcccgagaccatggaaacccttttactactggggctaatgatcctgttgaccgggggcgtaatgctgttcctcatcagcggcaaaggtattggcaagacttctattggacttatttgtgtgatcgccagcagcggcatgctttggatggccgaaatcccgttacaatggatcgcatccgccatcgtattggaattcttcatgatggtacttctgattcccgaacctgaaaaacaacggacgccccaggacaaccagctggcgtatgtagtgatcggaatattgacgctagccgccataatcgcggccaacgaaatggggttgctcgagactacgaagcgcgacctgggtatgagcaaggagccaggtgtcgtgtcgccaactagctatctggacgttgacctccatcccgcttccgcctggaccctgtatgctgtagccacgactgtcatcacgcccatgctccggcacaccatcgaaaactccaccgcaaatgtgtccctcgccgccatcgcgaaccaggctgttgtgttaatgggcctagacaaagggtggccgatcagcaaaatggacctcggagtgcctctgctggccctcgggtgctactcccaggtcaacccccttactctgaccgccgcggtgctcctgctgattacgcactacgcaatcatcggacccggcctccaggctaaggcaacgcgcgaagctcagaagcgcaccgccgccgggattatgaaaaacccgaccgtggacgggatcatgacgattgacttagaccccgtcatctacgatagcaagtttgagaagcagctgggccaggttatgctcctggtgctctgtgctgtacagctcctactgatgcgtacttcctgggccttatgtgaggctctgacgctggccactggtcctataaccaccttatgggagggttctcccgggaagttttggaacacgaccatcgccgtgtctatggctaatatcttccggggatcatatctcgcaggggcgggcttggctttcagtatcatgaaatccgttgggacgggcaagcggggtaccgggctgcagggcgaaacgctgggggagaaatggaagaagaagctgaaccaactctccagaaaggagtttgacttgtacaaaaagtcagggatcacggaggtcgataggactgaagccaaagagggactgaagcggggtgaaatcacacaccatgcggtgagccgcgggtccgccaagctccaatggtttgttgagcgaaacatggtcatccccgaaggacgtgtgatcgacttaggttgtgggcggggcggatggtcatactactgtgccgggttgaagaaggtgaccgaggtcaggggctacacgaagggcgggccaggtcacgaggagcctgtaccaatgagtacctacggatggaacatagtgaaactaatgagcggaaaagacgttttctacctaccgcccgaaaagtgtgacaccctgctgtgcgatatcggtgagtccagcccatcccctaccgtggaggagagccgcacgatccgcgtactcaagatggtcgaaccttggcttaagaacaaccagttttgcatcaaggtcctgaacccctacatgcccacggtgattgaacacctcgaacgattacagcggaagcacggggggatgctggtccgcaaccctctctcccgaaactccactcatgagatgtattggatctccaacggtactgggaatatcgtggctagcgtcaacatggtcagtcgcctgctactaaatcggttcaccatgacacaccgccgaccgaccattgagaaagacgtggacctgggcgctggcacccgccacgtaaatgcggaacccgagacacctaacatggacgtcatcggggagcggataaagcgcattaaggaggagcacaacagcacctggcactacgacgacgaaaacccttacaagacatgggcctatcatgggtcttacgaggtgaaagccactgggagtgcctcctcaatgatcaacggcgtcgtgaagttgctgacgaaaccctgggacgtggtccccatggtgacgcaaatggccatgaccgacaccacgcccttcggccagcaacgggtgttcaaggaaaaggtcgacacacgcacgccgaggtccatgcccggcacccgtcgggtcatgggcataacggcggaatggttgtggcgcactctagggcgcaataagaagccccgtttgtgcactagagaggaattcaccaagaaagtgcgtaccaacgccgccatgggcgccgttttcaccgaggagaatcagtgggatagcgccaaagcagccgtcgaggacgaagacttttggaaactggtggaccgcgaacgggagctgcacaagctagggaagtgcggtagttgcgtgtacaacatgatggggaagcgcgaaaagaagctgggcgagttcggcaaagcaaaagggtcgcgggccatctggtatatgtggctgggcgctaggtatctggaattcgaggccctggggttcctgaacgaggaccactggttcagcagagagaactcctacagcggggtggaaggagagggactccacaaattgggctatatcctaagagacatctccaaaattccagggggtgcaatgtatgccgacgacaccgccgggtgggatacccggattacggaggatgatctccataacgaggagaagattacccaacaaatggaccctgaacaccggcagttggcgaacgccatcttcaaattaacctaccaaaataaggtagtgaaggtgcagagacccacgccaaccgggaccgtcatggacatcatttctaggaaggaccagcgggggtcgggtcaggtcgggacttacggcctaaataccttcaccaacatggaggcccagctgatcagacagatggagggcgagggggtccttagcaaggccgacctcgagaatccacacctccctgaaaagaagatcacgcagtggctggaaacaaagggcgttgagcgactgaaacgcatggccatctccggcgacgactgcgtggttaaacctatcgacgaccggttcgcgaatgcgctgctggccttaaatgacatggggaaagtgcgcaaggacatcccccagtggcaacccagcaagggttggcacgattggcagcaggtcccgttctgctcccaccacttccatgagttgataatgaaagatggtcgtaagctagtggtgccttgccgcccccaggacgagctgattggcagagcccgcatcagccagggggccggctggagtctgcgtgaaaccgcatgcctgggcaaggcctatgcgcagatgtggagcctaatgtatttccaccgcagagacttaagattggcctcgaacgcgatatgcagcgcagttcctgtgcattgggtgccaacctcccgcacgacgtggagcatacatgcccaccaccaatggatgacgactgaggatatgctcaccgtatggaacagggtatggatcgaagataacccctggatggaagataagacgcccgtcacgacgtgggaaaacgtcccctacctgggtaagagagaggaccaatggtgtggctcgctgatcgggctcacgagccgggccacatgggctcagaacatcccgaccgcgatacaacaagtccggagcctcatcggcaacgaagagtttctggattacatgccttccatgaaacgcttcaggaaggaggaagagtcagagggcgcaatctggtag

SEQ ID NO: 26031 - RNA, 9873 nt, synthetic construct
  misc_feature 1..9873: note = derived and/or modified CDS sequence (opt11) from DENV-3__FJ639762__SS-prME
  source 1..9873: mol_type = other RNA
acttcactctgtttaatgatgatactgccagccgctcttgcttttcacctcactagccgggacggggaaccccgaatgattgtgggaaagaacgagaggggaaagtctctgctgtttaagacggctagcgggatcaacatgtgcacccttatagccatggacctgggcgagatgtgcgatgacacggtgacctataaatgcccccatatcacggaggttgagcctgaggacattgactgctggtgcaatctgacctcaacctgggttacctacgggacctgcaaccaagcgggcgagcatcgtcgagacaagcggtccgtggctttggcccctcacgtgggcatgggcctggacactcggacccagacctggatgtctgccgagggcgcctggagacaggttgaaaaggtcgagacgtgggccctgcgccaccctgggttcaccatactcgcgctgttcctcgcgcactacatcggcacatccctcacccagaaggttgtgatcttcatcctgctaatgcttgtcacacctagcatgactatgcggtgcgtgggtgtgggcaacagggactttgtagaggggctgtccggggccacctgggtggacgtggttctcgagcacggcggttgcgtgacgacgatggcgaagaacaagcccaccctcgacatagagctgcagaagacagaggccacccaactggcgacacttcgcaaattgtgtatcgagggcaagatcaccaacatcaccacagactcacgctgcccaacgcagggcgaggccgtgttacccgaggaacaggaccagaactacgtgtgcaagcatacctatgtcgacaggggttgggggaatggatgcggcctcttcggtaaggggtccctcgtgacctgcgcgaaattccagtgcctggagcccatcgaagggaaggtcgtgcagtacgagaacttgaagtacaccgtgatcatcactgtccacactggggaccaacatcaggtgggaaatgagacccagggggttactgcggaaatcacgccccaggccagcaccaccgaggcaatcctgccagaatacggcaccctggggctcgagtgctctccgcgcaccggcctggactttaatgagatgatactgctcacgatgaaaaacaaggcctggatggtgcaccggcagtggttctttgaccttccgctcccctggacttccggcgccaccaccgagacgcccacctggaaccgcaaggagctattagtcaccttcaagaatgcacacgccaagaagcaagaagtagtggtccttggcagccaggaaggcgcgatgcatacagccttgactggcgccacagagatacagaacagcggcgggacctctatcttcgccggccaccttaagtgtcggctgaagatggacaagctcgaactaaagggcatgagttacgccatgtgcaccaacacgtttgtactgaagaaggaggtgtcggagacccagcatgggacgatcctcataaaaatcgagtataaaggcgaggacgtaccgtgcaagatccccttcagtaccgaggacggacagggaaaggcgcacaacggccggcttatcacggccaaccccgtagtgaccaagaaagaggagccagtcaatatcgaggccgagccaccattcggagagagcaacatagtcatcggaatcggggacaatgccttgaagatcaactggtataagaagggctccagcatcgggaagatgtttgaggcgaccgcccgtggcgccagacggatggccatcctaggcgacaccgcatgggacttcggcagcgtgggtggggtactcaacagcctgggcaaaatggtccaccagatattcggatccgcgtacactgctttattctccggcgtgagctgggtgatgaagatcggcatcggggtcctcttaacctggataggtctcaacagcaagaacacctccatgtcattctcctgcatcgctatcgggatcatcacactctacctgggcgctgtggtgcaggccgatatggggtgcgtcattaattggaagggcaaggagctgaaatgcggtagcgggatcttcgtgacaaacgaggtccacacctggaccgagcagtacaagttccaggcggactcccccaaacgcctggccaccgcaatcgccggcgcctgggagaatggtgtgtgcggcattcgatccacgacacggatggagaacctgctctggaaacagatcgcgaacgagctcaactacatcctgtgggagaataacataaagctgaccgtagtggtcggcgacatcataggcgtgctcgagcagggcaagcgcaccctgacgccccagccgatggagcttaagtactcatggaagacctgggggaaagcaaagattgtgaccgccgagacccagaacagctcatttatcatcgacggccccaatacgcccgaatgccccagcgcatcccgggcatggaacgtctgggaggtggaagactacgggtttggtgttttcactaccaacatctggctcaaactgcgcgaggtgtacacccagctgtgtgaccaccgcttaatgagcgccgccgtgaaggatgagagagccgttcacgccgacatgggctactggatcgagtcacagaagaatgggtcctggaagctggagaaggcgagcctgattgaggtcaagacctgcacgtggccgaaatcccacacactatggtctaacggcgtgctcgagtcagacatgatcatccccaagagcctggccggacccatctcccagcacaattatcggccgggctaccatacccaaaccgccggcccatggcacctcggtaaactggagctggacttcaactactgcgagggcacgactgtggtaatcaccgaaaactgcgggaccagagggccctcactccggaccaccacggtgtctgggaagctgatccacgaatggtgctgccgcagctgcacactgccaccgctccggtatatgggcgaggacggctgctggtacggtatggagatccgacccatctccgagaaggaggaaaacatggtaaaaagcctggtctccgccggcagcggggaagttgacaacttcacgatgggtgtgctgtgcctagccatcctcttcgaggaggttatgcgggggaagttcggcaaaaagcatatgatcgcggggatatttttcaccttcgtgctgctcctgtccgggcagatcacttggagggacatggcacacaccctcatcatgatcggcagcaacgcgtccgaccgtatggggatgggcgtgacatatctcgccctgatcgcgacctttaagattcagcccttcctggcattagggtttttcctgcgaaagctgaccagcagagagaatctcctgctgggcgtcggcctcgcaatggccacgacgctgcagctgcccgaggacatcgagcagatggccaacgggatcgctctcggcttaatggcgctgaagctcatcacacagtttgaaacctaccaactgtggactgccctgattagcctcacgtgcagcaacacaatcttcacccttaccgtggcctggcgcacggccaccttgatcctcgcgggagtgtccttactgccggtctgtcaatccagctcaatgcggaaaaccgactggttacccatgaccgtggccgcaatgggtgtcccgcccctcccgctgttcatcttctcactcaaagacacgctcaagcgaaggtcctggcccctaaacgagggcgtgatggctgtgggcctcgtcagcatcttggcttcgtccctgttacgaaatgacgtgcccatggcgggaccacttgtggcaggcggcctgctcattgcctgttacgtcatcaccggaacaagtgccgacctgaccgtggagaaggccgcggacgtgacctgggaggaagaggcggagcagaccggcgtcagccacaacctgatgatcactgtcgacgacgacgggacgatgcgcatcaaggacgacgagactgagaacatcctcacggtcttgctgaagactgccctcctgatcgtcagcggcatcttcccgtatagcattccggcgaccctgctcgtgtggcacacctggcaaaaacagacgcaaagaagcggcgtcctctgggacgtcccctcgccgccagagacacagaaggccgagctggaagagggagtgtaccgcatcaagcagcagggcatcttcgggaagacccaggtgggcgtgggggtacagaaagagggagtgttccacaccatgtggcacgtcacgagaggggcggtactcacctacaacgggaagcgcttagaacccaactgggcctcggtgaaaaaggacctgatcagctacggcggcgggtggcgactctctgcccagtggcagaagggagaggaggtccaggtgatcgccgtcgagcccggcaagaaccccaagaacttccagacaatgcccggcaccttccagaccaccacaggggagattggggcgatagcgttagatttcaagcctggcacctccggcagccccatcatcaatcgcgaaggtaagatcgtcggcctgtacggcaatggagtcgtgacgaagaacggcgggtatgtctcaggcatcgcccagaccaacgccgagccggacggccccactcccgagctcgaggaggagatgttcaaaaagcgaaacctcactattatggacctgcaccccgggagcgggaagacgaggaagtacttacctgccatcgttcgagaggcgatcaagaggcggctccgaacgctgatcctggcccccacccgggtggtcgccgcagagatggaagaggccctcaaggggctgcccatccgctatcaaaccacggcgaccaagtctgagcataccggacgggaaatcgtggacttaatgtgccacgccacctttaccatgagactcctgtccccagtgcgggtccccaactacaaccttatcatcatggatgaggcccacttcaccgaccccgcctctatcgccgcgcgcgggtacatcagcacccgggtaggcatgggtgaggccgccgccatctttatgactgcgacgcctcccgggactgccgatgccttcccgcagagtaacgccccgatccaggacgaggaacgcgacatcccggagcgcagttggaactccggcaacgagtggatcaccgacttcgccgggaagaccgtatggtttgtccccagcatcaaggcgggcaatgacatagccaactgcctccgtaagaacgggaagaaggtgatccagctttcccgcaagacgttcgacacagagtatcagaagaccaagttaaacgactgggactttgtggttacgacggacatctcggagatgggcgccaacttcaaggccgaccgggtgattgatccgcgcagatgtttgaagcccgtgatcctcacggacggccccgaacgcgtcatcctggccggacctatgccggtgaccgcagcctcggccgcccagcggcgcggccgtgtggggcggaacccacagaaggagaacgaccaatacatcttcaccgggcagcccctcaacaacgacgaggaccacgcccactggaccgaggcgaagatgctgctggacaacatcaacacgcccgaaggaatcattccggcactgttcgagcccgagcgagagaagtccgccgccattgacggcgagtataggctgaaaggcgagtcacgcaagaccttcgtcgagttgatgcgcagaggggacctccccgtttggctggcgcacaaagttgctagcgaaggcataaagtacaccgaccgcaagtggtgtttcgatgggcagaggaacaaccaaatcctagaagagaacatggacgtcgagatctggaccaaagagggcgagaagaagaagctcaggccccggtggttagacgcccgcacgtactccgatccgctggccctcaaggagttcaaggacttcgccgccggcagaaagagcattgccctggacctggtgaccgagatcgggcgggtaccgacgcatctcgcccaccgaacccggaacgccctagacaaccttgtgatgctccacacctccgaacatggcgggaaagcctacagacacgccgtggaggagttgcccgagaccatggagaccctgctgctgctgggtctcatgatactgctgaccggcggagccatgctttttctgatcagcgggaaggggattggtaagacgagcatcggtcttatctgtgtcatcgcctcctctggcatgttatggatggccgagataccgctccagtggatcgccagtgctatcgttctggagtttttcatgatggttctcctgatcccagagcctgagaaacaacggacgccccaagacaatcaactggcctacgtcgtaataggcatcctcactcttgcagcgataatcgcggcgaacgagatgggcttactcgagaccactaaacgcgacctggggatgtcgaaggaaccgggggtagtttcccccaccagctatctggacgtcgacctccaccccgcctccgcctggaccctgtacgccgtggcgaccacggtcatcacccccatgctgcgacacaccatcgaaaattctacagccaacgtgtccctcgctgccatcgctaaccaggcggtggtcttgatggggctggataagggttggcccatctcaaaaatggatctcggcgtgcccctgctggccttagggtgctactcccaggtgaaccccttgacgctgaccgccgccgtccttcttctcattacccactacgccatcataggcccgggcttgcaggctaaggctacccgagaggcccagaagcgcacagccgcggggataatgaagaacccgaccgtggatggcatcatgaccatcgatttagacccagtgatatacgacagcaagttcgagaagcagctggggcaggtcatgctcctggtgctctgcgcggtgcagctcctgcttatgaggacttcctgggcgctctgcgaggccctgacgctggccaccggcccgatcaccaccctctgggagggcagtcctggaaagttctggaacacgaccatcgctgtatccatggccaacatcttccgaggcagctacctggccggggcgggcttggcattctcaatcatgaagtccgttggaactggcaagcgcggcaccgggtctcagggcgagaccttaggagagaagtggaagaagaagctgaatcagctgagccgtaaggagttcgacctctacaagaagtccggtatcacggaggtggaccgcactgaggcgaaagaaggtttaaagcggggagagatcacccaccacgccgtcagccgcggcagcgccaaattacagtggttcgtggagcggaacatggtaatcccggagggtagagtcatcgacctcggctgcgggcggggcggatggtcctactactgcgcagggctcaaaaaggtgaccgaggtaaggggctatactaagggcggacccggccacgaggaacccgtccccatgtctacctacggctggaacatcgtcaaactgatgagtgggaaggacgtgttttacctacccccagaaaagtgcgacaccctgctgtgtgacatcggcgaaagctcccccagccccaccgtggaggagtccagaacgatccgcgtgctgaagatggtggagccctggctcaagaacaaccagttctgtattaaggtactcaacccatacatgcctaccgttatcgagcacctggagcgtctccaacgaaagcacggcggcatgctggttcgcaaccccctgagtcgcaattccacccacgagatgtactggatctcgaacggcaccggaaatatcgtcgcttcggtgaacatggtttcccgcctcctgcttaaccggttcacgatgacccatagacggcccactatcgagaaggacgtcgacttgggcgcgggcactcgccatgtgaatgccgagcccgagacgcccaacatggatgtgatcggggaacggatcaagcgaattaaagaggagcacaactccacctggcactacgatgatgaaaacccgtataagacctgggcctatcacggcagctacgaggtcaaggccaccgggtccgcctcgtccatgattaatggcgttgtgaagctgctgacgaagccctgggatgtcgtacccatggtcacgcagatggccatgaccgacaccaccccattcgggcagcaacgtgtgttcaaggagaaggtggatacccgcacccctcggagcatgcccggcacacgccgggtgatgggcatcactgctgagtggctctggcgcactctgggtcggaacaagaaacctcgcttatgtaccagagaggagttcaccaagaaagtgcgcacgaacgccgccatgggcgcggtgttcacagaagagaaccaatgggatagcgccaaggccgccgtcgaggatgaggacttctggaagctcgtcgatcgcgagcgggagctgcacaagctgggaaagtgtggctcctgcgtctacaatatgatggggaagcgcgaaaagaagctaggcgagttcggtaaggccaaggggtctcgggcgatctggtatatgtggctgggagccaggtacctcgagttcgaggccctagggtttctgaacgaagatcactggttttcccgggaaaacagctactccggtgtcgagggggaggggctgcacaagttaggttacatcctgcgtgacatcagcaaaatccctgggggcgccatgtacgcagacgacacggctgggtgggacacccggatcacagaagacgacctgcacaatgaggagaaaatcacccaacagatggatccggagcaccgacagttggccaacgccatcttcaagttgacttaccagaacaaggtggtgaaggtgcagcggcccacccccactggcacagttatggacatcatctcgcgcaaggaccagcggggcagcggacaggtgggcacctacggactaaacacctttactaacatggaggcccagctcatacgccagatggagggcgagggcgtcctgtccaaggccgacctcgagaacccccatctcccagagaagaagatcacgcagtggctggagacgaaaggcgtggagcggctgaagcgtatggccataagcggagacgactgcgtggtcaagcccatcgacgatcggtttgccaacgccctcctggctctgaacgacatggggaaggtgcgcaaggacataccacagtggcagcctagcaagggctggcacgattggcaacaggtcccgttttgcagccatcacttccacgagttaattatgaaagacgggcgaaagctggtcgtaccgtgcagaccccaggacgaactgatcggccgggcccgcatttcccagggcgcgggatggagcctccgggagacagcctgcctgggcaaggcgtacgcgcagatgtggtcgctgatgtatttccaccgccgcgacctgcggctggcgagcaacgccatctgctccgccgtgcccgtccactgggtgccgacgagtcgcactacctggtccatccacgcccaccaccaatggatgacaacagaggacatgctgacggtctggaacagggtctggatagaagataacccctggatggaggacaagacgcccgtaaccacctgggaaaacgtcccgtacctcgggaagcgggaggatcagtggtgcggcagcctgatcggtctaaccagccgggccacttgggcccagaacattccgactgctatccagcaggtccgctccctgatcggtaacgaggagttcctggattacatgcccagcatgaagaggttccgcaaggaggaagagtccgagggggccatctggtga

SEQ ID NO: 26032 - RNA, 9873 nt, synthetic construct
  misc_feature 1..9873: note = derived and/or modified CDS sequence (opt11) from DENV-3__FJ639763__SS-prME
  source 1..9873: mol_type = other RNA
accagtctgtgcctcatgatgatcctgcctgcggccctggcgttccacctcacctcgagggacggggagccgcgcatgatcgtggggaagaacgaacggggaaagagcctgctgttcaagacggcctccggcataaacatgtgcaccctaatcgccatggatctgggggagatgtgcgacgacaccgtgacctacaaatgcccccacatcaccgaagtggagcccgaggacatcgactgctggtgtaacctgaccagcacctgggtgacctacgggacgtgcaaccaggcgggggagcaccggcgcgacaagcggtcagtggccttagcgccccatgtgggcatggggctggacacccgcacccaaacctggatgagtgccgagggcgcctggcgccaggtggagaaggtggagacgtgggcccttcgtcacccggggttcaccatcctcgccctgttcctggcccactacatcggcacctccctcacccagaaggccgtaatcttcatactgctgatgctcgtgacgccctcgatgacgatgcggtgtgtgggcgtgggcaaccgtgacttcgtagagggcttgtccggggccacctgggtcgacgtggtgctggagcacggtgggtgcgtcactacgatggccaagaacaagcccaccctcgatatcgagctgcagaaaaccgaggcaacgcagttggcaaccctccggaaactgtgcattgagggcaagatcacaaacatcacgaccgacagccgatgccccacgcaaggcgaggcggtgcttcctgaggagcaagaccagaactacgtgtgcaagcacacatacgtggaccgggggtggggaaacgggtgcgggctcttcggtaagggctcccttgtcacctgcgccaagttccagtgcctggagcccatcgagggaaaggtggtccagtacgagaacctcaagtacaccgtgatcatcacggtgcataccggggaccagcaccaggtcggaaacgagacccagggggtgaccgccgagatcaccccgcaggcgagcaccaccgaggccatcctgcccgaatacggaaccctggggctcgagtgctcgccgcgcaccggactggacttcaacgagatgatcttgctgacgatgaagaataaggcgtggatggtgcaccgacaatggttcttcgacctgcccctgccctggacgtcaggtgccaccaccgagacgcccacatggaaccgcaaagagctcttagttacctttaagaatgcccatgctaagaagcaggaggtggtggtgctagggtcccaagaaggcgctatgcacacggccctcacgggggccaccgagatccagaatagcgggggcacgtccatcttcgccggccacttgaagtgccggctgaagatggacaagttggagctgaagggtatgagctacgcaatgtgcaccaacacgtttgtcctgaaaaaggaggtcagcgagacccagcacgggacgatattgataaaggtggagtacaagggggaggacgtgccgtgcaagatccccttcagcacagaggacgggcagggcaaggcccacaacggccgcctgattacggcgaatcccgttgtgacaaagaaggaggagcccgtgaacatcgaggccgaaccgccatttggggagagcaacatagtcatcggcatcggggataacgccttgaaaatcaactggtacaagaagggcagtagcatcgggaaaatgttcgaggccaccgcccggggtgcccgccggatggccatcctgggggacactgcgtgggacttcggttccgtgggcggagttctcaacagcctgggcaaaatggttcaccagatcttcggttccgcgtacacagccttgttcagcggcgtgtcctgggtgatgaaaattggtatcggtgtactcttgacctggataggcctgaacagcaagaacacctccatgagcttctcctgcatcgccatcgggataattaccctctacctgggcgccgtggtgcaggcggacatggggtgcgtcatcaactggaaaggcaaggagctgaagtgcggctccggtatcttcgtcacgaacgaagtgcacacctggactgagcagtacaagtttcaggcggactcccccaagagactcgcgaccgccatcgccggcgcctgggagaacggcgtctgcggcattcgtagcacgacccggatggagaacctgctgtggaagcagatcgctaacgagctcaactacatcctctgggagaacaacatcaaactgaccgtggttgtcggggacatcattggcgtgctagagcagggcaagcgcaccctgaccccccagcctatggagttaaagtacagttggaagacctggggaaaagccaagatcgtgaccgccgagacacagaatagctccttcatcatagacggcccaaacacgcccgagtgcccgagcgcgtcccgggcctggaacgtctgggaggtggaggactatgggttcggcgtgttcacaaccaacatctggctcaagctgcgcgaggtctacacccagctgtgcgaccaccggctcatgagcgccgccgtgaaggacgagcgcgccgtgcacgcagacatgggctactggatcgagtctcagaaaaacggatcctggaagctggagaaggcctcactgatcgaggtcaaaacctgcacgtggccgaagtcccacaccctctggtctaacggcgttctggagtcagacatgatcattcccaagagcctggccgggcccatcagtcagcacaactacaggccgggctaccacacccagaccgccgggccctggcacctcggcaagctggagttagacttcaactattgcgagggcacgaccgtggtcatcaccgagaactgcgggacgcgcggccccagcttgcggaccaccacggtgtccgggaagctgatccacgagtggtgctgccgcagctgcacgctgcccccgctccggtacatgggcgaggacggatgctggtacggcatggagatcagacccatctccgagaaggaggagaacatggtcaagagcctggtctccgctggcagcggggaggtggacaacttcacaatgggcgtgttatgcctggcgatactattcgaggaggtcatgagaggtaagtttggcaagaagcatatgatcgccggggtgttcttcaccttcgtcctgctcctgtccggccagataacctggcgcgacatggcccacaccctgatcatgatcggcagcaacgcgtcggaccgtatggggatgggcgtcacgtaccttgccctgatcgcgaccttcaagatacagccctttctagccctcggattctttcttcgcaagctgaccagccgtgagaatctcctgctgggcgtaggcctcgccatggcaacgacgctgcagttgcccgaagacatcgagcagatggcgaacgggatcgcacttggcctgatggccctgaaattgataacccagttcgagacctaccagctgtggaccgccctgatcagtctcacgtgcagtaataccatcttcaccttaaccgtggcctggagaacggcgaccctgatactcgccggggtcagcttgctgccagtttgccaatccagctccatgcggaagaccgactggctccccatgaccgtcgccgcaatgggcgtgccgcccctccctctgttcatattcagcttaaaggacacgctaaagaggcgctcctggcccctcaacgaaggcgtaatggccgtcggcctcgtgagcatcctggcgtctagccttcttcggaacgacgtgcccatggcgggtcccctcgtagccggggggctgctcatagcttgttacgtaataactgggacgtccgccgacctgacggtagaaaaggcggccgacgtcacctgggaggaggaagccgaacagaccggggtgagccacaacctaatgatcaccgtggacgacgatggcaccatgcgcatcaaggacgacgagaccgagaacatcttaacggtcctgcttaagaccgccttgcttatcgtgtccggcatcttcccgtactccatccccgccacgctgctcgtttggcatacctggcaaaaacagacgcaacgatccggcgtcctgtgggacgtgccgtctccgccagagacgcagaaagcggagctggaggaaggggtgtaccgcatcaagcagcagggcattttcgggaagacccaggtcggagtgggggtgcaaaaggagggcgtcttccacaccatgtggcacgtgactcgtggcgccgtgctcacctacaatggtaagcgcctggagccgaactgggcgtccgtgaaaaaggacctgatcagctacgggggggggtggcggctctccgcccagtggcagaaaggcgaagaagtccaggtgatcgcggtcgagccgggtaagaaccctaagaacttccagaccatgcccggcaccttccaaactaccaccggggagatcggagccattgccttggatttcaagcccgggaccagcggtagccccataatcaacagggagggtaaggtggtggggctgtatggcaacggggtcgtgacgaagaacggcgggtacgtgtccggcatagcccagactaacgccgaaccagacggccccacccccgaacttgaggaggaaatgttcaaaaagcggaacctcaccattatggacctgcaccccggtagcggcaaaacgcgcaaataccttccggcgatcgtccgggaggctatcaagcgccggctccgtaccctgatcctggcccccacccgggtggtggccgcggagatggaagaagcgttgaaggggctgcccatccgctaccagacgacagccaccaagtccgagcacacaggccgcgagatcgtcgacctgatgtgccacgccaccttcacgatgcgcctactgagccccgtgcgggtcccgaactacaacctgatcatcatggacgaggcccatttcacggaccccgcctccatcgcggcacgcggttatatcagcacacgagttggcatgggggaggccgccgccatcttcatgaccgccacgcctcccgggaccgccgacgccttcccgcagagtaacgcccccatccaggacgaggagcgcgacatcccagagcgcagctggaacagtggcaacgagtggatcaccgacttcgccgggaagaccgtgtggttcgtccccagcatcaaagccgggaacgacattgcaaattgcctccggaaaaacgggaaaaaagtcatccagctgtcccgcaaaacgttcgatacggagtaccagaagaccaaactcaacgactgggattttgtggtgaccacggacatcagcgaaatgggcgctaacttcaaagccgaccgggtaatcgacccgcgccggtgcctcaagccagtgatcttgaccgatggacccgagcgtgttatcctcgcggggccgatgcctgtgaccgccgccagtgctgcccagcggcgcggacgggtagggcggaacccccagaaagagaatgaccagtacatcttcaccggccagcccttaaacaacgacgaggaccacgcgcactggaccgaggccaagatgctgctggacaacatcaacacgcccgaggggatcataccggccctcttcgagccggagcgggagaagtccgccgcgatcgacggcgagtaccgccttaagggcgaatccagaaaaaccttcgttgagctgatgcgccgaggtgacctccccgtctggcttgcccataaggtggcgagcgagggtatcaagtacaccgaccgcaagtggtgcttcgacgggcagcggaacaaccaaatccttgaggagaatatggacgtcgagatctggaccaaggagggcgagaagaagaagctacgcccccgttggctagacgcccggacgtactccgatccgctagccctaaaagagttcaaagactttgcggccggccgcaagagtatcgccttagacttagtgaccgagatcgggcgggtgccctcccacttggctcaccgtacccggaacgccctggacaacttagtcatgctccacaccagcgagcacggcgggaaggcgtacagacacgcagtggaggagttgcccgagacaatggagaccctgctcctgctgggcctcatgatcctgctgaccgggggcgccatgctgttcctgattagcggcaaggggatcggcaagacctccatcgggctgatctgcgtgattgccagctcaggtatgctttggatggccgagatcccattgcagtggattgcgagcgccatcgtcctggagttcttcatgatggtgctcttaattcccgaacccgaaaagcagcggactccccaggacaaccaattagcctacgtggtcatcgggatcctcaccctggccgctatcatcgcggccaacgagatggggctgctggagaccaccaagcgcgacctgggcatgtccaaggaaccgggggtagtttcacccacttcctacttggatgtcgacctgcaccccgcaagcgcctggaccctatacgcggtggcgaccaccgtcatcacgcccatgctgcggcataccatcgagaactccaccgctaacgtcagcctcgctgccatagcgaaccaggcggtggtcctgatggggctggacaaggggtggccgatctccaagatggacctcggcgttcccctgctggcactcgggtgctactcgcaggtgaaccccttgaccctgacggcggcagtgctcctgctgatcacccactacgcgatcatcgggcctggcttgcaggccaaggctacccgtgaggcccagaagcggaccgccgcggggatcatgaagaacccgacggtggatggcattatgaccatcgacctggatcccgtgatatacgactccaagttcgagaagcaacttggccaggtgatgctcctggtcctgtgcgccgtgcaactcctgcttatgcgcactagctgggccctctgcgaggccctgaccttagcgacgggccccataaccaccctctgggagggatccccaggcaagttctggaacaccacgatcgcggtatccatggccaacattttccggggctcttacctggcaggcgccggccttgcgttcagcatcatgaaatccgtcggtaccggcaagcgtggtaccggttcgcagggggaaaccctgggggagaagtggaagaagaagttgaaccagctcagccggaaggagttcgatctctacaaaaagtccggtatcaccgaggttgatcgcacggaggccaaggaggggctgaagcggggagagatcacccaccacgccgtctcacgcggctccgccaagctgcagtggttcgttgagcggaacatggtgataccggagggacgcgttatagacctcggctgcgggcggggcgggtggagctactactgcgccggcctcaagaaggtcaccgaggtgcgcggctataccaagggcgggcccgggcatgaggagcccgtgcccatgtccacttacggttggaacatagtcaagctgatgagcgggaaggacgtgttctatctcccgcccgagaagtgcgacaccctgctatgcgatatcggcgagagtagcccctcccccaccgtcgaggagagccgcaccatccgcgtactaaagatggtcgagccgtggctcaaaaacaaccagttctgcatcaaggtcttgaacccctacatgcccacggtgatcgagcacctggagcggctccaacggaagcacggcgggatgctggtgaggaaccccctatcccggaatagcacccacgagatgtattggatatccaatggcactggaaacattgtggcgagcgttaatatggtgtcacgtctcctgctgaaccggttcaccatgacgcatcgccgtccaaccatcgagaaagacgtggacttgggcgccggcacacgccacgtcaacgccgagcccgagacccccaacatggacgtgatcggtgagcggatcaagcgcatcaaggaggagcacaacagcacgtggcactacgacgatgagaacccgtacaaaacctgggcttaccacggctcctatgaggtgaaggcaaccgggagcgcgtcctccatgatcaacggggtggtgaagctgctaaccaagccctgggacgttgtgcccatggtgacgcagatggccatgacggacaccacccccttcgggcagcagcgtgtcttcaaggagaaggtcgacacgcgaacgccgcggagcatgccaggcacccgccgggtgatgggcatcaccgccgagtggctctggcgcactttaggacggaacaagaagccccgactgtgcacccgggaggagtttaccaagaaggtacgcaccaacgccgcgatgggcgccgtgttcacggaggagaatcagtgggacagcgccaaggccgccgtggaggacgaggatttctggaagctcgttgaccgtgagcgggagttacacaagctggggaagtgcggcagttgcgtatacaacatgatggggaaaagggagaaaaagctcggagagttcggcaaggcgaaggggagtcgggccatatggtacatgtggctgggcgcacgctacctggagttcgaggcccttggtttcctgaacgaggaccattggttcagccgggagaattcctacagcggcgtggaaggggagggcctgcacaagctcggctatatcctgcgcgatatctccaagatccccggcggcgccatgtacgcggacgacaccgccgggtgggacacccggattactgaggacgacttacacaacgaagagaagatcacgcaacagatggaccctgagcatcgccagcttgctaacgccatattcaaactgacctaccaaaacaaggtcgtaaaggtgcagcgtccgaccccgaccggcaccgtcatggacatcatcagccgcaaggaccagagaggctctggccaggtgggcacatatgggcttaacacctttacaaacatggaggcacagctaatccgccagatggagggcgaaggtgtgctgagcaaagcggacctcgagaacccgcacctcccggagaagaagatcacccaatggcttgagactaacggcgtcgagcggctgaagcgcatggccatctccggggacgactgcgtggttaagccgatcgacgatcggttcgccaacgccctcttagccttgaacgacatgggcaaggtccgcaaggatatcccccagtggcagccctcgaagggctggcacgactggcagcaagtcccgttctgctcccaccactttcacgagttgatcatgaaggacggacggaagctggtggtcccctgcagaccccaggacgagctgatcgggcgggcgcgcatcagccagggggccggctggtccctccgggaaacagcctgtctgggcaaagcctatgcgcagatgtggagtctgatgtactttcaccgccgcgacctccggctggcatccaacgccatatgcagcgctgtgcccgtacattgggtgccgacctccaggaccacgtggagcattcacgcccaccaccaatggatgaccactgaggacatgctgaccgtgtggaaccgggtctggatcgaagataacccctggatggaggacaagacgcccgtcaccacctgggagaacgtcccctacctcgggaagcgagaggatcaatggtgcggctcactgatcggactgacttcccgtgcgacgtgggcccagaacatcccaaccgccatccagcaggtccgctctttgatcggcaacgaggagttcctggactacatgccttccatgaagcgattccgcaaggaggaggaaagcgagggggccatctggtaa

SEQ ID NO: 26033 - RNA, 9873 nt, synthetic construct
  misc_feature 1..9873: note = derived and/or modified CDS sequence (opt11) from DENV-3__FJ639765__SS-prME
  source 1..9873: mol_type = other RNA
acctcactttgcctcatgatgatcttgcccgcagcactggcgttccacctcacgtcgcgggacggggaaccccggatgatcgtgggcaagaacgagcggggcaagagcctgctgttcaagaccgccagcgggatcaacatgtgcaccctcatcgctatggacctgggtgagatgtgcgacgacaccgtgacctataagtgtccacatatcacagaggtggagcccgaggacatcgactgctggtgcaacctgaccagcacatgggttacatacgggacatgcaaccaagcgggcgagcaccggcgcgacaaacggagcgtggccctcgcgccccacgtgggcatggggctggacacccgcacccaaacctggatgagcgccgaaggtgcttggcgtcaggtagagaaggtagagacgtgggccctgcgtcaccccggcttcaccatcctcgcattattcctagctcactacatcggcaccagtctcacccagaaagtagtgatcttcatcctgctgatgttagtcacgcccagcatgactatgcggtgcgttggtgtgggcaaccgcgatttcgtcgagggcctgtcgggggccacatgggtggatgttgtcctggagcacggcggctgcgtgaccacgatggccaagaacaagcccaccctcgacatagagttacagaagaccgaggccacccagctggcaacgctccggaagctgtgcatcgaggggaagatcaccaatatcacgaccgatagccgctgccccactcagggcgaggccgtgctgcctgaggagcaggatcagaactacgtctgcaagcacacctacgtggaccgggggtggggcaacggttgcggcctctttggaaagggctccttggtgacctgcgctaagtttcagtgtctggagccgatcgaaggcaaggtcgttcagtatgagaacctgaagtacaccgtcattataacggtacacaccggggaccaacaccaggttggcaacgaaacccagggggtgactgctgagataacgccccaggctagcactaccgaggcgatcctaccggagtacggcaccctggggctcgaatgctccccgagaaccggcctggacttcaacgagatgatattactaacgatgaagaataaagcctggatggtccaccgccaatggttcttcgacctccccctaccctggaccagcggcgcaacgacggaaacaccaacgtggaaccggaaagagttactggtgaccttcaagaacgcccacgctaagaagcaggaggtcgtagtgctggggtcccaggagggcgcgatgcacacagccctcacgggggccaccgaaatccagaactcgggcgggaccagcatttttgcagggcatctgaagtgccggttgaagatggacaagttagaactgaaggggatgagctacgccatgtgcaccaacacgtttgtcctgaagaaggaagtgtccgagacccagcacggcaccatcctcatcaaggtggagtacaagggcgaggacgtcccgtgcaaaatcccctttagtaccgaggatgggcagggtaaggcgcacaacggccgcctaatcacagccaaccctgttgttacaaaaaaggaggagcccgtcaatatcgaggcggagccccccttcggcgagagcaacatcgtgatcggcatcggggacaacgccctgaagatcaactggtacaagaagggatccagcatcggcaaaatgttcgaggcgacagcccggggggcccgtaggatggccatacttggagacaccgcctgggacttcggttcggtgggcggcgtgctcaacagcctgggcaaaatggtgcatcagatcttcggttccgcgtacacggccttgttctctggcgtgtcctgggtcatgaagatcggtatcggggttcttttgacttggatcggcctgaacagcaagaacaccagtatgtcattctcttgcatcgccatcgggatcatcaccctctacctcggcgcagtggtccaagccgacatggggtgcgtcatcaattggaaagggaaggagctgaagtgcggctctgggattttcgtgacgaacgaagtacacacctggaccgaacagtacaaatttcaggccgacagtcccaagcgcctcgccaccgccatcgcgggcgcctgggagaatggcgtgtgtggtatcagaagcacaacgcggatggagaatctgctgtggaagcaaatcgcgaacgagctcaactatatactgtgggagaataacatcaaactgacggtggtcgtgggggacatcatcggcgtcctcgagcagggcaagcgcacactgaccccccagccgatggagcttaaatactcctggaagacatgggggaaggcaaaaatcgtcaccgcagagacccagaacagttccttcatcatcgacggccccaatactcccgaatgcccctcggcttcccgggcgtggaacgtatgggaggtagaagattatgggttcggcgtattcaccacaaatatctggctcaagctgcgcgaggtgtacacccagctgtgtgaccaccggttgatgagcgccgccgtgaaggacgaacgagcagtccatgctgatatgggctactggattgaatctcagaagaatgggagttggaagctggagaaggcgagcctgatcgaggtgaagacctgcacgtggcccaagtcccacaccctttggagtaatggagtgctggagtctgacatgatcatccccaagagcctggccggtcccatcagccagcataactaccggccggggtatcacactcagaccgccgggccttggcacctcggcaagctggaactagactttaactactgcgaaggcacgaccgttgtgatcaccgagaactgcggtaccaggggccccagcctccggacaactaccgtttccggcaagctgatccacgaatggtgctgtcgtagttgcaccctgccccccttacggtacatgggcgaggacggttgctggtacggaatggagatcagacccatctccgagaaggaggagaacatggtcaaaagcctggtgtccgccggcagcggggaggtagacaacttcacgatgggcgtcctgtgcctcgccatactgttcgaggaggtgatgcgggggaagtttggcaagaagcacatgatcgccggggtgttcttcacatttgtcttattgctgagcggccagattacgtggagagatatggcacacacactcatcatgattggatcgaacgcctccgaccgcatggggatgggtgtaacatacctcgccctgatcgccaccttcaagatccagcccttcctggcgttgggtttctttttgcgcaagctgaccagtagagagaacctcctgcttggagttggcctcgccatggccaccacgctgcaactgcccgaggatatcgagcagatggccaatgggatcgcgctcggcctgatggctctgaagctcatcacccagttcgagacctaccagctgtggaccgccctgataagcctcacgtgcagtaacaccatcttcacccttacggtcgcgtggaggacggccacccttatcctcgcgggggtgagcttgctgccggtttgccaatctagctccatgcggaagaccgactggttgcccatgacggtggccgccatgggcgtgccgcccctcccgctgttcatattctcactcaaagatacactgaagcgccgctcatggcccctgaacgagggggtcatggccgtagggctcgtcagcatacttgcttccagcctgctccggaatgacgtccctatggcgggccccctggtggcggggggactgctaatcgcctgctacgtgatcacagggacctccgccgatctgaccgtcgagaaggcagcggacgtgacgtgggaggaggaggcagagcagacgggcgtgagccacaacctgatgatcaccgttgacgacgatgggaccatgcgcatcaaggacgacgaaacagagaacatcctcactgtgctcctgaaaacggccctcctgatcgtgtccggcatcttcccctactccattcccgccaccctgctggtttggcacacctggcagaaacagacgcagcggtccggcgtgctgtgggacgtgccaagcccgccggaaacccagaaggctgagctggaggaaggggtctaccgcatcaagcagcagggcattttcgggaagacccaggtgggcgtgggggtacagaaagagggcgtgttccacacgatgtggcacgtgacccggggcgcggtcctcacctataatggaaagcgcctggagcccaactgggcctccgtgaagaaggacctgatcagctacggcgggggctggagattatccgcccagtggcagaaaggggaggaggtacaggtaatcgcggtggagcccggcaagaaccctaagaacttccagaccatgcccggcaccttccagacaaccaccggggagatcggggcgattgccctggacttcaagcccgggacgagcggcagccccattatcaaccgggagggcaaggtggtcgggctgtacggtaacggggtggtcacgaagaacggcgggtacgtttccggcatcgcccagaccaacgcagagcctgacggacccaccccagaactggaggaggagatgttcaagaagagaaacctcaccattatggacttgcaccccggatcgggcaagacccggaagtatctgccggctatcgtgcgggaagccatcaagcgcagactcagaaccttaattcttgcccccacccgggtagtcgccgccgagatggaggaggcactcaaggggctccccatcagatatcagaccaccgcaactaagtccgagcacaccggccgggagatagtggacttaatgtgccatgccaccttcacgatgcgcttactaagccccgtgcgggttccgaattacaatttaatcatcatggacgaggcccacttcaccgatccagccagcattgcggctcgtgggtacatctccaccagagttggcatgggcgaagccgccgccatcttcatgaccgcaacgccgcccgggaccgcagacgccttcccgcagtccaacgcccccatccaagacgaggagcgcgatatccccgaacgatcttggaactcaggcaatgagtggatcacagatttcgctgggaagaccgtgtggttcgtccccagcatcaaggcggggaacgacattgcgaattgcctccgtaaaaacgggaagaaagtgatccagttatcccgcaaaacgttcgacaccgagtaccagaagaccaaactaaacgactgggatttcgtggttacgacggacattagcgagatgggcgcgaacttcaaggccgaccgggtgatcgatccgcgccgctgcctcaagcccgtgatccttacggacggtcccgagcgcgtcatcctggcgggcccgatgccggtcaccgcagcgagcgcagctcagcgtcggggccgggtgggcagaaatccccagaaagagaacgaccagtacatcttcacgggccagcccctcaataacgacgaggaccacgcccactggactgaggcgaaaatgctgctggacaatattaacacgcccgaagggatcattccggcccttttcgagccggaacgagaaaagagtgccgcgatcgatggcgagtaccgtctgaaaggcgagtccaggaaaaccttcgtagagctaatgcgtcgcggggaccttcccgtgtggttagcgcacaaagtcgcctccgagggcatcaagtacaccgaccgcaagtggtgcttcgacggccagagaaacaaccagatccttgaagagaacatggacgtggagatttggaccaaggagggtgagaagaaaaagctacgtccacggtggctggatgcccgcacctactccgacccgctggcactcaaggagttcaaggacttcgcagctggccgtaaaagcatcgccctggatctggtgaccgagatcgggcgggtccccacccacttggcgcaccgtacccgaaacgccctcgacaatctcgtaatgcttcacacgtcggagcacggcgggaaggcctacagacacgccgtggaggagctgcctgagaccatggagaccctgctcctgctgggcctgatgatattgctgaccggaggcgccatgctgttcctgatctcaggcaagggaatcggcaagacgagcatcggtctgatctgcgtcatcgcctccagcggcatgctctggatggccgaaatcccgctccagtggatcgcctccgcgataattttagagttcttcatgatggtgctcctgatacccgagcccgagaagcagcgaactccccaggacaaccagctggcctacgtggtcatagggatactaaccctagcggctatcatcgccgcaaacgagatgggcctgctcgagacaacgaagcgtgacctggggatgagcaaggaaccgggggttgtgtcccccaccagctaccttgacgtggacttgcaccccgcctcggcctggacattgtatgccgtggcgaccacggtgattacccctatgctgcggcataccatcgagaacagcaccgccaatgtatcccttgcggccatcgccaaccaagctgtggtccttatgggcctggataaggggtggccaatctctaagatggatttaggcgtcccgctgctggccttggggtgctatagtcaggtgaaccctctgacgctgactgccgccgtgctcctgcttattacgcattacgctattattgggcccggtctgcaggcgaaggccacccgcgaggctcagaagcggacggccgcggggataatgaagaacccgaccgtcgatggaatcatgaccatcgacctagacccggtgatctacgattcaaagttcgagaagcaactgggccaggtgatgctcctagtcttatgcgcggtgcagctcttactgatgcgcacctcctgggccctctgcgaggccctgacgctggcaactggccccatcaccaccctctgggagggttccccagggaagttctggaatacaactatcgcggtgtctatggccaacatcttccggggctcatacctggcaggggccggtctggccttctccatcatgaagtccgtcgggaccggcaagcgcggcactggatcccaaggcgagacactcggggagaaatggaagaagaagttaaatcaattaagccggaaagaattcgacttgtacaagaagtccggcatcacggaagtggaccgcaccgaggccaaagaggggctgaagcggggcgagatcacccatcacgccgtgtccagaggcagcgctaagctgcagtggttcgtggagcgcaacatggtgatcccagaggggcgcgtcatcgacctggggtgcggccgcggtgggtggtcctattattgtgccggcctgaagaaggtcaccgaggtccgcggttatacgaaaggagggccagggcacgaggaacccgtacccatgagcacctacggctggaacatcgtcaagctgatgtccgggaaggacgttttttacctgcctcccgagaagtgcgacaccctgctgtgcgacatcggcgagagctcgcccagccccaccgtggaagagtcacgcactattcgtgtcctgaagatggtggagccgtggctcaagaacaaccagttctgtatcaaggtgctgaacccttacatgcccaccgtcatagagcacctcgaacgcttacagaggaaacatggcggtatgctggtgcgcaaccctctgagccggaactcaacccacgagatgtactggatcagcaatggcaccgggaacatagtggcctctgtcaacatggtgagccgtctcctgctgaaccggttcaccatgacccaccgccggcctacgatcgagaaggacgtggacctcggcgcgggcacacgccatgtgaacgccgagcccgaaactcccaatatggacgtgatcggcgagcggatcaagcgcatcaaggaggagcacaactccacctggcattacgacgatgagaacccatacaagacctgggcctatcacgggagctatgaggtgaaagccaccggatccgcaagctcgatgattaacggtgtagtgaagcttctgacgaagccctgggacgtcgtgcccatggtgacccagatggcgatgacggataccacgccctttgggcagcagcgggtctttaaggagaaggtggatacccgaaccccgcggtccatgcccggcacccgtcgcgtgatgggtataacagccgagtggctctggcgcacactgggtcggaacaaaaagccccgactgtgcacccgggaagagttcaccaagaaggtccgcaccaacgccgccatgggcgccgtgttcaccgaggagaatcagtgggacagcgccaaagcggccgtggaggacgaagacttctggaagctagtcgaccgcgaacgggagctgcacaagctggggaagtgtggctcctgcgtgtacaacatgatggggaagcgcgagaagaagcttggcgagttcggcaaggccaagggtagccgggcgatctggtatatgtggctcggggctaggtacctggaattcgaggccttggggtttctgaacgaggaccattggttctcccgggagaacagctactccggcgtggagggtgagggactgcacaaactcggctacatcctgcgcgacatcagcaagatacccgggggcgccatgtatgccgacgacaccgcggggtgggataccaggatcacggaggatgacctgcacaacgaggaaaagattacccagcagatggaccccgagcaccgccaactcgcgaacgccatcttcaaactgacctaccagaataaggtcgtgaaagtgcagcggcccacgcctaccggcaccgtcatggacatcatctcccgcaaagaccagagaggctccggccaggtgggcacctacgggttgaacacattcaccaatatggaggcgcagctgatacgccagatggagggcgagggggtattgtccaaggccgacctcgagaaccctcacctgccggagaaaaagatcacgcagtggctagagaccaagggagtagagcggctgaagcgcatggcgatcagcggggacgactgcgtggtgaagcccatcgacgaccggttcgcgaacgccctcctggccctgaatgacatggggaaggtccggaaagatatcccccagtggcaaccctcgaagggctggcatgactggcagcaggtccccttctgcagccaccacttccacgaactcatcatgaaagacggtcggaagctggtagtcccgtgccgcccccaggacgaactgatcgggcgggcccgcatctcccagggcgcgggctggagcctccgggagaccgcctgcctgggtaaggcatatgcccaaatgtggtccctgatgtactttcaccgccgcgacctcagactggcgagcaacgccatctgctccgccgtgccagtgcactgggttccgactagtcgcacgacctggagtatacacgcccatcaccaatggatgacaaccgaggacatgctgacggtatggaaccgggtgtggattgaggacaacccctggatggaggacaagacccctgtcaccacctgggagaacgtgccctacctaggcaagcgggaggaccaatggtgcggcagcctgatcggtctgacgagccgggccacctgggcgcagaacatcccgaccgcaatccagcaagtccgctccttaattgggaacgaggagttcctggactacatgccaagcatgaagcggttccggaaggaggaggaatccgaaggtgcgatctggtga

SEQ ID NO: 26034 - RNA, 9873 nt, synthetic construct
  misc_feature 1..9873: note = derived and/or modified CDS sequence (opt11) from DENV-3__FJ639766__SS-prME
  source 1..9873: mol_type = other RNA
accagcctgtgcttaatgatgatcctgcccgccgcgctggcgttccacctcacaagtcgtgacggcgagcccagaatgatcgtggggaagaacgagaggggcaagagccttctgtttaagaccgcttccgggatcaacatgtgcacactcatcgccatggatctgggtgagatgtgcgacgatacagtgacatacaagtgtccccacatcacagaggtggagcccgaagacatcgactgctggtgcaaccttaccagtacctgggtgacctacggaacgtgcaaccaggccggcgagcaccgtcgcgacaagcggtcagtcgctcttgcgccacacgtggggatgggcctggacacccgcacccagacatggatgagcgccgagggagcatggaggcaagtggagaaggtagagacgtgggcccttcgccacccgggcttcaccatacttgcgcttttcctagcccactacatcggcaccagcctcacccagaaggtggtgatcttcatcctgctgatgcttgttacacccagcatgaccatgcggtgcgtgggggtggggaaccgcgactttgtcgaaggcctgtccggtgccacatgggtcgacgtagttctggagcacggcgggtgcgtgacaacgatggccaagaacaagcccaccctcgacatagagctgcagaagaccgaagccacccaactggcgactctccggaagctttgcatcgagggaaaaatcaccaacatcaccaccgacagccgctgccctacgcagggcgaggcggtgctgccggaggagcaggatcagaactacgtctgcaagcacacctacgtggaccgggggtggggcaacggatgcggcctcttcgggaagggctccctggttacctgtgccaagttccagtgcctggagcccatcgagggcaaggtcgtgcagtacgaaaacctaaagtacacggtgataatcacggtccacaccggggatcagcaccaagtcggcaacgagacccagggggtcactgccgagatcacgccgcaggccagcacaactgaggctatcttacccgagtacggaaccctgggtctcgagtgctccccgcgtaccggacttgatttcaacgagatgattctgctcacgatgaagaacaaggcctggatggtgcatagacaatggttcttcgacctgcccctgccttggacatctggcgccaccactgagacccccacctggaaccgcaaggagctcctggtaacgttcaaaaacgcccacgctaagaaacaagaggttgtggtcctggggtcacaggagggcgcaatgcacaccgctctcacgggggccactgagatacaaaacagcggcgggacctcgatcttcgccggccacctaaagtgccggcttaagatggataagcttgagctgaagggcatgagctacgccatgtgcaccaacacgttcgtcctgaagaaggaggtgtcggagacccagcacgggaccattctcatcaaggtggagtacaagggcgaagacgtcccatgcaagatccccttctcgactgaggacggtcaaggcaaggcgcacaatggtcgcctgatcactgccaatcccgttgtgaccaagaaggaggagcccgtcaacatcgaggccgaaccgccattcggcgagagcaatatcgttatcggcatcggcgacaacgccctgaagatcaactggtacaagaagggttccagcatcgggaagatgttcgaggcgaccgcccggggagcccgtcggatggctatcttgggcgacaccgcatgggacttcggctccgtcggcggggtactcaacagcctgggcaaaatggtgcatcaaatattcgggtccgcgtacactgcgctcttcagcggggtgtcctgggtcatgaagatcggcattggtgtgctgttgacatggattggcctgaactcaaagaacacctccatgagcttctcctgcatagctatcggcatcatcacactctacctgggcgccgtggtacaggccgacatggggtgcgtgatcaactggaaaggcaaggagctgaaatgcggaagcgggatcttcgtgacgaacgaagtccacacctggacagagcagtacaagttccaggccgactcccccaagcgcttggccaccgccattgccggcgcatgggagaacggggtgtgcggaatccgcagcacaacccggatggaaaacctgctgtggaagcagatcgccaacgaactcaattacatcctgtgggagaataacatcaagctgaccgttgtcgtgggggacattatcggggtgctcgagcagggcaagcgcaccctaactccccagccgatggagctgaagtactcctggaagacttgggggaaggccaagattgtaaccgccgaaacgcagaacagctccttcatcatcgacggcccgaacacgcccgagtgcccaagcgcctccagagcgtggaatgtgtgggaagtggaggactacggattcggcgttttcacgaccaacatctggctcaagctgcgagaggtgtacacccaactctgcgaccaccgtcttatgtcggcggcagtgaaggacgaacgcgcggtccatgcggacatggggtactggatcgagtctcagaagaacggatcatggaaactcgagaaggcgagtctgatcgaggtgaagacctgcacgtggccgaagtcccacacgctctggagcaacggcgtcctggaatcggacatgatcatccccaagagcctggccggacccatatcccagcataactacagacctggctatcacacccagactgccgggccctggcacctcggcaagctggagctggacttcaattactgcgaggggacgaccgtcgtgattaccgagaactgcggcacccgcggccccagccttcgcacgaccactgtatccgggaagctcattcacgagtggtgctgccgcagctgcaccttaccccctttacgctacatgggcgaggacgggtgctggtacggcatggagatccgccccatcagtgagaaggaggagaacatggtcaaatccctggtgtccgctggcagcggggaggtagacaacttcacgatgggggtcctgtgcctcgcaatcttgttcgaggaggtgatgcgggggaagttcggcaagaaacatatgatcgccggggtgttcttcaccttcgtcctgctcctgtccggccagatcacctggcgcgacatggcccacacattaatcatgatcggctctaacgcatccgaccggatggggatgggtgtaacgtacttggccctgattgccaccttcaagatccagccctttctggcgctcggatttttcctgcgcaagctgacgagccgagagaatttactgttgggtgtgggcctcgccatggcgaccacgctgcagttgcccgaggacatcgagcagatggctaacggcatcgcgctcggcctgatggcactgaagcttataacccagttcgagacctaccagctgtggaccgcccttatcagcctcacgtgctccaacaccatcttcaccctgaccgtcgcttggcgcacggccacactgattctcgcgggtgtgtccctgctgccggtctgccagtccagctccatgcggaagaccgactggctccccatgaccgtggctgctatgggcgtcccgcccctccctttgttcatattcaacctcaaggacacgttgaagcgccgcagctggcccctgaacgagggggtcatggccgtgggcctcgtgtccatcctggcgagctccttgctccggaacgacgtccccatggcgggccccctggtggcagggggcctgctcatcgcatgctatgtgatcaccgggacctctgccgacctcacagtcgagaaggccgcagacgtgacgtgggaagaggaggccgagcagaccggcgtgtcccacaacctgatgatcaccgtcgacgacgacgggaccatgcgcatcaaagatgacgaaaccgagaatatcctcacggtgctactgaagacggcattactgatcgtgagcggcatcttcccgtactcaattcccgcaaccctcctcgtgtggcatacctggcaaaaacagacgcagcggtcaggtgtgctgtgggacgtccccagcccgcccgagacccagaaggccgagttggaggagggggtctatcggattaaacagcagggcatcttcggcaagacccaggtgggcgtaggggtccagaaggagggcgtgttccataccatgtggcatgtcacgcggggggcggtcctcacctataacgggaagagattggagcccaactgggcctcagtgaaaaaagacctgatctcctatggaggaggctggcgcttaagcgctcagtggcaaaagggggaggaggtgcaagtcattgccgtggagcccggcaagaaccccaaaaatttccagactatgcccggcacctttcagacgaccacaggggagatcggtgcgatagccttggacttcaagcctgggaccagtggcagccccatcattaaccgcgaggggaaggtggtcggtctgtatggaaacggggtggtgacgaagaacggcggatacgtgtcaggcatcgcacagaccaacgccgagcccgatggccccacccccgagcttgaggaggagatgttcaagaagcggaacttaaccataatggacctgcaccccggctccggtaagacgcgcaagtacctgccggccattgtgcgggaggcgattaagcggcggctccgcaccctgatcctagcccctacacgggtggtcgccgccgagatggaagaggccctcaaggggttgccaatccgctaccagaccactgcgaccaaaagcgagcacaccggccgggaaattgtggacctaatgtgccatgctaccttcacgatgcgcctcctgagccccgtgcgggttccgaactacaacctgatcatcatggacgaggcccacttcaccgatcccgcgagcatcgccgcgagagggtacatctccacccgtgtgggcatgggcgaggcagccgccattttcatgaccgccacgccgcccgggaccgcggacgccttcccgcagagcaacgccccgatacaagacgaggagcgcgacatccctgagcgctcctggaacagcggcaacgaatggatcaccgactttgcaggtaagaccgtatggttcgtcccatccattaaggcgggcaatgacatagccaactgcctccggaagaacgggaagaaagtgatccaactgagccgcaagacgttcgacaccgaataccagaagacaaagttaaacgactgggattttgtggtaacaacggacatctccgagatgggcgccaacttcaaggcagaccgcgtaatagacccgcgccgctgcctcaagcccgtaatcctgacagacggacccgagcgagtgattctggccgggcccatgccggtcacggcggccagcgccgcccagaggcgtggcagggtggggcgcaacccccagaaagaaaacgatcagtacatcttcacaggccagcccctcaacaacgacgaagaccatgcccactggaccgaggcgaagatgctgctggacaatattaacacgcccgaaggcatcatcccggcgctgttcgagcccgagcgggagaagagtgccgccatcgacggcgagtaccgcctgaagggtgagagccggaaaaccttcgtggaactgatgcgacgcggggacctccctgtgtggctggcgcacaaggtggcatccgaggggattaagtacaccgaccgtaagtggtgcttcgacggacaacggaacaaccagatcctagaggaaaacatggatgtggagatctggaccaaggagggcgagaaaaagaagctccgccctcggtggctagatgcgcggacgtactcagacccgctggccctcaaggagttcaaagacttcgccgcgggacgcaagtccatcgccctggacttagtgacagagattggccgtgttcccacccatctcgcccaccgcacacggaacgccctggataacctggtgatgctccacacgagcgagcacggcggtaaagcttaccgccacgctgtggaggagctgcccgagacaatggagacactgcttctactgggcttgatgatattacttacagggggcgccatgctgttcctgatatctggaaaggggatcggcaagacgtctatcgggctgatctgcgtcatagcctctagtggcatgctatggatggccgagatcccgctgcagtggatcgccagcgctatcgtgctggaattcttcatgatggtcctccttatcccggagcccgagaagcagcggactccccaggataaccagcttgcctatgtcgtcatcgggatcctcaccttggcagcgatcatagccgcgaatgagatgggtctgctcgagaccacgaagcgagacctgggcatgtccaaggagcccggggtggtcagccccacgtcctatctcgacgtggacttgcaccccgcgtccgcctggaccctgtacgccgtggcgaccacggtaattacaccgatgctccggcatacaatagagaattccactgccaacgtgagcctcgccgccatagcgaaccaggctgtggtcctgatgggcctcgataaagggtggcccatctccaagatggacctcggtgtaccgctgctggccctcgggtgctacagccaggtcaatcccttaacgctgaccgctgccgtcctcttgctgattacccactatgcgatcatcggccccgggctccaggctaaagcaacacgcgaggcccagaaacggacggcagccgggatcatgaaaaacccaaccgtagacggcatcatgaccatcgacctggaccccgtgatctacgactctaagttcgaaaagcaactggggcaggtcatgctcttggtgctgtgcgcagtgcagttgctgctgatgcgcaccagctgggcgttatgcgaggctctgacgctggccactggaccaatcaccaccctctgggagggctcccccgggaaattttggaacacgaccatcgcggttagtatggcgaatatctttaggggctcctacctggccggtgccggcctggctttcagcatcatgaagtccgttggcactggcaagcgcggaacagggagccagggcgagacgttaggggagaagtggaaaaagaagctcaaccaattatcccggaaggagttcgacctctacaagaagtccggcatcacggaggtggaccgcaccgaagcgaaggaagggttaaaaagaggcgagatcacacaccacgccgtgagccgcggctctgcaaagttacagtggttcgtggagcggaacatggtcatcccggagggccgcgttatcgacttaggctgcggccggggggggtggagctactactgtgccggtctgaagaaggttaccgaggtgcgcggctacacgaagggaggaccaggacacgaagagcccgtccccatgtccacatatgggtggaacatcgtgaagttgatgagcgggaaagacgtgttctacctcccgcccgagaaatgcgacacactgctgtgcgacatcggcgagtccagtccctccccgaccgtcgaggaatcgcggacgattcgcgtgctgaagatggtggagccgtggttgaagaacaaccagttctgcatcaaggtcctgaacccctacatgcctaccgtgatcgagcacctggaacgcctccagcggaagcacggcgggatgctggtacgcaaccccctgtcccggaatagcacacacgagatgtactggatctccaacggcaccgggaatatagtcgccagtgtgaacatggtgtcccgcctactactgaaccgattcacgatgacacaccgccggccgaccattgaaaaggacgtcgacctcggagcgggcacccgtcacgtgaacgccgagcccgaaacgcccaacatggacgttatcggtgagcggatcaagcgcatcaaagaagagcataatagcacctggcactatgacgacgagaatccgtacaagacatgggcgtatcacggctcctacgaggtcaaggccacggggtcggcctccagtatgatcaacggcgtggtgaagctgctaacgaagccctgggacgttgtgcccatggtcacccagatggcgatgaccgacaccacgcccttcgggcagcaacgagttttcaaggagaaggtggacacccgcaccccgcggtccatgccaggcacccgccgggtcatgggcatcacggcagagtggctgtggcgcaccctggggcggaacaagaaaccccgcctgtgcaccagagaagagttcaccaagaaggtgcgcacgaacgcggccatgggggcggtttttaccgaggagaaccagtgggacagtgcaaaggccgctgtagaggacgaggacttttggaaactcgtggatagggagcgggagctgcacaagctagggaagtgtggcagttgcgtgtacaacatgatgggaaagcgcgaaaagaagctcggcgagttcggcaaggcaaaggggtcccgggcaatatggtacatgtggctgggcgcccgctatctggaattcgaggccctcgggttcctgaacgaagaccactggttcagcagagaaaactcctacagcggcgtcgagggggagggcctgcacaaactcgggtacatcctgcgcgacatatccaagatccccgggggcgcaatgtacgccgacgacaccgctgggtgggacaccagaatcacggaggacgacctgcacaacgaggagaagatcacccaacaaatggacccggagcatcgccagctcgccaacgccatcttcaaattaacataccagaataaggtggtcaaagtacagagacccacccccaccggaaccgtgatggacatcatcagtcgcaaggaccagcgaggctccggtcaggtgggaacctacggtctgaacacattcaccaacatggaggcacaactcattcgccagatggagggggagggggtcctgagcaaggcagatctggagaacccgcacctcccggagaagaagatcactcaatggctggagacgaagggtgtggagagattaaaacgcatggcgatctccggggacgattgcgtggtgaagcccatcgacgaccggttcgccaacgccctcctggcactgaacgatatggggaaagtgcgcaaggacatcccccagtggcagcccagcaagggatggcacgattggcagcaggtcccgttctgttcccaccacttccacgagctcatcatgaaagacgggagaaagctggttgtcccctgccgcccccaggatgagttgataggccgggcgcgcatcagccagggggccggctggtctctccgggagaccgcctgcctgggcaaggcatatgcccaaatgtggagcctgatgtacttccaccgacgcgacctccggctggcctcgaacgccatttgtagcgcagtgcccgtgcactgggttcccacctcccgcacgacctggtcgatacatgcccaccaccagtggatgaccacggaagacatgctgacggtgtggaacagggtctggatcgaggataacccctggatggaggacaaaacccctgtaaccacctgggagaatgtgccctacctcgggaagagggaggatcaatggtgcggatccctgattgggctcaccagcagggctacctgggcgcaaaatatcccgaccgccatccagcaggtccgtagcctcatcggcaacgaggagtttctggactatatgccctccatgaagcggttccgaaaggaggaggagtcagagggggccatctggtga

SEQ ID NO: 26035 - RNA, 9873 nt, synthetic construct
  misc_feature 1..9873: note = derived and/or modified CDS sequence (opt11) from DENV-3__FJ639767__SS-prME
  source 1..9873: mol_type = other RNA
accagcctgtgcctcatgatgatcctgcccgccgctttagcgtttcacctcaccagccgggacggggagccccggatgatcgtgggcaagaacgaacgcggtaagtcgctgctgtttaagacggcttctggaatcaacatgtgcactctcatcgcgatggacctgggcgagatgtgcgacgacacagtgacctacaagtgtccccatatcacggaggtggagcccgaagacatcgactgctggtgcaacctgacgagcacctgggtaacatacggaacgtgcaaccaggcgggcgaacaccggagggataaacgttctgtcgccctcgcgccccacgtgggcatggggctggacacccggacacagacctggatgagcgccgaaggtgcctggcgccaggtggagaaggtcgagacgtgggcgctgcgccatccgggcttcaccattctcgcgctgtttcttgcccattacatcggcaccagcctaacgcagaaggtggtgatcttcatcctgctgatgttagtcaccccctccatgacaatgcggtgcgtcggggtgggcaatagggatttcgtagagggactgagtggggccacctgggtggacgtggtcctggagcatggcggctgcgtgaccacgatggccaagaacaagcccactctggatatcgagctgcagaagaccgaggccacccagctggcgacgctgcggaaactttgcatcgagggcaagattaccaacataactaccgacagtcgctgccccacacaaggcgaggccgtgctgccggaggagcaggatcagaactatgtttgcaagcacacctacgtggaccgggggtggggcaacggttgcggcttgtttggaaaaggctcactggttacctgcgccaaattccaatgcctggagcccatcgagggcaaggtcgtgcaatacgagaacctcaagtacacagtgataatcacggtgcacaccggtgatcagcaccaagtgggaaacgaaactcagggcgtaactgccgagatcaccccgcaggccagcacaaccgaggctatactgcccgaatatggaaccctggggttagaatgcagcccccgcaccggcctcgatttcaatgagatgatcctgctcacgatgaagaacaaggcctggatggttcaccgccagtggttcttcgacctgcccttgccctggactagcggcgccaccactgagacgcccacctggaaccggaaggagttactggtgacgttcaagaacgcccacgcaaagaaacaggaggtagtggtcctggggtcccaggagggcgcaatgcacactgccttaacaggggccaccgagatccagaacagcggcgggacctctatcttcgcaggccacctaaagtgccggctgaagatggacaagctcgagcttaagggcatgtcttacgccatgtgcaccaacacgtttgtactaaagaaggaggtgtccgaaacccagcacgggaccatcctcatcaaggtggagtataaaggcgaagacgtcccgtgcaagatccccttcagcaccgaagatgggcagggcaaggcgcataacggacgcttgatcacggccaaccccgtggtgaccaagaaggaggaacccgttaacatcgaggcagagccgccattcggggaaagtaatatcgtgatcggaatcggcgacaacgctctgaaaatcaactggtacaagaagggctccagcatagggaagatgtttgaagcgaccgcccgaggcgcccgccggatggcaatactgggcgacaccgcctgggacttcgggtccgtaggaggggtcctcaatagcctgggcaaaatggttcaccagatattcgggtccgcatacacggcactcttcagcggcgtgtcctgggtgatgaagatcggtattggggtgctcctcacctggatcggccttaatagcaagaatacctctatgagcttctcttgcatcgcgatcgggatcattaccttatacctgggggccgtggtccaggctgacatgggctgcgtgatcaattggaagggcaaagagttgaagtgcggcagtggaatcttcgtgacgaacgaagtacacacgtggaccgagcagtataagttccaggcggacagccccaaacgcctcgccaccgcaatcgccggcgcctgggagaacggggtgtgtggaatccgcagcacaacccggatggagaacctgctatggaagcagatcgcgaacgagctcaattacatcctgtgggagaacaatatcaagctgactgtggtcgtcggggacatcatcggcgtgctcgaacagggcaagcgtaccctcacaccccagccgatggagctgaagtactcctggaaaacatggggcaaggccaagatcgtcaccgctgaaacacagaacagctcttttatcatcgacgggcccaacacgcccgagtgccccagcgcatccagagcgtggaacgtgtgggaggtggaagactatggcttcggcgtcttcaccacgaacatctggctcaaactccgcgaggtctacacgcaattatgcgaccaccgtctcatgagcgccgccgtgaaggacgagcgtgccgtccacgccgacatgggatactggatagaatcgcagaagaacggctcatggaagctggagaaggcaagtctgattgaggttaagacttgcacgtggccgaaatcccacaccctctggagcaacggcgtgctggagtccgacatgataattcccaagagcctcgcgggccccatatcccagcacaactaccggccgggctaccacacgcagaccgccgggccctggcacctcggaaagttggagctggactttaactattgcgagggaacgacggttgtgatcaccgagaactgcggtacccggggccccagcctccggactaccaccgtgtccgggaaactgatccatgagtggtgctgccggagctgcacgctgccgccactccgatacatgggcgaagacggatgctggtatggtatggaaatacgccccatttccgagaaggaggaaaacatggtcaagagcctagtgtccgccggctcgggggaggtggacaacttcacgatgggcgtcctgtgcctcgctatcctcttcgaagaggtgatgagagggaagttcggcaagaagcacatgatagcgggggtgttcttcaccttcgtcctgctcctgtccggtcagatcacctggcgcgacatggcccacactctgataatgatcggatcaaacgcctccgacagaatgggcatgggcgtgacgtacctcgccttgatcgccacgttcaagatccagcctttcctcgcgctcgggttcttcctgcgcaagttaaccagccgggagaatctcctgctgggcgtgggcctcgccatggccaccacgctgcagctgcccgaggatatcgagcagatggccaacgggatcgcgctagggctgatggccctgaaactcatcacccagtttgagacctaccaactgtggaccgccctgataagcctcacgtgctccaacaccatcttcaccttgaccgtcgcctggcgcaccgccaccttgatcctcgcgggagtgagcctcctgccggtctgtcagtccagctccatgcggaagacggactggctccccatgacggtggccgccatgggcgtgccgcccctccccctgttcatcttcagcctcaaggacacgctaaagagacgctcctggcccctaaacgaaggggtcatggccgtgggtctcgttagcatactagcctcctcgctgctccgaaacgacgttcccatggcgggccccctcgtggcagggggacttctcatcgcctgctatgtgatcaccgggacctccgccgacctcactgttgagaaagccgcagacgtgacttgggaggaggaggccgaacaaaccggagtgagccacaatctaatgatcaccgtcgacgacgacgggaccatgcgcatcaaggacgacgaaacggagaacatcctcacggtgctgttaaagacggccctcctgattgtgtccgggatcttcccgtacagcattcccgcaaccctgctcgtatggcatacttggcagaagcagacgcagcggtccggcgtgttgtgggacgtgccaagcccgcccgagacccagaaggcagagctggaagagggcgtctaccgcatcaaacagcagggcatcttcgggaaaacccaggtgggcgtgggggtccagaaggagggcgtgttccacaccatgtggcacgtgacgcggggagcggtgctcacctacaacgggaagcgcctagaacccaactgggcttcagtgaagaaagacctgatcagctacggagggggatggcggctttccgcccagtggcagaagggggaagaggtgcaagtgattgccgtagagccaggcaagaaccccaaaaacttccaaaccatgcccggcaccttccagactaccaccggggagatcggggcgatcgcactggacttcaagcccgggacctctggcagccccatcatcaatagagagggtaaggtggtcgggctgtacggcaacggagtcgtaacgaagaatggcggctacgtgtccggcatcgcccagaccaacgccgagccggatggccctacccccgagctggaggaggagatgtttaagaagcggaacctcaccatcatggacctccaccccggcagcggcaagacgagaaaatacctgccggcgatcgtgcgggaggctattaagcgccggctccgcaccctgatcctggcccccacccgggtggtcgcagccgaaatggaggaggcccttaaggggctgcccatccgatatcaaaccacggcgaccaaatcagagcacaccggccgggagatcgtggacctgatgtgccacgccaccttcacgatgcgcctgctcagccccgtgcgggtcccgaactacaacctgataatcatggacgaggcccacttcactgaccccgcttccatcgccgcccgggggtacatcagcacccgggttggcatgggcgaggccgccgccatcttcatgaccgcgactcctcccgggactgcagacgccttcccgcagtcgaatgctcccatccaggacgaggagcgcgacatcccagagcgcagctggaacagtggcaacgagtggatcaccgactttgccgggaagaccgtgtggtttgtccctagcatcaaggcgggcaatgacatcgcaaactgcctccggaagaacggtaagaaggtgatacagctgtcccgcaagacctttgacacggagtatcagaaaacgaaacttaatgactgggatttcgtggtaaccaccgacataagcgaaatgggggctaatttcaaggctgaccgcgtgatcgatccgcgccgttgcctgaagcccgtgatcctgaccgacggcccggaacgcgtcattttggccggtcccatgcccgtgaccgcggcctccgccgcccagcggcgaggccgggtagggcgcaacccacaaaaggagaacgaccagtacatattcaccgggcagcccctgaacaacgacgaggaccacgcccactggaccgaagcgaagatgctgctggacaacattaacacgcccgaggggatcatcccggcactcttcgaacccgagcgagaaaagtccgccgctatcgacggcgaatacagactgaagggcgaatcccggaagacatttgtcgaactcatgcgccgcggggacctccccgtctggctggcgcacaaggtcgccagcgagggcattaaatacaccgaccgcaaatggtgttttgacgggcagcggaacaaccagatcctggaggagaacatggatgtggagatatggaccaaagagggggagaagaagaaacttcgcccccggtggttagacgcccgcacgtattccgacccactggcactcaaagagttcaaagacttcgccgcgggccgaaagagcatcgccctggacctagtgaccgagatcgggcgggttccctcacacctcgcgcaccggacccggaacgcccttgacaacctggtgatgttgcatacgagcgagcacgggggcaaagcgtacagacacgcggtggaggagttgcccgagacgatggagacactacttctgctgggcctcatgatcctgctgaccgggggcgccatgctgttcctgatctctggtaagggaatcggtaagacctccattgggctaatctgcgtaatcgccagctccggtatgctctggatggccgagatcccactgcagtggattgccagcgctatcgtgcttgagttctttatgatggtgttactgatccccgagcccgaaaagcagcggacgccccaggacaaccagctggcctacgttgtgatcggaatcctcaccctagccgccattatcgccgccaacgagatgggcctactggagaccaccaaacgggacttgggcatgtccaaggagccgggggtggtcagccccatctcctacctggacgtggacctccaccccgcctctgcatggacgttatacgccgtagcgacgacagtcatcacccccatgcttcgacacacgatcgagaactccaccgccaatgtgtcgctcgcggcgatcgccaaccaggccgtggttcttatgggcctggataaagggtggccgatttcgaagatggacctcggtgtgcccctgcttgcattggggtgctacagccaggttaaccccttaaccctgaccgccgccgtcctcctcctgatcacgcactatgccatcattggccctggcctccaggctaaggccacgcgcgaggcccagaagcggaccgccgctggcatcatgaagaacccgaccgttgacggcattatgacaatagacctggaccccgtgatctacgactccaagttcgagaagcagctggggcaggtcatgctactggtactgtgcgcggtgcagctcctgctgatgcgcaccagctgggccctctgtgaggccctgaccctggccaccgggcccattacaacgctctgggaaggctcccccgggaaattttggaacaccaccatcgctgtaagcatggccaacatcttccgaggcagctacctggccggggccggactggcattctcaattatgaagtccgtggggacgggtaagcgaggcacggggagccaaggggagaccctaggggagaagtggaagaagaaactgaaccagcttagtcggaaagaatttgacttgtataagaagtccggcatcaccgaggtggaccgcaccgaagcgaaggaggggctgaagagaggggaaatcacgcaccatgccgtaagccgcggctccgccaaactgcaatggtttgtggaacggaacatggtgatcccggaggggcgcgtgatagacttaggctgtgggcggggcggttggagttattactgcgccggactgaagaaggtgaccgaggtgaggggatataccaagggcgggccagggcacgaggagcctgtcccaatgtccacctacggctggaacattgtgaagctcatgtcagggaaggacgtgttctacctaccgccagagaaatgcgacactctgctgtgtgacataggcgagagttctccctcccccaccgttgaggagagccgcaccatccgcgttctgaagatggtggagccgtggctcaagaacaaccagttttgcataaaagtcctcaacccctacatgcccaccgtgatcgaacacctggagcgcctccagagaaagcacggcggcatgctggtacgcaaccccttgtccaggaatagcacacacgagatgtactggattagcaatggaaccggcaacatcgtcgcaagcgtgaacatggtgtcccgccttctgctgaaccgtttcaccatgacacatcgccggcccactatagagaaggatgtggatcttggcgcaggcacgaggcacgtgaacgccgagcctgagaccccaaatatggacgtgatcggggaacggataaagaggatcaaagaggagcacaacagcacctggcactacgacgatgagaacccctataagacgtgggcataccacggatcctacgaagtcaaggctaccgggtccgcctctagcatgatcaacggcgtggtcaaacttctgaccaagccctgggacgtggtgccaatggtcacccagatggccatgaccgacaccacccccttcgggcagcagcgggtatttaaggaaaaggtggacacacgcacaccgcggagcatgcccggcacccgccgcgtcatgggcatcaccgccgagtggctctggcgcaccttggggcggaacaagaagccgcgcctgtgcacgcgggaggagttcaccaaaaaggtgcgcaccaacgccgcgatgggcgcggtgttcacagaagagaaccagtgggactccgccaaagccgccgtcgaggacgaggacttctggaagctcgtggaccgggagcgggagctacataagctcgggaagtgcggcagctgcgtttacaacatgatggggaagcgcgagaagaagctaggcgagttcggcaaggccaaggggtccagggcgatctggtacatgtggctgggcgcccgctacctcgagtttgaggccctcgggttcctaaacgaggaccactggtttagccgcgaaaattcctacagcggagtcgagggggagggcttacacaaactcggctacatactgcgggacatctccaagatccccggaggcgctatgtacgccgacgacacggcggggtgggacacccggatcacggaggatgatctgcataacgaggagaagatcacccagcagatggacccggagcaccgtcagttagccaatgccatcttcaagctgacctaccagaacaaggtggtgaaggtccagcggcccaccccgactggcaccgtgatggacatcatcagccgaaaggaccagagaggctccggccaggtgggcacttacggtttgaacacgttcactaacatggaggctcagctcatacgccagatggagggggagggggttctcagcaaagccgacctggaaaaccctcacttacccgagaagaagatcacgcagtggctggagaccaaaggggtggagcgtctgaagcgcatggcgatctcaggagacgactgcgtcgtcaaacccatcgatgaccgattcgccaacgccctcctggccctgaacgacatggggaaggtgcgcaaggacatcccccagtggcagccctcgaagggctggcacgactggcaacaggtcccgttctgttcgcaccacttccacgagctgatcatgaaggacgggcggaagctggtcgtgccctgccgcccccaggacgaactgataggccgggcccgcatctcccagggtgctggctggtccctccgggagacagcttgccttgggaaggcgtatgcccagatgtggagtctgatgtacttccaccgccgggacttacggctcgcgtccaacgctatttgtagcgccgtgccggtccattgggttccaacatcccgcaccacctggagtatccacgcccaccaccagtggatgacgaccgaggatatgctgaccgtgtggaaccgtgtctggatagaggacaacccatggatggaagacaagactcctgtcacgacctgggagaatgtgccctacttaggcaagcgcgaagatcagtggtgcggctcgctaatcgggctgacctcccgtgctacctgggcgcaaaatattccgacggccatccagcaggtccgcagcctaatcggcaatgaagagttcctggactacatgccctccatgaagcggtttagaaaggaggaggagagcgagggcgccatctggtga

SEQ ID NO: 26036 - RNA, 9873 nt, synthetic construct
  misc_feature 1..9873: note = derived and/or modified CDS sequence (opt11) from DENV-3__FJ639768__SS-prME
  source 1..9873: mol_type = other RNA
acctccctgtgcctgatgatgatcctgcccgccgccctggcattccatctcaccagccgggacggggaacctcggatgattgtagggaagaacgagcggggcaagtccttactgttcaagacggccagcggtataaacatgtgtaccctcatcgccatggacctgggggagatgtgcgacgacaccgtgacctataagtgcccccacataacggaggtggaacccgaggacatcgattgctggtgcaacctgaccagcacgtgggtaacctacgggacgtgtaaccaggccggcgagcaccggcgcgataagcggtccgtagccctcgcgccccacgtcgggatggggctggatacccgcacccagacctggatgagcgcagagggcgcctggcgacaggtggagaaagtggaaacatgggccctgcggcacccggggttcaccatcctcgccctgttccttgcccattacatcggcacctcgctcacccagaaggtggtgatctttatcttgctgatgctcgtcacgcccagcatgaccatgcggtgcgtgggggtcggcaaccgcgacttcgtcgaaggcttgtccggcgccacctgggtggacgtggtgctggagcacggaggctgcgtgaccaccatggctaagaacaagccgaccctcgacatcgagctgcagaaaaccgaggccacgcagctggcgacgctccgcaagctgtgcatagagggcaagatcaccaatatcaccaccgacagccggtgccctacgcagggcgaggctgtactgccggaggagcaggaccagaactacgtctgcaagcacacctacgtggatcggggctggggcaacggctgcggcctcttcgggaagggctccttagtgacttgtgccaagttccagtgcctggagccgatcgaggggaaggtcgtgcagtacgagaacctcaagtacaccgtgataattacggtccacacgggggaccaacaccaggttggcaacgagacccagggggtcacagccgagattactccccaggcctctaccaccgaggcgatcctgcccgagtacggcaccctggggcttgagtgctctccgcgcaccggcctggactttaacgagatgatcctgctaacgatgaagaacaaggcctggatggtgcaccggcagtggttcttcgacctgcctctgccctggaccagcggtgccaccaccgagacgcccacgtggaaccgtaaggagctcctggtgacattcaaaaacgcccatgccaagaagcaggaggtcgtggttctcgggtcccaagagggcgcgatgcacaccgccctcacgggggcgaccgagatccaaaattcgggcggcacctccatcttcgccggccacctgaaatgccggctgaaaatggacaagctcgagctgaagggcatgagctacgccatgtgtaccaatacgttcgtcctgaagaaggaggtttccgagacccagcacgggaccatcctcatcaaagtggagtataagggcgaggacgtcccatgcaagatccccttcagcacggaggacggacagggcaaagcccacaacggacgcctgatcacagctaaccccgtggtgacaaagaaggaggagcccgtcaacatcgaggcggagccgcccttcggagagagcaacatcgtgatcggcatcggggacaacgccctgaagatcaactggtataagaagggctctagcatcggcaagatgttcgaggcgaccgccagaggcgcccgccggatggccatcctgggcgacaccgcctgggacttcgggtccgttggaggggtccttaattccctgggcaagatggtgcaccagatattcggctccgcgtacactgccctgttctctggcgtgtcctgggtcatgaaaataggcatcggagtgctccttacttggatcgggctgaactccaagaacacctccatgagcttcagttgcatcgccatcgggatcatcaccttatacctgggcgccgtggtccaggccgacatggggtgcgtaatcaactggaagggaaaggagctcaagtgcggcagcggtatcttcgttacgaatgaagtccatacctggaccgagcaatacaagttccaggcggactccccgaagcgcctcgccaccgccatcgccggcgcctgggagaatggagtgtgcggaatccgcagcacgacccggatggagaacctgctttggaagcagatcgcgaacgaactcaactatatactgtgggagaacaacatcaagctgacggtagtcgtgggggatatcataggtgtacttgagcaaggcaagcgcaccctgacgccccagccgatggagctcaagtactcctggaagacgtgggggaaggccaagatcgtcaccgccgagacccagaacagctcctttatcatcgatggccccaacacgcccgagtgccccagcgcctcccgggcgtggaacgtgtgggaggtggaagactacggatttggcgtcttcaccaccaacatctggctgaagttacgcgaggtgtacacacagctgtgtgaccaccggctaatgagcgccgccgtcaaagacgagcgtgccgtccacgccgacatgggctactggatcgagtcccagaagaacgggtcctggaagttagagaaggcgagcttgatcgaagtgaagacctgtacgtggccgaagtcccacaccctctggtcaaacggagtgctggagtccgacatgatcatccctaaatcactggccggtccgatctcccagcacaactaccggccgggctaccacacccagaccgccgggccgtggcacctcggcaagctggagttagactttaactattgcgagggcactacggtcgtgatcaccgagaactgcgggactcgcggccccagcctccggacgaccaccgtgtccgggaaacttatccacgagtggtgttgtcgcagctgcaccctgcccccgttacggtacatgggcgaggacgggtgctggtatggcatggaaatacgccctatctccgagaaggaagagaacatggtcaagagcctggtttccgccgggtcaggtgaggtggacaatttcactatgggcgttctctgcctcgccatcctgttcgaggaagtgatgcgggggaagttcggcaagaagcatatgatcgccggggtgttcttcaccttcgtcctgttactaagtggccagatcacctggcgcgatatggcccacacgctgattatgatcggcagcaacgcttcagatcgcatggggatgggtgtgacgtacctcgctttgatcgccaccttcaagatccagcccttcctggcactcgggtttttcctgcgcaagctgactagccgggagaacctgctgctgggcgtgggcctcgccatggccaccacgctgcagctgcccgaggacatagagcagatggccaacggtatcgctttgggcctgatggccctgaagctcatcacgcagttcgagacctaccagctgtggaccgccctgataagcctcacatgctccaacaccatatttactcttaccgtcgcctggcgcacggccaccttgatattggccggggtgagcctgttgccggtctgtcagtccagctccatgcggaaaacagactggctccccatgaccgtggcagcaatgggcgtaccgccccttccactgttcatcttcagcctcaaggacacgctgaagaggcgctcctggcccctgaacgagggggtcatggccgtcgggctcgtgagcatcctggccagcagcttacttcggaacgatgtcccgatggcgggccccctggttgccgggggcctgctcattgcctgctacgttatcaccgggacgagcgctgacctgaccgtagagaaggctgcggacgtcacgtgggaggaggaggccgagcagaccggcgtgtcacacaacctgatgatcaccgtcgacgacgacgggactatgcgcatcaaggacgacgagaccgagaacattctcacagtgctgctgaagaccgccctactgattgtgtcaggcatcttcccgtactcaatacccgccaccctgttggtctggcacacctggcagaagcagacccagcggtcaggcgtgctatgggacgtgcccagtccacccgagacccaaaaggccgagttggaagagggtgtgtaccgtattaaacagcagggcatcttcgggaagacccaggtgggcgtgggggttcagaaagagggggtgttccacaccatgtggcacgtgacgagaggggcggtgctcacctacaacgggaagcgcctggaacccaactgggcctccgtcaagaaggacctgataagctacggcggtggttggcggttaaatgcccaatggcagaagggggaggaggttcaggtcatcgccgttgaacccggcaagaacccgaagaacttccagaccatgcccggcacattccagacgaccaccggggagatcggcgcgatcgccctggacttcaagcccgggacctccggcagccccataatcaatcgcgagggcaaagtggtcgggctctacggcaatggcgtggtgacgaagaacggcggttacgttagcggcatcgcgcagacaaacgccgagccggacggccccactcccgaattagaggaggagatgtttaagaaacggaatcttaccatcatggacctgcaccccgggtccggcaagacgcgcaagtacctgccggcaatcgtgagagaggcgatcaaacgccggctccgcaccctgatcttagcccccacccgggtggtcgctgccgaaatggaggaggcactcaaggggcttcccatccgctaccagaccacggcaacaaagagcgagcacactggccgggagattgtggacctgatgtgccacgccacgttcacaatgcgcctcctatcccccgttcgggtgccgaactataacctgatcatcatggacgaggcccactttaccgacccagcctcaatcgccgcgagagggtacatctcaacgcgggtgggcatgggtgaggccgccgccatcttcatgaccgcgacgccgcccggtaccgcagacgccttcccgcagagcaacgcacctatccaggacgaggagagagacatccccgagcggtcctggaacagcggaaacgagtggatcaccgacttcgcggggaagaccgtgtggttcgttccgtccatcaaggcgggcaatgacatcgccaactgccttcggaagaacgggaaaaaggtgattcagctgtcccgcaaaacgttcgacacggagtaccagaaaaccaaactgaacgactgggacttcgtcgtcacaacggacatatccgagatgggcgcgaacttcaaggcagaccgagtgatcgacccgcgccggtgcctcaagcccgtgatcctgaccgacggcccagagcgggttattctagcggggcccatcccggtgaccgcggccagcgcggcccaacggcgcggcagagtggggcggaacccccagaaggagaacgaccagtacatcttcacaggccagcccctcaacaacgatgaggaccacgcacactggacagaggctaagatgcttctggataacattaacacgcccgaggggatcatccccgccctctttgagcccgaacgcgagaagtccgccgccatagacggcgagtacaggctgaagggcgagagtcgtaagaccttcgtcgagctgatgcgccgcggggacttgcccgtgtggctggcacacaaggtcgcctccgagggcatcaaatacaccgaccgcaagtggtgcttcgacgggcagcggaacaatcagatcctggaggagaacatggatgttgagatctggaccaaagagggagagaagaagaaactccggccccggtggctggacgcccggacgtacagcgacccgctggccctcaaggagttcaaggacttcgccgccggccgcaagtccatcgccctggacctggtgactgagattggtcgggtccctagccacctcgcccacagaacccggaacgccttagacaacctggtgatgctccacacctccgagcatggtgggaaggcttaccgccacgcagtagaggagctgcccgagacgatggagaccctgctactgctgggcctcatgatattgctgaccgggggtgccatgttgttcctgatcagcggcaaggggatcggcaagaccagcatcgggctgatctgcgtcatcgccagtagcggcatgctctggatggccgagatcccattgcaatggatcgcctccgcgatcgtgctggagttcttcatgatggtgctcttaatccctgagccggagaagcaaagaacgccccaggacaaccagctggcctacgtagtgatcgggatcctcacattggccgccatcatcgccgcgaacgagatgggcctgctcgagacaaccaagcgcgacctgggcatgagcaaggaaccaggggtggtctcccccaccagctacctggacgtggacctccatcccgcctccgcctggaccctgtacgccgtggccaccaccgtcattacgccaatgctgcggcacactattgaaaacagcaccgccaacgtgtccctggccgccatagctaaccaagcggttgtccttatgggcctggacaaggggtggcctatcagcaagatggacctcggcgtgcccctgctggccctcgggtgttactcacaggtgaaccccctgacgctgacggcggcagtcctcctactgatcacccactacgccatcatcggccccgggcttcaggcgaaggccacccgcgaggcccagaagcggaccgccgccgggatcatgaagaacccgacggttgacggcatcatgaccattgacctggaccccgtgatctacgatagcaaattcgagaagcagctgggccaagttatgctcctggtgctgtgcgcggtgcaactcctgctgatgcgcacctcctgggccctctgcgaggccctcaccctggccaccggccccatcaccacactctgggagggcagccccggcaagttctggaacaccacgatcgcggtctccatggccaacatcttccgggggagctacatagccggggccggcctggcgttcagcatcatgaaaagcgtagggaccggcaagcgcggcaccgggtcacagggtgagaccctgggagagaagtggaagaagaagctcaatcagctgagccggaaggagtttgacctttacaagaagtcaggcatcaccgaggttgaccgcaccgaggcgaaagaggggctcaagcggggagaaatcacacaccacgccgtctcccgcggtagcgccaagctgcagtggtttgtggaacggaacatggtgatcccggaggggcgcgtgatcgacttgggttgcgggagaggagggtggagctactactgcgccggcctcaagaaggttaccgaggtccgaggctataccaagggcgggcccgggcacgaagaacccgtccccatgtctacgtacggctggaacatagtgaagctgatgtccgggaaagacgtgttctacctcccgcccgaaaagtgtgacaccctcctgtgcgacatcggcgagagctcacccagccccaccgttgaggagtcccggaccatccgcgtactgaagatggtggagccgtggctgaagaacaaccagttctgtatcaaggtgctcaacccctacatgcccactgttatagagcacctggagcgcttacaacgaaagcatggcggcatgctcgtcaggaaccccttaagccgcaacagcacccatgagatgtactggatcagcaacggcaccgggaacatcgtcgccagcgtgaatatggtcagccgcttactcctgaaccggttcaccatgacgcaccgccgtccgaccatcgagaaagacgtcgacctgggcgcgggcacccgccacgtgaacgccgagcccgaaacccccaacatggacgtgatcggggagcggatcaagcgcatcaaagaggagcacaactccacgtggcattacgacgacgagaacccgtacaagacctgggcctaccacggcagctacgaggtgaaggcaaccgggtccgcctcttccatgataaatggggtggtcaagctcctgacaaaaccctgggacgtggtgcccatggtcactcagatggcgatgaccgacaccacgcccttcgggcagcagcgggtgttcaaggaaaaggtggacacgcgtaccccgcggagcatgcccggcacccgccgggttatgggcatcactgccgagtggctgtggcgtacgctagggcggaacaaaaagccccgcctgtgcacccgcgaggagtttaccaagaaggtgcgaaccaacgccgccatgggagctgtgttcacggaggagaaccaatgggactcggccaaggcggcggtggaggacgaggacttttggaaattggtggaccgcgagcgcgagctccacaagctcgggaagtgtggctcatgtgtctacaatatgatgggcaagcgcgaaaagaagctcggcgagttcggcaaggcgaaggggagccgggcgatctggtacatgtggctcggcgcccgctacctggagttcgaggccttagggttcctcaacgaagaccactggttctcccgggagaactcctactccggcgtcgagggggagggcctgcacaaacttggttacatccttcgcgacatcagcaagatccccgggggcgcaatgtacgccgacgacaccgcgggatgggacactcggatcaccgaggacgacctgcacaacgaggagaaaatcacgcagcagatggacccggagcaccgccagttagccaacgccatctttaagctcacgtaccagaacaaggtggtgaaggtccagcggcccactcccaccggaaccgtcatggacataatctcccgcaaggaccaacgggggagcggccaggtagggacgtacgggctgaacacgttcaccaacatggaggcccagctgatccgccagatggagggcgaaggggtcctctccaaggccgatctggagaatccccatctccccgagaagaagatcacccaatggctggagaccaagggcgtagagcggctgaagcgcatggcgatcagcggcgacgattgcgtggtcaagcccatcgacgatcgtttcgccaacgccttgctcgccctgaacgacatggggaaggtgcgcaaggacatcccacagtggcagccctccaagggctggcacgactggcagcaggtcccgttctgctctcaccacttccacgagctgattatgaaggacggacggaagctcgtcgtgccctgccgcccgcaggacgagctgatcggcagagcccgcatctcccagggggcgggctggagcctgcgggagaccgcctgcctcggcaaagcgtacgcccagatgtggtcgctgatgtactttcaccgccgtgacctgaggctcgcgagcaacgccatctgctcagccgtccccgtccactgggtaccgacctcacgcaccacgtggtccatacacgcccaccaccagtggatgaccacagaggacatgctgaccgtgtggaatcgagtctggatagaagacaacccctggatggaagacaagactccagtgaccacctgggagaacgtgccctacctggggaaacgcgaggaccagtggtgtgggagcctcatcggtctgaccagccgggccacgtgggcgcagaatattccgaccgccatccagcaagtacgatccctgatcggcaatgaagagttcctcgactacatgcccagcatgaagcggtttcgcaaggaggaagagtccgagggtgccatctggtaa

SEQ ID NO: 26037 - RNA, 9873 nt, synthetic construct
  misc_feature 1..9873: note = derived and/or modified CDS sequence (opt11) from DENV-3__FJ639769__SS-prME
  source 1..9873: mol_type = other RNA
acaagcctgtgcttaatgatgatactgcccgccgccctggccttccacctcacaagccgggatggcgaaccccggatgatcgtcgggaagaacgagcggggcaaaagccttttattcaaaacagcaagcggtatcaacatgtgcaccctcatagccatggacctcggcgagatgtgtgacgataccgtgacgtacaagtgcccccatattacggaggtggaaccagaggacattgactgctggtgcaacctgaccagcacctgggtgacgtacggcacgtgtaaccaagccggcgagcaccggcgcgacaagcggagcgtcgccctcgcgccacacgttgggatggggctggatacccgcacccagacatggatgtctgcggagggcgcttggagacaggttgagaaagtggagacgtgggcactaagacacccggggttcactatcctggccctcttcctcgcccactacattgggacctcccttacccagaaggtagtgatcttcatactattgatgctggtgacgccctctatgactatgcggtgcgtgggggtgggcaaccgcgacttcgtagagggactcagcggcgccacctgggtggacgtggtcctggagcacggtgggtgcgtgaccaccatggccaagaacaagcccaccctcgacatcgaactgcagaagaccgaagcgactcagctagccacacttcggaaactgtgtatagagggcaagatcaccaacataaccacagacagtaggtgtccaacgcagggggaggccgtgctgccggaggagcaagatcagaattacgtctgcaagcatacctacgtagaccgcggttggggcaatggatgcggcttattcggtaagggctccctggtgacttgcgccaagttccagtgcttagagccgatcgagggcaaggtcgtccagtacgagaacctcaagtacaccgtaatcatcactgtacacaccggggatcagcaccaggtcggaaacgagacgcaaggggtcaccgcggagataacgccccaggcatccaccaccgaggcaatcctaccggagtacgggaccttagggctagagtgttccccgagaaccggcctggatttcaatgaaatgatactgcttacaatgaagaacaaggcatggatggtgcaccggcagtggttctttgacctacccctgccatggaccagtggcgccacgacggagacccccacctggaaccggaaagagctcctagtgaccttcaagaacgcccacgccaaaaagcaggaggtcgtggtgctggggtcgcaagaaggagccatgcacaccgccctcacgggggccacagagatccagaactcaggcggcacctccatctttgccggccacttaaagtgcagactgaagatggacaaactagagctgaagggcatgtcgtatgctatgtgcaccaacacgttcgtactgaagaaagaagtcagtgagacacaacacgggaccatactcatcaaggtggaatacaagggtgaagatgtcccgtgtaagatcccctttagcaccgaggacgggcagggtaaggcgcacaatggcaggctgattacggccaaccccgtcgttaccaagaaggaggagcctgtcaacattgaggctgagccgcctttcggagagtctaacatcgtgatcgggatcggtgataacgctctgaagatcaattggtataagaaaggctccagtattggaaaaatgtttgaagcgaccgctcggggcgcccgacggatggccatcctcggcgacacagcctgggactttgggtcggtaggcggagtcctaaacagcttaggtaagatggtgcaccagatcttcggttccgcgtacacagccctcttcagtggcgtatcctgggtaatgaagattggtatcggggtcctcctgacgtggattggcttgaacagcaagaacacttccatgtctttctcctgcatcgccatcggaataatcaccctctacctaggtgccgtggtccaggccgacatggggtgcgtaatcaactggaagggaaaggaacttaagtgcggctccggaatcttcgttacgaacgaggtgcatacctggactgaacagtacaaattccaggccgactccccaaagaggctggccaccgccatcgccggcgcctgggaaaacggggtgtgcggcatccgttcaactacaagaatggagaatctgctctggaagcagatcgcgaatgagctcaactacattttatgggagaacaacattaagctgaccgtggtcgtgggggacatcataggcgtgctcgagcagggcaagcggaccctgacgcctcagcctatggagttgaagtattcctggaagacttgggggaaagctaaaatcgtcaccgccgagacccaaaacagctccttcatcatagacggccccaatactccagagtgcccatcagcgtcacgggcatggaatgtgtgggaggtcgaggactacgggttcggcgtgtttacgaccaacatttggctcaaacttcgtgaggtgtacacccaactgtgcgaccatcggttaatgtcagccgccgtgaaagatgagcgcgccgtccacgccgacatgggatactggatcgaaagccagaagaatgggtcttggaagctggaaaaagcgagcctaattgaagtgaagacctgcacgtggccgaaaagccacaccctatggagcaacggcgtactcgagtccgacatgataatccccaagagtttagccggacccatatcccaacataactaccgcccaggataccacacccaaaccgccgggccctggcatctcggcaagctggagctcgattttaactactgtgaaggtacgacggttgtgattaccgagaattgcggaacccgcggccccagtctccggacgaccacggtctccgggaaactgatccacgaatggtgctgccgaagctgcaccctgcccccgttaaggtacatgggcgaggacgggtgctggtacggcatggagatccgccccatctccgagaaggaagaaaacatggtcaaaagcctggtatccgcaggctcgggggaggttgacaacttcaccatgggtgtactgtgcctcgccatcttattcgaggaagtcatgcgggggaagtttggcaaaaagcacatgatcgcgggagtattctttaccttcgtactgctgctctctgggcagatcacctggagagacatggcccatacactgataatgattggctcaaatgccagcgatcgcatggggatgggtgttacgtacctggccttgatcgccacgtttaagatccagcccttcctggcattgggtttcttcctaagaaagctgacgagccgtgagaacctcttgctgggcgtgggcctcgccatggccaccacgcttcagctccccgaggacatcgagcagatggccaacgggatagcgctcggcctgatggcgctgaaactcattacccaattcgagacctatcagctgtggacagccctcatcagcttaacatgcagcaatacaatttttactctgacagtcgcctggcgcacggctacgctgatcctcgcgggggttagcctgctaccagtgtgccaatccagctcaatgcggaaaaccgactggctcccgatgacggtggccgccatgggcgtacctcccttgccattgttcatttttagcttgaaggacacgctcaaacgtcgcagctggccactgaacgaaggcgttatggctgtgggattagtgagtattctggcatcctccctgctcagaaacgacgtcccaatggcgggcccattagttgccgggggactgctcatcgcctgctatgtcatcactgggacctcggccgacctgaccgtcgagaaggccgcagacgtgacgtgggaggaggaggcagagcagaccggcgtgtcacataacctcatgatcacagtcgatgatgatggcaccatgcgcataaaggacgacgagacggaaaacatcctcacggtcctcctgaagaccgcccttctgatcgtatcgggaatcttcccgtactcaatccccgcgaccttgctcgtctggcacacgtggcagaagcaaacgcagcggagcggggtgctgtgggacgtgccctcaccacccgagacccagaaggccgagttagaggagggggtctacaggattaagcagcagggcatcttcggcaagacgcaggtaggagtcggggtccagaaggaaggcgtgttccacaccatgtggcacgtgactcgcggcgccgttttaacctacaacggaaagcgactggaacccaactgggcctctgtcaagaaggacctgattagttacggcggagggtggcgcctcagcgcccagtggcaaaagggggaggaggtccaggtaatcgcagtggagcccggcaagaatcccaaaaactttcagaccatgcccggcaccttccaaactaccacaggggagatcggagcaatcgccctcgacttcaagcccggtacttctggcagccccatcataaaccgtgagggcaaggtggttggtctgtacggcaacggggtggtgaccaagaatggagggtacgtatccggcattgcccagactaacgcagaaccagatgggcccacgcccgagctggaggaggagatgttcaagaagcgcaacttgaccatcatggacctgcaccccggaagcggcaagacccggaagtatctgccggccatagtgcgagaggccatcaagaggcgactcaggaccctaatcctggcccctactcgcgttgtagccgctgagatggaagaggccctaaagggcttgccgatccgataccaaacaaccgcgaccaaatccgagcacaccggccgggagatcgtcgacctgatgtgccacgccacctttacgatgcgcctcctgagccccgtacgggtcccgaactataacctaatcataatggatgaggcgcactttaccgacccagcttccattgctgcgcgcgggtacatcagcacccgagttggaatgggcgaggcagcagctatcttcatgacagcaacgcctcctgggaccgctgatgctttcccacagtctaacgcccccattcaggacgaggaaagagacatcccagagcgcagctggaactctgggaacgaatggataaccgacttcgccgggaagaccgtgtggtttgttccctcgatcaaagcaggcaacgacatcgccaactgcctacgcaaaaacgggaagaaggtgatccagttatccagaaagacgttcgacaccgagtatcagaaaactaagctgaatgactgggactttgtagtcactacggacattagcgagatgggggctaatttcaaggccgaccgggtgatcgacccgcgacgatgcctcaagcccgtgattctgaccgatggcccagaacgtgttatccttgcaggccccatgcccgtcaccgctgcgtccgcggcccagcgcagggggcgggtggggcgaaaccctcagaaggagaacgaccagtacattttcaccggccagcccctcaacaatgacgaagatcatgcccactggaccgaagcaaagatgcttctggacaacatcaacacacccgaggggataatacccgcccttttcgagcccgagagagagaagtctgctgccattgacggggaataccgcctcaagggcgaatcccggaagaccttcgtggagcttatgcgccgcggggatctccccgtgtggctggcgcataaagttgccagcgagggcatcaagtacaccgaccgcaagtggtgctttgacgggcagagaaacaaccagattctggaagagaacatggacgtagagatctggaccaaggagggtgagaagaagaaactccgcccccggtggctggacgcgcgaacgtactccgacccgctggccttgaaggagttcaaggacttcgccgccggcaggaagtcaatcgcgctggacctggtcaccgagattggtcgggtccctacacacctggcccaccgcacccggaatgccttggacaacctggttatgctgcatacatcggagcacggcggtaaggcctaccgccatgcggtggaggagctaccggagaccatggaaaccctgctcctgctaggcctcatgatactgctgaccgggggcgcaatgctgttcctgatctccggcaaggggatcggcaagacgagcatcgggctaatttgcgttatcgcctccagcggtatgctctggatggccgagattccgctgcaatggatcgcatccgcgatcgtgctggagttcttcatgatggtgctcctgatccctgagccggaaaaacaacggacaccccaggacaaccagcttgcgtacgtcgtcatagggatactgaccctggctgccatcatcgccgcgaatgagatggggctgctagaaacgacgaagagggacctagggatgagtaaagagccgggtgtggtcagccccaccagctacctggacgtggacttgcaccccgcctccgcctggaccctttacgctgtggcaaccactgtaatcactcccatgctacgccacacaatcgagaactccacagccaatgtgtcacttgccgcaatcgcgaaccaggcggtggtcctgatgggcctagataagggatggccaatctcaaagatggacctcggggtgccgctgttagcgctcggatgttactcccaggtgaatccgctgacgctcacggcagccgtgttgctgctcatcacccactacgccatcatcggcccaggactgcaggcaaaagccacgcgtgaagcccaaaaacggacggccgcggggatcatgaaaaatccgaccgtcgacggcatcatgacaatcgatctggatcccgtgatttacgactctaagttcgagaagcagctgggccaggttatgctcctggtgctgtgtgtagtccagctcctgctgatgcgcacctcctgggctctgtgcgaagcgctaacgcttgcgacgggccccatcacaaccctctgggagggatcaccgggtaaattctggaacacgaccatagccgtgtctatggcgaacatttttcgtggctcgtacctggccggggccggactggcctttagtatcatgaagtcggtcgggaccggcaagcgcggcaccgggtctcagggcgagaccctcggggagaagtggaaaaagaaactgaaccagcttagccggaaggagtttgacctgtacaagaagtccggcattacggaggtagataggaccgaagccaaggaaggtctgaagcggggcgagatcacgcaccacgcagtatcccgcggttcggccaaactgcagtggtttgtggagcggaacatggtgatcccggaggggcgcgtcatcgacttaggttgcggccggggagggtggtcctactactgtgcggggctgaaaaaggtaaccgaggtgcgcggctacactaaaggagggcccggtcatgaggagcccgtgcccatgtccacctacggctggaatatcgtcaagttgatgtccggcaaggacgtcttttaccttcctcccgagaagtgcgacaccctgctgtgcgacatcggcgagtcttcgcctagccccaccgttgaggaatcccggacgatccgcgtgctgaaaatggtcgagccatggcttaaaaacaaccagttctgtatcaaggttctaaacccctacatgccaaccgtaatcgagcacctagagcgacttcagcggaagcacggagggatgttggtccgcaatcccttgagccgtaattctacccatgagatgtattggattagcaatggcaccgggaacatcgtggcttccgttaatatggtcagccggctcctgctaaatcgctttacgatgactcaccgacggcctaccatcgagaaggacgtcgacctcggcgccggaacccgccatgtaaacgcagaacccgagacgcctaatatggacgtaatcggggaaaggatcaagagaataaaggaagaacataactcaacttggcactacgacgacgagaatccatacaagacgtgggcgtaccacgggtcctacgaggtcaaggcaaccggtagtgcaagcagcatgattaacggcgtagtcaagctgctgacgaaaccctgggacgtagtcccaatggtcacacagatggccatgaccgacaccacgccattcgggcaacagagagtctttaaagagaaggtcgatacccgcacccctcggagcatgcccggtacccgccgggttatgggcattacggcggaatggctatggcgcactcttgggcggaataagaaaccaaggctttgtacgcgggaggagtttaccaaaaaggtccgcacgaacgccgccatgggagcggtcttcaccgaagagaaccagtgggacagcgcaaaggcggctgtggaggacgaggatttctggaagctcgttgatcgcgaaagggagctgcacaagctgggcaagtgcggctcctgcgtctataacatgatggggaaaagggagaagaagctcggcgagttcggcaaggccaaggggagccgggccatctggtacatgtggctgggcgcgcgatatctagagttcgaggccctggggttcctcaacgaggatcactggttttcacgggagaacagctactccggcgttgagggggagggattgcataagttgggctatatcctgcgcgacattagcaagattcccggcggagccatgtatgccgacgacacagccgggtgggacacaagaatcacagaagacgacctgcacaacgaggagaagattacgcagcagatggacccagagcacagacaacttgctaacgccatcttcaagctcacctaccagaacaaggtggtaaaggttcagcggcccacccccactggtactgtgatggacattatctcccggaaggaccaacgtggcagcggtcaagtcggtacatatggactaaacaccttcaccaacatggaggcccaactgattcgccagatggagggggagggagtgctgagcaaggcggatctggaaaacccccaccttccggagaagaaaataactcagtggttagagaccaagggtgtcgagcggctgaagaggatggctatcagtggcgacgattgcgtcgtgaaacctatagatgaccgctttgcgaacgccctcctcgccctgaacgatatgggtaaagtacgcaaggacattccacagtggcagccctccaagggctggcacgattggcagcaggtaccgttttgtagccatcacttccacgagctcatcatgaaagacgggcggaagttggttgtgccctgtcggccccaggacgagctgatcgggcgggcccgcatttcccagggggcgggctggagcctacgggaaacggcttgtctgggcaaggcttacgcccaaatgtggtccctgatgtacttccaccggcgcgacctccggctggcctcgaacgcgatatgtagtgccgtccccgtacactgggtaccgacaagccgtaccacttggtccatccatgcccaccaccagtggatgactaccgaggatatgctgaccgtctggaaccgggtgtggatcgaagataacccttggatggaggacaagacccccgtgaccacctgggagaacgtcccctacttggggaagcgcgaggaccagtggtgcggaagcctaatcggattgactagccgtgccacctgggcccagaacatcccgaccgcgatccagcaagtgcgttcgctcatcggcaatgaggaatttctggactacatgcccagcatgaagcgcttccgcaaggaagaggagtccgagggggcgatatggtga

SEQ ID NO: 26038 - RNA, 9873 nt, synthetic construct
  misc_feature 1..9873: note = derived and/or modified CDS sequence (opt11) from DENV-3__FJ882577__SS-prME
  source 1..9873: mol_type = other RNA
acgtcactgtgcctcatgatgatcctgcccgccgccctggctttccacctaaccagccgggatggagagccccggatgatcgtggggaagaacgagcggggtaagagcctgctgttcaagactgccagcgggatcaatatgtgcaccctcattgccatggacctcggagagatgtgcgacgacaccgtgacctacaagtgcccccacatcacggaggtggagcccgaggacatcgactgctggtgcaatctgaccagcacctgggttacctacgggacgtgcaaccaggctggcgagcaccggcgcgacaagcggagcgtggccctcgcgccccacgtgggcatggggcttgacacccgcacccagacctggatgagcgccgagggcgcctggcgccaggtggagaaggtcgagacgtgggcgctccgtcacccgggattcaccatcctcgcgctgttcctggcacactacatcggcacctccctcacccagaaggtcgtgatcttcattttgctgatgctcgtcacgcccagcatgactatgcggtgcgtgggggtgggcaatcgcgacttcgtcgagggtctatcgggggctacctgggtggacgtggtcctcgagcacggtgggtgcgtaaccacgatggcaaagaacaaaccaaccctagacatcgagctgcagaagaccgaggccactcagctggctacccttcggaagctgtgcatagagggcaagatcaccaacatcaccaccgacagtcgctgtcccacgcagggtgaggccgtgctgccggaggagcaggatcagaactacgtctgcaaacacacctacgtggaccgggggtggggcaacggctgcggcttatttgggaagggctccctggtgacctgcgccaagttccagtgcctggagcccatcgagggcaaggttgtccagtacgagaacctcaagtacacagtgatcatcacggtccacaccggggatcagcaccaagtaggcaatgagacgcagggggtcaccgccgagatcacgccccaggccagcaccaccgaggcgatcttacccgagtacgggaccctgggactcgagtgctccccccgcaccgggctggacttcaacgagatgatcctgctgacgatgaagaacaaggcctggatggtccaccggcagtggtttttcgacctgcctctgccctggaccagcggcgctaccaccgagacgcccacctggaaccgcaaggagctcctggtgaccttcaagaacgcccatgccaagaagcaggaggtcgtggtgctcgggtcccaggagggcgccatgcacaccgccctcacgggggccaccgagatccagaatagtggcgggacctccatcttcgccggccacctgaagtgtcggctgaagatggacaagctcgaacttaagggcatgtcgtacgccatgtgcaccaacacgttcgtccttaagaaggaggtgtctgagacccagcatgggacaatcctcatcaaggtagaatataaaggcgaggacgtcccgtgcaagatccccttcagcaccgaggacgggcagggcaaggcccacaacggacgcttaatcacggccaaccccgtggttacgaaaaaggaagagcccgtgaatattgaggccgagcccccgttcggggaaagcaacatcgtgatcgggataggcgacaacgccctgaagataaactggtacaagaagggaagcagcatcgggaagatgtttgaggcgaccgcccgtggtgcacgccggatggccatcctgggagacaccgcctgggacttcgggtccgttggaggggtcctcaacagcctgggcaagatggtgcatcagatattcgggagcgcgtacaccgccctgttcagcggcgtgtcgtgggtcatgaagattggcataggggtcctgctaacctggatcggcctgaacagcaagaacacatcgatgagcttctcctgcattgccatcgggataatcaccctctacttaggcgccgttgtccaggccgacatggggtgcgtgattaactggaagggcaaggaactgaagtgcggctccggtatctttgtgacgaacgaggtccacacgtggaccgagcagtacaaattccaggcggactccccaaagcgcctcgccactgccattgccggagcctgggaaaacggggtgtgcggcatccgcagcacaacccggatggagaacctgctttggaagcagatcgcgaacgagctcaactacatcctttgggagaacaatatcaagctgactgtagtcgttggagacataatcggggtcctcgagcaagggaaacgcacccttacgccccagccgatggagctgaagtactcctggaagacctggggcaaggctaagatcgtgaccgccgagacccagaacagcagtttcatcatcgacggccccaacactcccgagtgcccctcagcgtcccgggcatggaacgtgtgggaggtggaggattacgggttcggcgtcttcaccaccaatatctggctcaagctgcgcgaggtgtacacacagctatgtgaccaccggctcatgagcgcggccgtgaaggacgagcgcgccgttcacgccgacatgggttactggatcgagagccaaaagaacgggtcctggaagctggagaaggcgagcctgatcgaggttaaaacctgcacgtggccgaagtcccataccctctggtccaacggcgtgctggagtccgacatgatcatccccaagtccctggccgggcctatctcccagcacaactaccgaccaggttatcacactcagaccgccgggccttggcacctcggcaagctggagctggacttcaactactgcgagggcacgaccgtcgtgatcaccgagaactgcgggacccgcggccccagtctccggacgaccaccgtgtccgggaagctgatccacgaatggtgttgccgcagctgcaccctgccccccctccggtacatgggagaggacgggtgctggtacggcatggaaatccgcccgatctccgagaaggaggagaacatggtcaaaagcctggtgtccgccggcagcggggaggtggacaactttacgatgggcgtcttgtgcctcgccatcttattcgaggaggttatgcgggggaagttcgggaagaagcacatgattgcgggaatcttcttcaccttcgtgctgctcttatccggccagatcacgtggcgcgatatggcccacaccctgataatgatcggctcgaacgccagtgaccgcatggggatgggcgtgacgtacctcgcccttatcgccacctttaagatccagcccttcctcgcgctcggcttcttcctgcgcaagttgaccagccgggagaacctccttctgggcgtgggcctcgccatggcaacaacgttgcaattgcctgaagacatcgagcagatggcaaacgggatcgctctcgggctgatggccctaaagctcattacccagttcgagacctaccagctgtggaccgccctgatctctctcacatgcagtaacaccatcttcacgctgaccgtggcctggcgcactgcgacactgatcctcgcgggggtctcgctgcttccggtgtgccagtccagctccatgcggaagaccgactggctcccaatgaccgtcgccgccatgggcgtgccgcccctcccgctgttcatcttcagcctcaaggatacgctaaagcgccgatcttggcccctaaacgagggggtcatggccgtcggcctcgtgagcatcctggcgtccagcctgctccggaacgacgtccccatggctggccccttggtcgcggggggccttctcatcgcctgctacgtgattaccgggacctctgcagacctgaccgtggagaaggccgcggacgtcacgtgggaggaggaggccgagcagactggcgtgagccacaatctgatgatcaccgtggacgacgacggcaccatgcgcatcaaggacgacgagacggaaaacatcctcacggtcctgctgaagaccgctttattaatcgtgtccggcatctttccgtatagcattcccgccactctgctcgtttggcacacctggcaaaagcagacacagcggtccggcgtcctatgggacgtgccctccccgcccgaaacccagaaggccgagctggaagagggggtgtataggatcaagcagcagggcattttcgggaagacacaggtaggggtgggggtgcagaaggagggcgtcttccacaccatgtggcacgtgacgcggggtgccgtgctcacctacaacgggaagcgcctagagccaaactgggcgtccgtcaagaaggacctgatctcctacggcggtggctggagactctccgcccagtggcagaagggggaggaggttcaggtgatcgccgtcgagcccggcaagaacccgaagaacttccagaccatgcccggcaccttccaaacaactaccggggaaataggcgcgatcgcactggactttaagcccgggacgagtggcagccccataataaacagagagggaaagatcgtggggctgtacggtaacggcgtggtcacgaaaaacggcggatacgtgtccggcatcgcgcaaaccaacgcggagcccgacggccccacccccgaactggaggaggaaatgttcaaaaagcggaacctcaccatcatggacctgcaccccgggagcggcaaaacgagaaagtatctcccggcaatcgtgcgcgaggcgatcaagaggcggctccgcaccctgatactggcccccacccgggtcgtggccgccgaaatggaggaggccctcaaagggctgccgatccgttaccagacaacggcgaccaaatccgagcacaccggccgggagatcgtggatctaatgtgtcacgccacctttacgatgcgcttgctgagccccgtccgggtgccaaactacaacctgatcatcatggacgaggcgcacttcaccgaccctgcatccatcgccgcgagggggtacattagcacccgggtcggcatgggcgaagccgccgccatcttcatgaccgctacgccccccggaaccgccgacgcctttccgcagtcgaacgcccccatccaggatgaggaacgcgatatccccgagcgcagctggaactccggcaacgagtggatcacggacttcgccgggaagaccgtctggttcgtgccctccatcaaggcgggcaacgacatcgccaactgcctccgtaagaacgggaagaaggtgatccagctgtcccgcaagacgttcgacaccgagtaccagaagaccaagctgaacgactgggactttgttgtgaccacggacatttccgagatgggcgccaactttaaggccgatcgagtcatcgacccgcgccgatgcctcaaaccggtaatcctgacggacggccccgagagggtgattctggccgggcccatgccggtgaccgcggcctccgcggcccagcgtcgcggccgggtcggtcgcaacccccagaaggagaacgaccagtacatcttcaccggccagcctctcaacaacgacgaggaccacgcccactggacggaagcgaagatgctgttggacaacataaacacgcccgaggggatcatcccggccctcttcgagcctgagcgggagaaatccgccgccatcgacggcgagtaccgactgaagggcgagtcccgaaagacgttcgtggagctgatgcgccgcggggacctccccgtgtggctggcgcacaaggtagcgtcggaggggatcaaatacacagaccgcaagtggtgcttcgacgggcaacgaaacaaccagatcctggaggagaatatggacgtcgagatctggactaaggagggtgagaagaagaagctccggccaagatggctggacgcacgaacgtactccgaccctctcgccctcaaagagttcaaggacttcgccgctggccgcaagagcatagccctggacctggtgaccgaaatcgggcgggtgcccacccacttggctcacaggacccgtaacgctctggataacctcgtgatgctccacacgagcgagcacggcgggaaggcttaccgtcacgcggtcgaggagctgcccgagaccatggagaccctgctcctactgggcctcatgattctgctaacagggggggccatgttattcttgatctctggcaaggggatcggcaagaccagcatcggcctgatatgcgtaatcgcttccagcggcatgctctggatggctgagatccctcttcagtggatcgcctctgcgatagtactggagttcttcatgatggtcctcctcatccccgagcccgagaagcagcggacgccccaagacaaccagctggcctacgtggtcatcgggatcctcactctcgccgcgatcatcgccgcgaatgagatgggcctgctcgagacaacaaagcgtgacctaggtatgagcaaggagccgggggtcgtttcccccaccagctaccttgacgtcgatctccaccccgcctccgcctggaccctgtacgcagtcgcgactacggtaatcacccccatgctgcggcacaccatcgagaacagcaccgcgaacgtgtccctagctgccatcgccaaccaggcggtcgttctgatggggctcgacaaggggtggccgatctcaaagatggacttgggtgttccgcttctggccctcggttgctactcccaggtcaacccgttgacgctaacggccgcagtgttgctgctgataacccactacgccattatcggcccaggcctccaggcgaaggccactcgcgaggcccagaagcggacggccgccggcattatgaagaacccgaccgtggatggcattatgaccatcgacctggaccccgtcatctacgacagcaagtttgaaaagcagctgggccaggtgatgctcctggttttgtgcgctgtgcagctcttactgatgcgtacctcctgggccctctgcgaagccctgacgctggccaccgggcccatcaccaccctctgggagggcagccccgggaagttctggaacacgaccatcgcggtgtccatggctaacatcttccgaggcagctacctggccggggccgggctggccttctccatcatgaagagcgtggggaccggcaagcgcggcaccgggtctcagggcgaaacgctgggtgaaaagtggaaaaagaagctgaaccagctgagccggaaagagttcgacctatacaagaaatcgggcattacggaggtcgacagaacggaggcaaaggagggcctcaagcggggtgagatcacccaccacgccgtgtcccgaggcagcgccaaactgcagtggttcgtcgagcggaatatggtgatcccggaagggcgcgtgatcgacttaggctgtgggaggggagggtggtcctactactgcgccggcctgaagaaggtcaccgaggtccgcggttacacgaagggggggcccgggcacgaggagcccgtgcccatgagcacctacggctggaacatcgtgaaattaatgtccgggaaggacgtcttctacttgccgcctgagaagtgcgacactctgctgtgcgacatcggtgagtcttcccccagcccaaccgtggaggagtcacggacgatccgggtgctgaagatggtcgagccgtggctcaagaacaatcaattctgcatcaaggtgctgaatccctacatgcctaccgtgatcgagcacctggagcgtttacaacggaagcacggtggcatgctggtccgcaaccccctgagccggaacagtacccacgaaatgtactggatttcaaatggcaccgggaacatagtagcctccgtgaacatggtcagccgcctcctgctgaatcggttcacgatgacccaccgccggccgaccatcgagaaggacgtggacctaggcgcggggacccgccacgtgaatgccgagcccgagacccccaatatggacgtcataggggagcggataaaacgcatcaaggaggagcacaacagcacctggcactacgacgacgagaacccgtacaagacttgggcctaccacggctcctacgaggtgaaggctaccgggtccgccagctccatgatcaatggcgtggtcaagctgctgacgaagccgtgggacgtagtccccatggtcacccagatggcgatgaccgacacaacgcccttcgggcagcagcgggtgttcaaagagaaggtcgacacccgcaccccgcggagcatgcccggcacccgtcgggttatgggcatcacggctgaatggctctggcgcaccctggggcggaataaaaagccccgcctgtgcacccgggaggagttcaccaaaaaggtgcgcaccaacgccgccatgggcgcggtcttcacggaagagaaccagtgggacagcgccaaggccgccgttgaggacgaggacttctggaagctcgtggaccgcgagcgggagctgcataagttagggaagtgcggctcctgtgtctacaacatgatggggaaacgcgagaaaaagctcggcgagttcggcaaggccaaggggagcagggcgatctggtacatgtggctgggggcccgctacctggagttcgaggccctcgggttcctgaacgaggaccactggttctcccgcgagaacagctactctggcgtggagggggagggcctgcacaagctcggctacatcttaagagacatcagcaaaatccccgggggcgccatgtacgcagatgacactgcagggtgggacacccggatcacggaagacgacttgcacaacgaagagaaaattacccaacaaatggatccggagcacaggcagctcgccaacgccatcttcaagctgacctatcagaacaaggtggtcaaagtacagcggcccacccccaccggtacggtgatggacatcatttcccgcaaggaccagcggggcagcgggcaggtcggcacttacgggctgaacaccttcaccaatatggaggcccagctcatccgtcagatggagggagaaggggtgctttccaaggctgacttggagaacccccacttgccggagaagaagattacgcaatggctggagacgaagggagtcgagcggctgaagcgcatggcgatctctggcgacgactgcgttgtgaaacccatcgacgaccggttcgccaacgcactcctggcactgaacgacatggggaaggtaagaaaggatatcccccagtggcagcccagcaagggctggcacgattggcagcaggtcccgttctgcagccaccacttccatgagctcatcatgaaggacggaaggaagctggtggtgccctgtaggccccaggacgagctgatcggccgggcccgcatctcccagggtgccggctggagcctccgggagaccgcctgcctgggcaaggcctacgcccagatgtggtccctgatgtacttccatagacgcgacctccgcctggcgagcaacgctatctgctccgccgtcccggtgcactgggtgccgaccagccgcactacctggtcgatccacgctcaccaccagtggatgaccaccgaggacatgctgaccgtctggaaccgggtatggattgaggacaacccatggatggaggacaaaaccccggtgaccacctgggagaacgtcccttacctcgggaagcgagaggaccaatggtgcggcagccttatcgggctaacttcaagagccacttgggcccagaacatcccgaccgccatccagcaggtccgctccctcatcggcaacgaggagttcctggattacatgcccagcatgaagcggttccgcaaggaagaggagtccgagggggcaatctggtga

SEQ ID NO: 26039 - RNA, 9873 nt, synthetic construct
  misc_feature 1..9873: note = derived and/or modified CDS sequence (opt11) from DENV-3__FJ850096__SS-prME
  source 1..9873: mol_type = other RNA
acgagcctttgcctcatgatgatcctgcctgccgccctggcatttcacttgaccagccgggacggggagccacggatgatcgtcgggaagaacgagcggggcaagagcctgctgttcaagactgccagcggaatcaacatgtgcaccttgatcgcgatggacctgggagagatgtgcgacgacacagtgacctacaagtgcccccatataaccgaggtcgagcccgaagacatcgactgctggtgcaatttgacaagcacctgggtcacctacgggacgtgcaaccaagcaggcgaacatcggcgcgacaaaagatccgttgctttggcgccccatgtgggaatggggctggacacaaggacccagacctggatgagcgccgagggcgcatggagacaggtcgaaaaggtggaaacgtgggccctgagacatccggggttcaccatcctcgccctgttcctggcccactatattggcacctccctgacacagaaggttgtcatattcattctgctaatgctcgtgacgcccagtatgaccatgcggtgtgtgggggtgggcaatcgagacttcgtcgaaggcctttcgggggctacttgggtggacgtcgtattggaacacggggggtgcgttacaacaatggccaaaaacaagcccaccctcgacatcgagcttcagaagacagaagccacccagttagcgacgctacgaaagctttgcatcgagggcaagattaccaacatcaccacagacagccgctgccctacgcagggcgaggcagtgcttccggaggagcaggaccagaactacgtctgtaagcacacctatgtggatagagggtggggcaacggctgcggcctcttcgggaagggctccctggtgacctgcgcgaagttccagtgtctggaacccatcgagggtaaggtcgtgcaatacgagaacctaaagtacaccgtcatcatcacggtccacaccggcgaccagcaccaggttggcaacgagacccagggtgtcactgcagagataacgccgcaggctagcaccactgaggctatcctgcccgagtacggtaccctgggacttgagtgctctccgcgcaccggcttagactttaatgagatgatcttactcacaatgaaaaacaaggcctggatggttcacagacaatggttctttgacctgccccttccctggaccagcggtgcaaccactgagacgcccacgtggaaccgcaaggagctcctggtgaccttcaagaatgcccacgccaaaaagcaggaggttgtggtactcggttcccaagagggcgctatgcacaccgctctgactggggccaccgaaatccagaatagcggcgggacgtccatcttcgccggccatctgaagtgccggctgaagatggacaagctcgaactcaagggcatgtcctacgccatgtgcaccaacacgttcgtcctgaagaaggaggtttccgagacccagcatgggacgatcttaatcaaggtggagtacaagggcgaagacgtcccctgcaaaatccccttcagcacagaagatgggcagggtaaagcgcacaatggacgcctgatcacggcgaaccccgttgtgaccaagaaggaggagcccgtcaacatcgaggccgagccgcccttcggcgagagtaacatcgtgatcggcatcggcgacaatgctctcaaaataaactggtacaagaaaggcagcagcattgggaagatgttcgaagcgaccgccagaggcgccaggcgcatggccatcctcggcgacacagcgtgggacttcgggtctgtgggcggggtgctcaattcgctgggcaagatggtgcatcagatcttcggttctgcatacaccgccctgttcagcggcgtgtcctgggtaatgaagataggcatcggtctcctgttgacctggatcggcctgaacagcaagaacacctccatgagcttctcctgcatcgccatcggaatcatcaccctgtacctcggcgcagttgtgcaggcggacatgggatgcgtcatcaactggaaggggaaggagctcaagtgcggctccgggatcttcgtgacgaatgaggtgcacacttggacggaacagtacaaattccaggcggactcccccaagcgcttagccaccgcgatcgccggggcgtgggagaatggagtctgtgggatcagaagcacgacccgtatggagaatttactctggaagcagatcgctaacgaactgaattacatactgtgggagaataacataaagctcaccgtggtggttggggacatcataggcgtgctggagcagggtaagcgcactctgacgccccagccgatggagctcaaatatagttggaagacctgggggaaggccaagattgttactgccgaaacccagaactcgtcattcatcatcgacggccccaacacgcccgagtgccccagcgcctctcgggcgtggaacgtgtgggaggtggaggactatgggttcggcgtatttactacaaacatctggctcaaactgagggaagtctacacacagctctgcgaccaccggctgatgagtgccgctgtgaaggacgagcgcgccgtgcatgccgacatggggtactggattgagagccagaagaacggatcatggaaacttgagaaggcttccctcatcgaggtcaaaacgtgcacctggccgaagtcacacaccctgtggagcaacggcgtgctagagagtgacatgatcatccccaagagcctagccgggcccatctcccaacataactaccggccgggctatcacacccaaaccgccgggccgtggcacctggggaagctggagctcgacttcaactactgcgagggcacgacggtggtcatcaccgagaactgcggtacacgcggcccaagcttgcggacgaccacggtatcagggaaactaatccacgaatggtgctgccgcagctgcaccttaccgcccctgcggtacatgggtgaggacgggtgctggtacggcatggagatccgccccatcagcgagaaggaggagaatatggtcaagagcctggtctccgccggcagcggggaggtggacaacttcacgatgggcgtgctctgccttgcaatcctgttcgaagaggtaatgagaggtaaattcgggaagaagcacatgatcgccggggtgttcttcaccttcgtgcttctgctgtccgggcagatcacctggcgcgacatggctcataccctcatcatgatcggtagcaacgcctccgaccggatggggatgggcgtcacgtacctggccctcatcgcaacctttaagattcagccattcctcgcactggggttcttcctgcgcaagctgacctcccgggagaacctcctactcggggtgggccttgctatggccacgacgctgcaactgcctgaggatatcgagcagatggctaacgggatcgcgctgggcctgatggcccttaagctgatcacccagttcgaaacctatcaactgtggaccgccctgatatctcttacgtgtagtaacacgatcttcaccctcacggtggcttggcgcactgccaccttgatcctggcgggtgtgagccttctccccgtgtgccagtccagttccatgcgcaagacagattggctgcccatgacggtggccgccatgggtgtaccaccactccccctcttcatcttctccctgaaggacacgctgaagcgccgctcctggcctctcaatgaaggggtgatggcggtcggcctggtgagtatccttgcctccagcctcctgcggaacgatgttcccatggcggggcccctggtcgccgggggactcctgatagcctgctacgtgataactgggacctccgccgacctgacagtggagaaggccgctgacgtcacgtgggaggaagaggccgaacagaccggcgtcagtcataacttgatgatcactgtggacgacgacgggaccatgcgcatcaaagacgacgaaaccgagaatatcctaaccgtcctgctcaagactgccctgctgatagtgtccggcatctttccgtatagcatccccgccaccctcctggtgtggcatacctggcagaagcagacgcagaggtccggcgtcctgtgggatgttcccagcccgcccgagacacagaaggcggagctcgaggagggtgtttacaggatcaagcaacagggcatctttgggaagacccaggtaggcgtgggagtgcagaaggagggtgtattccacaccatgtggcatgtgacgcggggcgccgtgctgacctacaacgggaaacgactggagcccaactgggccagtgtaaagaaagacctaatcagctacggcggcggttggcggctgtccgcccaatggcagaagggagaggaagttcaggtgatcgccgtcgaaccgggtaaaaaccccaagaatttccagactatgccgggcaccttccagactaccaccggggagattggagcgatcgccctggatttcaagcccgggaccagtggaagtcccatcatcaatcgcgagggtaaggtggtcgggctgtacggcaacggggtcgtgacgaagaacggcgggtacgtatccggcatcgcccaaaccaacgctgaaccggatggccccacccccgaattggaggaggagatgttcaagaagcggaacctgaccatcatggacctgcaccccgggagtgggaaaacgcgcaaatacctcccggccatcgtccgggaagcgatcaagcgaagactgcgcacgttaattctcgcacctactcgggtagtggccgctgagatggaggaggcactgaaggggctgcccatccgctaccagaccacggcgaccaagtccgagcacacaggccgggagatcgtcgacttaatgtgccatgcaaccttcacgatgcgccttctgagccccgtgcgggtgccaaattacaacctcattatcatggatgaggcccacttcaccgacccggcctcaattgccgcacgtgggtacatcagcactcgggtcggcatgggcgaggccgccgcaatcttcatgacggcgacgccgcccgggacagcggacgcctttccgcagtccaacgcccccatacaagacgaggaaagagacatccccgagcgaagctggaacagtggcaacgagtggatcaccgacttcacgggtaagaccgtgtggttcgtaccgagcataaaagccggtaatgacatcgcgaactgcctccggaagaacgggaaaaaagttattcagctgtcgaggaagaccttcgacaccgagtaccaaaaaaccaagcttaacgactgggacttcgtggtgacgacggatataagcgagatgggcgccaatttcaaagccgaccgggtcatcgacccgcgcagatgcctgaagccagtaatcttaaccgacggccccgagagggtcatcctcgctgggccgatgccggtcaccgccgcttcagcagcccagaggcggggtcgcgtgggccgaaacccccagaaggagaatgaccaatacatcttcaccggccagcctctgaataacgacgaggaccacgcgcactggaccgaggccaagatgctgctcgataacataaacacccccgaggggatcattccggcgttgttcgagcccgagcgtgagaagtcggctgcgatcgacggcgagtatcgcctgaagggcgagtctcggaagacctttgtggagctaatgcggcgcggggacctgcccgtctggctggcccacaaggtggcgagcgagggcatcaaatacaccgatcggaagtggtgcttcgacgggcagcgcaacaaccagatcctcgaggaaaacatggacgtcgagatctggaccaaagagggcgagaagaagaagttgcgcccccgctggctggacgccagaacctactccgaccctctcgccctcaaggagttcaaggacttcgccgccggccgcaagtctatcgcactggacctcgtgacagagatagggcgggtaccctcccacctggcccacaggacgcggaatgccctggacaacttagttatgctgcatacatcggagcacggcgggaaggcctaccgtcatgcggttgaggagctgcctgagaccatggagactctcctgcttctgggcttgatgatcctgctcaccggtggcgcgatgctattcctgatcagcgggaaggggatcggcaagacgtccatcgggttaatctgtgtgatagccagctccggtatgctgtggatggccgagatcccgttgcagtggatcgccagcgcgatagtcctcgagtttttcatgatggttttactgatacccgaacccgagaagcagcggacgccccaggacaatcagctcgcgtacgtggtcatcgggatcctgaccctggcagccataatcgccgccaatgagatgggcctgttagagaccacgaagcgcgacctaggtatgtctaaggagcccggggtggtgagccccacctcctaccttgacgtcgacctgcacccagcaagcgcctggaccctttacgccgttgccaccacggttatcacccccatgctgcgacacacaatcgagaactccactgcgaacgttagcctggccgccatagccaaccaggcagtggtgctgatgggcttagacaaggggtggccgatcagtaaaatggacctgggggtgcccttgctcgcgctggggtgctacagccaggtaaatcccctcacgctcaccgccgccgttcttctgctcatcacccactatgcgatcatcggccccggcctgcaggccaaggcgactcgcgaggcccaaaagcggacggcggccggcattatgaagaacccgacagtcgacggcataatgaccatcgatctggaccccgtcatatacgactcaaaattcgagaagcagctcggccaggtgatgctgctggtcctctgcgccgtgcagctactcctgatgcgcacaagctgggccctatgcgaagcgctgacgcttgcaaccggccccatcacgacactttgggaggggtcccccgggaagttctggaacactaccatcgccgtgagcatggcgaacatcttccggggctcatacctggccggggctggcctcgccttcagcatcatgaagtccgtggggaccgggaagcgcggcaccggcagccagggtgagactctgggggagaaatggaaaaagaaactgaaccaactaagtcgtaaggagttcgacctttataaaaaatccggcatcacggaggtggaccggaccgaagctaaagaggggttaaagcggggcgagataacccaccacgccgtgagccgcggctccgctaaactccagtggttcgtcgaacggaacatggttataccggaggggcgagttatcgatctgggctgtggtcggggcgggtggtcgtactactgcgccggccttaagaaggtcacggaggtcagaggttacacgaagggcggccccggacacgaggagccggtgcccatgtcaacctacggatggaacatcgtcaaactcatgtctggcaaggacgtgttctaccttccgccagagaagtgtgacacgctattgtgtgacatcggcgagtccagcccctcccccaccgtagaggagtctcggacaatccgggtccttaagatggtagagccgtggctgaaaaacaaccagttctgcatcaaggtgctgaacccgtacatgcccaccgtcatcgagcacctagagcgactgcagcggaagcacggcggtatgctggtgcggaatcccctgtccagaaacagtacccacgaaatgtactggatctccaacggcaccgggaatatcgtggcctcggtcaacatggtgtcccgcctgctactcaaccggttcacgatgacccataggcgaccgaccatcgagaaagacgtcgacctgggtgccggcacccgccacgtcaacgcggagcccgagacgcccaacatggatgtgattggggagcggattaaacgcataaaggaggaacataacagcacgtggcactatgatgacgagaacccgtacaagacctgggcctaccacggctcctacgaggtgaaggccaccgggagcgcctcctcaatgatcaacggcgtcgttaagttactcacgaaaccctgggatgtcgtgcccatggttacccagatggccatgacggacaccacgcccttcgggcagcagcgggtcttcaaggaaaaggtggacaccaggacacctcggagtatgcccggcactcgcagagtgatggggatcacggctgagtggttatggcgcaccttagggcggaacaagaagccccgtctctgcacgagggaggaattcacaaagaaagtcagaacgaatgccgccatgggcgctgtctttaccgaggagaaccagtgggattccgccaaagccgcagtggaggacgaagacttttggaagcttgtcgaccgcgaacgcgaactgcataaactggggaagtgtggaagctgcgtgtacaacatgatggggaaacgcgagaaaaagctcggcgagttcgggaaagccaagggttcccgggccatctggtacatgtggctgggggcacgctacctcgagtttgaagctctggggttcctgaacgaggaccactggttcagcagggaaaacagttactcaggcgtggagggggagggactccataagctcggttatatcctgcgcgacatctccaagatacccgggggcgcaatgtacgctgacgacaccgcggggtgggacactcggatcactgaggacgacctgcacaatgaggagaagatcacccagcagatggacccagagcatcgccagcttgcgaacgccatctttaagttaacctaccagaacaaggtcgtcaaggtgcagagacctaccccgaccgggaccgtcatggacattatcagccgcaaggaccagcggggcagtggccaggtgggcacgtacggtctcaacaccttcacgaacatggaggcccagctgatccgccagatggagggtgaaggggtgttgtcaaaagccgatctcgagaacccccatctccccgagaagaagatcacgcagtggctggagacgaagggcgtcgagcgattgaagcgcatggccatctccggcgacgactgcgtggtcaagcccatagacgaccgtttcgccaacgccctgctggccctcaacgacatgggtaaggtccgcaaagacatcccccagtggcagccatcaaagggctggcacgactggcagcaggtaccgttctgctcccaccacttccacgagcttatcatgaaagacgggcggaagttagtagtcccctgccgcccccaagacgaactcatcggccgcgccagaatcagccagggggccggatggtccctgcgggagacggcgtgtctgggcaaggcctacgcccagatgtggagcctcatgtacttccaccgccgcgatctgcgactggcctcaaacgcaatatgtagtgccgtgccggtgcactgggtcccaacttcccgcaccacctggagcatccacgcccaccatcagtggatgaccaccgaagacatgctaacggtgtggaaccgggtgtggattgaggacaacccttggatggaagacaagacccccgtaaccacctgggagaacgtgccctacctggggaagcgagaggaccagtggtgcggcagcctgatcggattaacgtccagggcgacctgggcccaaaatatcccgaccgccatccagcaggtccgctcactgatcggcaacgaggagttcctggactacatgccatcaatgaagcggtttcgcaaggaagaggaaagcgagggcgccatttggtga

SEQ ID NO: 26040 - RNA, 9873 nt, synthetic construct
  misc_feature 1..9873: note = derived and/or modified CDS sequence (opt11) from DENV-3__FJ882578__SS-prME
  source 1..9873: mol_type = other RNA
acctcgctatgcctaatgatgatcttacctgcggcactggctttccacctaaccagccgggacggggaacccagaatgatcgtgggcaaaaacgaacgaggtaaatccttgctgtttaaaaccgcaagcggcatcaacatgtgcactttaatagcaatggacttgggagaaatgtgtgatgacacagtgacgtacaaatgtccgcacataacggaagtagaaccggaagacatcgactgctggtgtaatcttacaagcacgtgggtaacatacggaacgtgtaatcaagcgggcgaacaccgccgcgacaaacggtcagttgcactagcaccccacgtgggcatgggattagatacacgcacccaaacctggatgagcgcagaaggagcatggcgacaagttgaaaaagtcgaaacctgggccctacggcacccgggatttacaatactggcgctgttcctagcgcactatattggcacgtcgctgacgcaaaaagttgtaatcttcatactgcttatgttggtgaccccgtccatgacgatgcgctgtgtcggagtgggcaaccgcgatttcgtagaaggcctatcaggggccacatgggtcgatgtcgtcctagaacacggtggatgcgttacgaccatggccaaaaacaaaccaacactcgacatcgaactacagaaaacggaagctacgcaactagccacactcagaaaactatgcatcgaaggcaaaataacgaacataacaaccgactcgaggtgccccacccagggtgaagctgtgctcccagaagaacaagatcaaaactatgtatgcaaacacacatacgtcgacagaggttggggaaacggttgcggcctattcggcaaaggcagtctggtcacctgtgccaagttccagtgcctagaacccatagaaggtaaggtggtgcaatacgaaaacctcaagtacaccgtcattatcacggtacataccggagaccaacaccaagttggaaatgaaacccaaggcgtaacagctgaaattacaccccaggcctccactacggaagcaattctccccgaatacgggacgctcggattggagtgcagtccgcgcaccggcctggacttcaacgagatgattctcttgaccatgaagaacaaggcctggatggtccaccgacaatggttctttgacctacccctcccatggacctccggggccacgactgaaacaccgacctggaacagaaaagaactattggtaacttttaaaaacgctcacgccaagaaacaggaagtggtcgtactgggtagccaggagggcgccatgcacaccgcacttaccggcgcgacagaaatacagaactcagggggtactagcatattcgcgggccacctcaaatgtcgcctaaaaatggataaacttgaactaaaaggcatgagctatgcgatgtgcacaaacacgtttgtcctcaagaaagaagtgtccgagacccagcatggcacgatactgatcaaggtagagtacaagggagaagacgtcccatgcaaaataccattcagtactgaggatggccaaggtaaggcacacaatggacgcctgatcaccgccaacccagtggtaacaaagaaagaagaaccggtgaatattgaggcggaaccacccttcggagagagtaacatcgtcattggaatcggagataacgcattaaaaatcaattggtacaaaaagggatcgtccatcggaaaaatgtttgaagcaaccgcgcgaggggcccggcgcatggccattctcggggacacagcctgggacttcggttccgtaggaggtgtactcaacagtctcgggaaaatggtacaccagatctttggatcagcatacaccgctctattctcgggggttagctgggtcatgaagatagggataggagtactgttgacatggattggactaaattctaaaaacacaagcatgagcttttcttgcatcgcaatcgggattataacactatacctaggcgccgtagtacaagcggacatggggtgcgtaatcaactggaaggggaaggaactcaaatgcggcagcgggatcttcgtaactaacgaagtgcatacatggaccgaacagtataaattccaagcagattcgcccaaacgactcgcaaccgcgatagcgggagcttgggaaaacggagtgtgcggcattcggagtacgacaagaatggagaacctattgtggaaacagatcgccaacgaactcaactacatactctgggaaaataatatcaaacttacagtcgttgtcggagacaccataggtgtattggagcaaggaaaacgcatacttacgccccaaccaatggagctgaaatattcctggaaaacatgggggaaagcgaagatcgtgactgcggagacccaaaactcatcatttatcatcgatgggccgaacacacccgaatgcccctcagcgtcccgcgcctggaatgtatgggaggttgaggactatggtttcggcgtattcacaacgaatatatggctgaaactacgggaggtctacacgcagctctgcgaccaccggttaatgtccgcggccgtcaaagacgaaagggctgtccatgcagacatgggatactggatagaaagccagaaaaacgggagttggaaactggaaaaggccagcttaattgaagtaaaaacctgcacctggcctaagtcacacacgttatggagcaacggcgtgctagagagcgacatgatcatccccaaatcactagccgggcccatctcgcaacacaattacagaccaggatatcacacccagacggccggcccgtggcatctcggaaagctagagcttgatttcaactactgtgaagggactaccgtagttattaccgaaaattgcggaacgcggggtccatccctacgcacaactacagtgagtggaaaactaatccacgaatggtgttgtagaagctgcaccctaccaccattacgttacatgggtgaagacggttgctggtacggaatggaaatccgcccaatatcggaaaaggaagagaacatggtcaagagcctggtcagcgccggaagcggagaagtagataatttcacgatgggagtactttgtcttgcgatcctgttcgaagaagtaatgcgagggaaattcggcaaaaagcatatgatcgcgggggtgttcttcacgttcgtcctactgttatcaggccagataacctggcgtgacatggcacacacactcatcatgataggctcaaatgcgagtgacagaatgggtatgggagtaacgtacctggcgctcatcgccacctttaaaatccaacctttcctggccctggggttctttcttcgaaaactaacgagccgagagaacctactccttggagtcggacttgccatggcaaccaccttacaactaccggaagacatagaacaaatggcgaatggtatagcgctcggtctcatggccctcaaacttatcacacaattcgagacataccagctttggacggccctcatctcgctcacttgcagcaacacaatttttaccctaacggtcgcatggcgcacggcgacattaatactcgcgggcgtcagccttttacccgtgtgtcagtcctcctctatgcgtaagaccgattggcttcctatgaccgtagccgccatgggtgtcccacccctaccgctattcatcttttccctcaaggacacactcaaaaggcgtagctggcctctgaatgaaggagtaatggccgtcgggctcgtcagcatcttggctagctcactgctccgtaacgacgtccctatggccgggcccctagtcgccggcggacttctaatcgcatgctacgtgataacggggaccagcgccgacttaacggtcgagaaagcagccgacgtaacctgggaggaagaagccgaacaaacaggagtctcacacaatctaatgataacagtagatgatgacggaactatgagaataaaagacgacgaaaccgagaacatactgactgtccttctgaaaaccgcgctcttgattgtgtcaggaattttcccatattcgatcccagcaactctcctagtctggcacacctggcagaagcagacccaacggtcaggggtgctatgggatgttccgagtccgcccgagacgcagaaggctgagttggaggagggagtgtacagaataaaacagcagggcatattcggaaagacgcaggtcggcgtcggagtccaaaaagagggcgttttccacacgatgtggcacgttactaggggagccgtcctaacttataacggcaaacggctcgaacccaactgggccagtgtcaagaaagacctgatatcttatggaggcggctggcggttatcggcccagtggcaaaagggcgaagaagtacaggtcatcgcggttgagcccgggaaaaaccccaagaatttccagacgatgcccggaacatttcagaccacgaccggcgaaatcggggcaatagccctggacttcaaacccggaacatcagggtccccaataatcaaccgcgaaggcaaggtcgtcgggctatacggcaacggcgtcgtaacgaagaatggtgggtacgtctcaggaattgcccaaaccaacgcggaaccagatgggcccactccagagttggaagaagaaatgttcaagaaacgcaacctaacaataatggacctacaccccggctctgggaaaaccagaaaatacctgccagccattgtacgcgaggccatcaaacgtaggctgcgcactctcatactggcgccgacgagagtagtggccgctgaaatggaagaggcgctaaagggactaccgatcagatatcaaacgaccgccacgaagtccgagcacaccggaagagagatagtcgacctcatgtgccacgcaaccttcactatgcggctattgtcccccgtacgagtccctaactacaatctcatcataatggacgaagcacatttcacagaccctgcatcaatcgcggcacgggggtacatatcgacacgcgtcgggatgggggaggcggccgcgatcttcatgaccgcaacgcccccgggaacagcagacgctttccctcaatccaacgcacccatccaggacgaggaacgcgacatcccggaacgtagctggaactccggcaacgaatggataacagacttcgcaggtaaaacggtgtggttcgtaccgagcatcaaggccggaaacgatatcgcgaactgcttacgcaaaaacggcaagaaagtaatacaactctcgagaaagaccttcgacactgagtatcaaaagacaaagctcaacgattgggacttcgtggtgactacagacatctcggagatgggagccaatttcaaagcagacagagtgattgaccctcgaaggtgtttaaaaccggtcatcttaacggatggaccagagcgagttatcttagccggacctatgcccgtaaccgcagcaagcgccgcccagcgcagggggcgggtaggacggaacccgcaaaaagagaacgatcagtacatatttaccggacaaccactaaacaacgatgaagaccacgctcattggacagaagccaaaatgctccttgacaacataaatacccccgaagggatcatccccgccctctttgagccagaacgagagaaatctgcagccatcgacggggaatatcgattaaaaggcgaatcccgaaaaacattcgtcgaactcatgaggcgaggagatctgcccgtatggctggcgcacaaggtggccagcgagggcatcaaatacacagacagaaagtggtgcttcgatggacagaggaacaaccaaatactcgaagaaaacatggacgtagaaatatggaccaaagagggtgagaaaaagaaactgagaccgcggtggctagatgcgcgcacctacagcgacccgctcgccctcaaagaatttaaagacttcgcagcaggtcgaaagagcatcgcgctcgacctagtaactgaaatcggccgggttccgacacacctcgcacacaggacaaggaacgctctagacaacttagtcatgctacacacatcggaacacggcggaaaagcatacagacacgcagtcgaagaattaccagaaaccatggagaccctgctattgcttggtctcatgattctcctgacgggaggggcaatgttgttcttgatcagtggaaaaggtataggtaaaacaagcattggactgatctgcgtgattgcaagttccggcatgctttggatggcggagattcccctacagtggattgccagcgcaatcgtgctagaatttttcatgatggtactgttaatcccagaaccagaaaaacaacgaaccccacaagacaatcagctagcttatgttgtcataggcatcttaacattagccgcaatcattgccgctaacgagatgggccttttggagaccacgaagcgtgacctcggtatgagtaaagaaccaggggtggtctcccccacatcctacctggatgtagacctccatccagcctccgcgtggacactatatgcggtagccacaactgtcataacacccatgctccggcatacgatcgagaacagcaccgcaaacgtgtcattggcagccatcgcaaaccaagcagttgttctaatgggacttgataaaggctggccaatatcgaaaatggacctaggagtacccctactagcgctaggatgctactcacaggtcaacccacttactctcactgccgccgtactgctactgattacccactacgcaatcataggcccgggtctacaagccaaagccacacgagaggcacagaaaagaacagcagcaggtatcatgaagaaccctacagtggacggaataatgacgatcgacctcgacccggtgatatatgatagcaaatttgaaaaacaactcggccaggttatgctgctggtactatgtgccgtgcaattactcctcatgcgcacctcgtgggcgctatgcgaagcgctaacactggccacggggcccatcacaacactgtgggagggaagcccggggaaattctggaacacgacgatcgcagtcagcatggctaacatatttcgtggaagctatctcgcaggggcgggactcgcgttctccataatgaaatcagtcggaacgggaaagagagggacgggatcgcaaggcgagacactaggggagaagtggaagaaaaagttaaaccaattgagtaggaaagaatttgatctgtacaagaagtcgggtatcaccgaagtagatagaacggaggcaaaagagggcctcaaacggggagagatcacacatcatgctgtcagccgtggcagtgcaaaactccagtggttcgtcgaacgaaacatggtcataccggagggccgcgtaatcgacctaggatgcggccgcggaggatggagctactactgcgccggcctcaaaaaggtcacagaagtacgaggctacacaaaaggtggacccggacatgaagaaccagtgccaatgagcacgtacggttggaacatcgttaaactgatgtcaggcaaagatgtcttttacttgccacccgaaaaatgcgacaccctgctgtgcgacataggtgagtctagtccatccccgacagttgaagaaagcaggacaatcagggtactcaaaatggtcgagccttggctgaaaaataatcaattctgtatcaaagtgttaaacccgtacatgcccacagtaatcgaacacctggaacgactgcagagaaaacatgggggcatgctagtccggaatcccttaagccgcaacagcactcacgaaatgtactggataagcaacggtaccggaaacatcgtggccagcgttaacatggtctccagactactcttaaatcgtttcacgatgacgcacagacgacctactatagaaaaggacgtggacctcggagccggcacgcgccacgtgaacgcggaaccagaaaccccgaacatggacgtaatcggggaacggatcaagcggattaaggaggagcacaattccacatggcactacgacgatgaaaatccgtacaaaacttgggcataccacggttcctacgaagtgaaagcaacgggatcggcatcatctatgatcaacggtgtagtcaaactactcaccaaaccatgggatgtggtccccatggtaacacagatggcgatgaccgacaccacgccattcggacagcaacgcgtattcaaggaaaaagtagacaccaggacgccgagaagcatgcccgggacccgacgagtaatggggataacagcggaatggctctggcgcacgctcggacgtaacaagaaacccagactctgtacccgggaggagttcactaagaaggtcagaaccaacgccgcgatgggagccgtcttcacggaggaaaaccagtgggattcagccaaagcagcagtcgaggacgaagatttctggaagctagtcgatcgggaaagagagctccacaaactaggtaagtgtggaagctgcgtttacaacatgatgggaaagagagagaaaaagctgggggagttcggtaaagccaaaggcagtcgagccatctggtacatgtggctgggagccagatacctagagttcgaagcactcggtttcttaaacgaagatcactggttctcaagagagaatagttatagcggagttgagggggaggggctacacaaactcggatatatactgagggacatctcaaagattccagggggagccatgtacgccgacgacacagcgggatgggacacaagaataacagaagatgacttacacaacgaagagaaaatcacccagcaaatggaccctgaacatcgacaactagcgaatgcgatattcaaactaacttaccaaaacaaggttgtcaaagtgcaacggcccacgccgactgggacagtcatggacatcatttcacggaaagatcaacgcggctcgggccaggtagggacatacggactcaacacgtttacaaacatggaagctcaactcatacgtcagatggaaggcgagggggtgcttagcaaggcagacctagaaaacccgcatttgccagagaagaaaattacacaatggctggaaacaaaaggtgtagagcgtctgaaacgaatggcaatcagcggcgacgactgcgtggtaaagcccatagatgacagattcgcaaacgccctgctcgcgctaaatgatatgggtaaagttcgcaaggacattccgcaatggcaaccaagcaaaggctggcatgactggcaacaagtcccgttttgcagccaccactttcatgaactaatcatgaaggatggaaggaaactcgtcgtcccctgccgcccacaagacgaactcattggacgagccaggatctctcaaggggcagggtggagtctaagggaaacagcgtgcctggggaaggcatacgcccagatgtggtctctgatgtacttccatcggcgcgacctcagactggcctcaaacgccatatgctccgctgtgccagtccactgggtacccaccagccgtacgacctggagcattcacgcccaccaccagtggatgacgacagaagacatgctcacagtctggaaccgagtctggatcgaggacaacccatggatggaagacaaaaccccagtcacaacgtgggaaaacgtaccgtacctgggaaagagagaagatcagtggtgtggcagcttaatcggactaacctcgcgtgcaacctgggcacaaaatatacccactgcaatccagcaagtacgaagccttataggtaatgaggagttcttagactatatgcccagcatgaagcggttcagaaaggaagaagaatccgaaggtgcgatctggtag

SEQ ID NO: 26041 - RNA, 9873 nt, synthetic construct
  misc_feature 1..9873: note = derived and/or modified CDS sequence (opt11) from DENV-3__FJ639770__SS-prME
  source 1..9873: mol_type = other RNA
accagcctgtgcctcatgatgatcctgcccgccgccctggcgttccacctcactagccgggacggcgagccccggatgattgtggggaagaacgagcgcggcaagagcctgctgttcaagactgccagcgggatcaatatgtgcacccttatcgccatggatctgggcgagatgtgcgacgacaccgtgacctacaagtgcccccacatcacggaggttgagcccgaggatatcgactgctggtgcaacctgaccagcacctgggtaacctacgggacgtgcaaccaagccggcgagcaccggcgcgataagagatccgtggccctcgccccccatgtgggcatggggttagacacccgcacccagacctggatgagcgccgagggcgcttggcggcaggtcgagaaggtcgagacgtgggccctgcgccaccccgggttcaccatcctcgcgctgtttctggcacactacatcggcacctccctcacacagaaggtagtgattttcatcttgctgatgctcgtcacgcctagcatgaccatgcggtgtgtcggtgtgggcaatcgagacttcgtcgagggtctttccggggccacctgggtggacgtggtcctggagcacggggggtgtgtgacaacgatggcaaagaacaaacccaccctcgacatcgagctgcagaagaccgaggccacccaactggcgacgctccggaagctgtgcattgaggggaagatcaccaatatcaccaccgacagccgctgccccacgcagggcgaggccgtgcttcccgaggagcaagaccaaaactatgtctgcaagcacacctacgtggaccgggggtggggcaacgggtgcggcctcttcgggaagggctccctggtgacctgcgccaagttccagtgcctggagcccatcgagggcaaagtcgtgcagtacgagaacctcaaatacaccgtgatcatcacggtccacaccggggatcagcatcaggtgggcaatgaaacccagggggttaccgccgagatcacaccccaggccagcacgactgaggcgatcctgcccgagtacggcaccctggggctcgagtgctccccgcgcaccggcctggacttcaacgaaatgatcctgcttacgatgaaaaacaaagcctggatggttcacaggcagtggttcttcgacctgcccctgccatggaccagcggggccaccaccgagacgcccacctggaaccgaaaggagctgctggtgacattcaagaacgctcatgcgaagaaacaggaggtcgtagtgctgggatcgcaggagggagcaatgcacacggccttaacgggggccaccgagatacagaacagcggcgggacctccattttcgccggccacctgaaatgccggctcaagatggacaagctcgagctaaagggcatgtcctacgccatgtgcaccaacacgttcgtcctgaagaaggaggtttccgagacccagcacgggaccatccttatcaaggtagagtacaagggcgaagacgtcccgtgtaaaatccccttcagcaccgaggatgggcagggcaaggcccacaacggccgtctaatcacggccaaccccgtggtgaccaagaaggaggagcccgtcaacatcgaggccgagccgcccttcggggagagcaacatcgtgattggcataggggacaacgccctgaagatcaactggtacaagaagggctccagcatcgggaagatgtttgaggcgaccgcccggggcgcccgccggatggcgattttaggcgacacagcctgggacttcgggagtgtgggcggggtcctcaacagcttaggcaagatggtgcaccagatctttgggtccgcgtacacggccctgttcagcggagtgtcctgggtcatgaagataggcatcggggtgctcctaacctggattgggctgaactctaagaatacatccatgagcttctcctgcatcgcgatagggatcatcaccctctacctgggcgccgtggtccaagccgacatggggtgcgtgatcaactggaagggcaaggagctgaagtgcggaagcgggattttcgtgacaaacgaggtccacacctggaccgagcagtacaagttccaggcggactcccccaagaggttggccacagccatcgccggcgcctgggagaacggggtgtgtggtatcaggagcacgacccggatggagaacctgctgtggaagcagatcgcgaacgagctcaactacatcttatgggagaataacatcaagctgaccgtggtcgtgggggacgtgatcggcgtcctcgagcagggcaagcgcacgctgacgctccagcccatggagctcaagtactcctggaagacttgggggaaggccaagatcgtgaccgctgagacccagaacagctccttcatcattgacggcccgaacacgcccgagtgcccctctgcgtccagagcgtggaacgtgtgggaggtcgaagactacgggttcggcgtgttcaccaccaacatctggctgaagctgcgggaggtctacacacaactctgtgatcaccggctgatgagcgccgccgtaaaggacgagcgagccgtgcacgccgacatgggctactggattgagagccagaagaacggctcctggaagctggaaaaggccagcctaatagaagtgaagacctgtacgtggcccaagtcccacaccctgtggagtaacggcgtccttgagtccgacatgataatccccaagtcgctcgccggtcccatatcccagcacaactaccgtcccggctaccacactcagacagccggcccgtggcacctgggcaagctggaactcgacttcaactactgcgagggcacgaccgtggtgatcaccgagaactgcgggacccgtggccccagcctgcggacgaccactgtctctgggaaactgattcacgagtggtgctgccgctcctgcaccctgccccccctccgctatatgggcgaggatgggtgctggtatgggatggagatcaggcctatatccgagaaagaagaaaacatggtcaagagcctggtaagcgccggcagcggcgaggtcgacaacttcacgatgggcgtgctctgcctggccatcctattcgaggaggtcatgcgggggaagtttggcaagaagcacatgatcgcaggggtctttttcaccttcgtgctcctgctgtccggacagatcacctggcgcgacatggcccacacgctcatcatgatcggcagcaacgcctccgaccggatggggatgggcgtgacctatctggccctgatcgccaccttcaaaatccagcccttcctcgcgctggggttcttcctgcgcaagctcaccagccgggagaacctgctgctcggcgtcggcctggccatggccaccacgctgcagctccccgaagacatcgagcagatggccaacgggatcgcgctgggactgatggccctcaagctgatcacacagttcgaaacctaccagctgtggaccgcccttatcagcctgacgtgctccaataccatcttcaccttgaccgtggcctggcgcacggccacgctcatcctggcgggggtcagcctgctccccgtgtgccaatccagctccatgcggaagaccgactggctaccaatgaccgtggccgccatgggcgtgcctcccctgcccctttttatcttctccctgaaggacacgctgaagagacgctcctggccgttgaacgagggtgtaatggcagtgggcctggtctcgatcttagcctccagcctcttacggaacgacgtgcccatggcgggtcccctggtggccggaggcctcctgattgcctgctacgtaatcacgggcacgtccgccgacctgactgtggagaaggcagcggacgtgacttgggaggaggaggctgagcagaccggcgtcagccacaacctcatgatcaccgtggacgacgacgggactatgcgcatcaaggacgacgagactgagaatatcctgacggtgcttctgaagaccgctctgctgatcgtctcaggcatcttcccgtacagcatcccggccaccctcctcgtgtggcacacctggcagaaacagacgcagcggtccggcgtgctgtgggacgtcccctccccgcccgaaacccagaaagcagagctcgaggagggtgtttaccgcatcaagcagcaagggattttcgggaagacgcaggtaggtgtgggggtgcagaaagagggcgtgttccacaccatgtggcacgtcacgcgcggcgcggtgctgacctacaacgggaaacgcctggagccgaactgggcctccgtcaagaaggacctcatcagctacggcgggggctggcgtctgtccgcccagtggcagaaaggggaagaggtccaggtgatcgccgtggagcccggcaagaaccccaagaacttccagaccatgcccggcaccttccagactacgaccggggagatcggcgcgattgccctcgacttcaaaccgggcaccagcggcagcccaatcatcaaccgcgagggcaaggtcgtggggctctacggcaatggggtggtcacgaaaaacggcgggtacgtgtccggcatcgcccagaccaacgctgagcccgacggcccgacccccgagctcgaggaagagatgttcaagaagcggaacctgaccatcatggacctgcatcccgggagtggcaagacgcggaagtacctccccgccatcgtgcgggaggcgatcaaacgccgactgagaaccctcatcctcgccccgacacgggtcgtggccgccgagatggaggaggccctgaaggggctgcccatccgctatcagacgacggcgaccaagtccgagcacaccggccgggagatcgtagacttgatgtgtcacgccactttcacgatgcgcctgctgagccccgtccgggtgcccaactacaacctcatcatcatggacgaggctcattttaccgatccggcctccatcgccgcgcgcgggtacataagcacccgggtagggatgggcgaggccgccgcaatcttcatgaccgcaaccccgcccgggaccgccgacgcgttccctcagtccaacgccccgatccaggacgaggagagggacatccccgagcggagctggaacagcggcaacgagtggatcaccgacttcgccgggaagaccgtctggttcgtgcccagcatcaaggcgggcaatgatatcgccaactgcctgcggaagaacgggaagaaagtgatccagctgtcccgcaaaacgttcgacaccgagtaccagaagacaaagctcaatgattgggacttcgtcgtaaccacggacatcagcgaaatgggcgccaacttcaaagccgaccgggtgatcgacccacgacggtgcctgaagccggtcatcctgaccgacggccccgaacgcgtgatcctcgccgggcccatgcccgtgaccgcggcctccgccgcccagcggcgcggccgggtcggacgcaacccgcagaaggagaacgaccagtacatcttcaccggccagcccctgaacaatgacgaggatcacgcacactggaccgaagcgaagatgctgctcgacaacatcaacacgcccgaggggatcatccccgccctgttcgagccggagcgggagaagtccgccgccattgatggcgaataccgcttgaaaggcgagtcccggaagaccttcgtggagctcatgaggcgcggggacttaccagtttggttggcgcacaaggtcgccagcgaggggatcaagtacaccgaccgcaagtggtgcttcgacgggcagagaaacaaccagatcctcgaggagaacatggatgtggagatctggaccaaggagggcgagaagaagaagttgcgcccccggtggctggacgcccgcacgtactcggatcccctcgctctgaaagagttcaaggacttcgccgcgggccgcaagagcatcgccctggacctcgtcaccgagatcggccgggtgccgtcccatctagcccaccgcacccggaacgctctagacaacctcgtcatgctgcatacctccgagcacggcgggaaggcctacaggcacgcggttgaagagctgcccgagaccatggagaccctcttactgctcggcctgatgatcttgctcacggggggcgccatgttgttccttatttcaggcaaggggatcggcaagacctccatcgggctcatctgcgtgatcgccagctccggcatgttgtggatggccgagatccccctgcagtggatcgcgagcgcgatcgttctggagttcttcatgatggtccttctaatcccggagcccgagaagcagcggaccccccaggacaaccaactcgcctacgtggtgatcgggatcctgaccctggccgccatcatcgccgcgaatgagatgggcctcctggagaccaccaagcgcgacctggggatgtccaaggaacccggggtcgtgtccccgacgtcctacctcgacgtggacctgcaccccgccagcgcctggacactgtacgcagtcgcgacaaccgtaatcacgcccatgctccgccataccatagagaactccaccgctaacgtgagcctggccgccatcgccaaccaagcggtcgtactaatgggcctcgacaaggggtggcccatttccaagatggacctgggcgtgccgctgttggccctggggtgctacagccaggtcaatcccctgaccctcacggctgccgtgctgctgctcatcacccactacgctatcatcggtcccggcctgcaggcgaaagccacacgcgaagcccagaagcggaccgccgccggtatcatgaagaaccccacggtggacggcatcatgaccatcgacctggacccggtcatctacgactccaagttcgagaagcaactcggccaggtgatgctcctggtactctgcgccgtccagcttcttctcatgcgcaccagctgggccctgtgcgaagcactgacactcgccacgggacccatcaccacactgtgggagggctcccctgggaagttctggaataccacgatcgcggtgagcatggccaacattttccggggctcctacctggccggggcaggcctcgctttcagcataatgaagtccgtagggaccggcaagcgcggcactgggagccaaggcgagacccttggggagaagtggaagaagaagctgaaccagctctctcggaaggaattcgacctgtacaaaaaatcaggcatcaccgaggtcgaccggacggaagcgaaagaggggcttaagcggggagagattacccaccacgccgtgagccgcggctccgccaagttgcagtggttcgtagagcggaacatggttatccccgaggggagagtgatcgacctgggttgcgggcggggtgggtggagctactactgtgccggcctgaagaaggtgaccgaggtccgcggctacaccaagggaggcccggggcacgaggagcccgtgcccatgtccacgtacggctggaatatcgtgaagctcatgagcggcaaggacgttttctacctgcccccggaaaagtgcgataccctgttatgcgatatcggcgagtcgagcccctcccccaccgtggaggagtcccggacaatccgcgtgctcaagatggtcgagccctggctgaagaacaaccagttctgcatcaaggtactgaacccgtacatgcccacggtggttgagcacctcgagcgcctgcaacggaagcacggcgggatgctcgtgcgcaacccgctcagccggaatagcacccatgaaatgtactggatctccaacggtaccgggaacatcgtggccagcgtcaacatggtgtcccgcctgcttctcaaccggttcaccatgacccaccgccggcccaccatcgagaaagatgtggacctgggcgcgggtacccgccacgtcaacgccgagccggaaacccccaacatggacgtcatcggggagcggatcaagcgcattaaggaggagcacaacagcacgtggcactacgacgatgaaaacccctacaagacatgggcctaccacggctcctacgaggtcaaggcgacggggagtgcctccagcatgatcaacggtgtggtgaagctgttgaccaagccgtgggacgtcgtgcccatggttacgcagatggcgatgaccgacaccacacccttcgggcaacagcgggttttcaaggagaaggtggacacgcgcaccccccggagcatgccgggcacccgccgggtgatgggcatcactgctgagtggctgtggcgcaccctgggacgaaacaagaagccccgcctctgcacccgggaggagttcaccaaaaaggtccgcaccaacgccgccatgggtgcggtgttcacggaagagaaccagtgggactccgccaaggccgccgtggaggacgaggacttctggaagctcgtggaccgcgagcgggagctgcacaagctcgggaagtgcggctcatgcgtgtacaacatgatggggaagcgcgagaagaagctgggcgagttcggcaaggcaaagggttccagagcgatctggtacatgtggctgggcgcccgctacctcgagttcgaggccctggggtttctgaacgaggaccattggttcagccgggagaactcatacagcggcgtggaaggggagggcttacacaagctcggctacatcctacgcgacatctcgaagatccccggaggcgccatgtacgccgacgacaccgcggggtgggacactcggatcaccgaggacgacctccacaacgaggagaaaatcacgcagcagatggaccccgagcaccgccagctggccaacgctatcttcaagctgacctatcagaacaaggtcgtgaaggttcagcggccgaccccaacaggcactgtcatggacatcatttcccgcaaggaccagcgtggctccgggcaggtggggacatacggactcaacaccttcaccaacatggaggcacagctgatccgccagatggaaggcgagggggtgctgagcaaggccgacctcgagaacccccggctgcccgagaaaaagatcacccagtggctggagacgaagggcgtggagcgcttaaagcggatggcgatttccggcgacgactgcgtcgtgaagccgatcgatgaccgcttcgctaacgccctactggccctcaacgatatgggcaaagtccggaaggacatcccccagtggcagccatccaagggctggcacgactggcagcaggtgcccttctgctcccaccacttccacgagctgatcatgaaggacgggcgcaagctggtggtcccgtgccggccccaggacgagctcataggcagagcccggatcagccagggggcaggctggtccctgcgcgagacagcctgcctgggcaaggcctacgcccagatgtggtcattgatgtatttccaccgccgggacctgcgcctggcgtccaacgccatatgcagcgccgtgcccgtgcactgggtccccacctcccggactacgtggagcatccacgctcaccaccagtggatgaccactgaggacatgctcaccgtgtggaaccgcgtatggatcgaggacaacccttggatggaggacaaaacgcccgtcacgacatgggagaacgtgccctacctggggaaacgggaggaccagtggtgcggcagcctgatcgggctcacgtcccgcgccacgtgggcgcagaacatccccaccgcaatccagcaggtccggagcctgattggcaacgaagaattcctggactacatgccttcgatgaagaggttcaggaaggaggaggagagcgagggggccatctggtga

SEQ ID NO: 26042 - RNA, 9873 nt, synthetic construct
  misc_feature 1..9873: note = derived and/or modified CDS sequence (opt11) from DENV-3__FJ639771__SS-prME
  source 1..9873: mol_type = other RNA
accagcctgtgcttgatgatgattctgcccgccgccctggcttttcacctcacaagccgggacggggagccccggatgatcgtgggcaagaacgagcgcggcaagtctttgctgttcaagacggccagcgggatcaatatgtgcaccctcatcgccatggatctgggggagatgtgcgacgacactgtgacctataagtgcccccacataacggaggtcgagccggaggacatcgattgctggtgcaacctgaccagcacctgggtaacctacgggacgtgtaaccaggccggcgaacaccgtagagacaagcggtccgtggccctcgcgccgcacgtgggcatgggcctggacacccggacacaaacctggatgagcgccgagggcgcgtggcggcaggtcgaaaaggtggagacgtgggccttgcgccacccgggtttcaccattctcgccttattcctggcccactatatcggaacctcactgacccagaaggtggtgatattcatattactgatgcttgttaccccctccatgaccatgcggtgcgtcggggtcggcaaccgcgactttgtcgagggcctgtccggggccacatgggtggacgtggtcttagagcacggcgggtgcgtgaccacgatggccaaaaacaagccgaccctcgatattgagctgcagaagaccgaggccacccagttggcgacgcttcgcaaactgtgtattgagggcaaaattaccaacatcacaaccgatagtaggtgccccacgcagggcgaggccgtgctgccggaggagcaagatcaaaactatgtctgcaaacacacctatgttgaccgggggtggggcaacgggtgtggcctcttcgggaagggctccctcgtgacctgtgccaagtttcagtgcctagaacccatcgagggcaaggtcgtgcagtatgagaacctgaagtacaccgtcatcataactgtccacactggcgaccagcaccaggtgggcaacgagacccagggggtaacagccgaaataactccgcaggccagcactacggaggcgatcctgcccgagtatggcaccctagggttagagtgttccccgcgcaccggcttagacttcaacgagatgatactgctaacgatgaagaacaaggcttggatggtgcatcgccagtggttctttgacctgccgctaccttggaccagcggcgccaccaccgagacgcccacatggaaccgaaaggagctactggtgaccttcaaaaacgcccacgccaagaagcaagaagtagtggtattggggtcccaagagggggcgatgcacaccgccctcacgggagccaccgagatccagaactcaggcggaacctctatctttgccggccacttgaagtgccgactcaaaatggacaaactcgagctgaagggcatgtcttacgccatgtgcacgaacacattcgtactgaagaaagaagtgagcgagacccagcatggcaccatcctcatcaaggtggagtataagggagaggacgtcccgtgcaagatccccttcagcaccgaggatgggcaggggaaggcgcataacggccgcttaatcacggccaaccccgtggtgaccaagaaagaggagcccgtcaatatcgaggctgagccgcccttcggagagtccaatatcgtcatcggcattggcgacaacgcactgaagatcaattggtataagaaaggctcctcaatcgggaagatgtttgaagcgactgcccggggagcccgcagaatggccatactgggcgatacggcctgggacttcggctccgtcggcggcgtactcaacagcctgggcaagatggtgcaccaaatcttcgggtccgcgtacacggccctgttcagcggcgtatcctgggtcatgaaaatcggcatcggagtcctcctgacttggatcggactcaacagtaagaacacctccatgagcttttcctgcatcgccataggcatcattactctctacttaggggccgtggttcaggccgacatggggtgcgtgatcaactggaagggcaaggagctaaagtgcggcagcgggatcttcgtgacgaacgaggtccatacctggaccgagcagtataagttccaggcggacagccccaaacgcctcgcgaccgccatcgctggcgcctgggagaatggggtgtgcggcatcagatcaaccacgcgaatggagaacctattatggaaacagatcgcgaacgagctcaactacatcttaagggaaaataatattaagctcaccgtcgtagtgggggacgtaatcggcgttctcgaacagggcaagcgaaccctgacgccccagccgatggagctaaaatatagttggaagacctgggggaaggccaagatagtgaccgccgagacccagaatagtagtttcatcatcgacggcccgaacactcccgagtgtcccagcgcaagccgcgcgtggaacgtgtgggaagtcgaggactacgggttcggcgttttcaccaccaatatctggctcaaacttcgagaggtgtacacccagctgtgcgaccaccgcttaatgagcgctgccgtgaaggacgagagggccgtgcatgcagacatgggctactggatcgagagccagaagaacgggtcctggaagctcgagaaggcgtcactgatcgaagtgaagacctgcacgtggcctaaatcccataccttatggagcaacggagtcttagagtccgacatgatcatcccaaagagcctggccggacccataagccaacacaattacaggccaggctaccacacccagaccgccgggccctggcatttgggcaagctggagctggacttcaattactgcgagggcaccaccgtggtgattacagagaactgtgggacccggggccccagcttacgaactaccaccgtctccgggaagctgatccacgagtggtgttgcaggagctgcactctgcccccgcttcgctatatgggcgaggacggttgctggtacggcatggagattcgtcccatctccgagaaggaggagaacatggtcaaaagcctggtatctgctggaagcggggaggtcgacaatttcacgatgggcgtgttatgcttagcaatactattcgaggaagtaatgcgcggtaagttcggcaagaagcacatgatagcgggagtatttttcacattcgtgttgctcctgtccgggcagatcacatggcgggacatggcccacacactgataatgatcggcagcaacgcgtctgaccgcatggggatgggggtgacgtaccttgccttaatcgccactttcaagatccagcccttcctggcgctcgggttcttcctgcggaagttgaccagtcgcgagaacctgctgctgggcgtggggctcgccatggccaccacgctacagctgcccgaggacatcgaacagatggccaacggcatcgccctcggcctgatggccctgaagttaatcacccagttcgagacataccagctgtggaccgctctgatttccttgacatgctccaataccatcttcactttgactgtggcctggcggacagccaccctaatcctcgcgggtgtcagcctgctccccgtctgccaatccagctccatgcgcaagactgactggctccccatgaccgtggccgcaatgggcgtgccgcccctcccgttatttatattcagcctgaaggacacgctgaagcgccggtcctggcccctgaacgagggtgtaatggccgttggtctggttagcattctggcttccagcctgctgcgcaacgacgtgcccatggcaggacctctggtggccgggggcctgctgatcgcatgctatgtcatcaccggcacatcagccgaccttacggtggagaaggcagcggacgtaacctgggaggaagaagccgaacaaaccggcgtttcgcacaacctgatgatcaccgtcgatgacgacgggactatgcgaatcaaggacgacgagactgagaacatcctcactgtactgttaaagaccgccctcttaatcgtctccggcatatttccctactcaatcccagcgacactgctggtgtggcacacctggcaaaagcagacgcagcgctccggcgtcctgtgggatgtcccctcaccgcccgagacgcagaaggccgagctggaggagggggtgtaccggataaagcaacagggcatctttgggaagacccaagtgggggtcggggtgcaaaaggagggcgttttccacaccatgtggcacgtgacacgcggcgcggtgctaacctataacggaaagcggctggagcccaactgggcgtctgtgaagaaggacttaatcagctatggcgggggctggcgcctatctgcccagtggcaaaaaggggaggaagtccaagtgatcgctgtagagcctggcaagaaccccaagaacttccagaccatgcccggcaccttccagactacgactggggaaatcggcgcgatcgccctggattttaagcccgggaccagcgggagccccatcatcaatagggagggcaaggtcgtggggctgtacggcaacggagtagtcacgaagaacggagggtacgtgtctggtatcgcccagaccaatgcggaaccggacggccctacccccgagcttgaggaggagatgtttaagaagcgcaacctcactatcatggacctccaccctgggagcggcaagacgcggaagtacttgcccgccatagtgcgcgaggcgatcaagcggcgactccggaccctcatcctcgcccccacccgtgtggtggcagcagagatggaagaggccctcaagggattgcccataagataccaaactacggcgaccaagtccgagcacaccggccgcgagatcgtggacctgatgtgccacgccacctttactatgcggcttctaagccccgtgcgcgtaccgaactacaacctgatcattatggacgaggcgcacttcacggatccggcatccatcgccgccaggggatacatcagcaccagggtggggatgggcgaggcggccgccatcttcatgaccgcgacgccacccggtaccgccgacgcgtttccgcagtctaacgcacccatccaggatgaggagcgcgacatccctgaaaggtcctggaactccggcaacgagtggataaccgacttcgccggcaagaccgtctggtttgtacccagcatcaaggctggaaacgacatcgccaactgcctccgcaagaacgggaagaaggtgatccagctgtcccggaagacgttcgataccgagtatcagaaaactaagctgaatgattgggacttcgtggtgaccacggacatcagcgagatgggtgcgaactttaaggccgaccgagtgatcgacccgcgtcgctgcctcaagccagtcattctgacggacggccccgaacgggtcatattagccgggcccatgccggttacggcggcgtccgccgcccagcggcgaggcagagtagggcggaacccccagaaggagaacgaccagtacatattcaccggccaacctcttaacaacgacgaggatcatgcccactggaccgaagcaaaaatgctgctggacaatatcaacacgcccgaggggatcataccggccctcttcgagcccgaacgcgagaaatccgccgccatcgatggcgaatacagactgaagggtgaaagcaggaagaccttcgtggagctaatgaggcgcggggacctccccgtctggctggcgcacaaagtggcgtcagaaggcatcaagtataccgatcggaaatggtgttttgacggacagcgcaacaaccagatcctggaagagaatatggacgtggagatctggacaaaggagggagaaaagaagaagctcaggccgcgctggctcgacgcccgcacatactccgatccgctggcccttaaggagttcaaggacttcgccgcaggccgcaagagcatcgccctggacctggtcacagagatcggacgagtgccctcccacctcgcccaccgcacccgcaatgccctggacaacttagtgatgctgcacacatcagaacatgggggcaaggcctaccggcacgcggtggaggaactgccagaaaccatggaaaccctgctactactgggcctcatgatcctgctgacagggggagctatgctattcctgattagcggcaagggaatcggaaagacctcaatcgggctaatttgcgttatcgcttcgtctggccttctgtggatggccgaaattccactgcagtggatcgccagcgccatagtcctcgagttctttatgatggtgctcctaatccccgaacctgagaagcaacgtacgccccaggacaaccagcttgcatacgtggtgatcggaatcctgactctggccgccatcatcgctgcgaatgagatggggctcctggagaccaccaaacgggacctgggcatgagcaaggagcccggggtcgtgagtcccacgtcctacctcgacgtggacctccatcccgcctcggcctggaccctgtacgccgtcgcgaccaccgtgatcacgccaatgctcagacatactatcgaaaactcaaccgccaacgtgagcctggccgccatagcgaatcaagccgtcgtgctgatgggcctggacaaggggtggccgatctccaagatggacttgggcgttcccctgctagctttagggtgttacagccaggtcaaccccctgaccctcaccgccgccgtgcttttgttgatcacacactatgccatcataggccccggcctgcaagcgaaggccacccgggaggcccagaagcgcaccgccgccgggatcatgaagaaccctacggtggacggcatcatgaccatcgacctggaccccgtcatctacgactccaagttcgagaagcagttgggccaggtaatgctgctcgtgttgtgcgcggtccagctgctgctcatgcggaccagctgggctctttgcgaggcgctgaccctcgccaccggcccaatcaccacgttatgggagggctcccccgggaagttctggaacactacgatcgcggtgagcatggcaaatatcttccgcggctcctacttggcaggagccgggctcgcatttagcatcatgaagtccgtggggaccggcaaacggggcacgggcagccaaggcgagaccctgggcgagaagtggaaaaagaaactgaaccaactcagccgcaaggagttcgacttatacaaaaagtctgggatcaccgaggtcgaccgtacggaggcgaaagaagggctcaaaaggggcgagatcacccaccacgcggtgagccggggctcagccaagctccagtggtttgtggaaaggaacatggtcatcccggaggggcgggtcatagacttgggctgtgggcgcggcgggtggtcgtactattgtgccggcctgaagaaggtgaccgaggtcagaggctacaccaagggaggacccgggcatgaggagcccgtgcccatgtcgacgtacggctggaatattgtgaaacttatgagcggtaaggacgtcttctacctgccacccgaaaagtgtgacacacttctatgcgacatcggagagtcgtctccctcccccacggtagaggaatcccgcacgatacgcgtgctaaagatggtcgaaccgtggctgaagaataatcagttctgcatcaaggtgctgaacccctacatgcccacggtggtagaacatctcgagcggctccaacgcaaacacggcgggatgctggtcaggaaccccctctcgcgcaacagcacccacgagatgtactggatctccaacggcacggggaacatcgtggcaagcgtaaacatggtatcccggctgctgctcaaccgcttcacgatgacgcaccggcgcccgactatcgagaaggatgtcgacttgggcgcgggcacacggcacgtcaacgccgaacccgagacccccaatatggacgttattggggaacgtataaagcggatcaaggaggagcacaacagcacctggcattacgacgacgaaaacccttacaagacctgggcctatcacgggtcctatgaggttaaggccaccgggagcgccagcagcatgatcaacggcgtggtgaaactgttgaccaaaccctgggacgtcgtgcccatggtaacgcagatggcgatgaccgacaccacgccgtttgggcagcaacgagtctttaaggaaaaggtagacacgcggacaccacgctccatgcccggcacgcggcgcgtgatgggtatcaccgctgagtggctgtggcggacgctggggcgcaataagaaacctcggttgtgcacgcgcgaggagttcacgaagaaggtccgaactaacgctgcaatgggggctgtgttcacggaggaaaaccaatgggactccgccaaggcggccgtggaggacgaggacttctggaagctcgtagatcgggagcgggagctgcacaagctcgggaagtgcggcagctgcgtgtataacatgatggggaagcgggagaagaaacttggcgaatttggcaaggccaaagggagtagagcaatatggtacatgtggttaggcgccagatacctcgagttcgaggccctgggattcctgaacgaggaccattggtttagccgagagaactcctacagcggagtggaaggggagggcctacataagctggggtacatcctgagagatatatccaaaatccccgggggtgccatgtacgccgacgataccgcggggtgggacacccggatcacggaggacgatctccacaacgaggagaagataacacagcagatggacccggagcaccgccagctggctaacgccatctttaagctgacgtatcagaataaggtcgtgaaggtgcagcgccccacccctaccggcaccgtcatggatataatctcccggaaggaccagcgaggctccgggcaagtgggcacgtacggactcaacaccttcaccaatatggaggcccagctgattcgccagatggaaggcgagggggtgctgtccaaggccgatctcgaaaacccacgccttccggagaagaagataacccaatggctggaaacgaagggcgtagagcggctcaaacgcatggccatttccggcgacgactgcgtggttaagcccatcgatgaccggttcgctaacgcgctgctggccttaaatgacatggggaaggtccgcaaggacatcccccagtggcaaccaagcaagggatggcacgattggcagcaggtcccattctgcagccatcacttccacgagctgattatgaaggatgggcggaagctggtggtcccatgccggccccaggacgaactcatcggccgggcccgtatatcacaaggggcgggctggtcccttcgagaaaccgcctgtcttggcaaggcctacgcccaaatgtggtcgctcatgtacttccacaggcgcgacctcagactcgcttccaacgctatttgctcggctgtccccgtgcactgggtccccacgtcccgcaccacgtggagcatacacgctcaccaccagtggatgacgaccgaggacatgctcacggtttggaacagagtgtggatcgaggataacccgtggatggaggacaagacgcccgtcacaacctgggagaacgtaccctacctcggtaagcgcgaggaccagtggtgcggaagcctgatcgggctaacctcccgggcgacatgggcgcagaacattccgactgccatccagcaggtcaggagcctcataggcaatgaggagttcctcgattacatgccctccatgaagcggttccgcaaggaggaggagagcgagggcgccatctggtga

SEQ ID NO: 26043 - RNA, 9873 nt, synthetic construct
  misc_feature 1..9873: note = derived and/or modified CDS sequence (opt11) from DENV-3__FJ639772__SS-prME
  source 1..9873: mol_type = other RNA
acgagcttgtgcctcatgatgatcttacccgccgccctggcgtttcatctcacatcccgggatggggaaccacgcatgatcgtcgggaaaaacgaacgcggcaagtcgctgctgttcaagaccgcctccgggatcaacatgtgcaccctgatagctatggatctgggggaaatgtgcgacgacaccgtaacgtacaagtgcccccacatcacggaggtagagcccgaggacatagactgctggtgcaacctgacgagcacctgggtgacttacgggacctgcaaccaggccggggagcaccgacgcgataaacgctccgtggccctcgcgccacatgtgggcatgggcctggacactaggacccagacgtggatgagcgcagaaggcgcctggcgccaggtggagaaagtggagacgtgggccctgcggcacccagggttcaccatcctcgcgctgttcctggcccattatatcggcacctccctcacccagaaggtagtgatcttcatcctgctcatgttagtcacgccttctatgaccatgcggtgcgtgggggttggtaaccgcgacttcgtcgagggactgtcaggggctacatgggtggacgttgtcctggagcacggcgggtgcgtaaccaccatggccaaaaataagcccaccctagatatcgagctgcagaagaccgaggcgacccaattagcgacgctccggaagctgtgcatcgagggcaaaatcaccaatatcaccactgacagccgctgtccgacgcagggcgaggccgtactgccggaggagcaagaccagaactacgtctgtaagcacacctacgtggaccgggggtggggcaacgggtgcggcctcttcgggaagggttccctggtaacctgcgccaaattccaatgcctggagcccatcgagggaaaggtcgtccagtacgagaacctcaagtacacagtgatcatcacggtacacaccggagaccagcatcaagttggcaatgagacccagggcgtgactgccgagatcacgccccaggccagcacgaccgaagcgatcctgcccgagtatggcaccctggggctcgagtgctccccgcgcacaggcctggactttaacgagatgattctgctcaccatgaagaataaggcctggatggtgcaccggcagtggttctttgacctgcccctgccctggacatcgggcgcgaccactgaaacgcccacttggaaccgaaaagagttactggtgaccttcaagaacgcacacgccaagaagcaggaggtcgtcgtactggggtcccaggagggcgcgatgcacactgccctcacgggagcaactgaaatccagaacagcggcgggacttccatcttcgccgggcatcttaagtgtcgtctgaagatggacaaacttgagttaaagggtatgagctacgccatgtgtacgaacacgtttgtcctgaagaaagaggtgtccgagacccagcacgggaccatcctcatcaaggtggagtacaaaggagaggatgcgccctgtaagatccctttcagcaccgaggatgggcagggcaaggcacacaatggccgcctgattacggccaaccctgtggtgaccaagaaggaggagccagtgaacatcgaggccgagccgcccttcggggagagcaacatcgtcattggcatcggggacaacgcgctgaagatcaactggtataagaagggctccagcatcgggaaaatgttcgaagccacagcccggggcgccagacggatggccattctaggggacaccgcctgggatttcgggtccgtaggcggtgtcctcaacagcctgggcaagatggtccaccagatctttgggtccgcctacacggcgctgttcagtggcgtatcctgggtgatgaagattggcatcggggtcctcctcacgtggatcggcctaaattctaagaacacgagtatgagcttctcatgtatcgccatcggaatcatcaccctctatttaggggccgttgtgcaagcggacatggggtgtgtgatcaactggaagggcaaagaactgaagtgcggttccgggatcttcgtgacgaacgaggtgcacacctggaccgagcagtacaagtttcaggcagactcccccaagcgcctcgcaaccgccatcgccggggcgtgggagaacggggtctgcggaatcaggagcacgacccggatggagaacctgctgtggaagcagatcgccaacgagctaaactacatcctgtgggagaataatattaagttgaccgtggtggtcggagacattatcggcgtgcttgagcagggcaagcgcaccctgacgccccagccgatggaactgaagtactcctggaagacatggggaaaggccaagatcgtgactgctgagacccagaactcttccttcatcatcgacggacccaacacgcccgagtgcccgagcgcctcccgggcctggaacgtctgggaggtggaggactacgggttcggagtgttcaccactaacatctggctcaagctgcgcgaggtttacacccaactgtgcgaccaccggcttatgagcgccgccgttaaggatgagcgcgcggtccacgcggacatgggctactggatcgagagccagaagaacgggtcctggaaactggagaaggccagcctgatcgaggtcaaaacctgcacgtggccgaagtcccacactttgtggtccaacggcgtgcttgagtcagacatgatcatacctaagtcgctcgccgggcctatctctcagcacaactaccggccgggctatcacacccagaccgccgggccctggcacctgggcaaactagaattggacttcaactactgcgagggcacgaccgtggtcatcaccgagaactgtgggacccgaggccccagcctacggacgactaccgtgtcagggaagctgatccacgaatggtgttgccgcagctgcaccctgcccccgctccggtacatgggcgaagacgggtgctggtacggtatggagatccgtcccatatccgagaaagaagagaacatggttaagagcctggtcagcgccggcagcggggaggttgacaacttcacaatgggggtgctctgcctcgcgatcctgttcgaggaggttatgcggggaaaattcgggaagaagcacatgatcgccggggtcttcttcacttttgtgctgctcctgtccggccaaatcacttggcgtgacatggcgcacaccctgataatgatcggcagcaacgcgagtgatcggatggggatgggcgtaacatacctcgcgctaatcgcgacattcaagatccagccctttctggccctcggtttctttctgcggaagctgaccagcagggagaacctcctactgggcgttggcctcgccatggcgaccacgctgcaactgcccgaggacatcgagcagatggcaaacgggatagccttaggcctcatggcgctgaaactcatcacccagttcgagacctaccagctgtggaccgccctgatcagtctgacgtgctcgaacacgatattcacccttacggtcgcgtggcgcacggcgaccctgatcctcgccggggtctcactgctgcctgtgtgccagtccagctccatgcggaagaccgattggatccccatgaccgttgcagccatgggcgtgccgcccctcccgctgtttatcttcagcctgaaggatacgttgaagcgccgctcctggcccctgaacgagggtgtgatggccgtcgggttggtgagcatccttgcttccagcctgctgcggaacgacgtgcctatggcaggtccgctcgtcgccggagggctgctgatcgcctgctatgtgatcacggggacctctgccgatctcaccgtggagaaggctgccgacgtcacgtgggaggaggaagcagagcagaccggagtgtcacacaacctgatgatcactgtagacgacgacgggactatgcggatcaaggacgacgagacagagaacatcctgacggtactcctgaaaactgccctgctgatcgtgagtggcatcttcccgtacagcattcccgccacactcctggtgtggcacacatggcagaagcagactcagcggtccggcgtcctctgggacgtgcccagtccgcccgagacccagaaggcggagctggaagagggtgtgtacaggatcaagcagcagggcatcttcgggaagacccaggtaggcgtgggtgtgcagaaggagggcgtcttccacaccatgtggcacgtaacgcgaggcgccgtgctgacttacaacggaaagaggctcgagcccaactgggcgtctgtcaagaaggatctgatctcttacgggggtggctggcggttatcggcccagtggcagaagggggaggaggttcaggtgatagcggtcgagcccggcaagaacccgaagaacttccagaccatgcccggaacattccaaacgaccacaggtgagataggggccatcgcgctcgatttcaagcctggtacctctgggtcgcccattatcaaccgtgagggcaagatcgtcgggctctatggcaacggagttgttaccaagaacggcgggtatgtgtccggtatcgcacaaaccaacgccgagccggacggccccacacccgaactggaggaggagatgttcaagaaacggaacctgaccatcatggaccttcaccccgggagcggaaaaacgcgcaagtacctgccggcaatcgtcagagaggccatcaagcgccggctgcgcaccctcatcctggcacccactagggtggtggccgccgagatggaagaagctctgaaggggctccccatccgctaccagacctcggcaaccaagtcagagcacacgggccgggagatagtggacctgatgtgtcacgccactttcaccatgcgcctgttatcaccggtccgggtgcccaactacaacctgatcatcatggacgaggcccacttcacggatcccgctagcattgctgcccgcgggtacatctcaacccgggtggggatgggcgaggccgctgccatcttcatgaccgccacgccacctgggacggccgacgcattcccgcagtccaacgccccgatccaggacgaggagcgcgacatccccgaacgctcctggaacagcggcaacgagtggatcaccgacttcgcggggaagaccgtatggttcgtaccctccatcaaagccgggaacgacatcgccaactgcctgcgaaagaacgggaagaaagtgatccagctaagccgtaagacattcgacacggagtatcagaaaaccaagttgaacgactgggacttcgtcgtgaccaccgacatctccgagatgggtgccaatttcaaggccgaccgggtgatcgatccgcgacgctgcctgaaacccgtcatcctcaccgacggccccgagcgcgtgatcctggcggggcccatgcccgtcacggccgcctccgcagcccagcggagaggccgcgtcgggcgcaacccccagaaggagaacgaccagtacatcttcaccggccagcccctgaacaacgacgaggaccacgcgcactggaccgaggccaaaatgcttcttgacaacataaatacccccgagggtatcatcccggccctgttcgaacccgagcgagagaaatccgccgcgattgatggcgagtatcggctcaagggggagagccggaagacgttcgtggagctgatgcgacgcggtgacctgcccgtgtggctcgcccacaaggtcgcctccgagggcatcaagtacaccgatcgcaagtggtgctttgacgggcaaagaaacaatcagatcctggaggagaacatggacgttgaaatctggaccaaagagggcgagaaaaagaagctgcgtccccggtggctcgacgcccgaacctacagcgacccgctggcactcaaggagtttaaagacttcgcggccggccgcaaatctatcgccctggatttagtcacggagatcggccgggtgccgacgcacctggcccaccgcacccggaacgctctggacaatctggtgatgttacacacctctgagcacggcgggaaggcgtaccgccacgcggtcgaggagcttcccgagacgatggagaccctgctgctcctagggctgatgatcctcctgacaggaggggcgatgctgtttctcatctcaggtaaggggatcggcaagacttccatcgggctgatctgcgtgatcgcaagctccggaatgctgtggatggccgaaatcccgctacagtggatcgctagcgccatcgtgctggagttcttcatgatggtcctgttaatccccgagcccgaaaagcagcggacgccccaggacaaccagctagcctacgtggtgatcgggatcctgaccctcgcagccattatcgcggcgaacgagatgggactgctggagaccaccaagcgcgaccttggtatgtccaaggagccgggagttgtgtcccccacttcataccttgacgttgaccttcaccccgccagcgcctggaccctctacgcggttgccacaacggtgattacgcctatgctgcgccacaccatcgagaactccaccgctaacgtgtctttggccgctatcgcgaaccaggccgtggtgctcatggggttggacaaagggtggccgatctccaaaatggacctgggcgtgcccctcctggctctggggtgctactcccaggtcaaccccctcaccctgacagccgccgtactgctcttaataacccattacgcaataatcggacccgggctgcaggccaaagccacccgcgaggctcagaaacggaccgccgcggggatcatgaaaaacccgactgtagacggcattatgaccatcgatttggaccccgtcatatacgactccaagttcgagaagcagctgggccaagtgatgctactcgttctgtgcgccgtccagctgctgctgatgaggacatcttgggcactgtgcgaggctctcaccctggcgacgggccccatcaccacgctgtgggaaggttcccctggcaagttctggaacaccacgatcgccgtgagcatggcgaacatcttccggggctcctacctcgccggggccggcctagcgttcagcattatgaaatccgtgggcaccggcaagcgcggtacggggagccaaggcgagaccctgggggaaaagtggaagaagaagttgaaccagctgagccgcaaagagttcgacctgtacaagaagtccggaatcaccgaggtcgaccgcacggaagccaaggaggggctcaagcgcggcgagataacccatcacgctgttagccgtggctccgccaagctgcaatggttcgtggagagaaacatggtaattccggaggggcgcgtgatcgacctaggctgcgggcggggtgggtggagctactactgcgccggcctcaagaaggtgaccgaggtgcgcggctacaccaagggcgggcccgggcacgaggaacccgtgccgatgtccacatacggctggaacatcgtgaagctgatgagcgggaaggatgtcttctacctgccgcccgagaagtgcgacaccctcctgtgcgacatcggagagtccagcccctcccccaccgtggaggagagccggaccattagggtcctgaaaatggttgagccctggctgaaaaacaaccagttctgcatcaaggtgctcaacccctatatgcccactgtaatcgagcacctagagcgcctccagcggaagcacggcgggatgctcgtccgcaaccccctgtcccggaactcgacccacgagatgtattggatctccaacgggactggtaacatcgtggctagcgtcaacatggtctcccgcctgctcctgaaccggttcaccatgacgcaccgcagacctaccatcgagaaagatgttgatctgggcgccggcacccgccatgttaatgcagagccggaaacccccaacatggacgtcatcggggagcggatcaagagaatcaaggaagaacacaactccacgtggcattacgacgacgagaacccgtacaagacctgggcgtatcacggctcctacgaggtgaaggctaccgggagcgcctccagtatgattaacggcgtggtcaagctcctgaccaaaccctgggacgtggttccgatggtgacgcaaatggccatgaccgacactactccgttcgggcagcagcgggtgttcaaggagaaggtcgacaccaggaccccgcggtctatgcccggcacccgccgtgtaatgggcataaccgccgaatggctctggagaacgctagggcgcaacaaaaagcccagactgtgtacgcgggaggagttcaccaagaaggtgcgcacgaacgccgcgatgggagccgtattcacggaagagaaccagtgggactccgccaaagcagccgtggaggatgaggacttctggaagttagtagaccgcgagcgggagctccacaagctggggaagtgtggtagctgtgtatataacatgatggggaaacgcgagaagaagctgggcgagtttggcaaagcgaaggggagtcgggccatatggtatatgtggcttggcgcccgctaccttgagttcgaggctctgggattcctgaacgaggaccactggttcagccgggagaactcctatagcggcgtggaaggggaagggctgcacaagctgggctatatcctccgcgacatctccaagatccccgggggagcgatgtatgcagacgacaccgccggctgggacacccggatcacggaggacgatctgcacaacgaggagaaaatcacgcagcaaatggacccggagcacaggcagctggccaatgccatcttcaagctcacctaccagaacaaggttgttaaggtgcagaggcccaccccaaccggcaccgtgatggatatcattagccgcaaggaccagcgcggctccggacaggtgggcacgtacgggctgaacacctttaccaacatggaggcccagctgatacgtcagatggagggcgagggtgtcctgagcaaagcggaccttgagaacccgcatctccccgagaagaagatcacccagtggctggagacgaagggcgtggaacgcctcaagcgcatggcgatctccggcgacgactgcgtcgtgaaaccgatcgacgatcggtttgccaatgcactgctcgccttgaatgacatggggaaggtgcgcaaggacatcccccagtggcagcccagcaaaggctggcacgactggcaacaggtcccgttttgctcccatcacttccacgagctgatcatgaaggacgggcggaagctcgtcgtgccctgccgaccccaagacgaactaattggccgggcacgaattagccagggggcaggctggagcctgcgagagaccgcctgcctcggcaaggcatatgcgcagatgtggtcgctgatgtacttccatcgccgcgacctacgtttagcctccaatgccatctgtagcgccgtccccgttcactgggttccgacctctcgcaccacgtggtcgatccacgcccatcaccagtggatgaccaccgaggacatgttgacagtctggaaccgggtgtggatcgaggacaacccatggatggaggacaagactcctgtgaccacctgggagaacgtcccttacctggggaagcgcgaagaccagtggtgcggaagcctcatcggcctgacgtcacgggccacatgggcacagaacatccccacggccattcagcaggtccgcagcctaatagggaacgaagagttccttgattacatgcccagcatgaagcgtttccgcaaggaggaggaaagcgagggggccatttggtga

SEQ ID NO: 26044 - RNA, 9873 nt, synthetic construct
  misc_feature 1..9873: note = derived and/or modified CDS sequence (opt11) from DENV-3__FJ639774__SS-prME
  source 1..9873: mol_type = other RNA
accagcctgtgtttgatgatgatactacctgccgcgctcgccttccacctcacctcacgagatggcgaaccgcggatgatagtgggcaagaatgaaagagggaaatctctcctattcaaaacagcctccgggataaacatgtgcacgttaatagcaatggacctaggggaaatgtgcgatgacacggttacatacaaatgcccacatataacggaagtagaacctgaagacatcgactgctggtgcaacctaactagcacgtgggtcacatacgggacctgtaaccaagcgggtgaacaccgacgggacaaaagaagcgtcgctttagcaccccacgtaggcatgggcctggacactcggacacaaacatggatgtccgcagaaggcgcatggcgccaggtcgagaaggtggaaacgtgggcgctacggcaccctggattcacaatactggcactatttctagcacactacatagggacgtcacttacgcagaaggtcgtcatattcatactcctgatgttagtgacgcccagcatgacgatgagatgcgtcggcgtaggtaatcgagactttgtcgaaggactaagcggagccacatgggtcgacgttgtcctggagcacggagggtgcgtgacgacaatggccaagaataaacccacactagacattgaattgcaaaagacagaggcaacccaacttgctacacttagaaagctctgcatcgaaggtaaaatcaccaacataacaaccgattcaagatgccccactcaaggcgaggccgtgttacctgaggaacaagaccagaattacgtttgtaagcacacatatgtagatcgaggctggggaaacggatgcggactattcggaaaaggtagcctagtcacatgcgccaaattccaatgcctggaacctattgaagggaaggtcgtccaatacgaaaaccttaagtacacagtgatcataacggtccacacaggtgatcaacaccaagtgggaaacgaaactcagggggtcacggctgagatcacaccccaagcgagcacaactgaagccatattgcccgaatacggcacactcggactagagtgctcgccccgcaccggactggatttcaacgaaatgattctcctaacaatgaagaacaaggcatggatggtccatcgacaatggttcttcgatttacccctcccatggacctcaggcacaaccacagaaacaccgacatggaacaggaaagaactgctcgtcacgttcaagaacgctcatgctaagaagcaagaggtagtcgtcctaggatcccaagaaggcgctatgcacacggctctcacgggcgccacagaaatacaaaatagcgggggtactagcatattcgcaggccatctaaagtgccgcctaaaaatggataagttggagctaaaaggcatgagctatgcaatgtgtaccaacacgttcgtcctcaagaaagaagtatcagagacccagcacggaaccattctaatcaaggtggaatacaaaggtgaagacgtaccatgcaaaattcccttcagtaccgaagacggtcaggggaaggcgcacaacggcagactgatcaccgcgaatcccgtggtaacaaagaaggaagaaccagtaaacatcgaggcggaaccaccttttggcgagtccaacatcgtgatcgggatcggagacaacgcactgaagataaactggtacaagaaaggcagctccatagggaaaatgttcgaagcgaccgctagaggggccagacgaatggcaatcctaggagatacagcctgggactttgggtccgtagggggagtcctcaattctctaggtaagatggtacaccaaatcttcggaagtgcctacacagcgctattcagcggtgtcagctgggtcatgaagataggtataggcgtactactaacatggatcgggttaaacagtaagaacaccagcatgtcgttctcgtgcatagcaataggaatcattaccctatacctaggcgcagttgtgcaggccgatatgggctgcgtcattaattggaaaggaaaagaactcaagtgcggctccggtatattcgttaccaacgaggtgcacacgtggactgaacaatacaaattccaagcagatagcccgaaacgattagccacggcaatcgcgggtgcctgggaaaacggcgtatgcgggatacgtagcacaactcgaatggaaaacctactctggaaacagatagccaacgaattgaactacatcctgtgggaaaacaatataaaactcaccgtcgtcgtcggggacataattggcgtactcgagcagggaaagcgaacgttaacgccacaaccaatggaattgaaatattcctggaagacatgggggaaggcaaaaatagtaaccgcagagacacaaaactccagcttcatcatagatggacccaacacaccagagtgccccaacgcaagtagagcatggaacgtctgggaggtcgaagactacgggttcggagtcttcaccaccaatatttggttgaaactccgagaagtctatacccaactatgcgaccaccgtctgatgagtgctgcagtcaaggacgagcgggcagtacacgcagatatgggctactggatcgaaagccagaagaacggctcgtggaagctcgaaaaagcctcactaattgaggtaaaaacgtgcacctggccaaagtcacacacgctgtggtccaatggcgttttggaaagcgatatgatcattcctaaaagcctcgcggggccgataagtcagcacaactataggccggggtaccatacacaaacggcaggcccatggcatctagggaaacttgaactagactttaactactgtgagggtacaacggtcgtaatcacggaaaactgtgggacgagaggcccgtccctgaggacgacgaccgtatccgggaaactcatacacgaatggtgctgcaggtcctgcacattgccaccgttaagatacatgggagaagatgggtgctggtacggaatggagatcagacctatcagcgaaaaagaggagaacatggttaagagcctcgtatcagccgggtccggagaggtcgacaacttcaccatgggagttctatgcctagcgatactattcgaagaagtaatgcgaggaaaatttggtaaaaagcacatgatcgccggagtcttcttcactttcgtgctattactctccgggcagatcacctggcgggacatggcccatacgctgattatgatcggaagcaacgcctcagacaggatgggaatgggggtgacatacttagccctgatagctacctttaagatccagccgtttctcgcactggggttctttttacgcaaacttaccagccgggagaatctgctgttgggagtggggctagcaatggcaacgactctgcagctacccgaggatatagagcaaatggccaacggtatcgccttaggcctaatggctctaaagctcatcacccagttcgagacgtaccaactgtggacggctttaatatccctaacgtgctcaaacaccatattcacgctgacggtagcttggaggaccgccaccctaatcttagcgggggtcagtctcctgccggtatgccaaagctcctcgatgcgaaaaaccgactggctacctatgactgtcgcagcaatgggggtcccgccactgccactattcatattcagcctgaaagacacactaaagagaagaagttggccactaaacgagggcgtcatggcagttggtctagtctcaatactagcttcgtccctcctacgcaatgacgtccccatggctggacccttggtcgcgggtggactactaattgcatgctatgtgattaccgggacgtcagcagacctgacggttgaaaaagccgcagacgttacctgggaagaggaggccgagcaaacaggcgtgagccacaatttaatgatcaccgtcgatgacgacggaaccatgcgcataaaggacgacgaaaccgagaacatcctgacggtccttttaaagacagcacttctcatagtatccggcatcttcccatacagtataccagcgaccctcctcgtttggcacacctggcaaaaacagacgcagcgatcaggcgtgctctgggacgtgccaagtcccccggaaacccaaaaggccgagctagaagagggtgtctacagaataaaacaacaaggaatctttgggaaaacacaagtgggagtcggagtacaaaaggagggagtcttccacacaatgtggcacgtgacccgaggcgctgtactaacatataacggcaaaagactagaaccaaactgggcaagtgtaaagaaagacctcatttcatacggtgggggttggaggctatcagcgcaatggcagaaaggggaagaggtacaagtaatagccgtcgagcccggaaagaaccccaaaaactttcaaaccatgcccggtaccttccagacaacaacaggagaaatcggagctatagcactcgacttcaagccggggacctcagggtcccccataatcaaccgggagggaaaggtagtgggtctctacggtaatggagtagtgacgaaaaatgggggatatgtgagcgggatcgcacaaactaatgcggaacccgacgggcccacaccagagctagaggaagagatgttcaagaaacgaaacctaacaattatggacctccacccaggctccggcaagacaagaaagtatctaccggccatagtgagggaagctatcaagcggagactgagaacgctcatactggcacccacccgagtggttgctgcagagatggaagaggccctgaaaggcctgccgatcagataccagacaactgccacaaaatcagaacacacaggccgagagatagtagacttaatgtgccacgcgaccttcacgatgcggctgcttagcccggttcgtgtgccaaactacaatcttataatcatggatgaagcacacttcacagatcccgcaagcatagccgcacggggctacatcagcacccgcgttggtatgggcgaggccgctgccattttcatgaccgcaacccctccagggaccgcagacgcattcccacaaagcaacgcgcccatccaggacgaagaacgagacatcccggagagaagctggaatagcgggaatgaatggattaccgactttgcagggaagaccgtgtggttcgtcccgagtataaaagctgggaacgacatcgcaaattgcctccggaaaaatggtaagaaagtcatacaactgtcgagaaaaacattcgacacagaataccagaaaacgaaactcaatgactgggacttcgtagtgacaaccgacatttcggagatgggcgccaacttcaaagcggaccgagtcatcgacccaagaaggtgcctaaaacctgtcatactcacggacggcccagaaagggttatcttggccgggccaatgccagttacagccgcgagcgcagcacagagaagaggacgcgttgggcgaaacccgcaaaaggaaaacgatcagtacatattcacagggcagccactgaacaatgatgaagaccacgcccattggacagaggccaaaatgttactggacaacatcaataccccagaaggaatcataccggcgttgttcgagcccgagagggaaaaatcggcggcaatcgatggcgagtaccggctaaaaggcgaatctcgcaaaaccttcgtcgaattaatgaggcgcggggacttaccggtatggctcgcccacaaagtagcctccgaaggcataaaatacacggaccgcaagtggtgctttgacgggcaacgcaacaatcaaatactagaggagaacatggacgtcgagatctggaccaaggagggcgaacgaaagaagttacgaccccggtggcttgatgcacgcacctactcggaccccctcgcactaaaggaatttaaggacttcgcagcgggccgtaagtccatagctctagacctcgtcactgaaattggcagagtccctacacacctagctcaccgaaccagaaatgcgcttgacaatctagtgatgctacacacgtcagaacacggaggaaaggcctacagacatgcagtcgaggaattgccagagacgatggagacgctcctgctactcggtctaatgatccttctcactggaggagccatgctctttctaattagtggcaaagggatcggcaagacgtcgatcggcctgatttgcgtaatcgcctcttctggcatgctatggatggctgaaatacctctacaatggatagcgtcggcgatcgtcctagaatttttcatgatggtgctcctcataccagaaccggagaaacaacgaaccccacaagacaaccagctcgcttacgtagtaattggtatcctcacactggcggccataattgcggcaaatgaaatgggtcttctcgagacaacgaaaagggacctcggcatgtcaaaggaaccaggggtagtctcccccacaagctacctagacgtggacctgcaccccgcgagtgcctggacgctatacgcggtcgcgacgacagttatcactccgatgctccgacacaccatagaaaactccaccgccaatgtgagtctcgccgcgatagccaatcaagccgtagtgctaatgggcctcgacaaaggctggccaataagcaaaatggacctcggtgtcccattactggcattaggctgctactcccaagtcaatccattgacactaacagccgcagtactactactcatcacccactacgccataatcggtcccgggcttcaagcgaaagccacccgggaggcacagaaaaggacggccgctggaatcatgaagaacccaactgtcgacggaattatgaccatcgatctggacccggtgatctatgactcaaagttcgaaaagcaattgggacaagtaatgctgctagtactctgcgcagtacaattgctacttatgagaacaagctgggcactatgcgaagccctgactctggcgaccggcccaataacaactctctgggaagggtctccaggcaagttctggaacacaaccatagcagtaagcatggccaatatcttccgaggaagctatctagctggcgcaggattagcgttcagcatcatgaaaagcgtcggcaccggcaaacgcggcaccgggtcccaaggtgaaactcttggagaaaaatggaagaagaaactaaaccagttgagtcgcaaagagttcgatctgtataagaaaagcggtattaccgaggtggaccgcactgaggccaaagaaggtctgaaacgaggcgaaatcacacaccacgcagtcagcagaggatccgcaaaactacagtggttcgtagaaagaaacatggtcataccggaaggacgcgtgattgaccttggctgcggcagaggcggctggagttactactgcgcggggttgaagaaagtaacggaggtccgcggatacacgaaagggggcccgggccatgaggagcccgtaccgatgtcgacgtatgggtggaacatcgtaaaactgatgagtggcaaagacgtcttctatctgccgcccgagaaatgtgacacacttttatgcgacataggggagagctcgccgagcccaaccgtggaagaaagccgaacaatacgagtcttaaaaatggtagaaccctggctcaaaaacaaccaattctgcatcaaggtattaaatccatacatgccggctgtaatagaacacctagaacgcctgcaacgaaaacatgggggtatgcttgtgcgtaacccactaagcaggaactcgactcacgaaatgtactggatctccaacggaaccggcaacatcgtggcgagcgtgaacatggtgtcgcggcttctactaaatagatttaccatgacacatcgacgcccaaccatagaaaaagacgtggacttgggagcggggacccgacacgttaacgcagagccagaaacacccaacatggatgtgataggcgagcggattaaaaggataaaagaggaacacaacagtacatggcattacgacgacgagaatccatacaaaacgtgggcttaccacggatcatatgaggtaaaggcgaccgggtccgcaagtagcatgataaatggtgtagtcaaactgttgacgaagccatgggacgtggtaccaatggtgacccaaatggcaatgacggacacgacccccttcggccaacagcgggtattcaaggagaaggttgacacgcggactcctcgttccatgcctggaacaaggagagtaatggggatcacagcagaatggttgtggcggacgttagggaggaacaagaaacctaggctctgcacacgcgaagaatttacgaagaaagttcgtaccaatgcggccatgggcgcggtgttcaccgaggagaatcaatgggatagtgcaaaagcagcggtagaggacgaagacttctggaaactggtcgacagggaacgggaactacacaaactaggtaagtgcggttcatgcgtctataacatgatggggaaaagggagaaaaagctcggcgagttcggaaaagcaaaagggagcagggccatctggtacatgtggctaggagcacgctacctagagttcgaggccctcggtttcttaaacgaagaccactggttctcacgagaaaatagctactccggggttgaaggtgaaggactccataaactaggatacatccttagagacatcagcaagataccaggcggggctatgtacgcagacgacacggcagggtgggatacacgaataaccgaagacgatctccataatgaggagaaaatcacccaacagatggaccccgaacaccgccaactggctaatgccatttttaagctgacctaccaaaacaaagtggtgaaggtgcaacgcccgacccccacagggactgtgatggacataataagtcgcaaagaccagcgcgggtccggtcaggtagggacgtacggccttaacaccttcaccaatatggaggctcagctcatcagacaaatggagggcgagggggttctctcaaaagcagacctagaaaacccgcatctgccggagaaaaagattacccaatggctcgagacgaagggggtggaacgcctgaagagaatggcgatttcgggggacgactgcgtagtgaagcccatcgacgatagattcgcaaacgcccttctagcactaaacgacatgggaaaggtaagaaaggacatcccacagtggcaacccagtaaaggatggcacgactggcaacaggtaccattctgcagccaccacttccacgagctcataatgaaggatggccgaaagctagtcgtgccttgcaggccccaagacgaacttatagggcgcgcgagaatttcacaaggtgctgggtggtcgctccgagagacggcatgcctcggaaaagcatacgcacagatgtggagcctaatgtacttccatagaagagacctccggcttgcgtcaaacgccatatgcagcgctgtccccgtacactgggtaccaacctccaggaccacatggagcatacacgcacatcaccaatggatgactactgaagacatgctgaccgtatggaaccgggtctggatcgaggacaatccgtggatggaagacaaaacgcccgtaaccacatgggaaaacgtgccctacctgggcaagagagaagaccaatggtgtgggagcctcatcggcttgacatcccgcgcaacgtgggcccaaaatatccctacggcaatccaacaggtgcgaagcctcatcggaaacgaagagtttctagactatatgccgtccatgaagcgattcagaaaggaggaagagtctgaaggcgccatatggtaa

SEQ ID NO: 26045 - RNA, 9873 nt, synthetic construct
  misc_feature 1..9873: note = derived and/or modified CDS sequence (opt11) from DENV-3__FJ639775__SS-prME
  source 1..9873: mol_type = other RNA
acctcactgtgtctcatgatgatcctgcccgccgccttggcgttccacctcacttcgcgagacggggaaccccggatgattgtggggaagaacgagcgcggcaaaagcctgctgttcaagacggcctccgggatcaacatgtgtaccctcatagccatggacctgggcgagatgtgtgacgacaccgtgacctacaagtgcccgcacatcacggaagtggagcccgaggacatcgactgctggtgtaacctgaccagcacctgggtgacctacgggacgtgcaaccaggccggcgagcaccggcgcgacaaacggtccgttgcgctcgcgccgcacgtggggatgggcttagacacgagaacccagacctggatgagcgcggaaggcgcctggcgacaggtagagaaggttgagacgtgggccctgcggcatccggggttcaccattttagcgctgttcctggcccattacatcggcacctccctcacccagaaggttgtgatttttatcctgttgatgctcgtcacgccctcgatgaccatgcggtgcgtgggggtgggcaaccgcgacttcgtcgagggcctgtccggggcaacctgggtagacgtcgtcctggagcacggcggctgcgtgaccacgatggccaaaaacaagcccaccctcgacatagagctgcagaagaccgaggccacccaactggcgacactccggaagctgtgcattgagggcaagatcaccaacatcaccaccgacagccgatgccctacgcagggtgaagccgtcctgccagaggaacaagaccagaattacgtctgcaaacacacctatgtggatcgtggctggggcaatgggtgtggcctcttcgggaagggctccttggtgacctgcgctaaatttcagtgcctggagcccatagaggggaaggtcgtgcagtacgagaacctcaagtacacggtaatcatcacggtgcacaccggagaccagcaccaagtgggcaacgagacccagggggtcaccgctgagatcacgccccaggccagtaccaccgaggcgatcctgcccgagtacggcactctggggctcgagtgctcaccgcgcaccggcctagatttcaacgagatgatcctgttgacgatgaagaacaaggcctggatggtgcaccggcagtggttctttgatcttcccctgccctggacctcaggcgcaaccaccgaaactcctacctggaaccgcaaggagctcctggtgaccttcaagaacgcccacgccaagaagcaggaggttgtggttctggggtcccaggagggagcgatgcacaccgcgctcacgggggccaccgagatccaaaatagtggcggcacgtccattttcgccggacacctgaagtgccggttgaagatggacaagctcgagctgaagggcatgagctacgctatgtgcacgaacacctttgtattaaagaaggaagtgtcagagacccaacacgggaccatcctcatcaaggtggaatacaaaggggaggatgtcccgtgcaagatccccttcagcaccgaggacggacagggcaaggcgcataacggcaggctgatcacggccaatcccgtggtgactaagaaggaggagcccgtcaatatcgaggctgagccaccattcggggagagcaacatcgtgatcggcattggcgacaacgccctgaagatcaactggtacaagaaaggctcgtcgatcgggaaaatgttcgaggcgaccgccagaggcgcccgacgtatggccattctgggcgacacggcctgggactttgggtcagttggcggcgtcctcaactcgctgggcaagatggtgcaccagatcttcgggagtgcctacacggcccttttcagcggcgtgtcctgggtcatgaagataggcatcggtgtcctgctgacctggatcggcctgaacagcaagaacacctccatgagcttcagctgcatcgccatcgggatcatcaccctctacctgggcgccgtggtgcaggccgacatggggtgcgtgatcaactggaagggcaaggagctgaagtgcggcagcgggattttcgtgacgaacgaggtccacacatggaccgagcagtataagttccaagcggactcccccaaacgcctcgccaccgctatcgctggcgcctgggaaaacggggtgtgcggcattcgctccaccactcggatggagaaccttctgtggaagcaaatagcgaacgagctcaactacatcttatgggagaacaacatcaaactgactgtggtcgtaggtgatatcatcggcgtgctagagcaggggaagaggaccctcacaccccagccgatggagctgaagtactcctggaagacctgggggaaggccaagattgtcaccgcggagacccaaaatagctcctttatcatcgacggcccaaacacgcccgaatgccctagcgcatcccgggcgtggaacgtatgggaagtggaggactacggtttcggtgtcttcaccacgaacatctggttgaagctgcgcgaggtctacacccagctgtgcgatcaccggctcatgagcgccgccgtgaaggacgaacgcgccgttcacgccgacatggggtattggatcgagagccaaaagaatgggtcctggaagctggagaaggcgagcctgatcgaagtgaagacctgcacgtggcccaagtcccacaccctctggagcaacggcgtgctggagtccgatatgatcattcccaagagcctggcagggcccatctcgcagcataactatcggccgggctaccacacccagaccgccgggccttggcacctgggcaagctggagctggactttaactactgcgagggcacgaccgtcgtgattaccgaaaactgcggaacccgcggccccagcctgcggacaaccaccgtgagcggaaagttaatacacgagtggtgctgccgcagctgcacgctgcccccgctccggtacatgggtgaggacgggtgttggtacggaatggagatccgtccgatctccgagaaggaggaaaacatggtcaagagcctggtatccgcggggtcgggggaggtagacaacttcacgatgggcgtcttatgcctcgccatcctgttcgaggaggtgatgcggggcaaattcggaaagaagcacatgatcgcgggagtgttctttaccttcgtcctactgctgtccggccagatcacttggagagacatggcccacaccctgattatgattggctcaaacgccagcgaccggatggggatgggcgtgacgtatctcgccctcatagccacattcaagatccagccgttcctggcgctcgggttcttcctgcgcaagctgaccagccgggagaacctcctactgggagtgggcctagctatggccacaacgctgcagctgcccgaggatatcgagcagatggcaaacggaatcgccctcggcctgatggccctgaaactcatcacccagttcgaaacgtatcagctgtggaccgctctgatctcattgacgtgttccaataccatctttactctgactgtcgcttggcgtaccgccacccttatcctcgcgggcgtgagcctgctgccagtctgtcagtccagctccatgcgtaagacagactggctgcccatgaccgtggctgcgatgggcgtgccgccactccctctgttcatatttagcctaaaggacacgctgaagagacgctcctggcccctcaatgagggtgtcatggccgtgggtttagtgagcatcctggcctccagcctgctccggaacgacgtcccaatggcgggccccctggttgccgggggcctcctcatagcctgctatgtgatcactggaacctccgccgaccttaccgtggagaaggccgcggatgtcacgtgggaggaggaggccgagcagaccggggtgtcacataacctaatgatcacagttgacgacgatgggaccatgcgcatcaaggatgacgaaaccgagaacatccttacggtgcttctgaagaccgccctccttatagtgagcgggatcttcccgtattctatccccgccactctgctagtctggcacacctggcagaagcagacgcagcggtccggcgtgctctgggatgtgccctccccgcccgagacccagaaggccgaattggaggagggggtgtaccgcatcaagcagcagggcatatttgggaagactcaggtcggcgtgggggttcagaaggagggcgtgtttcacaccatgtggcacgtgacgcggggcgcagttcttacctacaacggtaagcgcctggagcccaactgggccagcgtgaagaaagacctgatcagttacggtggaggctggcggctctccgctcagtggcagaaaggggaggaggtgcaggttatcgcagtggaaccgggcaagaaccccaaaaacttccagacgatgcccggcaccttccagacgacaactggagagattggagcgatagcacttgacttcaagccggggaccagtggcagcccaatcatcaaccgcgaaggtaaggtggtcgggctgtacggcaacggggtggtgacgaagaatggcggctatgtctccggcatagcccaaacaaacgccgagccggacggtcccacccccgagctcgaggaggagatgttcaaaaagcggaacttaactataatggacctgcaccccgggagcggcaaaacgcgcaagtaccttccggccatagtgcgggaggctatcaagcggcgactccgaaccctgatcctggctcccacccgggtggtcgccgccgaaatggaggaagccctcaaaggactgcccatacgctaccagaccacggcgacgaagtccgagcacaccggacgggagatcgtggacctgatgtgccatgccacctttacgatgaggctcctcagccccgtgcgtgtcccgaactacaatctgataatcatggacgaggcccactttaccgaccccgcctccatcgccgcgcgcgggtacatcagcacacgggtaggcatgggggaggccgccgccatcttcatgactgcgacaccgcccggaaccgccgatgccttcccgcagtccaatgcccccattcaggacgaggaacgcgacatccccgagcgcagctggaactccggcaacgagtggataaccgacttcgctgggaagactgtgtggttcgtccccagtattaaggcggggaacgacatagccaactgcctccggaagaacggcaagaaggtgattcaactgtcgaggaagacgttcgataccgagtaccagaagacaaaactgaacgactgggacttcgttgtcaccacggacatcagtgagatgggcgccaacttcaaggcagaccgggttatcgacccgagacggtgtctcaagccagttatcctgaccgacgggcccgagcgcgtcatcctggccgggcccatgcctgtgaccgcagcctcagctgcccagcggcgcgggagagtagggcgcaatccccaaaaggagaacgatcagtacatattcaccggccagcccctcaataatgacgaagatcacgcccactggaccgaggcgaaaatgctgctggataacattaacacgccggaggggattatacccgccctcttcgaacccgaacgtgaaaagtcagccgcgatagatggcgagtaccgcttgaagggcgaatccagaaagaccttcgtagagctcatgcgccgcggcgacctccccgtgtggctggcgcacaaggtcgcaagcgaaggcataaagtacactgatagaaaatggtgtttcgacgggcagcggaacaatcaaattctagaggagaacatggacgtcgaaatctggacgaaggagggtgagaagaagaagctccgccctaggtggctagatgcccgcacgtactccgacccgttagccctcaaggagttcaaggacttcgccgcgggccgcaaaagcatagccctggacctagtgaccgaaattgggcgcgtcccctcccacctcgcccaccgcacccggaacgcgttggacaacttggtgatgttgcacaccagcgagcacggcggaaaggcctatcgccatgcggtcgaagaactgcccgagacaatggagaccctgctcctgttgggcctcatgatcctgctaaccgggggagccatgctgttccttatctcaggtaaaggtatcgggaaaacgtccatcgggctgatctgtgtcatcgccagtagtggaatgctctggatggccgaaataccactgcagtggatcgcctcggcaattgtgctggagttcttcatgatggttctcctgataccggagcccgaaaagcagcggacgccacaggacaaccagctggcatacgtcgtcatcgggatcctcacgctggcagccattatcgccgccaatgaaatgggcctgctcgagaccaccaagcgcgacctgggtatgtccaaggagcccggcgtggttagcccgacgtcctacttagacgtggaccttcaccccgcctctgcctggaccctgtacgccgtggcgaccaccgtcatcacgccgatgctacggcatacgattgagaatagcactgccaacgtgagcctcgccgccatcgccaatcaggctgtggtcttaatgggcctggacaaggggtggccgatctcgaagatggacctcggcgtaccattactggccttggggtgctacagccaggtaaaccccctcacactaacggccgccgtcctcctcctgatcactcactacgccatcatcggacccggactccaagcgaaggccactcgcgaggcccagaagcggaccgcggccgggatcatgaaaaacccgacggtcgacggtatcatgaccatcgacctggaccccgtgatctacgattccaagttcgagaagcagctgggacaggtcatgctcctcgtgctgtgcgctgtgcagcttctactgatgcgaaccagctgggccctctgcgaggctctgaccctggccaccggccccatcacgactctctgggaggggtcccccggtaagttctggaacaccacgatcgctgtgagcatggccaacatcttccggggctcttacctggctggggcaggcctggcgttcagcatcatgaagtccgtggggaccggcaagcgcggcaccgggagccaaggcgagaccttgggcgagaaatggaagaagaaacttaaccagcttagccggaaagagttcgacctctacaagaagtctgggattaccgaggtggacagaacggaggcgaaggaggggctgaagcgcggcgagataactcaccacgccgtctcacgcggctcggccaaacttcagtggttcgtggagcggaacatggtgatccccgagggtcgcgtcatcgacctcggctgcgggagaggtgggtggagctattactgcgccggccttaagaaggtgacggaggttcgcggctacaccaaaggcggacccggacacgaggagcccgtccccatgtccacctacggctggaacatcgtgaagctgatgagcgggaaggacgtattttacctcccgcccgagaagtgcgataccctgctgtgcgacatcggagagtctagcccctcccccaccgtcgaggagagtcggaccatccgggtgctgaaaatggtcgagccgtggctcaagaacaaccaattctgtatcaaggtcctgaacccctacatgccgacagtgatagagcacctggagcgcctccagagaaagcacggaggaatgctagtgcgcaaccccctgtcccgtaactcaacccacgagatgtactggatctccaacggaaccgggaacatcgtggccagcgtcaacatggtgtcccgcctcctgctgaaccggttcaccatgactcaccggagaccgaccatcgagaaggacgtcgatctcggcgcgggcactcggcacgtgaatgccgagcccgagacaccgaacatggatgttataggcgagcgcataaagagaatcaaggaggagcacaacagcacctggcactacgacgacgagaacccctacaagacctgggcctaccacggctcctatgaagtcaaagcgacgggcagcgcctccagcatgatcaacggggtggtcaagctgcttacgaagccctgggacgtggttcccatggtcacgcagatggcgatgaccgacaccaccccctttgggcaacaacgggtcttcaaggagaaggtcgacacgcgcacaccccggagcatgccgggcacccgccgggccatgggcatcaccgccgagtggctctggcgcacattgggtcggaacaagaagccccggctgtgcacgcgtgaagagttcaccaaaaaggtgaggaccaatgccgcgatgggcgccgtgttcacggaggagaaccagtgggactccgccaaggccgctgtggaggacgaagacttctggaagctcgttgatcgcgagcgggagctgcacaagttgggtaagtgcggcagctgcgtgtacaacatgatggggaagcgagaaaagaaactcggagagttcggaaaggcgaaagggtcccgggccatatggtacatgtggctgggcgcccgctacctggagttcgaggctctcgggttcctgaatgaggaccactggttctcccgggagaactcctacagcggtgtcgagggggaaggcctacacaagctcggctatatactgcgcgatatctctaaaatccccgggggtgccatgtacgctgacgacaccgctggatgggacactcgcattaccgaagatgacctgcacaacgaggagaagatcacccagcaaatggacccagagcaccgccaattggccaacgccatcttcaagctcacctaccagaataaggtcgtcaaggtccaacgccctacgcccaccggaactgtcatggacatcatcagccgcaaggaccagcggggctcaggccaggtgggcacgtacggcttgaacacctttacaaatatggaggcccagctaattcggcagatggagggcgagggggtgctgagcaaggcggacctggagaatccccacctcccggagaaaaagatcacacaatggctggagacgaagggtgtcgagcggctgaagcgcatggcgatctccggcgatgactgcgtagtgaagccaatagacgaccggttcgccaacgccctcctggccttgaacgacatgggaaaggtgcgtaaagacatcccccaatggcagcctagcaaaggctggcacgactggcagcaggtaccgttctgctcccaccacttccacgagctcatcatgaaagatggccgcaagctggtggtcccctgcaggccccaggacgagttgatcggccgggcacgcatctcccagggagcaggctggtccctccgggagaccgcctgcctaggaaaggcatacgcccagatgtggagcctgatgtacttccaccgcagggacctacggctggcgtccaacgccatctgcagcgcagtgcccgtgcactgggtccccacctcccgtaccacgtggtcaatccacgcccaccaccaatggatgaccaccgaggacatgctaaccgtgtggaaccgggtatggatcgaggacaacccctggatggaggacaagacgccggtcaccacctgggaaaatgtgccgtacctgggtaagcgcgaggaccagtggtgcggaagcctgatcgggctgacctcccgggccacatgggcacagaacataccgaccgccatccaacaggtacggagcctcatcgggaacgaggagttcctcgactacatgccgtcaatgaagcggttccgaaaggaggaagagtcagagggggcgatctggtaa

SEQ ID NO: 26046 - RNA, 9873 nt, synthetic construct
  misc_feature 1..9873: note = derived and/or modified CDS sequence (opt11) from DENV-3__FJ639777__SS-prME
  source 1..9873: mol_type = other RNA
accagcttatgtctcatgatgactttgcccgcagcgttagcgtttcacctcacaagccgagacggagaaccacgaatgatagtcggcaaaaatgaacgaggtaaatcactcctcttcaaaaccgcctctgggatcaacatgtgcacccttatcgctatggaccttggagaaatgtgcgatgacaccgtaacctacaaatgcccgcatatcacggaagtcgaaccggaagatatagactgttggtgcaacttgacgagtacttgggtaacttacggaacgtgtaaccaagccggagaacaccgccgcgacaaaagaagtgtcgcactagcaccccacgtgggaatggggctcgacacaagaacgcaaacctggatgagcgccgaaggggcctggagacaagtagagaaagtggagacgtgggctctccgacacccgggttttaccatacttgcgctttttctcgcccactacattggtacctccctgacacagaaagtagtgatcttcatcctactcatgcttgtcacgcccagcatgaccatgcgttgtgtaggagtagggaaccgggactttgtcgaaggactcagcggagcgacatgggtggacgtcgtgctcgagcacggtggatgtgtaacgaccatggccaaaaacaaacccaccctggacatagagctgcagaaaacagaagcaacgcaactggccactctgcgcaaattgtgcattgaaggaaaaatcacgaacatcactaccgactctcgctgccccacacagggagaagcagtactcccggaagaacaggaccagaactacgtctgcaaacatacatacgtagatcgcggatggggcaacggctgtgggcttttcggaaaaggatccttagttacgtgtgcaaaattccaatgcctggagcccatagaaggtaaagtagtgcagtacgagaatcttaaatacacggtcattatcacagtccataccggagaccaacaccaagtcggcaatgaaacacagggcgtaaccgcagagataacccctcaagcatccaccacagaagcaatcctgcccgaatacggtacgcttggcctcgagtgcagcccccgcacaggccttgacttcaacgaaatgattcttttgaccatgaagaacaaggcctggatggtccacagacaatggttcttcgaccttccactgccctggacgtccggcgcgactacagagacaccaacctggaaccgcaaggaactacttgttaccttcaagaacgcgcacgcgaagaagcaagaagtcgtcgtgctgggctcacaggaaggtgcgatgcacacagccctcacgggcgcaaccgaaattcaaaattccggagggacctcaatcttcgcaggacacctcaaatgccgcctgaagatggataagctcgaactaaagggaatgtcatacgccatgtgcacaaacacatttgtcctgaagaaggaggtaagcgaaacccaacacggcacgatcctaataaaagtggaatacaagggggaagacgtcccatgtaagattcccttcagcacagaggacggacaagggaaggctcacaacggaaggctgataacagcgaatccagttgtcaccaagaaagaagaacccgtgaacatagaagccgaaccgcccttcggggagtcaaacatagttatcgggattggagacaacgcactcaaaataaactggtacaagaagggctcatcaatcggaaaaatgttcgaagccactgcgcggggagcccggagaatggcaatactgggcgatacagcatgggacttcggcagcgtcggaggagtgctcaattccctcggcaaaatggtacaccaaatcttcggtagcgcatatacagcgttattcagcggcgtctcttgggtcatgaaaatagggatcggcgtactcctcacctggattgggctcaacagcaaaaataccagcatgagcttctcctgtatagcgataggcataatcactctttaccttggcgccgtcgttcaagcagacatggggtgcgttataaactggaagggcaaagagttaaagtgcggatccggcatattcgtaaccaatgaagtccacacttggacggaacagtataagttccaggccgatagcccgaagaggctggccactgcgatcgccggcgcctgggaaaatggagtatgcggtatccgcagcacgacgcggatggagaatctgctgtggaaacaaatagcaaacgaactcaactacatcctctgggagaataacatcaagctgaccgtggtcgtcggagatataataggtgtactagaacagggcaaaagaacgctcacacctcaaccaatggagctcaaatattcatggaagacctggggaaaagctaaaatcgtcgccgccgaaacgcaaaactcgagctttatcatagacggccccaacacgcccgaatgtccgagcgcaagtcgcgcctggaatgtatgggaagtagaagattacggcttcggggtattcacgacgaacatctggttaaaactacgcgaggtatatacccaactgtgcgaccaccgcttgatgtccgcagcagtcaaagacgagcgtgcagtacacgcggatatggggtattggatagaaagccagaagaacgggtcgtggaaactggagaaggcatcgttgattgaagtgaaaacttgtacttggccgaaatcgcacactctgtggagtaacggcgttctggaaagcgacatgataatcccaaagagcttagctgggcccatctcccaacacaactaccgccccggataccacactcaaacagcaggcccatggcacctgggcaagctcgaactagattttaactactgcgaaggcactacagtggtcattaccgaaaattgcggaactcgggggccaagcctccgaacaacgaccgtgtcgggcaaactcatacacgaatggtgctgtcgttcctgcaccctgcccccactacggtacatgggagaggatggatgctggtacggcatggaaatcagacccattagcgagaaagaggagaacatggtcaagtcgctagtgtcagcaggctcaggcgaagtagataacttcaccatgggggtcctgtgcttggccatactcttcgaagaggtgatgagaggcaaacttggaaagaaacatatgatcgcgggcgtattcttcacattcgttctcctcctgagcggacaaatcacatggagagacatggcacataccctcataatgattggctccaacgcctcggatagaatgggaatgggcgtaacctatttagcattgatagccacattcaaaattcaaccgttcctggccctaggtttcttcctccgaaaacttacgtctcgagaaaatctactactaggggtaggactagcaatggcaaccaccctccaactacctgaggacatagaacagatggcaaacggaatagcgctcggacttatggccctaaaactgatcacgcaattcgaaacttaccaactatggacggccctaatctcactgacctgttccaatacaatttttaccttgaccgtggcctggcgaaccgcgacactcatactcgcgggtgtatccctactgcccgtatgccagagcagcagcatgaggaagaccgactggctaccgatgaccgtagcagctatgggcgtccctccactgccactatttatcttttccctcaaagataccttaaagcgtcggtcctggccccttaacgaaggtgtcatggcagtcgggctcgtgagcatactggcaagctcactgcttaggaatgacgtccccatggccggacccctcgttgcgggcggcctcctaatagcgtgctacgtaataaccggaacaagcgcggacctaacggtagagaaagccgcggatgtgacctgggaggaagaagcagagcagaccggagtgtcccacaacctaatgataaccgtagacgacgacggaacaatgcggataaaagacgatgagactgaaaatatccttacggttttgttgaaaacagcgctgctaatcgtatcaggtatctttccctactccataccagcgacattgttagtgtggcacacatggcagaagcaaacacagcgatcaggagtcttatgggacgtcccgagcccaccagaaactcaaaaagcggagctcgaggagggggtttaccgtatcaaacagcagggaatttttggaaaaacgcaagtcggagtgggagtacagaaggaaggcgtcttccacaccatgtggcacgtgaccagaggtgcagttctcacatataatgggaagcgtctagagcccaattgggcgagcgtcaagaaagatctgatatcttacgggggaggctggcgtttaaacgctcaatggcaaaagggagaagaagtccaagtaatagcagtcgagcctggcaaaaaccccaaaaactttcaaacaatgccaggaacattccaaaccaccacgggcgagatcggagccattgcgctcgactttaagcctgggacgagtgggtcccccataataaatcgagaaggtaaagtggtcgggctctacggtaacggcgtggtcactaaaaacggagggtacgtcagcggcatcgctcagacaaacgccgagccggacggacccactccagaactcgaagaggagatgttcaaaaagcgcaatcttacaatcatggacctacacccggggtccgggaaaacacgaaagtatttacctgcgatcgtaagggaagcaatcaagcgacgactgcgcaccctgattctcgcccccactcgagtagtcgccgccgagatggaagaagcgctaaagggacttcccataaggtaccaaacaaccgcaaccaaatcggaacacacaggccgggaaatcgttgacctaatgtgtcacgccacgttcaccatgcgactactctcaccagtacgagtccccaactacaacctcataatcatggacgaagcccactttaccgaccccgctagcattgccgctaggggctacatctcaacccgagtaggcatgggcgaagcagccgccatttttatgacagcgactccaccgggaacggcggacgcatttcctcagagcaacgcgcctatccaagacgaagaacgggacatccccgagcgaagttggaactcagggaacgaatggatcacagacttcgccggcaaaaccgtgtggtttgtacccagcataaaagccggcaatgacatagcgaactgcctaaggaaaaacggcaagaaagtgattcaactctcacgcaagacatttgacaccgagtaccagaaaacaaaactaaatgactgggacttcgtagtaactaccgacatcagcgaaatgggggcaaattttaaggcagacagagtgatagacccacgtcgctgcctcaagccagtgatacttacagacggccccgaacgggtgatactcgcaggcccaatccctgtcacagcagcaagcgcggcgcaacgcaggggccgtgtaggccgtaaccctcaaaaggagaacgaccagtacattttcacggggcagcccctaaacaacgacgaagaccacgcgcactggaccgaagccaaaatgctcctagacaacataaacactccggaaggaattataccagcgttattcgagccagagcgggaaaagtcagcggccatcgatggcgagtaccgattgaaaggcgaaagcaggaaaacattcgtagaactaatgagacgcggagatctgcccgtctggctggctcataaagtcgccagcgagggtataaagtacactgaccggaagtggtgcttcgacggccaacgaaacaatcaaatcctggaagaaaacatggacgtagaaatctggacgaaagaaggcgaaaagaagaaactgaggccccggtggctagacgccagaacgtacagtgaccctctcgccctcaaggagtttaaggacttcgctgcaggcaggaaatctatcgcgctagacctggtcaccgaaattggacgcgtccccagtcacttggcccaccgtacgcgcaacgctcttgacaatctcgtcatgctccatacaagcgaacatggaggcaaggcctaccgccatgcagtggaagaattacccgagactatggagactttactacttttgggactgatgatcctgctcaccggaggggcaatgctattcttaatttccggaaaaggtatcgggaaaacctcaatcggtctgatatgtgtcatagcgagctcgggtatgctctggatggcagagatcccattgcaatggatcgccagcgccatagtcctagagttcttcatgatggtgctcctgattccagaacccgagaaacaacgcacaccgcaagacaaccaattagcgtatgtcgtgataggaatcctcacactcgcggcgataatcgccgccaatgaaatgggactgctggaaactacaaaacgggacctagggatgtcaaaggagccaggagtggtctcacccaccagctaccttgacgttgatcttcacccagcaagcgcctggacactgtacgccgttgctacgacggtgataactcccatgctcagacacacgatcgagaactccaccgccaacgtatccctggccgccatcgcaaatcaggccgtagtactaatggggctcgataaagggtggccgatctcaaaaatggacttaggcgtgccactgttggcactggggtgctattcgcaggtcaaccccctaacactaactgccgcggtgctactcctaattacccactacgccattataggacctggcctccaggccaaggcaacacgagaagcgcagaaaagaacggcagcgggcattatgaagaacccgacggtggatggcatcatgactatagaccttgacccggttatttatgactctaaatttgagaagcaactcgggcaagtaatgctactcgtcctgtgcgccgtccagctgctgctgatgcggacgtcatgggcactatgcgaggctctcaccctagcaaccggacccataacaaccctatgggaggggagccccggaaagttttggaacacgaccatcgcggtctcgatggccaacatcttccgtggttcgtatatagctggggcagggcttgcattcagtataatgaaatcagtaggaacgggcaaacgaggaacgggctctcagggcgaaacactcggagagaagtggaagaagaaattgaatcaactcagcaggaaggagttcgacctctacaagaagtccgggataaccgaagtcgaccggaccgaagcaaaagaaggcctaaaaaggggtgagataacccaccacgcagtatcccggggatcggccaagctgcaatggttcgtcgaacgcaatatggtaacacccgaggggagagtgatcgacctcggctgcggacgagggggctggagctactattgcgccggcctgaagaaagtcacagaagtaagaggctatacgaagggagggcccgggcacgaggaaccagtacctatgtcgacctatggatggaacatagtcaaactcatgtcaggcaaggacgtcttctacctcccaccagaaaaatgcgacacactactttgcgacataggcgaaagcagccccagcccaaccgtagaagaatcgagaacgataagggtactaaagatggtcgagccatggctaaagaacaaccagttctgcatcaaagtgcttaacccttacatgcctaccgtcatagaacatctagaacgactacagaggaagcacgggggtatgctggtccgaagccctctgtccagaaactcaacccatgaaatgtactggatctcaaacggcacaggaaacatagtagcaagcgtaaacatggtctcacgcctactacttaaccgctttaccatgacacacaggcggcctaccattgaaaaagacgtggatctaggcgcagggacccggcacgtaaacgcagaaccggagacacccaacatggacgttattggagaaagaataaaacgtataaaggaggaacataacagcacctggcactatgacgatgagaacccatataaaacatgggcatatcacggcagctacgaagtaaaagccacaggaagtgctagttcaatgataaacggtgtcgttaagctcctgacgaaaccgtgggatgtggtacctatggtcacacaaatggcgatgacggatacgacaccgttcggccaacagcgagtgttcaaagaaaaagtagacacccgcacgccccgctcaatgcccggaacacgtagagtaatgggtatcacggcagaatggctatggcgcacgcttggacgaaataagaaaccgcggctctgcactagggaagagttcaccaaaaaggtgcgtaccaacgccgcaatgggtgccgttttcacagaagaaaatcagtgggactcagcaaaagcggcggtcgaggatgaagacttctggaagctggtcgaccgggagcgagaactccacaggctgggcaaatgtgggtcatgtgtttataacatgatgggcaaacgagagaagaaattgggagagttcggaaaagccaagggttctagggcaatatggtatatgtggctgggggcgagatacctggagttcgaagctcttggcttccttaacgaagaccactggttcagccgcgaaaactcttacagtggggtagagggagaaggcttacacaagctggggtatatcctgagggacatatcaaaaatacccggaggcgcaatgtatgcagacgataccgcagggtgggatacgcgtatcacagaagacgacctacacaacgaagagaaaattacgcagcagatggacccagagcaccggcaactagctaatgccatattcaaactgacgtatcaaaacaaggtcgtcaaagtacagcgccccacgccaacaggcacggttatggatataatctcccggaaggaccagcgcggttcaggacaagtgggaacctacggactgaatacattcacgaacatggaggcccagctcataagacaaatggagggcgagggcgtactatcgaaagcggatcttgagaacccccacctccccgagaagaaaataacacagtggctcgaaacgaagggggtagaaaggctaaagcgtatggcgattagtggagacgactgcgtcgtcaaacctatcgacgaccgattcgcaaacgccctcctcgccctaaatgatatgggtaaagtgagaaaagatataccacagtggcaaccgtctaaaggatggcacgactggcaacaagtacctttctgcagccaccattttcacgagctcataatgaaagacgggaggaaacttgtggtaccatgcagaccgcaggacgaattgataggcagagctcgtatctcacaaggcgccggttggagccttcgagaaaccgcctgtctgggcaaagcatacgcgcaaatgtggagcctaatgtacttccaccgcagggacctgaggctcgcgagtaatgccatctgttccgcagttccggtgcactgggtgcccacctcccggactacctggagcattcacgcacaccaccagtggatgacaacggaagatatgttaacagtatggaacagagtatggatcgaagataacccttggatggaggacaaaacccccgtaacaacctgggagaatgtcccatacctgggaaaacgcgaagatcaatggtgtggaagcctaataggactcacgtcacgtgcgacttgggctcaaaacattcccacggctattcagcaagtaaggagcttaataggtaacgaagagttcctagattacatgccgagcatgaagaggttccgaaaagaagaggaaagtgagggtgcaatatggtaa

SEQ ID NO: 26047 - RNA, 9873 nt, synthetic construct
  misc_feature 1..9873: note = derived and/or modified CDS sequence (opt11) from DENV-3__FJ639778__SS-prME
  source 1..9873: mol_type = other RNA
accagcctgtgcttgatgatgatccttcccgccgccctggcgttccacctcacctctcgggacggcgagccccggatgatcgtgggaaagaacgagcgggggaagagcttactcttcaagacggccagtgggatcaacatgtgcaccctgatcgcgatggacctgggcgagatgtgcgacgacaccgtgacctacaagtgcccacacatcacggaggtggagccagaggatatcgactgctggtgcaatctgaccagcacgtgggtgacctacgggacgtgcaaccaagccggcgaacacaggcgtgacaagcgcagcgtcgcgttggcgccccacgtcggcatggggctggacacccgcacccagacctggatgtcagccgagggcgcctggcgccaggtggagaaggtagagacgtgggcacttcgccatccggggttcactatcctcgcgctctttctggcccattatatcggaacgtccctcacacagaaggtggtgatttttatcttgttgatgttggtcacgcccagcatgacgatgcggtgtgtgggagtgggcaacagggactttgtggagggcctgtccggtgccacctgggtggacgttgtcttagagcacggcggatgcgtgaccacgatggccaaaaataagcccaccttggacatcgagctgcaaaagaccgaggccacccagctggcgacactccgaaagctgtgcatcgagggacgcattaccaacatcactactgatagcaggtgccccacgcagggcgaggccgtgttgcctgaagagcaggaccagaactacgtctgtaaacacacatacgtcgaccgtgggtggggcaacgggtgcggcctcttcgggaaaggctccctggtgacctgtgctaaattccagtgcctggagcccatcgagggcaaggtcgtgcagtatgagaacctaaagtacaccgttataattaccgtccacaccggcgatcagcaccaggtggggaacgagacccagggcgtcacagccgagatcacgccccaggcgagcaccaccgaggcgatcctgcccgagtacggcaccttagggctcgagtgttccccgcggacaggattagatttcaatgagatgatcctgctgactatgaagaacaaagcctggatggttcaccgtcagtggttcttcgacctgcccctaccgtggacctcaggcgccaccaccgagacgccgacctggaatcggaaggagctcttagtgaccttcaagaacgctcacgcaaagaagcaggaggtcgtggtgctggggtcccaagagggcgctatgcataccgccctcacgggggccaccgagatccagaacagcggcgggacttccatcttcgccggccacctgaagtgccgccttaagatggacaagctcgagctgaagggtatgagctacgccatgtgcaccaacacttttgtcctgaagaaggaggtgtccgagacccaacacggcaccatcctcatcaaggtggagtataaaggcgaagacgtcccgtgcaagatcccgttcagcaccgaggacgggcagggcaaggcgcacaacggccggctgattacggccaaccccgtcgtgaccaagaaggaggaacccgtcaacatcgaggccgagccgccatttggggagagcaacatggttataggcatcggggacaacgccctgaagatcaactggtacaagaagggcagtagtatcggaaagatgttcgaggcgaccgcccgcggtgcacgtaggatggcgatcctgggcgacaccgcctgggacttcgggtccgtgggcggggtcttaaacagccttggcaagatggtacaccagatttttgggtcagcgtacacggccctgttcagcggcgtgtcctgggtcatgaagatcggcatcggggtgttacttacctggatcggcctgaatagcaaaaacacctccatgtctttctcttgcatcgccatcgggatcatcaccttgtacctgggcgcagtggtgcaggctgatatgggatgtgtgatcaactggaagggcaaggaactgaagtgcggcagcgggatcttcgtgacaaacgaggtccacacttggaccgagcagtataaattccaggcagactcacccaagcgcctcgcgacggccatcgccggagcttgggagaacggggtctgtggcattcggagcacgacccggatggagaacctgctgtggaaacagatcgcgaacgagctcaactacattttgtgggagaacaacatcaaactgaccgtggtcgtcggggacataatcggtgtgctcgaacagggtaagcgtaccctaacgccccagccgatggagctgaaatactcctggaagacatggggaaaggccaaaatcgtcactgccgagactcaaaatagctccttcattatagacggacccaacacacctgagtgccctagcgcctcccgcgcgtggaatgtgtgggaggtggaggattacggcttcggtgtcttcactacaaacatttggctcaagctgcgggaggtgtacacccagctatgtgatcaccgcttaatgagcgccgccgttaaggatgagcgggccgtccacgctgacatgggctactggatcgagagccagaaaaacgggtcctggaagttagagaaggcaagtttgatagaggtgaagacgtgcacttggccgaagtcccacaccctctggagcaacggcgtcttagagtccgacatgatcatccccaaaagcttggccggtccaatttcccagcacaattaccgcccgggataccacacgcagaccgccggcccatggcatctcggcaagctggagctggactttaactattgcgagggcacgaccgtcgtgatcaccgagaactgtgggacccgaggacccagcttgcgcacgaccacggtgagtgggaagttaatccacgagtggtgctgccggagctgcacgctgccacccctccgctacatgggcgaggacgggtgctggtacggcatggagatccggccaatatccgagaaggaggagaacatggtcaagagcttagtttccgccggaagtggagaagtggacaacttcacgatgggcgtcttatgtctcgccatcctgttcgaggaggtgatgcgggggaagttcggtaagaagcacatgatagcgggggtcttcttcactttcgtacttctcctgagtggccagattacctggcgggatatggcgcataccctgatcatgatcggcagcaacgcctccgacaggatgggcatgggggtgacgtacctcgccctgattgcaaccttcaagatccagcccttcctggctctcgggttcttcctgcggaaactgaccagccgcgagaacctcctgctgggcgtgggcctcgccatggccactacgcttcagctgcccgaggacatcgagcagatggccaacgggatcgctttaggcctgatggccctgaagctcatcacccaattcgaaacctaccagctttggaccgccctgatcagcctcacgtgttccaacacgatcttcaccctgaccgtcgcctggcggacggccaccctgatcctcgcgggtgtgagcctgcttcctgtctgccagtcctcttctatgcggaaaaccgactggttgcccatgactgtagccgccatgggagtaccgcccctcccgctcttcatcttcagcctcaaggatacgttaaaacgtaggtcctggccactgaacgagggagtcatggccgtaggcctggtgagcatactggcttccagtcttctcaaaaacgacgtcccgatggcgggcccactggtggccggcggcctgctcatcgcgtgctacgtaatcaccgggacgtcggcggacttaaccgtcgagaaggccgcggacgtaacgtgggaggaagaggccgagcagaccggcgtgagccacaacctgatgatcaccgtcgacgacgacgggaccatgcgtattaaagacgacgagaccgagaacatcctcacggtgcttctgaagacggccctcctgatcgtatccggcatcttcccatatagcatccccgccaccttgctcgtctggcacacctggcaaaagcagacccagcggtccggcgttctgtgggacgtgcccagcccgcccgagacccagaaagccgagctggaggagggcgtctaccgcatcaagcagcagggcatcttcggcaagactcaagtaggcgtgggggtccagaaggaaggcgtgttccacaccatgtggcacgttacacggggggcggtcctcacctacaacgggaagcgcctggagccgaactgggcctccgtaaagaaggatcttatcagctacggcgggggctggcggctcagcgcccagtggcagaaaggcgaggaggtccaagtcatcgccgtggagcccggcaagaacccaaagaacttccagaccatgcccggcacgttccagacgactaccggggagatcggtgcgatcgccctggacttcaagcccgggacgtctgggagccccatcattaacagagagggcaaggtagtcgggctatacggcaacggggttgtgacgaagaacggcggttatgtgtccggcatcgcccagaccaacgcagagccggacggccccacacccgagctggaagaagagatgttcaagaagcggaacctgaccatcatggacttgcatcccggaagcggaaaaacccgcaaatacctgccggccatcgtgagggaggcgatcaagcgccggctccgcaccctgatcctggcccccacccgggtggtcgcagccgagatggaagaagcactcaagggtctgcccatacgctaccagaccacggctacgaagtccgagcacaccggtcgggagatcgttgaccttatgtgccacgccacattcaccatgcgcctcctgagccccgtgcgcgtccctaactacaacctgatcatcatggacgaagcacatttcaccgaccccgcctcgattgccgcgcgggggtacatcagcactcgggtgggtatgggcgaggccgccgccatcttcatgaccgcgacaccgcccgggaccgcagacgccttcccgcagtcgaacgccccgatccaagacgaagagcgcgacatccccgagcgctcctggaactccggaaacgaatggataactgacttcgccggaaagaccgtgtggttcgtcccaagcataaaggcgggcaacgacatagccaactgcctccgaaagaacgggaagaaagttatccagctgtctcgcaagacattcgacacggaataccagaagacaaagctgaacgattgggacttcgttgtaactacggacatcagcgagatgggcgccaacttcaaagccgaccgggtgatcgacccccgcagatgcctcaaacccgtgatcttgaccgacggccccgagagagtgatcctggccgggcccatgcctgtgaccgcggcctccgccgcccaaagaagaggacgggtagggcgaaacccccagaaggagaacgaccaatacattttcaccggccagcctctcaacaacgacgaggatcacgcccactggaccgaggcgaagatgctactggacaacatcaatacgcccgaggggatcatcccagccctctttgaacccgagcgggagaagtccgccgccatcgacggcgagtatcgtcttaagggcgagtcccggaagactttcgtagagctgatgcgacgcggagatttgcccgtctggctggcgcacaaggtggccagcgagggcatcaagtacaccgaccgtaagtggtgtttcgacgggcagcggaacaaccagattctagaggaaaatatggacgtggagatctggactaaggagggcgagaagaagaagttgcgtccccggtggctcgacgccaggacttactccgacccgctcgccctcaaggaattcaaggacttcgcagcgggccgcaagagcatcgccctggacctggtgaccgagattggacgggtccccacgcacctcgctcatcgcactcggaacgctttagacaatctggtgatgctccacacatccgagcacggaggaaaggcctaccgccatgcggtggaggagctgcccgagaccatggagaccctgcttctgctgggtctaatgatcctgctgacagggggcgccatgttattcctgatcagtggcaaggggatcggaaagacgtcgatcggcctgatttgcgtcatagcttcgagtggcatgctctggatggccgagatacctctgcaatggatcgcgagtgccatagtgctggagttcttcatgatggtgctcctgatcccggagcccgaaaagcaacggacgccccaggacaaccagctagcctacgtcgttatcgggatcctcactctggccgccatcatcgccgcaaacgagatgggcctgctcgagaccactaagcgtgacctgggcatgagcaaggagcccggggtggtctcccccacctcgtaccttgacgtggatctccaccccgccagtgcgtggaccctttacgccgttgcgaccacggtcattacccccatgctgagacacaccatcgaaaactctaccgccaacgtgtccctggccgcgatcgccaaccaggccgttgtgctgatggggctggacaaaggatggccgatcagcaaaatggacctcggcgtaccgctgttggcccttgggtgttattcgcaggtgaacccactaacgctgaccgccgctgtcctccttctgatcactcattacgccatcatcggccccggactccaagcgaaggccacccgcgaagcccagaagcggacggccgctgggatcatgaagaacccaaccgtcgacgggatcatgacaatcgacctggacccggtcatctatgattcgaaattcgaaaaacagctggggcaagtaatgctcctggtgctgtgtgccgtgcaacttctgctgatgcgcacctcctgggcactctgcgaagcgcttacactggccaccggccctatcaccaccctatgggagggtagccccgggaagttctggaatacgactatcgcagtctcaatggccaatattttccgggggagctacctggctggggccgggctcgccttctccatcatgaagtccgtgggaacaggcaagaggggcaccgggtcccagggcgagaccctcggggagaagtggaagaagaaactgaaccagctgagccgaaaggagtttgacctttacaagaagtccggcatcacggaggtggatcgcaccgaggcaaaggaagggctgcgtcgcggcgagatcacccaccacgccgtatcccggggctcggccaagctgcaatggttcgtggagcgcaacatggttattccggagggacgagttatcgacctaggttgcggaaggggcgggtggtcctactactgcgccggccttaagaaggtgaccgaggtacggggctacacgaagggcgggccagggcacgaagaacccgtccccatgtcaacgtacggctggaacatcgtgaaactgatgtccggtaaggacgtattctacctcccccccgagaagtgcgacactctgctgtgtgacatcggagaaagctccccctctcccaccgtcgaggaatccaggaccatccgcgtgttaaagatggtggagccgtggctcaagaacaaccagttctgcataaaagtcctgaacccttacatgcccaccgtgatcgaacacctggaacggttacaaaggaagcacggcgggatgctggtacgaaaccctctgtcaagaaatagcacacacgagatgtactggatcagcaatggtaccggaaacatcgtggcatccgtgaacatggtgtcacgcctccttctgaatcgcttcacgatgactcaccgacgcccgaccattgagaaggacgtcgatctcggcgcgggcacccggcacgtgaacgctgagccggagacacctaacatggatgtgatcggggaacgcataaagcggattaaggaagagcacaactccacctggcactacgacgacgaaaacccgtataagacgtgggcataccacggtagctacgaggtaaaggccacagggtccgccagtagtatgataaacggcgtagtaaagctgctgacgaagccctgggacgtcgttcccatggtcacccagatggcgatgacggatactacgccctttggacagcaacgcgtgttcaaggagaaggtcgacacccggacgccgcgctccatgcccggtaccaggcgcgtcatgggcattactgccgagtggctctggcggaccctggggcgcaacaagaagcccaggctgtgcacccgcgaggagttcacaaagaaggtgagaactaacgccgccatgggagctgtgtttaccgaggagaaccagtgggactcggccaaggctgccgtggaggatgaggacttttggaagctcgtggaccgagagcgcgagctgcacaagctcgggaagtgcggctcctgcgtgtacaacatgatgggcaagcgagagaagaagctcggcgaattcggcaaggctaagggcagccgcgcgatatggtacatgtggctgggcgcccggtacctggagttcgaagccctcgggttcctgaacgaggaccactggttctcccgggagaacagctacagcggggtcgagggggagggactgcacaagctaggctatatcctgcgggacatcagcaagatccccgggggcgctatgtacgccgatgacaccgcggggtgggacacacgcatcacggaggacgaccttcacaacgaggagaagataacccagcagatggacccggagcaccggcagctcgccaacgccatctttaagctgacctaccagaacaaggtcgtgaaggtccagcggcccaccccaaccggcacggtgatggacatcatctcacgcaaggatcagcgcggcagcggccaagtggggacatacgggctgaataccttcactaacatggaggcccagctcatccggcagatggagggcgagggggtcttatccaaggccgacctggaaaacccccatctaccggaaaagaagatcacgcaatggctggagaccaaaggcgtggagcgcctgaagcggatggcgattagtggcgacgactgtgtggtcaagccaatcgacgaccgcttcgccaatgccctcctggctctgaacgacatggggaaggtgaggaaagacatcccccagtggcagccgtccaaaggctggcatgattggcagcaggtgcccttctgtagccaccatttccacgagctcattatgaaggacgggcgcaagctggtagtgccgtgcagaccccaggacgagttgatcggccgcgcacggatctcacaaggggcaggctggtccttacgcgagaccgcgtgcctgggtaaggcctacgcccagatgtggtccctgatgtacttccaccgccgggacctccgcctggcgtcgaatgccatctgctccgccgtaccagtccactgggtgccaaccagccggacgacctggtccatccacgcccaccaccagtggatgaccaccgaggacatgttaactgtgtggaaccgtgtgtggattgaggacaacccttggatggaggataagacccccgtgaccacctgggagaacgttccctacctcgggaagcgggaggaccagtggtgtggcagcctgataggactgacgtcccgcgcaacctgggcgcagaacataccgaccgccatccaacaggtccggtccctcattggcaacgaggagttcctggactacatgcctagcatgaagcgctttcgcaaagaagaggagtccgaaggggccatctggtaa

SEQ ID NO: 26048 - RNA, 9873 nt, synthetic construct
  misc_feature 1..9873: note = derived and/or modified CDS sequence (opt11) from DENV-3__FJ639779__SS-prME
  source 1..9873: mol_type = other RNA
accagcctgtgcctcatgatgatcctgcccgcggccttggcgtttcacctcaccagccgggacggcgagccccggatgatcgtcgggaagaacgagcgggggaaaagcctgttattcaagacggcgagcggtataaacatgtgcaccctcattgccatggacctgggcgagatgtgcgacgacaccgtgacctacaagtgtccccacatcaccgaggtggagcccgaagacatagactgttggtgtaacctgaccagcacctgggtgacgtacggtacgtgcaatcaggccggcgagcaccggcgcgataagcggagcgtggccttggcaccccacgtgggcatggggctggatacccgcacccagacatggatgagcgccgagggcgcctggcgccaggtggagaaggtcgagacgtgggccctgcgccacccggggttcaccatcctcgcactgttcctggcccactacatcggcacctccctcacccagaaggtcgtaatcttcatcctgctgatgttagtcacgccgagcatgaccatgcggtgcgtgggcgtgggcaaccgagacttcgtcgagggtctgtctggggccacgtgggtggacgtggtcttggagcatggcgggtgcgtgacgacgatggccaagaacaagcctaccctcgatatcgagctgcaaaagacggaggccacccagctggcgacgctccgaaaactttgcatagaagggaagatcaccaacatcaccaccgactcccgctgccccacgcagggcgaggccgtgctgccggaggagcaggaccagaactacgtctgcaagcacacctacgtggaccggggctggggcaacggatgcggcctcttcgggaagggcagcctagtgacctgcgccaagttccagtgcctagagcccattgagggcaaggtcgtacagtacgagaaccttaagtacaccgtgatcatcacggtccataccggggaccagcatcaggtgggcaatgagacccagggggtgaccgccgagatcacgccccaagcaagcaccaccgaggcgatcctgcccgagtacggcaccctgggactcgagtgctcaccgcgtaccggcctcgacttcaacgagatgatcctgttaacgatgaagaacaaagcctggatggtgcaccggcagtggtttttcgacttgcctctcccctggaccagcggcgcaaccaccgagacccccacctggaacagaaaggaactcctggtgaccttcaagaacgcccacgccaagaagcaggaggtcgttgtgttggggtcccaggagggcgcgatgcacactgccctcacgggggccaccgagatccagaactctggtgggacgtcaatcttcgccgggcacctcaagtgccggctgaagatggataagctcgagctgaaggggatgagctacgccatgtgcaccaatacgttcgtcctgaagaaggaggtgtccgagacccaacacggaaccattctcatcaaagtggaatacaaaggcgaggacgtcccgtgcaagatccccttcagcaccgaagacgggcagcgcaaggcgcacaacggccggctgattacggccaaccccgtggtgaccaagaaagaggaacccgtcaacatcgaggcagaaccacccttcggcgagagcaacattgtgatcgggatcggagacaacgctctgaaaatcaattggtataagaaggggtcgagcatcggcaagatgttcgaggcgacagcccgcggggcccggcgcatggccatactgggcgataccgcatgggatttcggctccgtcgggggcgtcttgaacagcctggggaagatggtgcaccagatctttggctccgcgtacacggccctgttcagcggggtgtcctgggtcatgaagatcggaataggcgtgttactgacctggatcgggctgaactcgaagaacacctctatgagcttctcctgcatcgccatcggcatcatcaccctctatttaggtgccgtggtccaggccgacatgggctgcgtgatcaactggaaggggaaggaactgaaatgcggctcaggcatcttcgtgacgaacgaggtccacacctggacggaacagtacaaattccaggcggactcccccaaacgcctcgccaccgccatcgccggggcctgggagaacggagtgtgcggtatccggagcacgactcgcatggaaaacctgctgtggaaacaaatcgctaacgaactcaattatattctctgggagaataacatcaagctgacggtggtcgtgggcgacatcatcggtgtgctcgaacagggcaaacgaaccctgacgccccagcccatggaactgaagtactcctggaagacctggggcaaggccaagatcgtgaccgccgagacgcaaaacagctccttcatcatcgacgggcccaacacgcccgagtgcccctccgcctcccgggcgtggaatgtgtgggaggtggaagactacggcttcggggtcttcaccaccaacatctggctcaagctgcgggaggtttacacacagctgtgcgaccatagattgatgagcgccgccgtgaaagacgagcgtgccgtccacgccgacatgggctactggatcgagagccagaaaaatggctcctggaagctggagaaggcgagcctgattgaggtgaagacctgcacctggccgaagtcgcacaccctctggagcaatggggtgcttgagtccgacatgatcattcccaagagcctggccggccccatcagccagcacaattaccgcccggggtaccacacgcagaccgccggcccctggcacctcgggaagctggagctggacttcaactactgcgagggcacgaccgtagtgatcaccgagaattgcggcacccggggtccctctctccgcaccaccaccgtgtccggcaaacttatccacgagtggtgctgccggagctgcactctgcccccgctccgctatatgggggaggacggatgctggtatggaatggagatacggcccatctccgagaaggaggagaacatggtcaagagcctggtctcagccgggagcggcgaggtggacaacttcacgatgggcgtcctatgcctcgcgatcctgttcgaggaggtaatgcgcggcaagtttgggaaaaagcatatgattgcgggcgtcttctttacgttcgtcttgttgctttccgggcagataacctggcgggacatggcccacaccctgatcatgatcggcagcaacgcctccgaccgtatgggaatgggcgtcacttacctcgccttgatcgcgactttcaaaatccagcccttcctggcattgggcttcttcctgcggaaacttaccagccgcgaaaacctattgctgggggtaggcctcgcgatggccaccaccctgcagctcccagaagacttcgaacagatggccaacggcatcgcgctcgggttgatggccttaaagctgatcactcagttcgaaacctaccagctttggaccgccctgatcagcctcacgtgctcaaacacgatctttactctgaccgtcgcatggcggacagcgaccctcatcctcgcgggcgttagtctgctgccggtatgccagtcaagctccatgcgaaagaccgactggctccccatgaccgtcgccgcgatgggggttcctccgctcccactgttcatcttcagcctaaaggatacgctgaagcgccggtcctggcctctgaacgaaggggtcatggccgtggggctcgtgagcatcctggcctctagcctgctacgtaacgacgtacccatggcgggccccctggtggccggagggctgttgattgcctgctatgtgatcaccggcacatccgccgacctgaccgtagagaaagcagcggacgtgacgtgggaggaggaggcagagcaaaccggcgtgagccataacctgatgatcaccgtcgacgacgacggcactatgcggatcaaggacgacgagaccgagaacatcctcaccgtgctgctgaagacggccctcctgatcgtgtccgggatcttcccttacagcatacccgccaccctgctcgtctggcacacttggcagaagcagacgcagcgctccggcgtgctgtgggacgtgcccagccctcccgagacccagaaagccgagctagaggagggcgtctaccggatcaagcaacagggaatcttcggcaaaacccaagttggggtgggcgttcagaaggagggggtgttccacaccatgtggcacgtgacgcgtggcgcggtcctcacctacaacggcaagcggctcgagcctaactgggcctccgtgaagaaggacctgatctcttacgggggcgggtggcgcctctccgcccagtggcagaagggggaggaagtacaggtgatcgccgtggagcccgggaagaatcccaagaactttcagacgatgccaggtaccttccagacgaccaccggagagatcggggcgatcgccctggacttcaaacccggaaccagcgggagcccaatcatcaatcgagagggaaaggtggtgggcctgtacgggaacggcgtggtgacgaagaacgggggttacgtttccgggatcgcccagaccaacgccgagccggacggtcccgcccccgagctggaggaagagatgtttaagaagcggaacctcaccatcatggacctgcatcccggaagcggcaaaactcggaagtacctgccggccatcgttagggaggccatcaagcggcgcctccgtacgctgatcctcgcccccacccgtgtggtcgccgccgagatggaggaggcgctcaaggggctgcccatccggtatcagacgaccgcaacgaagtccgagcacactgggcgcgagatcgtggacctgatgtgccacgccaccttcacgatgcggctcttatctcccgtgcgagtcccgaactacaatcttatcatcatggacgaggctcacttcacggatcccgcatccatcgcggcgcgcggctacattagcacgcgtgtggggatgggcgaggccgcagcgatcttcatgaccgccacaccgcctggcacggccgacgcattcccgcagtccaatgcccccatccaggacgaggagagagacatccccgagcgttcatggaactcggggaatgagtggatcaccgacttcgcgggcaagaccgtgtggttcgtccccagcattaaggcagggaacgacatagccaactgcctgcgcaagaacggcaagaaggtaatccagctgtctcggaagacctttgacactgagtaccagaagaccaagctgaatgactgggacttcgtggtcaccaccgatatcagcgagatgggagccaacttcaaggccgaccgcgtgatcgacccgcggcgctgtctcaagcccgtgatcctgacggacggccccgagcgggtcatcctggcgggccccatgccggtgaccgccgcctccgccgcccagcgccggggacgcgtgggccggaacccccagaaggaaaatgaccagtatatttttaccgggcagcccctcaacaacgacgaggaccacgcgcactggaccgaagccaagatgctgttagacaacatcaacacccccgaggggatcatcccggccctcttcgagcccgagcgagagaagtcagccgcgatcgacggggagtaccggctgaagggcgagtctcgaaaaacgttcgtcgagctgatgcggcgcggggatttgcccgtgtggctggcccacaaggtagcctccgaggggatcaaatataccgaccggaagtggtgtttcgacggccagcggaacaaccagattctggaggagaacatggacgtggagatctggactaaggagggggagaagaagaagttacggccccgctggctggacgcccgcacctactccgacccgctggcccttaaggagttcaaggattttgcggccggccgcaagagcattgccctggacctggttacggagatcggccgcgtcccaacccacctcgcccaccggacccggaatgccctggataaccttgttatgctccacacctcggagcatggaggtaaggcgtaccggcacgccgtggaggagctgcccgagacgatggagaccctgttgctactggggctcatgatcctcctgaccggcggagcaatgctgtttctgatcagcggcaagggcattgggaagaccagcatcggtctaatctgcgtcatcgcctcctctgggatgctctggatggccgaaattccgctacaatggattgcgagtgccatcgttctggagttcttcatgatggtgctcttgatccccgagccggagaagcagcgcacgccacaggacaatcagctcgcgtacgtagtaatcggcattctcaccctggcagccatcatagcggccaatgagatggggctgctcgaaaccaccaagcgggacctgggtatgtccaaggagccgggagtagtctcccccactagctacctggacgtggatcttcaccccgcatccgcctggaccctgtacgcagttgccaccaccgtgataacgcccatgctgcggcacacgatagagaacagcaccgccaacgtgtccctagctgctatcgcaaaccaggccgtggtcctaatggggctggacaagggctggccgatcagcaaaatggatctcggagtacccctgctggctttgggttgctattcccaggtgaaccccctgaccctgaccgcagccgtccttctgctgatcacgcattatgcgatcatcgggcccggcctccaggccaaggcgacacgcgaggcccagaagcgcaccgcggcgggcatcatgaagaacccgacggtggacgggatcatgaccatagacctggaccccgtgatctacgatagcaagttcgaaaagcagttgggccaagtcatgctcctggtgctgtgcgcagtgcagctcctgctgatgcggacatcctgggccttatgcgaggccctgaccctggcgacggggcccatcacgaccctctgggagggcagcccgggcaaattttggaacaccacgattgccgtctccatggccaacatattccgcgggtcatacctagcgggcgccgggctggcgttctccatcatgaagtctgtgggcaccggaaagagaggcaccggctcccagggggagaccctcggcgagaagtggaagaagaagctaaaccagctgagccgcaaggagttcgacctgtacaagaagtccgggattaccgaggtggacaggacggaggccaaggaaggcctgaagcgcggagagattacacatcatgccgtgtcccggggcagtgccaagctgcagtggttcgtcgagcgcaacatggtgattccggagggccgggtcatcgacctcggctgcggccgcgggggctggtcttactactgcgcagggctgaagaaggttaccgaggtccggggctacacaaagggcgggccaggccatgaggagcccgtgccaatgagcacgtacggctggaacatcgtgaagctgatgtccggcaaggacgtgttctacctcccgcccgagaagtgcgacacgctgttgtgcgacatcggggagagctccccctctcccaccgtcgaggaatcccgcaccatccgcgtcctgaagatggtggagccgtggctcaagaacaaccagttctgtatcaaggtcctgaacccctacatgccgacggtgatcgagcacctagagcggcttcagcgcaagcacggcggaatgctggtgcggaaccctctgtctcgcaactccacccacgagatgtactggattagcaacgggaccggcaacatcgtcgcgtccgtgaacatggtgtccaggctcctactgaaccgcttcaccatgacgcaccggcgcccgaccatcgaaaaggacgtcgacctaggggccggcaccagacacgtgaacgctgagccggagacacctaatatggatgttatcggcgagcgcatcaagcggatcaaggaggagcacaactccacgtggcattatgacgacgagaacccgtacaagacctgggcataccatgggagctatgaggtcaaagccacaggctccgccagctccatgatcaatggagtggtcaagctgctaacgaagccctgggacgtggtacccatggtcacgcagatggccatgaccgacactacccccttcggccaacagcgagtgttcaaggaaaaagtggacacaagaacccctcgctccatgcccgggacccggcgcgtcatgggcatcaccgcagagtggctctggcggaccctgggccgcaataaaaagccccggctgtgcaccagggaggagttcaccaagaaggtgcgcaccaacgccgcgatgggggctgttttcacggaggagaaccaatgggactccgccaaggccgccgtcgaagacgaggacttctggaagctcgtggatcgggagcgcgagctgcacaagctgggaaagtgcgggtcctgcgtgtacaacatgatgggaaagcgggagaagaagctgggagagttcggcaaggcgaagggaagccgcgccatctggtacatgtggctgggggcccggtacttggagtttgaagccctcggattcctgaacgaggaccactggttctccagggagaactcatactccggagtcgagggcgaggggttacacaaactgggttacatcctacgcgacatcagcaagatccccggaggggccatgtatgcggacgacaccgccggttgggacacccgcatcaccgaggacgacctgcacaatgaggagaagatcacgcagcagatggatccggagcaccggcagctcgccaacgccatcttcaagctgacctatcagaataaagtcgtaaaagttcagagaccgaccccaaccgggaccgtgatggacatcatctccagaaaagaccagcgcggcagcggccaagtgggtacgtatggactgaacaccttcaccaacatggaggcccagctcatccggcagatggagggagagggggtcctgtccaaggccgacctggagaatccccacttgccggagaagaagatcacccagtggctggagacgaagggggtggagagactcaagcggatggctatcagcggtgacgactgcgtggtgaagcccatcgacgaccgcttcgctaacgccctcctggcgctgaacgacatgggcaaggtgcggaaggacatcccccagtggcagccttccaaggggtggcacgactggcagcaggtaccgttctgcagccaccacttccacgagctcatcatgaaggacggccgcaagctggtcgtgccatgccggccccaagacgagctgatcgggcgcgcgcggatatcccagggcgccgggtggagcctccgcgagaccgcgtgcctgggcaaggcgtatgcgcaaatgtggtccctgatgtatttccacagacgcgacttacgcctggcctctaacgctatctgctccgccgtccccgttcattgggtgccgaccagccggaccacgtggtccatccatgcccaccaccaatggatgacaaccgaggacatgctgaccgtgtggaacagagtatggatcgaggacaacccctggatggaggacaagacgcccgttaccacctgggagaacgtaccctacctcggcaagcgggaggaccagtggtgcgggtctctgatcggccttacctcgcgcgcgacttgggcccaaaacatcccaaccgccatccagcaagtccgttccctcatcgggaacgaggagttcctggactacatgcccgccatgaagcgcttccggaaggaggaggagagcgagggcgccatatggtga

SEQ ID NO: 26049 - RNA, 9873 nt, synthetic construct
  misc_feature 1..9873: note = derived and/or modified CDS sequence (opt11) from DENV-3__FJ639780__SS-prME
  source 1..9873: mol_type = other RNA
acaagcctctgtctcatgatgatcctgcccgcggcgctggctttccacctcaccagccgggacggcgaaccgcggatgatcgtggggaaaaacgaacggggcaagagcctgttgtttaagaccgcatccggtatcaacatgtgcaccctcatcgccatggacctgggcgaaatgtgcgatgacaccgttacctacaagtgtcctcacattacagaggtcgagcccgaggacatcgactgctggtgcaacctgaccagcacctgggtgacctacgggacgtgcaatcaggccggcgagcaccggcgcgacaagcggtccgtggctctcgcgccccacgtcggcatggggctggacacccgaacccagacctggatgagcgccgagggcgcctggagacaggtggagaaggtggagacctgggccctgcgacacccggggttcaccatcctcgcgctgttcctggctcactacataggcacctccctcactcagaaagtggtgatcttcatcctcctgatgttggtcacgcccagcatgaccatgcgttgcgtgggggtgggaaaccgcgacttcgtcgagggcctgtccggggccacctgggtggacgtggtgctggagcacggcgggtgtgtgaccacgatggccaagaacaagcccaccctcgacattgaactgcagaagaccgaggccacccagctggcaacgctccggaagttatgcatcgagggcaagatcaccaacatcaccaccgactctcggtgcccgactcagggcgaggcagtgcttcctgaggagcaagaccagaactatgtctgtaagcacacctatgtagatcgggggtggggcaacgggtgcggcttattcgggaagggctcccttgtgacctgcgccaagttccagtgtcttgagcccatcgagggcaaggtagtgcagtatgagaacttaaagtacacggttataatcaccgtacacaccggggaccagcaccaagtgggcaacgagacccagggggtcaccgccgagatcacgccccaggcctcgacgaccgaggcgatactgcccgagtacgggactctggggctcgagtgctccccgcgcaccggactggacttcaacgagatgattctgctcacgatgaagaacaaagcctggatggtgcaccggcagtggttctttgacttacccctgccctggaccagtggcaccacgacggagactcctacctggaatcgcaaggagctattagtgacttttaagaacgcccacgcaaagaagcaggaggtcgtggtgctggggtcacaggaaggcgccatgcacacagcgctcaccggggctaccgagatccaaaattctggcggcacctccatcttcgccggccacctgaagtgccggctgaagatggataaacttgagctgaaggggatgtcctatgcgatgtgcactaacacatttgtcttaaagaaggaggtaagtgagacccagcacgggacaatcctaatcaaggtggagtataagggcgaggatgtgccctgcaagatcccgtttagcacggaggacggccaggggaaggcccacaacggccgcctcatcactgcgaaccccgtggtgaccaagaaggaggagcccgtcaacatcgaagcggagccacccttcggggagagcaacatcgtgatcggaatcggcgacaacgccctgaagattaactggtacaaaaagggctccagcataggaaagatgtttgaggccactgcgcggggcgcccgccggatggccattttgggcgacacggcctgggacttcgggagtgtcggaggggtcctcaacagcctgggcaagatggtgcaccagatattcgggtcagcatacacagctcttttctctggcgtgtcctgggtcatgaagatcggcatcggcgtgctcctgacgtggatcggcttaaacagcaagaatacctccatgtccttctcgtgcatcgcaatcggaatcattacactctatttgggcgccgtggtccaggcggacatggggtgtgtaatcaactggaagggtaaggagcttaagtgcggatcagggatcttcgtgaccaacgaggtccacacctggaccgagcaatacaaattccaggccgactcccccaagcgcctcgcgacggccatcgccggcgcttgggagaacggggtgtgcggtatccgcagcactacccggatggagaacctgctgtggaagcaaatcgcaaacgagttaaattacatcctctgggagaacaacatcaagctcaccgtggtcgtgggggacatcatcggagttctcgagcagggaaagcgcacgctgacgccccagcccatggagttaaaatacagttggaagacctgggggaaagcaaagatcgttaccgcagaaacccagaacagctccttcattatcgacggccccaacacccccgagtgccccaacgccagccgggcctggaacgtttgggaggtggaggactacgggttcggcgtattcactaccaacatctggctcaagctacgtgaggtgtacacccagctgtgcgaccaccgtctcatgtccgcggccgtgaaggacgagcgcgccgtccacgccgacatgggctactggatcgagtcacagaaaaacgggagctggaagctggagaaggcctccctgatcgaggtgaagacgtgcacatggcccaagtcccacacactctggtcaaacggcgtgctcgagtcagatatgatcatccccaaatccctggcggggcccataagccagcacaactatcggccgggatatcacacccaaacggccggaccctggcacctcggcaagctggagcttgatttcaactactgcgagggcaccactgtcgtgatcaccgagaactgcggaacgcgcgggccctccctccggacaaccactgtgagcgggaagctgatccacgagtggtgctgcaggagttgcacgctgccccctctccggtacatgggcgaggacgggtgctggtacggcatggaaattcgccccatcagtgaaaaggaggagaacatggttaagagcctggtgagcgccggctccggggaggtggacaacttcaccatgggcgtcctgtgcctagccatcctgttcgaggaagtgatgcgtgggaagttcggcaagaagcacatgattgccggggtatttttcaccttcgtcctactcctgagcggccagatcacctggcgcgacatggcgcacacgctgatcatgatcggcagcaacgcctcagaccggatgggaatgggcgttacctacctcgccctgatcgccaccttcaaaatccagcctttcctggccctcggattcttcctgcgcaagctaacctcccgggagaatctcctgctcggcgtgggcctggcgatggccacgaccctgcagctgccagaagacatcgagcagatggcaaacgggatcgccctcggcctgatggcgctaaaacttatcacccagttcgagacctatcagctgtggactgccctgatcagcttgacctgcagcaacacgatctttaccttaacggtggcctggcgaaccgccaccctgatcttagccggggtgtccctgctgcccgtatgccagagcagttctatgcggaagaccgactggctccccatgacggtggccgccatgggcatcccgcctctcccgctgttcatattcagcctaaaggacaccctgaagcgccgctcgtggcccctgaatgagggggtgatggccgtgggcctcgtatccatattggccagctccctgctccggaatgacgtgccaatggccggccctctggtcgccggcgggttgctaattgcctgctacgtgatcacggggaccagcgcagatctgacggtggagaaggccgccgacgtcacctgggaggaggaggcggagcagacgggcgtgtcccacaacctgatgatcaccgtggacgacgacgggaccatgagaatcaaggacgatgagaccgagaacatcctcaccgtgctgctgaagacggccctcctgatcgtgtccgggatattcccgtacagtatccccgccaccctcctcgtgtggcacacgtggcagaagcagacccagcggagcggagtcctgtgggacgtgcctagcccgcccgagacccaaaaagccgagctggaagagggggtgtacaggatcaagcagcaaggcatcttcgggaaaacccaagtcggcgtgggcgtacagaaggagggcgtcttccacaccatgtggcacgtgacacgcggcgccgtgctcacctacaacgggaagcgtctggagcccaattgggcgagcgtaaagaaggatctgatctcttacggtgggggctggcggcttagcgcccagtggcagaagggggaagaggtacaggtgattgctgtagagcccggaaagaatcccaagaacttccagaccatgcccggcacgttccagaccaccactggagagataggcgccatcgcgctggacttcaagcccgggacgtccggcagccctattatcaaccgcgagggcaaggtagttggcttatacggcaacggggtcgtgaccaagaacggcgggtacgtaagcggcatcgcccagaccaacgccgagccggatgggcccacccccgagctggaggaggagatgttcaagaagaggaacctcacgattatggacctgcaccccgggtccggcaagacccgcaagtacctgcccgccatcgtccgggaggccataaagcgccggctccgcacccttatcctggcacccacccgggtagtggccgccgagatggaggaggccctaaaggggctacccatccgctaccaaacgaccgcaaccaagagtgagcataccggcagggagatcgtagacctcatgtgccacgcgacgttcactatgcgcttactgtcccccgtgcgtgtgccgaactacaacctgataatcatggacgaggcccacttcacggaccccgcaagcatcgccgcgcgcggctacatctccacccgggtcggaatgggcgaggcagccgctatcttcatgacggccacgcctccagggaccgcggacgcctttccgcagagcaacgctcccatccaggacgaggagcgcgacattccagagcgctcctggaacagcggaaatgagtggattaccgacttcgccggtaagacggtatggttcgttccctccatcaaggcaggaaacgatatcgcgaactgcctccggaagaacgggaagaaggtgatccagctgagccgcaagaccttcgacaccgagtaccagaagaccaagctgaatgactgggatttcgtggtgacgaccgatatttcagagatgggcgctaacttcaaggccgaccgggtcatcgatccgcgccggtgcctcaagcccgtgattctgaccgacggccctgagcgggtgatcctggcgggccccatgccggtaaccgcagcgagtgccgcccaacggcgcggcagagtggggcgcaatccccagaaggagaacgaccagtacattttcaccggacagcccttaaacaacgacgaggaccacgctcactggacggaggccaaaatgcttctagacaacatcaacacccccgaggggatcatcccggccctctttgagcccgaacgggagaaatccgccgccatcgacggcgagtacagactcaagggcgagagccggaagaccttcgtggagttgatgcggcgcggagacctccccgtctggttagcccacaaggtggcgagtgagggcatcaagtacaccgaccgcaagtggtgcttcgacgggcagcggaacaatcagatcctggaggagaacatggacgtcgaaatctggacgaaggaaggggagaggaaaaagctccgtccccgctggctggacgcccgcacctacagcgatccgctggccctcaaagagttcaaggatttcgcagccggccgtaagtccatcgcgttagacctggtcaccgagatcgggcgcgtacccacacacctcgcccaccggacgcgcaacgctctggacaacctcgtcatgttacacaccagcgagcatggcgggaaggcctatcggcacgccgtggaggagctgcccgagaccatggagaccctgctcttactcggccttatgatactgctgaccggcggagcgatgctgttcctaatctccgggaaggggattggcaagaccagcatcgggctgatctgcgtgatagccagctccggcatgctctggatggccgagatcccgctgcagtggatagccagcgccatcgtcctggagttcttcatgatggtgcttttaattcccgagcccgagaagcagcgcacgccccaggacaaccagcttgcgtacgtggtcatcgggatactaaccctggccgccatcattgccgctaacgaaatgggcctgctcgaaacgaccaagcgggacctgggcatgtccaaggagccgggtgtggttagccccacttcctacctggacgtcgatttacaccccgcgtcggcgtggaccctgtatgccgtggccacgaccgtgatcacccccatgctgcgccataccatcgagaacagtaccgcgaatgtgagcctcgcggccatagccaaccaggccgtggtgctcatgggcctggacaaggggtggccgatctccaagatggacctcggcgtccccctgctggcgctagggtgctacagccaggtaaaccccctcaccctgaccgccgctgtgttgcttttgatcacccactacgcaatcattgggcccggcttacaggccaaggcgacacgggaggcccagaagcgcaccgccgccgggatcatgaagaatcctaccgtcgacggcatcatgaccatcgacctggaccccgtcatatacgactccaagttcgagaagcagctgggccaggtgatgctcctggttctgtgcgccgttcagttactgctgatgcggacgtcctgggcgctctgcgaggccctgaccctggccaccggccccatcaccacgctctgggagggctcccccgggaaattctggaacaccaccatcgccgttagcatggctaacatcttcagaggatcctatctggctggggccggcctggccttcagcataatgaagtccgtcggaaccggaaaacggggtaccgggagccagggcgaaacgctcggggaaaagtggaagaagaagctcaatcagctgtcccgcaaggagttcgacctctacaagaaatccggcatcaccgaggtagaccggaccgaggcgaaggaggggcttaaacgcggcgagatcacgcatcacgctgtgagccgaggctccgccaaactgcagtggttcgtggagcgcaacatggtaatccccgaggggcgtgtgatcgatctgggatgcggacgcggtgggtggagctactattgcgcgggactgaagaaggtcacggaggtgcggggctacaccaagggcgggcccgggcacgaggagcccgtgccgatgagcacctacggctggaacatcgtcaaacttatgagcgggaaggacgtcttctatctcccgcctgagaagtgtgacaccctgctttgcgacatcggcgagtcctctccttcccccacggtggaggagagtcgcaccatccgcgtcctgaagatggtggagccatggctaaagaacaatcagttctgcataaaggtgctgaacccctatatgcccgcggtcatcgagcacctggaacgtctccagcgtaaacacggcgggatgctggtgagaaaccccctgtcccggaactcgacccacgaaatgtactggatctccaacggcacagggaatattgtggccagcgtcaacatggtgagtcggctgctgctgaacagattcacgatgacccacaggcgcccgacgatcgagaaagacgtggacctcggcgctggcaccagacacgtaaacgccgagcccgaaactcccaacatggacgtgataggggagcgcatcaagcggatcaaggaggagcacaacagcacctggcattacgatgacgagaacccgtacaagacctgggcgtaccacggctcgtacgaggtgaaagccaccggcagtgccagtagcatgatcaacggagtcgtgaagttactgacgaagccctgggacgtcgtgcccatggtgacccagatggcgatgaccgacaccacccccttcgggcagcagcgagtcttcaaggagaaggtggacacccggaccccgcggtccatgcccggtacccggcgcgtgatgggcatcacggctgagtggctctggcggaccctggggaggaacaagaagccgcggctgtgtacacgggaggagttcaccaaaaaggtcaggacgaacgccgccatgggcgcggtgttcaccgaagagaaccaatgggacagcgcaaaggcggccgtggaggacgaggacttctggaagttagttgaccgggagcgcgagctgcacaagctgggcaagtgtggcagctgcgtctacaacatgatggggaagcgtgagaagaagctcggagagttcggcaaggccaaagggtcccgggcgatctggtacatgtggttgggcgcccggtacctggagtttgaggccctagggttcctgaacgaggaccattggttcagccgcgagaacagttacagcggcgttgagggggagggcctgcacaagttgggctacatcctgcgggacatctccaagatacccgggggcgccatgtacgctgatgacacagcggggtgggacacccgcatcaccgaggacgacctccacaacgaggagaaaatcacccagcagatggacccggagcaccggcagttggccaacgccatcttcaagttgacgtaccagaacaaggtcgttaaggtgcagcgcccgacccctaccggcacggtaatggacataatcagccggaaggaccagcgcggctccggccaggtgggcacatatggcctgaacaccttcaccaacatggaggcgcagctcatccggcagatggagggcgagggggtgctgagcaaggccgacctggagaacccgcacctcccggagaagaaaatcactcagtggctggagaccaagggcgtcgagcgcctgaagaggatggcgatctccggcgacgactgcgtggtgaagcctatcgacgacagattcgccaatgccctcctggccctgaatgacatggggaaggtccggaaggacatcccccagtggcagccctctaagggctggcacgactggcagcaggtcccgttctgctcccaccacttccatgagctcatcatgaaggacggacgcaagctggtggtcccctgccggccccaggacgagctcatcggtcgagcacggatctcacagggggcgggctggtccctccgcgagaccgcatgcctgggaaaggcctacgcccagatgtggtcactgatgtacttccaccgccgtgacctccgcctggcgtccaacgccatctgcagcgccgtaccagtgcactgggtcccgaccagtagaacgacatggagcatccacgcccatcaccaatggatgaccaccgaagacatgctgacggtgtggaaccgagtgtggatcgaagacaacccctggatggaagacaagacccccgtcaccacctgggagaacgtgccttacctcgggaaacgggaggaccagtggtgcggatccttgatcgggctgacgtcgcgcgccacctgggcgcagaacattccgaccgccattcagcaggtccgcagcctcatcggcaatgaggagttcctggattatatgccctccatgaagcgcttccgcaaggaagaggagagcgagggggccatctggtaa

SEQ ID NO: 26050 - RNA, 9873 nt, synthetic construct
  misc_feature 1..9873: note = derived and/or modified CDS sequence (opt11) from DENV-3__FJ639781__SS-prME
  source 1..9873: mol_type = other RNA
accagcctgtgcttaatgatgatcttacccgcagccttagcgttccacctcacaagccgggatggtgagccccgcatgatcgtggggaagaacgagcggggaaagagcctactttttaagacggcctcggggataaacatgtgtaccctgatcgcgatggacctgggggagatgtgcgacgacaccgtgacctacaagtgcccccacatcacggaggttgagcccgaggacatcgactgttggtgtaacctgacgtctacgtgggtgacgtacgggacgtgcaaccaggccggcgagcatcggcgcgataagcgctcggtggccttggcgccccacgtgggcatgggactggatacgcgcacccagacctggatgtcggccgagggcgcatggagacaggtcgagaaggtggagacgtgggctttgcgccacccggggtttacgatactcgcgctgttcctggcccaatacataggcacaagtctcacccagaaggtggtgatcttcatcttgctgatgctcgtcactcccagcatgacaatgcggtgtgtgggtgtgggcaaccgcgacttcgtcgagggcctgtccggtgccacctgggtggatgtagtcctagaacacggcgggtgcgtgaccacgatggcaaaaaacaagcccaccctcgatatcgagctgcagaagacagaggctacccagctcgcgacgctcagaaaactgtgcatcgagggcaaaatcaccaacatcaccactgacagccgctgcccgacgcaaggcgaggctgtgctcccggaggagcaggaccagaattatgtctgcaaacacacctacgtggaccgcgggtggggaaacgggtgcggcttgttcggcaagggcagcctggtgacctgcgctaaattccagtgcctggagccaatcgagggcaaggtggtgcagtacgaaaacctcaagtacaccgtcatcattacagtccacaccggggaccagcaccaggttggcaacgaaacgcaaggagtcaccgccgaaatcacccctcaggcctccaccaccgaggcgattctgcccgagtatggcaccctcgggctcgaatgctctccgcgcaccggactggacttcaacgagatgattctgctcacgatgaaaaacaaagcctggatggtgcaccggcagtggttcttcgatctgcctttaccctggaccagtggtgccaccaccgagacgcccacgtggaaccgcaaagaattgctcgtgactttcaagaacgcacacgctaagaagcaggaggtagtggttctggggtcccaggagggcgcgatgcacacagccctcacgggtgctaccgagatccagaacagcggcggaacctccatttttgccggccacctgaaatgccgactgaagatggacaagctcgagctgaagggaatgagctacgcaatgtgcaccaacacgttcgtgctgaaaaaggaagtgagcgagacccagcacgggaccattctaatcaaggtggaatacaagggtgaggacgtgccgtgtaaaatcccattcagcaccgaggacgggcaggggaaagcgcataacggccgcctgattacggccaaccccgtagtaaccaaaaaggaggaacccgtcaacatagaggccgagccgccatttggggagagcaacatagttatcggcatcggggacaacgccctgaagatcaactggtacaagaagggctcctccatcggaaagatgttcgaagcgaccgcccggggcgcccgccggatggccatcctaggcgataccgcctgggatttcgggtccgtgggcggggtcctcaacagcctgggcaaaatggtgcaccagatctttgggtccgcgtacacagcgctgtttagcggcgtatcttgggttatgaagattggcatcggcgtactcctgacctggatcggcctgaactctaagaacatctccatgagcttctcctgtatcgccattgggatcatcaccctctatctgggcgccgtggtccaggccgatatggggtgcgtgataaactggaaaggtaaggagttaaaatgcggaagtggaatttttgtgaccaacgaggtccatacgtggaccgaacagtacaagttccaggctgactctcccaagcgcctagccaccgccatcgcaggcgcctgggagaatggggtgtgcggcatccgcagcaccacgaggatggagaaccttctgtggaaacaaatcgcgaacgaactcaactacatcctatgggagaacaatatcaagctgacagttgttgtcggggacaccatcggcgtcctcgagcagggtaagaggactctgactccccaaccgatggaacttaagtactcctggaagacctggggtaaggccaagatcgtcaccgccgagacccagaactcttccttcataatcgacggccccaacacgcctgagtgcccctctgcctcccgtgcctggaatgtgtgggaggtcgaggactacgggttcggcgttttcaccaccaacatctggctcaagctgcgcgaggtgtatacacagctgtgcgaccaccggctaatgagtgccgccgtgaaggacgagcgcgcagtccatgccgacatgggttactggattgagagccagaagaacggatcttggaaactggagaaggcgagccttatcgaagtgaagacctgcacctggccgaaaagccataccctctggagcaacggcgtgctggagtccgatatgatcatacccaagtcacttgccgggcccattagtcagcacaactatcggccgggttatcacacccaaaccgcaggtccctggcacttaggtaaactggagttagactttaactactgcgagggtacgaccgtcgtgataaccgagaactgcggtacccgcggccccagcctccggacgacaaccgtgtcgggtaagctgatccatgagtggtgttgccgctcgtgcaccctgcccccgctccggtacatgggcgaagacgggtgctggtacggcatggaaatccgtcccatctccgaaaaggaggaaaacatggtcaagtcacttgtctccgccggcagcggagaggtcgacaacttcacgatgggtgtcctgtgcctcgccattctgttcgaggaggtgatgcgggggaagttcggcaagaagcacatgatcgcaggtgtgttctttacatttgccctcttgctgtccggccagatcacctggcgcgacatggcccacaccctgatcatgatcggcagcaacgccagtgaccggatgggtatgggcgtaacgtacctcgcactgatagcaaccttcaagatacaaccctttctggccctcgggtttttcctgcgcaaactgaccagccgggagaacctactgctgggagtgggcctcgccatggccacaacgctgcagctgccagaggacatcgagcagatggcgaacggtatagccctcggactcatggccctgaagctcataactcagtttgaaacgtaccagctctggaccgccctgatcagcctcacctgctctaacaccattttcaccctgaccgtggcttggcgcacggcgacactgatcctcgccggtgttagccttcttccggtgtgccagtccagcagcatgaggaaaaccgactggctccctatgaccgtcgcggccatgggcgtaccgccgctccccctgttcatctttagcctcaaggacacgctgaagcgccgctcctggcccttaaacgagggagtgatggccgtcgggcttgttagcatcctagcgtctagccttctacggaatgacgtccccatggccggccccctggtagccgggggcctactcatcgcctgctacgttatcaccggtacctcggccgacctgaccgtggagaaggccgccgatgtcacgtgggaagaggaggccgagcagacgggcgtgagccacaacttaatgatcaccgtggacgatgacgggaccatgagaattaaggacgacgagactgagaacatcttgacggtcctgctgaagaccgccctcttgatcgtgtccggcatcttcccgtatagcattcccgccaccctcctggtgtggcacacgtggcaaaagcagacgcagcggtccggcgtcctgtgggacgtccccagcccgccagagacccagaaggcggagttggaggagggggtataccgcatcaaacagcagggcatcttcgggaagacccaggtcggggttggggtgcagaaggagggggtctttcacaccatgtggcatgtgacgcgaggcgccgtattaacctataatgggaagcgactggagccgaactgggcatccgtcaagaaggaccttatcagctatggcggtggttggcgtctctccgcccagtggcagaaaggggaggaggtccaggtgatcgctgtcgagccaggcaagaatcccaagaacttccagaccatgcccggcacgttccagacgaccaccggggaaatcggcgctatcgccctggacttcaagcccgggaccagcggcagccccattatcaaccgcgagggcaaggtggtgggtctgtacggcaacggagtagtgacgaagaacggcgggtacgtgtccgggattgcccaaaccaacgccgagccggacggcccgacccccgagctggaggaagaaatgttcaaaaagcgtaacctcacaatcatggacctacacccgggatcggggaagacgcggaagtacctcccagcgatagtcagagaagccataaagcggcggctccgcaccctgatcctggcgcccaccagggttgtggccgccgagatggaggaggcgctcaaaggactgcccatccgctatcagaccacagctaccaagtccgaacacacaggacgggagattgtcgacctcatgtgtcatgctaccttcaccatgcgcctcctcagccccgtccgggtcccgaactacaacctgattatcatggatgaggcccacttcaccgaccccgcatccatcgctgcccgcggctacatcagcacccgtgtcggcatgggcgaggccgcggcgatctttatgacagccacaccgcccgggaccgccgacgcattcccgcagtccaacgcccccatccaagacgaggagcgcgacatccccgagcgctcgtggaactccggcaatgagtggatcaccgactttgctgggaagactgtgtggttcgtgccctcgattaaggccggtaacgatatcgccaactgtctccggaagaacggcaagaaggtgatccagttaagtcgcaagacttttgacaccgagtaccagaagaccaagctgaatgactgggacttcgtggtaacaactgatatctctgagatgggggcaaatttcaaggccgaccgagtcatagacccgcggcgatgcttgaagcccgttatattaaccgatggccccgaacgcgtgatcctggcggggcctatgccggtcaccgcggcctcagcggcccagcggcgcggccgggtcgggcgcaacccccagaaggagaatgaccaatacatcttcactggccagcccctcaacaacgacgaggaccacgcgcactggaccgaggccaagatgctgctggacaacatcaatacgccagaggggatcatcccggccctcttcgagcccgagcgggagaagtccgccgcgatcgacggcgagtatcggctgaagggggaatcccgtaagaccttcgtggaactgatgcgccgcggggacctccccgtctggttagcccacaaggtagcatcggagggaatcaagtacaccgaccgcaagtggtgcttcgacgggcaacggaataaccagatcctggaagagaacatggacgtcgagatatggaccaaggagggcgagaaaaagaagctacgcccccggtggctggacgcacgtacgtacagcgaccccctggccttgaaagagttcaaggacttcgcggccggccgcaagagcatcgcgctggatctcgtgacggagatcgggcgggtgcctacccacctcgcccaccgcacccgaaacgctctggacaacctggtcatgctccacacgagtgagcacggcggcaaggcgtaccgccacgccgtggaggagttacccgagaccatggaaaccctgctccttctgggactcatgatcctgctaaccgggggagccatgctgtttctgatcagcggcaaagggattggcaagacaagcatcggtctgatctgtgtgatcgccagtagcggcatgctttggatggcggagatcccgctgcagtggatcgcgtccgccatcgtccttgagtttttcatgatggtgctcctgatccccgagcccgagaagcagcggacaccccaagacaaccagctggcctatgtggtcatcgggatcctcaccctggctgccaccatcgcggccaacgagatgggcctgcttgagacgaccaaacgagacttgggcatgagcaaggagccgggggtggtgagccccactagctacctcgacgttgaccttcacccagcctccgcctggaccctgtatgccgttgccacgacagtcatcacacccatgctgcggcataccatagagaacagcaccgccaacgtaagcctcgccgccatcgcaaaccaagccgtagtgctgatgggcctagacaagggttggccgatcagcaagatggaccttggcgttcccctgctggccctcgggtgctattcccaagtcaaccccttaaccctgaccgccgccgtgctactgctgatcacccactacgcgatcatcggcccgggcctccaagctaaggccacgcgcgaagcccagaaaaggacggccgcgggtatcatgaagaatccgaccgtagacggcattatgaccatcgatctggaccccgtgatctacgacagcaagtttgagaaacagctgggacaggtgatgctcctggtcctgtgcgcggtgcaactccttctgatgcgcacgtcctgggcgttatgcgaggccctgacgctggcgaccggccccatcaccacactctgggagggaagcccaggtaagttctggaacaccaccatcgccgtgtccatggccaacatcttccggggcagctacctggctggggccggcctggccttctccatcatgaaatccgtggggacaggaaaacgcggaaccgggtcccagggcgagaccctcggagaaaagtggaagaagaaactaaaccagctgagccggaaggagttcgacctctacaagaagtccggcatcaccgaggtggatcgcaccgaagccaaggagggactaaagcggggggagatcacccaccacgccgtttccaggggcagcgctaagctccagtggttcgtcgaacggaatatggtcatcccggagggacgcgtaattgacttgggttgcgggcggggcgggtggtcctactactgcgccggcctgaagaaggtcacagaggtgcgcggctacaccaagggcgggcccgggcacgaggagcccgtgcccatgagcacatacggctggaacatcgtaaagctgatgtccggtaaagacgtgttctaccttccgccagagaagtgcgataccctgctgtgcgacatcggagagagctcccccagccccacggtggaggagtcccggacgatccgagtcctgaagatggtggagccgtggctcaaaaacaaccagttctgcatcaaggtgcttaacccctatatgccaacagtaatagagcacctggagagactacagcggaagcacggagggatgctggtgcgcaaccccctgagccggaactccactcacgagatgtattggatcagcaacggcacgggaaatatcgtggcgtctgtcaatatggtcagcagactgctgctcaaccgctttaccatgacccaccgccggccgaccatcgagaaggacgtggatctcggcgccggaacccggcatgtcaatgccgaacccgagacccccaacatggacgtcatcggagagagaatcaagcgcatcaaggaggagcacaactccacctggcactacgacgacgaaaacccgtataaaacctgggcctaccacggaagctacgaggtgaaggccactgggtccgcgagctcgatgatcaacggcgtggtaaaactgctgacgaagccctgggacgtcgtacctatggtgacacagatggctatgacagacacgaccccgttcgggcaacagcgggtcttcaaggagaaggtggacacccgcacaccgcggtcaatgcctggcacgcgccgggtcatgggcataactgccgagtggctctggcgcaccctggggcggaacaagaagccacgtctgtgcacgcgcgaagaattcacaaaaaaggtaagaaccaacgccgcgatgggcgccgtgttcaccgaggagaaccaatgggacagcgcaaaggcagccgtggaagacgaagacttttggaagctggttgaccgagagcgagagctgcacaagctagggaagtgtggtagctgcgtatacaacatgatgggtaaaagagagaagaagctcggcgaattcggcaaggctaaggggtcgcgggccatatggtacatgtggctgggcgccagatacctggagttcgaggccctcggtttcttaaatgaggaccactggttcagccgggagaacagctactccggcgtcgaaggggaaggcctgcataagcttggctacatcctgcgcgacatcagcaaaatccccggaggcgcgatgtacgcggacgacacagcagggtgggacacccggatcaccgaggacgacctgcacaacgaggagaaaatcacccagcagatggacccggagcaccgccagctcgccaatgccatcttcaagctgacttaccagaacaaagtcgtgaaggtgcaacgccccacccccacggggacagttatggacatcatctcccgcaaggaccaacgcggcagcggccaggtgggcacctacgggctgaacaccttcaccaatatggaagcccagcttatccggcagatggagggcgagggggtgctgtccaaggccgacctggaaaacccccacctcccggagaagaagatcacccagtggctggagaccaagggcgtcgagaggctgaagcgcatggccatcagcggtgatgattgcgttgtgaagcccatcgatgaccggttcgccaacgcgttgctggctttaaacgacatggggaaggtccgcaaggacatcccccaatggcagccctccaagggctggcacgactggcagcaggtcccgttctgtagccaccatttccacgagctcatcatgaaggacggacgtaagctggtggtcccctgtcgtccgcaggacgagctgatcggccgggcgcgtatctcccagggggccggctggagcctacgggagaccgcgtgcctgggcaaggcctacgcgcagatgtggtctctgatgtacttccaccgtcgagacctccggctggccagcaacgcaatatgtagcgctgtccccgtgcactgggtccccacgagccgcaccacctggtccatccacgcacatcatcagtggatgaccacagaggacatgctcaccgtttggaatcgagtttggatagaggataacccctggatggaggacaagaccccggttaccacctgggagaacgtgccttacctcgggaagcgcgaggaccagtggtgcggcagcctgatcgggctaaccagccgggcgacctgggcgcagaatattccgaccgccatacaacaggtccgctccctcattggtaatgaggagtttctggattatatgcccagcatgaagcggttccgcaaagaggaggagtccgagggcgccatctggtga

SEQ ID NO: 26051 - RNA, 9873 nt, synthetic construct
  misc_feature 1..9873: note = derived and/or modified CDS sequence (opt11) from DENV-3__FJ639782__SS-prME
  source 1..9873: mol_type = other RNA
acctcgctgtgtttgatgatgatcctacccgccgccctggcgttccacctaacctctcgggacggggagccccggatgatcgtggggaagaacgaacggggcaagtccttgctgttcaagaccgcgagcgggataaacatgtgcacgctcatcgccatggacctgggcgagatgtgcgacgacaccgtgacctacaagtgtccccacatcacggaggtggagcccgaggacatcgactgctggtgtaacctgacgagcacctgggtgacctacgggacgtgcaatcaagccggcgagcaccggcgcgacaagcggtccgtggccttagcgccccatgtgggaatgggtctggacacccgcacccagacctggatgtccgcagaaggcgcatggcgccaagtagagaaggtcgaaacgtgggccctgcgccatccggggttcaccatcctggcgctattcctggcccattacatcggcacctccttgacccagaaggtggtgatcttcatcttactgatgctcgtcaccccctcgatgaccatgcggtgcgtgggcgtcggaaaccgagacttcgtcgagggcctgagcggggctacctgggttgacgtcgtcctggagcacggcgggtgcgttaccacaatggccaagaacaagcccactctcgacatcgagctgcagaagacggaggccactcagttagcgactctccggaagttgtgcatcgagggcaagatcacgaacatcaccaccgacagccgctgccccacgcagggcgaggccgtgctgccggaggagcaggatcagaactacgtttgcaagcatacctacgtcgatcggggttggggcaacgggtgtggtctgttcgggaagggttccctggtgacgtgtgccaagttccagtgcctggagcccatcgaggggaaggtcgttcagtacgagaacctcaagtataccgtaataattacggtccacactggggaccagcaccaagtgggcaacgagacccagggggttacggcggagattacgccccaggccagcaccaccgaagctatcctgcccgagtacggcaccctaggcctcgagtgctcccctcgaaccgggctggatttcaacgagatgatcctgttaacgatgaaaaacaaagcctggatggtgcaccggcagtggttcttcgatctacccctgccctggacctcaggagccacaaccgagacgcccacctggaaccgcaaggagctcctggtcaccttcaagaacgcccacgccaagaaacaggaggtcgtggtgctgggctcccaagaaggcgcgatgcataccgccctcacgggcgccaccgagatccagaacagcggcgggacctccatcttcgccggccaccttaagtgcaggcttaagatggacaaacttgaactgaagggcatgagctacgccatgtgtaccaacacgttcgtgctaaagaaggaggtgtccgagacccaacacgggactatcctcatcaaggtggagtacaaaggcgaggatgtcccatgcaagatccccttcagcaccgaggatgggcagggcaaagcgcacaacggccgcctgatcacggccaaccctgtggtcaccaagaaggaggagccggtcaacatcgaggccgagccgcccttcggggagagtaacatcgtgatcggcatcggggacaacgccctgaaaattaattggtacaagaagggcagcagcattgggaaaatgttcgaagcaaccgcccggggtgcccgccggatggccatcctgggagacaccgcatgggacttcgggtccgtgggcggggtcctcaacagccttggcaagatggtgcaccagatcttcgggtccgcgtacactgccctattcagcggggtctcctgggtcatgaagatcgggatcggggttctcctgacgtggatagggctcaacagtaagaacacgtccatgtctttctcctgcattgccatcggaataatcaccctctacttaggcgccgttgtccaggctgacatgggctgtgttatcaactggaagggcaaggagctgaaatgtggaagcgggatcttcgtgacgaacgaggtccacacgtggaccgaacaatacaagttccaggcagactcccccaagcgcctcgcaaccgccatcgccggcgcttgggaaaacggggtgtgcggcatccgcagcacgacccggatggaaaacctgctgtggaagcaaatcgcgaacgagctcaactacattctgtgggagaacaacatcaaacttaccgtggtagtgggggatatcatcggggtgctggaacaaggaaagcgcaccctgacgcctcagccgatggagctaaaatattcctggaagacgtggggcaaggcgaagatcgttacggccgagacgcaaaactcctccttcatcatcgacggcccgaacactcccgagtgcccgagcgccagtcgggcttggaacgtgtgggaggtggaggattacggattcggtgtttttaccaccaacatctggctcaagctgcgagaggtgtacacccaactgtgtgatcaccgcctgatgagcgctgccgtcaaggacgagcgcgcggtccacgccgacatgggctactggatagagagccagaagaacgggtcttggaaactggagaaggcgagcctgatagaggtgaagacctgcacgtggccgaagtcccacaccctctggagcaacggggtactggaatccgacatgatcatccctaaaagtctggccggacccatctcccagcacaactaccggccgggctaccacacccaaaccgccgggccctggcacctcggcaagctggagctcgacttcaactattgcgagggaacgaccgtggtgatcaccgaaaactgcgggacccgcggccccagcctccggacaaccaccgtgagcgggaagctgatccatgaatggtgctgtcgcagctgcacactgcccccgctacgctacatgggcgaagacggatgctggtacgggatggagatccgtcccatttccgagaaggaggaaaatatggtcaagtcactggtgtccgccggcagtggggaagtggataacttcacaatgggcgtcctgtgccttgccatcctgttcgaggaggtgatgcgggggaagtttgggaagaagcacatgattgctggagtattctttacgtttgtcctactcttgtcaggacagatcacctggcgcgacatggcccacaccctgataatgatcggtagcaacgcctcggaccggatgggcatgggcgtgacgtacctagccctcatcgccaccttcaaaatccagcccttcctcgcgctcgggttcttcctgcgcaaactgaccagccgggagaacttgttactgggtgtgggcctcgccatggccaccacgctgcagcttcccgaggacatcgagcagatggccaacggaatcgcgctcggcctgatggccttgaagctcatcacccagttcgagacctaccagctgtggaccgctctgatctcgctcacgtgctctaacaccatcttcaccctcaccgtcgcctggcgcacggccacactgatcctcgccggggtgagcctgctgcctgtctgccagtcaagcagtatgcggaagactgactggttgcccatgaccgtggccgccatgggcgtgccacccctgccgttgttcattttcagtctcaaggacacgctgaagcgccgcagctggccccttaacgagggggtcatggcagtgggcctcgtaagcatcctggcctccagcctgctacggaacgacgttcccatggctggccctctggtggccggcggcctgttgatcgcgtgctatgtcatcaccggtacttccgcagacctcaccgtcgagaaagcagcggatgtaacctgggaggaggaagcagagcagaccggcgtgagccacaacctaatgattaccgtcgacgatgacgggaccatgcgcattaaggacgacgagaccgagaatatccttacggtgctgctgaagaccgccctcctgatcgtgagcggcatcttcccgtactcgatccctgccacgctgctcgtctggcacacttggcaaaagcagacgcagcggtccggagtgctgtgggacgtgccctcgccacccgagacccagaaggccgagctcgaagagggggtataccgcatcaagcagcagggtatattcgggaaaacacaggtgggcgtaggagtccagaaagagggggtgttccacaccatgtggcacgtaacgcggggcgcggttctcacctacaacgggaagcgactagagcccaactgggcttcagtgaaaaaggatttaatcagctacggcggcggatggcggctctcggcccagtggcaaaagggggaggaggtgcaagtcattgctgtggagcccgggaagaaccctaaaaactttcagactatgcccggcaccttccaaactaccaccggcgaaatcggcgctatcgccctggacttcaagccagggaccagcggtagcccgatcattaaccgtgaaggcaagatcgtggggctttacggaaacggtgtcgtgacgaagaacggcgggtatgtttccggcatcgcccagacgaacgccgagccagacggccccacccccgagctggaggaagagatgttcaaaaagcggaaccttacgatcatggacctccaccccgggagcggcaagacgaggaagtacctgccggccatcgtgcgggaagcgattaaacgccggctcaggaccctgatcctggccccaacccgggtggtggccgccgagatggaagaggctttgaaggggctgcccatccgataccagaccacggcgaccaagtccgagcacaccggacgggagatagttgacctgatgtgccatgcaaccttcacgatgcggctcctgagtccagtgcgggtgccgaactacaacttgatcataatggacgaggcccacttcactgaccccgcctccattgccgcgcgcgggtacatcagcactcgggtcggcatgggagaggccgctgccattttcatgaccgcgacgccacccgggaccgccgacgctttcccgcagtccaacgcgccgatccaagacgaagaacgcgacatccccgaacgcagctggaactccggcaacgagtggatcactgacttcgctggcaagaccgtgtggttcgttcccagcataaaagcgggcaacgacatcgcgaattgcctcagaaagaacgggaagaaggtcatccagctctcccgcaagacgttcgacacggagtaccagaagacgaagctgaacgactgggacttcgtggtgaccaccgacatcagcgaaatgggcgccaacttcaaggccgaccgggtcatcgacccgcgccgttgtctcaaacccgtgatcctaaccgacggccccgagcgcgtgatcctggccgggcccatgccggtcaccgcggccagcgccgcacagcggcgcggccgggtggggcgtaatccccaaaaggagaacgatcagtacatcttcaccggccagcccctcaacaacgacgaagaccacgcccattggaccgaggcgaaaatgctgctggataatataaacacgcccgaggggatcatcccggccctctttgaacccgaacgggagaagtccgccgctatcgacggcgagtaccgcctgaagggcgagtccagaaagaccttcgttgagctgatgcgccgcggggacctccccgtctggctggctcacaaagtggccagcgagggcatcaaatacaccgaccgaaagtggtgtttcgatgggcaacggaacaatcaaatcctggaggagaacatggacgttgagatctggaccaaggagggcgagaagaagaaacttcgcccgcggtggctagacgcccgcacttactccgaccccctcgctctcaaggagttcaaggacttcgcggcgggcagaaagagtatcgccctggacctggtgacagagatcgggcgcgtgcccacccacctcgcacatcggacccggaacgcccttgacaatttggtgatgttgcacacctccgagcatgggggtaaggcctaccggcatgcggtggaggaactccctgaaaccatggaaaccctgctcctgctgggcctcatgatcctgttaactgggggcgccatgctgttcctgatcagcgggaaggggatagggaagacgagcatcgggcttatctgtgttatcgcctccagcggcatgctctggatggccgagatacccctgcagtggatagcctccgcgatagtcctggagttctttatgatggtactcctgatccccgagcctgaaaagcaacggacgccccaagataaccagctggcgtacgtagtcatcgggatcctcaccctggccgccaccatcgccgcaaacgagatgggcctgctcgagacgaccaagagagacctcggcatgagcaaggagcctggggtggtctccccgactagctacctggatgtcgacctccaccccgcctccgcctggaccctgtacgccgtggctacgaccgtgatcaccccgatgttgcggcatacgatcgagaactctacggccaacgtctccctggccgccatcgcaaaccaagcggttgttctgatgggcttggacaaggggtggccgatcagcaagatggacctcggagtccctctgctggccctcgggtgctactcccaggtgaacccgctgaccctgacagctgccgtactcctgctgattacgcactatgccattattggtcccggcctgcaggcgaaggctacgcgcgaggcccagaagcggaccgctgcagggatcatgaagaatccgaccgtcgacgggatcatgaccatcgacttggaccccgtgatttatgatagcaagttcgaaaagcagctgggccaggtgatgctcctggtcctgtgcgcggtgcaattactgctaatgcgcacgtcctgggccctttgcgaagccctgaccctggccaccggaccaatcacgacgctgtgggaggggtcacccgggaaattctggaacacgaccatcgcggtgtccatggccaacatcttccgggggagctacctagccggggcggggctggcattttctatcatgaagtcagtcgggacaggcaagcgcggcaccgggagccagggcgagacgctcggggagaaatggaagaagaagctgaaccagctaagccggaaggagttcgacctctacaagaagtccggcattacagaagtggaccgcacggaggcgaaggaagggctgaagcggggcgagattacccatcatgccgtaagtcgtggttccgccaagctgcagtggttcgtcgagcggaacatggtgatcccggaggggcgggttatcgacctgggatgcgggcggggtgggtggtcctactactgcgccggcctgaagaaggtaacggaggtgcggggctacaccaaaggcgggcccgggcatgaggaacccgtgcccatgtcaacctacggctggaacatcgtaaagctcatgtccgggaaggacgtgttctacctgccgcccgaaaagtgtgacaccctgctgtgcgacatcggcgagagctctccctcgccgaccgtggaggagtcccgaaccattagggtcctgaagatggttgagccgtggctcaagaacaatcagttctgcatcaaggtgctgaacccctatatgccaaccgtcatcgagcacctggagcgcctccagcggaagcacggcggtatgctggtacgtaaccccttgagccggaactccacccacgagatgtactggataagcaacggtacggggaacatcgtagcatctgttaacatggtgagtcgcctactcttgaaccggttcaccatgacctacagacggccgaccatagagaaggacgtcgatttaggtgcggggacgcgccatgtcaacgccgagcccgaaacccccaacatggacgtgataggggagcggatcaagaggatcaaggaggagcacaacagcacctggcactacgacgacgagaacccgtacaagacctgggcctaccacggcagctacgaggtgaaggccacggggagcgcctcatccatgatcaacggcgtcgtgaaacttttaaccaagccttgggacgtggtgcctatggtaacccagatggcaatgaccgatacgacgcctttcgggcaacaacgggtcttcaaggaaaaggtggacacccgcaccccgcgatcgatgccgggcacgcgccgggtgatgggcatcaccgccgagtggctctggcgcaccctgggccggaacaaaaagccccgcctttgcaccagagaagagttcacgaagaaggtccgcaccaacgccgccatgggcgcggtgtttaccgaggagaaccagtgggacagcgccaaagccgccgtcgaggatgaggacttctggaaactcgtggatcgcgagcgggagttacacaagctggggaagtgcggcagctgtgtgtacaacatgatggggaaacgcgagaagaaacttggcgagttcggcaaagccaaggggagcagagcgatctggtacatgtggctgggggcccgctacctggagtttgaggccctagggttcttaaacgaggaccattggttctcccgggagaacagctactccggcgtggagggcgagggcttacacaagctagggtacatcctacgcgacatcagcaagatccctggcggcgccatgtatgcagacgacaccgctgggtgggacacgcggatcactgaagacgacctgcataacgaggaaaagatcacccaacagatggacccggagcatcgccagctcgccaacgccatcttcaagttaacctaccagaataaggtcgtgaaagtgcaacggccgacccctacgggtaccgtaatggacatcattagtcgcaaggaccagcgcggctctggccaggtgggcacctacgggctaaacactttcacgaacatggaggcccagctcatccgtcagatggagggcgagggggtgctgtccaaggccgatctggagaacccgcacctcccggaaaagaagatcacccagtggctggaaaccaagggcgtcgaacggttaaagcgcatggccataagtggagacgactgcgtggtgaagcccattgacgaccggttcgctaacgccctcctggccttgaacgacatggggaaagtccgtaaggatatccctcagtggcaaccttctaagggctggcacgactggcagcaggtcccgttctgcagccaccacttccacgagctcataatgaaggacgggcggaagctggtggtgccttgccgcccgcaggacgagctgatcggtcgggctcgcatttcccagggggcgggctggagcctccgggagaccgcctgcctgggcaaggcatacgcgcaaatgtggtccctgatgtactttcaccgccgggacctacgattagcgagcaatgccatctgctccgcagtgcccgtccactgggtaccgacgagccgcaccacatggagtatccacgcgcaccaccaatggatgaccaccgaggacatgctgacggtctggaaccgggtttggatcgaggacaacccctggatggaggataaaacgcccgtcaccacgtgggagaacgtgccctacctggggaaacgcgaggaccagtggtgcggcagcttaatcgggctgaccagccgggccacctgggcacagaacatcccgaccgccatacagcaggtcagatccctcatcggcaacgaggagtttctggactacatgcccagcatgaagcgtttccgcaaggaggaggagtctgagggagccatctggtga

SEQ ID NO: 26052 - RNA, 9873 nt, synthetic construct
  misc_feature 1..9873: note = derived and/or modified CDS sequence (opt11) from DENV-3__FJ639785__SS-prME
  source 1..9873: mol_type = other RNA
accagcctctgcctcatgatgatcctgccagccgctttagctttccacctcacctctcgggatggcgagccccgaatgatcgttgggaagaacgagcgggggaaaagcctactgttcaagaccgccagcgggatcaacatgtgcaccctaatcgcaatggacctgggtgagatgtgcgacgacacggttacctataagtgcccgcacatcaccgaggttgagcccgaggatatcgactgttggtgcaacctgacctccacttgggtaacctacgggacgtgcaaccaggccggtgagcaccggcgcgataaacgaagcgtggccctcgcgccccacgtgggcatggggctggatacacgcacccaaacctggatgtccgcagagggcgcctggcgccaggttgagaaggtggaaacgtgggccctgaggcatcccgggttcaccatattggcgctgtttctagcccactacatcggtacctcactcacacagaaagtggttatcttcatcctgctgatgctcgtcacgccaagcatgaccatgcggtgcgtaggggtgggcaacagggacttcgtcgagggtctgtcaggggccacctgggtggacgttgtcctagagcacggcgggtgcgtgaccacgatggcgaagaacaagcccacacttgacatagagctgcagaagacggaggccacccagctggcgacgttacggaaattgtgcatcgaaggcaagatcaccaacatcaccaccgatagccgctgtcccacgcagggggaggctgtgctgcctgaggagcaggatcagaactacgtctgcaagcacacctacgtcgaccggggctggggcaacgggtgcggcctcttcgggaaaggctcgctggtgacctgcgccaaattccaatgccttgaaccgatcgaggggaaagtggtgcagtatgaaaacctgaagtataccgtgatcatcacggtccacacgggggaccagcaccaagtaggcaacgaaacacagggggtcaccgccgagatcacgccccaggccagcaccaccgaggcgatactgcccgagtatggcacccttgggcttgagtgctcaccgcgaacgggtctggactttaacgagatgattctgttgacaatgaagaacaaagcgtggatggtgcaccggcagtggtttttcgatctgcctctgccctggaccagcggcgcgaccactgagactccaacgtggaaccgcaaagagctcctggtaacgttcaagaacgcccacgcaaagaaacaggaggttgttgtattggggtcacaggagggcgcgatgcacacggcgttgaccggtgccacggaaatccaaaactcgggcgggacctccatattcgccgggcacctgaagtgccggttaaaaatggacaagctcgagctgaaaggcatgtcctatgccatgtgcacaaacactttcgtcctgaagaaagaagtgtccgaaactcaacacgggaccatccttatcaaggtggaatacaagggagaagacgtcccgtgcaagatcccgttctcaaccgaggacggacaggggaaggcgcataacggccggctcattacggcgaacccagtggtgacgaaaaaggaggagcccgttaacatcgaggctgagccgccatttggagagagcaacatcgtgataggaattggcgacaacgccctgaagatcaactggtacaagaagggctcaagcattggaaaaatgttcgaggcgaccgcccggggcgcccgcagaatggccatcctgggagacaccgcttgggacttcggctcagtgggcggagtcctgaacagcctggggaagatggtgcatcaaatcttcggatccgcttacacggcgttgttcagcggcgtctcctgggtcatgaagattggcatcggtgtgttactaacctggattggcttaaatagcaagaacacctccatgagcttctcctgtatcgccatcgggatcatcaccctatatttaggcgctgtggtccaggccgacatggggtgcgtgatcaactggaagggcaaggagctgaagtgcggaagtgggatcttcgttacgaacgaggtccacacctggacggaacagtacaaatttcaggcggacagtcccaaacgcttagctaccgccatagccggcgcctgggagaacggggtatgcggcatccgaagcacgacccggatggagaacctactgtggaagcagatagctaacgagctcaactacattttgtgggaaaacaacatcaagctgaccgttgtggttggcgatacgatcggcgttctcgagcagggtaaacggacgctgacaccccagccgatggagctaaagtactcttggaagacctggggcaaagccaaaatcgtaaccgctgagacgcagaacagctccttcatcatcgacggcccaaacacccccgagtgccccagcgcctcgagggcatggaacgtgtgggaggtggaggattacggatttggcgtcttcacaactaatatatggctcaagctgcgcgaggtgtacacccagctgtgcgatcacaggctcatgagcgcagccgtaaaggatgagcgcgccgtccacgccgatatgggctactggatcgagagccagaagaacgggtcctggaaactggaaaaggcgagcttaatcgaggtgaagacgtgtacatggccgaagtcccacaccctctggagcaacggcgtgctggaatccgacatgatcatcccaaaaagccttgctgggccaatatcccaacacaactaccggccgggttaccacacccagacggccggcccctggcatttaggcaagctggagctggatttcaactactgtgagggcaccacagtcgtgatcaccgagaactgcgggacaagaggccccagcctccgaacgacaaccgtctccggaaagctgatccatgaatggtgctgtcgaagctgcaccttgcccccgttgaggtacatgggtgaggatgggtgctggtacggcatggaaattaggccgatctccgagaaggaggagaacatggtcaaatcgctcgtcagtgccggcagcggggaggtggataactttactatgggagtgctgtgtctcgccattctgtttgaagaggttatgcgggggaagtttggcaagaaacacatgatcgccggggttttcttcaccttcgtactgctcctgtccggccagatcacctggcgcgatatggcccacactctgatcatgatcggcagtaacgccagtgaccggatggggatgggcgtgacctatctcgccttgatcgccacctttaagattcagcccttcctggcgctcgggttcttcttacggaaactgacgagccgggaaaacctactgctgggcgtgggccttgccatggccacaaccctgcaactgccggaagacattgagcagatggccaatgggatcgcgttgggcctgatggccctgaagctgattacacagttcgagacctatcaactgtggacagctctgatcagcctgacctgctccaacaccatcttcaccctgactgtggcctggagaaccgccactctgatactcgcgggggtgagtctcctgcccgtgtgtcagtcttcatcgatgcggaaaaccgattggctccccatgacggtggccgccatgggggttcctcccctcccgctgttcatcttcagcttaaaggatactctgaagcgcagatcctggcctttaaacgaaggggtcatggccgtcggactcgtgagcattctggccagcagcctgctccgtaacgacgtccccatggccggacccctggtggccgggggcttgctcatcgcctgctatgtgatcaccgggacctccgccgacctcacggtcgaaaaagccgcggacgtgacctgggaggaggaggctgagcagaccggcgtgtctcacaacctaatgatcacagtcgacgacgacggtaccatgaggatcaaggacgacgaaactgaaaacattctgactgttctgctgaagaccgccctccttatagtgtccggcatcttcccttacagcatccccgccaccctactggtctggcacacgtggcagaagcagacccagcggagtggggtgctttgggatgtgcccagcccgcccgagacccagaaggctgagctggaggagggggtctacagaataaagcagcagggcatctttgggaaaacccaagtgggagtaggggtccagaaggagggcgtgttccacactatgtggcacgtcacccggggagccgtcctcacatacaacgggaagcgcctagaacccaactgggcttccgtcaagaaggacctcataagctacggtgggggctggcggctctcagcccaatggcaaaaaggagaggaggttcaggtgatcgcggtggagccgggcaagaaccccaagaacttccagaccatgcccggcacgttccagaccaccacgggtgagataggcgcgattgccttggatttcaagccagggacgagtggcagccccatcatcaaccgcgaaggcaaggtggtcgggctgtacggcaatggggttgtgaccaagaacggagggtacgtctccgggatcgcccagaccaacgccgagcctgacggccccacccccgagcttgaggaagaaatgtttaagaagagaaatttaacgatcatggacttacatcccgggagcggcaaaaccaggaagtatctgcccgccattgtgcgggaagcgatcaagcgccgtctccgcacactcatactcgcccccaccagggtggtcgcagccgagatggaggaagccctcaaaggactgccgattcgctaccagacaacggccaccaagtccgagcacaccggccgggagatcgtggacctgatgtgtcatgccacctttacaatgcgcctcttgagccccgtacgggtccctaactataacctgatcatcatggacgaggcccacttcaccgatcccgccagcatagccgcgcgagggtacatcagtacccgggtagggatgggcgaggccgccgccatctttatgacggcgacgcctccaggtaccgcagacgccttcccgcagtccaacgcccccatccaggacgaagaacgcgatatccctgagcgctcgtggaactccggcaacgagtggatcaccgacttcgcagggaagacggtgtggttcgtcccgagcataaaagcggggaatgacatcgcgaactgcttgcggaagaacgggaagaaggtaatccaactctcccgcaagaccttcgacaccgagtaccaaaagaccaagctgaacgattgggacttcgtggtcacgacggacatcagcgagatgggcgctaacttcaaggcagaccgggtaattgacccgcgacggtgcttaaagccggtgatcctgaccgacggccccgagcgcgtcatactggccgggcccatgccggtgaccgcggctagcgccgcccagcgacgaggccgggtggggcgcaacccacaaaaggaaaacgaccaatacatcttcacgggtcagccgctcaacaacgatgaagaccacgcccactggacggaggccaaaatgctgctcgacaacatcaacacccctgaggggatcatcccggccctcttcgagcccgagcgagaaaagtctgccgcgatcgacggcgaataccgcctgaaaggcgaatccagaaagaccttcgtggaactgatgagacgaggggacctccccgtttggctggcgcataaggtcgccagcgagggaataaagtacacagacaggaagtggtgcttcgacgggcagcggaacaaccagattttagaggagaacatggacgtggagatctggacgaaggagggtgagaagaagaaacttcggccacggtggctggacgcccgcacctactctgacccgctggccctcaaagagttcaaagactttgccgcggggcgcaaaagcattgctctagacctggtgactgaaatcgggagggtgcccacccacctggcgcaccgcacgcggaatgctctggacaatctcgtgatgttgcacacctccgagcacggcggtaaagcctatcgccacgcggtggaagaactgcccgagacaatggagaccctcctgctacttggcttgatgatcctgttaacgggcggcgctatgctgttcctgatcagcgggaaggggatcgggaagaccagcatcgggctgatctgtgtcatcgcctccagcggcatgttgtggatggcagagatacccctccagtggatcgcctccgctatcgtgctagagttctttatgatggtgctcctgatcccggagccggagaagcagcggacgccccaggacaaccagctagcgtacgtcgtgattggtatcctcaccctggccgcgacgatagccgcaaacgagatgggattactcgagaccaccaagcgtgacttgggcatgagcaaggagccaggagttgtttcccccacgagctacctagacgtggacctccaccccgcctcggcgtggacgctgtacgccgtcgcgacgacggtcattacacccatgctccggcacacgatcgagaacagcacggccaacgtctccctcgctgccattgctaatcaggcggttgtgctgatgggactggacaaggggtggccgatcagcaagatggacctcggcgtgcccctgctcgcactcggttgctattcccaagtcaacccgctgaccctaaccgccgccgtcctgctgctgatcacgcactacgcgatcattggtcccggcctccaagcgaaggccacccgcgaggcccagaagcggaccgccgccggtataatgaagaaccccactgtggacggcatcatgaccatcgacctggatcctgtaatctacgatagcaagttcgagaagcaactgggtcaggtaatgctgctggtactatgcgcagtgcaactcctgctgatgcgtacctcctgggccctatgcgaggctctgactctggctactggacccattactacactatgggagggtagccccggtaagttctggaacacgaccatagcggtctccatggccaacatcttccgtggcagctatctagcgggggctggcttagcgttcagtatcatgaaatccgtggggaccggcaagcggggcacagggtcccagggcgagacgctaggggagaaatggaagaagaagctgaaccagctgagccggaaagagttcgacctctacaaaaagtccggcatcaccgaggttgaccgcaccgaagcgaaggaggggctgaagcggggcgagatcacgcatcacgccgtctcacgtggatccgccaagctgcagtggtttgtggaacggaacatggtgataccggaggggcgcgtcatcgacctcggttgcggcagaggagggtggtcctactactgcgccggcctcaagaaggtaactgaagtgcgcggatataccaagggcggtccaggtcatgaggagcccgtacccatgagcacctatggatggaacatagtcaaactgatgtctggtaaggatgtattttacttgccgcccgagaagtgcgacacgttactgtgcgacatcggtgaaagctcacccagcccgaccgttgaggagtcccggaccatccgtgtgctgaaaatggttgaaccgtggctcaagaacaaccagttctgcataaaggtcctgaacccctacatgcccaccgtgatcgagcatctggagcgccttcagcggaagcacggcggaatgctggtgcgcaatcccttatcgcggaactcgacgcacgagatgtactggatttcaaacggcaccgggaacatagtcgcctcagtgaacatggtgagccgcctcctgctaaaccggttcaccatgacacatcgccgtcctaccattgagaaggatgtcgacttgggagcgggcactcgccacgtgaatgccgaacccgagacacccaacatggacgtaataggggagcggatcaagcgcatcaaggaggaacacaactccacttggcactacgatgatgaaaacccgtacaagacgtgggcgtaccatggaagctacgaagtcaaggccaccgggtccgccagctccatgatcaatggcgtggtcaagctgctgactaaaccctgggacgtggtccccatggtcacccagatggcgatgaccgacacaactcccttcgggcaacaacgtgttttcaaggaaaaggtggatacaaggacgccgcgtagcatgcccggaacccgccgggtcatgggaatcacagcagaatggctgtggcgcacactggggcgaaacaaaaagccccgcctgtgcacccgggaagagtttacaaagaaggtgagaaccaacgccgctatgggagctgtgttcaccgaggagaaccagtgggacagcgctaaggccgcggtcgaagacgaggacttctggaagctcgtggaccgcgagagagagctgcataagctgggtaagtgcggcagttgtgtttacaacatgatgggaaagagggagaaaaagctcggcgaatttggcaaggccaaggggagccgagcgatttggtatatgtggcttggcgccaggtatctagagttcgaagctctcgggttcctcaacgaggaccactggttctctcgggagaactcatactccggcgtcgagggggagggcctacacaagctcggctatatcctgcgcgacataagcaagatccctgggggcgccatgtacgccgatgacactgcggggtgggacacccggataacggaagacgacctgcacaacgaggagaaaatcacccaacagatggaccctgagcaccgccagctcgcgaacgccatcttcaaactgacgtaccaaaacaaggttgtaaaggtccagcgacccacgcccaccgggactgtgatggacatcatttcccgcaaggaccaacgaggcagcggtcaggtgggcacctatgggctgaacacgtttactaacatggaagcccagctcattcgccaaatggagggcgagggagtcctgtccaaggccgacctggagaacccccacctcccggagaagaaaatcacccagtggctggagaccaagggcgtagagcgcttgaagcgcatggcgatcagtggagacgactgcgtggtcaaacccatcgacgaccgattcgcgaatgcgctacttgcgttaaacgacatgggtaaagtccggaaggacatcccccaatggcagccctccaagggatggcacgactggcagcaggtcccattctgcagccatcacttccatgagctcatcatgaaggatgggcggaaactcgtcgttccgtgccgacctcaggatgaattgattgggcgggcgcgcatctcgcagggggccggctggagtctacgagaaacggcctgcttgggtaaggcctacgctcagatgtggtcgctaatgtacttccaccgccgcgacctgcgactagccagcaatgccatctgctctgccgtgcccgtacactgggtgcctaccagccgcaccacctggtctatacacgcccaccaccaatggatgacgaccgaagatatgctaaccgtgtggaaccgcgtatggatagaggacaacccctggatggaggacaaaactcccgtgacgacctgggagaacgtgccttatctcgggaagcgtgaggaccagtggtgcggctcgttaatcgggctgaccagccgggccacctgggcccagaacataccgaccgccatacagcaggtccgtagcttgatcggcaacgaggagtttcttgactacatgccctctatgaagcggttccgcaaagaggaggaatcagagggggccatctggtag

SEQ ID NO: 26053 - RNA, 9873 nt, synthetic construct
  misc_feature 1..9873: note = derived and/or modified CDS sequence (opt11) from DENV-3__FJ639786__SS-prME
  source 1..9873: mol_type = other RNA
actagcctctgcctcatgatgatcctgcccgccgccctggcgttccacctgacctcgcgggacggcgagcctcgcatgatcgtggggaaaaacgagcggggcaagagcctgctgttcaagaccgcgagcggaatcaacatgtgcaccctcatcgctatggacctgggcgagatgtgcgacgataccgttacgtacaagtgcccccacatcactgaggtggaacccgaggacatcgactgctggtgtaacctgaccagcacctgggtgacctacggcacctgcaaccaggcgggggagcaccgccgcgacaagcggtccgtcgctctagcgccccacgtgggcatggggttggacacccgcacccagacctggatgagcgccgagggcgcctggcgacaggtggagaaggtcgagacgtgggccctgcgccaccctggattcactatcctagcgctgttcctcgcccattacatcggcacaagtctcacccaaaaggtggtgatcttcatcctgctgatgctcgtcacgccctcaatgaccatgcggtgcgtgggggtgggcaaccgcgacttcgtcgagggcctgtccggggcgacctgggtggacgtggtgctggaacacggcgggtgcgtgaccaccatggccaagaataagcccacccttgacatcgagctgcagaagaccgaggccacccagctggcgacgctccggaagctgtgcatcgagggcaaaatcaccaacatcaccaccgacagccgctgccccacgcaaggcgaggccgtccttccagaggaacaggaccagaactacgtctgcaaacacacctatgtggatcgagggtggggcaacggttgcgggcttttcgggaagggatccctcgtcacctgcgccaagtttcagtgcctggagcccatcgagggcaaagtcgtgcagtacgagaacctcaaatacaccgtgatcatcaccgttcacactggggaccagcaccaagtgggaaacgagacccaaggagtcaccgccgagatcacgccgcaggccagcacaactgaggcgattttgccagaatacggtaccctggggctcgagtgctccccgagaacaggcctggacttcaacgagatgatccttctcacgatgaagaacaaagcatggatggtgcaccggcagtggttcttcgacctgcccctaccctgggccagcggggctaccaccgagacccccacgtggaatcgcaaagagctcctggtgacctttaagaatgcccatgccaagaagcaggaagtcgtggtgctggggtcccaggagggcgcaatgcacaccgccctgaccggggccacggagatccagaactcgggcgggacctctatcttcgccggccacctgaaatgccggctgaagatggacaagctggagttgaaggggatgagctacgcgatgtgcaccaacacctttgtcttgaagaaggaggtatccgagacgcagcacgggaccattctcatcaaggtggagtacaagggcgaagacgtcccgtgcaagatcccattcagcaccgaggacgggcaaggcaaggcccacaacggccgcctgatcaccgccaaccccgtggtgacgaagaaggaggagcccgtaaacatcgaggcggaaccgccgttcggggagagcaatatagtgattggcataggcgacaacgcactgaagatcaactggtacaagaagggatccagcatcgggaagatgttcgaggctaccgcccggggcgcccgccggatggccatactgggcgataccgcgtgggacttcgggtccgtgggcggggtcctcaacagcctgggcaagatggtgcaccagatcttcgggtccgcctacaccgccctcttttcgggcgtcagctgggtcatgaagatcggcatcggggtgttgctcacgtggatcggcctcaacagcaagaacacgtccatgagcttctcctgcatcgccatcgggataatcaccctctacctgggcgccgtggtccaggcggacatgggctgcgtcatcaactggaagggcaaggagctcaagtgcggcagcgggatttttgtgaccaacgaagtccacacgtggactgaacagtacaagttccaggcagactcccccaagcgcctcgccaccgccatcgccggagcgtgggagaacggggtgtgtggcattcgcagcaccacgcggatggagaaccttctgtggaaacagatcgccaacgagctcaactacatcctatgggaaaacaacatcaagctgacagtggtggtgggggacatcatcggcgtgctcgaacagggcaagcgcaccctgacgccccagccgatggagctgaagtactcttggaagacatgggggaaggccaagatcgttaccgccgagacccagaacagcagcttcataatcgacggcccgaacacccccgagtgccccagcgcgagtcgggcctggaatgtatgggaggtggaggactacggtttcggggtcttcacgaccaacatctggctcaagctgcgcgaggtctatacccagctgtgcgaccaccggctcatgagcgcggccgtcaaggacgagcgcgccgtccatgcagacatgggctattggatagagtcgcagaaaaacggaagctggaagctggagaaggccagcttaatcgaggtgaagacctgcacctggccgaagtcccatacgctctggagcaacggcgtgctggagtccgacatgatcatcccgaagagtctggccgggcccatctcccaacacaactatcggccgggctaccacacgcagaccgccgggccctggcacctaggaaagctggagctggacttcaactattgcgagggcaccacagtcgttataaccgagaactgtgggacccgcggacccagcttgcggaccacgacagtctccgggaagcttatccacgagtggtgctgccgcagctgcaccctgcctccgctcaggtacatgggcgaggacgggtgctggtatggcatggaaatacgccccatatccgagaaggaggagaacatggtcaagagcctggtgtccgcgggcagcggggaggtggacaacttcaccatgggcgtcctgtgcctcgcgattctgttcgaagaggtgatgcgcggaaagttcggcaaaaagcacatgatcgccggggtgttcttcacgttcgtccttctcctgtccggccagatcacctggcgcgacatggcccacaccctgatcatgatcggaagcaacgcctccgatcggatgggaatgggtgtgacgtacctagccctgatcgcgacgttcaagattcagcctttcctggccctggggtttttcttacgaaagttgaccagccgggagaacctcctgctgggcgtgggcctcgccatggccaccaccctgcagttacctgaggacatcgagcaaatggccaacgggatcgcactcggcttgatggctctgaagttaatcacgcagttcgaaacctatcagctgtggaccgctcttatcagcctgacctgctcaaacacgatcttcaccttgaccgtcgcctggcgcaccgcgacgctgatcctcgcaggggtgagcctgctgccggtctgccagtcctcttccatgcggaaaacagactggctccccatgacagtggccgcgatgggcgtgccgcccctcccgctgttcatcttttctctcaaggacaccctcaagcgccgctcctggcccctgaacgagggggtcatggccgtgggcctcgtgagcatcctggcctcgagcttactcagaaacgacgtgccaatggcaggcccccttgtggccgggggtctgctgatcgcctgctatgttatcaccgggacctccgccgacttaactgtggagaaggcggccgacgtgacctgggaagaggaggccgagcagacgggcgtgtctcacaacctgatgatcaccgtcgacgatgacgggaccatgcgcatcaaggacgacgagaccgagaatatactcaccgttctgctgaagacggccttgttgatagtgtccggcatcttcccgtactcgatccccgcgaccctgctcgtctggcacacctggcagaagcagacccagcggtccggcgtgctgtgggacgtgcccagcccgcccgagacgcagaaggcggagctggaggagggggtctaccgcatcaagcagcagggcatcttcgggaagacccaggttggcgtgggggtccagaaagagggcgtattccacaccatgtggcacgtgacccggggcgcagtcctcacgtacaacgggaagagactggagccgaactgggcgtctgtcaagaaagacctgatctcatatggcgggggctggcgtctctccgcccagtggcagaaaggtgaggaggtgcaggtcattgcggtggagccgggcaagaatccgaagaacttccagaccatgcccggcaccttccagaccacgactggggagataggcgccattgccctggatttcaagcccgggaccagcggcagcccaatcatcaaccgcgagggcaaagtagtcggcctgtacgggaacggggtggtgaccaagaacggcgggtacgtcagtggcatcgctcagacgaatgccgagccggacggccccacccccgagctggaggaggagatgttcaagaaacggaacttgacgattatggacctgcacccggggagcggcaagactcgcaagtacctacccgcgatcgtgcgagaggccatcaagagacggctccgcacgctgatactggccccaactcgggtcgttgcggctgaaatggaagaggcgctcaaggggctgcccatcagataccagacaaccgcaacgaagtccgagcacaccggccgggagatagtggacttgatgtgccacgccaccttcaccatgcgactactgagccccgtgcgggtcccgaattacaacctgattataatggatgaggcccacttcactgatcccgcctccatcgcggccagggggtacatcagcacccgggtgggcatgggcgaggccgctgcgatctttatgaccgctacaccgcctggtacggccgacgcctttccgcagtccaatgcccccatccaggacgaggagcgcgacattcctgaacgatcttggaacagtggcaacgagtggatcaccgatttcgcggggaagaccgtgtggttcgtcccaagtatcaaggccggtaacgacatcgccaactgtctccggaagaacgggaagaaggtgatacagcttagccgaaagaccttcgacacggagtatcagaagaccaagctaaacgattgggactttgtggttacaaccgatattagcgagatgggcgccaacttcaagacggaccgtgtcatcgacccgcgcaggtgcctcaagcccgtgatcctaacagatgggcccgagcgcgtcatactggccgggcccatgccagttaccgcggcctccgccgcccagcgtcgcggcagggtggggaggaatcctcagaaggagaacgaccagtacatcttcaccggtcagcccctcaacaacgacgaggaccacgcccactggaccgaggcgaagatgctgctggacaacatcaacacgcccgagggcataatccctgccctctttgagcccgagcgggaaaaatccgccgccatcgacggcgagtaccgcctgaagggcgagtcccggaagaccttcgtcgagctgatgcgccgcggggacctccctgtgtggttagcgcacaaggttgcaagcgaaggcatcaagtacaccgaccgtaagtggtgcttcgacgggcagcggaataaccaaatcctggaggagaacatggacgtcgagatctggaccaaggagggcgagaagaagaagctccgcccacgctggctggacgcccgcacgtactccgatccactggccctcaaggaattcaaggatttcgccgcgggccgcaagagcatcgcgctggacctggtaactgagatcgggcgagtcccgacccacctcgcacaccgcacccggaacgcgctcgacaacctggtgatgctccatacctctgagcacggcggaaaagcataccgacacgcggttgaagaactgccagagaccatggaaacgctcctcttgctgggcctcatgatcctgctgaccggtggcgccatgctgtttctgatctctggcaaggggatcggcaagaccagcattggactgatttgcgtcatcgcctcgagcggtatgttatggatggccgagattcccctacaatggatcgcctccgcgatagtgctggagtttttcatgatggtgttgctcatccccgaaccggagaagcagcggacgccccaagacaaccagttggcatacgtcgtgatcgggatcttgaccctagccgccatcatcgccgccaacgagatgggcctgttagagaccacgaagcgcgacctgggcatgagcaaggagccgggggtcgtcagtccgaccagttacctggatgttgacctccacccggcctccgcatggacgctgtacgccgtcgccactacggtcatcacccccatgctgcggcacaccatcgagaacagcaccgctaatgtgtcgctcgctgccatcgccaatcaggctgtcgtcttgatgggtttggacaaggggtggccaatcagcaagatggaccttggcgtgcccctgctagccctcgggtgctactcccaggtgaaccccctgacgcttaccgccgccgttctcctgctgatcacccattatgccatcatcggccctggcctccaagcgaaggccaccagagaagcccagaagcggacggccgcggggatcatgaagaaccctaccgtagacggcatcatgaccatcgacctggaccccgtgatttacgacagcaaattcgagaagcagctggggcaggtgatgctcctggttctgtgcgcggtgcaactcctgctgatgcgcacctcctgggctctctgtgaggccctgacgctggctaccggccctatcacaaccctctgggagggcagccccggcaaattctggaataccacaatcgctgtctccatggctaacatctttcggggttcttacctggccggggccggcctagccttctccatcatgaagtcggtggggaccggcaagcgcggcacagggtcgcagggtgagaccctcggagagaagtggaagaagaagctcaaccagctgagccgtcgcgagttcgatttatacaagaagagtggcatcacggaggtggaccggaccgaagcgaaggaggggctaaagaggggcgagatcacccaccacgctgtctccagaggctcggccaagctccaatggttcgtcgaacgcaacatggtgatcccagaggggcgggtcatcgacttgggctgcgggcgcggcgggtggtcctactactgcgccggcctgaagaaagtaaccgaggtgcggggctatacgaagggtgggcctgggcacgaggagcccgtgcccatgagcacctacggctggaacatcgtaaagctgatgtccggtaaggacgtcttctaccttccccctgagaagtgcgacaccctgctatgcgacatcggggagagctccccaagccctaccgtcgaggagtcccgcacgatccgcgtgctgaagatggtggagccgtggctcaagaacaaccagttctgcatcaaggtcctgaacccctacatgcccaccgtgatcgaacacttagagcggctccagcgcaagcatggcgggatgctggtgcggaacccccttagccgcaattccacccacgaaatgtactggatatccaacggcaccgggaacattgtcgcctccgtgaacatggtgagccggctcctgctgaatcgtttcacgatgacccaccggcgcccgaccatcgaaaaagacgtagacctcggcgcgggcacccggcacgtgaatgccgagcccgagacgcccaacatggacgtgatcggggagcgcatcaagcggataaaagaagagcacaactccacctggcactacgacgacgagaacccgtataagacctgggcttaccatggcagctacgaggttaaggccaccggaagcgccagctccatgatcaacggcgtggtcaagcttctgacgaagccctgggacgtggtgcccatggtcacccaaatggctatgacggacaccacacccttcgggcagcagcgagtgtttaaggagaaggtggacacccggaccccgcgccccatgcccgggacccggcgtgttatgggaatcacggccgaatggctctggcggaccctggggcggaacaagaagccgagactgtgtacccgcgaggagttcactaagaaagtgcgaaccaatgccgccatgggtgcggtgttcaccgaggagaaccagtgggacagcgccaaggccgccgtcgaggacgaggacttctggaagctcgttgaccgggagcgcgagctgcataagctgggtaagtgcggcagctgtgtgtacaatatgatggggaagagggagaaaaagctcggcgagttcggcaaggccaaggggtcccgcgcgatctggtacatgtggctgggcgcccgatacctcgagtttgaggccctagggttcctgaacgaggatcactggttcagccgagaaaattcctacagcggcgtcgagggggagggcttgcacaagctcggctacatcctgagagacatctccaagatccccggcggggccatgtacgccgatgacaccgcgggctgggatacccgcatcacggaggacgacctgcataacgaggagaagatcacccagcagatggaccccgaacaccggcagctcgccaacgccatcttcaaactgacataccagaacaaggtggtcaaggtccagcgccccacccccaccgggaccgtgatggacatcatcagccggaaggaccagcgcggttccggccaagtgggcacctacggactgaacaccttcaccaatatggaagcacaactcatacgccagatggagggcgagggagtgctgagcaaggcagatctggaaaacccgcatctccccgagaaaaagatcacgcaatggctggagaccaagggcgtcgagcgcttaaagcggatggcgatcagcggcgacgactgcgtggtcaagcccatcgacgaccgcttcgccaacgccctcctggccctgaacgacatggggaaggtccgcaaggacatcccgcagtggcagccatcgaagggctggcacgactggcagcaggtccccttctgctctcaccacttccacgagctcataatgaaagatgggcgcaaactggtagtgccctgccggccccaggacgaactaatcggacgcgcccggattagccaaggtgcgggctggtccctccgcgagaccgcttgcctgggcaaggcctacgcgcagatgtggagcctgatgtacttccacagacgggacctacgcctggcgagtaacgccatctgcagcgccgtgccggtccattgggtgcccacgtcacggacgacctggagcattcatgcccaccatcagtggatgaccaccgaggacatgctgacggtgtggaacagagtctggatcgaggacaatccctggatggaggacaagacccccgtgaccacctgggagaacgtgccgtatctcgggaaacgggaggaccagtggtgcggctccctgatagggctgactagccgcgccacctgggcgcagaatatcagcaccgccatccagcaagtccggtccctcattggcaacgaggagttcctggactacatgcccagcatgaagcgcttccggaaggaggaggagtctgagggcgccatctggtaa

SEQ ID NO: 26054 - RNA, 9873 nt, synthetic construct
  misc_feature 1..9873: note = derived and/or modified CDS sequence (opt11) from DENV-3__FJ639787__SS-prME
  source 1..9873: mol_type = other RNA
accagcctgtgcctcatgatgatactacccgccgcactggccttccacctcacctcacgggacggagagccgcgaatgatagtggggaagaatgaacggggaaaaagcctgctttttaagaccgcgtccgggatcaacatgtgcacgctcatcgccatggatctgggcgaaatgtgcgacgacacggtgacctacaagtgcccccacatcacagaggtggagcccgaggacatcgactgctggtgcaacctaaccagcacttgggtcacctacggaacctgcaaccaagccggcgagcaccggcgagacaagcgtagcgtcgcccttgcgccccacgtgggcatggggttggatacgcgcacccagacctggctaagcgccgagggcgcctggcgccaagtggagaaggtcgagacgtgggccctccggcacccagggttcaccatcctggcactgtttctcgcccactacatcggcacgagcctgacccagaaggtggtaatattcatcctgctcatgctggtcacgcccagcatgaccatgcggtgtgttggggtgggcaaccgcgacttcgtcgagggcctgtccggcgccacatgggtggacgtggtcctagagcacggcgggtgcgttaccacgatggctaaaaacaagcccaccctggacattgagctgcagaaaaccgaggcaacccagctcgctacgctgcggaagctgtgcatcgagggcaagatcaccaatatcaccaccgactcccgctgtcccacgcagggtgaggccgtgctcccggaggagcaggaccagaactacgtctgcaagcacacgtacgtggaccgggggtggggcaacgggtgcggcctgttcgggaagggatccctggtgacctgcgccaagttccagtgtctcgagcccatcgagggcaaggtagtccagtatgagaacctgaagtacaccgttatcataacggtccacaccggggaccagcaccaggtgggcaacgagacccagggggtcaccgccgagatcacgccccaggccagcactaccgaggcgatcctacccgagtacggcaccctcggactggagtgttcaccgcgcaccggcctggatttcaacgaaatgatcctcctcacgatgaagaacaaggcctggatggtccacagacagtggttcttcgacctgcctctaccctggaccagcggcgccaccaccgagacgcccacctggaatcgcaaggaactactggtgaccttcaagaacgcccacgccaagaagcaggaggtggtggtgctcgggtcccaggagggggcgatgcacaccgcactgacgggggccactgagattcagaacagcggagggacctccatcttcgccggccacctgaagtgtcgtctcaagatggacaagctggagttaaagggcatgagctacgccatgtgcaccaacacgtttgtcctcaagaaggaggtgtccgagacccaacacgggaccatcctgatcaaggttgaatacaagggcgaggacgtcccgtgtaagatacccttcagcaccgaggacggccagggcaaggcgcataacggccgcctgatcacggccaaccccgtagttacaaagaaagaggagcccgtcaacatcgaggccgagccgcccttcggagagagcaacatcgtgatcggcatcggggacaacgccctcaaaatcaactggtacaagaagggctccagcatcgggaagatgttcgaggcgacagcccggggcgcacgaagaatggccatccttggcgacactgcttgggacttcgggtccgttggcggggtcctaaactccttaggcaagatggtgcaccagatcttcgggtccgcctacacggctctcttctcgggtgtgtcctgggtcatgaagatcggcatcggggtgcttctgacctggatcggcttaaacagtaagaacacctcgatgagcttcagctgcatcgctatcggaatcatcaccctataccttggcgccgttgtccaggccgacatggggtgcgttatcaactggaagggcaaggagctcaagtgcggcagcggaatcttcgtgacgaacgaggtccacacgtggaccgagcagtacaaattccaggcggactcccccaagcgcctggccaccgccatcgcgggcgcctgggagaatggggtgtgcggcatccgctcaacgacccgtatggaaaatctgctttggaagcagatcgccaacgagctgaattacatcctgtgggaaaacaacatcaagctcaccgtggttgtgggggacactatcggggtgctagagcagggcaagcgcacgctgacgccacagccgatggagctcaaatactcctggaagacctggggtaaggctaagatcgtcaccgccgagacgcagaacagctctttcataatcgatggccccaacacccccgagtgtcccagcgcctcccgggcgtggaacgtgtgggaggtggaggactacggattcggcgtcttcaccaccaacatttggttaaagctacgcgaggtgtacacccagctctgcgaccaccggctgatgagtgccgccgtgaaggacgagcgcgccgtccacgctgacatgggctactggatcgagtcccagaagaatggctcctggaagttggagaaggcgagtctcatcgaggtgaagacctgtacctggcccaagtcccacaccctgtggtctaacggcgtgctggagtccgacatgatcatccccaagagcctcgccggacccatctcgcagcataactaccggccgggctaccatacccagacggccggcccctggcacctgggcaagctggaactcgacttcaactactgcgagggcaccacagtagtgataacggaaaactgcgggacgaggggccccagcctgcgaaccaccaccgtgtccgggaagctcatccacgagtggtgctgccgcagctgcaccctgccgcccctgcggtacatgggcgaagacgggtgctggtacggcatggagattcgccccatctctgaaaaggaggagaatatggtcaagagcctggtctctgccggcagcggggaggtggacaacttcaccatgggcgtcctctgtctggccatcctgttcgaggaggtgatgcgggggaagtttgggaagaagcacatgatcgcgggggtgttctttacatttgtgctcctgctgtccgggcagatcacctggcgcgatatggcgcacacgctcattatgatcggctcgaacgcctccgaccgaatggggatgggagtgacctaccttgccttgatcgccaccttcaagatccagcccttcctcgcgctggggttctttctgcgcaagctcaccagccgggagaacctgttgctcggcgttggccttgccatggccacgaccctgcagctccccgaagacatcgagcagatggccaatgggatcgcgctggggctcatggcccttaagttaatcacacagttcgaaacctaccaactttggacggccctcatcagtctgacctgctccaacaccatcttcaccctgacggtcgcgtggagaaccgccaccctcatattagcgggcgtgagcctactccccgtttgtcagtcctcatccatgcggaagaccgactggctgcccatgacggtcgccgccatgggcgtgccgcccctcccactgtttatcttctcgttgaaagacaccctgaagcgcaggtcctggcccttaaacgagggtgtcatggccgtgggcctggtgagcatcctcgccagcagcctcctgcgcaacgacgtccccatggccggccccctggtcgccggagggctcctgatcgcatgttatgtgataaccggaacctccgccgatctgacggtagagaaggccgcggacgtgacctgggaggaggaagccgagcagacgggtgtgagccacaacctcatgattaccgtcgatgacgacgggactatgcgcataaaggacgacgagacagagaacatcctcaccgtgctgctcaagactgccctgctgatcgtgtccggcatctttccatacagcatcccagccacgctcctggtatggcacacgtggcagaagcagactcagcggtccggagtgttgtgggacgtcccctccccacccgagacccagaaggccgagctcgaggaaggggtctatcgaattaagcagcagggcatcttcgggaagacccaggtaggcgtgggggtccagaaagagggcgtgtttcacacgatgtggcacgttacccgcggcgcggtcctaacttacaacggaaagcgcctcgagcccaactgggcctccgtgaagaaggacctcatcagctacggcgggggctggcggctgtccgcgcagtggcagaagggggaagaggttcaggtaatcgccgtggaacccggcaagaaccccaagaacttccagaccatgccgggcacttttcagaccacgacaggggagataggcgcgatcgccctggatttcaaacccgggacgagcggcagccccatcatcaacagagagggtaaggtggttgggctgtacggaaacggggtagtgaccaagaacggcgggtatgtttccggcattgcccagaccaacgccgagccggatggccccacccccgagctcgaggaggagatgttcaagaagcggaacctgacaattatggacctgcatcccgggagcggcaagaccagaaagtacctcccagccatcgttcgtgaggcgatcaagcgccggctgcgcaccctaatcctcgcccccacccgcgttgtcgccgcagagatggaggaggccctaaaggggctaccgatccgctaccagacgaccgcgactaagagcgagcacactggccgggagatcgtggatctcatgtgccacgccacgttcaccatgcgcttactgagccccgtgcgggtcccaaactacaacctcatcattatggacgaggcccattttaccgaccccgcctccatcgccgcgcgagggtacatcagcacccgggtgggaatgggcgaggccgccgccatcttcatgacggcgactccgccagggaccgcagacgccttcccgcagagtaatgctcccatccaggacgaggagcgcgatatccccgaaagaagctggaactccggcaacgagtggatcaccgactttgcgggcaagacggtgtggttcgtccccagcattaaggcgggcaacgacatcgccaactgcctgagaaagaacggaaagaaggtgatccagctgtcccgaaagaccttcgacaccgagtaccagaagaccaagctcaacgactgggacttcgtggtcacgacggatatcagcgagatgggtgccaacttcaaggccgaccgggtgatcgacccgcgacggtgcctgaagcccgtgatcctgactgacggacccgagcgcgttatccttgccggccccatgccggttaccgcggcgtccgccgcccagcggcgcgggcgggtgggtcgcaacccccagaaggagaacgaccagtacatcttcaccggccagcccctgaacaacgatgaggaccacgcccactggactgaggcgaagatgctgctcgacaacattaacacccccgaggggatcatcccagccctgttcgagcccgagcgggagaagagtgccgccatagacggcgagtatcgcctgaagggcgagtcccgaaagaccttcgttgagctcatgagaaggggggacctgcccgtgtggttagcccacaaggttgcgagcgagggaatcaagtacactgaccgcaagtggtgcttcgacgggcagagaaataaccagattctcgaggagaacatggacgtggagatctggacgaaggagggggaaaagaaaaagctgcgcccccggtggctggatgccaggacctattctgacccgctagctctgaaagaattcaaggacttcgccgcgggccgcaaaagcatcgccctggacctcgtgactgagatcggacgggtccccacccacctggctcaccgcacgcgaaacgcccttgacaacctcgtgatgctgcacacctccgaacacggcggaaaagcctaccgccacgctgtggaggaactgcccgagaccatggaaaccctcctgctgctcggcctgatgatcctgctcaccggcggggctatgctattccttatcagcgggaaggggatcggcaagaccagcatcgggctaatctgcgtcatcgcctccagcggaatgctgtggatggccgagatcccgctgcagtggatcgcgtcagcgatcgtgctcgagttcttcatgatggtgctcctgatccccgagcccgaaaagcagcggacgccccaggacaaccagctcgcatacgtggttatcgggatcctgaccttagccgccacgatcgccgcgaatgagatgggcctcctggagaccactaagcgcgacctgggcatgtcgaaggagcctggggtcgtctctcccaccagctacctcgacgtggacctgcatcccgcctccgcctggacgctgtacgccgtggcgaccaccgtcataacccccatgctccggcacacgatcgaaaacagcaccgcgaatgtgtccttggccgccatcgcaaaccaggctgtggtcctgatgggactcgacaaggggtggccgattagcaagatggacctgggtgtgccgctgctcgccttagggtgctattcccaggtgaatcccctgaccctcaccgccgccgtcctgttgctcatcacgcactacgcaatcatcggccccggcctgcaggcaaaggcgactcgtgaggcacagaaacggaccgccgccgggatcatgaagaatccgactgtggacggaatcatgacgatcgatctggatcccgtgatttatgacagcaagttcgagaagcagctcggccaagtcatgctgctggtgctctgcgccgtgcagctgctgctaatgaggacctcctgggccctgtgcgaagccctgaccctcgccaccggccccatcacgaccctgtgggagggcagccccgggaagttttggaacaccaccatcgcggtttctatggccaacatcttccggggctcgtacctggccggggccgggctagccttttccatcatgaagtcggtggggacgggcaagcgcggcacggggtcccagggggagaccctgggggaaaagtggaagaagaaactgaaccagctcagccgcaaggagttcgacttatataagaagtccggcatcactgaggtggaccgcaccgaggctaaagaggggctgaagcggggcgagattacgcatcacgctgtctccaggggcagcgccaagctgcagtggttcgtcgagcggaacatggttattccggaagggcgagtcatcgatttgggctgcgggcggggcgggtggtcctactactgtgccggattaaagaaggttacggaagtgcgcggctacaccaagggcgggcccgggcacgaggagcccgtacccatgtccacctacggctggaacatcgtgaagctcatgagcggaaaggacgtgttctatctgccgccagagaagtgcgacacgctgttatgcgacatcggcgagagcagtcccagcccaactgtcgaggagtctcggactattcgcgtgctcaagatggtcgagccatggttaaagaacaaccagttttgcatcaaggttctgaacccctacatgcccacggtgatcgagcacctcgagcgcctgcaacgaaagcacggcgggatgctggtgcgcaaccccctcagccggaactccacgcacgaaatgtactggatcagcaacggcacggggaacatcgtcgcctcagtgaacatggtatcccgcttactgttgaaccggttcacaatgacccaccgccggccgaccatcgaaaaggacgtcgatttgggcgccggcacccgccacgtgaacgcagagcccgagaccccaaacatggacgtcatcggggagcgcatcaagcgcatcaaggaggagcacaattccacctggcactatgacgacgagaacccgtataagacttgggcctatcacggcagctacgaggtcaaagccaccggaagtgcaagctccatgattaacggcgtggtcaagctgctcacgaagccctgggacgtagtgccaatggtcacccagatggcgatgacggacaccactcccttcgggcagcagcgggtgttcaaggaaaaggtggacactcgaacaccgaggagcatgcccggcacccgccgggtcatgggcataaccgccgagtggttgtggcgaacgctgggacggaacaagaaaccccgcctctgtacgagagaggagttcaccaagaaggtgcgtaccaacgccgccatgggagctgtgttcaccgaggaaaaccagtgggacagcgcaaaagccgccgtcgaagacgaggacttctggaagctggtggaccgcgagcgggagctgcacaagctcgggaagtgcggcagctgcgtgtataacatgatggggaagcgcgagaagaagctgggcgagtttggaaaagcgaaggggtcccgggcgatctggtacatgtggctgggcgcccgataccttgagttcgaagccttggggttcctgaacgaagaccactggttttcccgggagaactcgtactccggcgtcgagggggagggcctccacaagctgggctacatcttacgcgacatctctaagatccccgggggcgctatgtacgcagacgacacggcggggtgggacacccggatcactgaggatgacctccacaacgaggagaaaatcacgcaacaaatggatccggagcaccgccagctggccaacgcaatcttcaagctgacctatcagaacaaggtcgttaaggtgcagcggcccacgccaaccggcaccgtgatggacatcatatcccgaaaggatcagcggggctcaggccaggtgggcacctacgggctcaacacgttcaccaacatggaggcccagctgatccgccagatggaaggcgagggcgtactgtccaaggcagacctcgagaacccccaccttccagagaagaagatcacccagtggctggagacgaagggcgtggagcgactcaagaggatggcgatctcaggcgatgactgcgtggtcaagcccatcgacgaccggtttgccaacgccctgctggcactcaacgacatggggaaggtgcgaaaagacatacctcagtggcagccctcaaagggttggcatgactggcaacaggttcctttctgcagccaccacttccacgaactgatcatgaaggacgggagaaaactggtcgtgccttgtcgcccgcaggacgaactcatcggccgcgcccgcatctcccaaggggcgggctggagcctgcgggagacggcctgcctgggcaaggcttatgcccaaatgtggtccctcatgtacttccaccgccgcgacctgcgactggcgtccaacgccatctgctccgccgtccccgtccactgggtgccaaccagcaggaccacctggtccatccatgcacaccaccaatggatgacgaccgaggacatgctaaccgtgtggaaccgtgtctggatcgaggataacccctggatggaggacaagaccccggtgacgacgtgggagaacgtgccctacctggggaaacgcgaggaccaatggtgcggcagccttatcggactaaccagccgggccacctgggcgcagaacatcccgacggccatccagcaggtccgctcgctgatcggcaacgaagagtttctggactacatgcccagcatgaagcggttccgcaaggaggaggagtccgagggggcgatctggtga

SEQ ID NO: 26055 - RNA, 9873 nt, synthetic construct
  misc_feature 1..9873: note = derived and/or modified CDS sequence (opt11) from DENV-3__FJ639790__SS-prME
  source 1..9873: mol_type = other RNA
acctctctgtgcctcatgatgatcctgcctgccgccctggcgttccaccttacctcccgggacggcgagcctcggatgatcgtggggaaaaacgagcggggcaagagcctgcttttcaagaccgcctccgggatcaacatgtgcaccctcatcgccatggacctgggcgagatgtgtgacgacaccgtgacctacaagtgtccccacatcactgaggtggagccggaggatattgactgctggtgcaacctaaccagcacctgggttacgtacggtacctgcaaccaagccggcgagcatcggcgcgacaagcgttctgtagccttggcgccccacgtgggcatggggctggacacacgaacccagacctggatgagcgccgagggggcctggcgccaggtggagaaggtcgagacttgggccctacgccacccggggttcaccatcctcgcgctgttcctagcccactatatcggcacctccctcacacaaaaggttgttatcttcatcctgctcatgctggtcacgccctcaatgaccatgcggtgcgtgggggtgggcaaccgcgatttcgtcgaaggcctatccggggctacctgggtggacgtggtcctggagcacggcgggtgcgtgaccacgatggccaagaacaagcccactctcgacatcgagctgcagaagactgaggccacgcagctggcgacgttacggaagctgtgcatcgagggcaagatcaccaatatcaccactgactcccgctgccccacgcaaggcgaggccgtgctcccggaggagcaggaccagaactacgtctgcaagcatacctacgtggaccgggggtggggtaacggatgcggcctatttgggaagggctccctggttacatgcgccaagttccagtgccttgagcccatagagggcaaggtcgtgcagtacgagaacctcaagtacaccgttatcatcacggtccacacgggggaccagcaccaggtgggaaacgagacccagggcgtgacggccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtacaccggcagtggttctttgacctgcccctgccctggaccagcggcgccaccaccgagacgcccacctggaaccgcaaagagctcctggtgaccttcaagaacgcacacgccaaaaagcaggaggtcgtggtgctgggctcccaggagggcgcgatgcacacagccttgacgggcgcaaccgagatccagaacagcggagggacctccatcttcgccggccacctgaagtgccggctgaagatggataagttggagttgaagggcatgagctacgccatgtgcaccaacacgttcgtcctcaagaaagaggtttcagagacacagcacgggaccatcctaatcaaggtggagtacaagggagaagacgtcccgtgcaagatacccttcagcaccgaggacgggcagggcaaagcgcacaacgggcgcctgatcacggctaaccccgtggtaaccaagaaggaggagcccgtcaacattgaggccgagccacccttcggggagagcaacattgtcatcggcataggggacaacgcccttaagataaactggtacaagaagggctccagcatcgggaagatgttcgaggcaaccgcccggggcgcccgcaggatggctatcctgggcgacactgcgtgggactttggatccgttggcggagtcctcaactctttgggcaagatggttcaccagatctttgggtccgcttacacggccctgttcagtggagtgtcctgggtcatgaagatcgggatcggggtcctcctgacctggataggcctgaacagcaagaacacctcgatgagcttctcgtgcatcgccatcgggatcatcacactctacttaggagcggtggtccaagccgacatgggatgtgtgatcaactggaagggcaaggaactgaagtgcgggagcgggatcttcgtgactaatgaggtccacacctggacggagcagtacaagttccaggcggacagtcccaagcgcctcgcgaccgccatcgccggagcctgggaaaacggcgtgtgtgggatccgcagcacgacccggatggagaacctgctgtggaagcagatcgcgaacgagctgaactacattctgtgggagaataacatcaagctcaccgtggtcgtgggcgacatcatcggcgtgctcgagcagggcaaaagaaccctaacgccgcagccgatggagctgaagtactcctggaagacttgggggaaggccaagatcgtaacggctgagacccagaacagctcattcatcatcgacggccccaacacgcccgaatgccctagcgcttcacgggcgtggaacgtgtgggaggtggaagactacgggttcggtgtattcaccacgaacatctggctcaagttgagagaagtgtacacccagctgtgcgaccaccggctcatgagcgccgccgtgaaagacgagcgcgccgtccacgccgacatgggatattggatcgagtctcagaaaaacgggtcctggaaactggagaaggcgagcctgattgaggtgaagacgtgcacatggccgaagagtcacaccctctggagcaacggcgtgctggagtccgacatgatcattcccaagtcactggccgggcccatctcccagcacaactaccggccgggctaccacacccagacggccgggccttggcacctcgggaagttagaacttgactttaactactgcgagggcacgaccgtcgtgatcaccgagaactgcgggacccgcggccccagcctcagaacgaccaccgttagtgggaagctgatccacgagtggtgctgccggtcttgcaccctgcccccgctgcggtacatgggcgaggatgggtgctggtacggcatggagatccgccccatctcggagaaggaggagaacatggtcaagagcctggtttccgccggcagcggggaggtggacaacttcacgatgggcgtcttatgcctggcgatcctgtttgaggaggttatgcgcgggaaattcggcaagaagcacatgatcgcgggggtgttcctgaccttcgtcctcctgctgtctggccaaatcacctggcgcgatatggcccacaccctcataatgatcggcagcaacgcctccgatcggatggggatgggcgtgacataccttgccctgattgcgaccttcaagatccagcccttcctcgcgctggggtttttcctgaggaagctcaccagccgggagaatctgctgctcggagtgggccttgccatggccacaacgctgcaactccccgaggacatcgagcaaatggccaacgggatcgcgctgggcctgatggcactcaagctgatcacccagttcgagacctatcagctatggaccgctcttatcagcttaacgtgctcaaataccattttcactcttacagtcgcttggcgcacggccaccttgatactggcgggggtgagcctgctcccggtctgccagtcctcttccatgcggaagacagactggctgcccatgaccgtggccgccatgggcgtgccgccccttcccctgttcatcttcaacctgaaggacacgctgaagcgccgcagctggcccctcaacgagggggtcatggccgtgggcctggtgtccatactagcctcgtccctcctgcggaatgatgtccccatggccggcccactggtcgccgggggcttgctgatcgcctgctacgtcatcaccgggactagcgccgacctgaccgtcgagaaggccgctgacgtgacgtgggaggaggaagccgagcagaccggcgtgtcgcacaacctcatgatcacagtcgacgacgacgggaccatgcgcatcaaggacgatgagaccgagaacatcctaacggtgctgctcaagaccgccctgctgattgtgagcggcatcttcccgtattccattcccgccacccttctggtatggcacacctggcagaagcagactcagcggagcggtgttctctgggacgtgccatccccgcccgagacacagaaggccgagctcgaggagggggtctaccgcattaagcaacagggaatctttgggaaaacccaggtgggcgttggggtccagaaggaaggcgtgtttcataccatgtggcacgttacgcggggcgcggtcctgacctacaacgggaaacgcctggagcccaattgggcctctgtgaagaaagacctcatctcctatggcgggggctggcggttaagcgctcagtggcagaagggggaggaggtgcaggtcatcgccgtcgagccgggcaaaaaccccaagaactttcagaccatgcccggcaccttccagacgaccaccggggagattggcgcgatcgccctggatttcaagcccgggacctccggtagccccataatcaaccgcgaaggcaaagtggtcgggctgtatgggaacggggtggtgaccaagaacggcgggtatgtcagcggcattgctcagaccaacgccgagccggacggccccacccccgaactcgaggaggagatgtttaaaaagcggaacctgaccatcatggacctgcaccccgggtccggcaaaacgcgcaagtacctaccggccatcgtgcgggaggcgattaagcgccggctgcgcaccctgatcctcgcccccacgcgagtggtcgccgccgaaatggaggaggccctgaagggactgccaatcagatatcagacaactgcgacaaagagcgaacacaccggccgggagattgtcgacctaatgtgtcatgccaccttcactatgcgcctgcttagccccgttcgggtcccgaactacaacctcatcatcatggacgaggcccacttcaccgaccccgccagcatcgcggcccgcgggtacatctcgacccgggtgggcatgggtgaagccgccgccatcttcatgaccgcgactccgcccgggaccgccgacgccttcccgcagtctaatgcccccatacaggacgaggagcgcgacattcccgagcgctcctggaacagcggcaacgagtggatcaccgactttgccgggaagaccgtgtggttcgtcccatccatcaaggcgggcaatgacatcgccaactgcctgcggaagaacgggaagaaagtgatccagttatcacgcaagacgttcgacaccgagtaccagaagaccaagctcaacgattgggacttcgttgtaactacggacatttccgaaatgggtgcaaacttcaaggccgaccgggttatcgatccgcgccggtgtctgaagcccgtgatcctgaccgacggccccgagcgcgttatcctagccggacccatgcctgtgacagcggccagcgccgcccagcggcgcggccgggtggggcggaatccccagaaggagaacgatcaatacatcttcaccggccaacccctgaacaacgacgaagaccatgcccactggaccgaggcgaagatgctgctcgacaacatcaacacgcccgaagggatcatcccggccctgttcgagcccgagcgggagaagtccgccgcaatcgacggcgagtatcgcttaaaaggcgagagccggaagaccttcgtggagctcatgcgcagaggggaccttcccgtgtggctggcccacaaagtcgcgtccgagggcataaagtataccgaccgcaaatggtgcttcgacgggcagcggaacaatcaaattcttgaggagaacatggacgtcgagatttggaccaaggagggagagaagaagaagctccgcccccggtggctcgatgcccgcacgtacagcgacccgctcgccctgaaggagttcaaggacttcgccgcgggccgcaagtcgatcgccttagacctcgtgacagaaatcgggagggtccccacccatctggcccaccgtacccgaaacgcgcttgataatctcgtgatgctgcacacttcggaacacggcgggaaggcctaccggcatgcagtggaggagctgccagagaccatggagaccctccttcttcttggcctgatgatcctactcaccgggggcgccatgctgttcctgatcagtggcaaggggatcgggaagacaagcatcgggttaatctgcgttatcgcctcgagcggcatgctgtggatggcggaaatcccgctgcagtggatcgccagcgcgatcgtgcttgagttcttcatgatggttctcctgatccccgagcctgagaaacagcggacaccccaggacaaccagttagcctacgtcgtgatcgggatcctgaccctggccgccatcatcgccgctaacgagatgggcctattggaaaccacgaagcgcgacttggggatgtccaaggagccgggcgtggtctctccgacctcctacctggacgtggatctgcaccccgcctccgcctggaccctgtacgccgtggcgaccacggtcatcacccccatgctccgccacacaattgaaaattccaccgccaacgtgagcctggccgccatcgccaaccaggcggtggtcctgatgggcctcgacaaggggtggccgatctccaagatggaccttggcgtgcctctgctcgccttaggatgctacagccaggtgaaccccctgaccttaaccgccgccgtgttactgctaattacccactacgcaatcatcggccccggactgcaggcgaaggccaccagagaggcccagaagcggactgccgcggggattatgaagaaccctaccgtggacggaatcatgaccatcgacttagacccggtgatctacgattcaaagtttgagaagcagctcgggcaggtcatgctgctggtgttatgcgcagtgcagctgctgctcatgcgcacgtcttgggcactgtgcgaggctctgacgctcgctaccggccccatcaccaccctttgggagggctcccccggaaagttctggaacacgacgatcgcggtctccatggccaacatcttccgcggctcctacctggccggggctggcctcgccttcagcatcatgaagtccgtggggaccggcaaacgcggcaccggcagccagggcgagaccctgggggagaagtggaagaagaagctgaaccagctcagccggaaagagttcgacctgtacaagaaatccggcatcacagaggtggatcgcaccgaagcgaaagaggggctgaagcggggcgagatcacccaccacgccgtctcacggggcagtgcaaagctccagtggttcgtggagcggaacatggtgatcccggaggggcgggtcatcgacctgggctgcgggcgtggcgggtggagctattactgcgccggcttaaagaaggtgaccgaggtgcgcggctataccaaaggcgggcccgggcacgaggagcccgtccccatgtcgacctacggctggaacatcgtgaaactcatgagcggcaaggacgtattctacttgccgcccgagaagtgcgacaccctgctgtgtgatataggcgaatccagcccctcccccacagtcgaggagagccgaaccatccgagtgctcaagatggtagagccctggctgaagaacaaccagttctgcatcaaagtcctcaacccgtacatgcccaccgtgatcgagcaccttgagcgcttacagcggaaacatggcgggatgctagtgcgcaaccccctctcgagaaacagcacccacgagatgtactggatctccaacggcaccggcaatatagtggccagcgtgaacatggtatcccgcctgctcttgaaccggttcacgatgacccaccgcagaccgaccatcgagaaggacgtcgacctaggcgccggcactcgccacgtgaacgcggagccagagacgcccaacatggacgtgatcggggagagaatcaagcgcatcaaggaggagcacaacagcacctggcactacgacgatgagaacccctacaagacctgggcgtaccacggaagctacgaggtcaaggctaccgggagcgcctccagcatgatcaacggagtggtcaagctgcttacgaagccgtgggatgtggtgcccatggttacccagatggcgatgaccgacaccacaccctttgggcaacagcgggtgttcaaggagaaggtcgacacgcgcactcctcggtcgatgcccggcaccaggagagtcatgggcatcacagccgagtggctgtggcgcaccctggggcggaacaagaagccccgcctctgcacccgggaggagtttaccaagaaggtgcgaactaacgcggccatgggcgcggtgttcaccgaggagaaccagtgggacagcgccaaggccgccgtcgaggacgaggacttttggaagctggtggacagggagcgggagctccacaagctcgggaagtgcggctcctgcgtttacaacatgatgggaaagcgcgagaagaagctgggtgagttcggcaaggccaaggggtcccgggcaatctggtacatgtggctgggtgctcgctaccttgagttcgaggccctggggttcctcaacgaggatcactggttcagccgggagaactcctatagcggcgtcgagggggagggccttcacaaactgggctacatcctgcgcgacatctccaaaatccccgggggcgccatgtacgccgacgacaccgccggatgggacacaagaatcacggaggacgatttacataacgaagagaaaattactcagcagatggacccggagcaccgccagctggcaaacgccatcttcaagctgacctaccagaacaaggtcgttaaggtgcagcggcccacccccgccggcaccgtgatggacatcatctcccgaaaagaccagcgggggtccggccaggtgggcacctacggactcaacaccttcacgaacatggaggcccaactgatcaggcaaatggagggagagggggtactgagcaaggcggacctcgagaacccccacttgccagagaagaagatcacccagtggctggagacgaagggcgtggagagactcaagcgcatggccatctccggcgacgactgcgtggtgaagcccattgatgaccggtttgccaacgccctgctggcactcaacgacatggggaaggtacgcaaagacatcccccagtggcagcccagtaaggggtggcacgactggcagcaggtcccgttctgctcccatcacttccacgagctaatcatgaaggacgggcggaaactcgttgtaccctgccgcccccaggatgagctcattggcagagcgcgaatcagccagggggccggctggtccctgagggagaccgcctgcctgggcaaggcgtacgcgcagatgtggagcctcatgtacttccacagacgagacctgcggcttgcctccaacgccatctgcagcgccgtgcccgtccactgggtgcccacctcccgcaccacgtggtcgatccacgcgcaccaccagtggatgaccaccgaggacatgctcactgtgtggaatagagtctggatcgaggacaacccctggatggaggacaagacacccgtgaccacctgggagaacgtgccctacctggggaagcgcgaagatcagtggtgcggttccctcatagggctcacgagtcgagcgacgtgggcccagaacatcccgaccgccatccagcaggtccgctctctgatcgggaacgaggagttcctggactacatgccgtcgatgaagaggttccgcaaggaagaggagtcggagggggccatttggtaa

SEQ ID NO: 26056 - RNA, 9873 nt, synthetic construct
  misc_feature 1..9873: note = derived and/or modified CDS sequence (opt11) from DENV-3__FJ639791__SS-prME
  source 1..9873: mol_type = other RNA
acctcgctctgtctcatgatgatactccccgccgccttggcattccacctcactagccgggacggtgaaccgcggatgatcgtggggaaaaacgagcgcggcaagagcttgttgttcaagacggcctccgggataaacatgtgcaccttgatcgctatggacctcggtgagatgtgtgatgatactgtgacctacaagtgcccccacatcacggaggtcgagccagaggacatagactgctggtgcaacctgacctccacatgggtgacgtatgggacgtgcaaccaggcgggtgaacaccggcgcgacaagaggtccgtcgccctcgcgccgcatgtggggatggggctggacacccgcacccagacgtggatgagcgctgagggtgcctggagacaggtcgagaaggtcgagacgtgggctttacgccacccggggttcaccatccttgcgctgttcttggcccactatatcggcacctccctcacccagaaggtggtgatcttcatactgctcatgctcgtaacgcccagtatgaccatgagatgcgtaggggtgggcaaccgggatttcgtcgaaggtctgtccggggccacctgggtggacgtggtcttagagcacggcgggtgcgtaaccacgatggccaagaacaaacccaccctcgacatcgaactgcagaagaccgaagccacacagctggcgacgttgcgtaagctgtgcatcgagggcaagatcactaacatcaccaccgatagccgttgccctacgcagggcgaggcggtactgccggaagaacaggaccagaactacgtatgcaaacacacctacgtggaccgggggtggggcaatgggtgcggactcttcgggaagggctccctggtgacatgcgccaagtttcagtgccttgagcccgtcgaaggcaaggtggttcagtacgagaacttgaagtataccgttatcatcacggtgcacaccggggaccagcatcaggtcggcaacgagacccagggggtgaccgccgagattactccccaggccagcaccactgaggctatcttgcccgagtatgggaccctgggcctcgaatgctccccgcgtacggggttggacttcaatgagatgatcctgctcacaatgaagaacaaggcctggatggtgcacaggcagtggttcttcgacctacccctgccgtggacgtctggcgccaccacagagacgcccacctggaaccgcaaggagctcttggtaacattcaagaacgcccacgcaaagaaacaggaagtggtggtgcttgggtcacaggagggcgcgatgcatacggccctcacgggtgctaccgagatccagaacagcggcgggacctccatcttcgcggggcacctgaagtgtcggctgaagatggacaagctcgagctgaagggtatgtcatacgccatgtgtacaaacacgttcgtgctgaagaaagaagtaagcgagacccagcatgggaccatcctcatcaaggtcgagtacaaaggggaagacgtaccgtgcaagattcccttctccaccgaagatgggcaggggaaggcccacaacggccgcctgatcacggccaaccccgtggtcaccaagaaggaggagcccgtgaacatagaggctgagccacccttcggggagagcaatattgttatcggcataggggacaacgcacttaagatcaactggtacaagaagggctcgagcatagggaagatgtttgaggctaccgccagaggcgcccgccggatggcgatccttggtgacaccgcctgggactttggttccgtcggcggggtgctcaacagcctgggaaagatggtgcaccagatctttggctccgcgtacacggccctatttagcggcgtatcgtgggtcatgaagatcggaatcggcgtactcctgacctggatcggcctgaatagcaaaaacacgagtatgtccttctcttgtatcgctatcggaatcatcaccctctacttgggcgcggtagtgcaggcggacatggggtgcgttataaactggaaaggcaaggagttaaaatgcggctccggcatattcgtcactaacgaggttcacacctggaccgagcaatacaagtttcaggcggactctcccaagcgcctcgccacagccatagccggcgcctgggagaacggggtctgcggtatccggtcgacaacccggatggaaaacctcctgtggaaacagattgcgaacgagctcaattacatcctgtgggagaacaacatcaaactcacggtcgttgtgggcgacatcatcggtgtcttggagcagggcaagcgcaccctaacgccccagccgatggagctcaagtactcctggaagacctgggggaaggcaaagattgtgaccgccgagacacagaactcatctttcatcattgacggccccaacactcccgagtgccccagcgcgtcccgtgcgtggaacgtgtgggaggtagaagactacgggttcggcgtgttcacaaccaatatctggctcaagctgcgcgaggtgtatacccaactgtgcgaccaccggcttatgagcgcagccgtgaaggacgagcgcgccgtgcacgccgatatgggttattggatcgaaagccagaagaacgggtcctggaagctggagaaggcgagcctgatcgaagtgaagacctgcacgtggccgaagtcccacaccctctggagcaacggcgtactggagtccgacatgatcatacccaagagcctggccgggcccatctcccagcacaactatcggccgggataccacacgcagaccgccgggccctggcacttgggcaagctggagctggacttcaactactgtgagggcacgaccgtggtgatcaccgaaaactgcgggactcggggccccagtctccgtactactaccgtctccgggaaacttatccatgaatggtgctgccggtcttgcacgctgccaccgctccggtacatgggcgaggacggttgctggtacggcatggagatccgcccaatctccgaaaaggaggaaaatatggtgaaatccctggtgagcgccggtagcggggaggtcgacaatttcacgatgggcgtgctatgcctcgcgatcctgttcgaggaggtgatgcggggaaagtttggcaagaagcacatgatcgcgggtgtctttttcaccttcgtgttactcctgtccggtcagataacctggcgcgacatggcccataccctgatcatgatcggcagcaacgcctccgaccggatggggatgggcgtgacgtacctcgccctgatcgccactttcaagatacagccttttcttgcgctcggtttcttccttcgaaaactgacaagccgggagaacctgttactgggcgtcggtctcgccatggcaaccaccctgcagctgcccgaagacattgagcagatggccaacgggatcgcgctcggtctgatggcccttaagctcatcacccagttcgaaatctaccagctgtggaccgcactgattagtctgacctgctccaacacgatcttcactctgacggttgcctggcgcaccgccacgctgatcctcgcgggggtctcacttcttccggtgtgccagtcctcatccatgcggaagaccgactggcttcccatgaccgtggccgccatgggcgtgccgcccctcccgctgttcatcttcaatcttaaggacaccctaaaacgcagaagctggccccttaatgagggcgtaatggccgtgggcttggtctccatcctggcttcatccctgctccggaacgacgtgcccatggcgggccccttagtggccgggggactgctcatcgcgtgctacgtcatcacgggaaccagtgccgatctgaccgtcgagaaagccgcggatgtgacctgggaagaggaggcagaacagactggcgtgtcacacaaccttatgattaccgtggatgacgacggaaccatgcgtatcaaagacgacgagaccgaaaacattctcaccgtgctgttgaaaacagcccttctgatcgtcagcggcatcttcccgtactccattcccgccaccttactggtttggcacacctggcaaaagcagacccagcggagcggcgtgctttgggatgtcccctcacccccggagacgcaaaaggctgaactggaggagggcgtatacagaatcaagcagcagggcatcttcgggaaaacccaggttggcgtcggggtacaaaaggagggcgtgtttcacaccatgtggcatgtgacccggggcgcggtgctcacgtacaacgggaagcggctcgagcccaactgggccagcgtgaagaaggacctgatctcatatggcgggggctggcgcctcagcgcccagtggcagaagggagaggaggtccaggtgatcgccgttgagcccggcaagaaccccaagaacttccagacgatgccgggcaccttccagacaacgaccggagagattggcgcaatagctcttgacttcaaaccggggacctccggctctcccatcatcaaccgagagggcaaggtagtggggctgtacgggaacggagtggtcacaaagaatggcgggtacgtgagcggcatcgcccaaaccaacgcggagccggacggccccaccccagagctggaagaggagatgttcaagaagcggaacctcaccataatggatctgcaccccgggtccggcaaaacccgcaaatatctgcccgcgattgtgcgggaggccatcaagcgccggctccgcacactgattctggcaccgacccgggtagtcgcagccgagatggaggaagcactcaaagggctaccgatccgctaccagaccaccgcgaccaagtcagagcacacgggcagggagatcgtcgacctgatgtgccacgccacattcaccatgcgtctcctgtcccccgtccgcgtgccgaactacaacctgatcatcatggacgaggcgcacttcacggaccccgccagcatcgccgcgcgcgggtatatctctacccgcgtgggaatgggcgaggccgccgccatcttcatgaccgccacgccaccgggcacggcagacgctttcccacagagcaacgcccccattcaggatgaggagagggatatccctgagcggtcctggaacagcggcaacgagtggatcaccgacttcgccgggaagaccgtatggtttgtgcccagtattaaggcgggcaacgatattgccaactgtttacggaagaatgggaagaaagtgatacagttgtctcgcaaaaccttcgacacggagtaccagaagaccaaacttaacgactgggatttcgtcgttaccaccgacatctccgagatgggcgctaacttcaaggccgaccgggttatcgacccgcggcggtgcctcaagccggtcattttaacggacggccccgagcgtgtgatcctggccgggcccatgcccgtgaccgccgctagcgccgcccagcgacgcggccgggtcggtcgcaacccccagaaggagaacgaccagtatatctttaccggccagccactaaacaacgacgaggatcacgcccactggaccgaagcaaagatgctgctggacaacatcaacacccccgagggtatcatcccggccctcttcgagccggaacgggagaagtccgctgccatcgacggcgagtaccgcctgaagggcgagagccggaagactttcgtggagctgatgcgccgcggggacctcccggtctggctggcgcacaaggtcgcctcggaaggcatcaagtacaccgaccgcaagtggtgcttcgatgggcagcggaacaaccagatcctggaggagaacatggacgtggagatctggacgaaggagggtgagaaaaagaagctcagaccccgatggctggacgcccgcacctacagcgatccgctggcgctcaaggagttcaaggacttcgcggcggggcgcaagtccatcgccctggacctggtcacggagatcggcagggtgcctacccacctcgctcaccgcacaagaaatgccctggacaacctggtcatgctccacacgagcgagcatggcgggaaggcctaccggcacgcagtggaggagctacccgagacgatggaaaccctgttgctgctgggactcatgatcctgctaacagggggcgccatgctattcctgatctccggcaaggggattgggaagaccagcatcgggcttatttgcgtgatcgcctcgtccggaatgctctggatggccgaaataccgctgcagtggatcgcgagcgcgatcgtgttggagttcttcatgatggtgctgctgatccccgagccagagaagcagaggacaccacaggacaaccagctggcgtacgtcgtgatagggatcctcaccctggcagccatcatcgccgcgaacgagatgggcctactggagaccaccaagcgcgacctgggcatgtccaaggagccgggggtcgtgagccccacaagttacctggatgtggacctacatcccgcctctgcctggacgctatatgccgtagcgaccaccgtcatcacgcctatgctgcggcacaccatcgaaaattccaccgccaacgtcagcctcgccgccattgcgaaccaagcggtcgttctgatgggtctggacaaggggtggccgatatccaagatggaccttggcgtaccactcctggccctcgggtgctatagccaggtcaaccctctgacgttgacggccgccgtactcctgcttatcacacattatgccatcattggccccggactccaggcgaaggccacccgcgaggcgcagaaacggaccgcggccgggatcatgaagaacccgacggtggacggcatcatgacgatcgacctggaccccgtaatctatgactcgaagttcgagaagcagctgggacaagtgatgctcctggtgctgtgcgcggtccagctcctgctgatgcgcaccagctgggccctatgcgaggccctgacactggccacgggccctataaccaccctctgggaaggctcccccggaaaattttggaacaccacgattgcggtgagcatggccaatatctttcggggatcatacttggccggggccggcttagccttctcaatcatgaaaagcgtggggaccggcaaacgcggaaccgggagccaaggagagacccttggggagaagtggaagaagaaattgaaccagctgtctcgtaaagagttcgacctttataagaagtcaggcatcacggaagtggaccgcacggaggcgaaagaggggctgaaacggggcgagatcacccaccacgccgtgtcgcgcggatccgccaaactgcagtggttcgtggagcgcaacatggtcatcccggaggggcgcgtgatcgacctcggctgcgggaggggagggtggagctattactgcgccggactgaaaaaggtgaccgaggttcgaggctacaccaaaggagggcctgggcatgaggagcctgtccccatgtccacgtatggctggaacatcgtcaaactgatcagcgggaaggacgtcttctacctcccgcccgagaagtgcgacaccctgctgtgcgacatcggcgagtccagcccctcccccacggtggaggaaagccggaccatcagagtgcttaaaatggtcgagccgtggctcaagaacaaccagttttgcatcaaggtgctgaatccctacatgcccacggttatagagcacctggagcgcctccagaggaaacacggtggaatgttagtccgcaaccccttgagccggaactctacacacgagatgtactggatctcgaacggcagcgggaacatcgtggcatccgtgaatatggtaagcagattactgctgaaccgattcacaatgacccacagacggccgacaatcgagaaagacgttgacctcggcgcgggtacacgccacgtcaatgccgagcctgaaacccccaacatggacgtcattggggagcggatcaaacgcatcaaggaggagcacaacagcacctggcactacgacgacgagaacccctacaagacgtgggcgtatcacggcagttacgaagtgaaggcaaccgggagtgccagctccatgatcaatggcgtagtgaagctcctgaccaaaccctgggatgtggttccgatggtgactcagatggcgatgacggacaccacccccttcggacagcagcgcgtattcaaggagaaggtcgacacgaggaccccacgaagcatgcccggcacacgccgtgtgatgggtatcaccgcagagtggctctggcgcaccctcgggcggaacaaaaagccccgcctgtgcacgcgggaggagtttacgaaaaaggtacgtaccaacgcagccatgggtgcggtcttcaccgaggagaaccagtgggacagcgccaaggccgccgtggaggacgaggacttctggaagctcgttgaccgcgagcgggagctgcataagttgggaaagtgcggctcctgtgtttataacatgatgggcaagcgcgagaagaaacttggtgagttcggcaaggctaaggggagcagagcgatctggtacatgtggctgggggcgcgctacttggagttcgaggccctcgggttcctgaatgaggaccactggttctctcgggagaactcttactccggcgtcgagggggagggcctccacaagctcggatacatcctgcgcgatatcagcaagatcccaggaggggccatgtacgccgacgacactgccgggtgggatacccggatcaccgaagacgacctgcacaacgaagagaagatcacccaacagatggacccggagcaccgccagctcgccaatgctatatttaaactaacgtaccagaacaaggtggtcaaggtgcagcggcccacccccacagggactgtgatggacatcatctcccgcaaggaccagcggggcagcgggcaggtcggcacgtacggtctgaacacgtttaccaacatggaggcccagctcatccgtcagatggaaggcgagggggtcctgtccaaggccgacctggagaacccccacttgccggagaagaagatcacccagtggcttgagaccaaaggcgtcgagcggctgaagagaatggctataagcggagacgactgcgtagtgaagccaatcgacgaccggttcgccaacgccctccttgccctgaacgacatggggaaggtgcgcaaggacatcccccaatggcagccctccaagggctggcatgactggcagcaggtcccgttctgctctcaccacttccacgagctcatcatgaaggacggtcgcaagctggtggtgccctgccgcccccaggacgagttaatcggccgggcaaggatctcccagggggcaggctggtctctccgcgagacggcctgcctgggcaaagcctacgcccagatgtggtccctaatgtattttcaccgacgcgatctccgactggcgtcgaacgccatctgctccgccgtccccgtgcactgggtgccgaccagccgcaccacctggagcatccacgcccaccatcagtggatgacgacagaggacatgctaaccgtctggaaccgggtatggatagaggacaatccgtggatggaggataagacccccgtgacaacctgggaaaacgttccctatctcggcaagcgcgaggaccagtggtgtggcagcctgatcggtcttaccagtcgggcgacgtgggcgcagaacatcccgaccgccatccagcaggtccgctcgttgatcggcaatgaggagttcctggactatatgcccagcatgaagcgcttccgcaaggaggaggagtccgagggggccatctggtag

SEQ ID NO: 26057 - RNA, 9873 nt, synthetic construct
  misc_feature 1..9873: note = derived and/or modified CDS sequence (opt11) from DENV-3__FJ639792__SS-prME
  source 1..9873: mol_type = other RNA
accagcctgtgcctcatgatgatcttgcccgccgccctggccttccacctcacaagccgggatggggaaccccggatgatcgtggggaagaacgagagaggtaagtcgctgctattcaaaacagccagcgggatcaacatgtgcaccctcatagccatggacttgggcgagatgtgcgacgataccgtgacctacaagtgcccacacatcacagaggtggagcccgaggacatcgactgttggtgcaatctaacatctacctgggttacctacgggacgtgcaaccaggccggcgagcaccggcgggacaagcggtcagtcgccctcgcgccgcacgtgggtatgggtctggacacccgcacgcagacatggatgagcgcggaaggcgcgtggcgccaggtcgaaaaggtcgagacgtgggccctgcgccacccggggttcaccatcctcgcattgttcctggcccactacataggaacttccctaacccagaaggtggtaatcttcatcctcctgatgctagtcaccccgagcatgactatgcggtgtgtgggggtggggaaccgcgacttcgtcgaaggcctgtccggggcaacctgggtggacgtggtcctggagcacggcgggtgcgtgacgacgatggcaaaaaacaaacccaccctcgacatcgagctgcagaagaccgaggcgactcagctggctacgctgcggaagttatgcatcgagggtaagataactaacatcacgacagacagtcgctgccccacgcagggcgaggccgtgctgcctgaggagcaagaccagaactacgtttgcaagcacacctacgtggaccgggggtgggggaacgggtgcggtctctttgggaagggctcgttggtgacctgcgccaagttccagtgcctggaacccatcgagggcaaggtcgtgcaatacgagaacctcaaatacaccgtgattatcacggtgcataccggggatcagcatcaggtgggcaacgaaacccagggggtcaccgccgagatcacgccgcaagcctccaccaccgaggctatcctgcccgaatacggcacgctgggtctcgaatgttccccgcgcactggactggacttcaacgagatgatcctgctcaccatgaagaacaaggcctggatggtgcacagacagtggttcttcgatctgcccctgccctggaccagtggcgccaccaccgaaacccccacatggaaccgcaaggagctcctggtgaccttcaagaacgcccacgcgaagaaacaggaggttgtggtcctgggttcccaggagggggcgatgcacaccgccctcaccggggccaccgagatccagaactcaggcgggacctccatcttcgccggccacttaaagtgccgcctgaaaatggacaagctcgagctgaagggtatgagctatgccatgtgcacgaacacgttcgttctgaagaaagaggtgtccgagactcagcacgggactatcctcatcaaggtcgagtacaagggcgaggacgtaccctgcaagataccttttagcaccgaggacgggcaggggaaggcgcacaacggacgattaatcacggccaaccccgttgtgacgaagaaagaggagccggtaaacatcgaggccgagccgccattcggtgagtcgaatatagtgataggcatcggggacaacgccctgaagataaactggtacaagaagggctccagcatcgggaaaatgttcgaagcgaccgcccggggcgcccgccggatggctatcctgggtgacaccgcctgggacttcgggtccgtcggcggggtccttaacagtctgggcaagatggtgcatcagatcttcggttccgcgtatactgccctgttttctggcgtgtcctgggtaatgaagatcggaatcggggtgctcctcacctggatcgggctgaacagtaagaacacttccatgagcttctcttgcatcgccatcgggatcataaccctctacctgggcgccgtggtccaggccgacatggggtgcgtaatcaactggaaggggaaggagctcaagtgcggtagcggaatcttcgtgacgaatgaggtccacacatggacagaacaatacaagttccaggcggacagtcccaagcgcctcgccaccgccatcgccggtgcctgggaaaacggggtgtgcgggatccgcagcacgacccggatggagaacctgctgtggaagcagatcgccaacgagctcaactatatcctgtgggagaacaacatcaagctgaccgtggttgtgggggacatcatcggagtcctcgagcaggggaagcgcaccttaacaccccagccaatggagctgaaatactcatggaaaacctgggggaaagccaagattgtcaccgccgagacacaaaattctagttttatcattgacggccccaacacgcccgaatgcccctccgcctcccgggcgtggaacgtgtgggaagtggaggactatgggtttggcgtcttcaccaccaacatctggctaaagttacgagaggtgtacacccagttgtgtgaccaccggctcatgagcgccgcggtgaaggacgagcgtgcggtccacgccgacatgggctactggatcgagagccagaaaaacgggtcctggaagctggagaaggcgagcttaatcgaggtcaaaacgtgcacgtggccgaaatcccacaccctctggagcaacggcgtgttagagagtgacatgattatccccaagagcctggccggacccatctcccaacataactaccggccgggctatcacacccagaccgccggtccctggcacctcggcaaactggagctggattttaattactgcgagggcaccaccgtcgtcatcaccgagaactgtgggacacgcggcccaagcctacggacgaccaccgtgtccggcaagttgatccacgagtggtgctgccgctcatgcaccctgcccccactccggtacatgggcgaggacggatgctggtacggtatggagattaggcctatttccgagaaagaggagaacatggtcaaaagcctggtttccgccggcagcggggaggtggacaacttcacgatgggcgttctgtgcctcgccatcctcttcgaggaggtcatgagagggaagttcggcaagaaacacatgatcgcgggtgtcttcttcaccttcgttctgctcctgtctggccaaataacatggcgcgacatggctcacaccctgataatgatcggatccaatgcatcagaccgtatggggatgggcgtgacctacctcgctctgatcgccaccttcaagatccaacccttcctggctctcggattctttctgcggaagctgacctcccgtgaaaaccttctactgggcgtcggcctcgccatggccacgactctgcagctgcccgaagatatcgagcagatggccaacgggatcgcgttaggcctgatggcactgaagctcatcacccaattcgagacctaccagctttggaccgccctgatcagcctcacgtgctctaacaccatcttcaccctcaccgtagcctggcgcacggccaccctgatcttagcgggggtgagcctgctgccggtctgccagagtagcagtatgcggaaaacagactggctccccatgaccgtggccgccatgggcgttccgccactccctctgttcatcttctcactcaaggacactctgaagagacgctcctggcccttgaacgagggtgtcatggccgtgggcctcgtttctatactggcctccagcctgctgcggaacgacgtacccatggctggcccgcttgtggccgggggccttctcatagcttgctacgtgatcacaggtaccagtgccgacttgaccgtggaaaaggccgcggacgtgacttgggaagaggaggccgagcagacaggcgtgtcgcacaacctgatgatcacggtcgatgatgatgggactatgcgcataaaggacgacgagacggaaaacatcctcacggtgctgctgaaaaccgccctcctaatcgtgtccggcatcttcccgtattcgatacccgccactctgctcgtctggcacacctggcagaagcagacgcagagatccggcgtgctgtgggacgtgccgtcgccgcccgagacccagaaggccgaactggaagagggcgtttaccgaataaaacagcagggcatcttcggtaagacccaggtgggcgtgggggtgcagaaggagggtgtgttccacaccatgtggcacgtgacacgtggagcggtcctcacccacaacgggaagcgcctggagcccaactgggcctctgtgaagcgagaccttattagctacggcgggggctggcgcctctcggcccagtggcaaaagggggaggaagtgcaggttatcgccgtggagcccggcaagaaccccaagaacttccagactatgcccggtaccttccagacgactaccggcgaaattggcgcaatagccctggacttcaagcccgggacgagtggctctcccatcatcaacagggagggcaaagtggtaggtctttacggcaacggggtggtgacgaagaacgggggatacgtatccggcatcgctcaaaccaacgccgagccggacggccctaccccggagctggaggaggagatgtttaaaaaacgcaatcttaccatcatggatctgcaccccgggtcaggcaaaacgcggaaatatctgccggccatcgtgcgcgaggcgatcaagcggcgcctccggaccctgatcctggcccctacccgcgtggtcgccgcggagatggaggaggccctgaaagggctgcccatccggtaccaaaccacggcgaccaaatccgagcataccggccgcgagatcgtggacctgatgtgccacgccaccttcacgatgcggctcctgagccccgtgcgagtgccgaactacaacctgataatcatggatgaggcccacttcaccgatcccgcctccatcgccgccaggggttacatcagcacccgcgtgggcatgggcgaagctgctgctatcttcatgaccgcgacaccgcccgggaccgcagacgctttcccgcagtccaatgcccccatccaggatgaggagagggacattcccgagcggagctggaattccggcaacgagtggatcactgacttcgctgggaagacagtgtggttcgtacccagcatcaaggcaggcaacgatatagccaactgtctgcgcaagaacgggaagaaggtgatacagctgtcccggaagacgttcgatactgagtaccagaagaccaagctgaacgactgggattttgtggtcaccaccgacatctcagagatgggcgctaacttcaaggccgaccgggttatcgacccgcggcgctgcctgaagcctgtgatcctgaccgacggcccagagcgggttatcctagcggggcccatgccggtgaccgcggcgtcagcagcccagcgccgagggagggtggggcggaaccctcagaaggagaacgatcagtatatcttcaccggccagccattgaacaacgacgaggaccacgcccattggaccgaggcgaagatgctgctggacaacattaacacgcccgaggggatcatcccggctctgtttgagcccgagcgcgagaagtccgccgccatcgatggcgaataccggctgaagggcgagtcgagaaagacgtttgtcgagctgatgcggcgcggagatctccccgtatggctggcatacaaggtcgcctctgagggcatcaaatacaccgaccggaaatggtgcttcgacgggcagcgcaacaaccaaatcctggaggaaaacatggacgtggagatttggaccaaggagggcgagaagaagaagctcaggccacgctggctggatgctagaacgtactccgaccctctggcgttgaaggagtttaaggacttcgccgcgggtcgcaagagcatcgcgctggacctggtgaccgagatcgggcgcgtccccactcacctcgcccaccggaccaggaacgcgctggacaatctcgtgatgctccacacgtccgagcacggcgggaaggcatatcggcacgcagtggaggagctgcccgagaccatggagaccctgctcctgttagggctcatgattcttctcactgggggcgccatgctgttcttaatctcagggaaggggattggtaagacgagcatcggtttgatctgtgtgatcgcctccagtgggatgctctggatggccgagatcccgctgcagtggatcgcctctgcaattgtgctggagttctttatgatggtactcctgatccccgagcccgagaagcagaggactccccaggacaaccagctggcgtacgtcgtcatcgggatactcactctggccgccattatcgctgcaaacgagatgggcctgcttgaaaccacgaaacgggacctgggcatgagcaaggaaccaggcgtggtctcccctacgagctatctggacgtggacctccaccccgcctccgcctggacactatacgccgtcgcgaccacagtcatcacccccatgttgcgccacaccatcgaaaatagcaccgccaacgtgtctctcgccgcgatcgccaaccaagcggtggtcctgatgggattagacaaggggtggccgatcagcaagatggacctcggcgtgcccctgctggctctcggctgctactctcaggtgaaccccctgacgctgaccgccgccgtactcctgctgattacccactacgccatcataggccccggcctgcaggcgaaggccacccgggaagcccagaagcggacggctgccgggatcatgaagaacccgaccgtggacggcattatgacaatcgacttggaccccgtaatctacgacagtaagttcgaaaagcaactggggcaggtgatgctcctagtgctgtgcgcggtgcaactcttgctgatgcggacctcctgggccctttgcgaggccctgacgctggcgaccggacccatcacgaccctctgggagggcagccccgggaaattttggaacacgaccatcgcggtcagcatggccaacatcttccgcggcagctaccttgccggcgccggccttgccttctccatcatgaagagtgtgggcaccggcaaaaggggcaccggatcccagggcgagactctcggggagaagtggaagaagaagctgaaccagctgagccgcaaggaattcgacctatacaagaagtcgggcatcacggaggtggaccggacagaagcgaaggaggggttgaagcgcggcgagatcacccaccacgccgtcagtcggggcagcgccaagctgcaatggttcgtagaacgcaacatggttataccggagggccgggtcatagacctgggctgcgggcgcggcgggtggagttactactgcgccggcttaaagaaagtgactgaggtgcggggatacacgaaaggcgggcccgggcacgaggagcccgtccctatgagcacctacggttggaacatagtgaagctgatgtctgggaaggacgtgttctacctcccgcccgagaagtgcgacaccctgctgtgcgacataggtgagagctccccgagccccactgtcgaggagtcccgcaccatccgcgtgctgaagatggtggagccttggctcaagaacaaccagttctgcatcaaggtcctgaacccctacatgcccacggtaattgagcacctggagcggctccaaagaaaacatggtgggatgctggtgcggaaccccctgtcacgaaactccacgcacgaaatgtactggattagcaatggaaccgggaacatcgtcgcctccgtgaacatggtgtcccggctcctgctgaaccgctttacgatgacgcaccggagaccgacaatcgagaaggacgtagatcttggagcggggacccgtcacgtgaacgcagagcccgagacgcctaacatggacgtgatcggggaacgcattaagcggatcaaggaggaacataactccacctggcactacgacgatgagaacccctacaagacttgggcctaccacggcagctacgaggtcaaggccacagggtcggccagctccatgatcaacggcgtggtcaagttactgacgaagccctgggacgtcgtacccatggtcactcaaatggcgatgaccgacaccacgcctttcgggcagcaacgcgtgtttaaggaaaaggtggatacccggaccccccgcagcatgcccggcaccaggcgcgtcatgggaatcacggctgagtggctctggcggaccttgggacgcaacaagaaaccgcggctgtgcacccgcgaggagttcaccaaaaaggtgagaactaacgccgccatgggcgcggtgttcaccgaggaaaatcaatgggacagcgccaaggccgccgtcgaggacgaagacttctggaagctcgtggaccgagagcgcgagctacacaaactgggaaagtgcggctcatgcgtgtataacatgatgggtaagagagagaagaagctcggcgagttcggcaaagccaaggggtcaagagcgatctggtacatgtggctgggtgcccggtacctggagttcgaggccctcgggttcctgaatgaggaccactggttctcccgcgagaattcttactcaggagtcgaaggggagggcctgcacaagctcggctatatcctgcgggacatctcgaagatacctggcggtgcaatgtacgctgatgacaccgcggggtgggatacccgcataacggaagacgaccttcacaacgaggagaagatcacccaacagatggatcccgagcatcggcagctcgcgaacgccatcttcaagcttacctaccagaacaaggtggtgaaagtccagcgcccgacccccaccggcacggtgatggacatcatctcccgaaaggaccagcgcggctccggccaggtgggtacctacggcctgaacacctttacaaacatggaagcccagctcattcgccaaatggaaggggaaggcgttttgagtaaggccgacctggagaatccccaccttccggagaagaagatcacgcagtggctggaaacaaaaggcgtggaacgcctgaagcggatggcgatcagtggagacgactgcgtggtcaaacccatcgacgataggttcgccaatgccttgttggccctgaatgatatggggaaggtgcggaaggacatcccacagtggcagccgagcaagggctggcacgactggcaacaggtcccattctgtagtcaccacttccacgagttgatcatgaaggatgggcgcaaactggtcgtcccctgtcgcccccaggacgagctgatcggcagagcccggatctcccagggagcgggctggtcgctccgcgagaccgcctgcttaggcaaggcctacgcgcagatgtggtccttgatgtacttccacaggagggaccttagactggcgtcaaacgccatctgctccgccgtacctgtccactgggtgccgaccagccggacgacctggtccatccacgcacaccaccagtggatgaccaccgaggacatgctaaccgtgtggaacagagtctggatcgaggacaacccctggatggaggacaagacccccgtcacgacctgggagaacgtaccctacctcgggaaacgagaggatcagtggtgcggcagcctgatcggcttaacgtcgcgcgccacctgggcgcagaacattccaaccgccatccagcaagtccggtcgctcatcggcaatgaggagttcttggactatatgcccagcatgaagcgcttccggaaggaggaggaatccgagggggccatatggtga

SEQ ID NO: 26058 - RNA, 9873 nt, synthetic construct
  misc_feature 1..9873: note = derived and/or modified CDS sequence (opt11) from DENV-3__FJ639793__SS-prME
  source 1..9873: mol_type = other RNA
acctccctatgcctcatgatgattttacccgcgaccctcgctttccacctcaccagccgtgacggcgagcctcggatgatcgtggggaagaacgagcggggcaagagcctgctgttcaagaccgcgagcgggatcaacatgtgcacactcatcgccatggacctgggggagatgtgcgacgacaccgtgacctacaagtgcccccatatcaccgaggtggagcccgaagacatcgactgttggtgcaatctgaccagcacgtgggtgacctacggtacctgtaaccaggccggggagcaccggcgcgacaagcgcagcgtcgctttggcgcctcacgtgggcatggggctagacactcgcacccaaacatggatgtcggcggagggcgcctggcgacaggtagagaaggtcgagacttgggccctccgccacccggggttcaccatcctcgccctgttcctggcgcattacatcggcacctccctaacgcagaaggtggtgattttcatccttctgatgctcgtaacccccagcatgaccatgcgttgcgtgggggtgggcaaccgcgacttcgtggagggcctgtccggcgccacctgggtggacgttgtccttgagcacggcggttgcgtgacgaccatggccaaaaacaagcccacgctcgatatcgagctgcagaagacagaagccacgcaactggccacactccgcaagctgtgcatcgagggtaaaatcacaaacataaccacggacagccgctgccccacacagggcgaggcggtgctgccggaggagcaggaccagaactacgtctgcaagcacacgtacgtagaccggggctggggcaacgggtgcggtctcttcgggaagggctccttggtgacctgcgcaaagtttcagtgtctggagcccatcgaaggcaaggtggtgcagtacgagaacctgaagtatacggtgatcatcaccgtacacaccggggaccagcaccaggtgggcaacgaaacccagggggtaacggcggagatcacgccccaggccagcaccaccgaggccatactgcccgagtacggcaccctggggcttgagtgctccccgaggacgggcctggacttcaacgagatgatactgctcaccatgaagaacaaggcgtggatggtccaccggcagtggtttttcgacctgcccttgccctggaccagcggcgccaccacggagaccccgacatggaatcgcaaggagctcttggtaaccttcaagaacgcccacgccaaaaagcaggaagtcgtggtgctgggatcccaggagggtgccatgcacacggcgctgaccggcgccaccgagatccagaacagcggcgggacctccatcttcgcgggtcatttgaagtgccggctgaaaatggacaagctcgaactcaagggcatgagctacgccatgtgcacgaacaccttcgtcttaaagaaggaggtgtccgagactcagcacgggacaatcctcatcaaggtggaatacaagggcgaggatgtcccgtgcaaaatccccttcagcacggaagacggccagggcaaggcccataatggtcgcctaatcaccgcgaaccccgtggtgaccaagaaagaggagcccgtcaatatcgaagccgagccgcccttcggggagtcgaacatcgtcatcggcatcggggacaatgccctgaagatcaactggtacaaaaagggttcaagcatcggaaagatgttcgaggcaaccgcgcggggcgctcgtcggatggccatcctcggcgatacggcctgggacttcgggtctgtgggcggggtactcaacagccttgggaagatggtgcaccaaatcttcgggtcggcctacaccgcgctgttcagcggcgtttcctgggtaatgaagattggtatcggggtgttgctcacctggatcggcctcaacagcaagaacacatccatgtcattctcctgcatagccatcgggatcatcacgctttacctgggagccgtagtccaggcagacatggggtgtgtgatcaactggaagggcaaggagctgaagtgcggcagcgggatcttcgtgaccaacgaggtccacacttggaccgagcaatacaagttccaggccgactcccccaagcgccttgcaacggcgatagcgggcgcctgggagaacggggtgtgcggcatccgaagcaccacccggatggagaaccttctgtggaagcagatcgccaacgagctcaactacatcctctgggagaacaacattaagctgaccgttgttgtgggggacatcatcggcgtgctcgagcagggcaagcgcacactgacgccacagccgatggagctgaaatactcctggaagacctgggggaaggcgaagatcgtcaccgccgagacgcagaatagctccttcatcatcgacggcccgaacacacccgagtgccccagcgcctcccgggcctggaacgtttgggaggtggaggactacgggttcggcgtcttcaccaccaacatctggctcaaacttagggaggtgtacacccagctgtgcgaccaccggctcatgagcgctgcagtgaaggacgagcgcgccgtccacgcggacatgggctactggatcgagtcgcagaagaatgggtcatggaagttagagaaggcgagcctgatagaggtcaaaacgtgtacctggcctaagtcgcacacactctggagcaatggagtgctggagtccgacatgatcatccccaagagcctggcaggacccatctcccaacacaactaccggccgggctaccacacccagactgccgggccgtggcacctgggcaagctggaactggactttaactactgcgaggggactaccgtcgtgattaccgaaaactgcgggacgcgcggcccctcgctccggaccaccaccgtgtccggaaagctgatccatgagtggtgctgccgcagctgcacgctgcccccgctccggtacatgggcgaggatgggtgctggtacggcatggagatccgccccacctctgagaaggaggagaacatggtcaagagcctggtgagcgccggcagcggggaagttgacaacttcaccatgggcgtcctttgcctcgcaatcctgttcgaggaggtgatgcggggcaagttcggcaagaaacatatgatcgctggagtgtttttcaccttcgtgcttctcctgtccggccagatcacgtggcgcgatatggcgcacaccctgatcatgatcggctctaacgcctccgataggatggggatgggcgtgacctacctggcactcatcgccacgtttaagatccagccctttctggccttggggttcttcctgcgtaaactgacttcccgggagaacctcctactgggcgtgggcctcgctatggcaaccacactgcagctgcccgaggacatcgagcagatggccaacgggatcgccctcggcttgatggcgctgaagctcataacccaattcgagacgtaccagctgtggaccgccctgatcagcttaacctgcagcaacaccatctttacgctaaccgtcgcttggaggaccgcgaccctgatcctcgccggggtgagtctattgccggtctgccagtccagcagcatgcggaagacggactggctccccatgacggtggctgccatgggggtgccgcccctccctctattcatcttctctctcaaggatacgctgaagcgccgctcatggcccctgaatgagggggtcatggctgtggggctcgtgagcatcctggcctccagcctgctgcggaacgacgtccccatggccggtccccttgtggccggcgggctgctcatcgcgtgctacgtgatcaccgggacgtccgccgacctgaccgtcgagaaagccgccgacgtgacctgggaagaggaggcggagcaaaccggggtgagccacaacctgatgatcaccgtcgacgatgacgggacgatgcgcatcaaggacgacgagacagaaaacattctcaccgtactgctgaagaccgccctcctgatagtatccggcatcttcccatacagcatccccgcgaccctcctagtttggcacacctggcagaagcagacgcagcggtctggggtgttgtgggacgtgccaagtccacccgagacccagaaggccgagctggaggagggcgtctaccgcatcaagcagcagggtatcttcgggaagacccaggtgggcgtgggggtacagaaggagggtgtgttccacaccatgtggcacgtgacacggggcgcggttctcacctataacggtaaacgcctggagccgaactgggcgtccgttaagaaggacctgatctcttacggagggggctggcggttgtccgcccaatggcagaagggggaggaggtgcaggtcattgccgttgaacccggcaagaaccccaagaacttccagacgatgcccggcaccttccagaccaccacgggggagatcggggccatcgccctggacttcaagcctggtacgagcggcagcccgatcatcaaccgcgagggcaagatcgtggggctttacgggaacggggtagtgaccaagaacggagggtacgtgtccggcatcgcccagaccaacgcggaaccggatggcccaacgcccgagctggaggaggagatgttcaagaagcgcaatctgaccatcatggatctgcaccccgggagcggtaagacccgcaagtacctccctgccatcgtccgggaggccatcaagcgcaggctccgcaccctgatcctggcgccgacaagagtggtggccgccgaaatggaggaggccctcaaggggctgcccattcgctaccaaaccaccgccaccaagagtgaacacacgggacgggagatcgtcgacctgatgtgccacgcgacgttcaccatgcgcctcctgagccccgtgagagtgcctaactacaacctgatcatcatggacgaggcccacttcaccgaccccgcctccatcgccgccagagggtacatctcaacacgggtcgggatgggcgaggcggccgccatctttatgaccgctacaccgcccgggaccgcggacgccttcccgcagtctaatgcgcccatccaggacgaggagcgcgacatccccgagaggagctggaacagtggaaacgagtggatcactgacttcgccggaaagaccgtgtggttcgtgccctcaatcaaggcgggcaatgacatagcgaactgcctccggaagaacggaaagaaggtcatccagttatctcgcaagaccttcgacaccgagtaccagaagacgaagctcaacgactgggacttcgtggtgaccaccgatatcagcgagatgggcgccaactttaaggccgacagggtcatagacccgcggcggtgcctcaagcccgtgatcctgacggacggtcccgagcgcgtgatcctggcggggcccatgccagtcacagcagcgtcagcggcccaacggaggggacgggtggggcgtaacccccagaaggagaacgaccagtacatattcacgggccagcccctcaacaacgacgaggaccacgcccactggacggaggccaagatgttgctggacaacatcaatacccctgaggggatcattccggccctcttcgaacccgaacgcgagaagtccgcggccatcgacggcgagtaccgcctgaaaggagagtcccggaagaccttcgtagagctcatgcgccgtggcgacctccccgtctggctggcccacaaagtggcgtctgagggcataaagtatacggaccgcaagtggtgctttgacgggcagcggaacaaccagatcctggaggagaacatggacgtcgagatatggaccaaggagggcgagaagaagaagctccgcccccggtggctggacgctcgcacttactccgaccccctggctctcaaagagttcaaggacttcgctgccggccgcaaaagcatcgctctggacctggtgaccgagatcgggcgtgtgcccacgcacctcgcccatcgcacccggaatgccctggacaacctggtcatgctccacaccagcgagcatggcgggaaagcctaccgccacgccgttgaggagctgcccgagaccatggagacgctgttactgctgggcttgatgatcctgcttaccgggggcgcgatgttgttcctaatcagcggcaaggggatcggcaagaccagtatcggactgatctgcgttatcgccagcagcggcatgctgtggatggccgaaatcccgctgcagtggatcgccagtgccatcgtcctggagtttttcatgatggtgctcctgatccccgagcccgagaagcagagaacgccccaagataatcagctggcgtacgttgtcatcggtatcctcacgttggctgccataattgcagccaacgagatgggcctcttagagaccactaagcgtgacctgggcatgagcaaggagccgggagtggtgtcccccaccagctacctggacgtagacctccaccccgcttccgcctggacgctgtacgcggttgccaccaccgtgatcaccccaatgctgcggcatacgatcgaaaacagcacggctaacgtcagcctcgccgcaatcgccaaccaggccgttgtactgatgggcctcgacaaggggtggccgatcagcaagatggacctgggcgtccccctactggcgcttggatgctactcccaggtgaaccccctgaccctgaccgccgccgtgctcctgctgattacgcactacgccatcatcggccccggcctccaggccaaggcgacacgcgaggcacaaaagcgaacggcagccgggataatgaagaaccccacagtagacggcattatgacgattgacctggaccccgtgatctatgacagcaagttcgagaagcaactgggccaagttatgctcctggtcctgtgcgccgtgcagttactgctgatgcgcacgtcctgggccctctgcgaggccctgactctggctaccgggcccataacgacgctctgggagggctcccccgggaagttctggaacaccaccattgcagtgagtatggctaacatctttaggggcagttacctggccggggctggcctcgccttctcagtgatgaagtccgtggggaccggcaagcgcggcacggggtctcagggcgagactttgggggaaaagtggaagaaaaagttgaaccagctgagtagaaaagagttcgacctctacaagaagtccggcatcacagaggtggaccgcaccgaggccaaggagggtctaaagcgcggcgagatcactcaccacgcggtctcccgaggcagcgccaagctgcagtggttcgtggagcggaatatggtgatcccggaggggcgcgtaatcgacctgggctgcggacggggcgggtggtcctactattgtgccggcctgaaaaaggtgaccgaagtccgcggctacaccaagggcgggcccgggcacgaggagcccgtccccatgtcaacctacggctggaacatcgtgaagctgatgtccgggaaggacgtgttttatcttccgcccgagaaatgtgacacgctgctttgcgacatcggcgagagctcccccagccccaccgtcgaggagtcccggaccatccgcgtgttaaagatggtggaaccgtggttgaagaacaaccagttctgcattaaggtcctgaacccctacatgcccacggtgatcgaacacctggagcgcctccaacggaaacacggagggatgctcgtgcgcaaccccttaagcagaaactccacacatgaaatgtactggattagcaacggtaccgggaacatcgtcgcgtctgtgaatatggtgagccgcctcctgctgaacaggttcactatgacacaccgccggccgacgatcgagaaggacgtggacctgggcgccggcacccgccacgtgaacgcggagcccgagacccctaatatggatgtgatcggggagcggatcaagagaatcaaggaggagcataactccacctggcactatgacgacgagaacccatacaagacatgggcctaccacggcagctacgaggtcaaggccactgggtccgcctcgtccatgatcaacggcgtggtgaagctcctgaccaagccctgggacgtggtgcccatggtcacacagatggccatgacggacaccacccccttcgggcagcaacgtgtgttcaaggagaaggtggacacacgtacgccgcggagcatgccgggcacccgccgggtcatgggcatcaccgcggagtggttatggcgcaccctgggccggaacaagaaaccaagactgtgcacgcgggaggagttcaccaaaaaggtgcgcaccaacgccgcaatgggcgccgttttcaccgaggagaaccagtgggatagcgctaaggccgcggtggaggatgaggacttctggaagctcgtagatcgcgagcgggaattgcacaagctcggtaagtgcggctcttgtgtgtacaacatgatggggaagcgcgagaagaagctcggcgagttcggcaaagccaaagggagccgggccatctggtacatgtggttaggtgcgcgatacctggagttcgaagccttgggttttctaaacgaggatcactggttctcccgggagaacagctactccggcgtcgagggggaggggctgcacaagttgggctatatcctgcgcgacatcagcaagatcccaggtggagcaatgtacgccgacgacacggccgggtgggacacccgaataaccgaggacgacctgcataacgaggagaagatcacccagcaaatggaccctgagcaccgccagctcgcgaacgccatttttaaactgacctaccagaacaaggtggtgaaagtccagcgccccacgcccaccggcaccgttatggacatcatcagccgcaaggaccagcggggaagcggacaggtgggcacatacgggctaaatacgttcaccaacatggaggctcagttaatccgccagatggagggcgagggggtactgtccaaggcagacttagagaaccctcacctcccggagaaaaagatcacccagtggctcgagaccaagggcgtggagcggctgaagagaatggccattagcggcgacgactgcgtggtcaagcccatagacgaccggttcgctaacgccctcttggccttaaacgacatggggaaagtccgcaaggacatcccccagtggcagccctccaagggctggcacgactggcagcaggtcccgttctgcagccatcatttccatgagttgatcatgaaggacgggagaaagctggtcgtaccatgcaggccccaggacgagctgataggccgggcccgcatctcgcaaggtgccggctggtcgctgagagagacggcgtgcttgggcaaggcctacgcccagatgtggtcccttatgtacttccaccgccgcgacctccggctggccagcaacgcgatctgctcagccgttcccgtccattgggtgccgaccagccgcaccacctggtccatccacgcccaccatcagtggatgacgacagaagacatgctgaccgtgtggaatcgggtctggatcgaggacaacccgtggatggaagacaagacccccgtaacgacttgggagaacgtcccctatctcggaaagcgcgaggaccagtggtgcggcagcctgataggcttaaccagccgggccacctgggcccagaacatcccgacggcgatccagcaagtccgctccctcatcggcaacgaagagttcctggattacatgcccagtatgaaaagatttcgcaaagaggaagagtccgagggggcaatctggtga

SEQ ID NO: 26059 - RNA, 9873 nt, synthetic construct
  misc_feature 1..9873: note = derived and/or modified CDS sequence (opt11) from DENV-3__FJ639795__SS-prME
  source 1..9873: mol_type = other RNA
actagcttatgccttatgatgattctaccagctgcgttagcctttcacctgacgtcacgggatggggaaccacgaatgattgttggtaaaaacgaaagagggaaaagcctactgttcaaaaccgcttccgggataaatatgtgcacattaatagcgatggacctgggtgaaatgtgcgacgatactgtaacatacaaatgcccacacattacagaagtcgaacctgaagatattgattgctggtgcaatttgacgagcacatgggtaacctacggaacctgcaaccaagcaggcgaacatagacgagacaaacggtcagtagccctagcccctcacgtgggaatgggcctcgacactcgcacccagacgtggatgtcggcagaaggggcctggcggcaagtggaaaaagtggaaacgtgggcgctgcggcatccaggatttacaatactggccttattcctggctcactacatcggaaccagcttgacacagaaagttgtgatatttatcctcctcatgctcgtaaccccatcgatgacgatgagatgcgtaggcgttggaaaccgggatttcgtcgagggactaagcggcgcaacatgggtggatgtagtattagaacacggcggttgcgtaactaccatggccaaaaataaacccaccctggacatagaacttcagaaaacagaagcaacgcagctcgccactctacgcaaactctgtattgaaggaaaaataaccaatataacaacggattccagatgtccaacacaaggcgaagccgttctccccgaggaacaggatcagaattacgtctgcaaacacacgtacgtagaccgcggatggggcaacggatgcggcctgttcggtaaaggcagcctggttacttgtgcaaaattccaatgtctcgagccaatagagggcaaagtagttcaatacgagaatttgaaatacaccgtaatcataaccgtccacacaggcgaccaacaccaagtcggtaacgaaactcaaggcgtaaccgctgaaataacccctcaggcttcaaccacggaggcaatcttacccgaatacggcacactaggcctcgaatgctcccctaggacagggctggacttcaacgaaatgatactcctgacgatgaaaaacaaggcttggatggtgcaccgccaatggtttttcgaccttccgctaccctggacgtcaggcgccaccacagaaacaccgacctggaaccgaaaagaactactggtcacatttaaaaacgcccatgcgaagaaacaggaggtagtagtgcttggaagccaagaaggggcaatgcacacagcactaacaggggcaacagagatacagaactcgggcggaacctcaatctttgccgggcacctaaaatgtcgactcaagatggacaaattggaactgaagggaatgagttacgccatgtgtacaaacacgtttgttctcaagaaggaggtaagcgaaacccagcacggtaccatactcatcaaagtggaatacaaaggggaagacgtaccctgtaaaattccgttctccacagaagacggacaagggaaggcacacaacggaaggctaatcacggccaacccagtagtaaccaagaaagaagaaccagtcaacatcgaggcagagcctcctttcggagaatcaaacatagtcatcggcattggcgataacgccctcaaaattaactggtataagaaaggcagctcgataggcaaaatgtttgaggcgacggctagaggagcacgtaggatggccatcttaggcgacaccgcgtgggactttggctcagtaggtggggtgctgaactcactcggtaagatggtccatcaaatcttcggttctgcctacacggctctatttagcggggtgtcatgggtgatgaagatcggcataggcgttctacttacatggatagggttaaattccaagaatactagcatgagcttcagctgcatagccatcggaataataacgttatatctaggagcagtggtacaagccgatatgggttgtgtaatcaactggaaaggcaaagaactcaagtgcggaagcggaatattcgtcacaaacgaggtccatacatggacggagcaatacaagttccaggcggactcccctaaacgcctcgcaaccgcaatagcaggagcttgggaaaacggcgtgtgcggaatacggtcaacgaccagaatggaaaacctgctatggaaacaaatagcaaacgagctcaactacatactatgggagaacaacataaagctcactgtcgtagtgggagataccataggagtactagagcagggcaaacgcacgttgacgccacagccaatggaactcaaatactcttggaaaacgtggggtaaggcgaaaatcgtcacagcggagacacaaaacagctcctttataatagacggccctaacacacctgagtgcccctccgcatcccgcgcatggaacgtatgggaagtagaggactacggcttcggagtcttcacaacgaacatttggctgaagctccgagaggtctacactcaactctgtgatcaccggctaatgagcgccgccgttaaggacgagagagccgttcacgcagatatgggctattggatagaatcccaaaagaatggatcatggaagctcgaaaaagcctccctaattgaggtgaaaacgtgcacctggcccaagagccacacactatggtcaaacggcgtgttagaatcggatatgattatacccaaatccctcgcgggccccatctcgcaacacaactatagaccggggtaccacacacaaacagccggaccgtggcacctaggcaaactggagctcgactttaactactgcgaagggacgactgtggtaatcacagaaaattgtgggacgagaggccccagcctacgaaccactactgtctcgggaaagttaatccacgaatggtgctgtagatcgtgcacactaccaccgctacggtacatgggcgaggacggctgctggtacggcatggaaatccggcccatctccgagaaagaagagaatatggttaaatcgcttgtaagcgcaggctcaggcgaagtggacaattttaccatgggggtactctgcttggcgatcctgttcgaagaagttatgcgaggcaagttcggaaagaaacatatgatagcaggggtcttcttcaccttcgtactattactgagtgggcaaatcacctggcgagacatggcgcacacgctaataatgatagggtccaatgctagcgataggatgggcatggggataacgtacctagcactaatcgccacgttcaagattcaaccattcctagcgttgggattctttctgcgcaaactgaccagccgggaaaaccttctactcggagtggggctggcaatggccactaccctccaattgcccgaagacatagaacaaatggcaaacggaatcgcgttaggcctcatggcactaaaattaataactcaatttgaaacataccagctctggaccgccctgatcagcttaacatgctccaacaccatatttactcttacagtcgcgtggcggacggcaacgttaatcctcgcgggcgtatctctactacctgtatgccagtcctcgtctatgcgaaagaccgactggttaccaatgacagtcgcagcgatgggagtcccaccgttacctctgttcatattctcgttgaaagacactctaaaacggaggagctggccgcttaacgaaggagtgatggctgtgggtctagtcagcatactagcttcatcgctactacgaaatgacgtgcctatggctggacccctggtagccggcggcctattgatcgcatgttacgtcatcacaggaaccagcgcggacctgaccgtagaaaaagccgcagacgtgacatgggaggaagaggccgagcaaaccggcgttagtcataacctaatgatcacggttgatgatgacggaaccatgcgaatcaaggatgatgagacggagaacatccttaccgtactactcaaaacggctctactaatcgtgtcaggaatatttccatacagcatacccgcaaccctactggtgtggcacacatggcagaaacagacgcaacgctccggagtcctgtgggacgtcccatccccgcccgagacacaaaaggccgaacttgaagagggagtgtaccgcatcaaacaacagggaatattcggcaaaacccaagtaggagtgggtgtacaaaaagagggagtcttccacacaatgtggcatgtgacacggggagctgtactcacatataacggaaaacgactcgagccgaattgggcatcagtcaagaaagatttaatatcgtacggcgggggctggaggctgtcagcgcaatggcaaaagggagaagaggtacaggtcatagccgtagaacccggcaagaaccccaagaacttccaaacgatgcctggtacctttcaaacaacaaccggcgagataggagcaatagcactggatttcaagccgggaacaagcggatcccccataataaacagagagggaaaggtcgtaggtctatacggcaatggagtagttacgaaaaacggagggtacgtgagcggcatagcacagacaaacgcagaaccggatggccctactccggagctggaagaagaaatgttcaagaaaagaaatctaaccataatggacctacacccgggatcgggcaagacacggaagtacttaccggccatcgttagagaagcgataaagcgcaggctgaggacgttaattctagccccaacacgggtcgtagcggcagagatggaagaggcattgaaaggactacccattcgctaccaaacaactgcaaccaaaagtgagcatacgggccgagagatagtcgatctcatgtgtcacgcgactttcaccatgcgcctgcttagcccggtgagagttccaaactataacctaataatcatggacgaggctcacttcaccgatccggctagcatcgcggcacggggctacattagcacacgagtaggcatgggagaagcagcagcgatcttcatgacggccacacccccaggaactgcggacgctttcccacaatcgaatgcccccatacaagatgaagaaagagacatacccgaacgaagctggaactcaggcaacgaatggataaccgacttcgccggaaaaacagtatggtttgtgccaagcataaaagcgggcaacgacatcgccaactgcttgcgaaagaatgggaagaaagtaattcaactgagccgaaaaacattcgacaccgaataccagaaaacaaagctaaacgactgggattttgtggttaccacagacataagcgaaatgggagcaaactttaaagccgaccgggtaatcgaccccagaaggtgcctaaagcccgttatactcacagacgggccagagcgcgtcatcctggcggggccaatgccagtaactgcggcgagcgcggcccaaaggcgtggcagagtcggaaggaatccacagaaggaaaacgatcagtacatattcacagggcaaccccttaacaacgacgaagaccacgcacattggaccgaggcgaaaatgctgttagataatataaacacacccgagggcattatccccgcactctttgagccggagcgtgagaaaagcgcagccatcgacggcgagtaccgactgaagggtgaatcgaggaagacgtttgttgagctcatgagaagaggggatctcccggtctggctcgcccataaagttgcatcagaaggcataaagtacacggaccgcaagtggtgtttcgacggacaaagaaacaaccaaatcctggaagagaatatggacgtcgaaatatggacaaaggagggagaaaagaagaaactaaggccgcgttggctagatgcacgaacgtactcagaccccctggccctaaaggagttcaaagacttcgcagcgggccgaaaatccatcgcgctcgacctggtaactgaaatcgggcgtgtacccacacacctagcacatcgcacgcgaaacgcactagataacctcgttatgttacacacctcagaacacggcggcaaagcatatcgccacgctgtagaggaactccccgagacaatggaaacgctactactactcggactaatgatcctgctaaccgggggagccatgctgttcctcataagcgggaagggcataggaaaaacatccatcggcctcatatgcgtgatcgcctcgtctggtatgctgtggatggcagaaatccccctccaatggatcgcgtcagctatcgtgttggagttcttcatgatggtgttgctaatcccagaaccggaaaagcaacggacaccccaggacaaccaattggcttacgttgtgataggtatactaacattagcagcaacaatagctgcgaacgaaatgggactcctggaaacaacaaaacgcgacctgggcatgtcaaaagagccgggggtggtatcgcctacgtcttacctagatgtagaccttcatccggcttcggcatggacgttgtacgcggtagcaacaaccgtgataacaccaatgctgaggcacaccatagaaaactctaccgcgaacgtgtctctggcagcaatcgccaaccaagcagtggtgctcatggggctagataaagggtggcccatctcaaaaatggacctcggcgttcccctcctcgcgctcggctgctactcacaggtaaatccattaacactgacagcagcagtactcctgttaataacacactacgccataatcggcccgggacttcaggccaaagcgacccgcgaagcacagaaaagaaccgctgcgggaatcatgaaaaaccccaccgttgacggaataatgacaatcgacttggatcctgtcatatatgactctaaattcgaaaaacagctaggccaagtcatgcttcttgtcttatgcgcagtgcagctactgcttatgagaaccagctgggcactatgcgaggcgctgacattggccactgggcccataaccacgctttgggagggaagcccgggtaagttctggaacacgacaatcgccgtgagcatggcaaacatatttcgcggctcctatttagcgggagcgggactcgcctttagcatcatgaaatccgtgggaactggtaaaaggggtaccggaagccaaggagaaaccctaggtgaaaagtggaagaagaaattgaaccagctcagtagaaaggagttcgacctttataagaaatccggaataacagaggtggatcgaaccgaggccaaagaagggctcaaacgaggagaaatcacacatcacgctgtctccagagggtcagccaagctccagtggttcgtagagcgaaatatggtaatacccgagggacgggttatcgacctaggatgcggacgcggcgggtggagctactactgcgcaggactaaagaaagtgacagaagtcagggggtataccaagggcggcccgggacacgaagaaccggtcccaatgtcgacttacggatggaacattgttaagctgatgagcggaaaggatgtgttctacttgccacccgaaaaatgcgataccctcctgtgcgacataggtgaaagcagcccgtcaccaaccgtagaggaatcgcgcacgatcagagtactgaagatggttgaaccctggctcaaaaataaccagttctgtatcaaggtactgaatccttacatgccaacggtgatagaacacctcgaaaggctccagcggaaacatggtggaatgcttgtgagaaaccctctttcacggaacagcacgcacgaaatgtactggatcagcaatgggacaggaaacatcgtcgcaagcgtgaacatggtcagccgcctgctactgaacaggttcacaatgacgcaccgacgaccaacaatagaaaaggacgtggacctaggagcaggtactcgccacgtcaacgcagaaccggaaacaccgaatatggacgtcatcggcgagaggatcaagcgcataaaagaggaacacaactccacatggcactacgacgacgaaaacccctacaagacatgggcataccatggctcctacgaagtgaaggccaccggctcagccagcagcatgatcaacggcgtcgtcaagctccttaccaaaccgtgggacgtagtgccaatggtgacccaaatggcaatgacagacaccacccccttcggacagcaacgagtcttcaaggaaaaagttgacacacgcacaccacgctccatgccgggtacccggcgagtgatgggcataaccgcagaatggttgtggcggacattgggcagaaacaagaaaccccgactgtgcacgagggaggagttcaccaagaaagtccggacgaacgcagccatgggcgccgtctttaccgaagaaaaccaatgggacagcgccaaagccgcagtcgaagatgaggatttctggaaactggtagacagggaacgggaactccacaagttgggaaagtgcggatcgtgcgtgtataacatgatgggcaaaagagaaaagaaactcggagagtttggaaaggccaagggttcacgagcaatatggtacatgtggttgggtgcgcgctacctggaatttgaagccctgggattcctgaacgaggatcactggttctcacgggaaaacagttactccggggtagagggcgaaggactacacaaactcggatacattttaagggatattagcaagatcccgggcggtgcaatgtacgccgacgacaccgcggggtgggacactcgaatcaccgaagacgacctacacaatgaagagaaaatcacccaacagatggaccccgagcacagacaactggccaacgccatattcaaactcacctaccaaaacaaagtagtcaaggtacagcggccaacccccaccggtaccgttatggacattatctcaaggaaagaccaacgtgggagcggccaagtcgggacctacggattaaacacattcactaatatggaggcgcaactcatacgacaaatggagggagagggcgtgctcttaaaagcggatctcgaaaatccccacctccccgagaagaaaatcacacagtggctagaaacgaaaggggtcgaacgattgaaacgaatggctatcagcggcgacgattgcgtagttaagccgattgacgatagattcgccaatgcattactagcgctaaacgacatggggaaagtaagaaaagacatcccgcaatggcagccctcaaaaggctggcacgactggcaacaagtacccttctgcagccaccacttccacgaactaatcatgaaagacggcagaaaacttgtcgttccgtgccgacctcaggacgagctcataggcagagcccgcatatcacaaggggcggggtggagtctgcgcgaaacagcttgcttaggcaaagcgtacgcgcaaatgtggtcgctgatgtatttccacaggcgagatctacgcctggcatctaacgcaatctgctcggccgtcccagttcattgggtaccaacgtcgcgaacaacctggagcatacatgcacaccatcagtggatgacgacggaagacatgctcacggtatggaatcgagtctggatagaggacaacccttggatggaagacaaaacacctgtaacaacgtgggaaaatgtcccctatctaggaaagcgcgaagaccaatggtgtggatccctgatagggctgacctcccgagccacttgggcacaaaacatacctaccgcaattcaacaagtgcgctctctgataggcaatgaggagtttcttgactacatgccgtcaatgaagcgattcagaaaagaagaagagtcggaaggagccatctggtaa

SEQ ID NO: 26060 - RNA, 9873 nt, synthetic construct
  misc_feature 1..9873: note = derived and/or modified CDS sequence (opt11) from DENV-3__FJ639798__SS-prME
  source 1..9873: mol_type = other RNA
accagtctatgcttgatgatgatcttaccagccgccctcgcctttcacctcacgtcgcgtgacggagaaccccgaatgatagtcggcaaaaacgaaagagggaaatctttactattcaaaacagcaagcggaataaacatgtgcacgctcatcgccatggacctaggagaaatgtgcgatgacacggtgacatacaaatgcccccacataacggaagtcgaaccggaagacatcgactgctggtgcaacctgacaagcacatgggtgacgtacggcacctgtaatcaagcgggagagcacagacgagataaacgaagcgtggccctcgcaccccacgtaggaatgggactcgatacacgaacacaaacgtggatgagcgcggaaggagcgtggaggcaagtagaaaaagtagaaacatgggccctgcgacaccccggcttcacaattctcgcgctgtttctagcgcactacatagggacgtcactgacccaaaaagtcgtaatattcatcctcttgatgctagtcacaccgagcatgacaatgagatgtgtaggggtaggaaaccgtgactttgtagaagggctcagcggggcgacttgggtggatgtagttctcgagcacggcggatgcgtcaccacaatggccaaaaacaaacccaccctagatattgagcttcagaaaacagaagctactcaattggcgacgctgcgaaaactatgtatcgaaggcaaaattacaaacattacgacagacagccgatgtcccacgcagggggaggcggtactcccggaagaacaagaccagaactacgtctgcaaacacacctacgtggataggggatgggggaacggctgcgggctattcggtaaaggatcactggtaacatgtgccaaattccagtgcctggaaccagtagaagggaaagtcgtgcagtatgaaaacctgaaatatacagtaattattacagtccacacaggggaccagcaccaggtaggaaacgagacccaaggagtcacagccgaaatcacaccccaagcctcaacgacagaagccatactcccagaatacgggacacttgggttggagtgctcaccacggacaggtctagacttcaatgagatgatactcctcaccatgaaaaacaaggcgtggatggtccataggcagtggttcttcgacctaccgctcccatggacatcgggagccacaacggaaacgcccacctggaaccgtaaagagctactcgtcacattcaaaaacgcacacgccaagaaacaggaggtagtagtgctcggatcgcaagagggagcaatgcacaccgcgctcacaggtgctaccgagattcaaaattcaggaggaacgagcattttcgccggccaccttaaatgccgcctaaaaatggacaaacttgagctaaaagggatgagctacgccatgtgtacaaatacgtttgtactaaagaaggaagtttctgagacacaacacggaacaatactaatcaaagtcgaatataagggagaagacgtcccgtgcaagatacctttcagtaccgaagacgggcaaggaaaagcacataacggacgactaataaccgcaaacccggtcgtcaccaagaaagaagaaccggtaaatatagaggcggagccacccttcggcgagagcaatattgtaattggtatcggagacaacgcgctaaagataaactggtacaagaaaggaagcagtatcggtaaaatgttcgaagcgacggcccgaggagcccgaagaatggcgatactgggtgacacagcttgggatttcgggtcagtcggcggcgtactaaacagcctcgggaaaatggtccaccaaatcttcgggagcgcctatacagcactattcagtggggtcagttgggtgatgaagattgggataggagtcctccttacatggatcgggctgaactcaaagaatacaagtatgagttttagctgcatcgcgattgggatcataacactatacctcggtgcggtcgtccaggctgatatgggctgcgtcataaactggaaaggcaaagaactcaaatgtggttcaggcatattcgtcacgaacgaagtccacacgtggacagagcagtacaaattccaagccgacagtcccaagcgcctagccacagccatcgccggtgcctgggaaaacggggtttgtggtatacgctcaacgacgcggatggaaaatttgttgtggaaacagatcgccaacgagctcaattacatcctctgggaaaacaatataaaactgacggtggttgtgggcgatataataggagtgttggagcagggcaaaaggacactaacacctcaaccaatggagctcaagtactcatggaaaacgtgggggaaggcaaagatagtcacggcggaaacacaaaacagtagcttcatcatagacggacctaatactcctgaatgcccatccgcgagccgagcctggaacgtgtgggaggtcgaagattatggcttcggcgtcttcaccacgaatatttggctaaaactccgagaagtgtacacgcagctatgcgatcaccgattaatgtccgctgctgttaaggacgaacgcgccgtacatgctgacatgggatactggatcgaatcacagaaaaacggaagttggaagctagaaaaagcgagcctaatcgaggtaaagacgtgtacatggccaaagagccacacgctttggagtaatggagtcttggaatccgacatgatcatcccaaaatcactagcgggcccgataagccaacacaactaccgaccgggctaccatacacagaccgcagggccctggcacctgggaaagctcgaattagactttaactactgcgaaggaactacagtcgttataacagaaaactgcggcacccgaggccctagcctccggacgacgacggtctctggcaaactaatccatgaatggtgctgtcgatcgtgcaccctaccaccccttaggtatatgggagaagacggatgctggtacggcatggaaatacgacccataagcgagaaagaagaaaacatggtcaagtcgctagtcagcgcaggctcgggggaagtcgataatttcacgatgggggtcctttgccttgcgatacttttcgaagaagtgatgcgagggaaattcggaaagaaacacatgatcgctggagtcttctttacatttgttcttctcctgtcaggccaaatcacctggcgagatatggcacacacactaatcatgattgggtcaaacgcctccgatagaatggggatgggtgtaacttacctagccctgatagcaacatttaaaatccaacccttcctagccctcggattctttctaagaaaacttaccagccgcgaaaacctgctattgggcgttgggcttgctatggccacaacactacaattaccggaagacattgagcaaatggcaaacgggatcgcgctcggcttaatggcactgaagctgatcacgcaattcgaaacataccagctgtggacggcgctgatctcgctcacgtgcagcaacaccatctttacgctcaccgtagcctggcgcacagccacactcatcctggcaggagtgtcactactgccggtatgtcagagctcgtccatgagaaagacagactggctccccatgaccgtagccgccatgggcgtaccccctctgccgctgttcatattcagcctcaaggacacactgaagcgacggtcctggccgctaaacgagggagttatggcagtaggcctagtatccatactagcgagctcactactacgcaatgatgtaccgatggcggggccgctggtagctggcggtctactcattgcctgctacgtcattacgggcacctcggccgatctaaccgtcgaaaaagcagccgacgtaacgtgggaagaagaagcagaacaaacgggagtaagccataacctcatgataacggtcgacgacgacggtactatgagaatcaaagacgacgaaacagaaaacatcctaactgtcctcctgaaaactgcattgctgatagtgagcggtatcttcccgtactccattccagccacattactcgtctggcatacatggcaaaagcaaactcagcgtagcggcgtactgtgggacgtgccaagccctccagagacacaaaaagctgaacttgaagaaggggtatacaggatcaaacagcaggggatattcggaaagacccaagtaggggtgggagttcagaaggaaggggtattccacacaatgtggcacgttacgcggggagcagtactcacctacaacgggaagcgacttgagccaaactgggcctcggtcaagaaagacctcataagctacggaggaggatggcgcctgagcgcccaatggcaaaaaggcgaggaagttcaagtgattgccgtcgaacccggtaaaaatccaaagaacttccagacaatgccaggaaccttccaaacgacaacaggcgaaataggggcaatcgccctagatttcaagccaggcacatcagggtccccaatcattaaccgtgagggcaaggtggtcggcttatatggaaatggtgtggttacgaaaaacggaggttacgtaagcgggatagcacagaccaacgcagaaccggatggcccgacacccgagttggaagaagagatgttcaaaaagagaaacctaaccataatggaccttcatccggggagcggcaaaacaagaaaatacctacccgccatcgtcagggaggccataaagaggcgcttacggaccttaatcttggcgcccacaagagtcgtcgccgcagaaatggaggaagcactgaaaggcctgcctatacgataccagaccaccgccaccaagagcgagcacacaggaagagaaatcgtcgatttaatgtgccacgcgacattcaccatgcgattattaagccccgtacgcgtcccaaactataacctgatcattatggacgaggcgcatttcacagacccggccagtatagcagcacggggatacataagcacccgagttgggatgggtgaagcggcagcaattttcatgacggcgaccccaccgggcaccgccgacgcgttcccccaaagcaatgctccaatccaagacgaagaaagggacataccagagcgctcctggaactccggaaacgaatggatcaccgattttgctggcaagacagtatggttcgtaccgagcatcaaggctgggaacgacatcgcgaactgtctccgcaagaacgggaagaaagtcatacaactaagcaggaaaacctttgacactgagtatcagaaaacaaaattaaatgattgggacttcgttgtcacgacggacatctctgaaatgggtgcgaacttcaaggctgaccgggtaatcgacccccggcgatgcttgaaacccgtcatacttaccgacgggccagagcgagtgatattggctggacccatgccagtgacggcggcttctgccgcgcaacgcagaggccgtgtcggccgcaacccgcagaaagaaaacgaccaatatatcttcacagggcaaccactcaacaacgatgaagaccacgcgcactggacggaagccaaaatgctgcttgacaacataaacacgccggagggaataatacccgccttgttcgaacccgaacgcgagaaaagtgcagcaatagacggggagtacaggctgaaaggagagtcccgaaagacgttcgtcgagctgatgcgcagaggcgatctacccgtgtggctggcacacaaagtggcttccgaagggatcaagtacacagaccggaaatggtgctttgacggccagcgaaataatcagatactggaagaaaacatggacgtggaaatatggacgaaggagggagagaagaagaaactccgccctcgctggctagacgcacgtacatatagcgacccactagccctgaaggagttcaaggattttgcggccggaagaaagagtattgcgctggacctcgtgaccgagataggccgcgtacccacacacctcgcccaccgaacccgtaacgccctggacaatctcgttatgttacacactagcgaacatggtggcaaagcatacaggcacgccgtcgaagaactcccggaaaccatggaaaccctactactattaggattaatgattctgctaacaggaggagctatgcttttcctcatatcaggaaaaggcattgggaaaacctctattggtctcatatgcgtcatagcctcgagcggaatgctctggatggcggagatccctctccaatggattgcaagtgccatcgtactcgaatttttcatgatggttctactcataccagaaccggagaaacaacggactccacaagacaaccaattagcttacgtggtcatcggtatactaaccctagccgcaaccattgccgcaaacgaaatgggtttgctggagactacaaagagagatctggggatgagcaaagaacccggcgttgtgagcccgacctcctatctcgacgtcgacctacacccagcaagcgcttggaccctctacgcagtggctacgacagtcatcactccaatgctacgacacacgatagaaaacagcacagcgaatgtatcactagcggctatagccaaccaagctgtggttctcatggggttagacaaagggtggcccataagcaaaatggacctaggtgtgcctctactagcgcttggatgctactcacaagtcaatcccctcacgttgacggcagctgtgctgctactgatcacacactacgcaataataggcccagggctacaggcaaaagccacccgagaagctcagaaacgcacggctgcaggcatcatgaaaaacccgacagtagacggtatcatgacgatcgatctcgacccggtgatttacgacagtaaattcgagaaacagctcggacaagtcatgttgctagtactgtgtgctgtccagttgctgttaatgcgtacttcctgggcactatgcgaagccctaacgctagcaactgggcccatcacaacgctatgggaaggtagcccggggaagttctggaatactacaatagccgtaagtatggccaacatattccgcggaagctatctcgcgggagctggcctagcattctccataatgaaatcagtaggaacaggtaagcgcgggacaggcagtcaaggcgagacacttggcgaaaagtggaagaagaaactaaaccaactcagccggcgggaatttgatctctacaaaaagtccggcattaccgaggtggaccgaacagaagccaaagaggggctaaaaaggggagaaatcacacaccatgcggtatcgcgtggaagcgcgaaattacaatggtttgtcgagcgcaatatggtcatcccagaaggtcgcgtcatcgacctcggatgtggtcgcggaggatggtcgtactattgcgcaggcctaaagaaagtcactgaagtccgaggctacacaaaaggaggacccggccatgaagaacccgtcccgatgtccacatacggatggaatatagtaaaactaatgagcggcaaggacgtattctacctacccccagaaaaatgcgacacactgttgtgcgacattggagagagcagccccagtccgaccgtagaggagtccagaaccataagggtcctcaaaatggttgaaccctggcttaaaaataatcaattttgcatcaaagtcttaaatccatatatgccaacggtcatagaacacctagaacgactccaacggaagcatgggggaatgttagtcagaaatcccctttccaggaactcgacccacgagatgtactggataagcaacggaacaggcaatatagtagcaagtgtgaatatggtcagtcgcctattgctcaacagatttactatgacacacaggaggcccacaatagaaaaagacgtagacctaggagcgggaaccaggcacatcaacgccgaaccggaaaccccgaatatggacgttatcggcgagaggattaaacgtattaaggaagaacacaacagcacatggcattatgacgaggaaaacccatacaagacgtgggcatatcacggcagctacgaagtgaaagctacggggagtgcctcgtcgatgatcaacggagtcgtcaagctgcttaccaaaccgtgggacgtggtacccatggtaacacagatggccatgaccgacactacgccatttgggcaacagcgagtatttaaggagaaggtggacacaaggacgccgcgacctatgccgggaacgcggcgggtaatgggaatcacagcggagtggctatggcgtacgctagggcgcaacaagaaaccgcggctgtgtacgagagaggaatttacgaaaaaggtcaggacgaacgccgccatgggagccgtgttcaccgaggaaaatcaatgggatagcgccaaggcggccgtagaagacgaagacttttggaagctcgtcgacagggagcgtgagttacacaaactaggcaaatgcggatcatgtgtctataatatgatgggcaagcgggagaagaaactaggagagttcggcaaggccaaggggagtagagcaatatggtacatgtggctaggcgcccgataccttgagttcgaagcattagggttcctcaatgaagaccactggtttagccgggaaaatagctattccggggtcgagggggagggactgcacaagctcgggtacatactgcgcgacatatctaaaatcccgggaggagcgatgtacgccgacgacacagccggttgggacacacggatcaccgaggacgacctccacaatgaggagaaaatcacccaacagatggacccagaacaccggcagctagcaaatgcgatattcaaactaacataccaaaataaagtggtcaaagtgcagagacccactccgacagggacggttatggacataatctccaggaaagaccaacggggctcagggcaagtcggaacgtacggcctgaatacgttcacaaacatggaagcacaactaatccgacaaatggaaggtgaaggggtactgagcaaggccgacttagagaacccccatctgcccgagaagaaaataacgcaatggctcgagacgaagggggtcgaacgacttaaaaggatggcgattagcggcgacgattgcgtcgtaaaacctatcgacgatagattcgccaacgccctgctagcgctaaacgatatgggaaaagtacgtaaagacatacctcaatggcagccgagcaaggggtggcacgactggcaacaagttccattctgtagccatcacttccatgaactcataatgaaggatgggcgcaaactcgtcgtaccatgtagaccacaagatgagctgatcggccgagcccggatcagccagggcgcaggctggtcattgcgcgagaccgcctgcttaggcaaggcatacgcccaaatgtggagtctcatgtacttccaccggagagatctccgactggcatcaaatgcaatatgctccgccgtaccagtacactgggtcccaacatcaaggaccacttggagcatccacgctcaccaccaatggatgaccacggaggacatgctcaccgtctggaaccgagtatggatagaggataacccgtggatggaagataagacacccgttactacctgggaaaatgtcccatatttgggaaaacgggaagatcaatggtgtggtagcctgataggtcttacaagtcgcgcgacgtgggcccaaaacattccgacggcgatacaacaggtaagatcactaataggaaacgaggaatttctggactacatgccaagcatgaaacgcttccggaaagaagaagaatccgagggagccatatggtga

SEQ ID NO: 26061 - RNA, 9873 nt, synthetic construct
  misc_feature 1..9873: note = derived and/or modified CDS sequence (opt11) from DENV-3__FJ639799__SS-prME
  source 1..9873: mol_type = other RNA
acctcactgtgtctcatgatgatcttacccgctgcgctggcgttccatctcacatcccgcgacggcgaaccccggatgatcgtggggaaaaatgagcggggcaagagcctgctgttcaaaaccgctagcgggatcaacatgtgcaccctaatcgccatggatctgggagaaatgtgcgacgacaccgtgacctataagtgcccccacatcaccgaggtggagcccgaggacattgattgttggtgcaacttgacctccacctgggtgacctatggcacgtgcaaccaggcaggcgagcaccgacgcgacaagcggagcgtcgccttagcgccccacgttggcatggggctggacacgcggactcagacctggatgagcgccgagggcgcctggcggcaggtcgaaaaagtcgagacgtgggcactgaggcacccggggttcaccatcctcgcgcttttcctggcccactacattggcacctccctcacccaaaaggtggtgatcttcattctgttaatgctagtcacgcccagcatgaccatgcggtgcgttggggtgggcaaccgcgacttcgtcgagggcctgtcgggcgcaacctgggtagacgtggtcctggagcacggcgggtgcgtgacgacgatggccaaaaacaagccgactctggacatcgagctccagaagaccgaggcgacccagctggctacactccggaagttatgcatcgagggcaagatcaccaacgttacaaccgatagcagatgcccgacccaaggcgaggccgtcctgcccgaggagcaagatcagaactatgtgtgcaaacacacctatgtggaccgggggtggggcaacgggtgtggcctcttcgggaaaggatcgctggtaacgtgcgccaagttccagtgcctggaacccatcgagggcaaggtggtccagtacgaaaacctcaagtacaccgtcatcatcacagtgcacaccggggatcagcaccaggtcggcaatgagacgcagggggtgaccgccgagattacgccccaagctagcacgaccgaggcgatcctgcctgagtacggcaccttagggctcgagtgcagcccgcgaactggtcttgacttcaacgagatgatcctgctcacgatgaagaacaaggcatggatggtccaccggcagtggttcttcgacctgcctctgccctggacttcaggcgccaccacggagacgcccacctggaacagaaaggagctcctggtcaccttcaaaaatgcccacgccaagaagcaagaggtggtggtcctggggtcgcaagagggcgcgatgcacaccgccctcacgggggccacggaaatccagaactcaggcggtaccagcatcttcgctggccacctgaagtgccggttgaaaatggacaagctcgagctgaaaggcatgagctacgccatgtgtacaaatacgttcgtgttgaagaaggaggtgtccgagactcagcacgggaccatcctcatcaaagtcgagtacaagggggaggatgtaccgtgcaagattcccttcagcacagaggatggacagggaaaggcgcacaacggccgcctgataacggccaacccagtggtcactaagaaggaggagcccgtgaatatcgaggccgagccccccttcggggagtctaacatcgtgatcggcattggggacaatgcgctcaagatcaactggtataagaaaggctctagcatcggcaagatgttcgaggcgactgcccgtggggctcgccggatggcaatcctcggcgacacagcctgggacttcgggagtgtcggcggggtgctcaacagcctgggtaagatggtgcatcagatatttggttctgcgtacacggctctattcagcggcgtctcctgggtgatgaagatcggcatcggggttttactgacttggatcgggctgaacagcaagaacacatccatgagcttttcctgcatcgccatcggtatcattaccctctatctcggagcggtagtacaggccgatatgggctgcgtgatcaactggaagggcaaagagctgaagtgtggtagcggcatcttcgtcacgaacgaagtgcatacctggacggagcagtacaaattccaggcggactcccccaagcgcctcgcaaccgccatcgccggcgcgtgggagaatggggtgtgcggcatccgcagcacgactcggatggagaatctcctgtggaaacagatcgcgaacgagctcaactacatcctgtgggagaacaatataaagctgaccgtcgtagtgggggatatcattggcgtcctcgagcagggcaagcgcaccttaacgccccagccgatggagctcaagtactcctggaagacctggggcaaggcaaagatagtgacggccgagacccagaacagctcctttataatagacggccccaacactcctgagtgcccgtcggcgtcccgcgcctggaacgtgtgggaggtggaggactacgggttcggcgtattcactaccaatatctggctcaagctccgtgaggtgtatacccagctgtgcgaccaccggctcatgagcgctgccgttaaggacgagcgtgccgtgcatgccgacatgggctactggatcgaatcgcagaagaacggctcctggaagctggagaaagcgagcctgatagaagtgaagacctgcacgtggccgaagtcccacaccctgtggagtaacggcgtcctggagtccgacatgataatccctaagagcctggcaggccccatcagtcagcacaactacaggccgggataccatacccagaccgccggaccctggcatcttggcaagttagaactggacttcaactactgtgaaggcacgactgtggtgattaccgagaactgcgggacccgcggaccctcactccggacgaccaccgtctccggcaagctgatccatgagtggtgttgccgcagctgtaccctacccccgctccgctacatgggcgaggacgggtgttggtacgggatggagattagacccataagcgaaaaggaggagaatatggtcaaatccttggtgtccgctggcagtggggaggtcgacaacttcacgatgggcgttctgtgcttggccatcttattcgaggaggtgatgcggggaaagttcggaaaaaaacacatgattgcgggggtttttttcaccttcgtgctgctcctgtccggccagattacatggcgcgacatggcccacaccctgatcatgataggcagcaacgcctctgaccggatgggaatgggtgtgacgtacctcgcactgatcgccaccttcaagatccagcccttccttgccctcgggttctttctgcgcaagttgaccagccgggagaacctcctgttgggcgtaggcctggcaatggcaaccacgctacaactgcccgaggacatcgaacagatggccaacgggatcgcgctcggcctgatggctctaaagctaatcacacagttcgagacctatcagctgtggaccgctctgataagcctcacctgctccaacaccatcttcaccttgaccgtggcctggagaacggccaccctgattctcgcgggcgtctcactgctgccggtgtgccaatccagcagtatgcggaagaccgactggctcccaatgaccgtggccgccatgggcgtgccgcccttgccgctgttcatattcagtctcaaggacaccctgaagcgccgctcgtggcccctgaacgaaggagtgatggctgtgggcctcgtcagcatactggcctcgagcctgctcaggaacgatgtgcctatggcgggtcccctagtcgcggggggactgctcatagcctgctacgttatcaccgggacctccgccgacctgaccgtcgaaaaggccgcggacgtgacttgggaggaggaagcggagcagaccggcgtcagccataacctgatgattacggtcgacgacgacgggacaatgcgcataaaggatgatgagaccgagaacatcctcacagtgctgctgaagacagccctgctgatcgtctccggcatctttccatacagcatccccgccaccttattggtgtggcacacatggcaaaagcagacgcagagatcgggagtcctatgggacgtccccagtccccccgaaacccagaaggcggaactggaggagggggtgtaccgcattaagcagcagggcatcttcgggaagacccaggtaggcgtcggcgtgcaaaaagagggcgtattccacaccatgtggcatgtcacacgcggcgcggtgctcacctataatggaaagcgtctagagcccaactgggcctcagtgaagaaggatttgatcagctacggcggcggctggcgcctctcggcccagtggcaaaagggtgaggaggtccaggtgatcgcagtggagcccgggaagaaccccaaaaacttccaaaccatgcccggaacgtttcaaacgaccaccggagagatcggtgctatcgctctggacttcaaacccgggacctctggcagccccatcatcaaccgcgagggcaaggtcgtgggcctgtacggcaacggggtagtcacgaagaacggagggtacgtttccggcattgcacagaccaacgccgagccggacggacccacccccgagttagaagaggaaatgttcaaaaagcggaacctcactattatggacctgcatccggggagcggcaagacacgcaaatacttaccggccattgttcgagaggcgatcaagagacggctgcgcaccttgatactggcacccaccagagtagtggctgcggagatggaggaggccctgaaggggctgccaatacgctaccaaacaacggcgaccaagtctgagcacacaggccgggaaattgttgacctgatgtgccatgccaccttcacaatgcgcttactcagccccgtccgggtgccgaactacaatttgattattatggacgaggcgcacttcactgatcccgcgtcaatcgccgcgcgcgggtacattagcacccgtgtgggcatgggcgaagccgcagcgatcttcatgaccgcgacgccgcccggcaccgccgacgcattcccgcagagcaacgccccaatccaggacgaagagcgcgatatccccgagcgtagctggaactccgggaacgaatggatcaccgatttcgccgggaaaaccgtatggttcgtacccagcattaaagctggtaacgacatcgccaactgcctccggaaaaatgggaagaaagtcatacaactatcccggaagacgtttgacaccgaataccagaaaaccaagctgaatgactgggactttgtcgtgactacagacatctcagaaatgggcgccaacttcaaggccgaccgagtgatcgacccgcgacggtgtctgaaacccgtgatcctgaccgacggccccgagcgagttatactggccgggccaatgccggtcaccgcggcatccgccgcccagcgccgcggtcgggtcgggcgcaatccgcaaaaggaaaatgatcagtacattttcaccggccagccactgaacaacgacgaggaccacgcccactggaccgaggcgaagatgctgctcgataacatcaatacgcccgagggaataatcccagcgctcttcgagcccgaaagagagaagtcagccgccatcgacggcgagtatcggctgaagggtgaatcgcggaagacctttgtagagctgatgcgccgcggggacctgcccgtatggctagcgcataaggtggccagcgagggaatcaagtacacagatcgcaagtggtgctttgacgggcagcgtaataatcaaatcctggaagagaacatggacgtggagatctggacgaaggagggcgaaaaaaagaagctccgcccccgatggcttgacgccaggacctactccgaccccttggcactgaaggagttcaaggatttcgcggcggggcggaaaagcatcgccctggatctggtcacggagatcggtcgggtgccaactcacctcgcccaccgcactcggaacgctttagacaatctggtgatgctccacacgtccgaacacggcgggaaggcctaccgccatgcggtagaggagctccccgagacaatggagacgctgctcctgctgggtctaatgatccttctgactgggggtgctatgctattcctgatctctggaaaagggatcggcaagaccagcattggactcatatgtgtgatcgcctcatcaggcatgctatggatggcagagattccactgcagtggatcgcctccgcaatcgtcctggagtttttcatgatggtcctcctgatacccgaaccagaaaagcagcgaacgccccaggacaatcagctcgcatatgtggtgatcgggatcctcacgctggccgctataatagccgcgaacgagatgggcctgctcgagaccactaagcgcgacttgggcatgagccgggaaccgggggttgtgtccccaactagctacctggacgtggacttacaccccgcatcggcctggacgctgtacgccgtcgccaccactgtcatcacgcccatgctgcggcacaccatcgagaattctacagccaacgtgtccctcgctgcaatcgcaaaccaggcggttgtgctgatgggactggacaaggggtggccaatcagcaaaatggacctcggtgtgcccttgctggccctcggatgctactcgcaggtcaaccccttgactctgaccgccgccgtgctcttactgatcacccactacgccatcatcgggcccggcctacaggcgaaggccaccagggaggcccaaaagcggacggccgcggggatcatgaaaaacccgaccgtggacggcattatgaccatagacctggatcccgtcatctacgacagcaagtttgagaagcagttgggccaggtgatgctcctggtgctgtgtgcggtccagctgctgcttatgcggaccagttgggccctttgcgaagccctgaccttggccaccgggcccatcacaaccctttgggaggggagccccgggaagttctggaacactaccatagctgtgtccatggctaacatttttcgaggatcttacctggccggagccgggctggccttctccatcatgaaatccgtagggaccggcaagcggggcaccggcagccagggcgagaccctcggggagaagtggaagaagaagttaaaccaattaagccgcaaggaattcgacctgtataagaaatcaggcatcacggaggtcgacaggacagaggcgaaggagggtttaaaacgaggcgagataacccatcacgccgtgtcccggggaagcgccaagcttcaatggtttgtggagcggaacatggtcatcccggaagggcgggtgatcgacttaggatgtgggagaggcgggtggtcctattattgcgctggcctgaagaaggtgaccgaagtccggggctacactaagggcgggcccgggcacgaggagcctgtgccaatgagcacctacggctggaacattgtcaagctgatgtccggtaaggacgtgttctacctccctcccgaaaagtgtgacacattactgtgtgacatcggcgagtcgtcaccaagccccactgtggaagagtcccgcacgatccgtgtgctgaagatggtggagccgtggctgaagaacaatcagttctgcatcaaagtgctgaacccctacatgcccgccgtgatagagcacctggaacggctccagcgcaagcacggcgggatgctggtgcggaacccgctgtcccgcaattccacccacgagatgtactggattagcaacggcaccgggaatatcgtggcttccgtgaatatggtcagccggctcctgctgaaccgcttcaccatgactcaccggcgacccaccatcgagaaggacgtggacctcggggctggcacccggcacgtgaacgctgaacccgagacccccaacatggacgtcatcggggagagaatcaagcgcatcaaggaggaacacaactccacttggcactacgacgacgagaacccgtacaagacctgggcctaccatggctcgtacgaggtgaaggccacaggcagcgcgagctccatgatcaacggcgtcgtaaagctgttgaccaagccctgggacgtagttcccatggtgactcagatggccatgaccgacacaacgcccttcggccagcagcgcgtctttaaagagaaggtcgacacaagaaccccccggagcatgcccggcaccaggcgagtgatgggaatcaccgcggagtggctctggagaacgctcggacgcaataagaaaccccggctgtgcacacgcgaggagtttactaagaaggtccgcactaacgcggcgatgggcgccgtctttacagaagagaaccagtgggacagcgccaaggcagcggtggaggacgaggatttctggaagcttgtggaccgggaacgcgagctgcataagctcggcaagtgtggctcctgtgtgtacaacatgatggggaagcgggagaaaaagctgggcgagttcggcaaggctaaggggtcgcgcgcgatttggtacatgtggctgggcgcccggtacctggagtttgaggcccttggttttctaaacgaggatcactggttctccagagagaacagctactccggggtagagggggagggcctgcacaagctgggatacatcctgcgcgacattagcaagatcccgggaggcgccatgtacgcggatgacaccgctgggtgggacacccgcatcaccgaagatgacctgcacaacgaggagaagatcacgcagcagatggaccctgagcaccgacagctcgctaacgcgatctttaagctgacataccagaacaaagtggtcaaggtgcagcgccctactcccaccggcaccgtaatggacatcatatctcggaaggaccagcgcggatctgggcaggtaggcacgtatgggctgaacaccttcaccaacatggaagcccaactcatcagacagatggaaggagaaggggtgctgtctaaagcggacctcgagaacccccatctgccggagaaaaagatcacccaatggctggagactaaaggcgtggagagactgaaacggatggccatcagcggcgacgactgcgtagttaagccaatcgacgacagattcgccaacgcgctactggccttaaacgatatgggaaaagtgaggaaggatatcccacagtggcagcccagcaagggctggcatgactggcagcaggtcccgttctgcagccaccacttccacgaactcataatgaaggacggacgcaaactggtggttccctgcaggccacaggacgaactgatcggccgcgcccggatctcacagggggccggatggagtctcagggagaccgcgtgcctagggaaggcctacgcgcagatgtggtcgctgatgtacttccacagacgagatctccgcctggccagcaacgcgatatgttccgcggtcccggttcactgggtgcctaccagtaggactacatggtccatacacgctcaccatcaatggatgaccaccgaagatatgcttacagtctggaacagggtatggatcgaggataatccctggatggaggacaagacgccggtcaccacttgggagaacgtcccctacctagggaaacgggaggaccagtggtgcggctccctgatagggttgaccagccgcgcgacttgggcccagaacatcccgaccgccatacagcaggtgcggtccctcatcggcaatgaggagttcctggactacatgcctagcatgaaacgcttccggaaagaggaggagtctgaaggtgctatctggtga

SEQ ID NO: 26062 - RNA, 9873 nt, synthetic construct
  misc_feature 1..9873: note = derived and/or modified CDS sequence (opt11) from DENV-3__FJ639800__SS-prME
  source 1..9873: mol_type = other RNA
accagcttgtgcctgatgatgatcctgcccgcagcgctggcgttccacctcaccagtagggacggcgagcctcggatgatcgtggggaagaacgagcgcggcaagagcctgctgttcaagactgcatcgggaatcaacatgtgcaccctcatcgccatggatttgggcgagatgtgtgatgacactgtaacatacaaatgcccccacatcaccgaagtggaacctgaagacatcgactgctggtgtaacttgaccagcacctgggtaacgtacgggacgtgcaaccaggccggagagcatcggagggacaagcgtagcgtcgccctcgcaccgcacgtgggcatgggtctggacacccgcactcaaacatggatgtcagccgaaggcgcatggaggcaggttgaaaaggtcgagacctgggcccttcgacacccggggttcaccatcctagcgctgttcctggcccattacatcgggacctcgctcactcaaaaagtggttattttcatcctgctgatgctcgtcacgccctctatgaccatgcggtgtgtcggcgttggcaaccgagactttgttgagggcttgagcggggccacctgggtggacgtggtgttagagcatggcgggtgcgtgaccacgatggccaagaacaagcccacactcgacatcgagctgcagaagaccgaggccacccagctggcgacgctccgcaagctgtgtatcgagggcaaaatcaccaatattaccacggacagccgctgccccacccaaggcgaggccgtgctgccggaggagcaggaccaaaattacgtctgcaagcacacctatgtggaccggggctggggcaacgggtgcggacttttcgggaagggctccctggtaacctgtgcgaaattccagtgcctggaacccatcgagggtaaggtggtgcagtacgagaatctaaagtacacggtgatcatcacggtccataccggagaccagcaccaggtgggaaacgagacccagggggtgactgccgaaatcacaccccaggccagtacaacggaggccatccttccagagtatggaaccctggggctcgagtgcagcccgcgcaccggcctggacttcaacgagatgatcttactcacgatgaagaacaaggcctggatggtgcacaggcagtggttcttcgacttacctctgccctggacctccggtgccactaccgagacgcctacatggaaccgcaaggagttgctagtaaccttcaagaacgcccacgccaagaagcaagaagtcgtagtgctgggatcccaggagggcgccatgcacaccgccctcactggggcaaccgaagtacagaactcaggcggtactagtatctttgccgggcatctaaagtgccggttaaagatggacaaactcgagctcaagggcatgagttatgccatgtgcaccaatacgttcgttcttaaaaaggaggtgagcgagacccaacacgggaccatcctcatcaaggtggagtacaagggggaggatgtgccgtgcaagatcccattttccacagaggacgggcagggcaaggcgcacaacggccgcctgatcacagccaatcccgtggtcaccaaaaaggaggagcccgttaacattgaagcagagccgcctttcggggagtcgaatatcgtgatcggcatcggtgacaatgcactgcggatcaactggtacaagaaaggctccagcatcgggaagatgttcgaagcgacagcccgcggagcccggcgcatggccatcctgggcgacacggcctgggacttcgggtctgtcggcggtgtactcaacagcctcggcaagatggtgcatcaaattttcgggtctgcgtatacggcccttttctctggcgtatcctgggtgatgaagattggcattggggtgctgctaacgtggatcggcttaaacagcaagaacacgtcgatgagcttctcctgcattgcgattgggatcatcacactttatctgggagccgtcgtgcaggcggatatggggtgcgtcattaactggaagggcaaagagttaaaatgtggaagcgggatcttcgtcaccaatgaggtgcacacctggactgagcagtacaagtttcaggctgactctcccaagagattagccaccgccatcgcaggagcctgggagaacggggtgtgcggcatccggagcaccaccagaatggagaacctgctctggaagcaaatcgctaacgagctcaattacatactgtgggagaacaatatcaagttaaccgtcgttgtgggagacaccattggggtactagagcagggaaagcggacgttaacgcctcagccgatggagctaaaatactcctggaagacatgggggaaggcgaagattgtgacggctgagacgcagaacagttccttcatcatcgacggtcccaacacacccgagtgccccagcgccagtcgagcgtggaatgtgtgggaggtcgaggactatggcttcggcgtgttcacgactaacatctggctcaagcttcgggaagtgtacactcagttatgcgaccatcgcttaatgagcgcggccgtcaaggacgagagggccgttcacgccgacatgggatactggatagagagccagaagaacggttcgtggaagttggagaaggctagcctaatcgaagtaaaaacctgcacctggccgaaatcacacaccttatggtctaacggagtcctggaatcggacatgatcatccccaagagcctggccggccccatctcccagcataattaccgtccgggctaccacactcagacggcaggaccctggcacctcggcaagctcgaattggacttcaactactgtgagggcactaccgtagtcatcactgagaactgcgggactcggggcccgagcctgcgtaccaccactgtttccgggaaactaatccacgaatggtgctgccggagctgcaccttacctcccctgagatacatgggggaagatggctgctggtacggcatggagatcaggcccatttccgaaaaggaggaaaacatggtaaagtcgcttgtgtccgccggcagcggggaagttgacaactttaccatgggcgtcctgtgcctcgctatcctgttcgaggaggtgatgcgcggaaagttcgggaagaagcacatgatcgccggggtcttcttcacgttcgtactactcctgtctggccaaatcacttggcgggacatggcccacacgctgatcatgatcggctcaaacgcatcggaccgcatgggcatgggcgtgacctacctagcgctgattgccacattcaagatacaaccctttttagcgttagggttcttcctgcggaagctgactagccgcgagaacctcctcctgggagtggggctggcgatggccaccaccctgcagctgcccgaggatatcgagcagatggcaaacggcatcgcgctcggcctgatggccctaaaactgatcacacagtttgagacataccagctgtggacggccctgatcagcctgacctgctccaacaccatctttaccctaacggtggcctggagaaccgcgacactgatcctagcgggggtctcgttactacctgtgtgccagtccagcagtatgcgaaagactgactggctccccatgacggtcgctgctatgggcgttcctccgctcccgctgttcatattcaaccttaaagacacgctgaagcgcagaagttggccactgaacgaaggggtgatggcagtgggcctcgtcagcatcctggccagctccctgctccgcaatgacgtgccgatggcgggcccactggtggcgggcggcctgttaatcgcttgctacgtcattactgggaccagcgccgacctgaccgtggagaaggccgcggacgtgacatgggaggaggaggccgagcagactggggtctcccacaacctgatgatcaccgtagacgacgacgggacgatgcggatcaaggacgacgaaacggaaaatatcctcaccgttctgctgaaaacagctttgctgatcgtcagcggcatcttcccgtacagcattcccgcgacgcttttagtatggcacacatggcaaaagcagacacagcggagcggggtgctatgggatgtcccttcgccgcctgagactcagaaggccgaacttgaagaaggggtgtaccggatcaaacagcagggcatcttcggaaagacccaggttggcgttggggttcagaaagagggcgtgttccacacgatgtggcacgtgacccgcggcgcagtgctcacctataacgggaagcggcttgagcccaactgggcgagcgtgaagaaagacctcatttcctacggcgggggttggaggctctcagcccagtggcagaaaggagaagaggtccaggtcatcgccgtggagccagggaagaaccctaagaacttccagaccatgccgggtacgttccagaccacgaccggggaaatcggcgcgatcgccctggatttcaagcccgggacttcggggagtcctatcatcaaccgggagggcaaggtcgtggggctgtacggcaacggcgtcgtcaccaaaaacggcggatacgtgtctggaatcgcccagaccaacgccgagccagacggccccaccccagagctcgaggaagagatgtttaagaagcggaacttaactatcatggacctgcaccccggtagtggcaagacccggaaataccttccggccattgtgagggaggcgattaaacgacgcctccggaccctaatactggcacccacccgcgtcgttgccgccgagatggaggaagccctaaaaggcctacccatccgataccagacgaccgcgaccaagagcgagcataccggtagggagatagtggacctgatgtgccacgcgacgttcaccatgcggcttctgtcccccgtccgcgtgccgaactacaatctgataatcatggatgaggcccacttcaccgatcccgccagtatagcagcgcgggggtacatcagcacacgcgtgggcatgggcgaggccgccgccatcttcatgacggcgactccacccgggaccgccgacgccttcccgcagagcaacgctcctatccaggacgaggagcgtgacatccccgagaggtcctggaactcaggcaacgagtggatcacggactttgccgggaagacggtctggttcgtgccctcaataaaagcgggcaacgacatagccaattgcctccggaagaacgggaaaaaagtcatccagctgtcgcggaaaacctttgacactgagtaccagaaaacgaaactgaacgattgggattttgtcgtgacgactgacatctccgagatgggggccaactttaaggccgaccgcgtgatagacccgcggcggtgcctgaagcctgtcattctgacagacggccccgagcgggtgatcttagccggtccaatgcctgtgactgctgcctctgcagcccagcgccgggggcgcgtcgggaggaacccacaaaaagagaatgaccagtacatcttcaccggacagcccctcaacaatgatgaagaccacgcccactggacggaggccaagatgctgctggacaatatcaacactccagaggggatcatcccggcgctgttcgagcccgagcgcgagaagtccgctgccatcgacggcgagtaccggctgaagggcgagagccgcaagactttcgtggagctgatgcggcgcggggacctccccgtctggctggcgcacaaagtggcgtccgagggtattaagtacaccgaccggaaatggtgctttgacggtcagcgcaacaatcagatactggaggagaacatggacgtggagatctggacaaaggagggagagaagaagaagctccggccccgctggctggacgcccgcacatacagcgacccgctagccctgaaggaattcaaagatttcgccgcggggcgtaagtcaatcgccttagacctggtaaccgaaatcggtcgcgtgcctactcacctagcccacaggactagaaacgccctcgacaacttggttatgttacacaccagcgaacacggtgggaaggcttatcggcacgcggtcgaggaactgcccgaaaccatggagactctcctcctgctggggctcatgattttactgaccggcggggcaatgctattcctgatatccggcaaggggataggcaaaactagcatcgggttaatatgtgttatcgcctcttctggcatgctctggatggccgagatcccgctgcaatggatcgcatcagctatcgtgttagagttcttcatgatggtcctcctaatccccgagccagagaaacagcggacgccccaggacaatcagttagcgtacgttgtaatcggcatcttgaccctagccgctatcattgccgcgaacgagatgggcctcctcgagacgaccaaacgggacctgggcatgagtaaagagccaggggtcgtgagccccacctcatatctggatgttgacctccacccggcgtcagcttggaccttatatgcggttgcgacgaccgtcatcacccccatgctgcgccatacgatagaaaactctacggccaacgtgtcgttagccgctatcgctaaccaagctgtggtactgatggggctggacaaggggtggccgatcagtaaaatggacctcggcgtgcccctgctggctctcggctgctacagccaggtcaatccgctaacccttaccgccgctgtgctcctgctgataacgcactacgcgattatcggacccggattacaggcgaaggcgacacgcgaggcacagaagcgcaccgccgctggtatcatgaagaacccaacagtggacgggatcatgaccatcgaccttgaccccgtaatctatgactcaaagttcgagaagcaacttggccaggtgatgctcctggtgttgtgcgcggtccagttactgttgatgcggacaagctgggcactctgcgaagcccttaccctggccaccgggccgataacgacgctctgggagggctcccccggaaaattctggaacaccacgatcgctgtcagtatggccaatatctttcgcggttcctacctggcgggtgccggcctcgcattcagcataatgaagtccgtggggacgggcaagagaggcaccgggagccagggcgaaaccttaggggagaagtggaagaagaagttgaaccagctgtcccgcaaggagttcgacctctacaagaagtccgggataactgaggtagatagaactgaggctaaagaggggctgaagcgcggcgagatcacgcatcacgcagtgagccggggctctgcaaaacttcagtggttcgtggagcgcaacatggttatcccggaaggaagagtaattgacctaggctgcgggcgaggcgggtggagctactactgtgccggcctaaagaaagtgacggaagtccgcggctacacgaagggcggaccggggcacgaagaaccggtgccaatgtccacctacggctggaacatagttaaactgatgtccgggaaagacgtgttctacctcccgcccgagaagtgtgacacgctgctttgcgacatcggcgaatcctctccctcccccacggtggaggaatcccgcacgattcgcgtgctgaaaatggtcgagccgtggctcaaaaacaaccagttctgcattaaggtgttgaacccttacatgccgaccgtcatagagcacctagagcgactccagcgcaaacacggcgggatgctggtccggaatcctctctcgcgcaactctacacacgagatgtactggatctccaacggcagcggaaatatcgtagcctccgtgaacatggtcagccgcctcttacttaaccgcttcacgatgacccaccgtcgcccgaccatcgagaaggacgtggatctgggcgcgggcacccggcacgtcaacgcagagcccgagacgcccaacatggacgtcatcggggagcgcatcaagcggatcaaggaggagcacaatagcacttggcactacgacgacgagaacccgtataagacctgggcttaccacggatcatatgaggtgaaggcgacgggtagtgcttcatctatgataaacggcgtcgtaaagctgttgacaaagccgtgggatgttgtcccgatggtgactcagatggcgatgaccgataccacgcctttcgggcagcagagagtattcaaggagaaagtcgatacccgcaccccgaggagcatgcccggcacccgtcgcgtgatggggatcaccgccgagtggctgtggcggacacttgggcgtaacaagaagcctcggctgtgcacacgggaggagtttaccaagaaagttcgcactaacgcagcgatgggcgcggtatttacagaggaaaatcaatgggacagtgccaaggccgcagttgaggacgaggatttttggaagctcgtggatcgggagcgcgaactgcataagctcgggaagtgcggatcgtgcgtctacaacatgatggggaagcgggaaaagaagctcggcgaattcggcaaggccaaggggtctcgcgccatctggtatatgtggctaggcgcccggtatctggagttcgaggcattaggcttcctgaatgaagaccattggttctcccgggaaaacagctacagcggggtggagggggagggcctgcacaagcttggatatattttacgcgacatcagcaagattcccggcggcgccatgtatgccgacgatacagcggggtgggacacccgcatcacggaggacgacctgcacaacgaggagaagattacacagcagatggacccggaacacagacagctggctaacgccatttttaaactgacttaccagaacaaggtagtcaaggtgcaacgccccacccccaccggcacggtgatggacattatctcccgtaaggaccaacgcggttcaggacaggtcgggacttacggtctgaacaccttcaccaacatggaggcccagttgatccggcagatggaaggggagggagtgctgtcaaaggccgacctggagaacccccatctaccggagaagaagataacacaatggttggagacaaagggcgtggaacgcctgaaaagaatggccatctctggcgacgactgcgtggttaagcccatcgacgatcgcttcgcaaacgccttactggcccttaacgacatggggaaggttcggaaagacatcccccagtggcaaccctccaagggttggcacgactggcagcaggtcccgttctgtagccatcacttccacgagctcatcatgaaggatgggcgcaagctggtggtaccgtgccgcccgcaggatgagctgatcggccgcgcccgtatctcccagggggcgggatggagcctgcgcgagactgcttgtctgggcaaggcctatgcccagatgtggtccctgatgtactttcaccgccgggacctccgactagccagcaacgccatctgctccgccgtccccgtgcattgggtgccgaccagccggacgacctggtccatccacgctcaccaccaatggatgaccaccgaggacatgctgacggtctggaaccgcgtttggatcgaggacaacccctggatggaggacaagacccccgttaccacctgggagaacgttccctatctcgggaagcgggaggatcaatggtgcggcagtctgatcgggctgacgagccgcgcaacatgggcccaaaacatcccgaccgcaatccagcaggtgcggtccctgatcggcaacgaagagttcctcgactacatgccgtccatgaagcgctttcggaaagaggaggaaagtgagggggccatatggtag

SEQ ID NO: 26063 - RNA, 9873 nt, synthetic construct
  misc_feature 1..9873: note = derived and/or modified CDS sequence (opt11) from DENV-3__FJ639801__SS-prME
  source 1..9873: mol_type = other RNA
accagtctttgtttgatgatgatccttcctgctgccctggcatttcaccttaccagccgggacggcgaaccaaggatgatcgtggggaagaatgaacggggcaagagcctgctgttcaagaccgcgtcggggattaatatgtgcacgctcatagccatggacctgggcgagatgtgcgacgacaccgtgacctataagtgccctcacattacagaggtcgagcccgaggacatcgactgttggtgcaacctgaccagcacctgggtcacgtatggtacgtgcaaccaagcgggcgagcaccggagggacaaacggtccgtcgcgcttgcgccccacgtgggcatgggcctggacaccagaacccagacctggatgagcgcggagggagcctggcgtcaggtggagaaagtagagacttgggccttacgccacccggggtttaccatcctcgccctgttcctggcgcactacatcggcacgtccctcacccaaaaggtggtcatatttattcttctcatgctcgtcacgcccagcatgaccatgcgctgcgtaggggtgggaaatcgcgactttgtcgagggcctatccggggcaacttgggtggacgtggttctggaacatggcgggtgcgtcaccaccatggcgaagaacaagcctactctggacatagagttacagaaaactgaggcaacgcagcttgcgacgctacgtaaactttgcatagaggggaagataaccaacataacgaccgactcgcgctgccccacgcagggtgaggcagtgctgcccgaagagcaggaccagaattacgtctgcaagcacacctatgtggaccggggatggggaaatgggtgcgggctcttcgggaagggcagtctggtaacctgcgccaagttccagtgcttggagcccatcgagggaaaagtcgtgcagtacgagaacctcaagtacactgttatcatcaccgtgcacacaggcgaccagcaccaggtgggaaacgagacacagggggtcaccgctgagataacgccccaggcaagcaccaccgaggcgattttgcccgagtacggcaccctggggttggaatgctcgcctcgaaccggcttagacttcaacgagatgatcctgttaacgatgaagaataaggcctggatggtgcacagacagtggttcttcgacttacccctaccctggacgagcggcgctaccaccgaaacgcctacgtggaatcgcaaggagctcctggtgaccttcaagaacgcacacgccaagaaacaggaggtcgtcgtgttagggtcgcaggagggcgctatgcacacagccttgacgggggccacggagatccaaaactccggggggacttccatcttcgcaggccacctgaaatgccgtttaaaaatggacaaattagagttaaagggcatgagctatgccatgtgcacaaacacgttcgtcctgaagaaggaggtctccgaaacccaacatgggacgatcctcatcaaggtagagtacaaaggagaggacgtcccatgcaagatccctttcagcaccgaagacgggcaaggaaaggctcacaatggacgccttattacggctaacccagtcgtgaccaagaaggaggagcccgttaatatcgaggcagaaccgccctttggcgagtctaatattgtgatcggcattggtgacaacgcactgaaaatcaactggtacaagaagggttcctcgattgggaagatgttcgaggcgaccgcccggggcgcccgccggatggcaatcctgggagacaccgcttgggacttcgggtccgtagggggtgtcctcaactcgttaggcaagatggtccaccagatcttcgggtcggcgtacacagccctgttcagcggcgtgtcttgggtgatgaaaatcggcatcggggtgttgctcacctggatcggcttgaacagcaagaatacgtccatgagcttctcctgtatagccatagggatcatcaccctgtacctcggagcagtggtgcaggccgacatgggctgcgtaatcaattggaagggcaaggaattaaagtgcggcagcgggatattcgtgacgaatgaggtccacacctggaccgagcagtacaagtttcaagcggactccccaaagcgcctcgcaacagctatcgccggggcgtgggagaatggggtctgcggcatccgctctacgactcggatggaaaacctgctgtggaagcaaatcgctaacgaattaaattacattctctgggaaaacaatattaagctgacagtcgtcgtgggcgacaccatcggcgtgctcgagcagggcaagagaacactaacgccgcagccgatggagcttaagtactcgtggaagacctgggggaaggctaagattgtaaccgccgagacgcagaactcttccttcataatcgacggccccaatacccccgagtgccccagcgcctcccgagcatggaatgtatgggaagtggaagactacgggttcggagtcttcaccaccaatatctggctcaagttgcgcgaagtgtacacacagttatgcgatcaccggctgatgagcgcagccgtaaaggacgagcgcgccgtccatgcggatatgggctactggatcgagagtcagaaaaacgggtcctggaagctggagaaggcgagcctgatcgaggttaagacgtgtacttggcccaagagccataccctctggagtaacggagtgctggagtccgacatgattatccccaaaagcctggccggtcccatctcccagcacaattatcgcccgggctatcacacgcagacagccgggccatggcaccttggcaaacttgagttggactttaactactgcgagggcaccaccgtcgtgattaccgagaattgcggaacgcgcggaccttccctacgtactaccactgtctcagggaaactgattcacgagtggtgctgccgtagttgtacgctgcctccgctcagatacatgggagaagacggatgctggtacggcatggaaatccgtcccatctccgaaaaggaggaaaatatggtcaaaagtctggtctccgccggctccggggaggtggacaacttcacaatgggggtcctctgcttggccatcctgtttgaagaggtgatgcgcggcaagttcgggaagaagcatatgatagcgggtgtcttcttcaccttcgtactgctcctttcggggcagatcacctggcgggacatggcccacacgctgattatgatcggcagcaatgcctccgaccggatggggatgggcgtgacgtacctcgcactgatcgccaccttcaagatccagccctttctggctctcggcttctttctgcgcaagcttaccagtcgtgagaacctccttttaggcgtgggcctagctatggcgacgaccctgcagctgcccgaggacatcgagcagatggctaacgggattgcgctaggcctaatggcattgaaactcatcactcagttcgagacgtaccagctgtggacggcactgatcagtctgacttgcagtaacaccattttcactctgacggtagcctggcgcaccgccaccctaatcttggcgggggtgtcacttctgccggtatgtcagtccagctccatgcgtaaaaccgactggctccccatgacggtggccgctatgggcgtgccccccctccccctgttcatcttcagcttgaaagacacccttaaacgcaggagttggccgctaaacgagggggtaatggcggtaggcctcgtttcaatcctggcatccagcctgctccgtaatgatgtccccatggcgggccccctggtagccggaggcctgctcatcgcctgctacgtgatcactgggacctcagccgatttaactgtagagaaggccgccgacgtaacctgggaggaggaggccgagcagacgggtgtgagtcacaacctgatgatcaccgtcgacgatgacgggacaatgcgaatcaaggatgacgagactgagaacatcctcacggtcttgctgaagacagccctcctgatcgtgagtggcatcttcccgtacagcatccccgcaacgctgctcgtctggcacacatggcaaaagcagacccaacggtccggcgttctgtgggacgttccgagcccgcccgagacccagaaggcagagttagaggagggtgtgtataggatcaagcaacagggaattttcgggaaaactcaggtaggagtcggtgtccaaaaggagggcgtgttccacactatgtggcacgttacccggggcgcggtactgacctgcaatgggaaacgcctagagccaaactgggcatccgtaaagaaagacctgatctcctatggggggggctggaggctctccgcccagtggcagaagggggaagaggtgcaggtgatagccgtcgaacccggcaagaatcccaagaacttccagaccatgcccggcacgttccagaccactacgggtgagattggagcgattgccctagacttcaagcccgggacgagcggctcaccaatcatcaaccgcgaaggcaaggtggtcgggctatacggcaacggggtggtgacaaagaacggcggttacgtctctggcatcgcccagaccaacgcggagcccgatggtccaacaccagagttggaggaggagatgttcaagaagcggaacctcactatcatggacctgcacccaggttctgggaagacgagaaagtaccttccagcgatagttcgggaggcgattaagagacggctacgtaccctgatcctggcccccacccgtgttgttgccgcagagatggaagaagcactcaaagggctgcctatcagataccagacgacggcgacgaaatccgagcacaccggccgggagatagtggacctgatgtgccacgcaactttcacgatgcgcctcctgtcccccgttcgagtcccgaactacaacctgatcatcatggatgaggcacacttcaccgacccggcctccattgcagctcgcggatatatcagcacacgagttggcatgggggaggcagccgccatctttatgacggcgacgccccccggcacagctgacgccttccctcaatccaacgcccctattcaagacgaggagcgcgacatccccgagcgctcttggaacagcggcaatgagtggatcaccgatttcgctggcaagacggtttggtttgtcccctccataaaggcgggcaacgacatcgctaactgcctgcggaaaaatgggaagaaggtaatacagctgtcccgaaagaccttcgatacagagtaccagaagaccaagttaaacgattgggactttgtggtaacgaccgacatctcagaaatgggtgcaaatttcaaggccgaccgtgtgatagacccccgccgatgcctgaagcccgttatccttacagacggccccgagcgcgtcattctggcgggacccatgcccgtgaccgcagcttccgccgcccagagacgcggccgcgttgggcgcaacccccaaaaggagaacgaccagtacatctttactggtcaacccctcaacaacgacgaggaccacgcacactggaccgaggcgaaaatgctgctggacaacatcaacactcccgagggaatcatcccagctctgtttgagcccgagcgggagaagtcagccgcaatcgacggcgagtacaggctgaagggcgagtccaggaagaccttcgttgagctgatgcgccgcggcgacctgcccgtgtggctggctcataaggtagcaagcgagggcatcaaatacaccgaccgcaaatggtgcttcgacgggcaacggaacaatcagatcctggaagaaaacatggacgtcgagatctggacaaaagaaggagagaagaagaagctgcgtccccgctggttagacgcacgcacctactccgaccccctcgctctcaaggagttcaaggattttgcagctggccgcaagagcatcgcattagacctggtaacagagatcgggagagtccccactcacctcgcccaccgcacgcggaatgccctcgacaacctggtgatgctccacaccagtgagcatggtggaaaggcctaccgccacgcagtagaggaactgcccgagaccatggagaccctattactgctggggctcatgattctgttaacgggcggggccatgctgttcctgattagcggcaaaggaataggcaagaccagtatagggctaatctgcgtcattgcctccagcggcatgttgtggatggccgagataccacttcagtggatcgcctccgcgatcgtactcgaattcttcatgatggtactcctaatccccgagcccgaaaagcagcggacgccgcaggacaaccagttagcctacgtcgtcatagggatcctcaccttagcagccacgatcgccgcaaatgaaatgggccttctcgagacgacaaagcgcgatctaggcatgagcaaagagcccggggtggtctcgcctaccagctacctggatgttgacctacatccggcatccgcctggacgttgtacgccgtggcgaccactgtcatcacgcccatgctgcgacacacgatcgagaacagcacggccaacgtgtccttggcggccatcgccaaccaggcagtggtactgatgggtctggataagggttggcctatatcgaagatggatctcggcgtgccactgctggcactcgggtgttactcccaggtgaacccgctgacgcttacagcagcagtgttgctgctaattactcactacgccatcatcggccccggcctccaggcaaaggcaacccgtgaagcccagaagcgcacagccgctggtatcatgaagaacccgaccgttgacggcataatgacgatcgatctagatccagtgatttacgacagcaagtttgagaagcaactagggcaagtgatgctacttgttctctgcgctgtgcaattgctgctgatgcgcacctcatgggccctatgtgaagccttaactctggccactggccccattacaaccttatgggagggcagccccggcaagttctggaataccaccatcgcggtctccatggccaatatcttccggggctcctacctggccggagcagggctggcgttctccatcatgaagtccgtggggacaggtaagcgcggtaccggatcccagggagagactttaggcgagaagtggaagaagcggctgaaccagctgagccgcaaggagttcgatttatacaagaagtcagggatcaccgaggtggacagaacagaggcgaaagagggactgaagcgcggcgagattacccatcatgccgtgtctagaggcagtgctaagctgcagtggttcgtagagcgaaacatggtaatccctgagggacgggtcatcgacctcgggtgtggccgcggcgggtggtcgtactactgtgccggcttaaagaaggtgactgaggttcggggctacacgaagggtgggccagggcacgaggagcctgtccctatgagcacctacggctggaatatagtgaaactgatgtccggaaaagacgtgttctaccttcctcccgagaagtgcgacacgttactatgtgacatcggtgaatcttcgccaagcccgaccgtagaggagagtagaacaatccgggtgttgaagatggtggagccttggctcaagaataaccaattctgcatcaaggtcctcaacccctacatgccgacagtgattgaacatcttgagcgactccagaggaagcacggcggcatgctggtcaggaatccactcagccgcaacagcacgcatgagatgtattggatctccaacgggaccgggaacatagttgcctccgtgaacatggtcagccgcctcctactgaaccggttcaccatgacccatagaagaccgacgatcgagaaggatgtcgacctcggagctggcacccggcacgttaacgccgagcccgaaactccgaacatggatgttatcggggaacggatcaagcgcataaaggaggagcataacagtacctggcattacgatgacgagaacccttataagacgtgggcctaccatggcagctatgaggtcaaggccacggggtccgccagctccatgatcaacggggtggtgaaattgctgaccaagccatgggacgtcgtgcccatggtaacccagatggcgatgacggacaccaccccgttcgggcaacaacgggttttcaaggaaaaggtggatactcggacgccgagaagtatgccaggcactcggcgcgtaatgggcatcaccgctgaatggctctggcggaccctagggcgcaataagaagccccggctgtgcactcgtgaggagttcactaagaaggtgcgcaccaacgcggccatgggcgcggtgttcaccgaggagaaccagtgggactcggccaaggccgccgttgaggacgaagacttctggaaactcgtcgaccgggaaagggagctgcacaaacttgggaagtgcggctcctgcgtgtacaatatgatgggcaagagagagaagaagttaggcgaattcgggaaggcaaaagggagccgagcgatttggtacatgtggttaggcgcgcgctatctcgagtttgaggccctcgggttccttaacgaagaccactggttctctcgggagaattcttactccggcgtcgagggagaggggctgcataaactaggctatatacttcgggatatcagtaagataccggggggcgccatgtacgcggacgacacggctgggtgggacactcgcattaccgaagacgacctgcacaacgaggagaagatcacccagcaaatggacccggagcaccgacagctagccaacgccatctttaagctgacgtatcagaataaggtggtgaaggtccaacgaccgactcccactggcacggtgatggacatcatttcacggaaagaccagagaggcagcggccaggtgggaacgtacgggttgaatacctttaccaacatggaggcccagctcatccggcagatggagggcgagggtgtcttgtctaaggccgacctggagaaccctcacttaccagagaagaagatcacccagtggctggagaccaagggcgtggaacgcctgaaaagaatggccatcagcggggatgactgcgtggtcaagcccatcgacgaccggtttgccaacgcgctcttggccctgaacgatatggggaaggtgcggaaggatattccgcagtggcagccctcgaagggctggcacgactggcaacaggtcccgttctgttcacaccacttccatgaactgatcatgaaggatgggaggaagcttgtggtaccatgccgacctcaggatgagctcataggcagagcccggatttctcagggggcgggctggagcctacgcgagactgcctgtctaggtaaggcatacgcccagatgtggtccctaatgtacttccaccgccgcgatctgcgcctggcttctaacgccatctgctccgccgtgcctgtccattgggttcccacctcccggaccacctggagtatacacgcccatcaccagtggatgacgaccgaggatatgctgacagtctggaaccgcgtctggatcgaggacaacccatggatggaggacaaaacacccgtgacgacctgggaaaatgtgccctacttggggaagcgcgaggaccagtggtgcggttctctcatcgggctgaccagccgcgcaacctgggcgcagaacataccgacggccatccagcaggtacggtcccttatagggaacgaggaatttttggactacatgccctcaatgaaacggtttcggaaagaagaggagtccgaaggcgccatatggtga

SEQ ID NO: 26064 - RNA, 9873 nt, synthetic construct
  misc_feature 1..9873: note = derived and/or modified CDS sequence (opt11) from DENV-3__KF955471__SS-prME
  source 1..9873: mol_type = other RNA
accagcctgtgcctcatgatgatactgcccgccgccctggccttccacctcacctcccgggacggggagccccgcatgatcgtgggtaagaacgagcgtggcaagagcctgctgttcaagacggcctccggtatcaatatgtgcaccctaatcgccatggacctgggcgagatgtgcgatgataccgtgacttacaagtgtccacacattaccgaggtagagcctgaggacatcgactgctggtgcaaccttaccagcacttgggtgacctatgggacatgcaatcaagccggtgagcaccgacgcgacaagagatccgtagcccttgcaccccacgtgggcatgggtctggatacgcgcactcaaacctggatgagcgccgagggcgcctggcgccaggtggaaaaggtcgagacgtgggccttgcgacacccggggttcaccatcctggcactgtttttggcccactacatcggcacctccctcacccagaaggttgtgattttcatcttgttaatgctcgtcacgccttctatgaccatgaggtgcgtgggggttggcaatcgcgacttcgtcgagggcctgtccggggccacctgggtggacgtggtactggagcacggcgggtgcgtgaccacgatggccaagaataagcctaccctcgacatagagttacagaagactgaggccacccagctggcgacgctccggaagctgtgcatcgaaggcaagatcaccaacatcacaacagacagccgctgccccactcaaggcgaagccgtgctgccagaggagcaggaccagaactatgtctgcaagcacacctatgtggacagggggtgggggaacgggtgtggcctcttcggcaaaggttccctggtcacgtgcgccaagtttcagtgcctggagcccattgagggtaaggtcgtgcaatacgaaaacctcaagtacaccgttataatcactgtccacaccggggaccagcaccaggtgggaaatgagacacaaggggtcacggctgagatcacgccccaggccagcaccaccgaagcgatcctgcccgagtacggcaccctggggttggagtgctcgccgcgaaccggccttgacttcaacgaaatgatcttactcacgatgaagaacaaggcctggatggtgcaccggcagtggttcttcgacctgccgctgccctggacctccggcgccaccaccgagacccccacatggaaccgcaaggagttgctggtgacttttaaaaacgcccacgctaagaagcaggaggtcgttgtgctcgggtcccaggagggcgcgatgcatacggccctcacgggggccaccgagatccagaacagcggcgggacctcgatcttcgcaggccacctgaagtgtcggctgaagatggacaagctcgagctgaagggcatgagctacgccatgtgcacaaacacattcgtcctgaagaaggaggtgtcagagacccaacatgggaccatcctcatcaaggtggagtacaaaggagaagacgtgccgtgcaagatccccttctctacagaggacggacaaggcaaggcgcataatggccgcctgatcacggccaaccccgttgttacaaagaaagaggagcccgtcaatattgaggccgaaccgcccttcggggagagcaacatagtcattggaattggggataacgccttgaagatcaactggtacaagaaaggctctagcatcgggaaaatgttcgaggcgacggcccggggagcccgccggatggccatactaggcgataccgcatgggactttgggtcggtgggcggcgtcctcaactccctgggcaaaatggtgcaccaaatattcgggtccgcctatactgccctcttcagcggggtctcctgggtcatgaagatcggcatcggggtgctcctgacctggatcggcctgaacagcaagaacacctcaatgtcgttctcctgcatagccatagggatcatcaccctctacctgggcgccgtagttcaggccgatatgggttgtgtgatcaactggaaaggcaaggagctgaagtgcggaagtggtatcttcgtgacgaacgaggtacacacctggaccgagcagtacaagttccaggcggactccccgaaacgcctcgcaaccgccatagcaggcgcctgggagaacggggtgtgcggcatccgcagcacgactcggatggagaacctgctgtggaagcagatagcaaacgaactcaactacatcctgtgggagaacaatatcaagctgaccgttgtagtgggggatatcatcggcgtgctcgagcagggcaagagaaccttaacgccacagccgatggaacttaagtattcctggaagacatgggggaaggccaagatcgtcaccgccgagactcagaacagctccttcataatcgacggtcctaacacgccggagtgccccagcgcctcccgggcgtggaacgtgtgggaggtcgaggactacggtttcggagtcttcaccaccaacatttggctcaagctgcgcgaagtgtacactcagctgtgcgaccaccggttaatgagcgccgccgtgaaggacgagcgcgccgtccacgcagacatgggctactggatcgaaagccagaaaaacggatcctggaagcttgagaaggcgtcgctgatcgaagtgaagacctgtacgtggccgaagtcccacacactttggtcaaacggcgttctggagtccgacatgatcatccccaagagcctggccgggcccatcagccagcacaactacagaccgggctatcatacccagacggcgggaccctggcacctgggcaaattagagttggacttcaactactgcgaggggacgactgtggtcatcacggagaactgcgggacccgggggccctcgcttcggaccaccaccgtgtccgggaaattgatccacgaatggtgttgccgcagctgcaccctgccaccgctccggtatatgggcgaggacgggtgctggtatggcatggaaatacgccctatctccgagaaggaggagaacatggttaagagcctggtctccgccggttccggggaggtggacaacttcactatgggcgtcctgtgtctcgccatactgttcgaggaggtgatgagagggaagttcggcaagaaacacatgatcgcgggtgtgttcttcacattcgtcctgttactgtccggccagatcacatggcgggatatggcacacactctaattatgataggcagcaacgcctccgacagaatgggtatgggcgtgacgtacctcgcccttatcgccacgtttaagatacagccgttcctggcattgggcttcttcctgaggaagctgacgagccgggagaacctcctgctgggcgtgggcctcgccatggccacgactctgcaactccccgaagatatcgagcaaatggcgaacgggatcgctctcggcctgatggcactgaaactcataacccagtttgagacctaccagttgtggaccgccctgatctctctcacgtgttccaacaccatctttacactgactgtcgcctggcgcacggctaccctgatcctcgcgggggtgagcctccttccagtctgccagagtagctccatgcggaagaccgactggttgcccatgaccgtggccgccatgggcgtaccgcccttacctcttttcatcttcaatctcaaggacacgctgaagcgacgctcctggcccctgaatgagggagtcatggccgtgggcctcgtgtctattctggcctcctccctcttacgtaacgacgtgccgatggcgggcccgctggtggcagggggcctactcatcgcctgctacgtgataaccgggacatctgcagacctgaccgtcgagaaggccgccgacgtgacgtgggaggaggaggcagagcaaactggcgtgtcgcacaatctgatgatcaccgttgacgacgacgggacaatgcgcatcaaggacgacgaaaccgagaacattctgacggtcctgctgaagaccgccctcctgatcgtcagcggcatcttcccgtactccatccccgccaccctgttggtctggcacacctggcaaaagcagacgcagcggagcggagtgctgtgggacgtgcccagcccgccagagacgcagaaggcggagttagaagagggggtttaccgtattaagcagcaaggcatcttcgggaagactcaggtgggcgtgggggtccagaaggaaggcgtcttccacaccatgtggcatgtgacgcggggcgcggtattaacctacaatgggaagcgcctggagccaaactgggccagcgtcaagaaagacctgatctcctatggggggggctggcgtctctccgcccaatggcagaagggggaagaggtgcaggtcatcgccgtggagcccggaaagaaccccaagaatttccagactatgcctggcaccttccagactaccaccggggagattggcgcaatagcactcgacttcaagcccgggacctccggctcacccattatcaaccgcgagggcaaggtggtcgggctgtacggcaatggggtggtgacgaagaacggcgggtacgtcagcggtatcgcccagaccaatgccgagccggacggtcccactcctgagctggaggaggagatgttcaagaagaggaacctcactatcatggacctgcaccccggttcgggcaaaacgcgaaagtacctgccggcaatagtgcgggaggcgatcaagcgccggcttcggaccctaatcctcgcccccacccgggtggtcgccgccgagatggaagaggccctcaaagggctgcccattcgttaccaaaccacggcgacgaagagcgagcacaccggtcgggagatcgtagacctgatgtgtcacgccaccttcacgatgcgcctactctcccccgtgcgtgtcccgaactacaatctgataatcatggacgaggcccacttcaccgaccccgccagcatcgctgcgcgcgggtacatttccacccgggtaggaatgggcgaggccgccgccatcttcatgaccgcgacgccccccgggactgccgacgcgtttcctcagagcaacgcccccattcaggacgaagaacgcgatatacccgagcgctcctggaacagcggcaacgagtggataaccgacttcgcggggaagaccgtctggttcgtcccctccattaaggcgggcaacgacatcgccaactgcctgcgcaagaacgggaagaaggtgattcaactgagccgcaagacatttgacaccgagtaccagaagaccaagctgaacgactgggactttgtggtcaccactgacatctccgagatgggcgccaacttcaaggccgaccgggtgatcgacccccgcaggtgcctcaagcccgtgatcctaaccgatggacccgagcgggtcatcctggccgggcccatgccggtgaccgcggccagcgccgcccagcgtcgcggccgggtggggcgcaacccccaaaaggagaacgatcagtacatttttacaggtcagccactcaacaacgatgaggaccacgcccactggaccgaggcgaagatgctcttagacaacataaacacaccagagggtatcataccggccctcttcgagcccgaacgggagaagtccgccgctatagatggagagtatcgtctgaagggcgagagccggaaaacatttgtcgagctgatgcgacgcggggacctccccgtgtggctggcgcacaaggtcgcctctgagggcatcaagtacaccgacaggaagtggtgcttcgacggccagcggaataaccagatcttagaggaaaatatggacgtggagatatggaccaaagagggggaaaagaagaagctcagaccccgctggctggatgcgcgcacgtacagcgatccgcttgccttaaaagagtttaaggacttcgccgcgggccgcaaatccatcgccctggacttggtgaccgaaatcgggcgggtccccacccacttagcccaccgcacccgcaacgccctggacaacctggtgatgctccacacgtctgagcacggcgggaaggcatataggcacgcggtggaggagctacccgagaccatggagaccctgttactactgggcctcatgatcctgctgaccgggggtgccatgttattccttatctccggcaaggggatcggtaagacgagcatcgggctgatctgtgttattgccagctcaggcatgttgtggatggccgagataccgctgcagtggatagcctccgcgatcgttctggagtttttcatgatggtgctcctgatccctgaacccgagaagcagcggacgccccaggacaaccagctggcgtacgttgttatagggatactcacactggccgccatcatcgccgccaacgagatgggcctgttggagaccactaagcgcgacctcggtatgtccaaggaaccgggggtggtctcacccacctcctacttagacgtggatcttcacccagcaagcgcctggaccctctacgccgtcgcaaccacggtcatcacgcccatgctaaggcacaccatagagaattccaccgccaatgtgagcctcgccgccatcgccaaccaggcggtggtcctgatggggctggacaaagggtggcctatctccaaaatggacctcggcgtgccgctactggccctcgggtgctacagccaggtgaatcccctaacactgaccgccgccgtcctcctgttaattactcactacgccatcatcggccccggccttcaggcgaaggcaacccgcgaagcccaaaagcgtacggctgccggtatcatgaagaatccgaccgtcgatggcatcatgaccatcgatctagaccccgtgatctatgattccaagttcgagaagcaactgggccaggtcatgcttctggtgctgtgcgcggtgcagctcctgctgatgcgcaccagctgggccctttgcgaggccctgacgttagcaacgggccccattaccaccctctgggagggctccccagggaagttctggaacacgaccattgcggtctccatggccaatatcttccgcgggtcctacttagccggggccggcctggcgttctctatcatgaagtccgtggggaccggcaagcgtgggaccggaagccagggggagacactcggcgagaaatggaagaagaagctgaaccagctctcccggaaggagtttgacctctacaaaaagtccggcatcacggaggtagaccgcaccgaagccaaggaggggctgaagcggggtgagatcacccaccacgccgtctcacgcggttccgcaaagttgcagtggttcgtggagcggaatatggtaatcccggaggggcgcgtcatcgatctcggctgcgggcggggcgggtggagctactattgcgccggcctgaagaaggtgaccgaggttcgcggctacactaagggcgggcccgggcacgaggagcccgtccccatgtcaacctatggctggaacattgtgaagctgatgagcgggaaggacgtgttctatctcccgccggagaagtgcgacacactgctgtgcgacatcggcgagtctagccctagtcctaccgtcgaggagagtaggacgatcagagtgctgaaaatggtggaaccgtggctcaagaataaccagttttgcatcaaggtcctgaacccctatatgcccacggtgatcgagcacctggagcgtctccagcggaagcatggagggatgctggtgaggaaccccctgtccaggaacagcacccacgagatgtactggatttccaacggcagcgggaacatagtcgcgtccgtgaacatggtgagccgcctgctgctgaaccggttcaccatgacgcaccggcggccgaccatcgagaaggacgtcgacctcggcgcgggcacccgccacgtaaacgccgagcccgagacccccaacatggacgtgattggggagcggataaagcggatcaaagaggagcacaacagcacgtggcattacgacgacgagaacccgtacaaaacctgggcgtaccacggctcgtacgaggtcaaggccaccggttcagcaagctcaatgatcaacggcgtggtaaaactgctgaccaagccctgggacgtggtgccaatggtcacccagatggcgatgaccgacaccacccccttcgggcaacaacgggtgtttaaggagaaggtggacacgcgaaccccgcggagcatgcccggcaccagacgggtcatgggcatcaccgcagagtggctgtggcgaacgctgggccggaacaagaagccccggctgtgcacccgagaggaatttaccaagaaggtaaggacaaacgccgccatgggagctgttttcacggaggagaaccagtgggacagcgccaaggccgcagtagaggacgaagacttctggaagctcgtggatcgcgagcgcgagttacataagctagggaagtgcggctcgtgcgtctacaacatgatggggaagcgcgagaaaaagctgggcgagttcggcaaggcgaaggggagccgtgcgatttggtatatgtggcttggagcccggtatttggagttcgaggccctcgggttcctgaacgaggaccactggttctcgagggagaacagctattctggcgtcgagggggagggcctgcacaagctgggctacatcctgcgcgatatctccaagatcccggggggcgccatgtacgccgatgacaccgccgggtgggataccaggatcaccgaggacgacctgcacaacgaggagaagatcacgcagcaaatggacccggagcaccgccagctcgcgaacgccatcttcaagctgacctatcagaataaggtggttaaggtccagcggcccaccccgaccgggaccgtgatggacattatctcccgcaaggaccagcggggcagcgggcaggtgggcacgtacggccttaacacgttcaccaacatggaggcgcaactgatccgccagatggagggcgagggggtgttatccaaggccgatcttgagaacccccacttgccggaaaagaagattacgcagtggcttgagacgaagggcgttgagcggctgaagaggatggcgataagcggcgacgactgcgtggtcaaacccatcgacgaccgcttcgccaacgccctccttgccctgaacgacatgggcaaagtccgcaaggacatcccccaatggcagccatcgaaggggtggcacgactggcagcaggtgccgttctgttctcaccacttccacgaactcataatgaaggacggacggaaactggtcgtgccatgccgtccgcaggacgagctgatcggccgcgccaggatctcccaaggggccggatggagcctccgggagaccgcgtgcctgggcaaggcttacgcccagatgtggtccctcatgtacttccaccgccgtgacctgcgcctggcgagtaacgccatctgctccgccgtccccgtacattgggtgccgacctcacgcactacatggtccatccacgcgcaccatcaatggatgaccacggaagacatgctgaccgtgtggaatcgggtgtggatcgaggacaacccctggatggaggacaagacccccgttacgacctgggagaacgtgccctacctcgggaaaagggaggatcaatggtgcggcagtctgatcggcctgacctcgcgggccacgtgggcccaaaacatcccgaccgcgatccagcaggtgcgttccctcatcggtaacgaggaattcctggattatatgcccagcatgaagcggttcaggaaagaggaggagtccgaaggggctatctggtga

SEQ ID NO: 26065 - RNA, 9873 nt, synthetic construct
  misc_feature 1..9873: note = derived and/or modified CDS sequence (opt11) from DENV-3__FJ639803__SS-prME
  source 1..9873: mol_type = other RNA
accagcttgtgcctcatgatgatactgcccgctgcactggcgttccacctcacctcacgggacggagaaccccggatgatcgtcgggaagaacgagcgcggcaagtcactactgttcaagacagcgtccgggatcaacatgtgcacacttatcgcaatggacctgggcgagatgtgcgacgatacggttacctataagtgtccgcacattacggaggtagagcctgaggacatcgactgttggtgcaacctcaccagcacgtgggtcacctatggcacatgcaaccaagcgggcgagcaccggcgcgacaagcggtctgtggcactcgcgccccatgtcggaatgggactggacacacggacccaaacttggatgagcgctgagggcgcttggcgccaggtggagaaagtagagacgtgggcacttcggcacccgggcttcaccattctcgctttgttcctggcacactacatcggcacttcacttacacaaaaggtggtgatcttcatcctgctgatgctcgtcacgccgagcatgactatgcggtgcgtgggggtgggcaaccgcgactttgtggagggcctcagtggggccacttgggtggacgtggtactggaacacggagggtgcgtaaccacgatggcaaagaacaagcccacgcttgatatcgagctacagaagaccgaggctacccagctcgcaacgctccggaaactttgcatcgagggcaagattacaaacatcacgacggactccaggtgtcctacgcagggcgaggccgtactcccagaggagcaggaccagaactacgtttgcaaacatacgtacgtggacagaggctggggcaatgggtgtggcctattcggcaaggggtccctggtaacctgcgccaaatttcagtgcctagagcccatagagggcaaggttgtgcagtatgagaacctcaagtacaccgtgatcattacggtccacacgggggaccagcaccaggtgggcaacgagacccaaggtgttaccgctgaaataacgccccaggcaagcacgacagaggcgatactgccggagtatggaacgctgggactggagtgcagcccccgcaccggcctggacttcaacgagatgatcttgctcacgatgaagaacaaagcctggatggtgcacagacagtggttcttcgacctgccgttaccctggacgtcgggtgccacaaccgaaacgcccacctggaatcggaaagagctgctggtgacattcaagaacgcccatgcgaagaagcaggaggtagtcgtgctcgggtcccaggagggcgcgatgcacaccgcccttacgggagccaccgagatacagaacagcggcgggacgagtatattcgccggccacctaaaatgtcggctgaagatggacaagctcgagctaaaagggatgtcgtatgcaatgtgtacaaatactttcgtcctgaagaaagaagtttccgagacccagcatgggacaatattaatcaaagtggagtacaaaggcgaagacgtcccgtgcaagatccctttcagtacggaagacgggcagggcaaggctcacaacggccgcttaattacggcaaaccccgtggtgacaaagaaggaggagcccgtcaacattgaggccgagcctccttttggggagagcaatatcgtgatcggcattggggataacgccttgaagatcaactggtacaagaaaggctcctcgataggaaaaatgtttgaggcaaccgcccgtggggctcgccggatggccatcctgggagacacagcgtgggacttcggaagtgtgggaggggtcctaaactcgcttgggaaaatggttcatcaaatcttcggctccgcatatacggcgttatttagcggcgtgtcctgggtcatgaagatcggcatcggcgtgctcctgacttggatcggcctgaacagcaagaacacctctatgtccttcagctgtatcgcgatcggtataattaccctctaccttggggccgtggttcaggccgacatggggtgcgtgatcaactggaagggaaaggagctgaagtgcggttcggggatcttcgtgacaaatgaggtccacacctggactgagcagtacaagttccaggcggactctcccaagcgcttagccaccgccatcgccggcgcatgggagaacggagtctgtggcattcgaagtacgacccgcatggagaacctgctgtggaaacaaattgcgaacgagctcaactacatactgtgggagaacaacatcaagctgaccgtggtagtgggggacatcatcggcgtgctcgaacagggcaagcgcaccctaacaccccagcccatggagttaaagtacagctggaagacgtgggggaaggcaaaaattgtaacggctgagacccaaaactcctcctttatcatagacggaccaaacacaccagagtgcccaagcgccagcagagcgtggaacgtatgggaggtggaggattatggcttcggcgtctttaccaccaatatctggctgaaacttcgcgaggtttatacccagctttgcgaccaccgcctgatgagcgccgctgttaaggacgagcgcgcggttcatgccgacatgggatattggatcgagtcacagaagaatgggtcctggaagctagaaaaggccagcctgattgaagtgaagacttgtacctggccgaagtcgcacaccttatggtccaatggcgttcttgagtccgacatgattatccccaagagcctggctgggcctatctcccagcataattatcggcctggataccatactcagactgccggtccgtggcacctcggcaagctggagctggacttcaactactgcgagggcacgacggtcgttatcaccgagaactgcggaacgcgtggcccgtccctccggactacgacggttagtggcaaactgattcatgagtggtgctgtcgcagttgcactctgccaccgctacggtacatgggcgaggatgggtgttggtacggcatggagatccgccccatctccgagaaggaagagaacatggtaaagtcgctggtatcagctggatcaggggaagtggacaacttcacgatgggcgtactgtgcctagccatcctgtttgaggaggtcatgcggggcaaattcgggaagaagcatatgattgcgggggtgttcttcaccttcgtcctattgttaagcggccagattacatggcgcgatatggcccataccctgattatgataggcagtaacgcgtccgaccggatgggtatgggggtgacgtacttggcgctgatagccacttttaagatacagccctttctggcactcgggttctttttgcgcaagctgaccagccgggagaacctcttattaggcgttggtttggcaatggcaacgacgctccagctcccggaggatattgaacagatggctaacgggatcgctttgggcctgatggccctgaagctcatcacacagtttgagacgtatcagttgtggactgccctgatttccctgacatgctcgaacacgatcttcaccttaacagtagcctggagaaccgccaccttaatcctcgcaggggtgagcttactgccggtctgccagtctagctccatgaggaagaccgattggctaccaatgaccgtagcggccatgggcgtgccgcccctcccactatttatctttaatttaaaggacacgctgaaaagacgcagctggcccctgaatgagggggtcatggccgtgggactcgtgagcatactggctagctccctgctccggaatgacgtccctatggccggccccctggtggccggagggctgctcatagcgtgctatgtaatcacgggaacgagcgccgatctgaccgtcgagaaggctgccgacgttacatgggaggaggaggccgagcagaccggcgtgagtcacaatcttatgatcaccgttgacgacgacgggacgatgcgcataaaagacgacgaaaccgaaaacatcttgactgtgctgctgaaaacggcgctccttatagtgagcggcatcttcccgtactctatacctgccacacttctcgtctggcatacctggcaaaagcaaacccagcggagcggcgtgctttgggacgtgccgagcccgcccgaaacccagaaagccgaactggaggaaggggtctaccgcattaagcagcagggcatcttcgggaagacccaagtgggagtgggggtacagaaggagggggttttccatacgatgtggcacgtgacgcgtggcgcggtgctcacgtataacgggaaacggctagagcctaactgggccagcgtgaagaaagacctgatatcctacggcgggggctggcggctcagcgcccagtggcaaaagggggaggaagtacaggttattgcggtggagcccggcaagaaccccaagaacttccaaaccatgcccggcaccttccagacaaccaccggggaaatcggcgccatagctcttgacttcaagccaggtacctccggcagccccatcatcaatcgcgaaggcaaggtcgtcgggctttacggaaacggggtggtgacaaagaacggcgggtacgtctcgggtatagcccaaacgaatgctgagcccgatgggccaacccccgagcttgaagaggaaatgtttaaaaagcggaatctcaccatcatggaccttcatccggggagcggtaagacccgcaagtacctgcctgcaatcgtgcgggaggcgatcaagcgccggctacgaacactgatactcgctccaactcgagtggtcgcagccgagatggaggaggcactcaaggggctccccattcgataccagaccaccgcgaccaagagcgagcacacaggccgcgagattgtggacctgatgtgccatgcaacattcacaatgcgcctcctatcccccgtgcgggtcccgaattacaacctgattatcatggacgaagcacacttcaccgaccccgccagcatcgccgcgcgcgggtacatcagcaccagggtgggtatgggggaggctgctgctatctttatgacggcaaccccaccggggaccgcagacgcttttccgcaaagcaacgcccctatccaggacgaggagcgcgacattcccgagaggagctggaacagtggtaatgaatggatcaccgatttcgcggggaaaaccgtgtggttcgtcccttccatcaaggcggggaatgacatcgctaattgcctaaggaagaacgggaagaaagtgatccagctaagccgcaagacgttcgacactgagtaccagaaaaccaagctgaatgactgggacttcgttgtgacgacggatatttctgagatgggtgccaacttcaaggctgaccgggtcatcgacccgagacggtgcttaaaacccgtgattctgaccgacggccccgagagggtcatcctcgccgggccgatgccggtaaccgctgctagtgccgcacaacggcgcggacgggtggggcgcaacccccagaaagagaatgaccaatacatttttactgggcagccactcaacaacgacgaggaccacgcccactggacagaggcaaagatgttgctcgataacatcaacacacccgaagggatcatcccggccttgttcgagccagagcgcgaaaaatccgccgctatcgacggcgagtaccgcctgaagggcgagagccggaaaacgttcgtggaactaatgcgccgcggcgatctccccgtgtggctggcccacaaggtcgcctcagaaggaatcaagtacacggaccgcaagtggtgcttcgacgggcagcggaacaaccagatacttgaggagaacatggacgtagagatctggaccaaggaaggcgaaaagaagaaactccgcccgcggtggctggacgctcgcacttactctgacccactcgcattgaaagagttcaaagacttcgccgcgggacggaagtccatcgcactggacctggtgactgagatcgggcgggtacccacgcacctagcccaccgaacccggaacgccctggacaacttggtgatgctccacacgtcagaacacggcgggaaggcttacaggcacgcggtggaggaactgcccgagacaatggaaacattacttctgctcggcctcatgatcctgttaaccggaggggctatgctgttcctcatctccggcaaggggatcggaaagacgagcataggcctgatatgcgttatcgtgagctcgggtatgctctggatggccgagatcccgctgcagtggatcgccagcgccatcgtgctcgagtttttcatgatggtcttgctgatccccgaacccgaaaagcagcggacgccacaggacaaccaactggcgtacgtggtgataggtatcctaactctggccgcgatcatagcggcgaatgagatgggcctgctcgagaccacaaaacgcgatctcggcatgtctaaagaaccgggggtcgtgagccccacctcatacctggacgtggacttacaccctgcaagcgcctggacactgtacgcagtagcaaccacggtgatcactccaatgctgcgacacacaatcgagaactcaaccgcgaatgttagcttagccgccatcgcgaaccaggccgtcgtcttgatgggtctcgacaaggggtggccaatatcaaaaatggacctcggcgtacccctgctggcgttaggctgctacagccaggtcaatcccctaactctgaccgctgccgtgctgctgctgattacccactacgctatcatcggccccggactccaagcgaaggcgaccagggaggcgcagaagcggacggccgccgggatcatgaagaacccgacggtagacggaatcatgaccatcgacctggacccggttatctatgactcaaagttcgaaaaacagctcgggcaagtgatgcttctggtgctgtgtgccgtccagctcctgctcatgcgcaccagctgggcgctctgcgaagcattaacgttagccaccggccccatcaccactctctgggagggctccccagggaagttctggaacacgaccatagccgtgagcatggcgaacatcttccggggctcatacctagcaggggcgggtcttgcgttcagcatcatgaagtccgtgggtaccggaaaacgcggcaccggctcgcagggcgaaaccctcggggaaaaatggaaaaagaaacttaaccagctgtcccgcaaggagttcgacttatacaagaagtccggcatcacggaagtagaccgcaccgaggcgaaggaggggttgaagcggggcgagatcacgcatcacgcggtgagccggggctcagccaagctgcagtggttcgtggagcggaacatggtgatcccggagggacgcgttatcgacttaggctgcggaagaggcgggtggagctactattgcgctggcctgaaaaaggtcaccgaggtacgcggctacacgaagggagggcccggtcacgaggagccagtgcccatgtccacttacggctggaacatcgtgaagttaatgagcgggaaggatgtattctacctaccgcccgagaagtgcgataccttgctatgcgacataggcgagtcaagcccctcccctaccgtggaggagagccggacgatccgcgttctgaagatggtcgagccgtggctgaaaaataaccagttctgcattaaggtgctaaacccatacatgccaactgtcatcgagcacctggagaggctccagcggaagcacggcggaatgctggtccggaaccctctctcacggaacagcacccacgaaatgtactggatcagcaacggcagcgggaacatcgtggccagcgtaaacatggtcagccgcctcctcctgaaccggttcaccatgacgcaccgccggccaaccatcgagaaggacgtagacctcggagctgggacccgacacgtgaatgcggagcccgagacccccaacatggacgtgatcggggagcggattaaaagaatcaaagaggagcacaactccacgtggcactacgacgacgaaaacccctacaaaacctgggcctaccacggatcgtacgaggtgaaagccactgggagtgcgtctagcatgatcaacggtgtcgttaagttgctgaccaagccctgggacgtggtaccgatggtgacgcagatggccatgacagacactaccccattcggacagcagagagtattcaaagaaaaagtcgatacgcgaacaccgcggagcatgcccggcactcgacgggtgatgggcataaccgcggagtggctctggaggacgctggggagaaacaagaagccccgcctgtgcacccgggaggaatttactaagaaggttcgcactaatgccgccatgggcgcagtcttcaccgaggagaaccagtgggacagtgcaaaggcagccgtggaagacgaggacttttggaaattagtggaccgcgaacgggagttacacaaattaggtaaatgtggcagctgcgtgtacaatatgatgggtaagcgcgagaaaaagctcggcgagtttggcaaggcgaagggctcgagagccatctggtatatgtggttgggagcaaggtacctggagttcgaggcacttgggttcttgaacgaggatcactggttttcccgggaaaactcatactccggcgtggagggggagggcttacataagctcggctacatcttacgtgacatcagcaagatccccggtggagccatgtatgctgacgatacggcggggtgggacacaagaatcacggaggatgacctgcacaacgaggagaagatcacgcagcagatggacccggagcatcgccaactcgccaatgcaatcttcaagctgacctatcaaaacaaggttgtcaaagtgcagcggcccacccccacgggcaccgtgatggacattatctcccgcaaggaccagaggggtagcgggcaggtaggcacttatgggctgaacaccttcaccaatatggaggcgcagcttatccgccaaatggagggtgagggggtgctgagtaaggcagacctggaaaacccccacttaccagagaagaagatcacgcagtggctcgagacgaaaggagtcgagcggctaaagcgcatggccataagtggcgacgactgcgtggtaaagccaatcgacgacagattcgcgaacgccctcctggctctgaatgacatggggaaagtgcgcaaggacatccctcaatggcagccttcgaagggctggcacgactggcagcaggttcccttctgcagccatcacttccacgagctgatcatgaaggatgggcggaagctggtagtaccctgccgcccgcaggatgagctgatcggccgagcccgcatctcccaaggggcgggctggagtttgagggagactgcgtgtcttggcaaggcttacgcccagatgtggtcactaatgtacttccaccgacgggacctccggctcgcgtctaatgcgatatgctccgccgttcccgtacattgggtgccgacctcccgcaccacatggtccatccatgcccaccaccaatggatgaccaccgaggacatgctgaccgtatggaacagggtctggatcgaggacaatccctggatggaggataaaacgcccgtgacaacctgggagaatgtgccctacctcggcaagcgtgaggaccaatggtgtgggagcctgatcggactgactagccgggccacgtgggctcagaatatcccgaccgcgatccaacaagtgcgcagcctgatcggtaacgaagagttcctagattacatgccttccatgaaacggttccgcaaggaggaagagtccgagggggccatctggtag

SEQ ID NO: 26066 - RNA, 9873 nt, synthetic construct
  misc_feature 1..9873: note = derived and/or modified CDS sequence (opt11) from DENV-3__FJ639804__SS-prME
  source 1..9873: mol_type = other RNA
accagcctgtgcttaatgatgattctgcccgccgccctggcgttccacctgacctcccgagacggggagccccggatgatcgtcggtaaaaacgaacggggcaagtctctgctgttcaagaccgccagcgggatcaacatgtgcacactcatcgccatggatctgggggagatgtgcgatgacaccgtgacctacaagtgcccgcacatcaccgaggtcgagcccgaggacatcgactgctggtgtaacctgaccagtacctgggtcacctacgggacgtgtaaccaggccggcgagcaccggcgtgacaagcggtccgtggcccttgcaccccatgtgggcatgggtttagacacccgcacccagacatggatgagcgccgagggcgcctggcgccaggtggagaaggtagagacgtgggccctgcgccaccccgggttcaccatcttagcgttattcctggcccactacattggcacctcactcacccaaaaggtggtgatcttcatcctgttgatgctcgttacgcccagcatgaccatgcggtgcgtgggggtgggcaaccgcgatttcgtcgagggcctgtcaggggccacctgggtggacgttgtgttggagcacggcggctgcgttaccacgatggccaagaacaagcccaccttggacatcgagctgcaaaagaccgaggccacccagctggcaacgctccggaagctgtgcatagagggcaagattaccaatataacaaccgacagtaggtgcccgacacagggtgaggccgtgctgcccgaggagcaggaccagaactacgtctgcaagcacacctacgtggaccggggctggggcaacgggtgcggcctcttcgggaaggggtccctggtaacctgcgccaagtttcagtgcctggagcccatagagggcaaggtcgtgcagtacgagaacctcaagtatacagtgattatcaccgtccacaccggggaccagcatcaggtgggcaacgagacccagggggtcaccgccgagatcacgccccaggcctctaccaccgaggcgattctgcccgagtacgggacgctggggctcgagtgctccccgcgcaccggcctcgacttcaacgagatgatcctgctaactatgaagaataaggcctggatggtgcacaggcagtggttcttcgacctgcccctcccttggaccagcggcgccacaactgagactcccacctggaaccgcaaggagctcctggtgacgttcaagaacgcccacgccaagaagcaggaggtcgtcgtactggggtcacaggagggcgcgatgcacaccgccctcacgggggccaccgagatacagaactcaggagggacctccattttcgcaggccatctgaaatgccggctgaagatggacaagctagagcttaagggcatgagctacgccatgtgcaccaacacgtttgtcctgaagaaggaggtgagtgagacccagcatgggaccatcctcatcaaggtggaatacaagggcgaggacgtaccgtgcaagatccccttcagcaccgaggacgggcagggcaaggcacacaatggccgcctaatcacggccaaccccgtggtgaccaagaaggaagaacctgtgaacatcgaggccgagccgcccttcggggagagcaatatcgtgataggcatcggggacaacgccctaaagataaactggtataagaaaggctccagcatcggtaagatgttcgaggcgaccgccagaggggctcgccggatggctatcctgggcgacacagcttgggacttcgggtccgtgggcggggtcttaaacagcctgggcaagatggtgcaccagatctttgggtcagcatacacggcgctgttcagcggcgtgagctgggtcatgaagatcggcatcggggtcctcttaacgtggataggactgaacagcaagaacacaagtatgagcttctcctgcatcgcgattggtatcattaccttgtacctgggcgcggtggttcaggccgacatgggatgcgttatcaactggaagggcaaggagctgaagtgtggcagcgggattttcgtaacgaacgaggtccacacctggaccgagcagtacaagttccaggcggactcccccaagcggctcgcgaccgcgatcgccggcgcctgggagaacggggtgtgcggcatccgcagcactacccgcatggagaacctgctgtggaagcagatcgcgaacgagctcaactatattctgtgggagaacaacatcaagctgacggttgtcgtgggggacatcatcggcgtgctcgagcagggcaagcgcaccttgacgccgcagcctatggagttaaagtattcctggaagacctgggggaaggccaagatcgtcaccgccgagacccagaactcatcgttcatcatagacggtccgaatacgcccgagtgccccagcgcctcccgggcgtggaacgtgtgggaggtagaagactacgggttcggcgttttcaccactaacatctggctcaagctgcgcgaggtgtacacccagttgtgcgaccaccggctgatgagcgccgccgttaaggacgagcgcgctgttcacgcggacatgggttactggatcgagtcgcagaaaaatgggtcttggaagttagagaaggcgagcctgatagaggttaagacctgcacgtggccgaagtcccacaccctctggagcaatggcgtgttagagtccgacatgataatacccaagtccctggccggccctatatcccagcacaattaccggccgggctaccacacccagaccgccgggccctggcacctcggcaagctagagcttgacttcaactattgcgagggcacgaccgtagtaatcacggagaactgcgggaccaggggacccagcctccggacgaccaccgtgtctggaaagctaatccatgaatggtgctgtaggtcctgcacactgcccccgctccgatacatgggcgaggacgggtgctggtacggcatggagatcagacccatctccgagaaggaggagaacatggtcaagagcctggtatccgccggcagcggggaggtggataattttacgatgggcgtcctgtgcctcgccatcctgttcgaggaggtgatgcggggaaaatttggcaagaaacacatgatcgcgggggtgttcttcacgttcgtcttactattgtccggccaaataacctggagagacatggcccacacactgattatgatcggaagtaacgcatccgaccggatggggatgggagtgacgtacctcgccctgatcgccacattcaaaatccagcccttcttggcgctcggattctttttgcgcaagctgaccagccgggagaacttgctgctgggcgtgggcctcgccatggccaccacgctgcagctgccggaggatatcgaacagatggccaacgggatcgcgcttggcctgatggcactgaagctcatcacccagttcgagacctaccagctgtggaccgccctaatctcgttaacgtgctccaacaccatcttcaccctgaccgtcgcctggcgcacggccaccctgatcctcgcgggggtgagcctgctgccggtctgccagagttcctccatgcgcaagacggactggctccctatgaccgtggccgcaatgggtgtgccacccctcccgctgttcatttttagcctcaaggatacgctgaagcgccgctcctggccgttaaacgagggggtgatggccgtcggcctggtgagcatcctggcctccagcctgttgcgtaacgacgtccccatggcgggccccctagtagccgggggcctgttaatcgcttgctacgtgattaccgggacatccgccgacctgacagtcgagaaggccgcggacgtgacgtgggaggaggaagccgagcagaccggcgtgagccacaacctgatgataaccgtcgacgacgatgggaccatgcgcatcaaagacgacgagaccgagaacattcttacggtgctgttgaaaacggccctcctgatcgtgtccggcatctttccttactccatcccagctacccttctcgtctggcacacctggcagaagcagacgcagcggtccggtgtgctgtgggacgtgccaagcccgcccgagacccaaaaagccgagctggaagagggggtctaccggatcaagcagcagggcatctttggaaaatcccaggtgggcgtgggggtccaaaaggagggcgtgttccacaccatgtggcacgtgactcggggcgcggtcttaacgtacaacggtaagcgccttgagcccaactgggccagcgtgaagaaggacctgatctcctacggcgggggatggcggctcagcgcccagtggcagaaaggggaggaggtgcaggtcattgctgtggagcccgggaagaaccccaagaactttcaaaccatgcccggaacctttcagaccacgaccggggagatcggcgcaatcgccctggacttcaagcctgggaccagcggctcccccatcataaaccgcgaaggcaagatcgtcgggctgtacggcaacggggtcgtgaccaagaacggcgggtacgtgagcggcattgcccaaacgaacgccgagccggacggccccacacccgagttggaggaggagatgttcaagaaacggaacctcacgatcatggacctccaccccggatctggcaagacccgcaagtacctgccggccatcgtccgtgaggcgataaagcgccggctcagaacgctaatactggcaccaacccgggtggtggccgccgagatggaggaggccctcaaggggctacccatacgctaccagaccaccgctaccaagagtgagcatacgggccgggagatagtcgacctgatgtgccacgctaccttcaccatgcgtctcctctcccccgtacgtgtgccgaactacaacctgatcataatggacgaggcgcacttcacggatcccgctagcatcgccgcccgcgggtacatctccacccgggtcggtatgggcgaggccgctgccatcttcatgactgcgacgcctccagggacagccgacgccttcccgcagagcaacgcccccatccaggacgaggagagagacatccccgagcgatcctggaacagcggcaacgagtggatcaccgacttcgccgggaagaccgtgtggtttgtgccttccatcaaggcgggcaacgacatcgccaactgcctccggaaaaacgggaagaaagtcatccagctgagccgcaaaaccttcgacacggaataccagaaaacgaagctgaacgattgggactttgtggtgaccacggacatctccgaaatgggcgccaacttcaaggccgacagggtcattgacccgagacggtgcctgaagccagtcatattaacggacggccccgaacgagtgattctggccgggcccatgccggtcaccgcggccagtgccgcgcagcggcgcggtcgggtggggcgcaacccccaaaaggagaacgaccaatacatattcaccgggcaacccctcaataacgacgaagaccacgcccactggaccgaggcgaagatgctgctggacaacatcaacacccccgaggggatcatcccggccctcttcgagcccgagcgggagaagtccgccgccattgacggcgaataccgcctcaagggcgaaagccggaagacgttcgttgagctgatgcgcagaggggacctacccgtttggctcgcgcataaggtggcctcagagggcatcaagtacacagaccgcaaatggtgcttcgacgggcagaggaacaaccagatactggaggagaacatggatgttgagatatggacaaaagagggcgaaaagaaaaagctacgcccccgctggctggacgcgcgcacatactcagacccgctggccctcaaggagttcaaggacttcgccgcgggccgaaagagcattgccctggacctggtcacggagatcggacgggtgcccacccatctcgcccaccgcacgcggaatgcccttgataacctggtgatgctccacaccagcgagcacggcgggaaggcctaccgccacgcagtggaggagctgcccgagacgatggagaccctgctcctgctgggtctcatgatcctgctgaccggaggggcgatgctgttcctgatctccggtaagggaatcggtaagacttctattgggttgatctgcgtcatcgcctcgtctggcatgctgtggatggccgagatcccgctgcaatggatcgccagcgcaatcgtcctggagttctttatgatggtgctgctgatccccgagcccgagaagcagcggacgccccaggacaaccaactggcctacgtcgtgatcgggatcctgaccctggccgccacgattgccgcgaacgagatgggccttctcgagaccacgaagcgcgacctgggcatgtccaaggagccgggagtagtgtccccaacttcctacctggacgtagacctccaccctgcgagcgcctggacgctgtacgccgtggccacgacggtgataactcccatgttgcggcataccattgagaactctaccgccaacgtcagcctcgccgccatcgccaatcaagcggtagtgttaatgggccttgacaaggggtggccgatctccaaaatggacctaggggtccccctgctggcccttggctgctacagccaggtgaatcccctgacactgacggccgccgttctcctgctgataacccactacgcgatcatcggccccggtctccaggccaaagcgacccgcgaggcccaaaagcggacggcagcggggatcatgaagaacccgaccgtggacggcatcatgaccatcgacctggaccctgtcatctacgactccaagttcgagaagcagttaggccaggtgatgctcctggtcctgtgcgcggtgcagctcctcttaatgcgcacgagctgggccctctgtgaagccctcacgctggccaccggccccatcaccaccctctgggaaggctcccccgggaagttctggaacacaaccatcgcagtgagcatggccaacatcttccggggctcctacctggccggggcaggcctggcctttagcatcatgaaatcagtcgggaccggcaagcgcggcaccgggagccagggcgaaacactcggggaaaagtggaagaagaagctgaaccagctgagccggaaagagttcgacctctacaagaaatccggcatcacggaagtggatcgtaccgaggcgaaggaagggctgaagcgaggagagatcacccaccatgcggttagccgcggctctgccaagctgcaatggttcgtcgagcgtaacatggtgatccccgaggggcgcgtgatcgacctcggctgcgggcgcggcggttggtcttactactgcgccggcctgaagaaggttaccgaggtgcgcggatatacgaagggcggccccggtcacgaggaacctgtgcccatgtccacctatggctggaacatcgtcaagctgatgagcgggaaggatgtgttctacctcccaccagagaagtgcgacaccctgctgtgcgacattggtgagtctagcccctctcccaccgtcgaggagagccggaccatccgcgtcctgaaaatggtggagccgtggctgaagaacaaccagttctgcatcaaggtactaaacccctacatgcccaccgtcatcgaacatctggagcgcttgcagcgcaagcacggcggcatgctggtgagaaatccgctgtcgcgaaacagcacccacgaaatgtactggatctccaacggcaccgggaacatcgtagccagcgtgaacatggtgagtcgtctcctgctgaaccggttcacgatgacctacaggcgtccgacgatagagaaggacgtggatctcggggcgggcacccgccacgttaacgccgagcccgagacgcccaacatggacgtgatcggggagcgcatcgagaggatcaaggaggaacacaacagcacctggcactacgacgacgagaacccgtacaagacctgggcctatcacggctcatacgaggtcaaggccaccggctcggcctccagcatgataaacggcgtcgttaagctgttaacgaaaccctgggacgtagttcccatggtgacccagatggcgatgactgacaccacgcctttcgggcagcagcgggttttcaaggagaaggtggacacccggattccgcggagcatgccgggaacccggcgggtgatgggcatcaccgccgagtggctctggcgcacgctggggcggaacaagaagccccgcctatgcactcgggaggagttcaccaagaaggtccgcaccaacgccgccatgggcgcggtatttactgaggagaaccagtgggactcagccaaagcggccgttgaggacgaggacttctggaagctggtcgaccgcgaacgggaactgcacaagttaggcaagtgcggctcgtgcgtgtacaatatgatgggtaagcgcgagaagaagctcggcgagttcggcaaggctaaagggtcccgggcgatatggtacatgtggctgggcgctcgttacctcgagtttgaggccctcgggttcttgaacgaggaccactggttctcacgggaaaactcgtacagcggcgtggagggtgagggcctgcacaagctcgggtacatcctgcgcgacatttccaagatccccgggggcgctatgtatgccgacgacactgcggggtgggacacgcggatcaccgaggatgacctgcacaacgaggagaagatcacccagcagatggacccggaacaccgccagctcgccaacgccatatttaagctgacatatcagaataaggtagtgaaggtgcagcggcccacccccaccggaaccgtcatggacatcatcagccgcaaggaccagcggggctccggccaggtcggcacatacgggctgaacaccttcacgaacatggaggcccagttaatccgccagatggagggcgaaggggtgctgagcaaggctgacctggagaacccccatcttccggaaaagaagatcacccagtggctggagacgaagggcgtcgaacggctgcgcaggatggcgatctccggcgacgactgtgtggtgaagcccatcgacgaccgcttcgccaacgccctcctggcgctgaacgacatggggaaagtccggaaggacatcccccagtggcagcccagcaagggctggcacgactggcaacaggtcccgttctgctcacaccacttccatgaactcattatgaaggacggacgcaaactcgtggtcccctgccggccccaggacgagttgatcggccgcgcccgtatcagccagggggcgggctggtccctccgcgagaccgcctgcctggggaaagcctatgcgcagatgtggagtctaatgtacttccatcgacgcgacctgcgcctggcgtccaacgctatctgtagcgccgtgcccgtacactgggtcccgacctcccggaccacgtggagcatccatgcccaccatcagtggatgaccacagaggacatgctgaccgtgtggaaccgcgtgtggatcgaggacaacccctggatggaggacaagacacccgttaccacctgggagaacgtgccctacctggggaagcgggaggaccagtggtgcgggtcactgatcgggctgacgtcccgcgccacgtgggcgcagaatatcccgacagccatccagcaggtccggagcctcatcgggaatgaggaatttctggactacatgcccagtatgaagcgtttccggaaggaggaggagagcgaaggggccatttggtga

SEQ ID NO: 26067 - RNA, 9873 nt, synthetic construct
  misc_feature 1..9873: note = derived and/or modified CDS sequence (opt11) from DENV-3__FJ639805__SS-prME
  source 1..9873: mol_type = other RNA
accagcctgtgcttaatgatgatcctgcccgccgccctggcgtttcacctcacctccagggacggggagccgcggatgatagtagggaaaaacgagcgcggcaagagcctgctgtttaagaccgcctccgggatcaatatgtgcaccttgatcgccatggacttgggcgagatgtgcgacgacaccgtaacctacaagtgccctcacatcaccgaggtagagcccgaggacatcgactgctggtgtaacctgaccagcacttgggtgacttacggtacttgcaaccaggccggtgagcaccgaagggacaagcggtccgtcgccctcgcgccccatgtgggtatggggctcgacacccgcacccagacatggatgagcgccgagggcgcatggcgccaggtggagaaggttgagacgtgggccctgaggcacccggggttcaccatcttagcactgttcctggcccactacataggcacatcgctcacccagaaggtggtgatcttcatcctgctgatgctcgtgacgccctctatgaccatgcggtgcgtgggggttggtaaccgtgacttcgtggagggcctgtccggggctacctgggtggatgtggtcctggagcacggcggttgcgtgaccacaatggccaagaacaagcccaccctcgacatcgaactccaaaagaccgaggccacacagctggcgacactccgaaagctctgtattgagggcaagataaccaatatcacaactgacagccgatgccccacgcaaggagaggctgtgctgccggaggagcaagaccagaattacgtgtgcaaacacacgtacgtcgaccgggggtggggcaacgggtgcggcctcttcgggaaggggtccttggttacctgcgccaaattccagtgcttagaacccatcgagggtaaggtcgtgcagtacgaaaacctcaagtataccgtgatcatcactgtgcatactggggaccagcatcaggtgggcaacgagacccagggagtcaccgccgagatcacgccccaggccagcaccactgaggcgattctccccgagtatggcaccttaggactggagtgctccccgcgcaccggcctagactttaatgaaatgatcctgctcacgatgaagaacaaagcgtggatggtgcaccggcagtggttcttcgaccttcccctgccctggactagcggtgcgaccaccgagacacctacgtggaaccggaaggaactactggtgacgttcaagaacgcacacgccaagaagcaggaagtcgtggtgctgggatcccaggagggcgcgatgcacaccgcgctcaccggggcgaccgagatccaaaatagcggcggcacatccatcttcgcgggccacctgaagtgccggttaaagatggacaagctcgaactgaagggcatgagctacgctatgtgcaccaatacgttcgtactgaagaaggaggtgtccgagactcagcacgggaccatcctcatcaaggtggagtacaagggggaggacgtgccgtgcaaaatcccgttttcaacggaggacgggcaaggaaaggctcacaacggccgcctgatcacggctaacccggtcgtgaccaagaaggaggagcctgtcaacatcgaggccgagccgcctttcggggagagcaacattgtcatcggcatcggggacaacgcgctgaaaatcaattggtacaagaaaggatccagcataggtaagatgttcgaggcgaccgcgcggggcgcccgacggatggccatcctgggcgacaccgcctgggacttcgggagcgtgggcggggtcctgaactcgctcggaaagatggtgcatcagatctttgggtccgcatacacggctttgttcagcggcgtttcctgggtcatgaaaatcggcatcggggtgctcctgacctggatcggcctgaacagtaaaaacacctccatgagtttctcctgcattgccatcggcatcatcaccctttacctgggcgccgtggtccaggcagacatggggtgcgtgattaactggaaaggcaaagagctgaagtgcggcagcgggatcttcgtgacgaacgaagtccacacctggaccgaacagtacaagttccaggcggactcgccgaagcgcctggcgaccgccatcgcgggcgcctgggagaacggggtgtgcggaatccgatccacgacgcggatggaaaacctgttgtggaagcaaatcgcgaatgagctcaactacatactgtgggagaataacatcaagctcactgtagtggtcggggacatcatcggcgtgctcgagcaaggcaagcgcacgttaacaccccagccgatggaactgaagtactcctggaagacctgggggaaagctaagatcgtcaccgccgagacccagaacagctcgtttataatcgacggccccaatactccggagtgcccctccgcttcccgggcttggaatgtatgggaggtggaggactacgggtttggagtcttcactaccaacatctggctcaagctgcgagaggtgtacacccagctatgcgaccaccggctaatgagtgccgccgtaaaggacgagcgagctgttcacgccgacatgggctactggatcgagagccagaaaaacggttcatggaaactggagaaagcgagcctaatagaggtgaagacatgcacgtggccgaagagtcacaccctctggagcaacggcgtgctggagtccgacatgattatcccgaagagcctggccgggcccatttcccagcacaactaccgcccgggttatcacacgcagaccgcagggccctggcatctcgggaagctcgagctggacttcaactattgcgagggcacgaccgtcgtgatcaccgaaaactgtgggacccgcggcccctcgctccggaccaccacggtgagtggcaagctaatccacgagtggtgctgccgcagctgcacactgcccccgctccggtacatgggtgaggacggttgctggtatggaatggaaattcgacccatcagcgaaaaggaggaaaacatggtcaagtcactggtgtccgccggcagcggtgaggtagataacttcacgatgggcgtcctgtgccttgccatccttttcgaggaggtcatgagagggaagtttggcaagaagcacatgatagcgggggtattccttaccttcgtcctccttctgtccggccagataacctggcgcgatatggctcacacgctcatcatgataggtagtaacgcctccgaccggatgggcatgggcgtgacatacctggccctgatcgccacgtttaagatccagcccttcttggcgctgggcttcttcttgcgcaagctgaccagccgggagaacttgctgctcggcgtgggcctagccatggcaaccacgcttcagctccccgaggacatcgagcagatggccaacggaattgcgctgggccttatggccctcaagctgataacccagttcgagacctatcagctgtggaccgccctcatctccctgacgtgctccaacactatcttcaccctcaccgtcgcctggcggactgcgaccctcatactggcgggggtaagcctgctcccggtgtgccagtcctcgtcaatgcggaaaaccgactggctgcctatgaccgtggccgccatgggcgtgccgcccctgcccctgttcatctttaacctgaaggacacgctgcgccgccggagctggcccctcaacgaaggggtcatggcagtgggcctcgtgagcattctggccagcagtctacttcgcaacgacgtccccatggcgggccccctggtggccgggggcctcctaatcgcatgctacgtgatcacggggaccagcgccgacctgactgttgaaaaggcagcagacgtgacatgggaggaggaggccgagcagacaggcgtctcccacaacttgatgataacggttgacgatgacgggaccatgcggatcaaagacgacgagaccgagaacatcctgacggtcctgctcaaaaccgccctgctgattgtgagcggcatctttccctattccatcccagccacgctcctggtctggcatacctggcagaaacaaacccagaggtccggcgtcctgtgggacgtacccagccctcccgagacgcagaaggccgagctcgaggagggggtctaccggatcaagcagcagggcattttcgggaagactcaggtgggcgtgggggtccagaaggagggtgtgtttcacaccatgtggcatgtgacgcgcggcgctgtcctcacctataatgggaagcggctcgagcccaattgggcgagcgtaaagaaggacctcatctcctacgggggcggctggcgcttaagcgctcagtggcaaaagggggaggaagtgcaagtcatcgccgtggagcccgggaagaaccccaagaacttccagaccatgcccggcacattccagactaccaccggagagataggcgcgatcgcactggacttcaagccagggacctctgggagccccatcatcaaccgggagggtaaggtggtcgggctctacggcaacggggtggtgacgaagaacggaggctacgtcagcgggattgcccagaccaacgccgaaccggacggccccacccccgagctagaggaggagatgttcaagaagcgcaacctgactattatggacctacaccccgggtccggcaagacgcggaagtacctccctgcaatcgtgcgggaggcgatcaagcggcgcctgcggaccctgatactcgcccccacccgcgtggtcgccgccgagatggaagaagccctcaagggactgcccatccggtaccagaccacggcgaccaagagcgagcacactggccgggaaatcgtggacctcatgtgtcacgccaccttcacgatgcggctgctctcccccgttcgcgtcccgaactataacttgatcatcatggacgaggcccacttcaccgaccccgccagcatcgcggctcgcggttacatcagcacacgtgtaggcatgggggaggccgccgccatattcatgaccgcgacgccgcccggaaccgccgacgcctttccgcaaagcaacgccccaatccaggatgaggaacgcgacatccccgagcgcagctggaacagtggcaacgagtggatcaccgatttcgccgggaaaaccgtgtggttcgtcccctccatcaaggcgggaaacgacatcgccaactgcctgcgcaagaacgggaagaaggtgatacagctgtcccgcaagacgttcgatactgagtaccaaaagaccaagctcaacgactgggacttcgtagtcaccacggacatatccgagatgggcgccaactttaaggccgatcgcgtgatcgacccgcggcgatgcctaaagcccgttatcttaaccgacgggcctgagcgggtcatcctagccgggccgatgcctgtgaccgcagccagcgccgcccaacgccggggcagggtcggtcgaaacccccagaaggagaatgaccaatacatcttcaccggccagcccctgaacaacgacgaagatcacgcccactggaccgaggcgaagatgctgctcgacaacatcaacacgcctgaggggatcatcccggccttgttcgagcccgagcgcgagaagtccgccgctatcgacggggagtaccggctgaagggcgagagccgcaagacctttgtcgagctgatgcggcgcggtgacctccccgtgtggctggcgcacaaggtagcctccgagggtatcaagtacaccgaccggaagtggtgcttcgacgggcagcgcaataaccagatcctcgaggagaacatggacgtggagatctggaccaaggaaggcgagaaaaagaagctgcggccccgctggttggacgcccgcacgtacagtgacccgctcgcgcttaaggagttcaaggatttcgccgcaggccggaagtccatcgcgctggacctcgtcaccgagatagggcgcgtcccgacccacctggcccaccggaccaggaacgcactggataacctcgtgatgctgcacacgagtgagcacggcgggaaggcttacaggcacgcggtggaggagctgcccgagaccatggagactctcctgctgctcggacttatgatcctgctcaccgggggggccatgctgttcctgatctcagggaaggggttgggcaagacgtctatcgggctgatttgcgtcatcgctagcagcggcatgctatggatggcggagatcccgctccagtggattgcctctgcgattgtgctggaattctttatgatggtgttacttatccccgagcccgagaagcagcgcacgccccaggacaaccagcttgcctacgttgttatcgggattctgaccctagcagctatcattgccgcgaacgagatgggcctgctggagaccacgaaacgtgacctcggcatgtccaaagaaccgggggtggtgagccccacctcctacctggacgtggacctgcaccctgccagcgcctggacgctttacgccgtggctaccacggtcataacccccatgctgcgccacacaatagagaactcgaccgcgaacgtgagcttagccgccatcgccaaccaggcggtggtattaatgggcctggacaagggttggccgatctccaagatggatctgggcgttcccctcctggcgctggggtgttacagccaagtcaaccctctcacgctaaccgctgccgtccttctcttaataacccactacgcaattatcggaccgggactgcaggcaaaggccacccgtgaagcccagaagcgcacggcagcgggtatcatgaagaacccgacggttgacggcatcatgaccatcgacttggaccccgtgatctacgactccaagtttgaaaagcaactcgggcaggtcatgctgctcgtgttatgcgcggtgcagttactcctgatgcgaacaagttgggccctgtgcgaggcgctcacgctcgcaacgggtcccatcacgacactgtgggagggctcgcccgggaagttctggaacaccaccatcgcggtcagcatggctaacatcttccggggctcctacttggccggggccggcctggccttcagcatcatgaagtcggtggggaccggcaaacggggcaccgggtcgcaaggtgagaccctcggtgagaaatggaaaaagaagttaaaccaactatcccgcaaagagttcgacctgtacaagaagagtggcatcactgaggtagatcggaccgaggctaaggaggggctcaaacgaggagagatcacgcaccacgccgtcagccgaggctccgccaagctgcagtggttcgtggagcgcaacatggtcatccccgagggacgggtcatcgatctgggctgcggtagaggcgggtggagctactactgcgccgggctcaagaaggtgaccgaggtgcggggctacacgaaaggcgggccgggtcacgaggagcccgtgcccatgagcacctacggctggaacatcgttaagctcatgagcggcaaggacgtgttttatctgccgccggagaagtgcgacaccctcctttgcgacatcggagagtcctctccctcccccaccgtcgaggagagccgtacgatccgcgtgctgaaaatggtggagccgtggctaaaaaacaaccaattctgcatcaaggtcctcaatccatatatgcccactgtgatcgagcatctggagcgcctgcagcgcaagcacggagggatgctcgtccggaaccccctgtcccgcaacagcacgcacgagatgtactggatctccaacggcacaggtaacatcgtcgccagcgtgaatatggtctcacgacttctcctgaaccgctttacaatgacccaccggcgaccaaccatcgagaaggacgtcgacctgggcgcaggcacccggcacgtcaacgccgaacccgaaacgcccaacatggacgtgataggcgagcgaatcaagcgaatcaaggaggagcacaacagcacctggcattacgacgatgaaaacccctacaagacttgggcctatcacggcagctatgaggtcaaggccaccggctctgcctcctccatgattaacggcgtcgtcaagctcctcacgaaaccctgggacgtcgtccccatggttatccagatggctatgaccgacaccacacccttcgggcaacagcgcgtgttcaaagagaaggtggacacgcggaccccgcgctcaatgccgggcaccaggcgcgtcatgggcattaccgccgaatggctgtggcggacgctggggcggaataagaagccccgtctgtgcacccgcgaagagttcaccaaaaaggtgcgcactaacgccgccatgggcgctgtgttcacggaagaaaaccagtgggactccgccaaggctgctgttgaggacgaggacttctggaagctggtggaccgggagcgcgagctccacaagctggggaagtgcggatcgtgcgtgtacaatatgatgggaaagcgggagaagaagctgggagagttcggcaaggccaaggggagccgcgcgatctggtacatgtggctcggcgcccggtatcttgagttcgaggccttagggttcttgaacgaggaccattggtttagccgcgagaactcgtacagcggcgtcgagggggagggtctacacaagctgggttacattcttcgagacatctccaaaatacccgggggggccatgtacgccgatgacaccgcggggtgggatactaggatcactgaggatgacctgcacaacgaggagaaaatcacgcagcagatggatcctgagcaccggcagctggccaacgccattttcaagctcacctaccagaataaggtcgtgaaggtgcagcgccccaccccaaccggcactgtgatggacatcataagcaggaaggaccagcgcgggtccggccaggtgggcacttacgggctgaacacctttaccaacatggaggcccagcttatccggcagatggagggcgagggagtgttgagcaaggccgacctggagaacccccacctcccggagaaaaagatcacccagtggctcgagaccaagggggtggagagactgaagcgtatggcgatctcaggcgacgactgcgtggtcaagcccattgatgaccggttcgccaatgccctcctagccctaaatgacatggggaaggtgcggaaggacatcccccagtggcagcccagcaagggctggcatgactggcagcaagtcccgttctgctcccaccactttcacgagctgatcatgaaggacggacgcaagttggtggtgccctgcaggccacaggacgagctgatcggccgcgcccggatcagccagggggcgggctggtccctgcgcgagaccgcctgcctcggcaaagcatacgcccagatgtggagtttaatgtacttccaccgcagggacctgcgcctcgcttccaacgccatatgcagcgccgtgcccgttcactgggtgccgacttcccggaccacgtggagcatccacgcccaccaccaatggatgaccaccgaggacatgctaacagtctggaaccgcgtctggatcgaggacaacccgtggatggaggacaagacacccgtaaccacctgggaaaacgtgccctacctggggaagcgggaggaccagtggtgcggctccctcatcgggctcaccagccgcgccacgtgggcgcaaaacatcccgaccgccatacaacaggtccggagtctgattggcaacgaggagttcttggactacatgccctccatgaagcgcttcaggaaggaggaggagagcgagggggcgatctggtaa

SEQ ID NO: 26068 - RNA, 9873 nt, synthetic construct
  misc_feature 1..9873: note = derived and/or modified CDS sequence (opt11) from DENV-3__FJ639807__SS-prME
  source 1..9873: mol_type = other RNA
acctcactctgcctcatgatgatcctacccgccgccctggcgttccatctcacctctcgggacggcgaaccccggatgatcgtagggaaaaacgagcggggcaagagcctgctgtttaaaaccgccagcggcatcaatatgtgtaccctcatcgcaatggatctgggcgaaatgtgcgacgacaccgtgacctataagtgcccccacatcaccgaggtagaacccgaggacatcgactgctggtgcaacttgaccagcacctgggtgacttacggcacgtgcaaccaagccggcgagcaccggcgcgacaaacggagcgtcgcactcgctcctcacgtgggtatggggctggacacccgcacccagacctggatgagtgcagagggcgcttggcgccaggtggagaaggtggaaacttgggccctccggcaccctgggttcaccatcctggccctcttcctggcccactatatcggcacctccctcacgcagaaggtggtcatctttatcctgctgatgttggtaacgcccagcatgaccatgcggtgcgttggggttggcaaccgcgatttcgtcgagggcctgtcaggggcgacgtgggttgatgttgtgctcgagcacggtgggtgtgtgactactatggcgaagaacaagcccacactcgacatcgagcttcagaagaccgaagccacgcaactggcgacgctccgcaagctgtgcattgaaggcaaaatcaccaatataacgacagacagccgctgtcccacgcagggtgaggccgtgctaccagaggagcaggaccagaactacgtctgtaagcacacctatgtagaccgtgggtggggcaacgggtgcggactcttcgggaagggctccttggtaacctgcgcgaagttccagtgtctggagcccatcgaggggaaggttgtgcagtacgagaacttgaagtacaccgttattatcacggtccatacgggggaccagcaccaggttgggaatgaaacgcagggggtcaccgccgaaattacgccccaggctagcaccaccgaggcgatcctgcccgagtacggcacgttggggctcgagtgttccccacgaaccggtctggacttcaacgagatgatcctgctcacgatgaagaataaggcctggatggtgcaccggcagtggttctttgatttacccttaccctggaccagcggcgccacgactgagacgcccacctggaatcgcaaggagctcctggttacattcaaaaacgcccacgctaagaagcaggaggtcgtggtactggggtcccaggaaggggccatgcataccgccttgacgggggcaaccgagatacaaaacagcggtgggacaagtatcttcgccggccacctgaagtgccggttgaagatggacaagctggagctaaagggcatgagctacgccatgtgtactaacaccttcgtcctgaaaaaggaggtgtccgagacccagcacggcactatcctgattaaggtggagtacaagggcgaggacgtaccgtgcaagatccccttcagcaccgaggacgggcaaggaaaggcgcacaacgggcgcctgatcacggccaaccccgtggtgaccaagaaagaggagcccgtcaacatcgaggccgagcccccgttcggggagagcaacatcgtgatcggcatcggggacaatgccctgaagatcaactggtacaagaagggctccagtatcggcaagatgttcgaagcgaccgctcggggcgcgcgtagaatggcaatactgggggacaccgcctgggacttcggcagtgtcggcggggtcctcaacagcctgggcaagatggtgcaccagatcttcgggtcagcatacacggccttgttcagcggcgtgtcctgggtcatgaagataggcatcggggtactcctaacttggatcggcctgaacagcaaaaacacctccatgagcttctcttgcatcgccattggcatcatcacactttatctgggtgccgtcgtccaggcagacatggggtgcgtgatcaactggaaagggaaggagctaaagtgcggcagcgggatattcgtgacgaacgaggtgcacacctggaccgagcaatataaattccaggcggactccccaaagcgcctcgccaccgccatcgccggcgcatgggaaaacggggtatgtggcatccgctccacgactcggatggagaacctgctttggaagcaaatcgcaaacgagttaaactacattttatgggagaacaacataaagctgaccgtggtcgtgggggatacaatcggcgtccttgagcagggtaagcgcacgctcacgcctcagccgatggaactgaagtattcctggaagacatgggggaaggccaagatagttacggccgagacgcaaaattcttccttcataatcgacgggcccaacacccccgagtgccccagcgcctcgcgggcgtggaacgtgtgggaggtggaagactacgggttcggggtcttcaccaccaacatctggctcaagttgcgggaggtctacacccagttatgcgaccaccggttaatgagcgctgccgtcaaggacgagcgcgcggttcatgccgacatgggctattggatcgagtcgcagaaaaacgggtcatggaagctagaaaaagcgagcctgatcgaggtcaagacgtgtacctggccgaagtcccataccctgtggagcaatggcgttctagagtctgacatgattatccccaagagcctagccgggcccatctcccagcacaactaccggccgggttaccacacccaaacggccgggccctggcacctcggcaagctggagctggacttcaattattgcgaaggcaccaccgtcgtgataaccgagaactgcgggacccgaggcccgtcgctccgcaccaccaccgtgtctgggaagctgatccacgagtggtgctgcagaagctgtacgttacccccgcttcggtacatgggcgaagacgggtgttggtacgggatggagatccgccccatctctgagaaggaagagaacatggtcaagagcctggtctccgctgggagcggggaggtggataacttcaccatgggcgtcctatgtctggccattctgttcgaagaggtgatgcggggtaagttcggtaagaagcacatgatcgcaggggtattcttcacattcgtcttgctcttgtccggccagatcacatggcgagacatggcccacacgttaatcatgatcggaagcaacgcgtccgatcgaatggggatgggcgtgacctacctcgccctgatcgccaccttcaaaatccagcccttcctcgcgctcgggttctttctccgcaaacttactagccgagagaacttactgttgggcgtgggcctggcgatggccacgactctgcagctgcctgaggacattgagcagatggccaacggaatcgcgctcggcctgatggcactaaaactcatcacccagttcgagacttaccaactttggacggccctgatcagcctgacctgctccaacaccatcttcaccctgaccgtcgcatggcgcaccgccacattgatcttggccggggtgagcctgctgccggtctgccagagcagctctatgagaaagaccgactggctcccgatgacggtcgcagccatgggagtgcctcctctcccgctgtttatcttcagcctcaaggacaccctgaagcgccgttcctggcctttaaacgaaggggtcatggccgtaggactcgtgtcaatactggcgtccagcctcctccggaacgatgtccctatggctggacccctcgtggccgggggcctgctcatcgcctgctacgtaataaccgggaccagtgccgacctgaccgtcgagaaggccgcggacgttacatgggaggaggaggccgagcagaccggcgtgagccacaacctgatgatcaccgtagacgacgacgggacaatgcgcatcaaggacgacgaaacggagaacattctcaccgtgctgttaaagaccgccctcctgatcgtgtccggcatcttcccgtacagcatccccgcgactctcctagtctggcacacgtggcagaagcagacccaaaggtccggtgtgctttgggacgtaccctcgccgcccgagacccagaaggccgaattggaagagggtgtctaccgcatcaaacagcaggggatcttcgggaagacccaggtgggcgtgggtgtacagaaagagggcgtatttcacaccatgtggcacgtgacacgtggcgcggttttaacctacaacgggaagcgactggagcccaactgggcctccgtgaaaaaggacctgattagctacggcgggggatggcgcctctctgcccagtggcagaagggggaggaggttcaggtcatcgcagtggagcctggtaagaaccccaagaacttccagaccatgccaggcacgttccagaccaccactggggaaataggcgcgatcgccctggacttcaaacccgggacgagcggcagccctataattaaccgcgaaggcaaggtggtcgggctgtatggtaacggcgtcgtcaccaagaacggcggttatgtctccggaatagcgcagaccaacgccgagcccgacggcccgaccccagaactggaggaggaaatgttcaagaagcggaacttaactatcatggacctgcaccctgggagcggaaagacccgcaaatacctgccggcaatagtacgggaggccatcaagcgtcggctacgcaccctgattctggcacctacgagggttgtcgccgccgaaatggaggaagccttgaaggggctccccattcgttaccagacgactgctaccaagtccgagcacaccggacgggagatcgtagacctaatgtgccacgcaactttcaccatgcgcctcctatcgccggtgcgggtcccgaactacaacctaatcatcatggacgaggcccatttcaccgatccagcctccatcgcagcgcgcgggtacatttccaccagagtgggcatgggcgaggccgccgccatcttcatgacggcaacgccgcccgggaccgccgacgctttcccacaatccaatgctcccatccaggacgaagaacgcgacatccccgagcgcagctggaacagcggcaacgagtggattaccgattttgccgggaagacggtgtggttcgttccctcaatcaaggccggcaatgatatcgccaactgcctccggaaaaacgggaagaaggtcatccagctgtcccgaaaaacctttgacaccgagtatcagaaaaccaagttgaacgactgggacttcgtggtaacgactgacatcagcgagatgggagcgaacttcaaagcggaccgggttatcgacccccgccgctgcctcaagccagtgatcttaaccgatggtcccgagagagtcatcctggcggggcccatgcctgttaccgcggcctcagccgcccagcgccgtggccgggttgggaggaacccccagaaggagaacgaccagtatatcttcactggacaacccctcaacaacgatgaggaccacgcccattggacggaggcaaagatgctccttgacaacatcaacacccccgaaggcatcatccctgccctcttcgagcccgagcgagaaaaatccgccgccatcgacggcgagtaccgcctgaagggcgaatcacggaagacattcgtcgagctgatgaggcgcggggatctccctgtgtggttggcgcacaaagtcgcctccgagggcatcaagtacaccgaccggaagtggtgcttcgacgggcagcggaacaatcagatcctggaggagaatatggatgtagaaatctggacgaaggagggcgagaagaagaagctccgcccacgttggttagacgcccgaacctacagtgatccgctggccctaaaggaatttaaggactttgccgcgggccgcaagtctatcgccctggaccttgtgaccgagatcggaagggtccccacccacctggcgcatcgcacgcggaacgccctggacaacctggtcatgctccacacctccgagcacggcgggaaggcgtaccgccatgcggtggaggaactccccgagacaatggagactctgctcctcctagggctgatgatcttgctgacgggcggcgccatgctgttccttatctcgggaaaggggataggcaagaccagcatcgggttgatttgcgtcatcgcctcaagcgggatgctctggatggccgaaatccctctgcagtggatcgcctccgcaattgtcttggagttcttcatgatggtactcctaatacccgagcccgagaagcagcggacgccccaagacaatcagctcgcctacgtcgtgatcgggatccttaccctggccgcaacgatagccgcgaacgagatgggcctgttagagactactaagcgcgacctgggtatgagcaaagagccgggtgtagtctcccccactagctacctagacgtggacctccatcccgcgtccgcctggacactgtatgcagtggcgacaacggtcatcacccctatgctgcggcacacaatcgaaaacagcaccgccaatgtgtccttggccgcaattgccaaccaggcggtagtccttatggggctggacaaaggttggcccattagcaagatggacctcggggtgcccctgctcgcgctcgggtgctattctcaggttaaccccctgacacttactgcagccgttctcctccttatcacgcattacgccatcatcggccccggccttcaggcgaaggccacccgagaggcgcaaaagcgtactgcagccgggatcatgaaaaatcccaccgtggacggaataatgacgattgacttagaccccgtgatatacgacagcaagtttgagaagcagttaggacaggtcatgttgctggtgttgtgcgcggtacagctcctgttgatgcgaacctcatgggcgctttgcgaggcactcacgcttgccacgggccctatcacgaccttatgggagggcagtcccgggaagttctggaacaccaccatcgcggtgtcaatggccaacatcttccggggctcgtacctggcgggggccggcctagcattttccatcatgaagtccgtgggtaccggcaaaaggggcacggggtcccagggcgagactctcggagagaagtggaagaagcggttaaaccagttaagcaggaaagagttcgacttatacaagaagtctgggattaccgaggtggaccggaccgaggcgaaggaggggctgaagaggggcgagatcacgcaccatgccgtatcccgcggcagcgcgaaactgcaatggttcgtggagcgcaacatggtcatccccgaagggcgggtcatagatttaggttgcggccgcggagggtggtcctactactgcgccggcctgaagaaagtcaccgaggtgcggggctacaccaagggcgggcccggtcacgaggagcccgttcccatgagcacctatgggtggaacatcgtcaagctgatgtccgggaaggatgtgttctacctcccgcctgaaaagtgtgacacgctgctgtgcgacatcggcgagtcgtccccgagccctaccgtcgaggagtcccgcaccatacgcgtgctgaagatggtggagccgtggctcaagaacaaccagttctgcatcaaggtcctaaacccctacatgcctaccgtaatcgagcacttggagcggctccagaggaagcacggcggcatgctggttcggaatccgctgagccggaactcaacgcacgaaatgtactggatctctaacggcaccgggaatattgtcgcctccgtaaacatggtgtcgcggctcctgctgaaccgcttcaccatgacccatcggaggccgacgatcgagaaggacgtcgacctcggtgcgggcacccgacacgtaaatgctgagcccgagacacccaacatggatgtgatcggggagcgcataaagcggattaaggaggagcacaactccacgtggcactacgatgatgagaatccgtacaagacgtgggcctaccacggctcgtacgaagtcaaggccacagggtccgcgagcagcatgattaacggcgtggtaaagctgctgacgaagccgtgggacgtagtacccatggtcacgcagatggcgatgacggacacaaccccctttggacagcaacgcgtgttcaaggaaaaggtggacacgcgtaccccgcgcagcatgccgggcaccagacgcgtaatgggcataaccgcggagtggctctggcgtacactagggcgcaacaagaagccccggctgtgcacgcgcgaggagttcacaaagaaggtgcgaacaaatgccgctatgggagccgtgttcaccgaagagaaccagtgggacagtgccaaggccgccgtggaggacgaggatttctggaagctcgtggaccgggaaagggagctgcacaagctggggaagtgcggctcgtgcgtctacaacatgatgggtaagcgtgagaagaagctcggcgagttcggcaaggctaaagggagccgtgccatctggtacatgtggctcggcgcccgctacctcgaatttgaggccttagggttcctgaatgaggaccactggttttctcgcgaaaacagctacagcggcgtcgagggggagggcctgcacaagctcggttatatcctgcgggacatcagcaaaattcccgggggcgccatgtacgccgacgatacggcagggtgggacacccgcatcacggaggacgacctgcacaacgaggagaagatcacccaacagatggacccggaacaccggcagctcgccaacgcaatcttcaagctcacctaccagaataaggtggttaaggtccagcgccccacgcccacgggcacggtgatggacatcatctctagaaaggaccagcgaggcagcggccaggtgggcacctacgggctgaatacgttcaccaacatggaggcccagctcatccggcagatggagggagagggtgtgctttctaaggccgacctggagaacccccacttgcctgagaagaagattacccagtggctggagaccaagggcgtggaacgcctgaagcggatggctatctctggcgatgactgcgtggtcaaacccatcgacgatcgattcgctaacgccctcctggccctcaacgacatggggaaggttcggaaggacattccgcagtggcagccctccaaggggtggcacgactggcagcaggttcccttctgctctcaccattttcatgagttgataatgaaggatggccgtaagctggtcgtgccatgtcggccccaggacgagttgataggccgcgctcggatttcccaaggcgcgggctggagcctccgcgagacggcttgcctgggcaaagcctacgcccagatgtggtccctgatgtacttccatagacgggacttacgcttagcgagcaatgccatctgctcagccgtgcccgtgcattgggtcccgacaagccggaccacctggagcatccatgcccaccaccagtggatgacgaccgaggatatgctgaccgtgtggaacagagtgtggatcgaggataacccctggatggaggacaaaacccccgtaacgacttgggaaaacgttccctacctcggaaaacgggaggaccagtggtgcgggagcctgatcggactaaccagccgcgccacttgggcgcagaacataccaaccgccatccagcaggtccgatccctgatcgggaacgaggagttcctggactacatgccatcgatgaagcgcttccgtaaggaggaagaatccgagggagccatctggtga

SEQ ID NO: 26069 - RNA, 9873 nt, synthetic construct
  misc_feature 1..9873: note = derived and/or modified CDS sequence (opt11) from DENV-3__FJ639810__SS-prME
  source 1..9873: mol_type = other RNA
acctccttgtgtttaatgatgatcctacccgcagcgttggcattccacctaacctcaagagacggagagccgaggatgattgttggcaaaaacgaaaggggcaaaagcctactttttaaaactgcaagcggaataaacatgtgcacactcatcgccatggacctcggagaaatgtgcgacgacacggtgacctacaaatgtccccacattacggaagtagaacctgaggacatcgattgctggtgtaacctcacgagtacgtgggtaacctatggcacatgcaaccaagccggagaacacagacgagacaaacgtagcgtggccctggccccacacgtagggatggggctggatacgaggacacaaacatggatgtcagcggaaggagcctggcgtcaagtcgagaaagtcgaaacgtgggccctacgtcatccggggttcaccatactagcactattcctagcccactacataggcacgtcactcactcaaaaagtggtaatatttatacttctcatgcttgtgaccccatcaatgacaatgcgctgcgtgggagttggaaaccgtgactttgtcgaagggctctcgggggcaacgtgggtcgacgtagtcctagaacatggaggatgcgtcaccacaatggccaaaaacaaaccgactttggacatagaacttcagaaaacggaagcaacccaactagcaacattgaggaaattatgcatagaaggaaaaatcacaaacatcaccacagacagcagatgcccgacccagggggaagccgtactcccagaggaacaagatcaaaactacgtatgcaaacacacatacgtggaccggggctggggcaacggatgtggtctattcggaaaaggctccctagtaacctgcgccaagttccaatgcttagagccgatcgaaggcaaagtcgtccaatatgagaacctgaaatacactgtaataatcacagtccacacgggcgaccaacaccaggtaggaaatgaaacccaaggggttacggcggagataacaccgcaggcgagcactacagaggctatcttacccgaatacggcactttaggcctcgagtgttcaccccgaacagggctggacttcaacgagatgatactactaacgatgaaaaacaaagcatggatggtacacaggcagtggttcttcgatcttcctcttccgtggacgtcgggcgcgaccaccgaaacgcccacctggaataggaaagagctcttagtaacgttcaagaatgcccacgccaagaaacaagaggtggtggtacttggttcgcaagagggggcaatgcacacggccctcacaggggccacggagatccaaaactccgggggaacaagcatctttgccggccatctaaagtgcaggctgaagatggacaaactggagctgaagggaatgagctacgcaatgtgcactaacacattcgtactgaagaaagaagtttcagaaacgcagcatggcacaatcctgataaaagttgaatacaaaggggaagatgtaccatgcaaaataccatttagcacggaggacggtcaaggaaaagctcacaacggtcgtctgataacagcaaacccagttgtgaccaagaaggaagaaccggttaacatagaggctgaaccaccgttcggcgagagcaacatcgtgataggcatcggcgacaacgctttgaaaatcaattggtacaagaaaggatctagcattggaaaaatgttcgaagcaacagcacgcggcgccaggcgtatggcaatacttggcgatactgcgtgggactttggcagcgtaggcggtgtactaaactcgctcgggaagatggtccatcagatattcggttcagcctacaccgccctttttagtggagtgagctgggtcatgaaaatcggcataggcgtgcttctcacttggataggactcaactctaaaaataccagcatgagtttcagctgcatagcgatagggataatcacactctacctaggcgcagtagtgcaggcagacaccgggtgcgtcattaattggaagggcaaggaactgaaatgcgggtcaggaatcttcgtcactaatgaggtccacacgtggactgaacaatataaattccaagccgacagccccaagcgattagccacggccatagccggggcctgggagaacggagtatgcggtattcggtctacaacgcgtatggaaaatcttttatggaaacaaatcgcaaacgaacttaattatatcctgtgggagaacaacatcaaactgacggtagttgttggcgacatcataggagttctagagcaagggaaacgcaccctaacacctcaaccaatggaattaaaatattcatggaaaacgtgggggaaagcacgaatagtcactgctgaaacccaaaatagctccttcatcatagacggacccaacacacccgagtgccctaacacgtcacgcgcgtggaacgtctgggaagtcgaggactacggattcggggttttcacaacaaacatctggctaaagctcagagaagtctacacgcaactgtgtgaccaccgcctcatgtccgcagccgtcaaagacgaacgggcagtgcacgccgacatggggtattggatagaatcccagaaaaatggatcatggaagctagagaaagcaagcctcatagaagtgaagacctgcacctggcctaagtcccataccctttggtcaaacggagtcttagaatcagatatgatcataccaaagtcgctagccggccccatttcgcagcacaactaccggccaggctaccacacccaaacagcgggcccttggcacttgggcaaactagaactagacttcaattactgtgaagggaccacggtcgtgattacagaaaactgcgggacgcgtggaccatccttgcggacaaccacagtatccggcaagctgatccacgaatggtgctgccgatcttgcacgttacccccactaaggtatatgggggaagacggatgctggtacggtatggaaatacgacccattagtgagaaagaagaaaatatggtgaaatcacttgtatccgcaggatcgggcgaagtagacaacttcacaatgggtgtgctatgtcttgccatcctgtttgaggaggtaatgcgggggaaattcggcaagaaacatatgatagctggagtcctgttcacattcgtattactactcagcggacagattacgtggagagacatggctcacacgcttataatgataggcagcaatgccagtgataggatgggtatgggcgtcacctatttggcacttatcgccaccttcaaaatccaacccttcctcgccctgggtttcttcttaaggaagttaacctctcgcgaaaaccttctcctaggggttggccttgccatggcgactacactgcaattacccgaagacatagaacaaatggcaaacggaatagcgctcggcctaatggcacttaagctgattacccagttcgaaacgtatcaattatggaccgcactaatatcacttacgtgttccaatacaattttcaccttaactgtagcatggcgcaccgcgacgctaatcctcgctggcgtaagcctcctaccagtctgtcaatcttcaagcatgaggaaaacggactggctgccaatgacggtggccgcgatgggcgttccacccctaccactcttcatcttctgccttaaagatacactaaaacgccgaagctggccactaaacgagggagtaatggcggtgggactggtctcgattttagcatcatctctactaaggaacgacgtgccgatggcaggcccattggtcgcaggaggcctattaatcgcctgctacgtaatcacagggacatcagcagacttaactgtagagaaggccgcagacgtgacatgggaggaggaggcggaacaaacaggtgtatcacacaatttaatgattaccgtggacgacgacggaacgatgagaattaaagatgacgagacggaaaacatactaacagtgctactaaaaacggcgttacttattgtcagtggcatcttcccctactcgattcccgcgacgctattggtgtggcacacctggcaaaaacaaacacaacggagcggagtactttgggacgtgccaagcccaccggaaacgcaaaaagcagaactggaggaaggcgtatatcgtatcaaacaacaaggcatatttgggaaaacccaagtcggggtcggcgtccaaaaagaaggcgttttccacactatgtggcatgtcacccgtggggcagtcctgacctataacggtaagcgactagaaccaaactgggcaagcgtcaagaaagacctaatatcttacggcggcggatggcgactctcagcacaatggcagaaaggggaagaagtacaggtaatcgcagtggaacccggaaagaatcccaagaactttcagacgatgcccgggacttttcagaccaccacaggtgaaataggggcgatagctttagacttcaagccaggcacgagcggctcaccaatcataaaccgcgaaggaaaagtggtcggtctttatgggaacggagttgtcaccaaaaacggcggttacgtatccggaatagcacagacgaacgccgagcccgacggtcctacccctgaattagaggaagaaatgtttaagaagcggaacctgacaatcatggatcttcatcccggatccggcaagacgcggaaatatctcccggcaatagtacgagaagcaattaaacggcgcctccgcacgctcatattagcccccacccgggtcgtcgcagctgagatggaagaggcgcttaaagggcttccaatacggtaccaaacgacggcaaccaaatctgaacatacagggagagagatagtggatctgatgtgccacgcgacttttacaatgaggctgctcagccccgtgagggtccccaattacaatctcatcatcatggacgaagcccacttcaccgaccccgcgtcgatagccgcacgaggctatatatctacaagagtaggaatgggcgaagcagcagcgatcttcatgacggcaacgccgcccggaacagccgacgccttcccgcaatccaacgcacctatacaagatgaggagcgcgacatcccggaacgaagctggaatagcggaaatgaatggataaccgacttcgctggaaaaacagtttggtttgtcccatccatcaaggcaggaaacgacattgccaactgcctgaggaaaaacggaaagaaagtgatccagttaagccgtaaaacctttgacaccgaataccagaaaactaaactgaacgactgggactttgtggtcaccaccgacatttcagagatgggagccaacttcaaggccgacagggtcattgacccccgtcgctgcctcaagccggtcattctaaccgatggcccagaacgcgtcatacttgcgggacccatgccagttacggcagccagcgcagcgcaaaggcggggaagagtcgggcgcaacccccaaaaagaaaatgatcaatacatttttacgggacaaccgttaaataacgacgaagatcacgcacactggacggaggccaaaatgcttctagacaatataaatacaccggaagggataatgccagccttatttgagcccgagagagagaagtcggcagcgatagacggggagtaccgcctcaaaggagaaagtcgaaaaaccttcgtcgagctcatgcggcgcggcgacctaccagtgtggctagcccataaagtagcgtccgaggggataaagtacacagaccggaaatggtgcttcgacggccaacggaataaccaaatcctggaggagaacatggacgtggagatctggacaaaagaaggtgagaagaagaaactgaggccccgatggctagatgccagaacgtactcggacccgctcgccctcaaggagtttaaggacttcgcagctggccggaaaagcatcgcgctagacttagttaccgaaatagggcgggtccccacccacctagcacaccgtacaagaaacgccctggacaacctagtgatgctccacacgtccgagcacggcgggaaggcgtacaggcatgctgtggaagaactaccggaaacgatggaaaccctacttctattaggcctcatgatactactaaccggaggggcaatgctgttccttatatccggcaaaggtatagggaagacctctatcggcctaatctgtgtgatagccagctcaggaatgctctggatggcagagatacccctacaatggatagcatcagccatagtcttggagttctttatgatggtcctcctaatcccggaacccgaaaagcaacgaacaccgcaagacaaccaactagcctacgtcgtaatcgggatcctaaccctagctgcaataatcgcggcaaacgaaatgggcctgctagaaacaactaagagagatctaggcatgtccaaggaaccgggagttgttagccccacaagctacttagacgtggacctacatccggcaagtgcgtggacactgtacgcggtagccacaacagtaataacaccaatgcttagacacaccatagaaaattcaacagcgaacgtcagcttggccgcaattgcaaaccaggccgtggttctaatgggacttgacaaaggatggccaatctccaaaatggacctaggcgtaccactcctagcactgggatgctactctcaagtcaatcccttaacactcacagcggccgtgctgctactgatcacgcactacgccatcatcggcccaggcctccaagcgaaggcgacgcgagaggcacagaaacgtaccgccgcaggcattatgaaaaaccctacggtcgatgggataatgacaatcgacctggacccggtcatatacgattccaaatttgagaaacaactaggtcaagtgatgctacttgtattgtgcgcagttcaattactattgatgcgaacttcctgggcactatgtgaagcactcaccctggccacaggtcctataactaccctgtgggagggcagcccgggcaagttttggaacaccacgatcgccgtgagcatggcaaacatatttcgcggtagttacttagctggagcagggctagccttttcaataatgaaatcagtaggaaccggtaaacgaggaaccgggagccagggggaaacactgggcgagaaatggaaaaagaaactgaaccaactcagcagaaaggaatttgacctctacaagaaatcaggcataaccgaggtagacagaaccgaggcgaaagaaggcttgaaaagaggcgaaatcacgcaccatgcagtcagcagggggagcgccaaacttcagtggttcgtagagcgcaacatggtcatcccggaaggtcgcgtcatagatctgggttgcggacgcggcgggtggagctactactgcgccggcctcaagaaagtaacagaagtccgaggctatacgaaaggcggcccagggcacgaagaaccggtcccgatgagcacgtacggatggaacatagtaaagctgatgagcggcaaggacgtcttttacctgccacccgaaaaatgtgacacactactatgcgacatcggcgaatcatctccttcacctaccgttgaggagtctagaacaatacgggtacttaagatggtggaaccatggctcaaaaacaaccaattttgtattaaggtactcaatccatacatgccggcagtcatcgaacacctggaaagactccaacgaaagcacggcggtatgttggtgcggaaccccctgagccggaacagcacccacgagatgtactggatcagcaatgggacaggtaatatagtcgcgagtgtaaacatggtcagccgactcttgttgaaccgctttacgatgactcacaggagaccgacgatagaaaaggacgtagacctcggtgcaggcacgcgccacgttaacgccgaaccagagacaccgaacatggatgtcatcggcgagcgcataaaacgcatcaaggaggaacacaactcaacgtggcattacgatgacgaaaatccatacaagacctgggcataccacggctcatatgaagtcaaagctacgggaagcgccagcagcatgatcaatggagtcgtcaagctgctaacaaaaccgtgggacgtagtgccgatggtaacacagatggcgatgaccgacaccactccctttgggcaacagcgggtgttcaaagaaaaagtcgacacccggacgccgcgaagcatgcctgggactcggcgagtcatgggaatcacggccgaatggctctggagaacgctcggacgaaacaaaaagcctcgcctctgcacccgggaggagttcacgaagaaagtccggaccaacgccgcgatgggggccgtctttacagaagaaaaccaatgggactcggcgaaagccgcagtcgaggacgaggacttctggaagctcgtggaccgcgagagagaactacataagctgggcaagtgcggtagctgcgtttacaacatgatgggaaaaagagagaagaaactgggagagttcggcaaagcgaagggatcgcgggccatctggtacatgtggcttggggcgagatacctcgagttcgaggcactgggcttcctcaatgaggaccactggttctcgcgggaaaattcatatagcggcgtggagggcgagggactgcacaaactcggatacatcctccgcgatataagcaaaatccccggtggagccatgtacgccgatgataccgcaggctgggacactcgcataacagaggacgacctatacaacgaggagaaaataacgcagcagatggaccccgaacaccgccagcttgccaacgcgatctttaagctaacatatcagaataaggtcgtaaaagtccaacgacccactcccactggaacagtcatggacataataagtaggaaggaccaacgagggagcggccaagtgggaacctatggcctaaacaccttcaccaacatggaagcacaactaatccggcaaatggaaggagaaggagtattaagcaaggcggaccttgaaaatccacaccttccggagaagaaaataacgcaatggctcgagaccaaaggagttgagaggctaaagaggatggcgatcagcggagacgattgcgtcgtcaagcccatcgacgaccgattcgctaacgctctcctggctctgaacgatatgggcaaagtcagaaaagacatcccccaatggcaacccagtaagggatggcacgattggcaacaggtccccttctgtagccaccacttccacgaactcataatgaaggatgggaggaagctagtcgtcccgtgccggccccaagacgagctcattggtcgcgcgcgaattagccaaggggcaggatggtcgctacgtgaaacggcatgccttggcaaggcatatgcccaaatgtggtccctgatgtattttcacagacgagacctaagactggccagcaacgccatttgctcagcggtcccggttcactgggtccccaccagcagaacaacgtggtccatacacgcgcaccaccaatggatgacaacggaagacatgctgacagtctggaacagagtgtggatagaagacaacccatggatggaagacaagacaccagtgaccacctgggagaacgtaccgtatctcgggaaaagggaagaccagtggtgcggctctctaataggcttaaccagccgtgcgacatgggcacaaaacatccccacggcaatccaacaagttcgcagccttatagggaacgaagagttcctagactacatgccaagcatgaaaaggttccgcaaggaagaagagtcagaaggggcaatttggtaa

SEQ ID NO: 26070 - RNA, 9873 nt, synthetic construct
  misc_feature 1..9873: note = derived and/or modified CDS sequence (opt11) from DENV-3__FJ639816__SS-prME
  source 1..9873: mol_type = other RNA
accagcctctgcctcatgatgatactgcccgccaccttagccttccacctcaccagccgtgacggcgaaccccggatgatcgtgggcaagaacgagaggggcaagagcctgctcttcaagacggcgagcgggatcaacatgtgcaccctcatcgccatggacctgggcgaaatgtgcgacgacaccgtgacctacaagtgcccccatatcaccgaggtggagcccgaggacatcgactgttggtgcaacctgacaagcacctgggtgacctacgggacgtgcaaccaggccggcgagcaccggagggacaagcggagcgtggccttagcgccccacgtgggcatggggctggacaccaggacccagacatggatgagcgcggagggcgcctggcgccaggtggaaaaggtcgagacgtgggccctgcgccacccggggttcaccattctcgccctgttcctggcccactacatcggcacctccctcacgcagaaggtggtgatcttcatactgctgatgctcgtcaccccgagcatgaccatgcggtgcgtgggtgtgggaaatcgcgattttgtcgagggcctatccggggccacctgggtggacgtggtcctggagcacggcggatgcgttaccaccatggctaagaacaagcccacactggacatcgagctgcagaagactgaggccacgcaactagccaccctacggaagttgtgcatcgagggcaaaatcaccaacatcaccacggatagccgctgccccacccaaggcgaggcagttctgccagaggagcaggaccagaactatgtatgcaagcacacctacgtggatcgggggtggggcaacgggtgcggcctcttcgggaagggctccctggtgacctgtgccaagttccaatgcctggagcccatcgagggcaaggtagtgcagtacgagaaccttaagtacactgtgatcattacagtccacactggggatcagcaccaggtggggaatgagacacagggagtcacggctgagatcacgccccaggccagcactaccgaggccattctgcccgaatacggcacactcggactcgagtgctccccgcgcacggggctggacttcaacgagatgatcctgcttaccatgaagaataaggcgtggatggtgcaccggcaatggttcttcgacttacccttaccctggacctcgggtgccaccacggagacccccacctggaaccgcaaagagctcttggtgaccttcaagaacgctcacgctaagaagcaagaggtcgtggtgctgggttcccaggagggcgccatgcacacggcgttaaccggtgccaccgagatccaaaacagcggcgggacatccatcttcgcaggccatctgaagtgccggctaaagatggataagctcgagctgaaaggcatgagctacgccatgtgcacgaacacctttgtgctgaagaaggaggtgtccgagacccagcacgggaccatcctcatcaaggtggagtacaagggcgaggacgtcccttgcaagatccccttcagcactgaggacgagcagggaaaggcccacaacggtcgtctgatcaccgcgaaccccgttgtcactaaaaaggaggagcccgtcaacatcgaggccgagccgccttttggcgagtcaaacattgtgatcggaatcggcgataacgcgctaaagatcaactggtacaaaaagggatcctcgatcggcaagatgttcgaggccaccgcgcgcggggcccgccggatggccatcctgggcgacacagcctgggacttcggctccgtcggtggcgtcctcaatagtctggggaagatggtgcaccaaatcttcggcagcgcctacacggcgctgttcagcggggtgtcctgggtcatgaagatcggcatcggcgtgctcctgacctggatcggcctcaacagcaagaacacctccatgtcattttcttgcattgccatcgggattatcacgctctacctgggggctgtggtccaggccgacatgggatgcgtgatcaattggaagggtaaagagctgaagtgcgggagcgggatcttcgtgacgaacgaggtccacacctggacggagcagtacaagttccaggccgactcaccgaagcgcctcgcgactgccatcgccggggcttgggagaacggcgtgtgcgggatccgctccacaacccggatggagaatctgctgtggaagcagatagccaatgagctcaactacattctttgggagaacaacattaagctgaccgtggtcgtgggagacatcatcggggtcctcgagcaggggaagcgcacgctgactccccagcccatggaactgaagtacagctggaagacttggggtaaagcacggatcgtcacagccgagacgcagaacagctcctttatcatcgacgggcccaatacacctgagtgccccagcgcttctcgcgcctggaacgtgtgggaggtggaagactacggcttcggagtattcaccacaaacatttggttaaagctgcgtgaagtttacacccagctgtgcgatcatcgcctcatgagcgcggcggttaaggatgagcgggccgtgcacgccgacatgggctattggatcgagtctcagaagaacggctcctggaagctggaaaaggccagcttaatcgaggtgaagacgtgcacctggcccaagtctcacaccctctggagcaacggagtgcttgagtccgacatgatcataccgaagtcactggcgggcccgatatcccagcacaactaccgcccggggtaccacacccagaccgctggcccctggcaccttgggaagcttgagctggactttaattactgcgagggcacaaccgtcgtgatcaccgagaactgcggcacgcgggggcccagccttcgcactaccacagtttccggcaagctgatccatgagtggtgctgccggagctgcaccctgccgccactccgctacatgggggaggacggatgctggtacggcatggagatcagacccatctccgaaaaggaggaaaacatggtcaagagcctggtgtcagccggcagcggagaagttgacaacttcaccatgggggtcctgtgcctagccatcctgttcgaagaggtgatgcgcggaaagttcgggaagaagcacatgatcgccggcgtgttcttcaccttcgtccttctattaagcgggcagatcacctggcgggatatggcgcatacgctgattatgataggcagcaacgcctccgaccgcatgggcatgggagtgacctacctcgccctgatcgctacctttaagatccagcccttcctggccctcggcttcttcctgcggaagctgacgagcagagagaacctcctgctgggggtgggcctcgcgatggccacgaccctgcagttacctgaggacatcgagcagatggccaacggcatcgcccttgggctgatggcgctgaaactcatcacccaattcgaaacctaccaactttggacggccctgatctccctgacctgctccaacaccatcttcacgttaacagtcgcctggcggaccgccacccttatccttgccggtgtgagccttctgccggtctgccaatccagctccatgaggaagaccgactggctccccatgacggtggcggccatgggggttccgcccctgccgcttttcatcttcagcctcaaggacacacttaagcgccgaagttggcccctgaacgagggcgtcatggccgtgggcctggtaagcatcctggcctccagcttactgcgcaacgacgtccccatggcaggccccttagtagcgggtgggctgctcatcgcctgctacgtgatcaccggaacatccgcagacctgacggtcgagaaagccgcagacgtgacgtgggaggaggaggcggagcagacgggggtgagccacaacctgatgatcacggtagatgacgatggcactatgcggattaaggacgacgagaccgagaatatcctcaccgtgctcctaaagaccgccttgcttatcgtgtcagggatcttcccgtacagcatccccgccaccctgctcgtctggcacacttggcagaaacaaacccaacggtccggcgtcctgtgggacgtgcccagcccgcctgagacccagaaggccgagctggaggagggggtctatcggatcaagcagcaggggatctttgggaagacccaggtgggggttggcgtccagaaggagggggttttccacacgatgtggcacgtgacccgcggagccgtccttacctacaacggcaagagactggagcccaactgggcgtccgtgaagaaggacctgatcagctacggcggcgggtggcgcctctccgcccaatggcagaagggcgaggaagtgcaggtcatcgccgtggagcccgggaagaaccccaaaaacttccagaccatgcctggcacgttccagaccacaaccggcgagatcggggctatcgctctcgacttcaagcccggcacgagcgggtcacccatcatcaaccgggagggcaagatcgtgggcctgtatgggaacggcgtcgtgaccaagaacgggggctacgtgtccgggatcgcccagaccaacgccgaaccggacggtcccacccccgagctcgaggaggagatgttcaagaagcgcaatctcacgatcatggatcttcaccccggcagcggtaagacccggaagtacttgccggccattgtacgcgaggccatcaagcgacgactccggaccttgatactggcgcccacacgcgtggtggcggccgaaatggaggaggccctcaaaggcctgcctatcagataccagacgactgccaccaagtctgagcacaccgggcgcgagatagtcgacctgatgtgccacgcgacgttcacaatgcggctcctgagccccgtgcgcgtgccgaactacaaccttatcatcatggacgaggcgcacttcaccgacccggcatccatcgccgcccggggctacatctccacccgcgtggggatgggcgaggccgccgccatcttcatgacggccacgccgccgggcaccgcggacgccttcccgcagtccaacgcccccattcaggatgaggagcgcgacatccccgagcgcagctggaactccgggaacgaatggatcaccgacttcgccggcaagacggtgtggttcgtgcccagcatcaaggccggtaacgacatcgcaaactgcctccgcaagaacggaaagaaggtcatccagctgtcccggaagaccttcgacaccgagtaccagaagactaagctcaacgactgggatttcgtggtgacgaccgatattagcgaaatgggtgccaattttaaggcagaccgggtcatcgacccgagacgctgcctcaaacccgtgatcctaaccgacggtcccgagcgtgtgattttagccggccccatgcccgtcaccgccgcgtccgccgcccagcgccggggacgcgtgggccggaacccccagaaggagaacgaccaatatatcttcaccgggcagcccctcaacaacgacgaagatcatgcccattggacggaggccaagatgctgctagacaacataaatacccccgagggcatcatcccggctctcttcgagcccgagcgcgagaaatctgccgccatcgacggggagtaccggctgaaaggtgagtcccgcaagacattcgttgaactgatgaggcgcggtgacctccctgtatggctggctcataaggtggccagcgaggggattaagtacaccgaccggaagtggtgtttcgacggccagcgcaacaaccagatcctggaggagaacatggacgtcgagatatggacgaaggagggggagaagaagaagttgcggccccgctggctcgacgctcgcacctattcggacccgctggccctcaaggagtttaaggactttgctgctggccgcaagagcatcgcactggatctggtgaccgagataggccgcgtgcccacccacctcgcccaccggacgcgcaacgccctggacaacttggtcatgctccacacctccgagcatggcggcaaggcctacaggcacgccgtggaggaactgcccgagaccatggagaccctgctcctgctggggcttatgatactgctgacgggcggggcgatgctgttcctcatatcaggcaagggcatcgggaagaccagcatcggcctgatctgcgtgatcgcctcgagcgggatgctctggatggccgagatcccgctgcagtggatcgcctccgccatcgtcctagagttcttcatgatggtgctcctgatccccgaacccgagaagcagaggacgccccaggataaccagctggcgtacgtggtaatcggcatcttgaccctggccgccacaatcgccgccaacgagatggggttactagagaccaccaaacgagaccttggcatgagcaaggaaccgggggtggtatcccccacaagctacctagacgttgacctccatcccgcgtccgcctggacgttgtacgctgtggcgacaaccgtgatcacccccatgctgcgtcacacaatagagaactcaaccgcgaacgtctccttggctgctatagccaaccaagcggtggtgctgatggggctcgacaagggctggccgatcagcaagatggacctcggggttcctctgctggcgctcggctgctactctcaagtgaaccccctgaccctgaccgccgccgtactgctgctgataacgcactacgcgattatcgggcctggcctccaggccaaggcgactagggaggcccagaagcgcaccgccgccggcataatgaagaacccaaccgtcgacggaatcatgacaattgatctggaccccgtgatctatgacagtaagttcgagaagcagctgggccaagtaatgctgctggtcctgtgcgccgttcaactcctgctgatgcggacctcctgggcgctctgcgaagctctgaccctggccacagggcctatcacgaccctctgggagggcagccccggcaagttctggaacaccaccatcgccgtgtccatggcgaacatcttccgagggagctacctggccggcgccgggttggccttctccgtcatgaagtctgtgggcaccgggaaacggggcacggggtcccagggggagaccctcggcgagaagtggaagaagaagctgaaccagctgagccgcaaggagtttgacttgtacaagaagagcgggatcaccgaggttgaccggaccgaagccaaggagggcctgaagagaggggagataacgcatcacgcggtctcccggggcagcgccaagctgcagtggttcgtggagcgcaatatggtgatcccggaaggcagagtgatcgatctcgggtgcggccgcggaggttggtcgtactactgcgccggtctgaaaaaggtgaccgaggtgcggggctacaccaagggcgggcccggccacgaagagcccgtccccatgagtacctatggctggaacattgtgaagctaatgtccggcaaagacgtgttctacctcccgcccgagaagtgcgacacactgctgtgcgacatcggagagtcctcccctagccccaccgtagaggagtctcgcacgatccgcgtgctgaagatggtggagccgtggttaaagaacaatcaattctgcattaaggtcctgaacccctacatgcccaccgtgatcgaacacctggagcggctccagcgcaagcacggcggcatgctggtgcggaaccctctgagccgcaactccacgcacgagatgtattggattagtaacgggaccgggaacatcgtcgcatccgtgaacatggtgtcgagacttctgctgaaccgcttcacgatgacacaccgacgccccaccatcgagaaggacgtcgacctcggggccggcaccaggcacgtgaacgctgagccggagacccccaacatggacgtgataggcgaaaggatcaagcggatcaaggaggagcataattccacgtggcactacgacgatgagaacccgtacaagacgtgggcctaccacgggagctacgaggttaaggccaccggctccgctagctccatgatcaacggtgttgtcaagctgctgaccaagccctgggacgtggtgccgatggtcacccaaatggccatgactgacaccacccccttcggccagcagcgcgtgttcaaggagaaggtggacacccggacgccgaggagcatgcctgggacccggcgggtcatgggcatcacagcggagtggctgtggcggactctgggccgcaacaaaaaaccccggctgtgcacgcgcgaggagttcaccaagaaggtgcgaaccaacgccgccatgggggcagtgttcacagaggaaaaccagtgggatagcgcgaaagccgccgtcgaggatgaggacttctggaagcttgtggaccgggagcgcgaactgcacaagctaggtaagtgcgggtcgtgcgtgtacaacatgatgggcaagcgcgagaagaagttaggggaattcggcaaggccaagggctctcgcgccatctggtacatgtggttaggggcgcggtatctggagttcgaggccctcggcttcctaaacgaggaccactggttcagtcgcgagaacagctactccggggtcgagggagagggactgcataagctcggctacatcctgcgggatatcagcaagataccaggcggtgccatgtacgccgacgacacggcgggctgggacactaggatcaccgaggacgatctgcacaacgaggagaagatcacgcagcagatggacccggagcaccggcagctcgcgaacgccatcttcaagttgacctaccagaacaaagtcgtgaaggttcagcggcccactcccaccgggaccgtaatggatatcatctcccggaaagatcagcgcggcagcggccaagtgggcacgtacggtctgaacacgttcaccaacatggaggcgcagctcatccggcagatggaaggggagggcgtactgagtaaggccgatctggaaaacccccacctcccagagaagaagatcacccagtggctggagaccaagggggtagagcgcctaaaaagaatggccataagcggcgacgactgcgtggtcaagcccatcgatgaccgcttcgcgaacgcgctactggccttaaacgacatgggcaaggtccggaaggacatcccacagtggcagccctccaaggggtggcacgactggcaacaggtcccgttctgcagccaccacttccacgagttaatcatgaaggacggtcgcaagctagtcgtaccatgcagaccccaagacgagctgatcgggcgcgcacggatctctcagggcgccgggtggagcctccgcgagacggcgtgtctgggcaaggcctacgcccagatgtggtccctgatgtatttccaccggcgggacctccgcctggcaagcaacgccatctgctccgctgtgcccgtccactgggtgccaactagccggaccacttggtccatccacgcccaccaccagtggatgacgaccgaagacatgcttaccgtctggaaccgcgtgtggatcgaggacaatccctggatggaggacaagactcctgtgacgacctgggagaacgtgccgtacctgggcaagcgcgaggaccagtggtgcgggagcttaatcgggctgaccagccgtgccacctgggcccagaacattccgacagcgatccagcaggtcaggtccctcatcgggaacgaggaattcctggattacatgcccagtatgaagcgcttccggaaggaagaggaatccgaaggagccatctggtga

SEQ ID NO: 26071 - RNA, 9873 nt, synthetic construct
  misc_feature 1..9873: note = derived and/or modified CDS sequence (opt11) from DENV-3__FJ639817__SS-prME
  source 1..9873: mol_type = other RNA
acctcactgtgcctcatgatgattctgcccgcggccctggcgttccatctcacttctcgcgacggtgagccccggatgatagtggggaagaacgagcgaggcaaatctctactgtttaagaccgccagcgggatcaacatgtgcacactcatcgcgatggacctaggggagatgtgcgacgacaccgttacctacaagtgcccccacatcacggaggtggagcccgaggacatcgactgctggtgcaacctaacctctacctgggtgacttacgggacgtgcaaccaggccggtgaacaccggcgcgataaaaggagcgtcgccctagcccctcacgtgggcatgggcctggacacccgtacccagacgtggatgagcgccgagggcgcctggagacaggtggagaaagtcgaaacgtgggccctgcgccaccccgggttcaccatcctcgcactcttcctggcccactatatcggcacctcgctaactcaaaaggtcgtcatcttcatcctcttgatgctcgtgacgccttccatgaccatgcggtgcgtgggggtgggcaacagggacttcgtcgagggcctgtcgggggctacgtgggtggacgtggttctggagcacggcggttgcgttaccacgatggccaagaacaagcccaccctcgacatcgagctgcagaagaccgaggccacccagctggctacactccggaagctatgcatcgagggcaaaatcacaaacgttaccaccgactccaggtgccccacgcaaggtgaggccgttctgccggaggaacaggatcagaactatgtgtgcaagcacacatacgtggaccggggctggggcaacgggtgcggcctctttgggaaaggctccctggttacatgcgccaagttccagtgtctggagcctattgagggtaaagtggtacagtacgagaacctcaaatacacagtaattatcacggtgcacactggggatcagcaccaggtcggcaacgaaacccaaggggtgaccgccgaaataacgccgcaggcttccaccacggaagcgatcctgcccgagtatggcactctcggtctcgagtgtagcccccggaccggtctggatttcaacgagatgatccttctcacgatgaaaaacaaggcctggatggtgcaccggcaatggttctttgatctgcctctcccgtggacgtctggcgccactactgagacgcccacatggaaccgcaaggagttactggtgaccttcaagaatgcgcacgccaagaagcaggaggtggtggttctggggtcccaggagggcgcgatgcacacggcgctcacgggggcgaccgagattcagaacagcggcggaacgtccatcttcgccggccacctgaagtgccgcctgaaaatggacaagttagagctgaaaggcatgagctacgcaatgtgcaccaatacgttcgtgctcaagaaagaggtatccgagacgcagcacgggactatcctcataaaagtcgagtacaagggagaggacgtgccgtgcaagatcccgttctcgacggaggacgggcaggggaaggcgcacaacggccgcctgataacggccaaccctgtcgtcacgaagaaggaggagcccgtcaacattgaggccgaaccgcccttcggtgagagcaatatcgtgatcggcatcggggacaatgccttaaagatcaactggtacaagaaaggttccagcatcgggaagatgttcgaagctaccgcccgtggggctcgacggatggccatcctgggcgatacagcttgggacttcggttccgtcgggggcgtactcaacagcctaggcaagatggtacaccagatctttgggtccgcgtataccgcactgttcagcggcgtctcctgggtgatgaagatcggtattggggtgctgctgacttggatcggcctgaacagccgcaacacttccatgagcttctcctgtatagccatcgggatcataacattatatctgggcgccgtggtacaggccgacatggggtgcgtgatcaactggaaggggaaggagctgaagtgcggcagcggcattttcgtcacgaacgaggtacacacctggaccgagcagtacaagtttcaggcggactctccgaagcgcctcgcaaccgccattgccggcgcctgggaaaacggggtgtgcggcatccggagcaccacccgcatggagaatctgctgtggaaacagatagcaaatgagctcaactatatcctctgggagaacaacatcaaactaacagtagttgttggggacatcataggagtgttagagcagggcaagcggacactgacgccccagccgatggagctgaaatactcctggaagacctgggggaaggccaagatcgtgaccgcggagactcagaacagctccttcatcatcgacggccccaacacgcccgagtgcccgagcgcctctcgcgcgtggaacgtgtgggaagtcgaggattacgggttcggcgttttcaccaccaacatctggctcaagttacgggaggtctacacccaactgtgcgaccaccgcctcatgagcgccgccgttaaggacgagcgggccgtgcatgccgacatgggctactggattgagagccagaagaacggatcctggaagctggagaaggcaagcctgattgaggtgaagacctgcacgtggccgaagtctcacaccctctggagcaatggcgtcctggagtccgatatgataatccccaaaagcctggcggggccaatctcccagcacaactaccggcctggctaccacacacagaccgccggtccgtggcacctcggcaagctggagttagactttaactactgcgaaggcacgaccgtggttataaccgaaaactgtggtactcggggccccagcctccgcacgaccaccgtgtccgggaagttgatccacgagtggtgttgccggagctgcaccctgcccccgctccgctacatgggcgaagacgggtgctggtatggcatggagatccgtccgatctccgagaaggaggagaacatggtcaaaagccttgtgtccgctgggagcggggaggtcgacaacttcacgatgggggtgctctgcctagctatcctgttcgaagaggtgatgcgggggaagttcggcaagaaacacatgatcgcaggggtattcttcaccttcgtgctgctcctgtctggccagatcacctggcgggacatggcccacaccctcatcatgatcggtagcaacgcatcggaccgcatggggatgggcgtgacctacttggccctgatcgccaccttcaagattcagccgttccttgcgctagggttcttccttcggaagctgacctcacgcgagaacttactgttgggagtaggcttagccatggctactactctgcagctgcccgaggatatcgagcaaatggccaacgggatcgcgctcggcctgatggcgctcaagctcatcacccagttcgagacctaccagttgtggaccgcactgattagcctaacgtgctccaatacaattttcacccttacggtggcctggcggacggccaccctgatcctcgctggggtatcgctgctgcccgtatgccagagcagctctatgcgcaagactgactggttgcccatgaccgtggctgcaatgggcgtgcctcctttgccactgtttattttcagcctcaaagatactctgaagagacggtcctggcccctgaacgagggggtgatggcagtggggctcgtcagcatcctggcttccagcctgctccgcaacgacgtgcctatggctggccccctggtggccgggggcctgttgatcgcttgctacgtcataaccgggacctccgccgacctgacggtggagaaggccgcggacgtcacatgggaagaggaggccgagcagaccggcgtaagccacaacctgatgattaccgtagacgacgacgggaccatgcggatcaaggacgacgagaccgaaaatatccttacggtcttgctgaagacagcactcctgatcgtatccggcatcttcccgtactccataccagccaccctgctcgtatggcacacctggcagaagcagacgcagcgctccggcgtgttatgggatgtacctagcccgcccgagacccagaaggcggagcttgaggagggggtgtaccggatcaagcagcagggcatcttcgggaagacccaagtgggggttggggtccaaaaagagggagtgtttcacaccatgtggcacgtgacgcgcggcgcggtgctcacctacaacgggaagcggctggagcccaattgggccagcgtgaagaaggacctgataagctacggcggcgggtggcgcctcagtgcccagtggcagaaaggggaggaggtgcaagtgatagcggtcgagcctgggaagaatcccaagaactttcagaccatgcctggcaccttccagacgacaacgggagagatcggtgcgatcgcgctggacttcaagccagggaccagcggcagccctatcatcaaccgggagggaaaggtagtggggctgtacgggaacggggtggtcacaaagaacggcgggtacgtgtccggtattgcccaaaccaatgccgagcccgacggacctacacccgagctggaggaggaaatgttcaagaagcgcaacctcaccatcatggatctgcaccccgggagcgggaaaacgcggaagtacctgcctgccatcgtgcgcgaagcgatcaagcggcgcctccggacgctgatacttgcccccactagagtcgtggcagcggagatggaggaggccttgaaggggctgccaatccggtaccagaccacggcgaccaagtccgagcataccggccgcgagatcgtagacctgatgtgccacgccaccttcacgatgcgactgctgagcccagtccgcgtaccaaattacaacctgattatcatggacgaggcacacttcacggaccccgcttcaatcgccgcgcgggggtacatctccactcgtgtgggcatgggcgaagccgccgcgatcttcatgacagcgacgccgcccgggacggcggacgccttcccgcagtccaacgcgcccatccaagacgaggagcgcgacatacccgaacggagctggaactccggaaacgagtggatcaccgacttcgccgggaagaccgtctggttcgtgccgtcgatcaaggcgggcaacgacatcgccaattgcttaaggaagaacgggaagaaagtgattcagctgtcccgaaaaacgttcgacaccgagtaccagaaaaccaaactgaacgactgggacttcgtcgttacgacggacatcagcgagatgggggccaatttcaaagcagaccgcgtgatcgacccgcggcgctgcctcaagcccgtcatcctgaccgacggccccgagcgggtgatcctggccggtcctatgccggtgaccgcggcctccgcagcccagcgccggggccgcgtcgggcggaatccgcagaaagagaatgaccagtatatcttcaccggccagcctctcaacaacgatgaggaccacgcacactggactgaggcgaaaatgttgctggacaatatcaacacgcccgaggggatcatcccggccctgttcgagccagagcgtgagaagtccgccgccatagacggcgagtatcggctgaaaggagagtcccggaagaccttcgtggagctaatgaggcgcggggacctcccggtctggctggctcataaggtcgccagcgagggcattaagtacaccgaccggaagtggtgcttcgacgggcagcgcaacaatcagatcctggaggagaacatggacgtggaaatttggaccaaggagggcgagaagaagaaactccggccccgctggcttgatgctcgcacgtactccgacccattggcccttaaagagttcaaagatttcgccgccggcaggaagagtatcgcccttgatctggtcaccgagattgggcgcgtgcccacccacctcgcccaccgtacacgcaacgccctggacaatctggttatgctccacacatccgagcatggcgggaaagcctaccggcacgcggtcgaggagctgcccgaaaccatggagaccttactcctgctgggccttatgatcctgctgaccgggggcgccatgttattcctgatcagcggtaagggaatcggcaaaacaagcatcgggctgatatgcgtgatcgcctccagcggcatgttgtggatggccgaaatcccgctgcaatggattgcctccgcgatcgtgctagagttcttcatgatggtcttactgatccccgagcccgagaagcagcgcacgccccaagacaaccagctggcctacgtggtgatcggcatcctcaccttggcagccatcatcgcggcgaacgaaatgggcctgctcgagaccaccaaaagagacctgggcatgtcaagggagccgggggtagtgtccccaacctcatatctggacgttgacctccaccccgcctcggcctggaccctgtatgccgtggccactacggtgatcacccccatgctgcggcacactatcgagaacagcaccgctaacgtctcgctcgcagcgatcgccaaccaggcggtcgtgctgatgggcctggacaaggggtggcccatcagcaagatggacctcggtgttcccctcctggccctcgggtgttactcccaggtcaacccgctgacactgaccgcggccgtgctcctcctgatcacccactatgccatcatcggccccggcctccaggcgaaggccacccgcgaggcccaaaagcggacggcagctgggatcatgaagaatccgaccgttgacggcatcatgaccatcgacctggaccccgtcatatatgacagcaagttcgaaaagcagctgggccaggtcatgctcttggtgttatgcgctgtgcagctcctgctgatgcgcacgagttgggcactttgcgaggcactaacgctggccaccggccccattaccacgctctgggagggcagccccggaaagttttggaacacgaccatcgcggtgtccatggccaacatcttccgtggcagctacctggccggagccggcctggcattcagtattatgaagtccgtgggcactggcaagcgcggcaccgggtcccagggcgagaccctcggagagaagtggaagaagaagctgaaccagcttagcaggaaagagttcgacctctacaagaaaagcggaatcacggaggtggaccgcactgaggctaaggaggggcttaagagaggggaaataacccaccacgccgtgtcaagaggcagtgccaagctgcagtggtttgtcgagcggaacatggtcataccggaggggcgcgtgattgacctgggctgcgggcggggcgggtggtcctactactgtgccggcctgaagaaggtgaccgaggtccggggctatacgaagggcggaccgggtcacgaagaacccgtccctatgagcacctacggctggaatatcgtgaagctgatgtccgggaaggatgtattttacctaccgcccgagaagtgcgacaccctgctgtgcgacattggcgaaagctccccctcacccaccgttgaggagtcccgcacgattcgggtgcttaagatggtagagccgtggctcaagaacaaccagttctgtatcaaggtgctgaatccctacatgccggccgttatcgagcatctggagcgcctccagagaaagcacggaggtatgctggtccggaaccccctgagcagaaactccacccacgaaatgtactggatcagcaatggcaccggtaacattgtcgcgtccgttaacatggtcagccggctcctgctgaaccgatttaccatgacgcaccgccgcccgaccatcgaaaaggatgtggacttaggcgccggtaccaggcatgtgaatgccgagccagagactcctaacatggacgtcatcggtgagcggatcaagaggatcaaggaggagcacaattccacgtggcactacgacgacgagaacccgtacaaaacctgggcttatcatggcagctacgaggttaaggcgaccgggtccgcgtcctccatgatcaacggggtcgtgaaactgctgaccaagccctgggacgtggtccccatggtgacgcaaatggcaatgacagacaccaccccattcgggcagcagcgagtgttcaaagagaaggtcgacacgcgcaccccgcggagcatgcccggcacccgccgggtgatgggaatcaccgcagagtggctctggcgcacactggggcggaacaaaaagcctcgtctgtgtacccgcgaggagtttaccaagaaagtgcggaccaacgccgcgatgggcgccgtctttacggaggagaaccaatgggactcggccaaggcagccgtggaggacgaggacttctggaagctagtggaccgcgagcgggagttacacaaattggggaagtgcgggtcctgcgtctacaacatgatgggaaaacgcgagaagaagctgggcgagttcggcaaggcgaaggggagccgagcgatctggtacatgtggctgggcgcccgctacctcgagttcgaggcgctcgggttcctgaatgaggaccactggttctcccgggagaacagctactccggagtggagggggagggcctgcacaagctcggctacatcctgcgcgacattagcaagatcccaggaggggccatgtatgctgacgacaccgccggatgggacacccggatcaccgaggacgacctgcacaacgaggagaagatcacgcaacagatggatccggagcacagacagctcgccaatgccatcttcaagctgacttaccagaacaaagtggtcaaggtgcagcggccaacccctactggcaccgtgatggacattatttcccgcaaggaccagaggggatctggacaggtggggacgtatgggctaaacaccttcaccaacatggaggcccaattgatcagacagatggagggggagggcgtgttgagtaaggcggacctggagaacccccatctcccggagaagaagatcacccagtggctggagacgaagggcgttgagcggctgaagcgcatggccatctccggcgacgactgcgtcgtaaaacccatcgacgaccggttcgccaacgccctcctggccctgaacgacatggggaaggtacgcaaggatatcccgcagtggcaaccctccaagggttggcacgactggcagcaggtaccgttttgcagccaccacttccacgagcttatcatgaaggatggacgcaagctagtcgtcccttgcaggcctcaggacgaactgatcggccgggcgcgcatctcgcagggggcggggtggagtctgcgagagacagcctgcctgggcaaggcctacgcgcaaatgtggtccctgatgtatttccacagacgcgacctccgactggctagcaatgcgatctgctccgcagtccccgtgcactgggtgcctacaagtcgcaccacatggagcatccacgcacaccaccagtggatgaccaccgaggacatgctgaccgtctggaaccgcgtgtggatcgaggacaatccctggatggaggacaagacgccggtgacgacctgggagaacgttccgtacctaggtaaacgcgaggaccagtggtgtggaagcctgatcgggctgacgagtagggcgacttgggcgcagaacatcccgaccgccatccaacaggtcaggtccctcatcgggaacgaggagttcctggattacatgccgagcatgaagcggttccgcaaagaggaggaatccgagggggccatatggtga

SEQ ID NO: 26072 - RNA, 9873 nt, synthetic construct
  misc_feature 1..9873: note = derived and/or modified CDS sequence (opt11) from DENV-3__FJ639825__SS-prME
  source 1..9873: mol_type = other RNA
accagcctgtgcctcatgatgatcctgcccgccgccctggcgttccacctcacctcccgggacggggagccgcgcatgatcgtcggaaaaaacgaacgtggcaagagcctgctgtttaagaccgcctccgggatcaatatgtgcaccctcatcgccatggacctgggcgagatgtgcgacgacaccgttacctacaagtgcccgcacatcaccgaggttgagccagaggacattgactgctggtgtaacttgaccagcacctgggtgacctacgggacctgcaaccaggccggcgagcatcggcgcgacaagcggtccgttgctctcgcgccacacgtgggcatggggctagatacccgcacccagacctggatgagcgccgagggggcgtggcggcaggtggagaaagtcgagacgtgggccctgcgccaccccgggttcactatccttgcgctgttcctggcccattatatcggcacctccctcacccagaaggtggtgatattcatcctgctgatgctagtcacgcccagcatgaccatgcggtgcgtaggggtgggcaaccgtgactttgtcgaagggctgtccggggccacctgggtggacgtggtcttggagcacggcgggtgtgtgactaccatggcgaagaacaagcctaccctcgacatcgaactgcagaaaaccgaggcaacccaactggcgacgctccggaagctgtgcatcgaaggcaagatcaccaacatcaccaccgacagccgctgccccacgcagggcgaggccgtcctgccggaggaacaggatcagaactacgtctgcaagcacacttatgtggaccgggggtggggcaacgggtgcggcctcttcgggaaaggctccctggtgacctgcgccaaattccagtgcctggagcccattgagggcaaggtcgttcagtacgagaacctaaagtacacagtgatcattacggtacacaccggggaccagcatcaggtcggaaacgagacccagggggtcaccgctgagatcacgcctcaggccagcaccacggaggcaatcctgcccgagtatggcaccttgggtctcgagtgcagcccccgcaccggcctggacttcaacgagatgatcctgctaacgatgaagaacaaagcctggatggtgcaccggcagtggttcttcgacctgcccctaccctggaccagcggcgccaccacggagacgccaacctggaacaggaaagagcttctggtcacctttaagaatgcccatgccaaaaagcaggaggtcgtggtgctgggtagtcaggagggcgcgatgcacaccgccctcacgggggccaccgagatccagaacagcggcgggacgagtatctttgccggccacctgaagtgtcgcctgaagatggacaagttagagctgaagggcatgagctacgctatgtgcaccaacacgttcgtactgaagaaagaggtgtccgagacccagcacgggaccattctcatcaaggtggactacaagggcgaggacgttccctgcaagatccccttcagcaccgaggacgggcagggcaaggcgcataacggacgcctgataactgcgaaccccgtggtcactaagaaagaggagcccgtcaacatcgaggccgagccaccctttggggagagcaatatcgtgatcggcattggtgataacgccctgaaaattaactggtacaagaagggatcgagcatcggcaagatgttcgaggcgaccgcccggggcgcgcgccggatggccatcttaggcgacacggcctgggacttcgggtccgtgggtggggtcctcaacagcctgggcaagatggtgcaccagatcttcgggtccgcgtacacggccctattcagcggagtgtcttgggtcatgaagatcggcatcggtgtactcctgacctggatcgggctgaatagcaagaacacctccatgagcttctcctgcatcgccatcgggatcattaccctgtacctgggcgcggtggtacaggccgatacggggtgcgttatcaactggaagggcaaggagctgaagtgcggcagcgggatcttcgtgaccaacgaggttcacacctggaccgagcagtacaagttccaggcggactcccctaaacgcctcgccacggccatcgccggagcctgggagaacggggtatgcgggatacgcagcaccacacggatggagaacttgctgtggaagcagatcgcgaacgagctcaactacatcctgtgggagaacaacatcaagttgaccgtggtcgttggggatatcatcggcgtattggagcagggcaagcgcacgctgacgccccaaccgatggagctgaagtactcctggaaaacctgggggaaggccaagatcgtcaccgccgagacgcagaatagctccttcataatcgacggccccaacacccccgagtgccccagcgcctcacgggcctggaacgtttgggaggtggaggactacgggttcggcgtcttcaccactaacatctggttaaagctgagagaggtatacacccagcagtgcgaccaccggctgatgagtgccgccgtgaaagacgagcgcgccgtccacgccgatatgggctactggatcgagagccagaagaacggctcttggaagctcgagaaggctagcctgatagaggtaaagacgtgcacctggccgaagagccataccctgtggtccaacggagtgctagagtctgacatgatcatccccaaaagcctggccgggcctatctctcagcacaactatcggccgggctatcacacacagactgctgggccctggcacctgggcaagctcgagctggacttcaactactgcgagggcaccaccgtcgtcatcaccgaaaactgtgggacgaggggtccctcgctgagaaccaccaccgtatccggtaaactcatacacgagtggtgctgcaggagctgcaccctgcccccgttacgatacatgggcgaggacgggtgctggtacggcatggagattcgtcccatcagtgagaaggaagagaacatggtcaagagcctggtctccgccggctctggggaggtggacaatttcaccatgggtgtcctgtgcctggccatcttgttcgaggaggtgatgcggggtaagttcggcaagaagcacatgatcgcgggggtgttcttcaccttcgtcctgctgctcagcggccagatcacatggcgcgatatggctcacaccctaatcatgatcggctccaacgcctcagaccggatggggatgggcgtgacctacttagccctcatcgccactttcaaaatccagcccttcttggcgctgggattctttctccgcaagttgaccagccgggaaaacctgttactgggcgtgggcctggccatggctacgaccctacagctgcccgaggatatcgagcagatggccaacggaatcgcgctcgggctcatggccctgaaactaatcacacagttcgagacataccagctctggacggcactcataagcctgacctgctccaacaccatcttcaccctcacggtcgcctggcgcacggccaccctgatcttggctggggttagcctcctgcccgtctgccagtccagctccatgcggaagaccgactggctgcccatgacggtggcggccatgggcgtgccccccctcccgctgttcatcttctcgctcaaggacaccctcaagcggcgctcctggccactaaacgagggggtaatggcagtaggcctggtgagcatcttagcgtcatcactgctgcggaacgacgtacctatggctggccccctcgtggccgggggcctgctgatcgcctgctacgtgatcacggggacctccgccgatctcacggtcgagaaggccgcggacgtgacctgggaggaggaggccgagcagacgggtgtcagccacaacctgatgatcaccgtcgacgacgacgggaccatgcgcataaaggacgacgagacggagaacatcctgacagtgctactgaagaccgccctgctcattgtgtcgggcatcttcccgtacagcatccccgccacactcctggtctggcacacgtggcagaaacagacccagagatccggcgtgctctgggacgtccccagtccgcccgagacccagaaggctgagttggaagagggagtctacaggatcaaacagcagggcattttcgggaagacccaagtgggcgtaggggtacagaaggagggcgtgtttcacacgatgtggcacgtgacccggggcgcggtcctgacctacaacgggaagcgcctggagcccaactgggcctccgtgaagaaggacctgatcagctacggcgggggctggcggctgtcagcccagtggcagaaaggggaggaagtccaggtcatcgccgttgagcccggcaaaaaccccaagaatttccaaaccatgcccggcacgttccagactaccaccggggagataggcgcgatagccctcgacttcaaacccgggacgagcggcagccccatcattaaccgcgagggcaaggttgtcgggctttacggcaacggggtggtgaccaagaacggggggtacgtcagtggcatcgcccagaccaatgcagagccggacggacctacccccgagctggaagaggagatgttcaagaagcggaatctcaccattatggaccttcacccagggagcggcaaaacccgcaagtacctgcctgccatcgtccgggaggcgataaagcgccggctgcgcaccctcatcctggcccccacccgcgtggtagcggccgagatggaggaggccctcaagggactccccatacgctaccagacgaccgcaacaaagagtgagcacaccggccgggagattgtggacctcatgtgtcacgccactttcaccatgcgactgctaagtcccgtgcgggtcccgaactacaacctaatcataatggacgaggcccatttcaccgaccccgcctccatcgccgcgcgcgggtatatctccacccgggtggggatgggcgaggccgccgcgatcttcatgacggcgacgccaccaggaaccgccgacgccttcccgcagtccaacgcccccatccaagacgaggagcgagacatcccagagcgcagttggaactcgggcaacgagtggatcaccgattttgcagggaaaacggtatggtttgttccaagtattaaggcgggcaacgacatagccaactgcttgcggaagaatggcaagaaggtgatccagctctctcgcaagaccttcgacaccgagtaccagaagaccaagctgaacgactgggacttcgtggtcacgacggacatctcggagatgggcgcaaacttcaaggccgaccgggtgatcgatccccgacggtgcttgaagccagtgatcctcaccgacgggcccgagcgcgtaatcctggccgggcccatgccggtgaccgcggcaagcgccgcacagcgacgcggccgggtggggaggaacccccagaaggagaacgaccagtatattttcaccggccagcccctcaacaacgacgaggaccacgcccactggacagaggcgaagatgctcctggacaacatcaatacccccgaggggatcatcccggccctgttcgagcccgagcgggagaaatcagcagccatcgacggcgaataccgcttgaagggcgagtcccggaagaccttcgtcgagctgatgcgccgcggagaccttcccgtgtggctcgcccacaaggtcgccagcgagggcataaagtataccgacagaaagtggtgcttcgacgggcaacggaacaaccagatcctggaagagaacatggacgtggagatatggacgaaggagggcgaaaaaaaaaaactgcgcccccggtggctcgacgcccgaacctactccgacccgctggccctgaaagagttcaaggacttcgccgcgggccgcaagagtatcgccttggacctagtaaccgagatcgggagagtaccttcccatctggcccaccgcacccggaatgccctcgacaatctggtgatgcttcatacgagcgagcacggcgggaaggcctaccgtcacgccgtggaggaactccccgaaacaatggagaccctgttactcctaggtctaatgatcctcctgactgggggcgccatgctgttcctcatcagcggcaaggggattggcaagacgtccatagggctgatctgtgtcatagcctcatcaggcatgctgtggatggccgagatcccgcttcagtggattgcctccgcgatcgtgctggagttcttcatgatggtgctgctcatccccgagcccgagaagcagcggacaccccaagataaccagctggcttacgtcgttatagggatcctgacactcgccgccattattgctgcaaacgagatgggactgctggagaccacgaagcgcgacctcggcatgtccaaggagccgggggtagtctcccccacctcgtacctggacgtggacctgcacccggcaagcgcctggactctctacgccgtggcgacgacggtcatcacccccatgctgcggcacaccatcgagaactcaacggcgaacgtcagccttgccgccatcgcgaaccaggcggtagtcctcatgggcttagacaaggggtggccgatctccaagatggatctgggggtgcccctcctggccctggggtgctacagccaggtgaaccccctcacgctgactgccgccgtcctgttattaatcacccactacgccatcatcggcccaggtttacaggcgaaggccacacgcgaggcccagaagcggacggccgccgggattatgaaaaacccaaccgtagacggcataatgaccatcgacctcgaccccgtgatttatgactctaaattcgaaaagcagctggggcaggtcatgctcctcgtgctgtgcgcggtgcagctgctcctgatgcgcacctcatgggccctgtgtgaggccctcacgctcgccaccggccccatcaccaccctgtgggagggctcccccgggaaattctggaacacgaccatcgcagtaagcatggccaacatcttccgggggtcctatctcgccggggccgggctggccttcagtatcatgaagtccgtggggacaggaaagcgcgggaccgggagtcagggcgagaccctgggggagaagtggaagaagaagctcaatcaactgtcaagaaaggagtttgacctgtacaagaagtccggcatcacggaagtggaccgcaccgaagcgaaggaggggttgaaaagaggggagatcactcaccacgcagtcagccgcggaagtgccaagctgcagtggttcgtggagagaaatatggtgatcccggaggggcgtgtaatcgacctgggctgtgggcggggcgggtggagctactactgcgccggcctcaagaaggtgaccgaagtgcgcggatacacgaagggcgggcccgggcacgaggagcccgtccccatgtccacctacggctggaacatagtaaagctcatgagtgggaaagatgtgttctacttaccgcccgagaagtgcgacaccctcctgtgcgacatcggcgagtccagccccagccccaccgtcgaggaaagccggacgatccgcgttctgaagatggtggagccttggcttaagaacaaccagttctgcatcaaggtactcaacccctacatgccgaccgtgatcgagcaccttgagcgtctgcagaggaagcacggcgggatgctcgtgcgcaaccccctatcccggaactcgacgcacgaaatgtactggatttccaacggcaccgggaacatcgtggccagtgtgaacatggtctcccgcctgctcctaaatcggttcacgatgacgcaccgcagaccgacaattgagaaggacgtggatctgggcgcgggcaccagacacgtgaacgccgagccagaaacgcccaacatggacgtgatcggtgagcggatcaagcgcatcaaggaggaacacaacagcacctggcactacgacgacgagaacccgtacaagacctgggcctaccacgggtcatatgaagtaaaggcgacggggagcgccagcagcatgatcaacggcgtggtaaaattgctgacgaagccctgggacgttgtgcccatggttacccagatggcgatgaccgacaccacgcccttcgggcagcagcgagtgttcaaggagaaggtggacacccgcaccccgcgcagcatgccaggcaccagacgagtcatggggatcacggccgagtggctttggcgcaccctcgggcggaacaagaagcccagactgtgcacccgggaagaatttacgaagaaggtgcgcacgaacgccgccatgggcgcggtgttcaccgaggaaaaccaatgggactcggccaaggccgctgtcgaagacgaggacttctggaagctggtggaccgcgagcgggagctccacaagctggggaaatgcggatcgtgcgtgtacaacatgatgggtaaacgcgagaaaaagctgggcgagttcgggaaggccaaggggtcacgggcgatttggtacatgtggctcggagcccgctacctggagttcgaggccctgggtttcctgaacgaggatcactggttctcgcgggagaactcctacagcggagtggagggggaaggcttgcataagcttgggtacatcctcagggacatcagcaagatccccgggggcgccatgtacgccgacgacacagcgggatgggacacccggatcacagaggacgacttgcacaacgaggagaagatcacacaacagatggacccggagcacaagcagctggctaacgccatcttcaaactgacctaccaaaacaaggtggtcaaggtccaacgccccacccccacaggcacggtaatggacatcatctcacggaaggaccagcgcgggtccggccaggtgggcacatacgggctgaatacattcacaaatatggaggcgcagctgatccggcagatggagggcgaaggtgtactcagcaaggccgatctggaaaacccgcatctcccagagaaaaagattacgcagtggctggagaccaagggcgttgagcgcctgaagcggatggctatatccggcgacgactgcgtggtcaagcccattgatgatagattcgccaatgctcttctcgccctgaatgacatggggaaggtgcggaaggacataccccagtggcagcccagcaagggctggcacgactggcagcaagtcccgttctgctcccaccacttccacgagctgatcatgaaggacgggcgcaaactagtagtgccctgccggccccaggacgagttgattggccgcgcccggatcagccagggtgcgggctggtccctgcgcgagaccgcctgcctgggcaaggcctacgcccagatgtggagcctgatgtacttccaccggagggacctgcgcttagcgtccaacgccatctgtagcgccgtccccgtccactgggtcccgacctccaggacaacttggagcatccacgcccaccaccagtggatgaccaccgaggacatgctgactgtgtggaacagagtctggatcgaggacaacccctggatggaggacaagacccccgtgaccacctgggagaacgtgccctacctggggaagcgggaggatcagtggtgtggcagcctcatagggcttacgtcccgcgccacctgggcccagaacatcccgaccgcaatccagcaagttcggagcctgatcggcaacgaagaattcctagactacatgccctccatgaagcgcttccggaaggaagaggagagcgagggggcgatctggtga

SEQ ID NO: 26073 - RNA, 9873 nt, synthetic construct
  misc_feature 1..9873: note = derived and/or modified CDS sequence (opt11) from DENV-3__FJ639826__SS-prME
  source 1..9873: mol_type = other RNA
acaagcctctgcctcatgatgatcctacccgcggccctggcgttccacctcactagccgggacggcgagccgcggatgatcgtggggaagaacgaacgcggcaagagcctgctattcaagacagcctctgggatcaacatgtgcaccctcattgcaatggacctgggggagatgtgcgacgacacggttacctacaagtgcccccacataacagaggtggagcccgaggacatcgactgttggtgcaacctgacaagcacctgggtgacctatgggacttgcaaccaggccggcgagcaccggagggacaagcggtccgtcgccctcgcgccgcacgttggcatggggctggacaccaggacgcagacatggatgtctgcagagggcgcctggcgccaggtggagaaggtcgagacgtgggccttacgccatcccgggttcaccatcctcgcgttgtttctggcccactacattggcacctccctgacccagaaggtggtaatctttatcctgctgatgctcgtcacgcccagcatgaccatgcggtgcgttggtgtgggaaaccgggacttcgtcgagggcctgtccggtgccacctgggtagacgtcgtcctggagcacggcgggtgcgtgaccacgatggccaagaataagcccaccctcgacatcgaacttcagaagaccgaggccacccagctggcgacgctccggaagttgtgcatagagggcaagatcaccaacatcaccaccgacagccgctgccccacgcagggcgaggccgtgttaccggaagagcaggaccagaactacgtctgcaagcacacttacgtggaccgggggtggggtaacgggtgcggcctcttcgggaaggggtccctggtgacctgcgccaagttccagtgcctggagcccatcgagggtaaggtcgtgcaatacgaaaacctcaaatacaccgtgattatcacagttcatacgggggaccagcaccaggtgggcaacgagacccagggtgtcaccgccgagatcactccccaggccagcacgaccgaggcgatcctgcccgagtacgggaccctagggctcgagtgctccccacgcaccggcctcgattttaacgagatgatcctgctcacgatgaaaaataaagcctggatggtgcaccggcagtggttcttcgacctgcctctgccctggaccagcggcgcaacgaccgagacgcccacctggaaccgcaaggagctcctggttaccttcaagaacgctcacgccaaaaagcaggaggtcgttgtacttgggtcccaggagggtgcgatgcacacggccctcacgggggccacagagatacagaactccgggggcaccagcattttcgccggccacctgaagtgcagactaaagatggacaagctcgagctgaagggcatgagctacgcgatgtgcacaaacacgttcgtcctgaagaaggaggtctccgagacacagcacgggacaatactcatcaaggtggagtacaagggcgaggatgtcccgtgcaagatccccttctcaaccgaggatgggcagggtaaggcccacaacggccgcctgatcacagccaaccccgttgtgaccaagaaagaggagcccgtcaacatcgaagccgaaccgcccttcggggagtcgaacatcgtgatcggcattggggacaacgccctgaagatcaactggtacaagaaaggctcaagcatcgggaagatgttcgaggcgaccgcccggggcgcccgccggatggccatcctgggtgacaccgcctgggacttcggttccgtgggcggagttctcaacagcctgggcaagatggtgcaccagattttcggtagtgcgtacacggccctgttctcaggcgtgtcctgggtgatgaagatcggcatcggggtgttactgacctggataggcctgaacagcaagaacacctccatgagcttcagctgcatcgccatcggaataatcaccctctacctgggcgccgtggttcaagctgacaccgggtgtgtgatcaactggaagggcaaggagctgaaatgcggtagcgggatcttcgtgaccaacgaggtccacacctggaccgaacagtacaaattccaggcggactccccgaagcgcctcgctacggccatcgccggcgcctgggagaatggggtgtgcggcatacgcagcaccacccggatggagaacctgctgtggaagcaaatcgccaacgagctcaactacatcctatgggagaacaacataaagctgaccgtggtggtgggggacatcataggcgtgctcgagcagggcaagcgcacgctgacgccccagccgatggagctgaagtactcctggaagacctgggggaaggcccggatcgtcaccgccgaaacgcagaacagctccttcatcatagatggcccaaacacgcccgagtgccccaacacctctcgcgcctggaatgtgtgggaggtggaggactacgggttcggcgttttcaccaccaatatctggctcaagctgcgggaagtctacactcagctgtgcgaccatcgcctcatgtccgccgctgtgaaggacgagcgtgccgtccatgccgacatgggctactggatcgagagtcagaagaacggtagctggaagctcgagaaggccagtttaatcgaggtgaaaacctgtacttggcccaagagtcacaccctatggtccaacggcgtattagagagcgacatgatcatccccaagtcgctggcggggccaatctcgcagcacaactaccgcccgggctaccacacgcagacggccgggccctggcacctcggcaagctagaactcgactttaattattgcgagggcaccaccgtcgttatcacagagaactgcgggacgcggggcccctccttacgcaccactacggtgtctggcaagctgatccacgagtggtgctgtcggtcctgcaccctgcccccgctccgctacatgggcgaggacgggtgctggtacggtatggagatccggcccatcagcgaaaaggaggagaacatggtcaagtccctggtgtcggccgggtccggggaggtggacaacttcaccatgggagtcctgtgcctcgccatcctgttcgaggaggtgatgcgcgggaagttcggcaagaagcacatgatcgccggggtgttcttcaccttcgtcctgctcttgagcggccagatcacgtggcgagacatggcgcacactctgatcatgatcggctccaacgccaccgatcgcatggggatgggtgtgacctacctcgccctgatcgccacgtttaagattcagcccttcctggccttgggattcttcctgagaaagctgacgagccgtgagaacctactgctcggcgtgggcctcgcgatggccaccaccctgcagctgcccgaggacatcgagcagatggccaacggcatagccctcggcctgatggcgctgaagctcatcacgcagtttgagacctaccagctgtggaccgccctgatctcgttaacctgcagcaacacgatcttcaccctgaccgtagcatggcggaccgccacgctgatcctcgccggcgtgagccttctgccggtctgccagtccagcagtatgcgcaaaaccgattggctcccgatgaccgtggcggccatgggcgtacctccgctcccgctgttcatcttcagcttgaaggacacccttaaacgtcggtcctggcccttaaacgagggggttatggccgtgggtctcgtcagcattttagcctccagcctgctccgcaacgacgtccctatggccggccccctggtggccggagggctgctcattgcctgctacgtgatcacagggacctccgccgacctgacagtcgaaaaggcagccgacgtgacctgggaggaggaggcggagcagaccggggtcagccacaacctgatgatcactgtcgacgacgacggaactatgcgtattaaggacgacgagaccgagaacatcctcacagtgctgctgaaaacggcccttctgatcgtgtccggcatcttcccgtacagcatccccgccaccttactcgtctggcacacatggcaaaagcaaacacagcgctcgggcgtgctgtgggacgtgccctctccgcccgagacgcagaaagccgagctggaggaaggggtctaccgtatcaaacagcagggaatcttcgggaagacccaggtgggcgtcggggtccagaaggagggcgtattccacaccatgtggcacgtgacccgcggcgccgtgctcacctacaacgggaagagactcgagcccaactgggcctcggttaagaaggatctgatctcatatggcgggggctggcgcctttccgcccagtggcagaagggcgaggaggtgcaggtcatcgccgtcgagcccggcaagaaccccaagaactttcaaacaatgccaggcaccttccagaccacgaccggtgagatcggggccatcgcgctggacttcaagcccgggacctcgggctcccccatcatcaaccgggagggcaaggtggtcggcctgtacggcaacggcgtggtaaccaagaacggcgggtacgtcagcggcatcgcacagacgaacgccgagccggacggccccactcctgagctggaggaggagatgttcaaaaagcgcaacctgaccatcatggacctccaccccggctcgggcaagacgcgaaagtaccttccagccatcgtgcgtgaggcgatcaagaggaggctgcggacgttaatcctggcgccgacccgcgtggtcgcagccgagatggaggaggccctcaaaggcctgcccatccggtaccagaccacagccacgaagtccgagcataccggcagggagatcgtggacctgatgtgccacgcgaccttcaccatgcggctcctcagccccgtgagagttcccaactacaatttgatcatcatggacgaggcccacttcacggaccccgcgtctatagcggcccgggggtacatcagcacccgcgtgggcatgggcgaggcggccgccattttcatgaccgcaacgccgcctgggacggcggacgcgttcccccaatccaacgccccaatccaggacgaggagcgcgacatccctgaacggtcatggaacagcggcaacgagtggatcactgacttcacaggtaaaaccgtgtggttcgtccccagcattaaggccggcaacgacatcgccaattgcctccgcaagaacgggaagaaggtgatccagctgtcccggaagacattcgacaccgagtatcagaagacgaagctgaacgactgggacttcgtagtcaccaccgacatcagcgagatgggggcgaacttcaaggccgaccgggtgatcgacccgcggcgctgtctgaaacccgttatcctgacggatggccccgagcgggtcatcttagccgggcccatgccggtgaccgccgcatccgcggcccaaaggcggggccgcgtcgggcggaacccccagaaggagaacgaccaatacatcttcaccgggcagccactcaacaatgacgaggaccacgcccactggaccgaagcaaagatgctgctggacaacatcaacacgcccgaggggattatccccgccctcttcgaacccgaacgcgagaagtccgcggccatcgacggcgagtaccggctgaagggtgaatcccgcaaaaccttcgtcgagctgatgcgacgcggggacctccccgtgtggttagcccacaaggtcgctagcgagggcatcaagtatacagaccggaagtggtgcttcgatgggcagcgcaacaaccagatcctggaggagaacatggacgtcgagatatggaccaaggagggcgaaaagaaaaagctccggccccgttggctagatgcgcgtacgtactccgaccctctggccctcaaagagttcaaggacttcgcagctggccgtaagagcattgcattggacctggtgactgagatcgggcgcgtccccacacacctcgctcaccgaactcgcaacgccttagacaacctggtgatgctccatacgtcagagcacggcggtaaggcctaccggcacgcggttgaggagctgcccgagaccatggagactctgcttcttctgggcctcatgatcctgctgaccgggggcgccatgctattcctgattagcggcaaggggatcggaaagacgtccatcgggctgatctgcgtcatcgcgtcaagcggcatgctctggatggccgaaatcccgctgcagtggatcgcgtccgctatagtgttagagttcttcatgatggtcctccttatccccgagcccgaaaagcagcgcaccccacaagacaaccagctggcgtacgtcgtaatcgggatcctgactctagctgcaatcatcgccgccaacgagatgggcctgctcgagacaacgaagcgggacctgggcatgagcaaggagccaggggtggtctcccccaccagctatctggacgtggacctccacccggcgtccgcctggactctgtacgccgtggctactacggtcatcactcccatgttgcgccacaccatcgagaacagcactgccaacgtgtccctagcggccattgccaaccaggccgtggtcctgatgggccttgacaaggggtggccgatcagcaagatggacctcggcgttccactgctggccctaggctgctattcccaggtgaaccccctaacgctaactgcggccgttctcctgctgatcacgcactacgccattatcggccctggcctccaggccaaggccacccgagaggcgcagaagcgcacggccgccgggatcatgaagaatccgaccgtggacggcattatgaccatcgatctggaccccgtcatctacgacagcaagttcgagaagcagttgggccaggtcatgctcctggtgctgtgtgccgtgcagctcctgttgatgaggacatcctgggctctctgcgaggcgctgactctggccaccggacccattactacactctgggagggcagccccggaaagttttggaataccaccatcgccgtttccatggccaacatctttcgcggctcatacctggcgggagccggcctcgccttctccataatgaagagtgtgggaactggcaagcggggcaccgggtcccagggcgagaccctaggagagaagtggaagaagaagctgaaccaactgagtcgcaaggagtttgacctatacaagaagtccggcataacggaggtggaccggactgaggctaaggaggggctaaagcgcggagagatcactcatcacgccgtcagccggggcagcgcgaagctgcagtggttcgtagaacgcaacatggtgatcccggaggggcgggtcatcgatttaggctgcgggcgcggcggttggtcgtactactgcgccggtctgaaaaaagtgaccgaggtgaggggctacaccaagggaggccctgggcacgaggaacccgttcctatgagcacctacggttggaacatcgtgaagctgatgtccggaaaggacgtcttctacctcccgcccgagaagtgcgacaccctgctgtgtgacatcggcgagtcctcgccctcgcccactgtcgaggagagccgcaccatccgcgtgctgaaaatggtggagccctggctcaagaacaatcaattctgcataaaggtcttaaacccttacatgcccgccgtgatcgagcacctggagcggctccaacgcaagcacggtggcatgctggtgcgaaaccctctaagccgcaactccacccacgagatgtattggatctcaaacggcaccgggaatatagtcgcgtcagttaacatggtgagccggctcctgctgaaccgcttcacaatgacgcaccggcgcccgaccattgaaaaagacgtagacctcggcgcaggcacccggcacgtgaacgcggagcccgaaaccccaaacatggacgtgattggggagcgcatcaagcggatcaaggaggagcacaactccacgtggcattacgacgacgagaacccgtacaagacctgggcctaccacggcagctacgaggtaaaggccacgggttccgccagctcgatgatcaacggcgtggtcaagctgctgaccaagccctgggacgtggtgcccatggtcacgcagatggccatgaccgacaccacccccttcgggcagcagcgcgtgtttaaagaaaaggtggacacgcgtacaccgcgctccatgcccggcacccgccgcgtcatggagatcacggccgagtggctctggcggacgctgggtcgcaacaagaagccccgactgtgcacccgcgaagagttcaccaagaaggtacgcaccaatgccgccatgggtgccgtgttcacggaggagaaccagtgggactccgccaaggccgccgtcgaggacgaggacttttggaagctcgtggatcgggagcgcgaactgcacaagctcggcaagtgcgggagctgcgtgtacaacatgatgggcaagcgggagaagaagctgggggagttcggcaaggcaaagggcagccgtgccatctggtacatgtggctgggggcgcggtaccttgagttcgaggccctcggcttcttgaacgaggaccactggttctcccgcgagaacagctattccggggttgagggcgaagggctgcataagttgggttacatcctccgcgatatcagcaagatccccggcggggcgatgtacgctgacgacaccgccggctgggacacccgcattaccgaagacgacctgcacaacgaagagaagatcacccaacagatggatccggagcatcgccaactcgcgaatgccatctttaagctgacgtaccaaaacaaggtggtgaaggtccagcgccccacccccaccgggaccgtaatggacatcatctctaggaaggaccagaggggcagcggccaggttgggacgtacggcttaaacaccttcaccaatatggaggcccagctcatccggcaaatggagggcgagggcgttctgtccaaagccgatctggagaacccccatctcccggagaagaagatcacccagtggttagagacgaagggtgtggagcgcctgaagcggatggccatcagcggcgacgactgtgttgtcaagccgatcgatgaccgcttcgcgaacgccctcctggccctaaacgacatgggcaaggtgaggaaggacattcctcagtggcaaccctcgaagggctggcacgactggcagcaggtacccttctgcagccaccacttccacgaacttatcatgaaggacggccgcaagctggtcgtgccctgcagacctcaggacgagcttatcgggcgagcccggatatcccagggcgccggatggagcctgcgcgagaccgcgtgcctaggcaaggcctacgctcagatgtggtccctcatgtacttccaccgccgggacctgcgcctggccagcaacgccatatgctccgccgtgcccgtccactgggtgccgaccagccggaccacatggagtattcacgcccaccaccaatggatgaccaccgaggatatgctgactgtgtggaatcgcgtctggatcgaggacaacccctggatggaggacaagacgccagtgaccacctgggagaacgtgccctacctcggcaagcgtgaggaccagtggtgtggcagcctgatcggcttgacctccagggctacctgggcccagaacatcccgaccgctatccagcaggtccgcagcctcatcgggaacgaggagttcttagactatatgcccagcatgaaaaggttccgaaaggaagaggagtccgaaggcgccatctggtga

SEQ ID NO: 26074 - RNA, 9873 nt, synthetic construct
  misc_feature 1..9873: note = derived and/or modified CDS sequence (opt11) from DENV-3__FJ810416__SS-prME
  source 1..9873: mol_type = other RNA
accagcctgtgcctaatgatgatcctccccgccgccctggcgtttcacctcaccagtagagatggcgagcctcggatgattgtagggaagaacgagcggggcaagtcgctgctgttcaagactgcctctgggatcaacatgtgcactcttattgccatggacctcggggagatgtgcgacgacaccgtgacctacaagtgcccccacatcactgaggttgagcccgaagacatcgactgctggtgcaacctgaccagcacctgggtgacatacgggacgtgcaatcaggccggggaacaccgacgtgacaaacgttccgtcgccctcgcgccacacgtggggatggggctggacacacgcacccagacctggatgtctgccgagggcgcctggcgccaggtggagaaggtcgagacttgggccttgcgccacccagggttcactatcctcgcactgttcctggctcactatatcggcacctccttaacccagaaggttgtgatcttcatcttgctaatgcttgtaacgcctagcatgaccatgcggtgcgtaggggtgggcaaccgcgacttcgtcgagggcctgtccggcgcgacctgggtggacgtggtcctggagcatggcgggtgcgtgactaccatggccaaaaacaaacccaccctcgacatcgagttgcagaagaccgaggccacccaattggcgacgctccgaaagctatgcatcgaggggaagatcaccaatataaccacggactcccgctgccccacgcagggcgaggccgtgctgccggaagaacaggatcagaactacgtgtgcaagcacacatacgtggaccgagggtggggcaatgggtgcggcctctttgggaagggttccctggttacctgcgcgaagttccagtgcctggagcccatagagggcaaagtcgtgcagtacgagaacctcaagtatactgttataatcacggtccacaccggtgaccagcatcaggtgggcaacgagactcaaggtgtcaccgccgaaatcactccccaagcatcgaccaccgaggcgatcttacccgagtacggcaccctcgggctcgagtgctccccgcgaaccgggctggactttaacgaaatgatcctgctcacgatgaagaataaggcctggatggtccaccggcagtggttcttcgacttgcccttgccatggaccagcggcgccacgaccgagacgccgacctggaacagaaaggagttactggttaccttcaagaacgcccatgccaagaagcaggaggtcgtggtgctggggtcccaggagggtgcgatgcacaccgccctcacgggggccaccgagatccagaactcaggcgggaccagtattttcgccggccacttaaagtgccggctgaagatggacaagctagagctgaagggcatgagctatgccatgtgtactaacacgttcgtcctgaaaaaggaggtgtccgagacacagcacggaaccatcctgatcaaagtggaatacaagggcgaggatgtcccgtgcaaaatcccattctccaccgaggacggacagggcaaggcgcacaacggccgcctgatcaccgccaacccagtggtgactaagaaggaggagcccgtgaacattgaggccgagccgccttttggagagagcaacatagtcatcggcatcggggacaacgccttgaagatcaactggtacaagaagggctccagcatcgggaagatgttcgaagcgaccgcccgcggcgccaggcggatggctatcctgggcgacaccgcctgggacttcgggagtgtgggcggggtcttaaactctctgggcaagatggtccaccagatcttcgggtccgcctacaccgccctgttcagcggcgtgtcctgggtcatgaagatcggcatcggggtgctcttaacctggatcgggctgaatagcaaaaacacctccatgtctttctcctgcatcgcaattgggatcatcaccctctacctgggcgcagttgtccaggctgacatggggtgcgtgatcaactggaagggcaaggagctgaaatgcggctctgggattttcgtgacgaacgaggtccacacctggaccgaacagtacaagttccaggccgactccccgaagcgcttggctaccgccatcgcaggcgcctgggaaaacggggtgtgcggcatccgcagcacgacacggatggaaaacttgctatggaagcagatagcaaacgagctcaactacatcctgtgggagaacaacatcaagctcaccgtggtcgtgggggacatcatcggcgtgctagagcagggcaagaggaccctgacgccccaaccgatggagctgaagtattcctggaagacctggggaaaggccaaaatcgtcaccgccgagacgcaaaacagcagctttatcattgatggtccgaacactcccgagtgcccctctgcctcgcgtgcgtggaacgtttgggaggtagaagactacgggttcggcgtattcaccaccaatatctggctcaagctgcgcgaagtgtacacccagctgtgcgaccatcggctcatgagcgccgcagtgaaagatgagcgcgcagtgcatgcggacatgggctattggatcgaaagccagaagaacgggagctggaaattggagaaggcgagcctgatagaggtgaagacctgtacgtggcccaagtcccacacgctctggagcaacggcgtgctggagtccgacatgatcatccccaagagccttgcggggcccatctcccagcacaactacaggccgggctatcacacccagactgccggaccctggcatctaggtaagttagagctcgacttcaactactgcgagggtactaccgtcgtgatcacagagaattgcgggacccgcggccctagcttgcggacgaccacagtaagcggcaagttaatacatgagtggtgttgccgtagctgcaccttgcctccgctacggtacatgggcgaggatgggtgctggtacggcatggagatacgcccaatctccgagaaggaggagaacatggtcaagagcctggtatctgccggaagcggggaggtggacaacttcacaatgggcgtcctttgcctcgccattctgttcgaggaggtgatgcgtggcaagttcggcaagaagcacatgatcgcgggcgtgttcttcaccttcgtcttacttctgtccggacagatcacctggcgcgacatggcccacaccctgatcatgatcggaagcaacgcctccgaccggatggggatgggcgtgacgtacctcgcccttatagcaacctttaagatccagcctttcctggcactggggttcttcctgcgcaagctgacctcgcgggagaacctactgctgggcgtggggctggccatggctaccacgctgcagctgcccgaggatattgaacagatggccaacgggatcgcgctcggcctgatggctctgaaattgatcacacagttcgagacctaccagctgtggaccgccctgatcagcttgacgtgttccaacaccatctttaccctgaccgttgcctggcgcaccgcgaccctgatactcgccggggtgagccttctgccagtctgccaatccagctccatgcggaagaccgattggctccccatgaccgtggctgccatgggggtgccgcccctcccgttatttattttcagcctcaaggacacgctgaagcgcaggtcctggcccctgaatgagggagtgatggcggtgggcctcgtgtcgatcctggcctccagtctgctccggaatgacgtgcccatggcgggccccctggtggccgggggcctactcatagcatgctacgtgatcaccgggacctctgccgacctgaccgtggaaaaggccgcggacgtcacgtgggaggaagaggcggagcaaaccggcgtgagtcacaatctgatgatcactgtcgacgacgacgggaccatgcgaatcaaggacgacgagaccgagaacatcctcacggtgctgttgaagaccgccctcctgatcgtatccggtatcttcccctactctatccccgctacactgctcgtctggcacacgtggcagaagcagactcagcgttccggcgttctgtgggacgtcccgagtcccccagagacccagaaggccgaactggaggagggggtctaccgcatcaagcagcagggcatcttcgggaagacccaggtgggcgtgggagtccagaaggagggggtgtttcacaccatgtggcacgtgacgcggggcgcggtgctcacgtacaatggaaagcggcttgaacctaactgggcctccgtaaagaaggaccttatctcatacggagggggctggcgtctctccgcacagtggcaaaaaggggaggaggtccaggtcattgccgtggagcccggcaagaaccccaaaaatttccagaccatgcccggcacgttccagacaaccaccggagagatcggagcgatcgccctggacttcaagccagggacctccggctccccaatcataaatcgcgagggcaaagtggtcggtctgtacggcaacggggtggtcacgaagaacggcgggtatgtctccggcatcgcccagaccaacgcagagccggatgggccaacccccgagctggaggaagagatgttcaagaagcggaacctcactatcatggacctgcaccccgggagtggcaaaacgcgcaagtacctgccggccattgttcgtgaggcgatcaagcgccggttgcggaccctgattctggctccaactagagtggtcgcagccgagatggaggaggctctcaaggggctgcccatacgctaccagaccacggcgaccaagtccgaacacaccggccgggagatcgtagacctgatgtgccacgccactttcactatgcggctgctgagccccgtacgggtcccgaactataacctcatcatcatggacgaggcacactttacggaccccgccagtatcgccgcgcgcggttacattagcacgcgggtgggcatgggtgaggccgcagccatcttcatgactgcgacgccgcccgggaccgcagacgccttccctcagtctaatgcccccatacaggacgaggaacgtgacatcccggagcggagctggaactccgggaacgagtggataaccgacttcgccggtaagaccgtgtggttcgtcccttccatcaaggcgggaaacgatattgccaattgcctcaggaaaaatgggaaaaaggtgatccaactgtcccgcaagacgttcgacacagagtatcagaagactaagctcaatgactgggacttcgtcgtcaccacggacattagcgagatgggggccaacttcaaggcagatcgggttatcgacccgcgccgatgcctcaagcccgtgatcctgaccgatggccccgagcgcgtcatcctggccggccctatgccggtgaccgcagcctccgccgctcaacggcgaggccgggtcgggcgcaatccccagaaggagaacgaccagtacattttcaccggccagcctctcaacaacgacgaagaccacgcccactggacggaagcgaaaatgctgctggacaacatcaacacgccagaggggatcatcccggctctcttcgagcccgagcgggagaagtcggccgccatcgacggcgagtaccgcctgaagggcgaatcccggaagaccttcgtagagcttatgcgccgcggggacctccccgtgtggctcgcgcacaaggtcgcaagcgagggcatcaagtacacagaccgcaagtggtgcttcgacggacagagaaacaaccaaatcttggaagagaacatggacgtcgagatatggaccaaagagggagagaagaagaagctccgcccccggtggctagacgcccgcacttactccgaccccctggccctgaaggagtttaaggacttcgcagcgggccgcaagtctatcgcactggacctgatgaccgagatcggtagagtgccctcccacctagcccatcgaacccggaatgccctggataatctggtcatgctccataccagcgagcacggcgggaaagcataccgccacgcggtggaagaactacctgaaacgatggaaaccctgttactgctgggcctcatgatcctgctgaccgggggcgctatgctgttcctgattagcggcaaggggatcggaaagacgtcaatcgggctgatctgcgtcattgcgtcgtccggaatgctctggatggcagagatacccctgcagtggatcgctagcgcgatcgtcttggagttctttatgatggtgctcctgatcccggagcccgagaagcagcggacgccacaggacaaccagttggcctacgtggtcatagggatcctcaccctggctgccatcatcgccgctaatgaaatgggtctgctcgagaccaccaagcgcgacctgggcatgtccaaggagccaggggtggtgtcccccacttcgtatctcgacgtcgatttacaccctgcctcggcctggaccctttacgccgtagcgaccaccgtgatcacgcccatgctgaggcacaccattgaaaactccaccgccaacgtgagcctagcagcaatcgccaatcaggcggtggtgctgatgggcctggataaggggtggccgatttccaaaatggacctcggcgtccccctgctggccctcgggtgttactcccaggtcaatcctctgaccctgacggccgccgtgctcctgcttataactcactacgcgatcatcgggcccggcctccaagcaaaagccacccgcgaggcccagaagcggactgccgccgggatcatgaagaacccgacggtcgacggtatcatgacgatcgatttagaccccgtgatctacgattcaaagttcgaaaagcagttgggacaggtgatgctcctggtcctctgcgcggtgcagttactgctgatgcgcacaagctgggccctctgcgaggccctgaccctggcgacaggccccatcaccactttatgggaaggttccccaggaaaattttggaacaccacgatcgcggtgtccatggccaacatcttccggggctcctacctggccggggccggcttggcattctccatcatgaaaagcgtcgggaccggcaagcgcggcacgggatcgcagggagagaccctcggggagaagtggaaaaagaagttaaaccagctgagccggaaggagttcgatctctacaagaagagtgggataaccgaggtggatagaacggaggcgaaggagggactgaagcggggtgagattactcaccacgccgtcagtcggggctccgccaagctgcagtggttcgtcgagcggaacatggtgatcccggagggaagggtgatcgacctgggatgcgggcggggcgggtggagctactactgtgccggcctcaagaaagtcaccgaggtgcggggctacaccaaaggcggtcccgggcatgaggagcccgtgccaatgagtacctatggctggaacatcgtcaaactcatgagcgggaaggacgtgttctacctccctcccgagaagtgtgacaccctgctgtgcgacatcggcgagtcctcgccttcccccaccgtggaggaaagcagaaccattagggtcttaaagatggtagagccgtggttgaagaacaatcagttttgcatcaaggttctgaacccctacatgcccacggtcgtcgagcacctcgagaggctccagcggaagcatggagggatgctggtgcgcaaccccctgagccggaacagcactcacgagatgtactggatctccaatggcaccggcaacatcgttgcaagcgttaacatggtgtcacgcctactgctgaaccgttttaccatgacgcaccgccggccgaccatcgagaaggacgtcgatctaggggcgggaacccgccatgtgaacgccgagcccgaaacccccaatatggacgtgatcggggaacgtatcaagcgcatcaaggaggagcataacagcacgtggcactacgacgacgagaacccgtataagacctgggcttaccacggctcctatgaggtcaaggcgaccgggagcgcctctagcatgatcaatggcgttgtcaaacttctgaccaagccatgggacgtagtccccatggtcacgcaaatggcgatgaccgataccacgcccttcgggcagcagcgggtgttcaaggagaaggtggacacgcgcactccacggagcatgccgggcacacgccgggtcatgggcatcaccgccgagtggctctggcgcacgctagggcgaaataagaagccccgcctatgcacccgggaggagttcaccaagaaggtgcgaaccaatgccgctatgggtgcggtcttcacagaggagaatcaatgggactccgcgaaggccgccgtcgaagacgaggacttctggaagctagtggaccgcgagcgggagctgcacaagctggggaagtgcggaagctgcgtttacaatatgatggggaagagagagaagaagctcggcgagttcggcaaggcgaaaggcagtcgggcaatatggtacatgtggcttggggcccgatatctggagttcgaggcacttggttttctgaacgaagaccactggttcagccgagaaaattcctactccggcgtcgagggggagggcctgcacaaactcggctacatcctgcgagacattagtaagatccccggaggggccatgtatgccgatgacaccgcggggtgggacacgcggatcaccgaggacgacctccacaacgaggagaagatcacgcagcaaatggaccccgagcatcgccagctcgccaatgccatcttcaagctgacctaccaaaataaggtggtgaaagtgcagcggcccacccccacaggcaccgtgatggacatcatcagtcgcaaggaccaacggggctccggccaggtgggtacgtacggtctgaatacctttaccaacatggaggcgcagttgatccgccaaatggagggagagggtgtcctgtcaaaagccgacctggagaatccccggcttccggagaagaagatcacccagtggctggagacgaagggtgttgagcgcctgaagcggatggcgatctccggagatgactgcgtggtgaaacccatcgatgaccggtttgccaacgccctcctagccttaaacgacatggggaaggtacggaaggatatcccccagtggcaaccctctaagggctggcacgactggcagcaggttccgttctgctcgcaccactttcacgagctaatcatgaaggacggacgcaagctagtcgtgccatgccggccccaggacgagctaatcggtcgcgcccggatcagccagggggcgggctggtctcttagagagaccgcctgcctgggcaaggcctatgcccagatgtggagcctgatgtacttccaccgccgggacctccgcctcgcgtccaacgccatctgttcagccgtgcccgtccattgggtacccacctcccgaaccacgtggagcattcatgcccaccaccagtggatgacgaccgaggacatgctgacagtgtggaaccgcgtctggatcgaggacaatccctggatggaggacaagacccccatcaccacctgggagaacgtgccctatctcggaaagcgggaggaccagtggtgcggcagcctgattggcctgacctcgcgcgccacgtgggcgcagaacatcccgaccgccatccagcaggtccggagcctcatcggcaacgaggagtttctggattacatgccttccatgaagcgcttccggaaagaggaagaaagcgagggggccatttggtga

SEQ ID NO: 26075 - RNA, 9873 nt, synthetic construct
  misc_feature 1..9873: note = derived and/or modified CDS sequence (opt11) from DENV-3__GQ252678__SS-prME
  source 1..9873: mol_type = other RNA
accagcctgtgcttgatgatgatactgcccgccgcccttgcgttccacctcaccagccgggatggggaaccccgtatgattgtgggtaaaaatgagcggggcaaaagcctgctgttcaagacggcgtctggcatcaacatgtgcacgctcattgccatggacctgggtgaaatgtgcgacgacaccgtgacctataaatgcccccacatcacggaggtagagcccgaggatatagattgctggtgcaaccttaccagcacctgggtgacttacgggacgtgcaatcaggccggcgagcatcggcgcgacaagcggagcgtggccctcgcgcctcacgtgggcatggggctggatactcgcactcagacctggatgagcgccgagggcgcgtggcgtcaagtggagaaggtggagacgtgggccttacgacacccggggttcactatcctcgcactcttcctagcgcactacatcggcacctccctcacgcaaaaggtggtgatattcatccttctgatgctcgtcacgcccagcatgaccatgcggtgcgttggcgtgggcaaccgcgacttcgtcgaaggcctgagcggggctacctgggtggatgtggtcctggagcacggcgggtgtgttacaacgatggctaagaacaaaccaaccttggacatagagctgcagaaaaccgaggccacgcagctggcaacgctccggaagctatgtatcgagggcaaaatcacaaacattaccaccgatagtcgctgccccacccaaggcgaggccgtgttaccggaggagcaagaccagaattacgtatgcaagcacacctacgtcgatcgggggtggggcaatgggtgcgggctgtttgggaagggctcactggtgacctgcgccaagttccagtgtctggagcccatcgagggtaaggtcgtgcagtacgagaaccttaaatacaccgtcatcataacggtacacaccggggaccagcaccaggtgggcaacgaaacgcagggtgtcacagccgagatcaccccacaagccagcaccaccgaggcaatcctgccagagtatggcactttagggctcgaatgctctccgcgtaccggtttggacttcaatgagatgatcttgcttacaatgaaaaacaaggcttggatggttcaccgccagtggttcttcgacttacccctgccgtggacctcaggggccaccaccgaaacgcccacctggaatcgcaaggagctcttggtgactttcaagaacgcgcacgccaagaagcaggaggtcgtggtgctgggtagccaggagggggcgatgcatacggccctaacgggggcgaccgaaattcagaacagcggcggtacctccatattcgccgggcatctgaagtgccgtcttaagatggacaagctcgaactgaaggggatgtcctacgcaatgtgcaccaataccttcgtccttaagaaagaagtatccgagacccagcatgggaccatcctcatcaaggttgagtacaaaggcgaggacgtcccgtgcaagatccccttcagcacggaggatgggcagggtaaggctcataacggccgcctgatcacggccaaccccgtcgtgacgaaaaaggaggagcccgttaacattgaagccgaaccacccttcggggagtcaaacatcgtcatcggcattggggacaacgccctgaagatcaattggtacaagaagggctccagcatagggaagatgttcgaagcgaccgcccggggcgcccgccggatggccatcctgggcgacaccgcctgggacttcgggtccgtgggcggggtgctcaacagcttaggcaagatggtacaccagatattcgggtccgcatacacggccttgttctccggcgtaagttgggtgatgaagattggcatcggtgtactcttaacgtggatcggcctaaactcgaagaatacctcaatgagcttctcctgcatcgccatcggtatcatcacactctacctaggcgcggtggtccaagccgacatgggatgcgtgatcaactggaaaggcaaagaactgaagtgtggatccggcatattcgtgacgaacgaagtccacacttggaccgagcagtacaaattccaggcagactctcctaaacgcctcgcgaccgccatcgccggagcctgggaaaatggggtttgcggcatccgcagcacgacccgaatggaaaacttgctttggaagcagatcgcgaatgagctcaactacatcctgtgggaaaacaacatcaaactgacagtagtcgtgggggacataatcggggttctcgagcagggcaagcgcaccctcacgccccaaccaatggagctgaagtacagttggaagacttgggggaaggcgaaaattgtcacagccgaaactcaaaacagttcctttatcatcgacggccccaacacgcccgaatgtcccagcgcaagtagggcgtggaacgtgtgggaggtggaggactatggatttggcgtatttaccaccaacatttggctcaagctgagagaggtgtacacgcagctgtgtgaccacagactcatgtctgccgccgtcaaggacgagcgcgccgtgcacgccgacatgggctattggattgagtcccaaaagaacgggtcgtggaaactcgaaaaggcgagcctaatcgaggtgaagacctgtacgtggccgaagtcccacaccctctggagcaacggcgtcctggaatccgatatgattatccccaagagtctggcagggcctatctcccagcataactaccgcccaggctatcacacgcagaccgccgggccctggcacctcggcaaattggagttggacttcaactactgcgaaggcacgaccgttgtgataaccgagaattgcgggacccgcggaccctcactccggacgaccaccgtgtccgggaagctgatccatgagtggtgctgccgcagttgcaccctgcccccgttacggtacatgggagaggacggatgctggtacgggatggagatccgccctattagcgaaaaggaggagaacatggtcaagagtttggtatccgccggctctggggaagtagataattttacgatgggcgtactgtgtctcgccattcttttcgaagaagtgatgcggggcaagttcggcaagaagcatatgatcgcgggggtgttcttcaccttcgtccttcttctgtccgggcaaatcacctggcgtgacatggcccacacactaatcatgatcggcagcaacgcctccgacaggatgggcatgggagtcacgtacctcgccctgattgccacgtttaagattcagccctttttagcgctagggttcttcttacgcaagctgacctcccgggagaatctcctgttgggagtgggcctcgccatggccacaacgctccaactgcctgaggacatcgagcagatggccaacggaatcgcgcttggtctcatggctctgaagctcatcacccagttcgagacttaccagctatggaccgcactgatctcgctcacgtgctctaataccatctttacgttaaccgttgcgtggcgcactgcaaccctgatcctcgctggggtgtctctcctcccggtatgtcagagctcatccatgcggaagaccgactggctccccatgaccgttgctgccatgggcgtgccgcccctcccgctattcatcttcagcctgaaggatacgctgaagcgccgttcctggccactgaacgaaggggtaatggccgtcggtctcgtcagcatcctggccagttctctcttgcggaacgacgtccccatggccggtcccctggtagccgggggcctgctcatcgcctgctacgtgatcactgggacatccgccgacctgactgttgagaaggccgcagacgtgacatgggaagaggaagctgagcagacaggcgtgagccacaacctgatgataaccgtcgacgacgacgggaccatgcgcatcaaagatgacgaaaccgaaaacatcctcacggttctcctgaagaccgccctcctaatagtgtccggaatcttcccgtacagcattcccgccacgctactcgtctggcacacctggcagaagcaaacgcagagatcaggcgtgctgtgggacgtgcccagccctccggaaacccagaaagcggagctcgaggaaggggtctaccgcatcaaacagcagggtatctttgggaagacccaggttggcgttggagttcagaaggaaggagtgttccacaccatgtggcacgtgactcgcggcgcggtcctcacccacaacggtaagcgcttggagcccaactgggcttccgtgaaaaaggacctgatttcgtatggcggagggtggcggctcagtgcccaatggcagaagggggaggaggtgcaggttatcgccgtggagcccggcaaaaatcccaagaacttccagactatgcccggcaccttccagacgactaccggggagatcggggcgatcgccctggacttcaaacctgggacctcggggtcgcccatcataaacagagagggaaaagtggtggggctttacgggaacggagtggtgacgaaaaacggagggtacgtctcgggcatcgcccagaccaatgccgagccggacggccctacacccgagctggaggaggagatgttcaagaagcggaacctaaccatcatggatctgcatcccgggtcggggaagacgcgcaaatacctcccggccatcgtgcgggaggccatcaaacgacgccttcgcaccctgatcctcgcccccacccgggtggtcgccgccgagatggaagaggccctcaaggggctgccgatccgctaccagacaacggcgaccaaaagtgagcataccggccgagagatcgtggacctaatgtgccacgccacattcacgatgcgtctcctgagcccagtccgggtcccgaattacaacctgatcataatggacgaggcccatttcaccgaccccgcctccattgcagcgcgcgggtacatctcgacccgtgtgggtatgggcgaggcagccgccattttcatgaccgcaacgccgcccggtaccgctgatgcctttccgcagtcgaacgctccaattcaggacgaggaacgcgacattcctgagagaagctggaactccgggaacgagtggatcaccgacttcgccgggaaaaccgtgtggttcgtccccagcatcaaagcgggcaacgatattgcaaattgccttcggaaaaacgggaagaaggtgatacagctatcccgcaagacctttgacaccgagtaccagaagaccaagttaaatgactgggatttcgtggtcacaacagatattagcgagatgggcgccaacttcaaggctgaccgggtgatcgacccgagacggtgcttaaagccggtgatcctcacggacggcccggagcgagtcatcctggctgggcccatgccggtgaccgccgcctcagcagcacaacgtcgcggtcgggtgggccggaacccccaaaaggagaacgaccaatacatcttcaccggacagcctctaaacaacgatgaggaccacgctcattggaccgaggcaaagatgctgctggacaacatcaatacgcccgaaggtataataccagcactcttcgagcctgagcgtgagaagtccgccgctattgacggcgagtaccgcctgaagggcgaatcaaggaagaccttcgtcgagctaatgcgccgcggggacctccccgtctggcttgcgcataaggtcgccagcgagggcatcaagtacaccgaccggaagtggtgtttcgacgggcagcgaaacaaccagattctggaggagaacatggacgtggagatctggaccaaggaaggagagaagaagaagctccgcccgcggtggctggacgcaaggacgtactccgacccgttagccctcaaggagttcaaagatttcgcggctgggcgaaaaagcatcgccctggacctggtgaccgagatcggccgggtacccacccacctcgcacatcgcactaggaacgccctcgacaacctggtgatgctgcacacgtccgagcacggagggaaagcctaccgccacgcggtggaagaactaccagaaaccatggagacactactcctgctgggcctcatgatcctcctgacgggcggagcaatgctgttcctgatatcaggcaagggaataggcaaaacaagcatcggactgatctgcgtcatagcatccagcggcatgctctggatggccgagattccgctgcaatggatcgcctccgctatcgtgctagagttcttcatgatggtgcttctgattccggagcccgagaagcagcggacgccccaggacaaccagctggcctacgtcgtgatcgggatcttaaccctggccgccatcatcgctgcgaatgagatgggcctgctggaaaccacgaagcgcgacctgggcatgagcaaggagccgggggtggtttccccaacgagctacctggacgtggatctacacccagcctccgcctggaccctgtacgccgtcgcgaccacggtcattactccgatgctgcggcacacaatcgagaacagcacagcaaacgtgtccttggcggcgatcgccaaccaggcggtggtcttgatgggcctggacaaggggtggccgatcagcaagatggatctcggtgtgcccctactggcgctcgggtgctactcccaggtgaaccccctgaccttgaccgcagccgtactcctgctaataacccactacgccatcatcggccccggcctccaggcgaaggccacacgcgaggcgcagaagcggacggccgccgggattatgaagaaccctacagtcgacggtataatgacgattgatctggaccccgtaatctacgactcaaaattcgagaaacagcttgggcaggtcatgttgcttgtcctgtgcgcggtgcagcttctgcttatgcgcacgtcctgggccctctgcgaggctctgacgttagccaccggccccattacgacactgtgggagggcagccccggtaagttttggaacacgaccatcgctgtctcaatggccaacatcttccggggatcctacctggccggagccggcttggccttctcaattatgaagtccgtggggaccggaaagcgaggtactgggtctcagggcgagaccttgggggaaaagtggaagaagaagctaaaccagttgagccggaaggagttcgacctctataagaagtcgggcatcacggaggtggacagaaccgaggcgaaggaggggctgaagcggggcgaaatcacccaccacgcggtctcaagaggcagcgccaaactgcagtggtttgtcgagaggaacatggtgattccggaggggcgagtcatagacctcggctgcgggcggggcggttggtcctactactgcgccggcctgaagaaggttacggaggtgcgcggctacacgaagggcggtcccgggcacgaggagcccgtgccgatgtcgacctacggctggaacatcgtgaagctgatgtccggcaaagacgtgttctacctccctcccgagaagtgcgacaccttactgtgcgatatcggcgaaagctcccctagccccaccgtcgaggagtcccggacaatcagagtgctgaagatggtggagccgtggctcaagaacaaccagttctgcataaaggtcctgaacccctacatgccgaccgtgatcgagcacttggaacgcctgcagcggaagcacgggggtatgctcgtgcgcaatccccttagccggaacagtacccacgagatgtattggatctcgaacggtaccggcaatatcgttgcctccgtgaacatggtgagccgcctcctgctcaatcgtttcacgatgacccaccgacggccgacaatagagaaggacgttgacctcggagcgggcacccgccacgtgaacgcggagccagagacgcccaacatggatgtcatcggggaacggatcaagcgcatcaaggaggaacacaactccacgtggcactatgatgacgagaacccgtataagacctgggcttaccacggcagctacgaggtcaaggccaccgggtcggccagctccatgataaacggcgtggtcaagctgctgacgaaaccctgggacgtggtgcccatggtcacccaaatggcgatgactgacaccactcccttcgggcaacagagggtattcaaagagaaggtggacactcgcacgccacggagcatgcccggcacacgcagggtcatgggcatcacggccgagtggttgtggcgtaccctggggcgtaacaagaaaccacgcttatgcactcgcgaagagttcaccaagaaggtgcgcacgaacgccgctatgggcgcggtttttaccgaagagaaccagtgggactccgcaaaggccgcagtcgaggatgaggacttttggaaacttgtggaccgcgaacgtgagctgcacaaacttggcaaatgcggctcttgcgtgtacaacatgatggggaagcgtgagaagaagctcggcgagtttggcaaggccaaggggagcagggcgatctggtacatgtggctgggcgcgcggtacctggagttcgaggcgctcggattcctgaacgaggaccactggttctctcgagagaatagctattccggcgtagagggagagggactgcacaaactcggttatatcctgcgggacattagcaagatccccgggggcgccatgtacgccgatgacaccgcggggtgggatacacgaataacggaggacgacctgcacaatgaggagaaaattacccagcaaatggatccagagcaccgccaactcgccaacgctatctttaaattaacctaccagaacaaagtggtgaaggtacagcgacccacgcccaccggaacagtcatggatatcatctctcgcaaggaccagcgggggtcgggacaggtgggtacctacgggctgaatactttcaccaatatggaggcgcagctcataagacagatggagggcgagggtgtcctgtccaaggcggatcttgagaatccccatctgccggagaagaagatcactcagtggctggagactaagggcgtggagagattaaagcgcatggcgatcagcggggacgactgcgtggtcaagcccatcgacgaccgcttcgctaacgctctcctggccctgaacgacatggggaaggtgcgcaaggacatccctcagtggcagccctccaaagggtggcacgactggcagcaggtcccgttctgcagccaccacttccacgagctcatcatgaaggacgggcgcaagctcgtcgtgccctgccgcccccaagacgagttgatcggccgagcccgcatctcccagggtgctggctggtccttgcgcgagactgcgtgcctgggcaaggcgtacgcccagatgtggtcgttgatgtacttccaccggcgcgacctccggctggcgtccaacgccatctgttccgcggtgccggtccactgggtgcctacttcgcgcacgacttggtccatccacgcacaccaccagtggatgacgacggaagacatgctgacggtgtggaaccgtgtctggatcgaggataacccctggatggaagacaagacccccgtgaccacctgggagaacgtgccatacctcggcaagcgggaggaccagtggtgtggcagcctgattgggctaacgtcgagagccacctgggcgcagaacatcagcacagcaatccagcaggtccgtagcctcatcggcaacgaggagtttctggattacatgccgtccatgaaacggttccgcaaagaggaggagagcgagggggccatctggtga

SEQ ID NO: 26076 - RNA, 9873 nt, synthetic construct
  misc_feature 1..9873: note = derived and/or modified CDS sequence (opt11) from DENV-3__FJ850098__SS-prME
  source 1..9873: mol_type = other RNA
acctcactctgcctcatgatgatcctgccagcagccctggcgttccacctcaccagccgggacggggagccccggatgatcgtggggaagaatgagcgcggcaagagcctgttgttcaagacggcatcggggatcaacatgtgcaccctcatcgccatggatctgggggagatgtgcgacgacaccgtgacctacaagtgcccccacatcacggaggtggagcccgaagacatcgactgctggtgcaacctcacatcaacctgggtgacctatgggacatgcaaccaggccggagagcaccggcgcgacaagcggtcagtagcgctcgcgccccacgtcggcatggggttggacacacgcacccagacctggatgagcgccgagggcgcatggcggcaggtcgagaaggtggagacgtgggccttacgccaccccgggttcacgatcttggccttattcctggcccactacatcggcacttccctaacccaaaaggttgtgatattcatactgttaatgctagtcacgcccagcatgaccatgcgatgcgtgggggtgggcaaccgcgacttcgtcgagggcctgagtggggctacctgggtcgacgtggtactcgagcatggcgggtgcgtgaccacgatggccaagaataagcccaccctcgacatcgagttgcagaagaccgaagccacccagctggcgacgctccggaagttgtgcatcgagggcaagatcacgaacatcaccaccgacagccgctgccccacgcaaggcgaagctgtgctgcccgaggagcaggaccagaattacgtgtgcaagcacacctacgtggaccgggggtggggcaacgggtgcggcttgttcggtaaaggatctctggtgacctgcgccaagtttcagtgcctggagcccatcgagggcaaggtcgttcaatacgagaacctcaagtacactgtcatcatcacggtccataccggggaccagcaccaggtgggcaacgagacccagggggtcaccgccgagatcacgccccaggcttctaccactgaagcgatcctgcccgagtacggcaccctggggctcgaatgttccccacgcaccggcctggacttcaatgaaatgatactgctcactatgaagaacaaggcctggatggtgcaccggcaatggttctttgaccttcccctgccctggaccagcggcgccaccaccgagacgcctacctggaaccgcaaggagctcctggtgaccttcaagaacgcccacgccaaaaaacaagaggtcgtggtgctggggtctcaggaaggcgcgatgcataccgccctaacgggggcaactgaaatccaaaacagcggggggacctccatcttcgcgggtcacctgaagtgccggctgaaaatggataagctcgagctgaagggcatgagctacgccatgtgcacaaacacgtttgtcctgaagaaggaagtgtccgagacccaacacgggaccatcctcatcaaggtggaatacaagggcgaggatgtcccgtgcaagatccccttcagcacagaagacggacagggcaaggcacataacggccgcctgatcacggccaaccccgtcgtgaccaagaaggaggaccccgtcaacatcgaggccgagccgccatttggggaaagcaacatcgtgatcggcatcggcgacaacgccctgaaaatcaactggtacaaaaagggctccagcatcgggaagatgttcgaggcgaccgcccggggcgcccgccggatggcaatcctgggcgacaccgcctgggacttcgggtccgtgggaggggtcctcaactctctgggcaagatggtgcatcagatctttgggtccgcttacaccgccctctttagcggagtgtcctgggtgatgaaaattggcatcggggttctccttacatggatcggcctgaacagcaagaacacctccatgagcttctcctgcatcgcaatagggatcatcaccctctaccttggcgcggtggtccaagcggacatggggtgcgttatcaactggaagggtaaggaactgaagtgcggtagcgggatcttcgtgacgaacgaggtccacacctggaccgagcaatacaagttccaggcggactcccccaagcgcctcgccaccgccatcgcgggggcctgggagaacggggtgtgcggcatacggagcacgacccggatggagaacctgctgtggaagcaaatcgcgaatgagctgaactacatcttgtgggagaataacatcaagctgaccgtggtcgtgggggacgtgataggcgtactcgagcaggggaagcgcaccctgacacttcagcctatggagctcaaatacagctggaagacgtggggtaaggccaagatagtgacggccgagacccagaacagctccttcatcatcgatgggccgaacacgcccgagtgtccaagcgcctcccgggcgtggaacgtgtgggaagtcgaggactacgggttcggcgtttttacaaccaacatctggctgaagctgcgcgaggtgtacacccagctctgcgaccaccggttgatgagcgccgccgtcaaggacgagcgggccgtccacgctgacatggggtactggatcgaatcgcagaagaacgggtcctggaagttagaaaaagcaagcctaatcgaggtgaagacctgcacgtggcccaagagccacaccctgtggagcaacggcgtcctggaatccgacatgatcatccccaagagcctcgctggtcccatatcccagcacaactaccgccccggctaccacacgcagacggctgggccgtggcacctgggcaagctggaattagacttcaactactgcgagggtacgaccgtcgtgatcaccgagaactgcgggactcgcggccccagccttcggacgaccaccgtctccgggaagctgatccacgagtggtgctgcagaagctgcacccttccgcccctcaggtacatgggtgaggacggctgctggtacggcatggagatccgcccgatctccgagaaggaggagaatatggtcaagagccttgtcagcgcgggcagcggagaggtcgacaatttcacgatgggcgtgttgtgcctggcaattctgtttgaagaagtcatgagagggaaattcgggaagaagcacatgatcgcgggggtcttcttcaccttcgtactcctgctgtccggccagatcacctggcgcgacatggcccataccctcatcatgatcggcagcaacgcctccgacagaatgggaatgggcgtgacgtatctggccctgatcgctacctttaagatccagcctttccttgcgctgggattcttcctgcgaaagctcacgagccgggagaacctgctgctgggggtaggcctggccatggccacgacgttacagttgcccgaagacatcgagcagatggcaaacgggattgcgctggggctgatggcccttaaactgataacccagtttgaaacgtaccagctgtggaccgcgctcatttccctgacgtgctccaacaccatcttcaccctgaccgtggcctggcgaacggcgaccctcatcctggcgggggttagcctgttgcccgtgtgtcagtccagttccatgcggaagaccgactggctaccgatgaccgtggcggccatgggcgtgccgcccctgcctctcttcatcttcagcctgaaggacacgctgaagcgccgctcttggccactcaacgagggggtgatggccgtggggttagtcagcatcctggcctctagcctcctgcggaatgatgtgcccatggctggacccctggtggccgggggcttactgatcgcctgctacgttatcaccgggacctccgccgatctgaccgtggagaaggccgcggacgtaacgtgggaggaggaggccgagcagaccggcgtgtcacataacctcatgatcaccgtggatgacgacgggaccatgcgcatcaaggacgacgagaccgaaaacatcctgacggtgctgctcaaaaccgccctgctgatcgtttccgggattttcccctacagcatccccgccactctcctggtctggcacacctggcaaaagcaaacgcagcggtccggcgtgctatgggatgttccctccccgcccgagacccagaaggcagaactcgaagagggagtgtaccgcatcaagcagcagggcatcttcgggaagacccaggtgggcgttggggtgcagaaggagggcgtgttccataccatgtggcacgtaaccaggggcgcggtgctgacctacaatgggaagcgcctggagccgaactgggcttccgtaaagaaggatctaatcagttacggtggggggtggcggctgtctgcacaatggcagaaaggggaggaagttcaagtgatcgccgtggagcccggcaagaaccccaagaatttccagaccatgccagggacattccagacaaccaccggggagatcggcgcgatcgccctggacttcaagccggggaccagcgggagcccaatcattaaccgcgaaggcaaggtcgtggggctgtacggcaacggggtcgtcacgaagaacggcgggtacgtgtccggcatagcccagactaacgctgagcccgacggcccgacccctgagctcgaggaggaaatgttcaagaagcggaacctgaccatcatggacctgcaccccgggagcggcaagacacgcaagtacctccccgccatcgtgcgggaggcgatcaagagacggctgcgcactttgatcctcgccccgacccgcgtcgtggccgccgagatggaggaggccttaaaaggcctcccgatccgctatcagactacagcaaccaagtccgagcacaccggccgggaaatcgtggacctcatgtgccacgccaccttcacgatgcgcctgctttctcccgtacgggtccccaactacaatctcatcatcatggacgaggcccacttcactgacccggcctccatcgccgcgcgcgggtacatcagcacccgggtaggcatgggtgaggccgcggccattttcatgaccgcgacgccacccgggaccgctgacgccttcccccaatccaacgcgccaatccaggacgaggaacgcgacatacccgagcgcagctggaactccggtaacgagtggattaccgacttcgccgggaagaccgtctggttcgttccttcaatcaaggcgggcaacgacatcgccaactgcttgcggaaaaacgggaagaaggtgatccagctgagtcgcaagacattcgacaccgagtaccagaaaacgaaactcaacgactgggacttcgtcgtgaccacggacatcagcgagatgggagccaatttcaaggccgaccgggtgatcgacccacgccggtgtctaaagcccgtcatattgacagacggccccgaacgcgtgatattggcggggcctatgcccgttaccgcggccagtgctgcccagcggcgtgggcgggtcgggagaaacccgcagaaggaaaacgaccagtacatcttcaccggccaacccctgaacaacgacgaagaccacgcccattggacagaggcgaagatgctgctcgacaacatcaacacgcccgaagggatcatccccgctttgttcgagccggaacgagaaaaatccgccgccatcgacggcgagtaccgcctgaagggcgagtcccggaagacattcgtagagctaatgaggcggggggacctgcccgtctggctggcacacaaggtggccagcgagggcataaagtatacggaccgcaagtggtgcttcgacgggcagcggaataaccagatcctcgaggagaacatggacgtggagatctggaccaaggagggcgagaagaaaaagctgcgcccccggtggcttgacgcccgcacgtactccgaccccctcgccttgaaggagttcaaggacttcgcagcgggccgcaagagcatcgccctggacctcgttaccgagatcgggcgggtgccgtcccatcttgcccataggacccggaatgccctggacaacctcgtgatgctacatacaagcgagcacggggggaaggcctaccgccacgcggtggaggagttgccagagacgatggaaaccctcctactgctcggcctgatgatcctgttaaccgggggcgcaatgctcttcctgatctcaggcaagggaatcggcaaaacctccatagggctcatctgcgtgatcgccagctccggtatgctgtggatggccgagatcccgctgcagtggattgccagcgcgatcgtgctcgagttcttcatgatggtcctgctgattccggaacccgagaagcagcggactccccaggataaccagctcgcctatgttgtgatcgggatcctgacactggccgccatcatcgccgcgaacgagatgggcctcttagagaccaccaagcgtgacctgggcatgtccaaggagcccggcgtcgtgagcccgacgtcctaccttgacgttgacctgcaccccgcctcagcctggaccttatacgccgtggcgaccaccgtgatcacgcccatgctacggcacacgatagaaaactccaccgccaacgtcagtcttgcggccatcgccaaccaagctgtcgttctgatgggactagataaggggtggcccatctccaagatggacctgggcgtgccgctgctcgctctggggtgctacagtcaggtcaaccccctgaccttaacggccgcggtcctcctgctcatcacccactatgccatcatcggcccgggcctgcaggcgaaggccacccgagaggcacagaagcggaccgcggccgggataatgaagaaccccaccgttgacggcatcatgaccatcgacctggacccggtcatttacgactccaagttcgagaagcagctgggtcaggtgatgttgctggtcctctgtgcggtccagctgctgctcatgcgcacgagctgggctctgtgcgaggccctgacgctcgctacgggccccatcactaccctgtgggagggctcccccgggaaattctggaacaccactattgcggtgagcatggcaaacatctttcgggggtcctacttggcaggtgcgggcttagcctttagcatcatgaagtcggtggggaccggcaaacgcggcaccgggagccagggcgagactctgggagaaaaatggaagaagaagctaaaccagctctcccggaaggagttcgatctgtataagaagtccggcatcactgaagtcgaccgcacggaggcaaaggaaggactgaagcggggcgagattacccaccacgccgtgtcccgcggctccgccaagctccagtggtttgtggagagaaacatggttatccctgaagggcgtgtgatcgacctaggctgcgggcgggggggctggagctactattgtgcgggactgaagaaggttacagaagtccgcggctacaccaagggcgggccggggcacgaagagccagtacccatgtccacatacggctggaatattgtgaagctcatgagcgggaaggacgtcttctatctgccccccgagaagtgcgacacactgctgtgcgatatcggcgagtccagcccctcccctaccgtggaggagagccggaccatcagggtcctcaagatggtagagccctggctgaaaaacaaccagttctgcatcaaggtgttaaacccgtacatgcccacggtggtcgagcacctcgaacgcctgcagaggaagcacggcgggatgctggtgcgcaaccccctctcccggaactcaacccatgagatgtattggatcagtaacggcaccgggaacatcgtggccagcgtcaacatggtatcccggcttctgctcaaccggttcaccatgacccaccgccggcccaccatcgagaaggatgtggacctgggcgcgggcacccgccacgtcaacgccgagcccgagactcccaacatggacgtgatcggcgagcggatcaaaagaatcaaggaggagcacaacagcacgtggcactacgacgacgagaatccctacaagacctgggcgtaccacgggtcctacgaggtcaaggccactgggagcgccagttctatgatcaacggcgtggtgaagctgctcaccaagccgtgggacgtcgtgcccatggtcacgcagatggcgatgaccgacaccaccccgttcgggcagcagcgggtctttaaggagaaggtggacactcgcacgccccggagcatgccgggcacccgccgagtgatgggcataaccgctgaatggctgtggaggaccctaggacggaacaaaaagccccgcctctgtacccgggaggaattcaccaagaaggtccgcaccaacgccgccatgggagcggtgttcacggaggaaaaccagtgggactccgccaaagccgcagtggaggacgaagacttctggaagctggtcgaccgcgagcgggagctacataagctgggcaagtgcggcagctgcgtgtacaatatgatgggaaagcgcgagaagaaattaggtgagttcggcaaggccaaggggagtcgggcgatctggtacatgtggctgggcgcccgatacttagaattcgaagccctggggttcctgaacgaggaccactggttcagccgggagaactcctacagcggcgtggagggggagggcctgcacaagctgggatacatccttcgcgatatctccaaaatccccggcggagccatgtacgccgacgataccgcggggtgggacacacggatcactgaggatgacttacacaacgaagagaagatcacgcagcagatggaccccgaacaccgccagctggccaacgccatcttcaaactgacctatcagaataaggtcgtgaaggtgcagcgcccgacacccaccggtaccgtcatggacattatctcccgcaaggaccaacgaggctccggccaggtgggcacgtacgggcttaatacctttacaaacatggaggcccagctgatccgccagatggagggcgagggggtgctgagcaaggccgacctcgaaaacccccgcctgcccgagaagaagataacacagtggttggagacgaagggagtcgagcgcctcaagcggatggcgatctccggggacgactgtgtggtgaagccgatcgacgaccgcttcgccaatgccctgctggccctcaacgacatggggaaggttcggaaggacatcccccagtggcagccctcgaagggttggcacgactggcaacaggtccccttttgctcccaccacttccacgaactgatcatgaaggacgggcggaaactggtggtcccgtgccggccccaggatgagctcatcggccgcgcccggatcagccagggggcgggctggtcactgcgcgagaccgcgtgtctgggcaaggcctatgcccagatgtggagcctcatgtatttccaccgccgggacctgcgcctcgcgtccaacgccatctgcagcgccgtgcctgttcactgggtgcccacctcccggaccacgtggagcatccacgctcaccaccaatggatgaccacagaggacatgctcactgtgtggaaccgcgtatggatcgaggacaacccttggatggaggacaagacgcccgtcaccacctgggagaacgtgccctacctggggaagcgggaagatcagtggtgcggttctctgatcgggctaacttcccgcgccacgtgggcgcagaacattcccaccgccatccagcaggtcagaagcctgatcggcaacgaagagttcctggactacatgccgtccatgaagcggtttcgtaaggaagaggagagcgagggggccatctggtga

SEQ ID NO: 26077 - RNA, 9873 nt, synthetic construct
  misc_feature 1..9873: note = derived and/or modified CDS sequence (opt11) from DENV-3__KF955479__SS-prME
  source 1..9873: mol_type = other RNA
acttcactttgcctcatgatgatactccccgcggccttagcgttccacttgaccagccgggacggagaaccccgcatgattgtggggaagaacgaaagggggaaaagcctactattcaagacagcaagcgggatcaacatgtgcacgcttatcgcaatggacttgggggaaatgtgcgacgacacagtaacatacaaatgcccacacatcacagaagttgaaccagaagacattgactgctggtgtaatttgacctccacctgggtaacatatggaacgtgcaaccaagccggtgaacatcgaagggacaagcggagtgtagcactcgccccacacgttggtatgggactcgacacgagaacacaaacgtggatgagcgcagaaggcgcctggaggcaagtagagaaagtggagacatgggccttaaggcacccaggttttaccatcttagcactcttccttgctcactatatcggaacttccctaactcaaaaagtggtgatcttcatattgctaatgttagtcactccttccatgacaatgaggtgcgtaggcgtcggcaacagggactttgtagaaggcctaagcggggcaacctgggtcgatgttgtgctagaacacgggggatgcgtaacgacaatggctaagaacaagcctacccttgatatagagctacaaaagacagaggccactcaactggccactcttcgcaagttgtgcatcgaaggcaagatcacaaacatcacgaccgatagtcgatgccccactcaaggtgaggcagtgctgccagaggaacaagaccagaactatgtatgtaagcacacatatgtagacaggggttggggcaacggatgcggcctattcggaaaaggcagcttggtaacatgcgctaaattccagtgtctagaacccatagaaggcaaggtcgtccaatatgaaaatctgaagtacaccgtgattataacagttcacacgggcgaccaacaccaggtaggaaacgagacgcaaggagtaacagctgagataacaccccaagcctctaccacagaggctatcctacccgagtacgggacccttggactggagtgctcgcccagaacaggcctggatttcaacgaaatgatactcttaactatgaaaaacaaggcttggatggtacaccgccagtggtttttcgacctacctcttccctggacgagtggggcgaccacggaaacgcctacgtggaaccgaaaggagttattagtcacgttcaaaaacgcacatgcaaagaaacaagaagtcgtggtactaggtagccaagagggcgcaatgcacacggcgctcaccggggccaccgaaattcagaacagcgggggcacatctatttttgccggccacctcaagtgtcgcctaaaaatggataaactagaattgaaaggtatgagctacgctatgtgtacgaacactttcgtactcaagaaagaggtaagcgaaacacaacacggaacaatattgattaaagtcgaatataaaggcgaagacgtaccgtgcaaaatccctttctccacagaggacggccaaggcaaggcgcacaacggccgattaataactgcaaatcccgtggtgaccaaaaaggaggaaccagtcaacatcgaggcggagccacccttcggcgagtctaacatagtaataggtataggagacaatgcgctaaagatcaactggtacaagaaaggatcaagcataggcaagatgtttgaagcgacggccagaggcgccaggcggatggccatcctgggcgacaccgcgtgggacttcggcagcgtaggtggagttctaaactcactagggaagatggtacaccaaatcttcgggagtgcatatacagccctgttcagtggtgtatcatgggtaatgaagatcgggatcggggtcctgctaacatggatcggactcaactctaaaaatacgagcatgtcgttttcttgcatcgcgatcggaatcatcacgttatacctaggcgctgtagtacaggccgatatgggatgcgtgataaactggaaaggcaaagagctaaagtgcggttcgggaatcttcgtcacaaacgaggtccatacatggaccgaacagtacaaattccaagccgacagcccgaaaagacttgcaacggctatcgccggcgcctgggagaacggagtatgcggaatacgaagcacaaccagaatggagaacctattatggaagcagatcgccaacgagctgaactacatattatgggaaaataacattaagctaaccgtagtcgtaggcgacatcataggagttctcgaacaaggaaaacgaaccctgaccccgcaaccaatggaactgaaatactcatggaagacttggggaaaggctaagatcgtgacagctgagacccaaaacagttcattcattatagacggccccaacaccccggagtgcccctccgcctcccgggcctggaacgtctgggaagtagaagactacggattcggcgttttcaccaccaacatctggcttaaattacgcgaagtctatacccaattgtgtgaccacaggctcatgagcgccgcggtgaaagatgagcgcgccgtgcacgcagacatgggctattggatagagtcgcagaaaaatggtagttggaagctagaaaaagcctcgttcattgaggtgaagacctgcacgtggccaaagtctcatacgctttggagcaatggcgtactagagtccgacatgataataccgaagtccctggcaggacccatctcccaacataattaccgtccaggctaccacacacaaacggcagggccatggcacctaggcaagctagaactggactttaactattgcgaagggacgaccgtggtaattacggaaaattgcggcactaggggaccatcgctacgaacaacgactgtatccggcaagttaatacacgaatggtgctgccgtagttgcacgcttccacccttaagatatatgggcgaagacggatgctggtacggaatggagattcgccccatcagtgaaaaggaggaaaacatggtgaaaagcctggtctcagccgggagcggtgaggtagataacttcaccatgggagtcctgtgtctcgcaattctcttcgaggaggtgatgcgaggcaaattcggtaagaaacacatgatagcaggagtattcttcacattcgtactactcctttccgggcagataacgtggagagatatggcccataccctcatcatgattggatctaatgcatcggaccgcatgggtatgggggtaacgtacctcgcactcatcgccacattcaagatccaacccttcctcgcactgggattctttctaagaaaactaacgtcgagagagaacttactactcggcgtcgggcttgcgatggcaacaaccctacaactccccgaagacatcgaacaaatggccaacggcatagcgctaggactcatggcactaaagctaataactcagtttgagacttaccagctatggaccgcgttgatctcgttaacatgctccaataccatattcaccctaacggtagcctggcgcaccgctacattaatcctggcgggcgtatcactgctgcctgtttgccaatcctcctccatgcgcaaaacagattggctccccatgaccgttgccgcaatgggcgtaccgccattgccgctattcatcttctccttaaaggatactctaaaaaggaggtcatggcctttgaacgagggggtaatggctgtcgggcttgtaagcattctcgcctcttccctgctgcgaaacgacgtaccaatggccggccccctagtggcgggtgggctacttatcgcgtgctacgtgattacaggtacaagcgcggacctgactgtggaaaaggcagccgatgtcacatgggaagaagaggcggaacaaacgggcgttagtcacaacctgatgatcacagtcgatgacgacggtacaatgcgcataaaggacgacgaaacggaaaatatcctcacggtactactcaagactgccctactaatagtaagtggaatcttcccgtatagtatccccgctaccctcctggtatggcacacttggcaaaaacaaacacaacggagcggggtactctgggatgtacccagcccgccagaaacacaaaaagcagaactagaagagggcgtctaccgaataaaacaacaggggatattcggcaagacacaagttggagtaggagtacagaaagaaggggtattccacacgatgtggcatgtaacaaggggtgcagtactaacatacaacgggaaacgactagagccgaactgggccagcgtcaagaaagaccttataagttatggcggcggatggcgactatcggcgcaatggcagaaaggcgaagaggtacaggtaatcgcagtggaaccggggaaaaatcccaagaacttccagactatgcccggtacattccagaccacgacaggagagataggcgccattgctctcgacttcaaaccaggaaccagcggcagcccaattattaatagagaggggaaagtagtaggcctctatggaaacggagtcgtaactaagaatggaggctacgtgagcggcatcgcccagactaacgcggaaccagatgggccaacaccagagctcgaagaagaaatgttcaaaaagaggaatcttacaatcatggacctacacccagggtcaggcaaaactcgaaagtacctcccagctatcgtccgggaggcgataaaacgcaggctgagaaccctgatactggcacccacgcgagtggtcgcggcagaaatggaagaagccctgaaaggcctcccgatacgctaccaaacaaccgccaccaaatcagaacatacaggacgggagatcgttgatctcatgtgccacgccaccttcaccatgcggctgctatccccagtacgcgtgcccaactataatctgataataatggatgaagcccactttacagacccggcctcaattgcggcccgaggctacatatcgacccgggtcggcatgggagaggcggcagccatattcatgacagctacaccgcccgggacagccgacgccttcccccagagcaacgcccccatccaggacgaggagagggacatcccagaacgctcatggaacagcgggaacgagtggataacagattttgccggcaaaactgtatggttcgtacccagcataaaagctgggaatgacatagcaaactgtctacgtaaaaacggcaagaaggtcatacaactaagccgtaagaccttcgacacagaataccagaaaactaaactcaacgactgggacttcgtagtcaccacagatatatcagagatgggtgcgaacttcaaagcagaccgggtcatagacccacgccggtgcctcaagccagtaattctgactgacggaccggaacgggtaatcctcgccgggccaatgcccgtcaccgcggcctccgccgcacagaggcggggaagggtcggacggaatccccaaaaggaaaacgaccaatacatattcacaggacagcctctcaacaatgacgaagaccacgcccattggaccgaggccaaaatgctcctcgacaatatcaacacaccagaaggcataatcccggccctattcgagccagagagggaaaagtcagcggcaatagacggagaataccggctaaagggtgaaagcagaaagaccttcgtagaacttatgagacggggcgatctccccgtatggttagcgcacaaagtggcgagcgaaggcataaaatacacggaccggaaatggtgcttcgatggacagagaaacaaccagatattagaagaaaatatggatgtcgaaatatggacaaaggagggggaaaagaagaaattaagaccaagatggcttgacgcccggacctattctgaccccttagcgctcaaagagttcaaggatttcgccgcggggcggaaatcgattgcgctagatcttgtaacagagatagggagagtacccagtcacctagcccaccgaacaaggaacgcactagacaacctagtcatgctgcacactagcgaacacgggggcaaagcatacagacacgcagtggaggagctacctgaaaccatggagacgctccttctactgggacttatgatcctactcaccgggggagctatgctattcctcatcagcgggaaagggatcggcaagacctcaataggattaatatgcgtgatcgcgagtagcgggatgttatggatggcggaaattccactacaatggatcgcgtccgccatagtcctggagttcttcatgatggtcttgctaataccagaaccagagaaacaacggacaccgcaggacaaccaactcgcttatgtagtaataggtatactaacgctcgccgccatcatcgctgcaaatgagatgggactccttgaaacaactaagagagacctcggaatgagtaaggagccaggcgtggtatcgccgacaagctacttagacgtggatctacacccagccagtgcatggacactatacgccgtggccaccaccgtcatcactcccatgctaagacacactatagagaacagcacggcaaatgtaagcctagctgcgatagcgaaccaagcggtcgtccttatggggctggacaaaggatggccaatcagcaagatggacctaggcgtgccactgttagcgctcgggtgctattctcaggtgaacccattaacactgacggccgcagtactcctcctaatcacccactacgcgatcatcggtcccggactccaagcaaaggccacacgggaagcccagaagcgcaccgcagccggcattatgaagaaccccacagtagatggaataatgacaatagacttagacccggttatctatgacagcaaattcgagaagcagctgggacaggttatgctcctcgtactctgcgcagtacaactcctattaatgagaacgagctgggcgctctgtgaggcgctgaccctcgctacgggacccataaccacattgtgggagggtagcccgggcaaattctggaacactaccatcgccgtaagcatggccaacattttccgagggagctaccttgcaggagcaggcttagccttcagcataatgaagtcagtaggaaccggaaagcgcgggactggaagccaaggcgaaacccttggggaaaagtggaagaagaaacttaaccagctctcgagaaaagagttcgacctgtacaagaaatctggaatcaccgaagtcgacagaacagaagccaaagaaggactaaaacggggagaaataactcatcatgcggtgagtagggggtcagcgaaactccaatggtttgttgaacgaaacatggtcatccccgagggccgcgtaatcgacctaggatgcggaagaggaggctggtcctattactgtgctggactaaagaaagtcaccgaagtaaggggatatacgaaaggcgggccagggcacgaggagccagtaccaatgagcacttacggctggaatatagtaaaactcatgtcgggcaaagacgtcttctaccttccacccgagaagtgcgacacactgctgtgcgacatcggagaatcatcaccaagcccaacggtggaagaatcccgcacaatccgagttctgaagatggtcgagccctggctcaagaataaccaattctgtataaaagtcctaaacccctatatgccgacagtaatcgagcaccttgaaaggctgcaacggaaacacgggggaatgctagtgcggaatcctctaagtcggaacagtacccatgagatgtattggatcagcaatgggaccggaaacatagtagcaagcgtcaacatggtctcacgattattattaaatcgcttcactatgacgcatcgtagaccgactatagagaaagacgtggacctcggagccggaactaggcacgtgaacgcggaaccagagactcccaatatggatgtaataggagagcgaattaaacgaataaaagaggagcacaactccacatggcactacgacgatgagaatccctacaaaacatgggcgtaccatgggagttacgaggttaaggcaacgggttcggcatctagcatgatcaacggagtggtaaagttactgacaaagccctgggacgtggtcccaatagtgacccagatggcgatgacagacacaacgccgtttggccagcaacgcgtgttcaaggaaaaggtagatactcggacaccgagatctatgcctggcacgcgcagggtcatgggaattacggcagaatggctatggcggacacttgggagaaacaaaaagcccagactctgtaccagagaggagttcaccaaaaaggtgcgaaccaacgcggcaatgggggctgtctttaccgaagagaatcaatgggacagcgcaaaggcggcagtggaggacgaagacttctggaagctagtcgaccgggagagagaactacacaaacttggcaaatgcggatcctgcgtgtacaatatgatgggaaagagggagaaaaagctaggcgagtttggtaaggccaaaggatcacgagctatatggtatatgtggctaggtgcaaggtacctcgagttcgaggccctcgggttcttaaacgaggaccactggtttagtcgagagaacagctacagcggcgtagagggcgaagggctgcataagttaggctacatactgagggacatcagcaaaataccaggcggtgcgatgtacgcagacgacacagccggatgggacacgcggataacggaagacgacctccacaacgaagagaaaataacacaacaaatggacccagaacaccgtcagctagccaacgctatcttcaagttaacctaccaaaataaagtagtcaaggtccagcggcctacgccaacgggaacagtgatggatataatatcacggaaggaccagcgcggatccgggcaagtgggcacctacgggctcaacaccttcaccaatatggaggcgcaactaattcgtcagatggagggagaaggcgtattaagcaaagcagaccttgagaatccacatctaccagagaagaagataacacagtggctcgagacaaaaggcgtagaacgtctaaaacgcatggcaatatcgggggacgactgcgtggtgaagccgatcgacgaccgcttcgcaaatgccctgctagcccttaacgacatggggaaagtgagaaaagacatcccccagtggcaaccctccaaaggatggcatgactggcaacaagttcccttctgcagccatcatttccatgagcttatcatgaaagacgggagaaaactggtggtcccttgtaggccgcaagacgagctgatagggcgcgcacgcatatctcaaggagcaggctggagcttacgggaaacggcgtgcctaggcaaggcctatgcgcaaatgtggtccctaatgtacttccacagaagagacttgcgcctagcgtctaacgcaatatgcagcgcagtacctgtccactgggtgcctacctcccgcacaacatggtctatccacgcccaccatcaatggatgaccacagaagacatgctcacggtatggaacagagtctggatcgaagataacccttggatggaagacaaaacacccgtaaccacgtgggaaaatgtaccatacttaggtaaaagagaagatcaatggtgcgggtccctcataggactaaccagccgggcgacgtgggcccaaaacatccctaccgcaatccagcaagtgagatcgttaataggtaacgaggagttcctcgactacatgccctcaatgaaacggttcaggaaagaagaggaaagcgagggggccatatggtga

SEQ ID NO: 26078 - RNA, 9873 nt, synthetic construct
  misc_feature 1..9873: note = derived and/or modified CDS sequence (opt11) from DENV-3__FJ850109__SS-prME
  source 1..9873: mol_type = other RNA
acgagtttatgtctcatgatgattctgcccgccgccctggcattccacctcacgtcacgggacggcgagccccgtatgatcgtggggaagaatgaaagaggcaagagtttgttgttcaagaccgcatcaggcatcaacatgtgcaccctcatcgctatggacctcggagagatgtgcgatgataccgtgacctacaagtgcccccacataaccgaggtcgagcccgaggacatcgactgttggtgcaacctgaccagcacctgggtgacgtacgggacctgcaaccaggccggcgagcaccgtcgcgacaagcggtcggtcgccctcgccccccacgtgggcatggggctggatacccgcacccagacctggatgagcgcagagggcgcctggcgccaggtggagaaggttgagacgtgggccctgcgccacccggggttcacgatccttgcgttattcctggcacactacaccggcaccagcctcactcagaaggtggtgatcttcattctgttgatgctcgtcacccccagcatgaccatgcggtgtgtgggggtgggcaaccgcgacttcgtcgagggactgtccggggccacatgggtggacgtggtactggagcacggcggttgcgtaacgaccatggcgaagaacaaacctaccctcgacatcgagctacagaagaccgaggccacacaactggctacattgcggaagctgtgcatcgagggcaagatcaccaacatcaccacggatagccgctgcccaacccaaggcgaggccgttctgccagaagagcaggaccagaactacgtctgcaaacacacctacgttgaccgggggtggggaaatgggtgcggccttttcgggaagggctccctggtgacctgcgccaagttccaatgcctggagccgattgagggaaaggtcgtgcaatacgagaacctcaagtacacggttatcatcaccgtccacaccggggaccaacaccaagtgggcaacgaaacccagggcgtcactgccgagatcacaccacaggcgagcactaccgaggcaatcttacccgagtatggcacgctgggcctcgagtgctcccctcggaccggcctggatttcaatgagatgatactgctaaccatgaagaacaaggcctggatggtgcacagacagtggttcttcgatctgcctctgccctggaccagcggagccaccaccgagaccccgacgtggaacaggaaggaactcctggtgacatttaagaacgcccacgccaagaaacaagaggtcgtggtgctggggagtcaggagggcgcgatgcatacggctctcaccggtgccactgagatccagaattcaggcgggacctcaatattcgccggacacttaaaatgtcggctgaagatggacaagctcgagttaaaaggaatgagctacgccatgtgcacgaataccttcgtccttaagaaggaggtatccgagacccagcacggcacaatcctcatcaaggtggagtacaagggcgaggacgtcccgtgcaagatccccttcagcacggaggacggtcagggcaaggcgcacaatggcagactgatcaccgctaatcccgtcgtgaccaagaaggaggagccggtcaacattgaggcggagccacccttcggcgagagcaacatagtgataggcatcggtgacaacagtctgaaaatcaactggtacaagaagggctcgtccattgggaagatgttcgaggccaccgcgcggggcgctcgccggatggctatcctgggcgacacggcctgggatttcgggtctgtaggaggggtcctcaactcgctgggtaagatggtgcaccagattttcggcagcgcctacaccgcgttgtttagtggagtgtcgtgggtcatgaagataggcatcggagtactcctgacctggatcggccttaactccaaaaacacgagcatgtcattcagctgcatcgctatcgggatcattacgttgtacctgggcgccgtggtccaggccgacacggggtgcgtgataaattggaagggcaaagagctgaagtgtggatcagggatctttgtgaccaacgaggtccacacctggacggagcagtacaagttccaagccgatagccccaaacgcctcgcgactgccatcgccggggcctgggagaacggggtgtgcggtatccgcagcactaccagaatggaaaacctcctgtggaagcaaatagcgaacgaacttaactacatcctgtgggagaacaacattaagctgacggtggtcgttggagatatcatcggcgtcctcgaacagggcaaacgcaccctgacgccccaaccgatggagctgaagtactcatggaagacctggggtaaggctcggatcgtcacggccgagacccagaacagctcgttcatcatcgacggccccaacaccccagagtgccccaacaccagccgcgcctggaacgtgtgggaagtggaggactacgggttcggcgtcttcaccacgaacatctggctcaagctgcgtgaggtgtacacccaactgtgcgaccataggctcatgagcgccgcggtgaaagatgagcgggccgtgcacgcagacatgggctactggatcgagagccagaaaaacgggtcctggaagctggagaaggccagcctcatcgaggtgaaaacttgcacctggccgaagtcccacacgctttggagcaacggggtgctagaaagtgacatgatcatccccaagtcgttggcgggtcccatctcccagcacaactatcgccccggctaccacacgcaaaccgcggggccctggcacctgggcaagctggagctggacttcaactactgtgaggggaccacggtagtgatcaccgagaattgcgggactagaggccccagcctccgcaccactaccgtgtccgggaagctgatccacgagtggtgctgccggagctgcacccttcccccgctgcgctacatgggcgaggatgggtgttggtatggcatggaaatccgtccaatctccgagaaggaggagaacatggtcaagagccttgtgtctgccggcagtggcgaggtggataacttcacaatgggagtcctgtgtctagcaatcctgttcgaagaggtgatgcgtggtaagttcggcaaaaagcacatgatcgccggagtgttcttcacgttcgtcctgttgttatccggacagataacctggcgtgacatggcccacaccttgattatgatcggctctaacgcgactgaccggatggggatgggcgtgacctacctcgccctgatcgctaccttcaaaatccagccattcctggccctcggtttctttctgcggaagctaacctcccgcgagaatttactgctgggcgtgggccttgccatggcgaccacgctgcaacttccggaagacatcgaacaaatggcaaacgggatcgccttgggcctgatggccctgaagctcataacgcagttcgagacctaccaattatggaccgctctgatctcactcacgtgcagcaacacgatcttcaccctgaccgtggcttggcggacggccaccctcatcctcgccggggtgtccctgctgccggtatgtcagagcagtagcatgcgcaagaccgactggcttcccatgaccgtggccgcgatgggcgtaccgcccctcccgttgttcatcttcagcctcaaggacacgctgaagcggcgcagctggcccctgaatgagggagtcatggccgtgggcctcgtctccatcctggcctcatccttattgcgaaacgacgtcccaatggccggccccttggttgccggaggcctcctcatcgcatgctacgtgatcacggggaccagcgccgacttgaccgttgagaaggcggccgacgtgacctgggaggaagaggcggaacagacgggcgtgtcccacaatctgatgataaccgtcgacgacgacgggacaatgcggatcaaggatgacgagaccgagaacatcctcacggtgctgctgaagaccgcgctcctgatcgtgagcggcatattcccgtattcaatcccagccacactgttggtgtggcacacgtggcaaaagcagacccaacgctcaggcgtgctgtgggacgttccctcaccgcccgagacccagaaggccgagttagaggagggggtctaccgaatcaagcagcaggggatcttcgggaaaacccaggtcggcgtaggggtccagaaggagggcgtgtttcacaccatgtggcacgtgacgcgcggagccgtactcacctacaacggcaaacggctagaacccaactgggccagcgtgaagaaggacttgatctcatacggcgggggatggcgcttatcagcgcagtggcagaagggggaggaggtgcaggtcatcgccgtcgagccgggtaaaaatcccaagaacttccagaccatgcccggcaccttccaaacgaccaccggggagatcggcgccatagcattagattttaagcccggaactagcggctcccccatcattaaccgagagggcaaggtggtcgggctgtatggcaacggggtggttacgaaaaacggcgggtacgtgagcggcattgcgcagactaacgccgaaccggacggccccacccccgagctagaggaggagatgttcaagaagaggaacttgaccatcatggacctgcaccccggttccggcaagacgcggaagtacctgccggccatcgtgcgcgaggccatcaagaggcgcctacggaccctaatcttagcacccacccgcgtcgtcgcggccgagatggaggaggcactcaagggactccccatccggtaccagaccaccgccactaagagcgagcatacgggccgcgaaatcgttgatctgatgtgccacgctacctttacgatgcggctcctgtcccccgttcgcgtcccgaactacaatctgatcataatggatgaggcgcactttaccgaccccgcctcgattgccgcgcggggctacatctccacccgcgtgggcatgggcgaggcggcggccattttcatgactgccacgccgcccgggactgccgacgcgtttcctcaaagcaacgcacccatccaggacgaggagcgcgacatccccgagaggtcctggaacagcggcaatgaatggataaccgacttcgcggggaagaccgtgtggttcgtcccctccatcaaggccggcaatgatatcgcgaactgcctccgcaagaacgggaagaaggtgatccagctgagccgtaagacgtttgacaccgagtatcagaaaaccaagctgaacgactgggacttcgttgtgaccacagacatctccgagatgggcgcgaacttcaaggccgatcgcgtgatcgacccacggaggtgcctcaagcccgtaatcctgacggacggccccgagcgggtcatcttggccggcccgatgccggtaaccgccgccagcgcggcccagcgacggggtcgcgtgggacggaatccacagaaggagaacgaccagtacatctttaccgggcagcccttaaataacgacgaggaccacgcccactggaccgaagcaaagatgttactggacaatatcaacactcccgaggggatcatccccgctctcttcgagcctgagcgcgaaaagtccgcggcaatcgatggcgaatacagactcaagggcgagagccgcaagaccttcgtcgagctgatgcggagaggggacctccccgtgtggctggcccacaaggtcgcctccgagggcatcaaatacaccgatcggaagtggtgcttcgacggacagagaaacaaccagatcctggaggagaatatggacgtggagatatggaccaaggaaggcgagaagaagaagctccggcctcgctggctggacgcgcgcacgtacagcgacccgctggccctcaaagagtttaaggatttcgccgccggccggaagagtatcgccctggacctggtcaccgagattgggcgggtccccacccacctcgcgcaccggactcgaaacgcccttgacaacctggtgatgcttcacaccagtgaacacggcggaaaggcctaccgccatgccgtggaagaacttcccgagaccatggagactctactcctgctcggcctcatgatcctgcttaccgggggcgccatgctgtttctgatctccgggaagggcatcggcaagacgtccatcgggctgatctgcgttatcgcgtcctccggcatgctttggatggccgagattccgctgcagtggatcgccagcgccatcgtactggagttcttcatgatggtgctcctgatcccggagccagagaaacagcgcacaccccaggacaaccagctggcctacgtcgtgatcggtatcctcaccttggcagcaatcatcgccgccaacgagatgggcctgctggagaccacgaagcgtgatttaggcatgagtaaggagccaggagtggtcagccccacctcctacctagacgtggatctccatcccgcgagcgcgtggactctgtacgccgtggccacgacggtcataacccccatgctacgccataccattgagaactccaccgcgaacgtgagccttgcggcaatcgcaaaccaggccgtggtcctaatgggcctggacaaggggtggccgatcagtaagatggacctcggggtgcctctgctggccctcggatgttacagccaggtgaacccccttacgctaaccgcggcagtgctcttactaattacacactacgccatcatcggccccggcctccaggccaaggcaacccgggaggcgcagaagcgcacggctgccggtatcatgaagaaccccaccgttgacggaatcatgaccatcgacctggaccccgtgatttacgactccaagttcgagaaacagctgggacaggtcatgctcctcgtcttgtgtgccgtgcagctcctgctgatgcgtacaagctgggcgctctgcgaagcgttaacactggccaccgggcccattaccaccctgtgggagggatcaccgggtaagttctggaacaccaccatagccgtaagtatggccaacattttccgcggctcgtatcttgcgggggctggcctggccttctcgatcatgaagtccgttgggaccggtaagcggggcactgggagccaaggagagaccctcggggagaagtggaagaagaaactgaaccagctgtcccgcaaggaattcgacctctacaagaagtccggcatcacggaggtagatcggacagaggccaaggaagggctgaaacgcggcgaaatcacgcaccacgccgtcagtcggggctcagccaagttacagtggtttgtggaacgcaacatggtgatcccggaggggagagtcatcgacctcggctgtgggcgcggcgggtggtcgtactactgtgccggcctgaagaaggtgaccgaagtgcggggatacacgaagggcgggcccggacatgaggagcccgtccccatgtccacctacggctggaacatcgtgaagttgatgagcgggaaggacgttttctacctcccgcccgagaagtgtgacaccctgctgtgtgacattggcgagagcagcccctctcccacagtcgaggagagccgcacgattcgcgtcttaaagatggtggaaccgtggctaaaaaataatcagttttgcattaaagtcctcaatccctatatgcccgccgttatagagcacctggagcgtctccagcgcaaacacggggggatgttggtgaggaaccccctgtctcgcaacagcactcacgagatgtactggatctccaacggcaccggaaacatcgtcgccagtgttaacatggtgtcccgactcctgctgaaccgatttaccatgacgcaccggaggccgaccatcgagaaggacgtcgacctcggagccggcacccgtcatgtcaacgcggaacctgagacccccaatatggatgtgattggagagcgcatcaagcggatcaaggaggagcacaacagcacatggcactacgacgacgaaaacccgtacaaaacatgggcctaccacggctcctacgaggtcaaagccacagggtccgccagcagcatgatcaacggcgtcgtcaagctgcttaccaagccctgggacgtggtgcccatggtcattcagatggcaatgacggacaccactcccttcggtcagcagcgtgtatttaaagagaaggtggacacccggacgccgcgctccatgcccgggacccggcgcgttatggaaataaccgcagagtggctctggcggaccctgggccggaacaagaagccccggctgtgcacgcgcgaggaattcaccaagaaagtgcggaccaatgccgccatgggtgccgtgttcaccgaggagaaccagtgggatagcgcgaaagccgctgtcgaggacgaagacttctggaaactcgtggaccgagagcgcgagctgcacaaactgggaaagtgcggcagctgtgtgtataacatgatgggcaagcgggagaagaagctcggggaattcggcaaggccaagggctcccgcgcaatctggtacatgtggctgggcgcccggtatctggagtttgaggccctcggctttctgaatgaagaccactggttcagccgcgagaactcctacagcggggtcgagggcgaagggctgcataagctcgggtatatcctgcgggacatctccaagatccccggcggtgcgatgtacgccgacgacacggccgggtgggacacccgtatcaccgaggacgatctgcacaacgaggaaaagataactcaacagatggacccggagcaccggcaactcgcgaacgcgatcttcaaacttacataccagaacaaggtggtgaaggtgcagaggcccacgcccaccgggaccgtgatggacatcatctcccggaaggaccaacgaggctccggccaggtggggacctatgggcttaacacgttcactaacatggaggcccagctcattcggcagatggagggggagggcgttctcagcaaagccgacctggagaacccgcatttgcctgagaagaagatcacacagtggctcgagaccaagggggttgagcgcctgaaacggatggcgataagcggcgatgactgcgtagtaaagcctatcgacgaccggttcgcgaacgccctgctggccctgaacgatatgggaaaggtgcggaaggacatcccgcaatggcaacctagcaaggggtggcacgattggcagcaggtcccgttctgctcccatcacttccatgagctcatcatgaaggacggccgcaaactggtcgtgccgtgtcgtccgcaagatgagctgatcgggcgcgcccggatcagccagggagccgggtggtccttacgtgagacggcttgtctgggcaaggcgtacgcacagatgtggagtttaatgtacttccataggcgggacctcaggctggcgtccaacgcgatctgcagcgctgtgcccgttcactgggtgccaacctccagaaccacctggagtatccatgcccaccaccagtggatgaccaccgaagatatgctgaccgtatggaatcgcgtctggattgaggacaacccctggatggaggataagacccccgtgacgacctgggagaatgtgccgtacctcggtaagcgggaggatcagtggtgcgggtcactgatcggcctgactagccgcgcgacctgggcccagaacataccgacggcaatccagcaggtccggagtctaattgggaacgaagagttcctggactacatgccgtccatgaagcgcttccggaaggaggaggaaagcgagggcgcaatttggtga

SEQ ID NO: 26079 - RNA, 9873 nt, synthetic construct
  misc_feature 1..9873: note = derived and/or modified CDS sequence (opt11) from DENV-3__GQ868586__SS-prME
  source 1..9873: mol_type = other RNA
accagcttatgcctcatgatgatcttgcccgccgccttggcgtttcatctcaccagccgagacggagaaccgcgaatgatcgtggggaaaaatgaacggggcaaatcgcttctgttcaaaaccgcgtcaggcatcaacatgtgcacgctcatcgccatggatctgggcgagatgtgtgacgacactgtgacctacaagtgcccccacataactgaggtggagcccgaggacatcgactgctggtgcaaccttacctctacctgggtgacctatgggacttgcaatcaggccggcgagcaccggcgcgacaagcggtccgtggccctcgcaccccacgtgggtatggggctggacacccgaacccagacctggatgtcggccgagggcgcctggagacaggtggagaaggtcgaaacttgggccctgaggcatccggggttcaccatcctcgccctgtttctcgcccattatatcgggacctccctcacccagaaagtggtgatcttcattctgctgatgctcgtcaccccctcaatgaccatgcgatgcgtgggggttgggaaccgcgacttcgtcgagggcctgtccggggccacgtgggtcgacgtagtcctcgagcacggcgggtgcgtgactacgatggcaaagaacaagcccaccctcgacatcgaactgcaaaagaccgaggcgacccagctggcgacgctccggaagctgtgcatagagggcaagatcaccaatataacgactgacagccgctgccccacgcagggcgaggccgtgctgcccgaggagcaggaccagaactacgtctgcaagcacacatatgtggaccgtgggtggggcaatgggtgcggcctcttcgggaagggctccctggtgacctgtgccaaatttcagtgcttagagcccattgagggcaaggtagtgcagtacgagaatcttaagtataccgtaatcatcacggtccacaccggagaccagcaccaggtgggcaacgagacccagggggttaccgcagaaatcacgccccaggcctcgaccaccgaggcgattttacccgagtatggcactctggggctcgagtgcagcccgcgcaccggactggacttcaacgagatgatcctgctcacaatgaagaacaaagcctggatggttcaccggcagtggttcttcgacctgccactgccctggaccagcggcgccaccaccgagacgcccacctggaaccgcaaggaactcctcgtgaccttcaaaaacgcccacgccaagaagcaagaggtcgtggtgctggggtcccaggagggcgcgatgcacaccgccctcacgggggccaccgagatccagaacagcggcggcacctccatattcgccggccacttaaagtgtcggctgaagatggacaagctcgagttgaagggcatgtcatacgctatgtgcacgaacacgttcgtcctgaagaaggaggtgtccgagacccagcacgggaccatcctcattaaggtggactacaagggggaggacgtcccgtgtaagattccctttagcaccgaagacgggcagggcaaagctcacaacggccgcctgattaccgccaaccccgtggtgaccaagaaggaggagcccgtcaatatcgaagccgaaccacccttcggggaatcaaacattgtgatcggcatcggcgacaacgcactgaagatcaattggtataagaaggggtccagcatcggtaagatgttcgaggcgacagcccggggcgcccgccggatggcgatcttgggtgataccgcatgggacttcgggtccgtgggaggggtcctcaattctctgggcaagatggtgcaccagatcttcgggtccgcgtatacggcactattctcaggcgtgagctgggtcatgaagatcggcatcggtgtgctccttacctggattggcctgaacagcaagaatacttccatgagcttctcctgcatcgccatcgggattatcaccctctacttaggcgccgtggtccaggccgacacgggatgcgtgataaactggaagggcaaggagctgaagtgcggatctggtatcttcgtgaccaacgaggtccacacctggacagagcagtacaagttccaggcggactcccccaagcgcctagccacggcaatcgccggagcctgggaaaacggggtgtgcggtatccgcagtacaacacgtatggaaaatctactttggaagcagatcgcgaacgagctcaactacattttgtgggagaacaacatcaagctgaccgtagtcgtaggggacataatcggcgtgctcgaacagggcaaacgcactctgactccccagcccatggagctgaagtactcctggaagacctggggtaaggccaaaatcgtcacagccgagacgcagaatagctccttcatcattgacggccccaacacccccgagtgccccagcgcctcccgggcgtggaacgtatgggaggttgaggactacgggtttggggttttcaccaccaacatatggcttaagctccgtgaggtgtatacccagcagtgcgaccatcggctgatgtcagccgccgtgaaggacgagcgcgccgtccacgccgacatgggatattggatcgaaagccagaagaacgggtcgtggaagctcgagaaggcgtccctgatcgaagttaagacgtgcacctggccgaagtcccataccctgtggagcaatggcgtgctcgagtctgacatgatcatccccaagagcctggccggtcccatctcccagcataactaccggccgggataccacactcagacggccgggccctggcatctggggaagctcgagttggactttaactactgcgagggcacgaccgtcgtgattacagagaactgcggaacgcgcggccccagtctacgaaccaccaccgtgtccggaaagttaattcacgagtggtgctgccggtcctgcacgctgcccccgctgcggtacatgggcgaggatggatgctggtacggcatggagatccgtcccatttcagagaaggaggagaacatggtgaaaagcctcgtgtccgccggcagcggggaagtggacaattttacgatgggtgtcctatgcctcgcgatcctcttcgaggaggtgatgcgggggaagttcggcaagaaacacatgatcgctggggtgttctttaccttcgtcctgctgctctccggccagatcacctggcgcgatatggcacacacgctaatcatgatcggcagcaacgcctcagatcggatggggatgggcgtgacctacctggcattgatagccaccttcaagatccaaccgttcctagcactggggttctttcttcgcaagctgaccagccgggagaatctgctcctgggagtgggcctggcgatggccacgaccctccagctgcccgaggacatagagcagatggcaaacgggatagcgctgggcctcatggccctgaagctgatcacccagttcgaaacttaccagctctggacggccctgataagcctaacctgctctaataccatcttcaccctcaccgtcgcctggcgcaccgccaccctgatcttagcgggggtcagccttctgccggtctgccagtcctcgtccatgcggaagaccgactggcttcccatgacggtggctgccatgggcgtgccaccccttccgctgttcattttcagcctcaaggataccctcaagcgccgttcctggcccttgaacgagggggtaatggccgtgggcctggtaagcatattagcctcgagcctactgcggaacgacgtccccatggctggccccctcgtggcagggggcctgctgatcgcctgctacgtgattacggggacctccgccgacctcacggttgaaaaggccgccgacgtgacctgggaggaggaggctgagcagacaggtgtgtcccacaacctgatgatcaccgtcgacgacgatggtaccatgcgcatcaaggacgacgagacggagaacatcctgaccgtgcttcttaagaccgctctgttgatcgtgtctggaatcttcccgtactctattcccgccaccctgcttgtctggcacacttggcagaagcagacgcagcggtccggcgtgttatgggatgtgcccagtccacccgagacccaaaaagccgagctcgaggagggggtctaccgtatcaagcagcagggcatcttcggtaagacccaagtgggggttggggtccagaaggagggggtgttccacacgatgtggcacgtgacgcgcggtgcggtacttacctacaacggcaagcgtctagagcccaactgggcctccgtgaaaaaggacctgattagctacggcgggggttggcggctgtccgcccagtggcagaagggcgaagaggtgcaggtcatcgccgtggaacccggcaagaatcccaaaaacttccagaccatgcccggcacgttccagaccaccactggggagatcggcgcgatcgctctcgacttcaagcccggcacgagcggctcccccattatcaaccgagaggggaaggttgtggggctatacggaaacggggtggtaaccaaaaacggcgggtatgtctcaggcatcgctcagacgaacgccgagccggacggccccacccccgagttggaggaggagatgtttaagaaacggaacctgacgatcatggacctccaccccgggagcggcaagacccggaagtacctgccggccatcgtgcgggaagcgataaagcgccggctgcgaaccttaatcctggctcccacccgggtggtggccgcagagatggaggaggcgctgaaggggttacccatccgctatcaaaccaccgcgacaaaatccgagcacaccggccgtgagatcgtggacctaatgtgccacgccacgtttactatgcgcctgctcagccctgtacgggtcccgaactataatctaatcatcatggacgaagcccacttcactgaccccgcgtccatcgcggcgcgcgggtatatcagcactcgggtgggtatgggcgaagccgcggccatcttcatgacggctacaccgcccggcaccgccgacgcgttcccgcagagcaacgcccccatacaggacgaggaacgcgacatacccgagcgcagctggaactccggcaacgagtggatcacagatttcgccgggaagacggtgtggttcgtaccctcgatcaaggcgggcaatgacattgccaactgtctacggaaaaacgggaagaaagtgatccagttatccagaaagaccttcgacactgagtaccaaaagaccaagctgaatgactgggactttgttgtaacgaccgacataagcgaaatgggcgccaacttcaaggcggatcgtgtaatcgaccccaggcggtgcctgaagcccgtgatcctcaccgacggtcctgagcgcgtcattttagccggtcccatgcctgtgaccgcggcctccgctgcacagcgacgggggcgggttggacggaacccccaaaaggaaaacgaccagtacatctttacgggccagcccctgaacaacgacgaggaccatgcccactggacggaggcaaaaatgctcctggacaacatcaacacccccgaggggatcatcccggctctgtttgagcccgagcgggagaagtccgccgctatcgacggtgagtatcgcttaaagggagaatcccggaagacctttgtcgaactgatgcgccgcggagacctgcccgtgtggctagcgcataaggtcgcgagtgagggcattaagtacaccgaccgaaaatggtgcttcgatggacagcgcaacaatcagatcctagaggagaacatggacgtcgagatctggacgaaggagggcgagaagaagaagctgcggcctcggtggctcgacgcacgtacatactctgacccactcgctctgaaggagtttaaggactttgcagcggggcgcaagagcatcgccctcgacttggtgacagaaattgggagagtcccctcccacctggcccaccgcacccggaacgccctggacaacctggtgatgctgcacacgagcgagcacggcgggaaggcctaccggcacgcagtagaggagctacccgagactatggaaacactcctcctcttgggcctgatgatcctgttgaccgggggcgcaatgctatttctcatcagcggcaaggggatcggcaagacgtcaatcgggctcatctgcgttatcgcgagctcggggatgctgtggatggccgagatcccgctccagtggatcgccagcgccatcgtgctggagttcttcatgatggttctgctgatccccgaacccgagaagcagcggacgccccaggacaaccagctggcctacgtcgtgatcgggatcctgactctcgccgcgataatcgccgcgaacgagatgggcctgctggagaccacgaagcgcgacctcggcatgagcaaggagccgggggtcgtctctccgacctcctacctggatgtggacctgcaccccgcgtccgcctggacgctctacgccgtggcgaccaccgtcatcacccccatgctaaggcataccatcgagaactctactgcaaacgtgtcgctggccgcaatcgcaaatcaggccgtggtgctcatgggcctggacaaggggtggccgatatccaagatggacctgggtgtacccttactggccctggggtgctacagccaggtaaaccccctaacgttgacggcagccgtcctactattaatcacccattacgccatcatcggcccgggtctacaagcgaaggccacccgcgaggcccagaagcgaactgctgccgggataatgaaaaacccgaccgtggacggcatcatgaccatcgacctcgacccggtcatctacgactccaaattcgaaaagcagctggggcaggttatgctgctagtgctgtgcgcggtgcagttactcctgatgagaacgagctgggccctgtgcgaggccctaacgctggccaccggccccatcacaaccctgtgggagggatcccccgggaagttctggaacactaccattgcggtctccatggccaacatcttccggggatcctacctcgccggagccggcttagccttcagtatcatgaagtcagtggggacaggcaagagaggcacagggtcgcagggcgagaccctgggggaaaagtggaagaagaagctcaaccagctgagccggaaggagttcgacttgtacaagaaatccggcatcacggaggtggaccgcaccgaggcgaaggaggggctcaagagaggggaggtcacccatcacgccgtgagccgtggctccgccaagctgcagtggttcgtggagaggaacatggtcatccccgaggggcgcgtgatcgacctaggctgcgggcggggcgggtggagctactactgcgccggccttaagaaagtgactgaggtccgcggctatacgaagggtgggccaggacacgaggagccggtgcccatgtccacctacgggtggaacatcgtgaagctgatgagtgggaaggacgtcttctacctcccgcccgagaagtgtgacacactcctgtgcgacatcggcgagtccagcccctcccccaccgtggaagagagccggacgattcgcgtgctgaagatggtcgagccgtggctcaagaacaaccaattctgcatcaaggtgctcaacccctacatgcccaccgtcatcgagcacctcgagcgcctacagcggaagcacggcggaatgctcgtccgcaaccccctgtccagaaactctacccatgagatgtactggatctctaacggcaccgggaatatcgttgccagtgtgaacatggtctcccgcctcctcctgaatcgatttacgatgacccaccgccggccgaccatcgagaaggacgtagacttgggggcgggcacccgccacgtaaacgccgagcccgagacgcctaacatggacgttatcggcgagcggatcaagcgcatcaaagaggagcacaacagcacctggcactacgacgacgagaacccgtacaagacatgggcctaccacggcagttatgaggtgaaggcaactggcagcgcctccagcatgatcaacggcgtagtgaagttgttaacgaaaccctgggacgtagtccctatggtgacccagatggcgatgaccgataccacgccctttgggcaacagcgggtcttcaaggagaaggtcgacacccggacaccccggagcatgcccggcacccgacgggtgatgggcatcacggccgagtggttgtggcgcacgctcggacggaacaaaaagccccgactgtgcacccgggaggagttcaccaagaaggtgcgtacgaacgccgcgatgggtgcagtcttcactgaagaaaaccagtgggacagcgccaaggccgccgtggaggacgaggacttctggaaacttgtggagcgcgaaagagagctccataagctggggaagtgcggcagttgcgtctataacatgatggggaagcgcgaaaagaagctgggcgaatttggcaaggccaaaggatcccgagcgatctggtacatgtggctcggagcccgttatctggagttcgaggccctagggttcctcaacgaggatcattggttcagccgggagaactcttacagcggagtggagggggaaggcctgcacaaattagggtatatcctccgtgatatctccaagatacccgggggcgccatgtacgccgacgacaccgcggggtgggacacccggataacggaggacgacctgcacaatgaagagaagatcacgcagcagatggacccggagcacaagcagctggctaacgccatattcaagttaacataccaaaacaaggtggtcaaggtgcagcgccccacaccgactggcacggtgatggacatcatcagccggaaggaccagcgcggctccgggcaggtcggcacctacgggctgaatacgttcacgaacatggaggcccagctgattcggcagatggagggcgaaggggtgctctcgaaagccgacttagagaacccccacttacccgagaaaaagattacgcagtggctggagaccaagggcgttgagcgcttgaagcgcatggcaatctctggcgatgactgcgtggtgaagcccatcgacgaccgctttgcgaacgccctgctagccctgaacgatatgggaaaggtgcgaaaagacatcccccaatggcagccaagcaagggttggcacgactggcagcaggtcccattctgtagtcaccacttccacgaactgataatgaaggacggtcgtaagctcgtggtgccctgtcggccccaggatgagctgatcggccgcgcccggatcagccagggggccggatggtccctgagagaaacggcctgcctcgctaaggcttacgcccagatgtggagcttgatgtacttccaccggcgcgacttacggctggcttccaacgccatctgcagcgccgtaccggtgcactgggtgccgacctcccggacgacctggagcatacacgcccaccaccaatggatgacgaccgaagacatgctgacggtctggaaccgtgtctggatcgaggacaatccttggatggaggacaagacccccgtgactacctgggagaacgtcccctacctgggcaagcgggaggatcagtggtgcggtagcctcatcggcctgacgtcccgtgcgacctgggcccagaacatccccactgctatacaacaggtgcggagccttatcgggaacgaggagttcctcgactacatgcctagtatgaagcgatttcggaaggaggaggagtcagagggtgccatctggtga

SEQ ID NO: 26080 - RNA, 9873 nt, synthetic construct
  misc_feature 1..9873: note = derived and/or modified CDS sequence (opt11) from DENV-3__FJ850110__SS-prME
  source 1..9873: mol_type = other RNA
acaagcctctgtttgatgatgatactcccggctgccctggccttccacctcacgtcacgggacggtgaaccccgcatgatcgtcggtaaaaatgaaagaggaaaatcgctgttattcaaaaccgcctccggcataaacatgtgcacgttaattgcaatggacctcggagaaatgtgtgacgacacagtcacttacaagtgtccacacatcacagaggtcgaacccgaagatatagactgctggtgcaacttgacttctacatgggtcacctacggcacgtgcaatcaggcgggagaacaccgacgcgataagagatctgtcgcattagcgcctcacgtggggatgggattagatacaagaacacaaacgtggatgtcggcagaaggagcctggcgacaagtcgagaaagtggaaacgtgggcactcagacacccgggatttacaatactcgctctattcctagcccactacatcggaacctcactcactcaaaaggtggtaatatttattctactgatgctcgtgacacccagcatgacaatgcgctgtgtaggagttgggaacagagacttcgtagagggactgagcggtgcaacatgggtggacgtcgtactggaacacggcggctgcgtcacaacaatggccaaaaacaaacccaccctagacatagaactgcaaaagactgaggccacgcaactagctacgctacggaagctatgcatagagggaaaaataacaaacatcacaaccgactcacggtgcccaacacaaggagaggcagtactaccagaagaacaagaccaaaactacgtatgtaaacacacgtatgtggatagagggtgggggaacggctgtggactcttcggaaagggtagcttggtaacctgcgcgaaattccaatgcttggaacctatagaagggaaagtcgtgcagtacgagaatctaaaatacaccgtcataataactgtccacacgggggaccaacatcaagtgggtaatgagacccaaggggttactgcggagataacgccacaggccagcacaacggaggcgatcctacccgagtacggaacactaggactagaatgcagcccacgcacagggctggacttcaacgaaatgatactcctcaccatgaaaaataaggcctggatggtacaccgccaatggttcttcgacctaccgctcccgtggacgagcggggctacaacagaaaccccgacgtggaatcgaaaagaactactggtcacgttcaaaaacgcgcacgcaaagaagcaagaagtcgtggtcttgggaagccaggagggcgcaatgcataccgcgttaacaggtgcgaccgaaatccaaaacagcggaggcacatccatatttgcaggccacctcaagtgcagactaaagatggacaagttagagctgaaggggatgagttacgctatgtgcactaacaccttcgtactaaagaaagaggtgtctgagacccagcatggaaccatcctaatcaaggtagagtacaagggagaagatgttccctgcaaaatcccattctcaacagaagacgggcaaggcaaagcgcacaacggccggctcattacagcaaaccccgtagtgacgaagaaggaagaaccggtaaacatcgaagccgagccaccgtttggtgagagtaacattgtcataggcattggggacaacgccctaaagatcaactggtacaagaaaggatcatcaatagggaaaatgttcgaggcaaccgcacgcggggcgcggaggatggccatacttggcgataccgcatgggacttcggatcagtaggcggggtgttgaactcgctggggaaaatggtccaccaaatcttcgggagcgcctacacagcattattctccggagtctcctgggtaatgaaaattggtataggcgtactactcacctggattggactcaactccaaaaacaccagcatgagcttcagttgcatcgcgataggaataataacgctgtacctcggcgcggtcgtgcaagcagacactggctgcgtgatcaattggaaaggcaaagagctgaagtgcggcagcggaatattcgtaaccaatgaggtccatacttggacagagcagtataaattccaagcggactccccgaaaagactagcgactgcaattgccggcgcatgggaaaacggcgtctgcggaatcaggagcacaacgcgcatggagaacctgctatggaaacaaattgcgaatgaattgaattacatcctctgggaaaataatatcaaattgacggtcgtagtaggagatatcattggggtgctggaacagggtaaacggacactgacaccccagccgatggagctcaaatatagctggaaaacctgggggaaagccaggatagtaaccgctgaaactcaaaactcatcctttatcatcgatggcccaaatacgccagaatgccccaacacttcacgggcatggaacgtctgggaagtagaggactacggcttcggcgtgttcaccactaacatatggctcaaacttcgagaagtctacacacagctgtgtgatcatcgactcatgagtgcagcggtgaaagacgaaagggcagttcacgccgacatgggctattggatagagagtcagaaaaacggaagctggaagctggagaaggctagcctgatcgaagtaaaaacctgcacatggccaaaaagccataccctatggtcgaacggcgtcctggagtctgacatgataataccaaagtcattggcgggacctatatcgcaacacaattacaggcccggataccatacccagacagcagggccatggcatctgggcaaacttgagctggacttcaactactgcgaagggacaacggtggtaatcacggagaactgcgggactcggggaccaagccttcgaacaacaaccgtgtctggaaaactaatacacgaatggtgttgcaggagctgcaccctaccaccactaagatacatgggagaggacggctgctggtacggaatggaaatcagacccattaacgaaaaagaggaaaacatggttaaatccctcgtcagtgcaggctcgggagaagttgacaactttacaatgggcgtactatgcctagccatactatttgaggaggtaatgcggggtaagttcgggaagaaacacatgatcgcgggcgtgttcttcacgttcgtgctcctgttgagcggccaaataacctggcgggacatggcacacaccctaataatgatcgggtccaacgccacagatcgcatggggatgggtgtaacctacctagcactaatagctactttcaaaattcagcccttcctagcactgggattcttcctgcgcaaattaacttccagagagaatctactactaggtgttgggctagcgatggcgacaacgctgcaacttcccgaagacatagagcagatggcaaacggaatcgcactagggctcatggcactcaaactcataacacaattcgaaacctaccagctctggactgcactcattagcctaacatgctctaacacgatattcacgctaaccgtcgcatggcgtaccgctactcttatcctagcaggggtctcccttctgcccgtctgccaaagttcgtcaatgcgaaagacggattggctgccaatgaccgtggcggccatgggagtaccacccctccccctcttcatcttctctctcaaagatacgctgaaaagaaggagctggcctctcaacgagggtgtcatggcagtcgggctagtgagcatcctagcgagcagcttgctgcgaaacgatgtaccaatggccggcccgttagtcgccgggggcttattaatagcctgttacgtaatcacgggaacgagcgctgacctaacagtggagaaagcagctgatgtcacatgggaagaggaggcagaacagacaggcgtaagccacaacttgatgataaccgtcgacgacgatgggaccatgcgaataaaagatgacgagacggaaaatatattaacagtactactgaagactgcacttctgatagtctcaggcatattcccatattcgatacccgccactctgctcgtatggcacacttggcagaagcagacacaaaggtccggcgtgctatgggacgtccccagtccgcctgagacacagaaagcggaattagaggaaggagtctatcgcatcaagcaacagggcatattcgggaaaacgcaggtcggggtcggggtgcagaaggagggggtattccacaccatgtggcatgtaacacggggcgccgtactgacatacaatggcaaaagactagaaccgaactgggcttccgtgaagaaagacctcatttcatatggaggcggttggcgactcagcgcacagtggcagaagggagaggaagtccaggttattgcagtggagccgggcaaaaaccccaagaatttccagacaatgccgggaacattccaaacaacaacaggcgagataggagcaatcgcgctggacttcaaaccaggcacaagcggatcaccaattatcaaccgggaggggaaggtcgtaggactgtacgggaacggcgtcgtaaccaaaaatggcgggtacgtgtctggaatcgcacaaacgaatgcggagccagacggaccaactcccgaattggaggaagaaatgttcaagaaaaggaacctcacaatcatggatctgcacccaggctcgggtaagacaaggaagtatctacccgctatagttagggaagcgataaagcgacgcctaaggacattaatcctagccccaacgcgagtcgtcgctgccgagatggaagaagccctcaaaggtctaccgatacggtaccaaacaaccgcaacgaaatcagaacacaccggcagagagatagtggatctgatgtgtcacgctacttttacgatgagattactatctcccgtacgtgtgcccaattacaatttgataataatggatgaagcacacttcaccgaccctgccagcatcgcagccagaggctacatatcaacaagagtaggcatgggcgaagcggcagcgattttcatgacggctaccccgcctggaacggcggacgcgtttccccagagcaacgctcccatccaggacgaggaaagagatatccccgagcggtcatggaacagcggtaacgagtggatcacagacttcgcagggaaaaccgtttggttcgtccccagcattaaggccgggaatgacatagcgaactgcctcaggaaaaacggaaagaaagtcatccaattaagccgaaagaccttcgacaccgaataccaaaagacaaaactgaatgactgggactttgtggtaacgacggacatctcggagatgggcgcgaatttcaaagcagacagagtaatagacccccgaaggtgccttaagccagtaatactcaccgatggacccgagagggtaatcctagccgggccaatgccggtcacggcagcatctgcggcacagaggaggggacgggtgggacgcaaccctcaaaaagaaaatgaccagtacatcttcacgggacagccactcaataacgacgaggaccacgcccattggactgaggccaaaatgcttctagacaatatcaacacacccgagggaatcatcccagctctgttcgaaccggagagagagaaaagcgcggcgatagacggcgagtaccgtctgaagggagaatcccgtaaaacatttgtcgaactaatgaggagaggagacctgcctgtatggctcgcccacaaagtcgcgtccgaaggcataaaatacacggatagaaagtggtgctttgacggccaacgtaataaccagatcctggaagaaaatatggatgtcgaaatctggacgaaggaaggggagaaaaagaaacttcgaccccggtggctagacgcaaggacatactcagacccactcgccctgaaagagttcaaggatttcgctgccgggagaaaatcgatcgccctagacttggtgacggaaatcgggcgcgtccccacacatctcgctcatagaacgagaaacgctctggacaacctagtcatgctacataccagcgaacacggaggaaaagcatatcgacacgccgtggaagagttgcctgagactatggagacgctactgctgcttggactgatgattctactcacagggggagcaatgctattcctcataagcggtaaagggataggtaaaaccagcataggactgatatgcgtcatagcaagcagtgggatgctgtggatggccgaaataccactacagtggattgcgtcagctatcgtcctcgagttcttcatgatggtcctacttatccctgagccggaaaaacaacgcacgccccaggacaatcaactcgcatatgtggtcataggaatccttacgctcgccgcgataatagcagccaacgaaatgggcctactggaaacaaccaagagggacctaggcatgtcaaaagaaccaggggtagtatccccgacctcctacctcgatgtagacctgcacccagccagtgcgtggacgctatacgcggtggcgaccaccgtgatcacaccaatgctccgccatactatagaaaattcaaccgccaatgtaagccttgcggcaatagcaaatcaagccgttgtactaatgggactcgacaagggatggcccatatcgaaaatggatcttggggtccctctgttagcgctcgggtgctactcccaagtcaacccattaacgctaacggccgcagtactcctgctgatcacacattacgcgatcataggtcccggcctccaagccaaagccacacgcgaagcacaaaagagaacggcagcagggataatgaagaaccccacagtggacgggatcatgacgattgatttagacccagtaatatacgatagcaaattcgaaaaacaactagggcaagttatgctcctcgtactgtgcgcagtccagctgttgcttatgcgcacatcgtgggcactatgcgaagcactgactttggcaacgggacccataacaaccctatgggagggctcaccagggaaattctggaatacaacgatagcagtaagcatggcaaacatattcagaggttcctacctagccggcgcaggattggcgttttcgataatgaagtctgtgggaacgggtaaacgaggaaccgggagccagggcgagaccctcggcgagaaatggaaaaagaaattgaaccaactctcgcgaaaggagttcgacctatacaagaaatcagggattaccgaagtagatcgcaccgaggcaaaagaaggattgaaacggggagagatcacgcaccacgcagtatcacgtgggagtgcaaagctccagtggtttgtggagagaaacatggtgataccggaagggagagtaatagacctggggtgcggtaggggtggctggagctactactgcgctggcctaaagaaagtaaccgaggtcaggggatacactaaagggggacccggacatgaggagcccgtgcccatgtcgacgtacggctggaatatagtgaaacttatgtcaggcaaggatgtattctacctcccacctgagaaatgcgacactttattatgtgacataggggaaagtagtcccagcccgacagtagaggagtcacgtacaatccgcgttctcaaaatggtagaaccgtggctgaagaacaaccaattctgcatcaaggtgctgaatccatacatgcccgccgttatcgagcacctagagcggttacaacgaaagcatggaggaatgctagtccgaaaccccctctcgagaaacagcacccacgaaatgtactggatcagcaacggcaccggtaatatcgtagcctcagtaaacatggtcagtcgattacttttaaaccgcttcaccatgactcatagaagaccaacaattgaaaaagacgtcgacttgggagccggaacccgccacgtgaacgccgagcccgagacccccaacatggatgttataggagaacgaataaaacgtattaaagaagaacacaacagcacctggcactacgacgatgagaacccatacaaaacctgggcctaccacggatcatacgaggtaaaagccacgggctcagcgagctccatgataaatggagtagtgaaactcctgaccaagccctgggatgtagtccctatggtcacacaaatggccatgaccgacacaacccctttcggtcagcagagagtattcaaagaaaaagtagacactcggacaccacgttcaatgccaggaaccaggcgggtgatggaaatcactgcagaatggctatggcggactctaggacggaacaagaaacccagactatgcaccagagaagagttcacaaagaaagtgcgaacaaacgcggcaatgggagccgtattcacggaagagaaccagtgggactcggccaaagcggcagtcgaagacgaagacttttggaaattggtagacagagagcgcgaactacataagctaggaaaatgcgggagttgcgtgtacaacatgatgggaaaacgcgagaagaagctcggcgagttcggtaaggcgaaagggagcagagcaatttggtacatgtggctcggcgcccggtacctggagttcgaggccctcggatttctaaatgaggaccactggttcagcagagagaacagctactcgggcgtcgaaggggaggggctacacaagctcggttacatactacgagatatctcgaaaatacctggtggtgccatgtatgcagacgacacggcaggatgggacacacgtataaccgaagacgatctacataacgaagagaagataacccagcagatggaccccgaacacagacagctcgcaaacgcgatcttcaagctaacgtaccagaataaagtcgtaaaggtccaacgacccaccccgacggggacagttatggatatcatcagtagaaaagaccagcgcggaagtggacaggttggtacttatggtctcaacactttcacaaacatggaggcccagctcatccgtcaaatggaaggcgagggcgtactttcgaaagctgatctggagaacccgcatctgcctgagaagaaaataacacaatggctggaaacaaaaggagttgagagactgaaacggatggcaataagcggagatgactgtgtcgtgaaaccgatcgacgaccgattcgcgaacgcactactagcactcaatgacatgggtaaagtccggaaagatataccacaatggcagccttcaaaaggctggcacgactggcaacaagtcccattttgtagtcaccacttccacgagctcataatgaaagacgggagaaaactggtggtaccctgccggcctcaagacgaactgattgggcgagcgcgtattagccagggggcaggctggtccctgagagaaactgcctgcttgggaaaagcatacgcccaaatgtggtctttaatgtactttcatcgccgggatctacgcctcgcttctaacgctatttgctccgccgtaccagtccattgggtaccaacaagtcgaaccacgtggtcaatacacgcgcaccatcaatggatgaccaccgaagatatgcttactgtatggaaccgcgtgtggattgaggacaatccatggatggaggacaaaacacccgtcacaacttgggaaaacgtgccctatctagggaagcgtgaagatcaatggtgcgggagcttgatcgggctgacttcaagggccacgtgggcacaaaatatccccacagctatacaacaagttagatcgcttataggtaacgaagaatttctcgactacatgccctcaatgaaacgctttcgaaaggaagaagaaagcgaaggggccatatggtga

SEQ ID NO: 26081 - RNA, 9873 nt, synthetic construct
  misc_feature 1..9873: note = derived and/or modified CDS sequence (opt11) from DENV-3__FJ850111__SS-prME
  source 1..9873: mol_type = other RNA
acgagcctctgcctcatgatgatcctgcccgccgccttggcgttccaccttaccagccgggacggcgagccccggatgatcgtggggaagaacgaacgcggcaagtcgctgctgtttaaaacagcctccgggatcaacatgtgcacgttgattgccatggacctcggcgagatgtgcgacgacactgtcacctacaagtgtccccatatcaccgaagttgagcccgaggacatcgactgctggtgcaacctgaccagcacctgggttacctacgggacgtgcaaccaggcgggcgaacatcggcgagacaagcgttccgtcgccttagcgccccacgtgggaatggggctggacacacgtacacaaacctggatgtcagccgagggtgcctggcgccaagtggagaaggtggaaacttgggccctgcgccacccgggattcaccattttagcactgtttctggcccactacatcggtacgtccctaacccagaaggtggtaatcttcatcctactgatgttagtaacgcccagcatgaccatgcgctgcgtgggggtgggtaaccgcgacttcgtcgagggcctgtccggggccacttgggtcgatgtggtcctggagcatggagggtgtgtgaccacgatggccaagaacaagcccaccctggacatcgagttacagaagaccgaggcaacgcaactggcgacgctccggaaactgtgcatagaaggcaagatcaccaatatcacgaccgactctaggtgccccacgcagggcgaggcagtgctgccggaggagcaggaccaaaattacgtctgcaagcatacttacgtggaccggggatggggcaatgggtgcggcctcttcgggaagggctcccttgtgacttgcgcgaaatttcagtgcctggagcctatcgagggcaaagtcgtgcagtacgagaacctaaagtacacagtgataatcaccgtccacactggggaccagcatcaggtgggcaacgagacccagggggtcaccgctgagataaccccgcaggcttctaccacagaggcgatcctgcccgagtacggcacactggggctcgagtgttccccgaggaccgggctggacttcaacgaaatgatccttctcacaatgaagaacaaagcctggatggtgcacagacagtggttcttcgacctgcccttaccctggacctctggcgccaccacagaaacgcccacctggaataggaaggaactgctggtgaccttcaagaacgcacatgcgaagaagcaggaagtcgtggtgctgggttcccaggagggcgcgatgcacacggcgcttacgggggccaccgagatccagaacagtggcggtacctctatcttcgcgggccacctgaagtgccgactgaagatggataaactagagctcaagggcatgtcctacgctatgtgcaccaacactttcgtactgaagaaggaggtgtcggagacccagcacgggaccatcctcatcaaggtagagtacaagggcgaggacgtcccgtgcaagatacccttcagcactgaggacgggcagggcaaagcgcacaacggccgcctgatcacggccaaccccgtggttacgaagaaggaggagccagtcaacatcgaggccgagccaccctttggggagagcaacatcgtgatcggcatcggagacaactcactgaagatcaactggtacaagaaggggtcatctattgggaagatgtttgaggccaccgctcggggcgcccgccggatggccatcctgggcgatacggcctgggacttcggctctgtgggcggggtcctcaactccttaggaaagatggtgcaccaaatcttcgggagcgcctacacggcgttattttccggcgtaagctgggtcatgaagatcggcatcggagtgctcctgacctggatcggactgaactccaagaacaccagcatgtcgttctcgtgcatagccatagggattatcactctctacctgggcgccgttgttcaggccgacacggggtgcgtgatcaactggaagggcaaggagctgaagtgcggctccggtatctttgtgaccaacgaggtccacacctggacggagcagtacaaatttcaggcagacagccccaagcgcctcgcgacggcgatcgccggcgcctgggaaaatggcgtgtgtggcattcgttccaccaccagaatggaaaacctgctgtggaagcagatcgccaacgagctcaattacatcttgtgggagaacaacatcaagctgaccgtggtcgtgggggatatcatcggcgtgctcgaacagggcaagcgcactctcacgccccagccgatggagttgaagtacagctggaaaacctgggggaaagcgcggatcgtgaccgccgagacgcagaactctagctttatcatcgacggcccaaatacccccgagtgccccaacacctcccgtgcctggaacgtgtgggaggtggaggactacgggttcggcgtcttcactaccaacatctggcttaaacttcgcgaggtgtacacgcagctgtgcgaccaccgccttatgagcgcagccgtgaaggacgagcgagccgtccacgccgacatgggctattggatcgagagccagaagaacgggtcctggaagctggagaaggcgagcctgatcgaggtaaagacctgcacctggccaaagtcccacaccctctggagcaacggcgtgctggagtccgatatgatcatcccgaaaagcctggcagggcccatctcccagcataactaccgaccgggataccacacgcagaccgcggggccctggcacttaggcaaacttgagctggacttcaattactgtgagggtaccaccgttgtgatcacggagaactgcggaacccgcggccccagcctccgcacgaccacggtctctgggaaacttatccacgagtggtgctgtagaagctgcaccctgcctccactacgctacatgggcgaagacgggtgctggtatggcatggagatccgacctatctctgagaaagaggagaacatggtaaagagcctggtgtcggccggtagcggggaagtcgacaacttcaccatgggagttctgtgtctcgccatactcttcgaggaggtcatgcgcggcaaatttggtaagaagcacatgatcgccggggtgttctttacgttcgtcctgttgctgtccggacaaatcacgtggcgagacatggcccacaccctaatcatgatcggcagcaacgcgaccgaccgcatggggatgggcgtgacctacctcgccctgatcgccacattcaagatccagccctttctcgccctggggttcttcctgcggaagttaacctctcgcgagaacctcctgctgggtgtgggcctcgccatggcgacaacactgcagctgcccgaggacatcgagcaaatggccaacgggatcgcgctaggcctgatggcgctgaagctaatcactcagttcgagacctatcagttatggaccgcgctgatctctttaacctgcagcaatacaatattcaccctgaccgtcgcctggcggacagccacgctgatcctcgccggggtgtccctcctgccggtctgtcagagctcctcgatgaggaagaccgactggctccccatgactgtggctgcgatgggcgtgccgcctctcccgttgttcatcttttccctcaaggacaccttaaaacgccgcagctggcccttaaacgaaggggtcatggctgtgggcctcgtgtccatcctggcgagcagcttgctacgcaacgacgtgcctatggccggcccgctggtggctggaggcctgctcatcgcgtgttacgtgatcacgggcacctccgcggacttaaccgtcgagaaggcggccgacgtgacctgggaggaggaggcagagcagactggcgtgtcccacaacctgatgattaccgtcgacgatgacgggacaatgcggatcaaggacgatgagacggagaatatattgaccgtgctactgaagacggctctcctgatcgtgagtggcatcttcccgtactccatacccgccaccttgctcgtctggcacacctggcagaagcagacccagcgcagcggcgtattatgggatgtgcccagcccaccggagacgcagaaggccgagctggaggaaggtgtgtaccggattaaacagcagggcatcttcggaaaaacccaagtgggcgtgggcgtccaaaaagaaggcgtgttccacactatgtggcacgtgacccggggtgccgtccttacctacaacgggaagcggctggagcccaactgggccagcgtgaagaaggacttgatctcctacggaggaggctggcgcctcagcgcgcaatggcagaagggggaggaggtgcaagtcatcgcggtggagcccggcaaaaaccccaagaacttccaaaccatgcccggcacgtttcaaaccactactggagaaatcggggctatcgctctggactttaagcccgggacgtcagggagcccgatcataaaccgggagggcaaggttgtcggcctgtacggcaacggggtggtaaccaagaatggcgggtatgtctcaggcatcgcacagacgaacgccgagccggacggccccacccccgagctggaggaggagatgtttaagaagcgaaacctcaccattatggacctgcatcccggcagcgggaagacccgaaagtacttgccggctattgtgcgcgaggcgatcaagaggcgactccggacgctgattctggcccccacccgcgttgtcgcggcggagatggaagaggccctcaaggggctgcccatcaggtaccagaccaccgccaccaagtccgaacacaccggccgcgagatagtggacctgatgtgccacgccaccttcaccatgcggctcctgtcccccgtgcgcgtaccgaactacaacttaataataatggatgaggcccactttacggaccccgccagcatcgccgcccggggttacatctccacccgcgtaggcatgggcgaggccgcggcgatcttcatgaccgccacgccacccggcacggcggatgcgttcccgcagtccaacgcccccatacaggacgaggaacgcgacatccctgagcggagttggaactctggcaatgagtggataaccgacttcgcagggaagactgtgtggttcgtcccttccatcaaggcaggcaacgacatcgccaattgcctccgcaagaatggaaagaaggtgatccaactgagccggaaaaccttcgacacagagtaccaaaagaccaagctgaacgactgggacttcgtggttaccaccgacatctcagagatgggcgcgaacttcaaggccgacagggtgattgaccctcggcgctgcctcaagccggtgatcctgaccgacggcccagagcgggttatcctggcggggcctatgcctgtgacggcggcatcagcggcccagcgccgggggcgcgtggggcggaaccctcaaaaggaaaacgaccagtacatctttaccggccagcccctcaacaatgacgaggaccacgctcactggaccgaggctaagatgctgctagacaacataaacacgccggaagggatcatcccggccctgttcgagccagaacgcgagaagagtgctgccatcgacggagagtaccgccttaagggagaaagccgcaagaccttcgttgagttaatgcggcgcggggatcttcccgtgtggctggcccataaggtggcatccgagggcattaaatatacagacagaaagtggtgcttcgacgggcagagaaacaaccagatcctagaagagaatatggacgtggagatctggaccaaggagggcgagaagaaaaagttacgtccgcgctggctggacgcgcgcacctactctgacccgttggccctcaaagagttcaaagactttgccgcagggaggaagtcaatcgccctggacctggttacggaaatcgggagagtcccaactcacctagcgcaccggacccgcaacgccctggataatttggtcatgctccacactagcgaacacggcgggaaggcctaccggcacgccgtagaggaactgccagagacgatggagaccctgctcctgctcggactcatgatcctgctgaccgggggcgccatgctgttcctcattagtggcaaggggatcggcaagacctctatcgggctgatctgcgtcatcgcgagctccggcatgctctggatggcagagatcccgctgcagtggatcgcatcagccatcgtgttagagttcttcatgatggtgctcctgatccctgagcccgagaagcagcgcacgcctcaggacaaccaactggcctacgtggtgataggaatcctcaccctggcggccatcatcgccgcgaacgagatgggcctgctcgagactaccaagcgcgacctgggcatgtccaaagagccaggggtggtctcccccacgtcctaccttgacgtggacctgcatcccgccagcgcgtggaccctgtacgccgtagctacaacagtcataacgccgatgctgcgccacacgatcgagaactccaccgccaatgtgagcctcgcggccatcgcgaaccaggctgtggtcctgatgggcctggataagggttggccgatctccaagatggatctcggggtgcccctgttggccctcgggtgttacagccaggtgaacccccttaccttaacggcggccgtcctcctgctgatcacacactacgcgataattgggcccggactccaggccaaggccacccgggaagcgcaaaagcgcacggccgccgggatcatgaagaacccgacggtagacgggataatgaccatagatctggacccagtcatctacgactcgaaatttgagaagcagttggggcaggtcatgctcttggtcctatgcgccgtgcaactgctgctgatgcggacctcatgggcactctgcgaggcgctgacacttgccaccggccccatcaccaccctctgggagggctcccccgggaagttctggaacacaactattgctgtcagtatggccaacatcttccgcggcagctatctggcgggggcaggcctggccttcagcattatgaaatcagtggggacgggcaagcgcggcaccgggagccagggcgagaccctcggggagaagtggaagaaaaagctgaaccagctgtcccgcaaggagttcgacctctacaagaagtccggcatcactgaggtagaccggacggaggccaaagagggtctgaagcgcggcgagatcacccaccacgccgtgagccggggatccgcgaagctgcagtggttcgtggagcgcaacatggtgatcccggaggggagagtcatcgatctcggctgtgggagaggcgggtggagctactactgtgcgggcttgaagaaggtgacggaggtgcgggggtacacaaagggcggccccgggcacgaggagccggtacctatgtccacttacggctggaacatcgtgaagttaatgagcggaaaagacgtattttacctcccgcccgagaagtgcgatacccttctgtgcgatatcggcgagagtagcccctcccccactgttgaggaaagtcgcaccatccgcgtactgaaaatggtggaaccctggctgaaaaacaatcagttctgcatcaaggtcctgaacccctacatgccggcggtgatcgaacacctggagcgtctccaacgcaagcacggcgggatgctggtacggaacccgctgtctagaaacagcacgcacgagatgtactggatctcaaacggcaccgggaacatagtcgcctcggtgaacatggtgtcccgactcctgttgaaccgattcaccatgacgcatcggcgcccgacgatcgagaaggatgttgacctcggcgcaggcactcggcatgtgaacgcggagcccgagacccccaacatggacgtgataggggagagaatcaagaggatcaaggaggagcacaacagcacctggcactacgacgacgagaatccgtacaaaacgtgggcctaccacggctcctacgaggtcaaagccactgggtccgcctccagcatgatcaacggcgtggtcaagctgctgaccaagccgtgggacgtcgtgcccatggtcatacagatggctatgaccgacactaccccattcggccaacaacgcgtgtttaaggagaaagtggacaccagaaccccgcgctccatgcccggaaccaggcgcgtcatggagatcaccgcggaatggctctggagaacgctcggccgcaacaaaaagccccggctgtgcacccgcgaggagttcacgaagaaggtgcgcacgaacgccgccatgggggccgtgttcaccgaagagaaccagtgggacagcgcaaaggcagccgtcgaagacgaggacttttggaaactcgtggaccgggagcgcgaattacacaagctgggcaaatgtggtagctgtgtatacaacatgatgggtaagcgggagaagaagctcggggagtttggcaaggctaagggcagtagggccatctggtacatgtggctgggggcgcggtacctggagtttgaggcactcggcttcctgaacgaagatcactggttcagccgggaaaattcctatagcggggtcgagggcgaaggtttgcacaaacttggctacatacttcgggacatctccaagatccccggcggggccatgtacgccgacgacaccgcaggctgggatacgcgtatcaccgaagacgacctgcacaacgaggagaaaataacccagcagatggacccggaacatcggcagttggcgaatgccatattcaaactgacctaccaaaacaaggtggtgaaagtgcaaagaccaacacccactggtaccgtgatggacataatcagccggaaagaccagcgcggctccggtcaggtcgggacctacggcctgaacacctttacgaacatggaggcgcagctgataagacaaatggaaggggaaggcgtactgagcaaggccgacctcgagaatccccacctcccggagaagaaaatcacccagtggctggagaccaagggcgtggagcgactgaagcggatggctatcagtggcgacgactgcgtggtcaagcccatcgacgacagatttgcgaacgcccttctggccctgaacgacatgggaaaggtgcgtaaggacattccgcagtggcagcccagcaagggctggcacgactggcaacaggtcccgttctgctcccaccacttccacgagctaatcatgaaggacggccgcaagctggtcgtgccatgtagaccccaggacgagctgatcggccgcgcgcggatcagccagggggcggggtggtccctccgcgagacagcctgcctgggcaaggcttacgcccaaatgtggagtctgatgtacttccaccgccgggacctccgcctagcctccaatgcgatatgcagcgccgtgcccgtccactgggtgccgacgtctcggaccacctggagcatacatgcccatcatcaatggatgaccacggaggacatgctgaccgtgtggaaccgtgtctggattgaggacaacccctggatggaggacaaaacgcccgtgaccacttgggagaacgtgccctacctcggcaagcgggaggaccagtggtgcgggtccctgatcggcctaacctctcgcgccacctgggcccagaacatcccaaccgcgattcagcaggtccggagcttaattggcaacgaagagttcctggactacatgccgtccatgaagcgctttcggaaggaggaagagagtgagggcgccatttggtga

SEQ ID NO: 26082 - RNA, 9873 nt, synthetic construct
  misc_feature 1..9873: note = derived and/or modified CDS sequence (opt11) from DENV-3__KF955486__SS-prME
  source 1..9873: mol_type = other RNA
accagcctctgcctcatgatgatcctgccggccgccctggcgttccacctcactagccgtgacggcgagccccggatgatcgtaggaaaaaacgaaaggggcaaaagcttgctgtttaaaactgcctctgggatcaacatgtgtaccctcattgccatggacctgggcgaaatgtgcgacgacaccgtaacctacaaatgtccacacattacggaagtggagccggaagacatcgattgctggtgcaatttaaccagcacttgggtgacatatgggacatgcaaccaggcaggcgagcatcggcgcgataagcggagcgtcgcccttgcgccacacgtgggcatggggctcgatacccgcacccagacctggatgtcggccgagggcgcctggcgccaggtggagaaggtcgagacgtgggcactgcgacacccggggttcaccatcctcgcactgtttctggcccattacataggcacttctttgacgcagaaggtggtcattttcacgctgctgatgcttgtcaccccctccatgaccatgcggtgtgtcggggtcggtaaccgcgacttcgtggagggtctttccggggccacttgggtggacgtagtcctggagcacggcgggtgcgtgacgacgatggctaaaaacaagcccaccctcgacatcgaactgcaaaaaaccgaggcgacgcagctggcgaccctccgaaagctttgcatcgaagggaagatcaccaacataacaacggacagccgctgccccacccagggagaggccgtgctgcctgaggagcaagatcagaattacgtctgcaagcatacctacgtggaccgggggtggggcaatggctgcggcctcttcgggaagggctccctggtgacctgcgctaagttccagtgtttagagcccatcgagggcaaggtcgtacaatacgagaacctcaagtacacggtcatcatcaccgtccacaccggggaccagcaccaggtaggtaacgagactcaaggggtcaccgccgagataacgccccaagctagcacgaccgaagcgatcctgcctgagtacggcacactggggttggagtgcagcccgcggactggcctggactttaatgagatgatccttctcaccatgaagaacaaagcgtggatggtacatcggcagtggttcttcgacctgcccctgccatggacgagcggcgccaccaccgagacgcccacctggaatcgcaaagagctcctggtaacatttaaaaacgcccacgcgaaaaagcaggaggtcgtcgtgctgggttcgcaagagggcgcgatgcatacggcgcttaccggcgccaccgagatccagaacagcggtgggacctccatattcgccgggcacttgaagtgcaggctaaagatggacaagcttgaactgaagggcatgagctacgccatgtgcacgaacacattcgtcctgaaaaaagaagtaagcgagacccaacacggtaccatcctaatcaaagtggagtataagggcgaggatgtcccgtgtaagatacccttcagtacggaggacgggcaaggcaaggcccacaacggccgcctgatcacagccaaccccgtggtaaccaagaaggaagagcccgtcaacatcgaggccgagccgcccttcggggaatcgaacatcgtgatcggcatcggagacaacgcgctcaaaatcaattggtacaagaagggctcctcgatcgggaagatgtttgaagcgactgcccggggcgcccgcaggatggccatcctcggcgacacggcttgggacttcgggtccgtcggcggagtcttaaatagcttgggcaaaatggtgcaccaaatcttcgggtccgcgtacacggccctgtttagcggcgtctcctgggttatgaagatcggcatcggggtactgctgacgtggatcggtctgaacagcaagaacacctccatgtcattctcctgcatcgccatcggcataataacgctctacctcggcgccgttgtccaagccgacatgggatgcgtgatcaactggaaagggaaggagctgaagtgtggcagcgggatcttcgtgacaaacgaggtccacacctggaccgagcagtacaagtttcaggcggactcccccaaacgcctcgccacggcaatcgccggtgcctgggagaacggtgtctgcgggatccgcagtactactcggatggaaaacctgctgtggaagcagattgcgaatgagttgaattatattctgtgggagaacaacatcaagctgaccgtggtcgttggcgacatcattggcgtgctcgagcagggcaaacgcacgttgacgcctcagccaatggagctgaagtactcctggaagacgtgggggaaggccaagatcgtcactgcggagacgcaaaacagctcgttcatcattgacggtcctaacacccccgaatgcccctcggcgagcagggcatggaacgtgtgggaggtggaggactatggcttcggcgtcttcacaactaatatctggcttaagctgcgggaagtgtacacacagctttgcgaccacagactcatgagtgccgccgtgaaggacgagcgcgccgtccacgccgacatgggctattggattgaatcgcagaagaatgggtcctggaagctggagaaggcgtcactgattgaggtcaaaacgtgcacgtggccgaaatcgcacaccttgtggagcaacggggtgctggagtccgatatgatcataccaaagtccttagccggcccgatctcccagcataactaccgtccgggctaccatactcaaacggctgggccctggcacctcggcaagctggaactcgacttcaactattgtgagggcaccactgttgtgatcacagagaactgcgggacccgcggaccctccctccggacgaccacggtgtccggcaaattgatccacgaatggtgctgcagatcttgcacgttgcccccgttacggtacatgggcgaggacgggtgctggtatggaatggagatccgccccatcagcgagaaggaggaaaatatggtcaaaagccttgtatccgccggcagcggggaggtggacaactttacaatgggcgtactttgcctcgccatcctgttcgaggaagttatgcggggcaagttcgggaagaaacacatgatcgcaggggttttcttcaccttcgttctcctcctctcagggcagatcacctggagggacatggcccacactctgataatgatcggcagcaacgcctcggatcggatggggatgggtgtgacgtacctcgcgctcatcgccactttcaagatccagccattccttgcgttggggttcttcctcaggaaactgacctctagggaaaacctactactcggcgtaggcctcgccatggctaccaccctgcaactgcccgaggacatagagcagatggcgaacgggatagcgctcggcctgatggccttaaagctcatcacccaattcgagacataccagctgtggactgccctaatcagcctgacctgctctaacaccatcttcacgctgactgtagcctggcgaaccgcaacactgatcctcgcgggtgtgagccttctgcccgtctgccagtcctcatccatgcgaaaaaccgactggctccccatgacggtggccgctatgggcgtgccgcccctcccgctgtttatttttagcttgaaagacaccctgaagcgcaggtcctggcccttgaacgagggggtcatggcagtgggcttagtgtcgatattggcctcctccctcttacgtaacgacgtcccaatggcgggcccgctggtagccgggggactgctcatcgcgtgctacgtgatcacgggcacctccgccgacttaacggtcgagaaagccgctgacgtgacctgggaggaagaggcagagcagaccggagtgagccataacctgatgatcaccgtcgacgacgacgggacgatgcgcattaaagatgatgagacggagaacatcctcaccgtgctcttgaagaccgccctgcttatagtgtccgggatcttcccgtacagcatccccgccaccctgttagtatggcatacttggcagaagcagacccagcggtccggcgtgctttgggatgtgcccagcccacccgagacccagaaggccgagctggaggagggggtataccgcatcaagcaacagggaatctttgggaagactcaggtgggtgtgggggtccagaaggagggtgtgttccatacgatgtggcatgtgacccgaggcgccgtcttaacctacaacgggaaaaggctggagcccaactgggcctctgttaagaaagacttgatcagctacggcgggggctggcggctcagtgcccagtggcagaagggggaagaggtgcaggtcatcgcagtggaacccggcaagaatcccaaaaacttccagaccatgcccggcacgttccagaccaccaccggagagataggcgctatcgcgctggatttcaagcctgggacgagcggcagtcctatcatcaacagggagggtaaggtggtcggtctgtacggcaacggggtcgtgacgaagaacggcgggtacgtatccggcatcgcgcagaccaacgccgaaccggacggccccacccctgagttagaggaggagatgttcaaaaagcggaacctcacgatcatggaccttcatccaggatcgggcaagaccaggaagtacttaccggccatcgtgcgggaagcgataaaacgccgcctgcgcaccctgatcctggcgccgacccgggtagtcgccgccgaaatggaggaagccttgaaagggctccccatccgttaccagaccaccgcgacaaagtccgagcacacaggccgggagatcgtggacctgatgtgccacgccaccttcaccatgcgactcttgtctccagtgcgggtccctaactacaacctcatcatcatggacgaggcccacttcaccgaccccgcgtcaatcgccgcgcggggttacatcagcacccgggtgggcatgggcgaggccgcagctatcttcatgacggcgactccgcccgggacggccgacgccttcccgcagtccaacgcccccatccaggacgaggaaaaggatatccccgagcgaagctggaactccgggaacgagtggatcaccgatttcgcagggaaaacggtgtggtttgtcccatcgatcaaggcggggaacgacatcgccaactgcctccgcaaaaacgggaagaaggtgatccagctgtcccggaagacattcgacactgagtaccagaaaaccaagctgaatgactgggacttcgttgtgacgaccgacatcagcgagatgggagcaaacttcaaggcggaccgcgtgatcgacccgcggcgctgcctcaaacccgtgatcctgaccgatggccccgagcgggtcatactggccggccccatgccggtgaccgcggccagcgccgcccaacgtagaggtcgcgtagggagaaacccccaaaaggagaacgaccagtacatcttcaccggccagcccctcaacaacgatgaggaccacgcgcactggacggaggcgaagatgctcctggacaacattaacacccctgaggggattatccccgcactcttcgagcccgagagggagaagtccgccgcgatagacggcgaataccggcttaagggagagtccagaaagaccttcgttgaactaatgagacgcggggacttacccgtgtggctcgcgcacaaggtcgccagcgagggcatcaagtataccgacagaaagtggtgtttcgacggacagcgaaacaaccagatactcgaggagaacatggacgtggagatctggacgaaggagggcgagaagaagaagctccggccgcgctggctggacgcaaggacatactccgacccgctggcacttaaggagttcaaggacttcgcagcgggccgcaaaagcatcgccctggacctggttaccgagatcggccgcgtccctacccacctagcgcaccggacgcgcaatgcattagacaacctggtgatgctccacacgtccgagcatggcggtaaggcctaccggcacgctgtagaggagttgcccgagaccatggagaccctgctcctgctcggccttatgatcctgctgaccggtggggcaatgctgttcctgatctccgggaaggggatcggcaaaacttccatcgggctgatttgcgtcattgcgtccagcggcatgctatggatggcggagatcccgctgcaatggatcgcgtccgcgatcgtgctggagttttttatgatggtgcttctgatccccgagccagagaagcagcgcacgccacaggataaccagctggcctacgtcgtgatcgggatccttacgctcgccgccatcatagcggcgaacgagatgggcctcctcgaaacgaccaaacgggatctgggcatgtcgaaagaaccgggggtagtatcgccgactagctacctagacgtggacctgcacccagcttccgcctggaccctgtacgccgttgccaccaccgtcatcacccccatgctacgccacaccatcgagaactccaccgctaacgtttcgttggcagctatagccaaccaggcggtagtcctgatggggctggataaagggtggccaatctccaaaatggacctcggcgtgcccctgctggctctcggttgctattcccaggtaaaccccctgacattgaccgccgccgtcctcctgctgatcacgcactacgccatcatcggccccggcctgcaagcgaaggcaacgagagaggcccagaagcgcaccgctgctgggatcatgaagaacccgactgtggacggcataatgacaattgacttagaccccgtgatctacgactcgaagttcgagaagcagctagggcaggtcatgctcctggtgctgtgcgcggtgcaattgcttctgatgcggacgtcctgggccctctgtgaggccctcaccctggccaccggacccatcaccacgctgtgggagggctcccccgggaagttttggaacaccaccatcgcggtctccatggccaacatcttccggggtagttacctggcaggggccgggttggccttctccatcatgaagtccgtggggaccggcaagcggggcactgggtcccaaggagagacgctcggtgaaaaatggaagaagaagctgaatcagcttagccgcaaagagtttgacctctacaagaagtccgggatcaccgaagtggatcggaccgaggcgaaggaagggctgaagaggggggaaataacccaccacgccgtctcccggggaagcgccaagttgcagtggtttgtggagaggaacatggtaatccccgaggggcgggtcatcgaccttggctgcgggcgcggcgggtggtcctactactgtgccggcctgaagaaggtcacggaggtgagaggctacacaaagggcgggcccgggcacgaagagcccgtccccatgagcacttatggatggaatatcgtgaagctgatgtccgggaaggacgtattctacctcccgcccgagaagtgcgacaccctgctgtgcgacatcggcgagtcgagcccgagccccacggtagaggagtcacgaaccatccgggtgctgaaaatggtggagccgtggctcaagaacaatcagttttgtataaaggtcctgaacccctacatgcccaccgtgatcgagcacctggagcgcttacagagaaagcacggcgggatgctggtgcgtaacccccttagccgaaattccacgcatgagatgtactggatcagcaacggtaccgggaatatcgtggcctcagtaaacatggtcagccggctcctcttgaaccgcttcaccatgactcaccggcgcccgacgatagaaaaggatgttgacctcggcgcaggcacacgtcacgtgaacgccgagcccgaaacccctaacatggacgtgataggggaacgcattaagcgtatcaaggaggagcacaactcaacctggcactatgacgatgagaacccatataagacctgggcctaccatggtagctacgaggtcaaggctacggggtccgccagctccatgatcaacggcgtggtcaagctgctgaccaagccctgggacgtggtgcccatggtcacccagatggccatgaccgacacgactcccttcgggcagcagcgcgtgttcaaggagaaagtggatacacgcaccccgcgcagcatgcccggcacccgccgggtcatgggcatcaccgcggagtggctctggcggacactcgggcgcaacaagaagccccggttgtgcacccgcgaggagttcaccaagaaggtgagaaccaatgccgccatgggcgctgtgttcacggaggagaaccagtgggatagcgcgaaggcggccgttgaggatgaagatttttggaagctcgtagaccgcgagcgggagttacacaagctgggtaaatgcggttcctgcgtgtacaacatgatgggaaagcgggagaagaagctcggcgagttcggtaaggccaagggaagcagggcgatctggtatatgtggctgggcgcccggtatctggagttcgaagccctgggcttcctgaacgaggaccactggttctcccgggaaaatagctactccggagtcgaaggagagggcctgcataagctcggctacattcttagggacattagcaagatacccggaggcgccatgtatgccgatgacaccgcggggtgggacacgcggatcaccgaggatgacctgcacaacgaggagaagatcacccaacagatggatccggagcaccggcagctagccaacgccatctttaagctgacctaccagaacaaggtggtaaaggtccagcgccccactcccactggcaccgtgatggacattatctcccgtaaggaccagcgcggctcgggacaggtgggcacctacgggctcaacacctttactaacatggaggcccagctgatccggcagatggagggcgagggggtcttatctaaggcggacttagagaacccccatctcccggagaagaaaatcacacagtggttagagacgaaaggcgtggagcgcttaaagcggatggcgatcagcggcgacgattgcgtggtgaagcccatcgatgaccgctttgccaacgccctcctggccctgaacgacatgggtaaggtgcggaaggacatcccccagtggcagccctcaaagggctggcacgactggcagcaggtccccttctgcagccaccacttccacgagctcatcatgaaggacgggcgcaaactggtcgtgccctgtcggccccaagacgaactgataggtcgcgctcgaatatcccagggagcggggtggtcgctacgcgagaccgcttgcctgggcaaggcctatgcccagatgtggagtctgatgtacttccacagacgcgacctacgcctggcgtcaaacgccatctgttccgccgtgccggtccactgggtcccgacaagccggaccacgtggtccatccacgcccatcatcaatggatgacaacggaggacatgttgaccgtatggaaccgcgtctggatcgaggacaacccctggatggaggacaaaaccccggttaccacgtgggaaaacgtgccgtacctcgggaagcgggaggaccaatggtgcggcagcctgataggcctgacctcccgcgccacatgggcgcaaaacatcccgacggccatccagcaggtacggtctttgatcgggaacgaggaattcctggactacatgccaagcatgaagcgcttccgtaaggaggaggaatccgagggtgccatttggtag

SEQ ID NO: 26083 - RNA, 9873 nt, synthetic construct
  misc_feature 1..9873: note = derived and/or modified CDS sequence (opt11) from DENV-3__FJ898468__SS-prME
  source 1..9873: mol_type = other RNA
accagcttgtgcctcatgatgatcctgccagccgccctagcattccacttgacttcccgggacggggaaccccgaatgatcgtggggaagaacgagcgcggcaagtctctgctgtttaaaacggcctccgggatcaacatgtgcaccctcatcgccatggatttgggagagatgtgtgacgacactgtgacctacaagtgcccccacatcacggaagtggaacccgaagatatcgactgttggtgcaatctgaccagcacctgggtgacatacggaacgtgcaatcaggccggcgagcatcggagggacaagcgttccgtggccttagcgccccacgtgggcatggggttggacacacgcacccagacctggatgagcgccgagggcgcctggcgccaagtagagaaggtggagacatgggccctgcgccatccgggcttcaccatcctcgcactgttcctggcccactacataggcacatccctcacccagaaggttgtgatcttcatcctcctgatgctcgtcaccccctcaatgaccatgcggtgcgtaggggtgggcaaccgcgacttcgtagagggcttgtccggggccacctgggtggacgtggtcctggagcacggcgggtgtgtgacgacgatggccaagaataagccaaccctcgacatcgagctgcagaagaccgaggccacccagctggctaccctgcgcaagctgtgcatcgagggcaagataacaaatattaccaccgacagccgctgccccacacaaggtgaggccgtcctgccggaggaacaagaccagaactacgtctgcaagcacacatacgtggaccgggggtggggaaacgggtgcggtctatttgggaaaggctcactggtgacctgcgctaagttccaatgcctagagcccatagagggcaaggtagtgcaatatgagaacctcaaatacaccgtcatcatcacggtgcacaccggggaccagcaccaggtgggcaacgagacgcaaggtgttaccgccgagatcacgccacaggcctcaacaaccgaagccatcctgcccgaatacggcaccctggggctcgagtgttccccgcgtaccggcctggatttcaacgaaatgatcctgttgacgatgaagaacaaggcctggatggtgcaccgacagtggttcttcgacctgccactgccctggaccagcggcgcaaccaccgagacccccacttggaaccgcaaggaattgctggtgacctttaagaacgcccacgccaagaagcaggaggtcgttgtgctggggtcccaggagggcgcgatgcacaccgcgctcacgggggccaccgagatccaaaattcaggggggaccagtatctttgccggccacctgaagtgccgacttaagatggacaaactcgaactgaagggcatgagctacgccatgtgtaccaacacgttcgtcctgaagaaggaggtgtccgagacccagcacgggaccatactcatcaaggtggaatacaagggcgaggacgtcccgtgcaagatccccttctcgaccgaggatgggcaaggcaaggcgcacaacggccgcttaattacggcaaatcccgtcgttaccaagaaagaggaacccgtcaacatcgaggccgagccgccattcggtgaatcgaacatcgtgatcggcattggagataacgccctaaagattaactggtataagaaaggctccagcatcgggaaaatgttcgaagcgaccgcccggggagcccgccgaatggccatcctgggcgacaccgcctgggacttcggatccgtgggcggggtcttaaattcactgggaaagatggtgcaccagatctttgggtccgcgtacacggccctgttctccggcgtcagttgggtcatgaagatcggcataggggtattactgacgtggatcggcctgaacagcaagaacacatcaatgtcattctcctgtatcgcaatcgggatcataaccttatacctgggggcggtggtccaggccgatatggggtgcgttattaattggaagggcaaggagcttaagtgtgggagcgggatcttcgtcacgaacgaggtccacacgtggaccgagcagtacaaattccaagcagactcccccaaacgtctcgccaccgccatcgccggcgcctgggaaaacggggtgtgcggaatccgcagcacgacccggatggaaaacttgctgtggaagcagatcgcgaacgagttaaactacatcctgtgggaaaacaacatcaagctgaccgtagtcgttggggacgtaatcggcgtcttagagcaaggcaagcgcaccctgacgccccagccgatggagttgaagtactcctggaagacatggggaaaggccaagatcgtcaccgcggagacccagaacagctcgttcatcatagacgggcccaacacgcccgagtgccccagcgcctcacgagcctggaacgtttgggaggtcgaggactatgggtttggagtcttcactaccaacatatggcttaaattacgcgaggtgtacacccagctttgcgatcacaggctcatgagcgctgcagtcaaggacgagcgcgccgtgcatgccgatatgggctattggattgagagccagaagaatgggtcttggaaactggaaaaggcgagcctgatcgaggtgaagacctgcacttggccgaagtcccacacgctctggtcaaatggcgtgctggaatccgacatgatcatacccaagagcttagccggacccatttcacaacacaattaccggcccggctaccacactcagacggccgggccctggcacttgggcaagttggaattggacttcaactactgtgaaggaacgaccgtggtaatcaccgagaattgcggtacgcgcggccccagcttgcggacaacaaccgtctccgggaagttgatccacgagtggtgttgccgcagctgcaccttaccaccgctacggtacatgggcgaggatgggtgctggtacggcatggagatccgccctatctccgagaaggaagagaacatggtcaagagccttgtgtccgccggctctggcgaggtcgacaacttcacgatgggcgtgctgtgcctagctatcctgttcgaggaggtgatgcgggggaagttcggcaagaagcacatgatcgcgggcgtattcttcaccttcgtactgctcctgtccggccagatcacctggcgcgacatggcccacacactcatcatgatcggaagcaacgcctccgaccgaatggggatgggcgtgacgtaccttgccctgatcgccaccttcaagatccagcccttccttgcgctcgggttctttctacgcaagctgaccagtcgggaaaacctcctgctgggcgtcggtctcgccatggcgaccactctgcagctgcccgaagacatcgagcagatggccaacggcatcgcgttaggcttaatggctctgaagctcatcacccagttcgaaacctaccagctgtggaccgccctgatcagcctgacctgctccaacaccatcttcaccctgactgtcgcctggcgcacggccaccctgatcctcgctggggtaagtctgctgccggtgtgtcagtccagctcaatgcgaaaaaccgactggctccccatgaccgttgccgccatgggcgtgccgcccttgccgctgttcatctttagcctcaaggacacgctaaagcggcgttcttggccactgaacgagggtgttatggccgtaggcctcgtgagcatccttgcctcctccctgctccggaacgacgtgcctatggcgggccccctggtggccgggggcctgctcatcgcctgctacgtcataaccggaacaagtgccgatttgaccgtggagaaagccgcggacgtgacatgggaggaggaggccgagcagaccggcgtcagccacaacctgatgatcaccgtggacgacgacgggaccatgagaatcaaggacgatgagaccgaaaacattctcaccgttcttttaaagaccgccctcctgatagtatccgggatcttcccgtatagcatcccagccactctgctcgtttggcacacctggcagaagcagacgcagcggtccggggtactgtgggacgtccccagcccgcccgagacccagaaggccgagctggaagaaggggtgtaccgtatcaaacagcaggggatcttcggtaagacacaggttggagtcggggtccagaaagagggcgtattccacaccatgtggcacgtaacgcggggcgcggtgctcacctacaatggaaagcgcctcgagcctaactgggcctctgtgaagaaggacctgatctcatacggtgggggctggcggctctccgctcagtggcagaaaggggaggaagtccaggtgatcgcggtggaacccggcaagaacccgaagaacttccagaccatgcccgggaccttccagaccaccaccggggagatcggcgcgatagccctggacttcaagcccgggactagcggcagccccatcatcaaccgcgagggcaaggtcgttgggctgtacggaaacggggtggtcacgaagaacggcgggtacgtgtccgggatcgcccagactaatgccgagccagatggccccacccccgaactggaggaggagatgttcaagaagcgtaacctcaccattatggacctgcaccccgggtcaggcaagacgaggaagtacctgcccgctatcgttcgcgaggcgatcaaacgccgcctccgcaccctgatcctggcccccacgcgggtagtcgctgctgagatggaagaggccctcaagggcctgccgatcaggtaccaaactacggcgaccaagtccgagcacaccggccgggagatagtggacctaatgtgccacgccacgttcacgatgcggctcctgagcccagtccgggtgccgaactacaacctgataattatggacgaggcccactttaccgaccccgcctccatcgccgcgcgcgggtatatcagcacccgggtgggcatgggcgaggccgctgccatttttatgaccgcgaccccgcccgggaccgctgacgcctttccgcagtccaacgcccccatccaggacgaggagcgagacattcccgaacgcagctggaactccggcaacgagtggataaccgatttcgccggaaagacagtctggttcgtgcccagcatcaaggcgggcaacgacatcgccaactgcctccggaagaacgggaagaaggtgatacagctgtcccgcaagacgttcgacaccgagtatcagaagactaagctgaacgactgggacttcgtcgtaacaacggacatcagcgaaatgggggccaactttaaggcagaccgtgtgatcgacccgcgccgctgcctcaagccagtcatactgactgacggccccgagcgggtgatcctggcaggaccaatgccggtgaccgcggccagtgccgcccagaggaggggccgggtggggcgcaacccgcagaaggaaaacgaccagtacatcttcactggccagccactaaacaacgacgaggaccacgcccactggacggaggcgaagatgctgcttgacaacattaacacccctgaagggataattccggctctcttcgagcccgaacgggagaaaagcgccgctatcgacggcgagtaccgcctgaaaggcgaaagtcggaagacattcgtggagttgatgcggcgcggggacctccccgtctggctggcgcacaaagtggcctccgagggtataaaatacacagaccgcaagtggtgtttcgatggacagcggaacaaccagatcctggaagaaaacatggatgttgaaatctggaccaaggagggcgagaagaaaaaactccgcccccgctggctggacgcccgaacgtattccgacccgttagccttaaaggagtttaaggacttcgccgcgggccgcaagagcatcgctctggacctggtcaccgagatcggcagagttccctcccacctcgcgcaccgcacccgcaacgccctagataacctggtaatgctccacacaagcgagcacggcgggaaggcctaccgccacgcggtcgaagaacttcccgagacgatggaaaccctgctcctgctgggactcatgatcttgctgaccggtggcgccatgctgttcctgattagcggcaaaggtatcggcaaaacttccataggcctcatctgcgtgatcgccagttccggcatgctatggatggccgagatcccgctacagtggatcgccagcgcgatagtgctggagttcttcatgatggtcctcctgatccccgagccagaaaagcagcggacgccccaggacaaccaactggcctatgtggtgatcgggatcctcactctggcggccatcatcgccgcgaatgagatgggtctactggagaccacgaagagggatctcggcatgtccaaggagccgggagtcgtgagccccacatcctacctggacgtggacctccaccccgccagcgcctggaccctgtacgccgtcgccaccacagtgatcacgcccatgctgcggcacactatcgagaactccaccgcgaacgtgtccttagccgcgatcgccaaccaggctgtagtgctgatgggcttggacaagggatggccgatctccaagatggacctcggcgtgcccttgctggccctcgggtgctactcccaggtcaatccactgaccctgacggctgccgtacttttgttgataacccactacgccatcatcggcccggggttgcaggcaaaggccaccagagaggcccaaaaacgaacggctgcggggatcatgaaaaatccgacggtggacggcatcatgaccatcgacctggaccccgtcatctacgactccaagttcgagaaacagttaggccaggtaatgcttctggtgctgtgcgcggtccagctcctgctgatgagaactagctgggccctatgcgaggcccttaccctggccacgggtcccatcactactttatgggagggatccccagggaagttctggaacactacgatagcggtgtcgatggccaacattttccgggggtcctacctggctggggccgggctggcctttagtatcatgaagagcgtggggaccggaaagagagggactgggagccagggcgagacactaggggagaagtggaagaagaagcttaatcagttaagccggaaggagttcgacctttacaagaagtccggcatcacagaggtggacagaacggaggcgaaggaggggctgaagcggggtgagataacccaccacgccgtgagccggggcagtgctaagctgcaatggtttgtggagagaaacatggtcatcccggaagggcgcgtgatcgacttgggatgcgggcggggtgggtggagctattactgcgcgggcctgaagaaggtgacggaagtccgcggctataccaagggcggccccgggcacgaggagcccgtgcccatgtccacgtacggctggaacatagtgaagctcatgagcgggaaggacgtgttctacctcccacccgaaaagtgcgataccctgctgtgcgacataggggagagttccccctcaccgaccgtggaggagtcgcggacaatccgcgttctgaagatggtcgaaccctggctaaagaacaaccagttctgcatcaaagtgctgaacccgtacatgcctacggtcgtcgagcatctcgagagactccagcggaagcacggcggaatgctggtgagaaaccctctgtcccggaacagcacccacgaaatgtactggatatcaaatggcaccgggaatatagtagccagcgtcaacatggtgtcccgcctgttgctaaaccggttcaccatgacccaccgccggccgactatagagaaggacgtggacctcggcgccggcacccgccacgtaaacgcagagccagagaccccaaacatggacgtgatcggtgagcggatcaagagaatcaaggaagagcataattcaacgtggcattacgacgacgagaacccatacaagacctgggcctaccacggctcctacgaggttaaggccaccgggtcagcttcctcaatgatcaatggcgtggtgaagctgctgaccaaaccgtgggatgtggtccccatggtgacccagatggcgatgaccgacaccacccccttcggtcagcagcgggttttcaaggagaaggtggatactcgcaccccccgtagcatgcccggcacccgccgggtgatgggcataaccgccgagtggctctggcgcacgctcgggcggaacaagaagccccgcttgtgcacccgggaagagttcaccaagaaagtccgcacgaacgccgcaatgggagcggtgttcacggaggaaaaccaatgggactccgctaaagccgcggtggaggacgaggacttctggaagctcgtcgaccgcgaacgggagctgcataagctgggaaaatgcggcagctgcgtgtacaatatgatggggaagcgcgagaagaagctgggcgagttcggcaaagccaaggggtcccgggcgatatggtatatgtggctgggtgcccgctacttagaattcgaggccctcgggttcttgaacgaggaccactggttcagccgggagaactcctacagtggcgtggagggggagggcctgcacaagctcggttacatcctgcgtgacatctctaagatcccgggtggcgccatgtacgctgacgataccgcggggtgggacacgcggatcaccgaggacgatttacataacgaggagaagatcacgcagcagatggacccggagcaccgccagctcgctaacgccatcttcaagctgacctatcagaacaaggtggtgaaagttcagcggcccacccccacaggcaccgtcatggacatcatcagccgcaaagaccagcggggctccggccaagtggggacgtacgggctgaacacctttaccaatatggaggcacagctcatccgacagatggagggcgaaggcgtattatcaaaggccgacctggagaacccccgcctcccggagaagaagataacccagtggctggagacgaagggcgtcgaacgcctgaagcggatggccatctccggcgacgattgcgtggtaaagccaatcgacgaccgcttcgccaatgccctcctggccctgaacgatatgggaaaggtccggaaggacataccacaatggcagcccagcaagggctggcatgattggcagcaagtcccgttttgctcccatcatttccacgagctcatcatgaaggacgggcgcaagctggtggtcccctgccggccccaggacgaactgatcggcagagcccgaatcagccagggagctggctggtccctccgggagaccgcctgcctggggaaggcctacgcccagatgtggagtttgatgtacttccaccgccgcgacctccgcctggcatctaacgcgatctgcagcgctgtgcccgtccactgggtcccgacatcccggacgacgtggagcatccatgcccaccatcagtggatgaccacggaggacatgctgaccgtgtggaatcgcgtgtggatcgaggacaacccatggatggaggacaagacgcccgtgaccacctgggagaacgtgccctacctcggcaagcgcgaggaccagtggtgcggcagcttgatcgggctgacctcacgcgcgacgtgggcccaaaacatcccgactgcaatccagcaagtccggtcactcataggcaacgaggagttcctggactacatgccctctatgaagagattccggaaggaagaagaaagcgagggggccatctggtag

SEQ ID NO: 26084 - RNA, 9873 nt, synthetic construct
  misc_feature 1..9873: note = derived and/or modified CDS sequence (opt11) from DENV-3__FJ898469__SS-prME
  source 1..9873: mol_type = other RNA
accagtctgtgcctcatgatgatcctgcccgccgccctagcattccacctcacgtctcgggatggggagccacgtatgatcgtggggaagaacgagcggggcaaaagcctgttattcaagaccgccagcgggatcaacatgtgcaccctcatagcgatggatttgggcgagatgtgcgacgacaccgtcacctacaagtgcccccacatcacggaggtggagccagaggacatcgactgctggtgcaacttgaccagcacttgggtgacgtacggtacgtgcaatcaagccggcgagcaccggcgtgacaagcggagcgtcgccctcgcaccccacgtgggcatggggttggatacccgcacccagacctggatgagcgccgagggcgcctggcgccaggtcgagaaggtcgagacgtgggctttacgccacccggggttcaccatcctcgctctgttcctggcgcactacataggcaccagtctaacccagaaagtggtaatctttatcctgctgatgttagtgacgcccagcatgaccatgcggtgcgtgggtgtaggcaacagggacttcgtcgagggcctgagtggtgccacctgggtggacgtggtcctggaacacggcgggtgcgtcaccacgatggccaaaaacaagcccaccctcgacatcgagctgcaaaagacagaggccacacagctcgcaacgctcaggaagctgtgcatcgaggggaagattaccaacattaccaccgatagccggtgtcccacgcagggggaggccgtgctgccggaggagcaggaccagaactacgtctgtaagcacacatacgtggaccgggggtggggcaatgggtgcggcctgttcgggaagggctccctggtcacctgtgccaaatttcagtgcctggagcccatagagggcaaggtcgtgcagtacgagaacctcaagtataccgtaatcatcacggtgcacaccggagaccagcaccaggtgggcaacgagactcaaggggtcacggccgagatcactccacaggccagtaccaccgaggcgatcctccccgaatacggtacactagggctcgagtgttccccgcgcaccggcctggactttaatgagatgatcctgctcaccatgaagaataaggcttggatggtgcaccggcagtggtttttcgacttgcctctgccctggacaagcggcgccaccactgagacgcccacctggaaccgcaaggaactactggttacttttaagaacgcccacgccaagaaacaggaggtcgtcgtgctcgggagtcaagagggtgccatgcacaccgccctcacgggggccaccgagatacagaatagcggcggaacttccatctttgccggccacctgaagtgccggctgaagatggataagctcgagctgaagggcatgtcctacgccatgtgcacgaacacgttcgtcctgaaaaaggaggtatccgagacccagcatgggacaatcctcatcaaagtcgagtacaagggggaggacgtaccttgcaagatcccgtttagcacggaagacgggcagggcaaggcgcacaatggccgcctgatcaccgccaatcccgtggtgacaaagaaagaagaacccgtcaacatcgaagcagagccgcccttcggggaaagcaacatcgtgatcggaatcggtgacaacgccttgaagatcaactggtacaagaaaggctccagcatagggaagatgttcgaagcgacggcccggggcgcccgccggatggcaattctgggcgacaccgcatgggactttgggtccgtaggaggggtccttaactccctgggcaagatggtgcaccagatcttcgggtccgcgtacacggccctgtttagcggcgtttcgtgggtcatgaagatcggcattggcgtgctcttgacctggattggactgaacagcaagaacacctccatgagcttctcctgcattgccatcgggattatcacgctctacctgggggccgtggtccaagccgacatggggtgcgtgataaactggaagggcaaggagttaaagtgcggttccgggatttttgttacgaacgaagtccacacctggaccgagcagtacaaattccaggcggattcccccaagcgcctcgccaccgccatcgccggcgcctgggagaacggggtgtgcggtatccggagcacgacccggatggagaatcttctttggaagcaaatcgcgaacgagctaaattacatcctatgggagaacaacattaaactgaccgttgtcgtgggggacatcattggcgtgctcgagcagggcaagcgcaccctgactccccagcccatggagctgaagtactcctggaagacctgggggaaggcgaagatcgtcaccgccgagacccagaatagctctttcatcatcgatggccccaacactcctgagtgccccagcgcctcccgcgcgtggaacgtgtgggaggtggaagactacggtttcggcgtctttaccaccaatatctggctaaagctgcgcgaggtatacacccaactgtgcgaccatcgtctcatgtccgcggccgtgaaggacgagcgcgccgtccacgccgatatgggatactggatcgagagccagaagaacgggtcctggaagctggagaaggccagcctgatcgaggtcaaaacctgtacgtggcctaagtcccacaccctctggagcaacggagtcctggagtcggacatgatcataccgaaaagcctggccgggccaatcagtcagcacaactaccggccgggttatcatacgcaaaccgccgggccctggcacctcggcaaactggagttggacttcaactactgcgaaggcacgaccgtagttatcaccgagaattgtgggacgagagggccttccctccgaacgacgactgtttcagggaaattgatccatgagtggtgttgtcgaagctgcaccctgccgccgctccggtacatgggcgaggacgggtgctggtacggcatggagatccgccccatctcagagaaggaagaaaacatggtcaagtcactggtgtccgcaggaagcggtgaggtcgacaacttcactatgggcgtcctgtgtctcgccatcctgttcgaggaagttatgcggggcaagttcggcaagaagcacatgattgcgggagtgtttttcaccttcgtcctgttattgtctggccagatcacatggcgcgacatggcccacaccctcatcatgatcggcagtaacgccagcgaccgcatgggtatgggcgtgacgtacctcgccctgatcgccaccttcaaaatccagccctttttggcgctcgggttctttctgcgtaagctgaccagccgggagaacctcctgctgggggtagggctcgccatggcaaccacgctgcagttgcccgaagacatcgagcagatggctaatgggatcgcgctcggcctgatggctctgaagctgatcactcaattcgagacctaccagctgtggaccgccttaatctctctcacatgctccaacaccatattcaccctgacggtggcctggcgcacggcaaccctgatcctagcgggggtgagtctcctgcccgtctgccagtcaagctccatgcggaagaccgactggctccccatgaccgtggccgccatgggcgtgccgcccctcccgttattcatcttcagcctcaaagacactttgaagcgccggtcatggcccctgaacgagggagtcatggccgtcggcctagtgagcatcctggcctcctccctgcttaggaatgacgttcccatggcgggccccctggtggccggagggctcctgatcgcatgctatgttatcacagggacctccgcagacctgaccgtcgagaaagccgcggacgtgacctgggaggaggaagccgaacagactggcgtgagccacaatctgatgatcaccgtcgacgacgacgggacgatgcgcatcaaggatgacgagacagagaacatcctcacggtgctgctgaaaacggcgctcttaatcgtgtccggcatcttcccgtacagcatccctgccaccctgctcgtctggcacacctggcaaaaacagacgcagcggtccggcgtgctgtgggacgtccccagcccgcccgagacccaaaaggccgagctggaggagggggtctaccgaatcaagcagcagggaatattcgggaagacccaggtgggcgtgggggtccagaaggagggtgtgtttcacaccatgtggcacgtaacgcggggcgcggtcctcacctataacgggaagcgcctagagcctaactgggcgtccgtgaagaaggacctgatctcctacggcgggggatggcggctcagtgcgcagtggcaaaagggtgaggaagtgcaggtcatcgccgtggagcctggcaagaatcccaaaaacttccagaccatgccgggcacctttcagacaacgactggcgagatcggcgcaatagccctggactttaagcccgggacctcgggcagccccatcatcaaccgcgagggcaaagtggtaggactatacggtaatggggttgtgacaaagaatggcggttacgtctccggcatcgcccagaccaatgccgaaccggacggccccacccccgagctggaagaggaaatgttcaagaagagaaacttaacgataatggacctccaccccgggagtggcaagacaagaaagtacttaccggccatcgtgcgggaggcaattaagcgcagattacgcaccctaatccttgcccccacccgggtggtagcagccgaaatggaggaagccctaaaggggttgcccattcgctatcagaccaccgcgacaaagtccgaacacaccggccgcgagatcgtggacctgatgtgtcacgcgacattcacgatgcgcctcttgtcacccgtgagggtaccgaactacaacctgatcattatggacgaggcccacttcaccgaccccgcctccatcgccgctcgcgggtacattagcacccgggtgggcatgggcgaggccgccgccatcttcatgaccgcgacgccgccagggacggccgacgccttcccgcagtccaacgctcctatccaagatgaagaacgcgacatccctgagcgcagctggaactccggcaacgagtggatcaccgacttcgcaggaaagaccgtgtggtttgtccccagcatcaaggctgggaacgatattgcgaactgtctccgtaagaacgggaaaaaggtgatccaactttcccggaaaacattcgacaccgagtaccagaagaccaagctgaacgactgggacttcgtcgtcactacggacatcagcgagatgggcgccaacttcaaagccgaccgggttatcgacccgcgccggtgtcttaagcccgtgattctgactgacggccccgagcgcgtcatcctggccgggcccatgcccgtgaccgcggcctcagccgctcagcggcgcggccgtgtgggacgcaacccacagaaagaaaacgaccaatatattttcactggccaacccctcaacaatgacgaggaccacgcccactggacagaggcgaaaatgctgctggacaatatcaacacaccagaggggattatcccggccctcttcgagccagagcgggagaagtccgccgccatcgacggcgagtatcgcctgaagggcgagtcccggaagactttcgtggagctaatgcgacgcggcgacctacccgtgtggctggcgcataaggtggccagtgagggaatcaagtatactgatcgcaagtggtgcttcgacgggcagcggaacaaccagattctggaggagaacatggacgtggagatctggaccaaagagggcgagaagaagaagctccgcccccggtggctggacgcccgcacgtactccgatccgttagccctcaaggagttcaaagacttcgccgcgggccgcaagagcatcgcactggacctggtgaccgagattgggcgggtccccacacatctcgcccatcgcacccggaacgccctggacaaccttgtgatgctccatacgtccgagcacggcgggaaggcctaccgccacgctgtggaggagctgcccgagaccatggagacgctgctcctgttaggcctcatgatactgctgacagggggcgccatgctgttcctgatcagcggcaaggggattggaaagacgtccatcggtttgatatgcgttatagcctcctcaggcatgctgtggatggccgagatccccttgcagtggatcgcttccgcgatcgtactggagttcttcatgatggtgctcctgatccccgagcccgaaaaacagcgtacgccccaggataatcagctggcctatgtcgtgatcgggatcctcaccctagccgccataatcgccgccaacgagatgggtctgctcgagaccactaagagagacctcgggatgtctaaggagccgggggtagtctccccaacaagctacctggacgttgacctccaccccgcatccgcctggaccctctacgccgtagcgactactgtcatcacccccatgctgagacataccatcgagaacagcaccgccaatgtgtcccttgccgctatcgcaaaccaagcggttgtcctaatgggcctggacaaagggtggccgatcagcaagatggacctcggggtgcccctgctggccctggggtgctactcccaggtgaatcccctgacgctgaccgccgccgtcctcctgctgatcacccattacgccatcatcggacccggactccaagctaaagcgacccgcgaggcacagaagcggacagccgccgggatcatgaagaaccccaccgtagacggcatcatgaccatcgacctggaccccgtgatctacgacagcaagttcgagaagcagctggggcaggtcatgctccttgttctgtgcgcggtgcagctcttgctgatgcgcacctcctgggccctgtgcgaggccctgacactggctaccggccccatcaccacgctctgggagggatcccccgggaagttctggaacacgaccatcgcagtctccatggccaacatctttcggggaagctacctagccggcgcgggtctggccttctccatcatgaagtccgtcggaaccgggaagcgaggcactgggcttcagggcgagaccctgggcgaaaagtggaaaaagaagctgaatcagctcagtcgcaaggagttcgacctatacaagaaatccggcatcacggaggtggacagaaccgaggcaaaggaggggttgaagcggggcgaaatcacgcatcacgctgtcagccggggctccgccaagctccagtggttcgtggagcggaacatggtgatcccggaaggacgcgtcatcgatctgggctgcgggcggggcggctggagctactactgtgccggactgaagaaggtgactgaggtgcgcggctacaccaaaggcgggcctgggcacgaggagcccgttccaatgtccacctatggctggaacattgtcaagctcatgagcgggaaagacgtgttctacctgccgcccgagaagtgtgataccctactgtgcgacatcggcgagtccagcccctcccccaccgttgaggagagccggacgatcagggtgctcaagatggtggaaccgtggctgaagaacaatcagttctgcatcaaggtcctgaatccatacatgcccaccgtgatcgagcaccttgagaggctgcagaggaagcacggagggatgctggtgcgcaacccgctctcccggaatagcacccacgagatgtactggatctccaacggcactgggaacatcgtagccagtgtaaacatggtttcccgcctgctgctcaaccgtttcacgatgactcaccgccggcctaccatcgagaaggacgtcgacttaggcgcgggcacccgccatgtgaacgccgagcccgaaactcccaacatggacgtgatcggggagcggataaaacgcatcaaggaagaacataacagcacctggcactacgacgacgagaacccctacaagacgtgggcgtaccacggatcctacgaggtaaaggctaccgggagcgcatccagcatgatcaacggcgttgtcaaacttttaacgaagccctgggacgtggtgcccatggtcacccagatggccatgaccgacacgacgcccttcgggcagcagcgggtgttcaaggagaaggtcgacacccgcaccccgcggagcatgccgggcacgcgcagggtcatgggcatcaccgccgagtggctctggcggaccctggggcggaacaagaagcctcgcttatgcacccgggaggagttcactaagaaagtgaggacgaacgccgcaatgggcgcggtgttcaccgaggagaaccagtgggacagcgccaaggccgccgtcgaagacgaagacttttggaagctagtggatcgcgaacgtgagctgcataagctcgggaagtgcgggagctgtgtgtataacatgatggggaagcgggagaagaaactgggcgagttcggaaaggccaaggggtcccgggcgatctggtacatgtggctgggcgcccgctacctcgagttcgaggccctggggttcttgaacgaggaccactggttctcccgggaaaactcctacagcggcgtcgaaggtgagggcctccacaagctgggctacatcctgcgagacatctctaagatccccgggggcgcaatgtacgcagacgacaccgcggggtgggacaccaggatcacggaggacgacctacacaacgaggagaaaatcacccagcaaatggacccggagcaccgacaactggctaacgccatcttcaaacttacctatcagaacaaggtggttaaggttcagcggcccacccccacgggcacggtaatggacattattagccgtaaggaccagcggggctcgggccaggtgggcacctatgggctcaacaccttcaccaatatggaagcccaactgatccgccagatggagggggaaggggtactgtcaaaggccgacctcgagaatccccacctcccggagaagaagattacgcagtggctggagaccaagggtgtggagcggctgaagcgaatggcgatctcgggcgacgactgcgtcgttaagcccatcgacgatcggttcgctaacgccctgctggccctcaacgatatggggaaggtgcgcaaggacatcccccagtggcagccgagcaagggctggcacgattggcaacaggttccgttctgttcccaccacttccatgagctgatcatgaaggatgggcggaagctcgttgtgccctgcaggccccaggacgagctaatcggccgggccaggataagccagggggcgggctggtccctgcgcgagaccgcctgtctgggcaaggcctacgcccagatgtggagccttatgtacttccaccgtcgcgatctaaggcttgcaagcaacgccatctgcagcgccgtgcccgtccactgggttcccacctccaggacgacctggagtattcacgcccaccatcagtggatgaccaccgaggatatgctcaccgtgtggaatcgggtctggatcgaggacaacccttggatggaggacaagacccccgttacaacctgggaaaatgtgccctacctggggaagagagaggaccagtggtgcggctccctgatcgggctcacgtccagggccacgtgggcgcagaacataccgaccgccatccaacaggtgcgcagcctgatcggcaacgaggaatttctggactatatgccctccatgaagcgattccgcaaggaggaggaaagcgagggggccatctggtaa

SEQ ID NO: 26085 - RNA, 9873 nt, synthetic construct
  misc_feature 1..9873: note = derived and/or modified CDS sequence (opt11) from DENV-3__FJ898470__SS-prME
  source 1..9873: mol_type = other RNA
acgtccctgtgcctgatgatgatactaccagcagcactcgcatttcacctaaccagccgcgacggggaaccacggatgattgtaggcaaaaacgaacgcggaaaatcccttctctttaaaaccgcttcaggcataaatatgtgcactctgatcgctatggaccttggcgaaatgtgcgacgacacggtcacttacaaatgcccacacatcacggaagtggaacccgaagacatagactgctggtgcaacctcaccagcacgtgggtaacatacggaacgtgcaaccaggcaggcgagcacagacgcgacaaacggtcggtagccctagcgccccacgtcggaatgggtctagacacacgcacgcaaacgtggatgtccgctgagggagcctggagacaagtcgagaaagtggagacctgggcactacgccaccctggctttaccatcctggcgctgttcctagcacactatatcggaacaagcctaacacagaaagtcgtcatatttattcttctaatgctcgtaacccccagcatgacgatgaggtgcgtgggagtcggaaaccgagactttgtcgaaggactctctggcgccacatgggtagacgttgtgctagaacatgggggctgcgtcacgacaatggccaaaaacaaaccaacactggacattgaacttcagaaaactgaggccacccaactcgcaacgttacgcaaactatgtatagaaggcaaaattacaaatataacgacagactcacgatgcccgacgcaaggagaggccgtactccctgaggagcaggatcagaactacgtatgtaaacatacatatgtagaccgaggatggggaaacgggtgcgggctgttcggtaaaggatcgctcgtaacatgcgctaaattccagtgcctggagcccatagaagggaaagtagtacaatacgagaatctcaaatacaccgtaataatcacagtacacacaggcgatcagcaccaagtaggaaacgaaacacaaggcgtcacggctgagataaccccacaagcgtcaaccaccgaggcaattctacccgaatacggaactctaggactagaatgcagcccacgcacaggtttagacttcaatgagatgatcttgttgactatgaaaaacaaagcgtggatggtccaccgccaatggtttttcgacctacccctcccctggacctccggggcaaccaccgagacccccacatggaaccggaaagagctcttggtgacgtttaaaaatgcacacgctaagaaacaagaggtagtagttctcggaagccaagaaggggccatgcatacggcgctcactggagctacagagatccagaactcaggaggcacatcaatatttgccggacacttaaaatgtcggctaaaaatggacaagttagagctgaaaggcatgtcatatgccatgtgtactaacactttcgttctcaagaaagaggtctcagagacacaacacggcacaatcctgatcaaggtggagtataagggggaagacgttccctgcaaaatcccgttctcgacagaggatggacaaggaaaagcacacaacgggcggctgatcacagcaaaccccgtggtaacgaagaaagaggagccagtgaacatagaagctgagccgcccttcggcgaaagcaacattgtgataggtatcggcgataacgcgttgaagataaactggtacaagaaagggtcatcgatagggaagatgttcgaggctaccgcaaggggagctcgtcgaatggcgattctaggcgatacagcctgggacttcggtagcgttggaggtgtcctaaacagtctgggtaagatggtccatcaaatattcggaagcgcttatacagccctattctccggagtgtcctgggtcatgaaaataggcataggagtactcctcacatggataggactcaattctaaaaacacaagcatgtcattcagctgcatcgccatcggaataataaccctctacctcggagccgtcgtacaggccgatatgggctgcgtaatcaactggaaaggcaaggaactcaaatgcggttcaggcatcttcgtaaccaacgaggtgcacacgtggaccgaacagtataaattccaagctgattcacccaagcgcctcgcaaccgccatcgccggtgcctgggaaaatggagtgtgcggcatccgatctaccactcggatggagaacctactttggaagcaaattgccaacgaattgaactacatcctatgggaaaacaacattaaacttaccgtggtagtcggtgatatcatcggcgtactcgagcaggggaaaaggaccctcacgccacagccaatggaactaaaatactcctggaaaacctggggcaaggccaaaatagtaacagcagaaactcaaaactcgtccttcataatagacggtccaaatacacctgaatgtccaagcgcctcccgagcgtggaacgtatgggaggtcgaagactacgggtttggagtatttactacgaacatatggttaaagctccgggaagtatacacacaactatgcgaccaccgcctaatgagtgcggcagtcaaagatgaaagagcagtacatgccgacatgggatactggatcgaatcccagaaaaacggaagctggaaattggaaaaagcctccctcatagaggtgaagacgtgcacctggccgaaaagtcacacgctatggtccaatggtgtactggaatcagacatgataatcccgaaaagcctggccggacccatctcgcagcacaactaccgaccggggtaccacactcaaacggccgggccatggcacctaggcaaactagagcttgactttaactactgtgaagggactacagtcgtcattacggaaaactgcggcacacgagggccgagcctcagaaccacaaccgtcagcggcaagctaatccatgaatggtgctgcagaagttgcacactaccaccactgcgctacatgggggaagatggatgctggtacggtatggagatcagaccaatcagcgaaaaagaagagaacatggtaaagagcctagtaagcgcgggctccggcgaagtcgataactttacaatgggcgtgctctgcctcgcgatattgttcgaggaggtaatgcgaggcaaattcggaaagaaacacatgattgcaggcgtattcttcacttttgttcttctcctctcaggtcagataacatggcgagacatggcccataccctaatcatgataggtagcaacgcaagtgacagaatggggatgggcgtcacctatcttgcgttaattgccacgttcaaaatccaacccttcctagccctaggattcttcctcagaaaattgacatcacgggaaaacctcctactaggagttggcctcgcaatggccacgaccctacaattgcccgaagatatcgaacagatggcaaacggtatcgcactaggattgatggccctgaaactcataacccaatttgagacttaccaattatggacggccctaatatcattgacatgcagcaataccatcttcacgctaaccgtcgcgtggcgcacagctacactaatcttagcaggagtatctctactcccggtgtgccagtcaagcagcatgcgcaagactgactggttacctatgaccgtcgcggcaatgggagttccacctctcccactgtttatattctcgctaaaagataccctcaagcgccgatcatggcctttgaatgaaggcgtaatggccgtcggacttgtcagcattcttgccagtagccttctgagaaatgacgtaccaatggccgggcccctagtcgcagggggcctattaatagcatgctatgtcatcacagggactagcgctgacctcacggttgagaaagcggccgacgtcacgtgggaggaagaggcagaacaaaccggtgtctcacacaacctcatgataactgtggacgatgacggcactatgcgtattaaagatgacgaaacagagaacatattaaccgtgttattaaagaccgcactccttatcgtgagtggtatcttcccctattccattcccgccacactcctagtgtggcatacttggcaaaaacaaacgcaacgctccggtgtactatgggacgtgccctcacccccggagacgcaaaaagcagaactggaagaaggtgtgtacagaatcaaacagcagggaatattcggaaagacacaagtcggcgtcggtgtccaaaaggaaggcgtcttccacaccatgtggcatgtaacccggggcgcagttcttacctataacggcaagcgtctggaaccaaactgggcgtcagtgaagaaagatttgatctcgtacggcggcggctggcgccttagtgcacagtggcagaagggggaagaagtccaggtaatcgccgtagagcctggaaagaaccccaaaaacttccaaaccatgcccgggacgtttcagacgacgaccggggaaataggagccatagccttagacttcaaaccaggcacctccggatcccccattataaatcgggaaggaaaggtcgtcgggctgtacggtaatggtgtggtaactaaaaacggaggctacgtatccggcatcgcccaaacgaacgctgagccggatggtcccacacccgagctcgaggaagagatgttcaagaaacgcaatcttacaatcatggacctccatcccggctcgggaaagaccaggaagtacctgcccgctattgtaagggaggccataaaaaggcgactcaggacgctgatcttggcccccacccgcgtagtggcggccgaaatggaggaagcactaaaagggctaccaatacgatatcaaacaaccgcgaccaaatccgaacatactggacgggaaatagtagaccttatgtgccacgctacctttaccatgcgcctactatcgcccgtacgagtcccgaattacaacctaataataatggacgaggcacactttacagacccagcctccatcgcagcccgcggctacatctcaacacgggttggcatgggagaagcagcggcaatttttatgacagcgaccccacctggaactgccgacgcattcccgcagagtaacgcccccatccaggacgaagaacgggacataccggaacgctcatggaatagcggtaacgaatggataaccgacttcgccgggaaaacagtctggtttgtaccaagtataaaggccggaaacgatatcgccaactgcctccgaaagaatggcaagaaagtaatacagctcagccgcaagacattcgacacagaatatcagaaaaccaaactgaacgactgggactttgtcgtaactacggacatatccgaaatgggagcgaactttaaggccgacagagtaatagacccccgccggtgcctaaaacccgtaatcctaacggacggcccagaacgtgtcatcttagcaggccctatgccagttaccgcagcatcagcagcacagcggaggggacgggttggacggaacccacagaaagaaaacgaccagtacatttttacaggccaaccactaaacaacgacgaggaccatgctcattggacagaagcgaagatgttattggacaacatcaacacaccggagggcatcataccagcgcttttcgagcccgaacgtgaaaaatccgcagcaatcgacggcgagtaccgccttaaaggagagtcgcgaaaaacattcgtagagctaatgcgcaggggagacttacccgtctggctggcccataaagtagcctccgaaggcatcaaatacaccgaccggaaatggtgcttcgacggccagagaaataaccagatactcgaagaaaatatggatgtggagatctggacaaaagaaggcgagaagaagaaactccgccctcgctggctcgacgcaaggacgtacagtgatccccttgctctaaaagagttcaaggattttgccgcgggacggaaatcaatcgcactagacctggtaactgagatcggacgggtaccaacgcacctagctcataggacaagaaacgcgctagataacctagtaatgctacacaccagcgagcacggcgggaaagcctatcggcacgcagtagaagaattacccgaaacgatggaaaccctgctgttactaggcctgatgatactgttaacaggaggcgccatgctattcttaatatccggaaaaggcattggaaaaacttcaattgggttaatctgcgtgatcgctagcagcggtatgttatggatggccgaaatacctctgcaatggattgcgtcagctatagtacttgagttcttcatgatggtactgctgataccggaacctgagaagcagcgaacaccccaagacaaccaattagcgtacgttgtaatcgggattctcaccctagccgcaataatcgccgcaaatgaaatgggtctactcgaaacgacaaaaagggacctaggcatgtcaaaggaacccggcgtggtcagtcccacgagctatttagacgttgacttacacccggcaagcgcgtggacactttacgcagtggctacgactgtcataacgccgatgctgagacacaccatcgaaaactctacagcaaacgtatctctggccgccatcgccaaccaggccgtcgtgttaatggggttagataaaggttggcctatatcaaaaatggatttaggcgtgcctctgttagcactaggatgctacagtcaagtcaatcccctaacgctaacggcagccgtgctcctgctcataacgcactacgccatcatcggtccaggactgcaggcaaaagccacccgcgaggcccaaaagcgtaccgcggctggtatcatgaagaacccgactgtcgatggcatcatgaccatagatctagacccagtaatatacgactcgaaatttgaaaagcaattaggccaagtcatgctgctcgtcctctgcgcggtacaactgcttctaatgcgtacctcgtgggcgctttgcgaagcccttacccttgccaccgggccgataacgacactgtgggaagggtcacccggcaaattctggaataccactatcgccgtgtcgatggctaacatcttccgaggttcgtacttagctggagcgggccttgccttctccatcatgaaatcagtagggacaggcaaaagaggtaccgggtctcaaggcgaaactctcggcgagaaatggaagaagaaattaaaccaactgtcacgtaaggaatttgacttatacaagaaatcaggaatcactgaagtcgatcgaaccgaagcgaaggaaggcctgaaaagaggcgaaattacacaccacgcagtatccagaggctctgctaaattacaatggtttgtagaacgaaacatggtgataccggagggaagagtcatcgatctcgggtgcggcagaggaggctggagctactactgcgcgggcctaaagaaagttaccgaggtcagaggatacacgaagggcgggccagggcacgaagaacctgtacccatgtcaacctacgggtggaacatcgtaaaacttatgtctggcaaagatgttttctacctaccgccagaaaagtgtgacaccctactgtgcgacatcggagaaagtagcccgtctcctacagttgaagaaagcagaacaatacgagtgctaaaaatggtagaaccctggctaaagaacaaccaattctgcataaaagtactcaatccgtacatgccaacagtcatcgaacatctcgaaaggctccaaaggaaacacggcggcatgctcgtacgaaacccacttagcagaaacagcactcacgaaatgtactggatatctaacggcactggcaacatcgttgcaagcgtcaacatggtgtcgcggttgcttctaaaccgcttcacaatgacgcatagacgcccaacaattgagaaggacgtggacctgggggctggtacccgccatgtcaatgcggaacccgaaacaccaaacatggacgtgatcggagaaagaataaagaggattaaagaagaacataactcaacatggcactacgatgacgagaatccctacaaaacgtgggcataccatggatcgtatgaggtaaaagctaccggcagtgcttcctcgatgattaacggagtggtcaaactcttgactaagccctgggacgtcgttccgatggtgacccaaatggcgatgacagacaccaccccgttcggacaacagagggtcttcaaagaaaaagttgatacccgtaccccgcgctcgatgcccgggacccgccgagttatgggtataaccgctgagtggttatggagaacattaggaaggaataagaagccgaggctttgcacgcgagaagagttcactaagaaagtgagaacaaatgcagcaatgggggcagtcttcaccgaggaaaaccaatgggatagtgcaaaagcggcggtcgaagacgaggacttctggaaactcgtcgatagggaacgtgaattgcataaactggggaaatgtgggtcatgcgtatacaacatgatgggtaagagggaaaagaagttaggcgagtttgggaaagccaagggcagcagagccatctggtacatgtggttaggcgcccgctacttagagttcgaggcactcggatttctcaacgaagatcactggttcagccgcgagaactcctacagcggagtagagggcgaaggactacacaaactcggttatatactcagggacataagcaagataccaggaggggcaatgtatgccgacgacactgcgggatgggatacaagaataacggaggacgatctacacaatgaagagaaaatcacgcaacagatggaccccgaacaccgacagctggcaaatgccatatttaaactcacctatcagaataaagtcgtaaaggtgcaacgcccaacgcccgctggaactgttatggacataatctcccgaaaagaccaacgaggctcaggccaagtggggacgtacggactgaatacatttaccaatatggaggctcaactgattaggcagatggagggggagggagtgctatcaaaagcggatctggaaaacccccacctcccagagaagaaaatcacccaatggctggaaacaaaaggcgtcgaacgcttaaaacgcatggcgatctcaggcgacgattgtgtcgtaaaaccaatagacgacaggttcgccaacgcgcttctagcccttaatgacatgggaaaagttcgaaaagatataccccagtggcaaccctccaaaggatggcacgactggcaacaagtgcccttttgtagtcaccacttccacgaactgataatgaaagatgggcgaaagctcgttgtcccatgtcgcccgcaagatgagctcataggtagagcaagaatatcccaaggagcagggtggtccctgagagagacggcctgcctcgggaaggcttacgcccaaatgtggtcactcatgtatttccaccgcagggatctccgccttgctagcaacgcgatctgcagcgcagtacccgtccactgggtgccgaccagtcgtaccacatggagcatacacgcccatcaccaatggatgacgacagaagacatgcttacggtatggaatcgtgtgtggatagaggacaacccctggatggaggacaaaacacccgtcacgacgtgggagaatgtcccctacctcggaaagcgagaagaccaatggtgtgggagcttaatcggcttgacatctcgagccacctgggcgcaaaacatccccacagccatccagcaggtacgcagcctgatcggcaatgaggagttcctcgactacatgcccagcatgaaaagatttcggaaagaagaggaatctgaaggagcaatctggtga

SEQ ID NO: 26086 - RNA, 9873 nt, synthetic construct
  misc_feature 1..9873: note = derived and/or modified CDS sequence (opt11) from DENV-3__FJ898471__SS-prME
  source 1..9873: mol_type = other RNA
accagcctctgcctcatgatgatcctgcccgccgctctggcgttccatctcacgagccgggacggggaaccccgtatgatcgtggggaagaacgagcggggaaagagcctgctattcaagaccgctagtgggatcaacatgtgtaccctcatcgccatggacttgggagagatgtgtgatgacacagtgacctacaagtgcccccacatcaccgaggtggaacctgaggacatcgactgctggtgcaacctgacctcaacatgggtgacctacggtacctgcaaccaggccggcgagcaccggcgcgacaagcggtccgttgccctcgcaccccacgtgggtatggggctggatacccgcacccagacctggatgagcgccgagggggcctggcggcaggtcgagaaggtggagacctgggccctgcgccacccggggttcacaatcctcgcgttgttcctggcccattacatcggcacttccctcatccaaaaggtagtgatctttatcctgctgatgctagtgacacccagcatgactatgcggtgcgtgggggtgggcaatcgcgacttcgtggagggcctatccggtgccacctgggtggacgtggtcctggagcacggcgggtgcgtgacgaccatggctaagaacaagcccacgctcgacatagaactgcagaagacagaggccacccagctggctaccctccggaagctatgcatcgagggcaagatcacgaacatcaccaccgactcccgctgcccaacccagggcgaggccgtactgcccgaggaacaagaccaaaattacgtctgcaagcacacgtacgtggaccgggggtggggcaacgggtgcggcttattcggcaagggatcacttgtaacctgcgccaagttccagtgcttagagcccatcgagggtaaggtcgttcagtacgagaacctgaagtacaccgtgataataaccgtccacacgggcgaccagcaccaggtgggcaacgaaacccagggggtcaccgccgagatcacgccgcaggccagcacgaccgaggcgattctgcccgagtacggcaccttggggctcgagtgctcgcctagaaccggcctggacttcaacgagatgatccttctcaccatgaagaacaaggcctggatggtgcaccggcagtggttcttcgacctgcccctgccctggacgagcggcgccaccaccgagacacccacttggaaccgcaaggagttgctcgtgaccttcaagaacgcccatgccaaaaagcaggaggtcgtcgtactgggttcccaggagggtgcgatgcacaccgccctcactggggccacggagatacagaacagtggcggaaccagcatcttcgccggccacctgaagtgccggctgaagatggacaagctcgagttaaagggtatgagctacgccatgtgcaccaacactttcgtcctgaagaaggaggtttctgagacgcagcacgggaccatcctaatcaaggttgaatacaagggcgaggacgtcccctgcaagatccccttcagcacggaggacgggcaaggaaaggcgcacaacggccgcctgatcaccgccaacccagtggtgaccaagaaggaggagcccgtcaatatcgaggcggaaccgcccttcggtgagtccaacatcgtgatcggcattggggacaatgccctgaagattaattggtataagaagggctcctccatcgggaagatgttcgaggccaccgctcggggcgcccgccggatggccatcctgggcgacacagcctgggactttggatcagtgggcggagtcctcaacagcctgggcaaaatggtgcaccagatcttcgggtcggcgtacacagcgctgttcagcggcgtgtcctgggtcatgaagatcggtatcggggtgctcctgacgtggatcggcctgaacagcaagaacacctccatgtcgttctcctgcatagtgatcgggatcattaccctctacctgggggccgtagtgcaagccgacatggggtgcgttatcaactggaagggcaaggagcttaagtgtggcagcggaatcttcgtcaccaatgaggtgcacacgtggaccgagcagtacaagttccaggccgattcccctaagcgcttagcaaccgccatcgccggggcctgggagaacggggtgtgcggcatcagaagcaccacacggatggaaaacctgctgtggaagcagatcgccaacgagctcaactacatcttgtgggaaaacaacataaagctcacggttgtggtgggggacattatcggcgtcttagaacagggcaagcgcaccttaacgccccagccgatggagctgaagtacagttggaaaacgtgggggaaagcgaagatcgtgaccgccgagacccaaaattctagcttcatcatcgacggccccaacacccccgaatgccccagcgcctcccgggcctggaacgtatgggaggtcgaggactacgggtttggcgtttttacgaccaacatctggctcaagctgagggaggtgtacacccagctgtgtgaccaccggctgatgagtgctgccgtcaaggatgagcgcgcggtgcacgccgacatgggctactggatcgagagccagaagaacgggtcctggaagctggaaaaggctagcttaatcgaggtgaagacctgcacctggccgaagtcccacacgctgtggagcaacggcgtcctggaaagtgacatgatcatccccaagagcttggcggggcctatctcacagcacaactaccggccgggatatcatacccagaccgctgggccctggcacctgggcaagctggagctggacttcaactactgcgagggcacaaccgtggtgatcaccgagaactgcgggacccgtggccccagcctccggacaacgaccgtctccggtaagctgatccatgagtggtgctgccgcagctgtaccctgcccccgctccggtacatgggcgaggacgggtgttggtacggcatggagatccgccctatctccgagaaggaggagaacatggtaaagagcctggtgtccgcaggcagcggggaagtagacaacttcaccatgggcgtgctgtgcctagccatcctgttcgaggaggtgatgcggggtaagtttgggaagaagcacatgatcgcgggggtattcttcacgttcgtgctgctactgtccggccagatcacctggcgcgatatggcgcacacgctaatcatgatcggtagcaacgcctccgaccgcatggggatgggcgtaacctacctagccctaatcgccacattcaagatccaacccttcctggccctcgggttcttcctgcgcaagctgaccagccgggaaaatctcctcctgggcgtcggactcgcgatggccaccacactccagctgcccgaggacattgagcagatggccaacgggatagcgctcggtctgatggcgttaaagctcatcacgcagtttgaaacctaccagctgtggacggcgctggtgagcctgacctgctccaatacgatctttaccttaaccgtcgcctggcgcaccgccacgctgatactcgccggtgtgagcttactgccggtgtgccagagcagctccatgcggaagaccgactggcttcccatgaccgtcgcggccatgggcgtgccgcccctcccgctatttatcttcagccttaaggacaccctgaagcgccgctcctggccgctgaacgaaggggtgatggccgtcggcctcgtgtcgatcttggcctccagcctgctccggaacgacgtgcccatggccggcccactggtcgccggcgggcttctcatcgcctgctacgttataactgggacctccgctgacctgaccgtggagaaagccgcggacgtgacatgggaggaggaggccgagcagacgggggtgagtcacaaccttatgattaccgtggacgacgatgggaccatgcgcatcaaggacgacgagaccgagaacatcctcaccgttctcctgaagaccgccctcctgatcgttagtggcatatttccgtatagcatacccgccaccttgctcgtgtggcacacttggcagaagcagacccagcgctccggcgtcctgtgggacgtgccaagccctcccgaaacgcaaaaggccgagctggaggagggggtgtaccgtatcaagcagcaaggcatctttggtaagacacaggtcggcgtgggagtccagaaggagggcgtgttccatacgatgtggcacgtgacccgaggagccgtgctcacctacaatgggaaacgcctggagcccaactgggcgtccgtcaaaaaggacctgatcagctacggtgggggctggcggctcagtgcccagtggcagaagggggaggaggtccaggtgatcgccgttgagcccggaaagaaccccaagaacttccagaccatgcccggcaccttccagacaacgaccggggagatcggtgcgatagcgctggacttcaagcccgggaccagcggcagcccgatcatcaaccgcgagggcaaagtggtcggtttgtacggcaatggggtcgtgaccaagaatggcgggtacgtgtccggcatcgcccagacaaatgccgagccggacggcccgacccctgagcttgaggaggaaatgttcaagaagcggaacctaaccatcatggacctgcaccccggtagcggcaaaacgcgcaaatacctgccggccatcgtccgggaggctatcaaacgccggctccgcacgctgatcctggcgcccaccagggttgtggccgccgagatggaggaggccctcaagggacttcctatccgctaccagaccaccgcgacgaagtcagagcacaccggccgggagatcgtcgacctgatgtgccacgcgacattcactatgcgcctcctgagccccgtccgggtgccgaactacaacctaatcataatggatgaggcccactttacagaccccgccagcatcgccgcccgaggatacattagcacccgggtcggtatgggcgaggcggccgccattttcatgaccgcaacgccgcccgggacggcggacgctttcccgcaatctaacgcccccatccaggacgaagagcgcgacatccccgagcgcagctggaactccggcaacgagtggatcaccgactttgccgggaagaccgtgtggttcgtgccaagcatcaaagccggtaacgacattgcgaactgtctccggaagaacgggaagaaggtaatccagctgtcccgcaagactttcgacacggagtaccagaagactaagctgaacgactgggacttcgtggtgaccaccgacatatccgagatgggcgccaacttcaaagccgaccgggtgatcgatccgcgcagatgcctcaaacccgtgatactgacggacggacccgagcgcgtcatcctggccgggcccatgccggtcaccgccgcatcagccgcccaacggcgcggccgggtggggcgcaacccccagaaggagaacgaccagtacatcttcactggtcagcccctcaacaacgacgaggaccacgcccactggaccgaggccaagatgctgctagacaacatcaacacccccgaggggatcataccggccctctttgaacccgagagggagaagtccgccgccatcgacggcgagtacagattaaagggcgagtcccggaagacgttcgtcgagctgatgcgccgcggggacctccctgtgtggctggcctacaaggtcgcgtctgaaggaatcaagtacaccgatcgcaaatggtgcttcgacgggcagcggaacaaccagatcctggaggagaacatggacgtcgagatctggaccaaggagggcgagaagaaaaagctccgcccccggtggttggacgcccgcacctactccgacccgctggccctcaaggagttcaaggacttcgccgccggccgcaagagcatcgcgctggacctggttaccgaaatcgggcgggtgccctcccacctcgcccaccgcacccgaaacgcacttgacaacctggtcatgctccacacaagcgagcacggcgggaaggcctacaggcatgccgtggaagagctcccagagacgatggagacgctgctcctgctgggcctcatgatcctgttaaccgggggcgcgatgctgttcctgataagcggcaaggggattggcaagacttccatcgggctgatttgcgtgattgccagctcaggcatgctctggatggctgaaatcccactgcagtggatcgcgagcgccatcgtcttggagtttttcatgatggtcttactgattcccgagccggaaaagcagcgaacgccccaggataaccagttggcgtatgtggtcatcgggatccttacgttggccgccatcattgccgccaacgagatgggcctgctcgagaccaccaagcgcgacctcggcatgtccaaggagccgggggttgtgagccccacctcctatctggacgtcgatctccatccggcgagcgcctggacgctatatgccgtggccacgaccgtcatcacccccatgttacggcacacgatcgagaactccacggcgaacgtcagcctcgccgccatcgccaatcaggccgtggtcctgatgggcctggacaaggggtggcccatctcaaagatggacctcggcgtaccacttctggcgctcgggtgctacagccaggtgaaccccctgaccctgacagccgccgtgctcctgttgatcacgcattacgccatcatcgggccaggcttgcaggccaaggcaacccgggaggcccagaagcggaccgccgctgggatcatgaagaacccgaccgtcgacggcatcatgacgatcgacctggaccccgtaatctacgattccaagttcgagaaacaactgggccaggtgatgctcctggtattatgcgccgtccagctacttttaatgcgcaccagctgggcgttatgcgaggccctgaccctggccaccggacccatcaccaccctttgggagggctcaccggggaaattctggaatacaaccatcgccgtctcaatggcgaacatcttcaggggctcctaccttgctggggcgggcctggccttcagcatcatgaaatccgtcgggacgggcaagcgcggcaccggttctcaaggcgagactctcggagagaaatggaagaagaaactgaaccaactgagcagaaaggagttcgacctctataagaagtccggcatcaccgaggtggacagaaccgaggccaaggaggggctgaaacggggagagatcacgcaccacgcggtgagccgcgggtccgccaagctccagtggtttgttgagcggaacatggttatcccagagggaagggtcatagacctcggctgcggaagaggagggtggagctactactgcgccggtctcaagaaggtcaccgaggtgcgcgggtataccaagggagggcccgggcacgaagaacccgtgcccatgtccacctacggctggaacatcgtcaagctgatgagcgggaaggatgtgttctaccttccgcctgagaagtgcgacacgctgctatgcgacatcggcgagtccagcccctcccccacagtggaggagagccggaccatcagagtcctcaagatggtggaaccttggctcaaaaacaaccagttctgtattaaggtgctgaacccgtacatgcccaccgtcatagagcacctggaacgcctccagcgtaagcacggcgggatgctggtgcgaaaccccctgtccagaaacagcacgcacgagatgtactggatctcgaacggcaccgggaacatcgtggcctcggtcaacatggtgtcccgcctactgctcaaccggttcaccatgacacaccgccggccgacgatcgagaaggacgtggacctcggcgccgggacccgccacgtcaacgctgagcccgagacccccaacatggacgtgatcggggagcggatcaagcgcatcaaggaggaacataactcgacttggcactacgacgacgagaatccgtacaagacttgggcctaccacggtagttacgaggtgaaggcgaccggtagcgcctccagcatgatcaacggcgtggttaagctgctgaccaagccctgggacgtcgtgcccatggtgacccagatggccatgacggacacaacgccattcggacagcaaagagtcttcaaggagaaggtggacacccgcacgccgcggagcatgccgggcacccgccgggtgatgggcatcaccgcggagtggctctggcgcaccctggggcggaacaagaagccccgcctgtgcacacgcgaggagttcaccaaaaaggtccgcaccaacgccgccatgggagccgtgttcaccgaggagaaccagtgggactccgcaaaggccgcagtggaggacgaggacttctggaagctcgtcgaccgcgagcgagagcttcacaagctggggaaatgcggcagctgcgtgtacaacatgatggggaagcgcgaaaagaagctcggtgaattcggcaaggccaaagggtcccgagcgatctggtacatgtggctgggcgcgcgctaccttgagtttgaggccctcgggttcctgaacgaggaccactggttcagccgggagaactcatacagtggcgtggagggtgaaggcttgcacaagctcggttatatcctgcgcgacatttccaagatccccgggggcgccatgtacgcggacgatacggccgggtgggacacccggatcaccgaggacgacctgcacaacgaggagaagataacccagcagatggatccggagcaccgccagctcgcgaacgctatcttcaaactgacttaccaaaacaaagtagtgaaagtgcagcgacccaccccgaccggtacagtcatggacatcataagccgtaaggaccagcgtggctccggccaggtgggcacgtatgggctaaacacgttcacgaacatggaggcccagctcatccgccagatggagggcgagggggtgctgagcaaggccgacctggaaaacccccacctaccggagaagaagatcactcagtggctggagaccaaaggcgtggagcggttgaagcgtatggccatttccggcgacgactgcgtggtaaagcccatcgacgaccggttcgcgaacgccctcctggccctgaacgacatggggaaggttcgcaaggacatcccccagtggcaacccagcaagggctggcatgactggcagcaggtcccgttttgctcccaccacttccacgagctcatcatgaaggacgggcggaagttagtggtcccctgccgcccccaagacgagctgatcggccgggcccgtatcagtcagggggccgggtggtccctccgggagaccgcgtgcctggggaaagcctacgcccagatgtggtcactgatgtatttccaccgccgcgacctccggctggcctccaacgcgatctgcagcgccgtgcccgtgcactgggtcccgacctcccgcaccacatggagcattcacgcccaccaccagtggatgacaaccgaagacatgctgacggtgtggaacagagtgtggatcgaggacaatccttggatggaggacaagacccccgtcacgacctgggagaatgtgccctacctcgggaagcgcgaggaccagtggtgcggcagcctgatcgggctgacctcccgggcaacgtgggcccagaacatcccgacggctatccagcaggtccgaagtttgataggcaacgaggagttcttagattacatgccatccatgaagcggttccgcaaggaggaggagagcgagggggccatctggtga

SEQ ID NO: 26087 - RNA, 9873 nt, synthetic construct
  misc_feature 1..9873: note = derived and/or modified CDS sequence (opt11) from DENV-3__FJ898472__SS-prME
  source 1..9873: mol_type = other RNA
acttcgttatgcctgatgatgatcctgccggccgccctcgccttccacctcacctcgcgggatggggagccccggatgatcgtggggaagaacgagcggggcaagagccttctgttcaagacggcttccggaattaacatgtgcaccctcatcgctatggaccttggagagatgtgcgacgacacagtgacctacaagtgcccccatatcacagaggtggagccagaggatatcgactgctggtgtaacctgactagcacctgggtcacctatgggacgtgcaaccaggccggggaacaccgtcgcgacaaacggtccgtcgccctcgcgccccatgtcggcatggggttggatacccgcacccagacctggatgagcgccgagggcgcttggcgacaagtagagaaagtcgagacatgggctctgcgccacccaggtttcaccatcctggcgctgttcctggcccattacatcggcacctccctaacccagaaggtggtgatcttcatattactgatgctcgtaacgcccagcatgaccatgcggtgcgtgggggtcggcaatagggacttcgtcgagggcctgtccggcgcaacctgggtggatgtggtgctggagcacggcgggtgcgtgaccacgatggcaaaaaacaagcccacgctcgacatcgagctgcagaagaccgaagctacccagctggcgaccctgagaaagctgtgcatcgaaggcaagatcaccaacatcaccaccgatagcagatgcccgacgcagggggaggccgtgttaccggaggagcaggatcaaaactacgtctgtaagcacacctacgtggatcggggctgggggaatgggtgtggcctcttcgggaagggctctctggtgacctgcgccaagttccagtgtctggagcctatagaaggaaaggtcgtgcagtacgaaaacctaaaatacaccgtaatcataacggtccacaccggggatcagcaccaggtggggaatgagacccagggggtcaccgccgagatcaccccccaggcctcaaccactgaggcgatcctgcccgagtacgggaccctgggcttagaatgctccccgcgcaccggccttgacttcaacgagatgatcctactcacgatgaagaacaaggcctggatggtacaccggcagtggttctttgatctgccactgccctggaccagcggcgcaaccaccgagaccccgacctggaaccggaaggagctcttagtgacctttaagaacgcccatgccaaaaagcaggaggtcgtggtcctagggagccaggaaggagcgatgcacacggccctcacaggggccaccgagatccaaaacagcggcgggacctcaatcttcgcgggacacctaaagtgccggcttaaaatggacaaacttgagctgaagggtatgtcatacgcaatgtgtaccaacacgtttgtcttaaaaaaggaggtatccgagacccagcacgggacgattttaattaaggtggagtataagggcgaggatgtcccgtgcaaaatccccttctcaaccgaggacgggcagggaaaggcgcataacggtcgcctgatcacggccaacccagtggtgacgaagaaagaggagcccgtaaatatcgaggccgagccgcccttcggggagagcaacatcgtcataggtatcggtgacaatgccctgaagatcaattggtacaagaaaggctccagcatcgggaaaatgttcgaggcgacagcccggggagcccggcggatggccatactcggcgacaccgcatgggacttcgggagtgtcgggggtgtcctcaacagcctaggaaaaatggtccaccaaatattcgggtccgcgtacacagccctgttcagcggcgtgtcctgggtcatgaagatcggcatcggggtgctcctgacttggatcggcctgaacagcaaaaacacctccatgtcattctcctgcatcgccatcggtatcatcaccctctatctgggcgccgtagtccaggccgacatgggatgcgtaatcaactggaaggggaaggagctgaagtgcggcagcgggatctttgttacgaatgaggtccacacctggacggagcaatacaagttccaagcggactcccctaagcgcctcgcgaccgccatcgccggagcctgggagaacggggtgtgcgggatcagaagcacgacccggatggagaacctgctgtggaaacagatcgcgaatgaactaaactacatactctgggagaacaacatcaagcttaccgtggtcgtcggggacatcatcggcgtgctcgagcaaggcaaaaggaccctgacgccacagccgatggagctgaagtactcctggaagacgtgggggaaggcaaagattgtaaccgccgagacccaaaattcctcattcatcattgacggccccaacacgcccgagtgtccttcagcgtcccgggcatggaacgtgtgggaagtggaggactacggtttcggcgtcttcaccaccaacatctggctcaagctgcgcgaggtgtacacccagctgtgtgaccacaggctgatgagcgccgccgtcaaggacgagcgcgccgtccacgccgacatggggtactggatcgagagccagaaaaacgggtcctggaagctggagaaggcgagcctgatcgaggtgaagacctgcacgtggccgaagtcccacaccctgtggagcaacggcgtgttggaatccgacatgatcatacccaagagcctagccgggcccatctcccagcacaactacaggccggggtaccacacccaaacagccgggccctggcacctaggaaagctggagctggatttcaattattgcgaaggtacgaccgtcgtgatcaccgagaactgcgggacccgcggccctagcctcagaactaccaccgtctccggcaagctgatccatgagtggtgctgtcgcagctgcaccttaccgccgctccgatacatgggcgaggacgggtgctggtatgggatggagatccgccccatatcagaaaaggaggagaacatggtaaagagcctggtatctgcaggcagcggggaggtggataattttacgatgggcgtcctttgcctcgccatcctgttcgaggaggtcatgcgggggaagttcggcaagaaacacatgatcgcgggtgtgttcctgacgtttgtcctcctgttatccggccagatcacttggcgcgacatggcccacaccttaatcatgatcggcagcaatgcgtccgaccggatggggatgggcgtgacgtacctggccctgatagccaccttcaaaatccagcccttcctcgccctggggttctttctgcgcaagctcacctctcgggagaacctgctgctcggagtgggcttggccatggcaactacgctgcagctcccagaggacatagagcagatggcgaacgggatcgcgctgggtctcatggcactcaagctaatcacccagttcgagacgtatcagctgtggacagccctcatctcacttacgtgctccaatactatattcacgctgaccgtggcctggagaacggccacgttaatcctggccggggtgtcactactccccgtctgccagtcctcttccatgcggaagaccgactggctgcccatgacggtggcagccatgggcgtgccgccactgcccctgttcatcttcaacttaaaagacactctgaaaagacgtagctggcccctcaatgagggggtcatggccgtgggcctagtgtctatcctggccagctcccttctgaggaacgacgtcccgatggcgggccccctcgtggctgggggcctcttaatcgcctgctacgtgatcactgggacgagcgccgacctgaccgtcgagaaagcagcggacgtgacgtgggaggaggaggccgagcagaccggcgtgtcccacaacttgatgataaccgtagatgacgacggaaccatgaggatcaaggacgacgaaacggagaacatcctgactgtattgcttaagacagccctgctgatcgtgtcaggcatcttcccgtactccatacctgccaccctcttagtttggcacacttggcagaagcaaactcaacggagcggcgtgctgtgggatgtgcccagcccgcccgagacccagaaggccgagctcgaggagggggtgtatcgcattaagcagcagggcatcttcgggaagacccaggttggtgtgggggtccagaaggagggggtgttccacactatgtggcacgtaacgcggggcgcggttctgacatataacggtaagcgcctagagcccaattgggcgagcgttaagaaggaccttatctcatacggcgggggctggcggttgtccgcccaatggcagaagggcgaggaggtgcaggtcatcgccgtggagcccggcaagaaccccaaaaacttccagaccatgcccggcaccttccagacgacgaccggcgagattggggcgatcgctctggatttcaagcccgggacctccgggagccccatcatcaaccgcgaaggcaaagtggttggcttgtacggcaacggagtggttacaaagaacggcggatacgtctctggaatcgcccagaccaatgccgagccggacggccccacccccgagttggaggaagagatgttcaagaagcggaacttaaccatcatggatctgcaccccgggtccggtaagacgcgcaagtaccttccggccatcgtgcgggaggcgatcaagcgccggttgcgcaccctgattttggcccctacacgtgtggtcgccgctgaaatggaggaggcgctgaagggtctgccaatccgctatcagaccacggcgaccaaaagcgagcacacggggcgggagatcgtagacctcatgtgccatgcgacctttacgatgagactgttgagtcccgttcgggtcccgaactacaatctgatcatcatggatgaagcccatttcaccgaccccgctagcatcgccgcccgcgggtacatcagtactcgggtgggcatgggcgaggccgccgccatctttatgaccgcgacgccgcccggaaccgctgacgccttcccgcaaagcaacgccccaatccaggatgaggagagagacatccccgaaagaagttggaacagcggaaacgagtggatcaccgacttcgccggcaagactgtgtggtttgtcccctctatcaaggcgggcaacgacattgcgaactgcctacggaagaacgggaagaaggtaatccagctatctcggaagactttcgataccgagtaccagaagactaagctgaacgattgggacttcgtggtcaccacggacatctcggagatgggcgccaacttcaaggccgatcgagtgatcgacccacgccgctgtctgaagcccgtgatcttaacagacggcccggagcgcgtaatactcgccgggcccatgccggtgacagcggccagcgcagctcaacggcgcggccgggtgggccgcaacccccagaaagagaacgaccaatacatcttcacgggacagcccctgaacaacgacgaggaccacgcacactggaccgaggctaaaatgctgttggacaacatcaacacgcccgagggaatcatcccggcattattcgagcccgagcgggagaaatccgccgccatcgacggggagtaccgcctcaagggggagagccgcaagacgttcgtcgagttaatgcgcaggggggatctgcccgtgtggctggcgcacaaagtcgcctccgagggcatcaaatacaccgatcgcaagtggtgcttcgatgggcagcgcaataaccagatcctcgaggagaacatggatgtagagatttggactaaggagggcgagaagaagaagctgcgtccccggtggttagatgcccgcacgtacagtgaccccctcgccctgaaggaattcaaggacttcgccgcgggccgcaagtccatcgctctggacctcgtcaccgagatcgggcgagtccccactcatcttgcccaccgaacccggaacgccctggacaacttggtgatgctgcacacgagcgaacacggcggaaaggcgtatcgccatgcggtggaggagctgcccgagaccatggagaccctattgctgctcggcctgatgatcctgctcacgggtggcgccatgcttttcctgatctccggaaaagggatcggtaaaacgagcattgggctcatctgcgttattgcctcgtctggcatgttatggatggccgaaattccgctgcagtggatcgccagcgcgatcgtgctcgagtttttcatgatggtgctgctgatccccgaacccgaaaaacagcggacgccccaggacaaccagctcgcatacgtcgtgatagggatcctgaccctggcagccattatcgcggcgaacgagatgggactcctggaaacaacgaagcgcgacctgggaatgtcgaaggagccgggcgtcgtcagccccaccagttacctcgacgtggacctccacccggccagcgcctggacactgtacgctgtggcgacaacagtcatcaccccgatgctccggcacaccatcgagaactccaccgccaacgtttcactggccgccattgccaaccaggcggtggtcctgatgggtcttgacaaggggtggcccatcagtaagatggacctgggagttccgctgctcgccctgggctgctattcacaggtgaaccccctaacgctgaccgccgccgtgctgctgctcatcacccactacgccataataggccccggcctccaggcgaaagccacgcgcgaagcccagaagagaaccgccgctgggatcatgaaaaacccgaccgtggacggcataatgaccatcgacctagatccagtaatctatgactctaagttcgagaagcagctcgggcaggtcatgctgctggtgctctgcgcggtacagctgctgctcatgcgcactagctgggctctgtgcgaagccctgactctggccacgggcccgatcacaacgctatgggaggggtcccccgggaagttctggaacacgaccattgcggtcagcatggccaatatcttccgggggagttacttagcaggggccggcctcgccttcagtataatgaagtccgtagggaccggaaagcggggcaccgggagccagggggagaccctgggggaaaagtggaagaagaaactgaatcagttgagccggaaggagttcgacctgtacaaaaagtccggcattactgaggtggaccgcactgaggctaaagagggactgaaacggggcgagattacccaccacgccgtcagccgcggctccgcgaagttacagtggttcgtggagagaaacatggtgatcccggaggggcgcgtgatcgacttgggctgcgggcggggaggttggagctactactgcgcgggcctgaagaaggtgacagaggtgagaggctacacgaagggcgggcccgggcacgaagaacccgtccccatgtcaacctacggctggaacatcgtaaaactcatgtcggggaaggatgtgttctacctgccgcctgagaaatgcgacaccctgctatgcgatattggcgagtccagtccctccccgaccgtggaagagtcgcggacgatcagggtgctaaagatggtggagccctggctgaagaacaaccagttctgcatcaaggtcctgaacccctacatgcccaccgtgatcgaacacttggagagactgcagcggaagcacggcgggatgctggtgcgcaaccccctctcccgcaacagcacccacgagatgtactggatttccaacggaaccggaaacatcgtcgccagcgtgaacatggtgagccgcctcctgctaaaccggttcacgatgacccaccgccggccgaccatcgagaaggacgtcgatctgggcgcggggacccgccacgtgaacgccgaacccgaaacgcccaacatggacgtgatcggggagcggatcaagcgcatcaaggaagagcacaactctacctggcactacgacgacgagaacccgtataagacctgggcttaccacggctcctacgaggtcaaggccactggcagcgcctcctccatgatcaacggcgtggtcaagcttttgacgaagccctgggacgtggtccccatggtcacccagatggcgatgacagacacgacgcccttcgggcagcagcgggtgttcaaggagaaggtggacacccgcaccccgcggtccatgccgggcacccgccgggtcatgggcatcacggcggagtggctatggcgcacactggggcggaataagaagccccggctctgtacccgggaggagttcaccaagaaggtccgcacgaacgccgctatgggcgctgtgttcaccgaagagaaccagtgggacagtgccaaggccgccgtcgaagacgaggacttctggaaactcgtggaccgagagcgggagcttcacaagctcgggaaatgcggcagctgcgtatacaacatgatggggaagcgcgaaaagaagctgggcgagttcggcaaggcaaaggggtcacgggcgatctggtacatgtggcttggtgcgcgctacctagaatttgaggccttggggttcctcaacgaagaccattggttcagccgggagaacagttatagcggcgttgagggggagggactccacaagctgggctacatactgcgcgacatctccaagatcccggggggcgccatgtacgccgatgacaccgcggggtgggacacccgcatcacggaagacgacctccacaacgaggagaagatcacccagcaaatggacccagagcaccgtcagctggccaacgccatcttcaagctcacctaccagaacaaggtggtcaaggtccagcggcccaccccaaccggcacggtgatggacatcatcagccgcaaggaccagcggggaagtggccaggtgggcacatatgggcttaacaccttcaccaacatggaggcacagctgatccgccagatggagggcgagggggtcctgtccaaagccgacttggaaaacccccacctccccgagaagaagatcacgcagtggttagagaccaaaggcgtggagcgtctcaagcgaatggcaatctctggcgacgattgcgtcgtcaagcccatcgacgaccggttcgccaatgcgctactggccctcaacgatatggggaaggtgcgcaaggacatcccgcagtggcaacccagcaaaggctggcacgactggcagcaggtcccgttttgctcgcaccatttccacgagctgatcatgaaggacgggcgcaagctggtcgtgccctgccgcccccaggatgagttaatcggccgggcgcgcatctcgcagggggctgggtggtccctgagagagaccgcctgtctcggcaaggcctacgcccagatgtggagcctcatgtacttccaccgcagagacctgcgtttagcgtccaacgccatctgctctgcggtgcctgtccactgggtaccgaccagccgcacgacatggagtatccatgcccatcaccagtggatgaccaccgaggacatgttgacggtatggaaccgggtttggatcgaggacaatccatggatggaagacaagacacctgtcaccacctgggagaacgtgccctacctggggaaacgcgaagaccagtggtgcggctcactgatcgggctaacgagccgggcgacctgggctcagaacatcccgactgcaatccagcaagtcaggtctctgatcggcaacgaagagttcttggattacatgccttccatgaagcggttccgtaaagaggaggagagcgaaggtgccatctggtga

SEQ ID NO: 26088 - RNA, 9873 nt, synthetic construct
  misc_feature 1..9873: note = derived and/or modified CDS sequence (opt11) from DENV-3__FJ898474__SS-prME
  source 1..9873: mol_type = other RNA
acgtctctgtgcctcatgatgatcttgcccgccgccctggcgttccacctcaccagccgggacggcgagccccggatgatcgtagggaagaatgagcggggcaagagccttctgtttaagaccgcctccggtatcaacatgtgcactctcatcgcaatggacctcggcgagatgtgcgatgacaccgtgacctacaaatgcccccatatcaccgaagtggagcccgaggacatcgactgctggtgcaatctgacttcgacctgggtgacctatgggacatgtaaccaggcgggcgagcaccgccgcgacaagcggtccgtggctcttgccccgcacgtgggcatggggctggacacccgcacccagacctggatgagcgcggagggtgcctggcgccaggtggagaaggtcgagacgtgggctctgcgccaccctgggttcaccatcctcgcgctgttccttgctcattacattggaacctccctgacccaaaaggtggtgatcttcatcctgctgatgctcgtgacgcccagcatgaccatgcggtgcgtgggagtcggcaaccgcgactttgtggagggcctgtcaggggctacctgggtggacgtggtcctggagcacggcgggtgcgtgacaacaatggccaagaacaagcccaccctcgacatcgagctgcagaaaaccgaagccacccagctggcgactttgaggaagctgtgcatcgagggaaagatcaccaacatcactaccgacagccgttgccccacccagggcgaggccgccttgccggaggagcaggatcagaactacgtgtgcaagcacacctacgtcgaccgggggtggggcaacgggtgcggcctcttcgggaagggcagcctggtaacctgcgccaagttccagtgccttgagccaatagaaggcaaggtggtccagtacgagaatttaaagtacaccgtgatcattacggtgcacaccggggaccagcaccaggttggaaacgagactcagggtgtgaccgcggagatcacgcctcaggccagcacgaccgaggccatactgcccgagtacggcaccttaggcctcgagtgctcaccgcgcacaggcctggactttaacgagatgatcctgctgacgatgaagaataaggcctggatggtgcacagacagtggttcttcgacctgcccttgccctggacttctggcgcaaccaccgagactcccacctggaaccgcaaggagctcctggtgacctttaaaaacgcccacgcgaagaagcaggaggtggttgtgcttgggtcccaggaaggtgctatgcacacggccttaacgggagctaccgagattcaaaacagcggcgggacctccatcttcgctggccacctgaagtgccggctaaagatggataagcttgaactgaagggcatgagctatgcgatgtgcaccaacacattcgttctgaagaaggaggtctccgagacccagcacgggaccatcctcatcaaggttgagtacaagggcgaggacgtgccgtgcaagatccccttcagcaccgaagacggtcagggaaaggcccacaacggccgtctgattacggccaaccccgtcgtgacaaagaaagaagagcccgtcaacatagaggccgagcccccattcggggaaagcaacatcgtcattggcattggggacaacgcgctgaagataaactggtacaagaagggatccagcatcgggaagatgttcgaggctactgcccgcggggcccgccggatggctatcctgggcgatacagcgtgggacttcgggtcggtgggaggagtgctgaacagcctgggaaagatggtccatcagatcttcgggtctgcctatactgccctcttcagcggcgtgtcctgggtgatgaagattggcatcggagtcctcctgacctggatcggcctgaacagcaagaacacctccatgagcttctcatgcattgccattgggattatcacactatacctgggcgccgtggtccaggcagacatggggtgcgtcatcaactggaaaggcaaggagttaaagtgcggaagcgggattttcgttacgaacgaggtccacacctggaccgaacagtacaagttccaggccgactcacccaaacgcctcgccaccgcaatcgcgggcgcgtgggagaacggggtttgcggcatccgcagcacgaccagaatggagaatttactgtggaagcagattgccaacgaactcaactacatactgtgggagaacaatataaagttgaccgtggtggttggagatataatcggcgtcttagagcagggcaagagaacactgacgccccaaccgatggagctcaagtactcttggaagacctgggggaaagcaaagatcatgaccgcggaaacccagaactccagtttcatcatcgacggtcccaacacgcccgagtgcccctcggcgtcacgggcctggaacgtctgggaagtcgaggactacgggtttggcgtattcaccaccaacatttggctcaagttacgcgaggtgtacacgcagctgtgcgaccatcggttgatgagcgccgccatcaaggacgagcgcgccgtgcacgccgacatgggctactggatcgaaagccagaagaacgggtcctggaagctggagaaggccagtttgatcgaggtgaaaacctgtacgtggccgaagtcccacaccctctggagcaacggcgtgctggagtccgatatgatcatcccgaagggccttgccggccccattagccagcacaaccaccgaccggggtaccacacccaaaccgccggcccctggcatctcggcaagctggagctggactttaattactgcgaggggacgaccgtcgtgatcaccgaaaactgcggcacccgcgggccctccctcaggacgaccaccgtgagcggcaagctgatccacgagtggtgctgtcgcagttgcacgctgccaccactccggtacatcggggaggacgggtgctggtatggcatggaaatccggccgatcagcgagaaggaggagaacatggtcaagtcgctggttagtgccgggtcaggcaaagtggacaacttcacgatgggggtcctgtgcctcgcgatcctgtttgaggaagtgatgaggggtaagttcggtaagaagcacatgatcgccggcgtgttcttcacattcgtcctgctactgagcggccagattacctggcgcgacatggcccacacgctgatcatgatcgggtccaacgccagcgacagaatgggaatgggggtgacgtacttagccttaattgcgaccttcaagatccagcccttcctggccctcggcttcttcctgcgaaagctgacctcccgggagaatttattactgggagttgggctagcaatggccaccacgttacagctgcccgaggacatcgagcagatggcgaatggtatcgccctcgggctaatggccctgaagctcatcacccagttcgagacctatcaactgtggaccgccctgatcagccttacgtgtagcaacaccatcttcaccctgacggtcgcctggcgcacggcgacgctgattctcgccggcgtcagtctgctcccggtttgccaaagctccagcatgcggaaaaccgactggctccccatggccgttgccgccatgggggtgccccccttaccgttgttcatcttttccctcaaggacaccctgaagcgccgcagctggcccctgaacgagggcgtaatggcggtgggcctcgtatccatcctggcctcttccctgctccggaacgacgtccccatggccgggcccctggtagcgggcgggctactcatcgcctgctacgtgatcacgggcaccagcgcggacctgaccgtcgagaaagcagccgatatcacctgggaggaggaggccgagcaaacgggggtctcccacaacctgatgatcaccgtagacgatgacggcacgatgcgcataaaggatgatgagacggagaacatcctcaccgtcctgctgaaaacggccctcttaattgtgtcgggcatatttccgtattccattcccgcgaccttactcgtttggcacacttggcaaaagcagacccagcgcagcggggtcctgtgggacgtgcccagcccgcccgagacacagaaagcagagctagaggaaggcgtgtaccggatcaagcaacaggggatcttcggcaagacccaggtcggggttggcgtgcagaaggaaggtgtcttccacactatgtggcatgttacccgcggggctgtgttgacgtacaacggcaaacgccttgagccaaactgggccagcgtcaagaaggacctgatctcctacggcggcggctggcggttaagcgcgcagtggcagaagggcgaggaggtccaggtgatcgccgttgagcccggcaagaacccaaagaacttccagacgatgcccgggaccttccagaccatcacgggcgaaatcggggccatcgccttagacttcaaacccggcacctccggcagccccatcatcaaccgcgaggggaaggttgtaggcttatacgggaacggcgtcgtgaccaagaacgggggttacgtgtcggggatcgcacagacgaacgccgagccggacgggcccacgccagagttagaagaagagatgttcaagaagcggaatctgaccatcatggacctgcaccccggctcgggcaaaacccgcaagtatctgccagctatagtccgggaggccatcaagcgacggctccgcaccttaatcctagctcccacgcgggtcgtagccgcggagatggaggaggccctcaaaggtctgcccatcaggtaccagaccacggccaccaagagcgagcacacggggcgggagatcgttgatctgatgtgccacgccaccttcaccatgagactcttatccccggtgcgggtcccgaattacaatctgatcatcatggacgaagcccactttacagaccccgcgagcatcgccgcccgcggatacatatccacgagggtcggcatgggggaggccgcggccatcttcatgactgcgacgccacccggtaccgctgatgccttcccgcaatccaacgcacccatccaagacgaggagcgggatattcccgagcgctcctggaacagcgggaacgagtggattactgacttcgcgggcaagaccgtgtggttcgtgccctccatcaaagctgggaacgacatcgccaactgcttacggaagaatggcaagaaggtcatccagctgagccgcaagactttcgacacggagtatcagaaaacgaagctgaacgactgggatttcgtggtgacgaccgacatctccgagatgggagcgaacttcaaagcggatcgcgtcatagacccgcgccggtgcctcaaacccgtcatcttaacagacggcccagagcgcgtgatcctagccggccctatgccggtcacggccgcctccgcggcgcagcggcgcgggcgggtaggacgcaatccccagaaggagaacgaccagtacatcttcaccgggcaacccttaaacaacgatgaggaccacgcccactggaccgaagcgaagatgctgttggacaacattaatacccccgagggtatcatcccggccctcttcgagcccgagcgggagaagtccgcggccatcgatggagagtacagactgaagggggagagccggaagaccttcgttgagctgatgcgacgtggcgacctcccggtctggttggcccacaaggtggcctccgaggggattaaatacacggatcgaaagtggtgctttgacggccagaggaataatcaaatcctggaggagaacatggacgttgagatctggaccaaggagggagagaagaagaagctccgcccccggtggttggacgcccgcacctattctgaccctttagcgctcaaggaatttaaggatttcgccgccgggcgcaagtccatcgcgctcgacctggtaacagagatcggccgggtccccagccacttggcccaccgcacgcggaacgcgctggacaacctggtcatgcttcatacctccgagcacgggggtcgcgcctaccggcatgccgtggaagagctgcctgaaaccatggagaccttgctcttactgggcctcatgatcctgctgactggaggcgccatgctcttcctgatcagcgggaagggcatcggcaagacctcaataggcctgatctgcgtaatcgcctccagcggtatgctctggatggcggaaatcccactgcagtggattgcctccgccatcgtcctggagttctttatgatggtcctgctaattcccgagcccgagaagcaaagaacgccccaggacaaccaactggcctatgtggtcatcggaatcctcaccctggccgcaataattgccgccaacgagatgggcctgctcgagacgaccaagcgtgatctggggatgagcaaagagccgggggtagtcagtcccacgagctacctggacgttgacctccaccccgcgagtgcatggaccttgtatgccgtggccacgacagtgatcaccccaatgctgcgccacaccatcgagaacagcacggccaacgtttccctcgcagcgatcgccaaccaggccgtagtgctcatgggcctggacaaaggctggccgatatcgaagatggatctcggggtccccctgctggcactgggctgctactctcaggtgaatcccctgacactgacagcagcagtgctcctgcttatcactcactacgcaattatcggccccgggctacaggctaaggccactcgggaagcccaaaagcgcaccgcggccggcatcatgaagaatcctaccgtcgatggaattatgaccatcgacctcgaccccgtcatctacgacagcaagttcgagaagcaactgggacaggtgatgctcctggtcctgtgcgccgtgcagctgctgctgatgcggacgtcctgggccctctgcgaggcgctgaccttagcgacaggccccataactactctctgggaggggagccccggcaagttctggaacaccaccatcgccgtgtccatggccaacatcttccgcgggtcctatctggcaggcgcgggactcgctttctccatcatgaagtccgtcggcaccggaaagcgggggacaggatcacagggtgagacgctcggtgagaagtggaagaagaagctgaaccaactgtcccgcaaggaattcgatctctacaagaagagcgggattaccgaggtggaccggaccgaggctaaggaaggcctgaagcgcggcgaaaccacgcaccacgccgtgtcccgggggtccgccaagctgcagtggttcgtagagcgcaacatggtcatcccggaggggcgggtgatcgacttggggtgcggccgcggtggctggagttactactgcgcggggttgaagaaggtcaccgaggtgcgggggtacaccaagggcggtccgggccatgaggagccagtgcccatgagcacgtacgggtggaacatcgttaagcttatgtcgggaaaagacgtgttctacctaccgcccgagaagtgcgacaccctgctgtgcgacatcggcgaatcctcccccagccccaccgttgaggagtcccgcaccatcagagtcctgaagatggtggagccgtggttaaagaacaatcagttttgcatcaaggtgctgaatccctacatgcccaccgtcatcgagcatctggagcgcctgcagcgcaagcatggcggcatgttggtgcggaaccccctctcccgtaattcgacgcacgagatgtactggatcagcaatgggaccggcaacatcgtggcctctgttaatatggtgagccggctcctgctgaaccgcttcacaatgacccatcggcgccccacaatcgagaaggacgtggatctcggcgcagggacccgtcacgttaacgcggagcccgagacccccaatatggacgtcattggcgaaagaatcaaacggattaaggaagaacacaactccacctggcattatgacgacgagaacccgtacaaaacgtgggcctaccacgggagctacgaagtcaaggcgaccggctccgcttcttccatgattaacggggttgtgaagttgctgactaagccctgggacgtggttcccatggtgacgcagatggccatgacggacacaacccccttcggccagcagagggttttcaaggagaaagtggacacccggacgccccgctcgatgcccgggacccggcgcgtaatggggatcaccgccgagtggctctggcgaaccctgggccgcaacaaaaagcctcggctatgcacgcgcgaggagttcaccaagaaggttcgcaccaatgcggccatgggggccgtgttcactgaggagaaccagtgggacagtgccaaggccgcggtggaggacgaggatttctggaagctcgtcgaccgggagcgtgaactgcacaagctgggcaaatgcgggagctgcgtctacaacatgatgggcaaacgggaaaagaaactaggcgagttcgggaaagccaagggcagccgggccatctggtacatgtggctgggcgcccggtacctggagttcgaggccctcggtttcctgaacgaggaccactggttctcccgcgaaaacagctactccggggtggagggcgagggcttacacaaactcgggtacatcctacgggacattagcaagatccccggcggagcgatgtacgccgacgacacggccgggtgggacacgaggatcaccgaggacgacctgcacaatgaggaaaagatcacacagcagatggaccccgagcaccggcagctcgctaatgccatcttcaagcttacgtaccaaaacaaggtggtgaaagtgcagcgccccacccccaccggcactgtcatggacatcatctccagaaaagaccagcgcgggagcggtcaggtaggaacgtacggactgaacacgttcaccaacatggaggcgcaattaatccggcaaatggagggagaaggcgtcttgagtaaggctgaccttgagagcccccacctcccggagaaaaagatcacccagtggttagagaccaagggagtggagcgcctcaagcggatggctatctccggggacgactgcgtggtgaagccaatagacgacaggttcgccaacgcgttactggcgttaaacgacatgggcaaggtgcggaaagatatcccccagtggcaaccaagcaaagggtggcatgactggcagcaagtcccgttctgtagtcaccacttccacgaacttattatgaaggacggccgcaagctggtggtcccctgccggcctcaggacgagctgatcggccgggcccggatcagccagggcgccggctggtccctccgcgagacggcctgcctggggaaggcttacgctcagatgtggagcctaatgtacttccaccgccgggacttgcgcctggcctccaacgccatatgctcagccgtgcccgtgcactgggtccctacgtcccggaccacctggagcatacacgctcatcatcagtggatgacgaccgaggacatgctgactgtgtggaatcgcgtatggatcgaggacaacccgtggatggaggataagacccccgtcacgacatgggagaacgtgccttacctcggcaagcgcgaggatcagtggtgcgggtccttgatcggcctgaccagcagagccacctgggcccagaacatcccgacggcgatccagcaggtccggagcctgatcggcaacgaggagttcctggactacatgccctccatgaagcgtttccggaaggaggaagagagtgagggtgccatctggtga

SEQ ID NO: 26089 - RNA, 9873 nt, synthetic construct
  misc_feature 1..9873: note = derived and/or modified CDS sequence (opt11) from DENV-3__EU529688__SS-prME
  source 1..9873: mol_type = other RNA
acctcactatgcttaatgatgatcctgcctgccgccctagcgttccacctaacttctcgcgacggcgaaccccgcatgattgtagggaaaaacgaacggggcaaaagccttctattcaaaaccgcctccggaataaacatgtgcaccttgatagccatggacctaggagaaatgtgcgatgataccgtgacctataagtgccctcatataactgaagtagaacccgaagacatcgactgttggtgtaacctaaccagcacttgggttacttacggaacctgcaatcaagcaggagaacacagacgagataaacgatcggtggccctagcaccccatgtgggaatgggactcgatacgagaacccaaacatggatgtcagctgaaggggcgtggcgacaagtagaaaaagtagaaacgtgggcactacgccacccgggatttaccatactcgcacttttcctggcccactacatcgggaccagcctaacacaaaaagtcgtgatattcatactactcatgctagtcaccccgtcgatgacaatgagatgcgtcggagtaggaaatagagatttcgtagaagggctctcgggcgccacatgggtagacgtggtattggaacacggaggatgtgtcacgaccatggctaaaaacaaacccacactagacatcgaattacagaaaacagaagccacgcaacttgccacactacgaaagctatgcatagaaggcaaaattacgaacatcaccaccgactcccgttgccccacacaaggggaagccgtgttgcccgaagaacaagatcagaactacgtctgcaagcacacctacgtagacagaggatggggcaacgggtgcggactgttcggaaaaggctccctcgtgacgtgtgcaaagtttcaatgcttagaaccaatcgaaggtaaagtagtccaatacgaaaacctaaagtacaccgtgataataacagtacacaccggcgaccagcaccaagtcggtaacgagactcaaggcgtgactgcggaaatcacaccacaggcgtcgacaacagaagcaattctacccgaatacggcacgttaggacttgagtgctcaccacgtaccggactagatttcaatgaaatgatactactcacgatgaagaacaaggcgtggatggtccaccgtcaatggttctttgatctaccccttccatggaccagcggcgccacaaccgaaaccccgacgtggaaccgaaaagaactattagtaacttttaaaaacgcgcacgcgaagaaacaggaagtagtcgtgctggggagccaggaaggagccatgcatacagcgctgaccggggcaacagaaatacaaaattccggaggcacaagcatatttgcgggtcacctaaaatgtcgcctaaaaatggacaaacttgaactcaaagggatgagctacgcaatgtgcacgaacaccttcgtgctcaaaaaggaagtgagcgaaactcaacatgggaccatactaataaaggtggagtacaaaggagaagacgtgccctgtaaaataccctttagtacagaagacggacaaggcaaggcgcacaacgggaggttgatcaccgccaaccccgtggtaacgaagaaggaggaaccagttaacatagaggccgaacccccattcggcgaatcgaacatcgtgatcggcataggcgataacgctctcaagattaactggtacaaaaagggctccagcatcggaaaaatgttcgaggccacagcaaggggcgcacgacgtatggcgatacttggcgataccgcatgggacttcgggtcggtaggcggcgtcctaaattccctcggcaaaatggtccaccagatttttggaagtgcgtacactgctctgttttcgggtgtgagctgggtcatgaagataggcatcggcgtactcctcacatggatcgggctcaacagcaaaaacacaagcatgtcattttcatgtatcgccatcggtatcattaccttatacctaggcgcagttgtacaagcagatatgggctgcgtcattaactggaagggcaaggaactcaagtgcggaagcggaatttttgttacaaacgaggtacacacctggacggagcagtataagttccaagccgattctccaaaacgtctagcgacggccatagccggagcatgggaaaacggcgtctgtggtatacgatctaccacgagaatggagaatctactgtggaagcagattgcaaatgaactgaattacatcctgtgggaaaacaacataaaactaaccgtcgtggttggggacaccatcggcgtattggagcaggggaaacgcaccctaacaccccaacccatggaactcaaatactcatggaagacgtggggaaaagccaagatagttaccgcagaaacccaaaattccagctttataatagacggcccgaacaccccagaatgcccaagcgcttcccgagcatggaacgtatgggaagtagaggactatggattcggggttttcactacaaacatctggctgaaattgagagaagtatacacacagctatgcgatcaccgccttatgagcgcggcggttaaggacgaacgggcagtccacgcggacatggggtactggatcgagtcacagaaaaatggctcttggaaacttgaaaaagcgtccctcattgaggtaaaaacatgcacatggccaaaatcccacacattgtggagcaacggagtccttgaatcggacatgataatccctaaatcattagcaggaccgatcagtcaacacaactatcgcccagggtaccacacacaaacggcgggcccatggcatctaggtaaactcgaactagactttaactactgcgaagggaccacggtggtgattactgaaaactgcggaacacgggggccaagtctcagaaccacaacagtcagtgggaaacttatacacgaatggtgctgtcggagctgcaccctaccacctctgaggtacatgggggaagacggctgctggtacggcatggagatccggccgatatcagaaaaagaagaaaacatggttaagagtctagtgtctgcaggctcaggcgaggtagacaacttcaccatgggggtactatgtctcgccatcctattcgaagaagtcatgcgcggcaagttcggcaagaaacacatgatcgccggcgtcttcttcacgtttgtactactgttaagcggacaaatcacatggcgcgacatggcccacacccttattatgattggaagcaatgcctccgaccgaatgggaatgggtgtcacttatctagcattgatagccacattcaagatccagccgttcttagcattaggatttttcctcagaaaattaacatcgagagaaaacctcctcctcggcgtcggcctcgcgatggcaacgacactccagctcccagaggacatagaacaaatggccaacggaatagccctggggcttatggccctaaagctaataacccaattcgaaacataccaactatggacagctctcatatccttaacctgttcaaacacgatatttaccttaacggtagcctggcggacggctacgctcatcctagcaggagtatccctcctgccggtttgtcagtcctcttcgatgcgaaagacagattggctcccaatgaccgtagccgccatgggggtaccacccctacctctcttcatcttcagcctcaaagacactctcaaacgacggagctggccactcaacgagggagtgatggccgtaggcctcgtctcaatcctggccagctcacttttgcgaaacgacgtgcccatggccggccccctcgtcgcgggtggcctacttatagcgtgctatgtgattacgggaacgtccgccgacttgactgtagaaaaagcggcagacgtgacgtgggaggaggaggccgagcaaacaggagtgtcacacaacctgatgataaccgtggacgacgatgggaccatgcgaattaaggacgacgaaactgaaaacatcttgactgtcctactcaaaacagcgctcttaattgtgagcgggattttcccgtacagcatcccagcaacattgctagtctggcatacctggcaaaagcaaactcaacgatctggagtcctatgggatgtgcccagtccacccgagacacaaaaagccgaactcgaagaaggagtttaccggataaagcaacagggcatattcggaaaaacacaggtgggcgtgggagtacaaaaggaaggggtctttcacaccatgtggcacgtcacgagaggggccgtgctcacttataacgggaaacgactcgaacccaactgggcctcggtcaagaaagacctaatttcctacggcggaggatggaggctatccgcacaatggcagaagggtgaagaagtccaggtcattgcagttgagcccgggaagaaccccaaaaattttcaaacaatgccgggcacttttcagacgaccaccggggagatcggcgcgatagccctagactttaagccgggaacgagcgggagcccaataattaacagagaagggaaggtagtaggtctgtacggaaatggcgtggtgaccaagaacgggggatatgtttccgggatcgcccagacaaacgccgaaccagatggaccaacccccgaactcgaggaagaaatgttcaaaaagcgaaacctaacaataatggacctccacccgggctcagggaagacgcgcaagtacctacccgcaatcgttcgcgaggcgatcaaacgccggcttcgaacgctcatactggccccgacccgggtagtagcagcagaaatggaggaggcactaaagggcctcccaatcagataccaaacgacagccacaaaatccgaacacaccggacgagaaattgtagatctgatgtgtcacgccacctttactatgcggctactttcccctgttcgcgtacccaactacaacctgatcattatggacgaggcacatttcacagacccggcatccatagctgcgcggggttacatatccacacgcgtcgggatgggtgaagccgctgcgatattcatgacagccacaccacccggcacagctgacgccttcccccagtccaacgcgccgatacaggacgaggaacgggacatccccgagcgaagttggaacagcggaaacgaatggatcacagacttcgcaggtaaaaccgtctggttcgtaccaagcataaaagccgggaacgacatcgcaaactgcctacgcaaaaacggcaaaaaggtaatccaattgagcagaaagacgttcgacactgagtaccaaaagacaaaactgaatgattgggacttcgtagtaaccaccgatatcagcgaaatgggcgccaacttcaaagcggacagagtaatagaccctcgacgatgcctaaaaccagtcatcctgactgacgggcccgagcgcgtgatcctggccggaccaatgcctgtcacagccgccagcgctgcacaacgtcgcggacgagtgggaagaaacccccagaaagaaaacgaccaatacatttttactgggcagccactcaacaacgacgaggatcacgcacactggacagaggcgaagatgttactggacaatataaatacgcccgagggcataattccagctttgtttgaacccgaacgagaaaagtccgcggcaatcgacggcgaatacaggctgaagggggaaagccggaagaccttcgtagaactcatgagacgcggagacttaccagtgtggttggctcataaagtggcctcagaagggatcaaatatactgatcgcaaatggtgctttgacggccagcgcaataaccagatcctggaggaaaacatggacgtcgagatctggacaaaagaaggcgagaagaagaaactccgcccgagatggctggacgccaggacctacagcgacccgcttgccctaaaagagttcaaagacttcgcggcgggccgaaaaagcatcgcgttggacctggtcaccgaaataggccgcgtcccctcccacctagcacacagaacccgaaacgcacttgacaacttagtcatgctccatacaagcgagcacggtggaaaagcctacagacacgccgtggaagaactccccgaaacgatggagacactcttacttttagggttaatgatcctactgacgggtggagcaatgctgttcctaataagcgggaaagggatagggaaaacaagcataggcctgatctgcgtgatagcaagttctggcatgctctggatggccgaaataccactgcagtggatagcaagcgccatcgtgttagaatttttcatgatggtattactgatacccgaacctgaaaagcagcggacccctcaagacaaccaactagcgtacgtcgtcatcggaatcttaaccctagcagccataattgcggctaatgagatgggtttactggagacaaccaaacgggaccttggaatgagcaaagaacctggagtagtcagcccaacatcgtacctcgatgtcgatctccaccccgccagcgcttggacactctatgcagtagcaaccaccgtaataacgcccatgctgcgccacacaatcgaaaattcgactgcgaacgtcagcttagctgcaatcgcaaaccaagcggttgtactaatgggcctagacaagggctggcccatctcaaaaatggatctaggagtccccctcctagctctgggatgctactcgcaggtcaatccgttaaccctgaccgccgctgtacttctactgattacccattacgccataatcggacccggcctccaggcaaaggccacgcgggaggcacagaaaagaacagccgcaggaattatgaaaaatccaacggtagacggcataatgacgatagacctggacccggtcatctacgatagtaaattcgaaaaacaactggggcaggtaatgcttctcgtgctgtgcgccgtacaactacttttaatgaggacgtcttgggccctctgtgaagcactaacgctggcaacaggaccaataacaacactatgggagggcagcccaggtaaattctggaacaccaccatagcagtcagcatggcgaacatcttcagaggatcatatctcgccggagcgggacttgctttctcgattatgaaaagtgtgggtacgggcaagcgcggaacgggttcacaaggagaaacactaggcgagaagtggaaaaagaaattaaatcaactcagccgtaaagagttcgacctctataagaaatccggaataacggaggtagacaggaccgaggcaaaagagggtttaaaacggggtgaaattacgcaccatgcggtgtctagaggcagtgctaaactacaatggtttgtggaacgaaatatggtgatcccagaagggcgagtgatagacctagggtgcgggcggggcggttggagctactattgcgcaggactgaaaaaggtgaccgaagtcagaggttacaccaagggcggtcctgggcacgaggaacccgtaccgatgtcaacttacggctggaacatcgtgaaactaatgagtggtaaggatgtattctacctaccacccgagaagtgcgatactctcttgtgtgacataggagaaagtagcccatcacccacagtagaagagagtcgtacgattagagtacttaaaatggtagaaccctggcttaagaacaatcagttctgtataaaggtactgaacccgtacatgccgactgtcatagagcacctggagcggctacaacgcaaacacgggggtatgctagtgagaaaccctctgagtcgaaacagcacgcacgagatgtactggatcagcaacggaacagggaacatagtagcatctgttaacatggtctcaaggctgctactgaacaggttcacgatgacccaccgacgccccacgatcgaaaaggacgtagacctcggcgcaggcacccgtcacgtgaacgcagaacccgagacaccaaatatggacgtgatcggtgagaggatcaaacgcatcaaagaagaacacaactccacctggcactacgacgacgaaaatccctataaaacgtgggcataccatggctcatacgaagtgaaagcaaccggctcagcctcgagcatgataaacggggtagtgaagctcctaaccaagccgtgggacgtagtccccatggtcacgcagatggcaatgacagacacgaccccgtttggccaacaacgcgtgttcaaggagaaagtcgatactagaacaccgcggagcatgcctgggacacgccgcgtcatggggataaccgcggaatggctgtggaggaccctaggtcggaacaaaaagccgagactctgcacacgtgaagagttcaccaagaaagtccgtacaaatgccgccatgggagctgtcttcacggaagagaaccaatgggatagcgcaaaagcggccgtcgaggacgaagacttctggaagctggtggatcgcgagcgcgaactacacaaactcggaaagtgcggaagctgcgtctacaacatgatggggaaacgcgagaagaaacttggggagttcgggaaagcaaagggaagccgagcgatctggtacatgtggctcggcgcccgatatctcgaatttgaagcgttaggatttctaaacgaggaccattggttcagccgggaaaacagttactctggggtagagggcgaggggctacacaaactcggctacattctccgagacataagtaaaataccaggtggcgcaatgtacgcggacgacacagcagggtgggatacccgcatcacagaagacgatctacacaacgaagaaaagatcacccaacaaatggaccccgagcaccgacagcttgcaaacgcaatatttaaactaacataccagaacaaggtcgtaaaggtacagagaccgacccctaccggcacagtaatggacatcatctcccgtaaagaccaaagaggaagcgggcaggtagggacttacggccttaacaccttcacgaacatggaggcccagctcataaggcaaatggagggagaaggagtgcttagtaaggcagacctcgaaaacccacacctacccgagaaaaagatcacccaatggctagagacgaagggagtcgagaggctaaaacggatggcaatcagcggcgacgactgcgtagtgaagcccatagacgatcgattcgcgaatgccttgttggccctgaatgacatgggtaaagtacggaaggacataccgcagtggcaaccatcaaaaggctggcatgactggcagcaggtaccattctgctcgcatcactttcatgaattaatcatgaaagacggtagaaagctagtcgtcccgtgcagaccgcaggacgagttaataggtcgagcacgaataagtcaaggggccgggtggtctctaagagaaacagcatgcctcggtaaagcatacgctcagatgtggagcctgatgtacttccaccgacgggacttacgccttgcgagcaatgcgatatgtagcgccgtacctgtacactgggttccaacgtcgcgaactacatggtctattcacgcacaccaccaatggatgaccaccgaagatatgctaacagtatggaaccgcgtatggattgaagacaacccttggatggaagataaaacgcccgttaccacatgggaaaacgtgccgtacctaggcaagcgggaagatcaatggtgtggctcactgatcgggcttactagcagagcgacctgggcgcaaaatataccgacagctatacagcaggtacgcagtcttatcggcaacgaggaatttctagactatatgccgtcgatgaagaggttccgaaaagaggaagaatcagaaggcgccatatggtaa

SEQ ID NO: 26090 - RNA, 9873 nt, synthetic construct
  misc_feature 1..9873: note = derived and/or modified CDS sequence (opt11) from DENV-3__EU482613__SS-prME
  source 1..9873: mol_type = other RNA
acatcgctctgcctcatgatgattctaccggctgcactagccttccacctcaccagtcgagatggtgagcctagaatgattgttgggaagaacgagcgcggaaagagcctactattcaaaacagccagcggcataaacatgtgtacgctcatagcaatggacttgggcgaaatgtgcgacgacacagtaacctacaagtgcccccacataacagaagtcgaacccgaggatatagactgttggtgcaatctaacatccacctgggtgacctacgggacctgcaatcaggcaggggagcaccgtagagacaagcgaagcgtagcacttgcgccgcacgtggggatgggactcgacacccgtacgcaaacctggatgagcgccgaaggcgcctggcgtcaagtcgagaaggtggaaacgtgggcgctgaggcacccgggcttcacaattctggcgctctttctcgcacactacattggcacctctttgacccaaaaagtggttatatttatactattgatgctcgtaacacccagcatgacgatgagatgtgtgggtgtagggaaccgcgactttgtcgagggtctgtctggggcaacgtgggtggacgtggttcttgagcacggtgggtgcgtcactaccatggcaaaaaacaaaccaaccctcgacatagaactgcaaaaaacagaagcaacacaactcgccacgctgcgtaagctctgtattgagggaaaaattacaaacatcacgacggacagcaggtgtccaacgcagggagaagcagtacttccagaagagcaagaccagaactacgtatgtaaacacacctacgtcgatagagggtggggaaacggctgcggcctatttggtaaaggttccctagtcacgtgcgcgaagttccaatgtctggaaccaatagaaggcaaagtagtacagtatgaaaacctgaaatatacggtgataataacagtgcacaccggcgaccaacaccaagtaggcaacgaaactcaaggggtgacggcagaaatcacaccacaggcctcaacgacggaagctatactccccgagtacggcaccctcggattggaatgtagcccccgtaccggcctagacttcaatgagatgatactgctaacgatgaaaaacaaggcgtggatggtgcaccgacaatggttcttcgacctgccgctgccttggacatcaggcgccacaacggagacccccacatggaataggaaggaactgctggtgaccttcaaaaacgcacacgccaaaaaacaagaagttgtggtactaggcagtcaagagggggcgatgcatacggcgctcactggggcgactgagatacagaacagcggggggaccagcattttcgcgggacacctaaagtgtagactaaaaatggacaaactcgaactaaagggcatgagctacgccatgtgcactaacacgtttgttctgaagaaagaggtctccgaaacccagcacggcactattctaataaaagtcgaatacaaaggagaagacgtcccttgcaagataccgttcagcacggaagacggacaaggcaaggcacacaatggacgcctaattacagccaaccccgtcgtcacaaagaaggaggaaccagtcaacatagaagccgaaccaccgtttggagagagcaacatagtaattggcataggcgacaacgccttaaagatcaattggtacaaaaagggaagctcgataggtaaaatgttcgaggcgaccgcgagaggtgcgcggagaatggcgatcctaggtgacaccgcatgggacttcggaagcgtaggcggggtccttaatagccttggcaaaatggtacaccaaatatttgggtcggcgtacaccgcattgttctcgggggtgtcatgggtgatgaagattggtattggagtactccttacctggataggcctaaactccaaaaataccagcatgtccttcagctgtatcgccatcgggataataacactttacctcggcgccgtcgtacaggccgatatgggatgcgtgattaattggaaaggaaaggaattaaaatgcggcagcggcattttcgttacgaacgaggtccatacatggacggaacaatataaattccaagcagactccccgaaaagactggctaccgccatagccggggcctgggaaaatggagtgtgcggaattagaagtacgacccggatggaaaatctactatggaagcaaatagcgaacgagctgaattacatattatgggaaaacaacataaaactgactgtggtagtgggagacataataggtgtactggaacaggggaagcgaaccctaaccccgcaaccaatggaactaaaatactcgtggaaaacctggggcaaggcgaagatagtgaccgctgaaacgcagaactcgtcgtttatcatagacgggccaaacacacctgaatgccctagcgcatccagagcatggaatgtctgggaagtggaagattatggatttggagtcttcacgacaaacatctggctaaaacttagagaggtatacacacaactgtgtgatcacagactcatgtccgcggctgttaaggacgagagagccgtccatgccgacatggggtactggatcgaaagtcaaaagaacggttcatggaagttagagaaggcgagcctcatcgaggtaaaaacatgcacatggccaaaatcacatacgctgtggtcaaacggagtgctcgaatccgacatgatcatccccaagagcctagcgggccccatatcccaacacaactaccgtcccggatatcatacccagacggcgggaccatggcatctcggcaaactcgaactggacttcaactactgtgaagggacgaccgtcgtcatcaccgagaactgtggcacgcgcggcccgagccttcgaaccactaccgtttccggaaaactaatacatgaatggtgctgtaggtcctgcactctgccaccactgagatacatgggcgaagacgggtgctggtacggcatggagatacgaccaatctcggaaaaagaagagaacatggtaaaatccttggtaagcgcggggtcgggggaagtagacaatttcaccatgggagttctatgcttagccatcctatttgaagaagtgatgcgagggaagtttgggaaaaagcacatgatagcaggagtattctttacatttgtgctactgctgtcaggccaaataacgtggagagacatggcacatacgttgattatgatcggcagtaacgcctcggaccgtatgggaatgggagtcacatacctggctcttatcgcaacgttcaagatacaacccttcttagcgctgggcttcttcctgagaaagctgacttcccgcgagaacctgttactaggagtcgggcttgccatggccacaacccttcaactcccggaggacatcgaacaaatggcaaacggcatcgccctagggctcatggcccttaaactcataacccagtttgagacctaccagctttggacggccctaatatcgctgacctgctcaaacacgatctttacacttacagttgcctggcgaacagccacacttatcctggctggagtcagccttctaccggtatgccaaagcagctccatgaggaaaacggactggcttccaatgaccgtggcagccatgggcgttccaccactgccactctttatattttccctaaaggatacactaaagaggcgcagctggccgctcaacgaaggagtgatggcagtcgggctcgtaagtattctagcgagtagtctcctccgcaatgacgtacccatggcaggtcccttggtggcaggaggactactcatcgcatgttacgttatcacggggacctccgccgacctcactgtagagaaagccgcagacgttacatgggaggaggaagcggagcaaaccggtgtaagtcacaacctaatgataaccgtagacgacgacgggacaatgcgaatcaaagacgacgagactgagaacatcctcaccgtcctccttaagaccgctctcttaatagtgtcaggaatattcccgtacagcattccagctacactcctcgtatggcacacatggcagaaacaaacgcaaagatcgggagtgctgtgggatgtaccgtcgccacctgagacccaaaaagcggagttggaagagggcgtgtaccgaataaagcaacaaggaattttcggaaaaactcaagtcggagtaggagtccagaaggaaggcgtcttccacacgatgtggcacgtgacacgaggcgcggtcctgacttacaacggcaagcgactcgagcccaactgggcctcagtgaaaaaggaccttatctcctacggaggagggtggagactatcagcccaatggcagaagggagaagaagtacaagtgatagccgtggagcctggcaagaatccgaaaaactttcagacgatgccaggcacctttcaaaccactacgggcgaaatcggagccatagctctagacttcaaacccggcacaagcggaagcccaataataaatcgcgaaggcaagatagttgggctatacgggaacggagtagttacgaaaaacgggggatacgtgtcagggatcgcacaaaccaacgcggagccagacggaccaacaccggaattagaggaggagatgttcaaaaaaaggaatctaacgataatggacctccatcccggaagcgggaagacacgcaaatacctcccggccatcgtccgagaagctatcaagaggcggctaagaactttaatccttgcccccacgagagtggtcgccgcagaaatggaagaggcattgaagggactgccaatacgctatcaaaccacagccacaaagtcggagcatacaggcagagaaatagtggacctgatgtgccatgcgactttcacaatgaggcttctcagccccgtgcgagtgcccaattataacctaattatcatggacgaagcacatttcaccgatccggcctcaatagccgcaaggggctacatcagcacacgggtaggcatgggggaggccgcagccatcttcatgacggcgacccctcccggcaccgccgacgcctttccccaaagcaatgcacccatacaagacgaagagagggacatcccagaacgaagctggaactccggcaacgagtggatcacggattttgcaggaaaaactgtctggtttgtacccagcataaaagcggggaacgatattgcaaactgcttgcgcaagaatggtaaaaaagtcattcaattgagtaggaagacattcgacacggaatatcaaaaaaccaagctaaacgactgggacttcgtcgtaaccacagatatctccgaaatgggtgctaatttcaaggccgacagggtcatagatcccagacgatgtctgaagccagtcatcctcacagacggtcccgaacgggtcatcttggcaggaccaatgccagtcacggcagccagcgcagcgcaacgtcgcggacgagtaggaagaaaccctcagaaggaaaacgaccaatatatcttcaccggacagcctcttaacaacgacgaagaccacgcacattggactgaagcaaaaatgttactggacaacattaacactccagaaggcataatcccggcactgttcgaaccagagagggaaaagagcgccgccatcgatggggaataccgactaaagggtgagtcccggaaaaccttcgtcgagcttatgagaaggggcgacctaccggtatggctggcccacaaggtcgcctcggaaggcataaaatacacagaccgtaagtggtgcttcgatgggcagcgtaataaccaaatcctcgaagaaaacatggacgtcgaaatctggacgaaggaaggggagaaaaagaagctacggccgagatggctagatgctcgcacttacagcgaccctcttgccctcaaggagtttaaggacttcgccgctggccgaaaatccatagcgctagacctagtcacagaaatcgggcgagtaccgactcatctggcacaccgaaccagaaacgccttggacaacctcgttatgttgcataccagtgaacacggaggcaaggcatacagacatgcagtggaggaactgcctgaaacaatggagacactactgctactggggctaatgatacttctcaccggtggagccatgttatttctcatctcaggaaaagggatcggaaaaaccagcataggattaatctgcgtgatcgcttccagtgggatgctctggatggccgaaatccccctacaatggatagcatctgcaatcgtattggaattcttcatgatggtactgctgataccagaacccgaaaaacaacgcaccccacaagataaccaactcgcatacgtagtaataggcattctaacgttagcggcaatcatagcggcaaacgaaatgggtctcctagagactaccaaaagagacctaggaatgtcaaaagaaccaggagtcgttagcccaacgtcgtacctggacgtcgacttacatccggcttccgcctggaccctatacgccgtagccaccacagtgattaccccaatgcttaggcacacaatagagaacagtacagccaatgtgagccttgcagcaatagccaaccaggcagtcgtgctgatgggacttgacaaaggatggccaatctcgaaaatggacctgggcgtacccttgcttgcgttgggctgctacagtcaggtcaacccattaaccctgaccgcagccgtacttttgctaatcacacactacgctattataggaccaggattacaagccaaggccacacgcgaagcacaaaagcgcaccgcagcaggcatcatgaaaaaccctaccgtggatgggatcatgacaatcgatctcgacccagtcatttacgattcaaaatttgagaaacagctcggacaggttatgctacttgtactatgtgcagtacagctgctactgatgcgcacgtcgtgggccctttgcgaagccttaacgctggcaacgggacctatcacaactttatgggaaggcagccccgggaaattctggaacaccaccatcgcggtatcaatggcaaacatattccgcggatcatacctagcgggggcggggctcgcattctcgataatgaagagcgtgggcacgggcaagcgaggcacggggtcgcaaggagaaacattgggtgagaaatggaagaagaagctgaatcagttgtctcgcaaagagttcgatctctacaaaaagtcaggcataactgaagtggaccgaacagaggcaaaggaaggcctgaaacggggagagattacacaccacgcagtgagccgaggcagcgcgaaattacaatggttcgtcgagcgaaacatggtgataccagaaggacgcgtaatagacctaggctgcgggagggggggctggagttactattgcgccgggttgaaaaaagtcaccgaggtgcgaggctataccaaaggaggaccaggacacgaggaaccagttccaatgagcacctacgggtggaacatcgttaagctaatgagtggcaaggacgtattctacctgccgcccgaaaagtgcgatacactattatgtgacattggcgagagctcaccaagtcccaccgtagaagaaagcagaacaatccgagttctgaagatggtagaaccgtggctgaagaacaaccagttctgcataaaagtcctaaacccctatatgccgacggtcatagaacaccttgaacgcctacaacgcaagcatggaggcatgctagttagaaatccgctctcaaggaacagcacgcacgaaatgtattggatctccaacggaacggggaacatcgtggcaagtgttaacatggtatctcgactcctcctgaatcgatttaccatgacacaccgacgaccaacaatagaaaaagacgttgacctaggcgccggaacgcgccacgtaaacgctgaaccggaaacccccaacatggacgtcattggagaaagaataaagaggatcaaggaggaacacaactctacgtggcactacgacgacgaaaacccgtataaaacatgggcgtaccacggatcatacgaggtgaaagcaacaggcagtgcctcttccatgatcaacggtgtggtcaagttgctaacaaagccctgggatgtagtccccatggtcacgcagatggctatgacagacacaaccccattcggccagcaacgggtctttaaggagaaggtagacactcgcactccaagatccatgccagggacgcgacgcgtgatgggcatcaccgccgagtggctgtggagaacactcggtaggaacaaaaagccgagactgtgcacacgggaggagttcacaaagaaggttcgaaccaacgcagcgatgggcgcagtcttcacggaggaaaaccagtgggacagcgcgaaggctgcagtagaagatgaagacttctggaagttggtggaccgggaacgagaactacacaaactcggaaagtgcggcagttgcgtatacaacatgatggggaagcgtgaaaagaaactgggagaattcggcaaagcgaaaggatcgagggcaatctggtacatgtggctgggtgcccgctacctggagttcgaggccctaggtttcctaaacgaagatcattggttcagcagggaaaacagttacagtggcgtcgaaggcgaagggctacacaagctcggctacatactcagggatattagcaaaatacccggaggggcgatgtacgcggacgacacggcaggttgggacacgcgaatcacggaggacgatctacacaacgaagaaaagatcactcaacagatggaccccgagcatcggcaattggcgaacgcgatcttcaaacttacatatcagaataaggtcgtcaaggttcaaagaccgactcctacaggaacagttatggacataatctcgcgtaaagaccagcgcggctcaggacaggtcgggacatatgggctaaacacctttactaacatggaagcccaattaatacgacagatggaaggcgagggggtattaagtaaagccgaccttgagaaccctcacctaccagagaaaaagataacacaatggcttgagaccaagggggtggaacggcttaagcgcatggctataagtggcgatgattgtgtcgtgaagccaatcgatgaccgattcgctaacgctcttctagcccttaacgacatgggtaaagtgcggaaagacataccgcagtggcaacccagcaaaggatggcacgactggcagcaagtacccttctgctcccaccatttccacgagttaattatgaaagacgggagaaagctagtagtcccatgccgaccccaggacgaattaatcggccgcgcgagaatatcacaaggggcaggttggagcctgagagagacggcatgcttaggaaaagcatacgcacaaatgtggtccctaatgtactttcatagacgtgatctgcgactcgcgagcaacgccatatgctccgctgtacccgtccactgggtcccaacatctcgcacaacatggagcatacacgcgcatcatcaatggatgaccaccgaggacatgctcaccgtgtggaatcgggtgtggattgaagacaacccctggatggaggacaaaaccccagtgacgacatgggaaaacgtaccgtacctgggcaagcgagaagaccaatggtgtggcagtctaatagggctaacttcaagggcgacttgggctcagaacataccaacagcaatccagcaagtgaggagcctaataggaaatgaagagttccttgactatatgcctagcatgaagcgctttagaaaagaagaagagtcagaaggtgcgatatggtga

SEQ ID NO: 26091 - RNA, 9873 nt, synthetic construct
  misc_feature 1..9873: note = derived and/or modified CDS sequence (opt11) from DENV-3__EU529690__SS-prME
  source 1..9873: mol_type = other RNA
acatcgctgtgcctcatgatgatcttgcccgccgccctggccttccacctcaccagcagggacggcgagccccggatgatcgtggggaaaaacgaacggggtaagagcctgctgttcaagaccgcatccgggatcaacatgtgcaccctcatcgccatggacctgggcgagatgtgcgacgacaccgtcacttataagtgccctcacatcactgaggtggagcccgaggacatagactgttggtgcaatttgaccagcacctgggtgacctacgggacttgcaatcaagccggcgaacaccggcgagataaacgctccgttgctttggcaccccacgtcggcatggggctcgataccaggactcagacctggatgagcgctgaaggcgcctggaggcaggtcgagaaggtcgagacgtgggcgctgcggcatccggggtttaccatccttgcgcttttcctggcccactacatcggcacctccctcactcagaaggtggtgatctttattctactaatgctcgtgacgcccagcatgactatgaggtgcgtcggggtgggcaaccgcgatttcgtcgagggcctgtccggggccacctgggtggatgtggttttggagcacggcggctgcgtaaccacgatggccaagaacaagccgaccctcgacatcgaattgcagaagaccgaggccactcaactggcgaccttgcgcaagctgtgcatagagggcaaaatcaccaatatcacgactgatagccgctgtcccactcagggggaagccgtactgccggaggagcaggaccagaactacgtctgtaagcacacctacgtggaccgggggtggggcaatgggtgtggcctctttgggaagggatccctggtgacctgcgccaagttccaatgcctggagcccatcgagggtaaggtagtgcaatacgaaaacctaaagtacacagtgatcatcaccgtccacaccggggaccagcatcaggtgggtaatgagacccaaggggtcacggcagagatcacgccccaggccagcaccacggaggctatcttgcctgagtacggcaccctggggctcgagtgttcgccgcgcacgggcctggacttcaacgagatgatcctactcaccatgaagaataaggcctggatggtgcacaggcagtggttcttcgatctccccctgccctggacttcgggcgctaccaccgagaccccaacctggaaccgaaaggaactcctggtcaccttcaagaacgcccatgccaaaaagcaggaggtggtggtgctggggtcccaggagggggcgatgcacaccgccctcacgggtgccaccgagatccaaaacagcggcggcacctcaattttcgctggccacctgaaatgccggcttaaaatggacaagctagagcttaagggcatgagctacgcaatgtgcactaacaccttcgtactgaagaaggaggtctctgaaacgcaacatgggaccatattaataaaggtggaatataaaggggaggacgtaccgtgcaagataccgttcagcaccgaggacgggcagggcaaggctcataatggccgtctgatcacggccaaccccgtggtgaccaagaaagaggagcccgtgaacatcgaggcagagccgcccttcggggagagcaacatagtgatcggcattggggataacgccctgaagattaactggtacaaaaagggatcaagcatcgggaaaatgttcgaggccactgcccggggcgcgcgccggatggccattctgggcgacaccgcctgggactttgggagcgtaggaggggttttgaactctctgggcaaaatggtgcaccagatctttgggtccgcctacacggctctgttctcgggcgtttcctgggtcatgaagataggcataggggtactactgacctggatcgggttaaacagcaagaacacatccatgagcttctcctgcatcgccatcggcatcatcacgctatacctgggcgctgtggtccaggccgacacggggtgcgtgataaactggaaaggcaaggagctgaagtgcggcagcggaatcttcgtaaccaacgaggtccatacctggactgagcagtataagtttcaggcagactcccccaaacgcctagccacggccatcgccggcgcctgggagaacggggtatgcggcatccgcagcacaactagaatggaaaatctgctttggaagcagatcgcgaacgagctaaattacatcttatgggagaacaacatcaagctgacagtggtcgtcggtgacatcatcggtgtgctcgagcagggcaagaggacgctgacgccccagccgatggaactgaaatactcctggaagacctggggaaaagctaagattgtaacagccgagacgcagaacagctccttcatcatcgacggccccaacacccccgagtgcccctcggcctcgcgggcgtggaatgtctgggaggtggaggattatgggttcggcgtcttcaccaccaacatttggctcaagctgagagaggtatatacccagctatgcgaccatcggttaatgagcgccgccgtgaaggatgaaagagccgtccacgccgacatgggttattggatcgagagccaaaagaacggttcctggaagctggagaaagcatccctgatagaggtgaagacttgtacctggccaaaaagccacacattatggtcaaatggcgtcctagaatccgacatgataatccctaagtcattggctggtccaatatcccagcataactaccggcccggctaccacacccagacggccgggccgtggcacctaggcaagctggagctcgacttcaactactgcgaggggaccaccgtggtgatcactgagaactgcggaacccgcggcccgtctttgcggaccaccacggtgagtgggaagctgatccatgagtggtgctgccgcagctgcacgttacccccgctcagatacatgggcgaagacgggtgttggtacgggatggagatccgtcccatctccgagaaggaggagaatatggtcaagagcctggtgagcgccggatcaggggaggtggacaacttcaccatgggcgtcctttgtctcgccatcctgttcgaagaggttatgcgggggaaattcggcaagaaacacatgatcgcgggggtgttcttcaccttcgtcctgctcctgtccggccagataacgtggcgcgacatggcccacacgctgatcatgataggtagcaatgccagcgaccggatgggtatgggcgtgacctatctggccctgattgccacctttaagatccagcccttcctggcgctagggtttttcctgaggaagctaaccagtcgggagaacctcctgcttggggtgggcctcgcaatggcaacgaccctgcagctgcccgaagacatcgaacagatggccaacgggatcgcgttgggcctgatggcacttaagctcatcactcaattcgagacctaccagctttggacggcccttatcagcctgacctgctccaacaccattttcaccctgacggtcgcctggcgcaccgcgacactgatcctggcaggggtgtcgctcctgccggtctgccagtccagttccatgcgtaagacggactggctccccatgacggtggccgctatgggcgtgccgcccttaccgctgttcattttcaatctcaaggacacgctgaagcgccgcagctggcccctaaatgagggggtcatggccgtcggcctcgtctcaatcctggcctcgtccctgctacggaacgatgtccccatggcgggccccctggtggccggtggcctcctcattgcctgttacgtgatcaccgggaccagcgcggatttgacggtcgagaaggccgcggacgtgacctgggaggaggaggcagagcagaccggtgtctcgcacaacctgatgatcacagtggacgacgatgggacaatgcgcatcaaagacgacgagacagagaacatactcacggtgctcttgaaaactgcgctactgatcgtgagcggcatcttcccgtattccatacctgctaccctgctagtgtggcacacgtggcagaaacagacgcaacggagcggcgtgctgtgggacgtgcccagcccacccgagacgcagaaagccgagctggaggagggggtctaccgcatcaagcagcagggcatcttcggcaaaacgcaagtgggcgtgggggtccagaaggaaggggtgttccatactatgtggcatgtgacccggggcgcggtccttacctacaacgggaagcgcctggaaccaaattgggccagcgtgaagaaagatctgatctcctacggcggaggctggcggctcagcgcccaatggcaaaaaggagaagaggtgcaggttatcgcggtggagcccggcaagaaccccaagaacttccagactatgccgggcacgttccagacgaccaccggggagatcggcgcgatagccctcgactttaagcccggaacgtccggcagtcccatcatcaaccgcgaaggaaaggtagtcggtctctacggcaacggggtcgtgaccaaaaatggagggtacgtcagcggcatagcacagaccaatgccgagccggacggacccacacccgagctggaggaggagatgttcaagaaacggaacctaacgataatggacctacaccccgggtccggcaagacacgcaaatacctcccggcaatcgtgagagaggcgatcaagagacggctccgcaccctgatcctggcccccacccgggtggtcgccgccgagatggaggaggccctcaaggggttacccatacgctaccaaacgaccgcgacaaagagcgagcacacgggacgggaaatagtggacctgatgtgccacgcaacctttacaatgcgcttgctgtccccggtgcgggtcccgaactacaacctgatcatcatggatgaagcccatttcactgaccccgcaagcattgccgcgagaggttacatctcgactcgggtgggcatgggcgaagccgccgctattttcatgaccgcaacgccgcctggaaccgccgacgccttccctcagagcaacgcccccatccaggacgaggaacgcgatatccccgaacgctcgtggaactctggcaacgaatggatcaccgatttcgccgggaagacggtgtggttcgtgccttcaatcaaggcgggcaacgacatagccaactgcctccgcaagaatgggaaaaaggttatacagctgagccgcaagaccttcgacaccgagtaccagaaaacaaaactgaacgactgggacttcgtagtcactaccgacatatccgaaatgggcgcgaatttcaaagccgaccgtgtgatcgacccgcgccggtgtctcaagcccgtaatcctgaccgacggccccgagcgcgtcatcctggccgggcctatgccagtgacggcggcgagcgccgcccagcggcgcggccgggtggggaggaacccgcagaaggagaacgatcagtacatcttcaccggtcagccgttaaacaacgatgaagaccatgcccactggacagaggcgaagatgctgctggacaacataaacacacccgagggcattatcccggccctcttcgaaccggaacgggagaaatccgccgccatcgacggcgagtatcgcctgaagggagagtctcggaagaccttcgtcgaactcatgcgacgcggggacctccccgtctggctcgcgcacaaggtcgcatccgagggcatcaagtacaccgaccggaagtggtgcttcgacggtcagagaaacaaccagatcctggaggagaacatggatgtggagatctggacgaaggagggcgagaagaaaaagctgcgcccccggtggcttgacgctcgcacctattcagacccgctggccctaaaggagttcaaagacttcgcagccggccgtaagtcgatcgctctcgacctggtgaccgagatagggcgggtgcccacgcatcttgcacatcgcacgcggaacgccctggacaacttggtcatgctccacaccagcgaacacggcggcaaggcgtaccggcacgcggtggaggagctgcccgagactatggaaaccttactcctgctgggcctcatgatcctgcttaccggcggggcgatgctgtttcttatatccgggaaggggatcggcaagacaagcatcgggctgatctgtgtaattgcctcatccggcatgctatggatggccgaaataccgctacagtggattgccagcgcgatagttctggaatttttcatgatggtgctcctgatacccgagccagagaaacagcggacgccccaagacaaccaactggcctacgtggtgattgggatactcaccctggccgccattatcgccgcgaacgagatggggcttctcgagaccaccaagcgcgacctaggaatgtccaaggagccgggggtggtctcccccacctcctacctggatgtggatctccacccagcttcagcctggaccctgtacgctgtggcgacgaccgtaatcacccccatgctgcggcacactattgaaaacagcaccgccaacgtatcactcgccgctatcgctaaccaagctgtagtactgatggggctggataagggatggccgatatctaaaatggacctcggcgtgccgctgctggctctagggtgctacagccaggtgaaccctctgacgttgactgccgccgttctcctgctcatcactcattacgcgatcattggccccggcctccaggcgaaggccacgcgcgaggctcagaagcggacagccgccgggatcatgaagaatccgactgtcgacggcataatgacaatcgacctggaccctgtgatctacgattccaagttcgagaagcagctggggcaggtcatgcttctggtgctgtgcgcggtgcagctcctgctcatgcgcacctcttgggccctctgcgaggccctcactctcgccaccggccccatcaccacgctctgggagggctctcccgggaagttctggaatacaaccatcgcggtgagcatggcaaacatcttccggggctcctatctcgcgggtgcaggactggcattctcgatcatgaagtccgtagggaccgggaagcggggcaccgggagtcagggcgagaccttgggtgagaagtggaaaaagaagttaaaccaactgagccggaaagagttcgacctctacaagaaatccggcataaccgaagtcgaccgtaccgaggcaaaggaggggctgaaaagaggagagatcacccaccacgccgtcagccgcggttccgcaaagctgcagtggttcgtggaacggaatatggtgataccggaggggcgagtcatcgacctgggctgcgggcggggtgggtggtcttactactgtgccggactgaaaaaggtaactgaggtacgcggatacaccaaaggcgggcccggtcacgaggagcccgtccccatgtcgacgtacgggtggaacatcgtgaagctgatgagcggaaaggacgtcttctatctgcctcccgaaaagtgtgacaccttgctttgtgacatcggcgagtccagcccctccccgacggttgaggagagccggacgatcagggtgctcaagatggttgagccgtggctcaaaaacaaccagttctgcatcaaagtcttaaacccctacatgcccaccgtgattgagcaccttgagcgtctccagcggaaacatggcgggatgctagtgcgcaatcccctgtccagaaatagcacccacgagatgtattggatttcaaacggaacggggaatatcgtcgccagcgtgaacatggtgtcccgactcctgctgaatcggttcactatgacgcatcgccggccgactatcgagaaggatgttgatctcggcgcgggaactcgccatgtgaacgccgagcccgagacccccaacatggacgtcatcggagagcggatcaagagaatcaaggaggagcataacagcacatggcactatgacgatgagaacccgtacaagacctgggcataccacggctcctacgaagtaaaggccacggggagcgcatctagtatgatcaacggcgtggtcaagttacttaccaagccctgggatgttgtgcccatggttacgcagatggcaatgactgacacgaccccgttcgggcagcagcgggtttttaaggagaaagtggatacccgcacaccgcgttccatgcccggcacacggcgggtcatgggcataaccgcggagtggctctggcgcaccctggggcggaataagaagccccgcctgtgcacccgggaggagttcacgaagaaggtgagaacgaacgccgccatgggcgcggttttcaccgaagagaaccagtgggactcagccaaggccgcagtcgaggatgaggacttttggaagctcgtggacagagagcgggagctacacaaattagggaagtgcggctcttgcgtgtataacatgatggggaagagggagaaaaagctcggcgagtttggcaaggccaaggggtccagagcaatctggtacatgtggctgggcgcacgttacctggagtttgaggccttggggtttttaaacgaggaccactggttcagtcgtgaaaacagctacagcggcgttgagggtgagggcctgcataaactcggttacatcctgcgtgatatctccaagatcccgggtggcgccatgtacgccgatgacacagcgggttgggacacgcggataaccgaagatgacctacacaacgaggagaagatcacccaacagatggacccggagcaccgccagctcgccaatgccatatttaagctgacttaccaaaacaaggtggttaaagtccagagaccgacccccactggcactgtgatggacatcatcagccgcaaagaccagcggggttccggccaggtggggacatatggactcaacactttcacgaatatggaggctcaactcatccggcagatggagggagagggggtcctgagcaaagccgacctggagaatccccatctgccggagaagaagataacacagtggctcgagaccaaaggggtggagaggctgaagcgcatggcgatcagtggtgacgactgcgtggttaagcccatcgacgacagattcgccaacgccctcctcgcattgaatgacatggggaaggtgcgcaaggacatcccccagtggcaacccagcaaaggctggcacgactggcagcaggttccgttctgcagccaccacttccatgagctaatcatgaaggacggacggaaactcgttgtaccgtgccgtccccaggacgaactgatcggccgggcaagaatcagccagggggcgggatggtccctccgggagaccgcctgcctggggaaagcgtacgcgcagatgtggagtctgatgtacttccaccggagagacctccggctagcgtctaacgccatttgtagcgccgtgcccgtccactgggtccctacgtcccgcaccacctggagcatacacgcccaccaccagtggatgaccacggaggacatgctcaccgtgtggaatcgggtgtggattgaggacaatccatggatggaggacaagacccctgtaaccacatgggagaacgtgccctacctcgggaagcgggaagaccaatggtgcggttccctgatcgggttgactagcagagctacctgggcgcaaaacatcccgaccgccatccaacaagtccgctctctcattggcaacgaggagttcctggactacatgccatccatgaagcgtttcaggaaggaagaggaatcggagggggcgatctggtag

SEQ ID NO: 26092 - RNA, 9873 nt, synthetic construct
  misc_feature 1..9873: note = derived and/or modified CDS sequence (opt11) from DENV-3__EU529691__SS-prME
  source 1..9873: mol_type = other RNA
accagcctgtgcctgatgatgatcttaccggccgctctggcatttcatctcacgagcagggatggtgagccgcgcatgattgtgggaaagaacgagaggggcaagagcctgctgttcaagacagccagcgggatcaacatgtgcactctcatcgctatggacctcggtgaaatgtgcgacgataccgtgacctacaaatgcccgcacatcactgaggtcgagcccgaagatattgactgctggtgcaacctgacaagcacctgggtaacctatggaacctgtaaccaggccggtgagcaccggcgcgacaaacggagcgtcgccctcgcgccccacgtgggtatgggcctggacacccgaacccagacgtggatgtctgccgagggagcctggcgccaggtggagaaggtcgagacgtgggccttacgtcaccctgggttcaccatcctagcgttattcctggcccactatatcggcacctccctgacccagaaggtcgtgatcttcattcttctgatgctagtcactcctagcatgaccatgcggtgcgtgggcgtaggcaaccgcgacttcgttgaaggcttgagcggagcgacgtgggtggacgttgtccttgagcacggtggatgcgtgaccaccatggcgaagaataaacccaccctcgacatagaactgcagaagaccgaggccacgcagctggctacgcttcgtaagctgtgcatcgagggcaagatcacaaatataacaactgacagccgatgccccacgcagggcgaggccgtactgcccgaagagcaggaccagaactatgtgtgcaagcacacgtacgtggaccgggggtggggcaacgggtgcggtctgtttggcaagggctccctggtaacgtgcgccaagttccagtgtctggagccaatcgaggggaaggtcgtgcaatacgaaaacctcaaatataccgtgattatcactgtccacaccggggatcaacatcaagtcggcaacgagacacaaggagtcaccgccgagatcacgccacaggcctctacaaccgaggcaatcctgcccgaatacgggaccttgggcctagagtgttccccgcgcaccggcctggactttaacgagatgatcctactcacaatgaagaacaaagcgtggatggtgcaccggcagtggtttttcgacctgcccctgccctggaccagtggcgccactactgagacgccgacgtggaacagaaaggaactcctggtgacattcaagaacgcacacgcgaagaagcaagaggtagttgtgctgggctcgcaagagggcgcgatgcacaccgccctcacaggggccacagaaatccagaactccggagggacctccatcttcgccggccacttaaagtgcaggctaaagatggacaaactcgagttaaagggcatgtcttacgccatgtgtacaaatacgttcgtgctcaagaaggaggtgtccgagacccagcacgggaccattctcatcaaggtggagtacaagggtgaggacgcaccgtgtaagatacccttcagcaccgaagatgggcaaggaaaggcccacagcggtagattaatcaccgcaaaccctgtcgtgaccaagaaagaggagcccgtgaacatcgaggccgagcctcccttcggggagtccaacatagtcataggcatcggcgataacgccctgaaaataaactggtacaagaagggcagctccatcgggaagatgttcgaggcgaccgcccggggtgcccgccggatggccatcctgggcgacaccgcgtgggacttcggcagcgtaggcggggtgctcaactccctgggcaaaatggtgcaccagatcttcgggagcgcatacacggcgctgttcagtggcgtgagttgggtgatgaaaatcggtatcggggtcctcctgacctggatcggcctgaattccaagaacacatctatgtctttctcctgcattgccgtggggataatcaccctatatctgggagccgtcgtccaggcggacatgggctgtgttatcaactggaaaggcaaggagctaaagtgcggctccgggatcttcgtgacgaacgaggttcacacctggaccgagcagtataagtttcaggcggattcacccaagcgtctggctacggccatcgcgggggcttgggagaacggagtatgtggcatacggtcgactacccgtatggaaaacctgctgtggaagcagattgccaacgagctcaactacattctatgggagaacaacatcaaactgaccgtggtggtgggtgatatcataggcgtgctcgagcaaggcaagaggacgctcaccccacagccgatggagctgaagtactcgtggaagacctgggggaaggccaaaatagtcactgcggagactcagaactccagcttcattatcgacggccccaacactcccgagtgccctagtgcgagtcgggcatggaatgtgtgggaagtggaagactacggcttcggtgtattcaccaccaacatttggcttaagctgcgagaagtgtacacccagttgtgcgaccaccggttgatgagcgcagcggtgaaagacgagcgcgctgtgcatgcagacatgggctactggatagagtcccaaaaaaacggtagctggaagctggagaaagcttccctgatagaggttaaaacttgtacgtggcccaagtcccacaccctatggtccaacggagtgcttgagagcgacatgattatcccgaaaagcctggccggacctatctcacagcacaaccatcggccaggttaccacacccagaccgcgggtccctggcacctaggaaaacttgaactggatttcaactattgtgagggcacgaccgttgtgatcaccgagaactgcggaacccgaggccccagtctccggaccacaacggtgtcaggtaaactgatacacgaatggtgctgcaggtcgtgcaccctgccccccctccggtacatgggggaggacgggtgctggtacggcatggagattcgccctatcagcgagaaggaggagaacatggtcaagtcgctggtgagcgccggctccgggaaggtggataacttcactatgggcgtcctgtgcctcgcaatcctgttcgaggaggtgatgcggggtaaattcggcaagaaacacatgattgccggggtgtttttcaccttcgttctgctactctctggacaaatcacctggcgcgacatggcccacaccctgatcatgatcggaagcaatgcaagcgaccgaatggggatgggcgtgacgtacttggccctgattgcgaccttcaagattcagccctttttagccctcggtttcttcctgcgcaagctgactagccgagaaaacctcttgctgggcgtaggcctcgccatggctaccacactgcagttacccgaagacatagaacagatggccaatgggatcgccctgggcctgatggccctgaagctcatcacccagttcgagacctaccagttgtggaccgccctgatctccctcacttgttcgaacacgatgttcactctgaccgtagcatggcgcaccgcgacactgatcctcgcgggagttagcctgctaccggtctgccagagctccagcatgagaaagacggactggttaccgatggctgttgccgccatgggcgtaccgcccctcccactcttcatcttctccctcaaggacaccttaaagagaaggtcatggcctctgaacgagggggtcatggcggtcggcctcgtgtccattctggccagctccctcttgcggaatgacgttccgatggccggtccccttgtggccgggggcctgctcatcgcatgctatgtgataaccggaactagcgcggacctcacggtagagaaagcggccgacatcacctgggaggaggaggctgaacagacaggggtcagtcacaacctgatgatcaccgtagacgacgacggtaccatgagaatcaaagacgacgaaaccgagaatatacttactgtgctgctgaagaccgccctgttgatcgtgtcaggcgtgttcccttacagcatccccgcgacactgctcgtatggcatacctggcagaaacagacccagcgttcgggggttctgtgggacgtgccgtcgccaccagagacgcagaaggctgagctggaggaaggtgtctataggattaagcagcagggcatttttgggaagacccaggtgggagtgggggtgcagaaggagggcgtgtttcatactatgtggcacgtgacccgcggcgccgtattgacgtacaacggtaagcgcttagaacccaactgggcaagcgtgaagaaggacctgatctcttatggcggaggctggcggttaagtgcccaatggcagaagggtgaggaagtgcaagtcatagcggtagagcccggaaaaaaccccaagaactttcagacaatgcccggcaccttccagaccacgaccggggagatcggcgccatcgcgcttgattttaagcccgggaccagcggctcccctatcataaaccgggagggcaaggtggtcggcttatatggcaatggggtggtcaccaagaacggcggatacgttagcggcatagcacagacgaacgccgaaccggacggcccaacccccgagctggaggaggaaatgtttaagaagcgaaacttgacgatcatggacctgcacccaggttccgggaagacgcgcaaatacctgccggctatagtgagggaggccatcaaaaggcggctccgcacattgatcctggcacccacccgggtggtcgccgcggagatggaagaggccctgaaagggcttcccatcagataccagactaccgctaccaaaagcgaacacaccggtcgcgagattgtggacctcatgtgccacgccaccttcaccatgagactccttagcccggtgcgggtacccaattacaacctgataatcatggacgaggcccacttcacggaccccgcgagcatcgctgcccgcggttacatcagcacacgggtgggcatgggcgaagccgcggcaatcttcatgaccgccacgccacccgggacggctgacgcctttccacagagcaacgcgcccatccaggatgaggagcgcgacattccggaacgctcctggaatagcggcaacgaatggatcaccgacttcgctggaaagacagtgtggttcgtcccctccattaaggccggaaacgacatcgccaactgcttgagaaagaacggcaagaaagtgatccagctgagccggaaaaccttcgacacggagtaccaaaagaccaaattgaacgactgggacttcgtggtcacgactgacatctccgagatgggcgccaacttcaaggccgatcgagttatcgacccgcgccgctgtctgaagcccgtgattctgacggacggccccgagcgcgtgatcctcgccgggcccatgccggttaccgctgccagcgccgcgcagcgaagaggccgggtcgggagaaacccccagaaggaaaacgaccaatacatattcaccgggcagcccctcaacaatgacgaagaccacgcgcactggaccgaagctaagatgctgctggacaacatcaacacccccgagggtatcatcccggccttgttcgagccagagcgggagaagtccgcggccatcgacggtgaataccgcttaaaaggcgagtctagaaagacgttcgtcgagttgatgcgccgcggagacctacccgtgtggctggcacacaaggtcgcctccgagggaatcaagtataccgatcgaaaatggtgctttgacgggcagcggaacaaccagatcctggaagagaacatggacgtggaaatttggactaaggagggcgaaaagaagaagctcagaccccggtggctcgacgcccgaacatacagcgatccactggcgctaaaggaattcaaggacttcgcggccggccgcaagtcaatcgcccttgacctggtgacggagatcgggagagtcccctcgcacctagcccaccgcacccggaacgctctagacaatctggtgatgctacacacctcggagcacggcggtcgcgcttatcggcacgccgtcgaggaactacccgagactatggaaacgctcctcctgctggggctcatgatactgctcaccggtggcgccatgcttttcctgatctctggaaagggaatcggcaagaccagcattgggctgatatgcgtgatagcctcctcaggcatgctctggatggcggaaatccctctgcagtggatcgcctccgccattgtgctggagttcttcatgatggtgctgttaatccctgagcccgaaaagcagcgcacgccccaggacaaccagttagcttacgtggtaatcgggatcctcactttagccgcgatcatcgccgccaacgagatgggactgctcgagacgaccaagagggacctgggaatgagtaaggagccgggggtagtttccccaaccagctacctggacgtagacctccaccccgccagcgcgtggaccctgtacgccgtcgccaccaccgtcataacgccaatgctgcgtcatacgatcgagaacagtaccgctaacgtgtccctcgcggcgatcgccaaccaggccgtggttctgatggggctggacaaggggtggccgatcagcaagatggatcttggagtgcccctgctggccttagggtgctattcgcaggtgaatcctctgaccttaaccgccgcggtactactgcttatcacgcactacgccattataggtcctggtctccaagctaaggcgacccgcgaggcgcaaaaacgcacagctgccggtatcatgaagaaccctaccgtggacggaattatgaccatcgacctggacccagttatctacgactcgaagttcgaaaagcagctggggcaggtcatgctcctagttctgtgcgctgttcagctcctgttgatgagaacctcctgggccctctgtgaggcgctgaccctggccaccggcccgatcacgaccttgtgggagggctctccagggaagttctggaatactacaatcgccgtctccatggccaacatcttccgaggcagctaccttgccggggcgggcctagccttctccatcatgaaatccgtgggaacaggaaagcgaggaaccggatcacagggcgagaccctcggggagaagtggaagaagaaattaaaccagctgtcccgcaaggagttcgacctctacaagaaatccggcatcacagaggtggacagaacagaggcgaaggaggggctcaagcgcggggagacgactcaccacgccgtctcccggggatcggcgaagctgcagtggttcgtggagcgcaatatggtgatccccgaagggcgggtcatagatctcgggtgtgggaggggcgggtggtcctactattgcgcgggtctgaagaaggtaaccgaggtgcggggctacacaaaaggcggtcctgggcacgaggagcctgtccccatgtccacatatggctggaacatcgtgaaactgatgtcggggaaggacgtgttctacctgccccccgagaagtgtgacaccctgctgtgcgacattggcgaatcctcacccagtccaaccgtcgaggagtcccgcaccatccgcgtgctaaagatggtcgagccttggctcaagaacaaccagttttgcattaaagtcttaaatccctatatgcccacggtgatcgagcatcttgagcgcctccaacgcaagcacggggggatgctggtacggaacccgctcagtaggaactccacccacgaaatgtactggatttcgaacggcaccgggaatattgtcgcctccgtgaacatggtgagccggctcctgttaaaccggttcaccatgacgcatcggcgcccgaccatcgagaaggacgtcgacctgggcgcaggcactaggcacgtgaacgccgagcccgagacccccaacatggatgtaataggggagcgtatcaagcgtataaaagaggagcacaactccacctggcactacgacgacgaaaacccctacaagacctgggcctaccacggaagctacgaggtaaaggcgaccgggtccgcaagcagcatgatcaacggcgtggtcaagctgctgaccaagccttgggacgtagtgcccatggtaacccagatggcgatgacggacaccacccccttcggacagcagcgcgtgttcaaagagaaggtggacacgaggaccccgcgctccatgcctggcacccggcgggtcatgggcatcaccgccgagtggctttggaggacgctggggagaaacaagaaaccccggctgtgcacacgcgaggagttcaccaagaaggtgcgaacgaacgcggccatgggcgcggtgttcacagaggagaaccagtgggactcagccaaggccgccgtagaggacgaagatttctggaagctcgtggaccgggagcgcgagttgcataagcttgggaagtgtgggtcctgtgtatacaacatgatggggaaacgggagaagaagctcggtgagttcggcaaggccaaggggagccgagcaatatggtacatgtggcttggtgcccgatatctggagttcgaggccctcggatttttaaatgaagaccactggttctcccgcgagaatagctattccggggtcgaaggtgaaggcttgcacaaactgggctacattctgcgggatatcagcaagatccccggtggcgccatgtacgccgacgataccgccggttgggatacccgcatcacagaagacgacctgcataacgaagaaaagatcactcagcagatggacccggagcaccggcagctcgccaatgccatatttaagctcacataccaaaacaaggtggtgaaggtccagcgtcccacccccaccggtaccgtcatggacatcatcagtaggaaagaccaacggggcagcggccaggtgggtacttacggcctcaacactttcaccaacatggaggcccagctgatacggcagatggaaggggagggggttctgtctaaagccgatctggaaaacccgcacttacccgagaagaaaattacccagtggctggaaactaaaggcgtggaaagactgaagcggatggcgatctcgggggacgactgcgtggttaagcccatcgacgatagatttgccaacgctctcctggcgctgaacgacatggggaaggtgcggaaggacatcccccaatggcaaccatccaagggctggcatgactggcagcaggttccgttctgtagccaccacttccatgagttgattatgaaggacgggagaaagctcgtcgtgccatgccggccccaggacgagctaatcggccgagctcggatctcccagggggccggctggagtttgagggagaccgcgtgtctgggcaaggcgtacgcccagatgtggtctttaatgtacttccaccgccgggatttacgcctagcttctaatgccatctgctcggccgtgcctgtacattgggtccccacgtcacggacaacgtggagcatccatgcccaccaccaatggatgaccacagaggatatgctgaccgtgtggaaccgagtctggatcgaggataatccttggatggaggataaaacaccggtaactacctgggagaatgtgccttacctaggcaagcgtgaggaccagtggtgcggctccctgatcgggctgaccagtcgcgccacgtgggctcagaacattcctaccgctatccagcaagtccgtagtctcatcggcaatgaggagttcctcgactacatgcccagcatgaagagattccggaaggaggaggagtccgagggtgcaatctggtga

SEQ ID NO: 26093 - RNA, 9873 nt, synthetic construct
  misc_feature 1..9873: note = derived and/or modified CDS sequence (opt11) from DENV-3__EU569689__SS-prME
  source 1..9873: mol_type = other RNA
accagcttatgccttatgatgattctgcctgccgccctggcgttccacttgacgagccgggacggtgagccgcggatgatcgttgggaagaacgagagaggcaagtcgttactgttcaagacggccagcggaatcaacatgtgcaccctaatcgccatggacctgggcgaaatgtgcgacgataccgtgacctacaagtgcccacatatcacggaggtagagcccgaggacatagattgctggtgcaacctgaccagcacatgggtgacttacgggacgtgcaaccaggcgggggagcaccggcgcgacaagcggtcagtggcccttgccccccacgtgggcatggggttagacaccagaacgcagacctggatgagcgctgagggggcctggcgacaggtggaaaaggttgagacgtgggccttgcgccacccggggttcaccatcctcgcactgttcctggcacactacatcggcacctccctaacccagaaggtggtgatcttcatcctgctgatgctggtgacgcccagcatgacgatgcgttgcgtgggggtaggcaaccgcgacttcgtcgagggcctgtccggggcaacgtgggtcgacgtagtcctggagcatggcgggtgtgttaccactatggccaagaacaagccaaccctcgacatcgagcttcagaagacagaggccacccagttagcgacgctacggaagctgtgcatagagggtaagatcaccaacatcaccaccgacagccgctgtcccacgcagggtgaagccgtgctgccggaagagcaggaccaaaattacgtctgcaaacacacttacgtggatcgagggtgggggaacgggtgcggcttgttcgggaaaggttccttagtaacctgcgccaagttccagtgcctagagcctatcgagggcaaagttgtgcagtacgagaatctcaagtacacggtgatcatcacggtccacactggggaccagcaccaggtgggcaacgagacccagggggttaccgccgagatcacgccccaggcgagcaccaccgaggcgatcctgcccgagtatggtaccctggggctcgaatgctctccgcgcacaggtctggatttcaatgagatgatcttattgacgatgaagaataaggcctggatggtccaccggcagtggttcttcgatctacccctgccctggactagcggcgccacaaccgagacgcccacgtggaaccgcaaggaactccttgtgaccttcaagaacgcgcacgccaagaagcaggaggtcgtggtgctggggtcccaggagggcgcaatgcacaccgccctcacgggggccactgagatccagaacagcggcggtacctcaatcttcgccggccacctgaaatgccggctgaaaatggacaagctcgagctgaaagggatgagctacgccatgtgcaccaatacgttcgtcctgaagaaggaggtctccgagactcagcacgggaccatcctcatcaaggtcgagtacaagggcgaggacgtcccttgcaagatccctttcagcacagaggacggacagggcaaggcgcataacggtcgcctgatcacggcaaaccccgttgtgaccaaaaaggaggagccagtcaatatcgaggcggagcccccgtttggggagagtaacatagtcatcggaatcggggacaacgccctaaagatcaactggtacaagaaagggtcgtcgatagggaaaatgttcgaggcaactgcccggggcgctcgaaggatggccatcctgggagacaccgcctgggacttcgggagtgtgggcggggtcttaaacagccttggcaagatggtccaccagatattcgggtccgcgtacacggccttgttctctggcgtgtcctgggtcatgaagatcggcatcggggtgctcctaacctggatcggcttgaactctaaaaacacctccatgtcgttcagctgcattgccatcggcatcatcaccttatatctgggcgccgtagtccaggctgacatggggtgcgtcatcaactggaaaggcaaggagctgaagtgtgggagcggcatcttcgtgacgaatgaggtccatacatggaccgagcaatacaagttccaagcggacagtcccaagcgcttggccaccgcaatcgcgggcgcctgggagaacggagtgtgcggcatccgcagcactacgcgaatggagaatttgctgtggaagcagatcgctaacgagctcaactacatcctgtgggaaaataacatcaaactgaccgtggtcgtgggggacatcatcggcgtgctcgagcagggcaaacgcactctgactccccagccaatggagctgaagtactcctggaaggcctgggggaaagccaagatcgtaaccgccgagacgcagaacagctccttcatcattgacggtcccaacacaccggagtgtcccagcgcgtcccgggcctggaacgtgtgggaggtagaggactacggattcggcgtcttcacgaccaacatctggctaaagctgcgcgaggtgtacacgcagctgtgcgaccaccggttgatgagcgctgccgtgaaggacgagcgggccgtccacgcggacatgggctattggatcgaaagccagaagaatgggtcctggaagctggagaaggccagcctgatcgaggtgaagacgtgcacctggcctaagagccacacgctctggtcaaatggagtgctagagtccgacatgatcatcccaaaaagcctggcggggcccatttcccaacacaactacaggccgggctaccacacccagaccgccgggccgtggcatctcggcaagctggagctagacttcaactactgcgagggcaccacggtcgtgatcaccgagaattgtggaacccggggccccagcctccggaccactaccgtgtccgggaaactgatccacgagtggtgctgtcgtagctgcacattgcctcccctgcggtacatgggcgaggacggctgctggtatggcatggaaatacgccccatctccgagaaggaggagaacatggtcaaaagcctggtgtccgccggctccggggaggtggacaacttcaccatgggcgtcttatgcctcgctattctgttcgaggaggtgatgagggggaagttcgggaagaagcacatgatagccggggtgttcttcacgttcgtcctgctcctgtccggccaaataacgtggcgcgacttagcccacaccctcattatgatcggctcaaacgcctccgaccggatggggatgggcgtgacctacctggcgctgatcgcgacgttcaaaatccagcccttcctcgccctggggttcttccttcgcaagctcaccagccgggagaacttgttactcggtgtaggtctggccatggccaccacattacagcttcccgaggacatcgagcagatggcaaatggcatcgccctgggcctgatggccctcaaattaatcacgcagttcgagacctatcagttatggaccgccctcatctcgctgacgtgctccaacactattttcacgctgaccgtcgcctggcggaccgcgactctcatcctggccggtgtgagcctgctcccggtctgccaatccagctccatgcggaagaccgactggctgcccatgaccgtggccgccatgggcgtgccgccactgccgctgttcatcttcagcctgaaggacaccctgaaacgtagatcctggcctctcaacgagggggtcatggccgtaggcctggtttccatcttagcaagttccctgctgcggaatgatgtccccatggccggacccttggtggccggtggactcctgatcgcctgctacgtgatcacagggacatccgccgatctgactgtcgaaaaagcggccgacgtgacctgggaggaagaagcggagcagacgggcgtgagccacaacttaatgatcaccgtcgacgacgacgggaccatgcggatcaaagacgatgagaccgagaacatcctgaccgttctgctcaagacggcacttctgatcgtctccggcatttttccgtacagcatcccggccacgttgttggtatggcacacctggcaaaagcagacccagcggtccggcgtgctgtgggacgtgcccagcccacccgagacgcaaaaagctgagctcgaggaaggagtctaccgtattaagcaacagggcatatttggaaagacccaggtgggagtgggggtgcagaaggagggcgtgttccacaccatgtggcacgtgacccggggcgccgtcctgacgtataacggcaagcgcctcgagccgaactgggcctccgtgaagaaggacctcatatcgtacggcgggggctggcgactgtccgcccaatggcagaagggagaggaggtgcaagtcatcgcggtggagcccggcaagaatcccaaaaacttccagaccatgccaggcacgttccagaccacgacaggtgagatcggcgccatcgccctcgactttaagcccgggacgtccggcagcccgataataaaccgcgagggcaaggtggtcgggctatacggtaatggggttgtgaccaagaatggcgggtacgtatccggcatagcccaaacgaatgccgaacctgacggccccacccccgagctcgaggaggagatgttcaagaagcgcaatctgaccatcatggacctgcaccccgggtcgggcaagaccagaaaatacctcccggcaatcgtgcgggaggccattaagcgccggctgcgcacgctgatactcgcccccacccgggttgtggcggccgaaatggaggaggcgctgaagggactgcctatccgctaccagaccactgccacgaagtccgagcacacaggccgggaaattgttgacctgatgtgccacgccaccttcaccatgcgcctgctgtcccccgtgcgggtcccgaactataatctcattatcatggacgaggcgcactttacagaccctgcatccatcgcggcccgcgggtacatcagcacacgggtgggtatgggcgaagccgccgcaatattcatgaccgccacgccgcccgggacggccgacgccttcccccagagcaatgcccccattcaagacgaggagcgcgacatccccgagcgctcctggaatagtggcaacgagtggataaccgacttcgctgggaagacagtgtggttcgtaccaagcataaaggctggcaatgacatagccaactgtctgcggaagaatggaaagaaggtgatccagctgtcccgcaagacctttgacacggagtaccagaaaaccaagctcaacgactgggacttcgttgtcacgaccgacatcagcgagatgggagccaatttcaaggccgaccgggtgatcgacccgcgccgatgtctgaagccagtgatcttgacggacggccccgagcgtgtcatcctcgcgggccccatgccggtgacagccgccagtgcggcccagcggaggggacgggtggggcgcaatccccagaaggagaatgaccagtacatattcacgggtcagccgctgaacaatgatgaggaccacgctcattggaccgaggccaagatgctgctcgacaacatcaacactcccgagggtatcatcccggccttatttgagcccgagcgggagaagtccgcagcgatagacggcgagtaccgcctgaagggcgaatcccggaagacgttcgtcgagcttatgcgcaggggggacctgcccgtgtggctggcccacaaagtcgcttcagaggggatcaagtacaccgaccgaaagtggtgcttcgacggccagcggaataaccagatattagaggagaacatggatgtggagatctggaccaaggagggtgagaagaagaagctgcggccacggtggttggacgcccgcacctactctgatccgctcgctttgaaggagtttaaggacttcgcagccggccgcaagtcgatcgctctcgatctcgtaacggagatcgggcgggtccccacccacctggcgcaccgcaccagaaacgccctggacaacctcgtgatgctgcacacatccgagcacggcgggaaggcgtataggcacgccgtggaggagttacccgaaacgatggagacactcctgctgctcggtctgatgatactgctaaccgggggcgcgatgctgtttctgatcagcggcaaagggatcggcaagacgagcatcgggctaatctgcgtcattgcctccagcggcatgctgtggatggccgagatcccgctgcaatggatagcgtccgcgattgtgctcgagttcttcatgatggtgctgttgatacccgagcccgaaaaacaacgcacgccgcaggataaccagctcgcctacgtcgtaatcgggattctgacactggccgccatcatcgcggccaacgagatgggcctcctggaaacgaccaagcgtgacttgggcatgagcaaggaaccgggggtggtctcccccacgtcgtacctcgatgtggacctgcaccctgccagcgcctggaccctgtacgcagttgccacaacggtcataacacccatgctccggcacaccatcgagaacagcaccgccaacgtgtctctggccgccatcgcgaaccaagccgttgtcctcatgggcctcgacaagggctggcccatcagcaagatggacctgggcgtgcccttgctagccttagggtgctattctcaggtgaacccccttaccctcactgcggccgtcctgctgctcatcactcactacgcaataatcggcccaggccttcaggccaaagctacccgcgaggcccagaagcggaccgccgcgggtatcatgaaaaacccgacggtcgacggcatcatgacgattgatttagaccccgtgatctacgacagcaagttcgagaaacaactcggtcaagtgatgttgctcgtgctctgcgccgtgcagctgctgctcatgcgaacatcctgggccctttgcgaggcgctcaccctcgctacgggccccatcaccaccctgtgggagggtagccccgggaagttctggaacaccacgatcgccgtttccatggccaatatcttccggggctcctacctcgcgggggctggcctcgcgttctccatcatgaaaagcgtagggaccggcaagcgcggcactgggtcccagggcgagaccctgggggaaaagtggaagaagaagcttaaccagttaagccggaaggagtttgacttgtacaaaaagtccggcataaccgaggtggatcgcacggaggcaaaggaagggctgaagcgcggggagatcacacaccatgccgtaagtagggggagcgcaaaactccagtggttcgtggaacgaaatatggtgatcccggaggggcgcgtcatcgacttaggctgcggcaggggcgggtggtcttactactgcgccggcctgaaaaaggtgaccgaggtgcgcggctataccaagggcgggccggggcacgaggagcccgtccccatgagcacgtacggctggaatatcgtgaagttaatgtccggaaaagacgtgttctaccttccgcctgagaaatgcgacaccctactgtgcgatattggcgagtcttctcccagcccgaccgtcgaggagtcccggacaatccgcgtgctcaagatggtcgagccgtggctaaagaacaaccagttctgcatcaaagtcctgaacccctacatgcccacggttatcgaacacctcgagcgcctgcagcggaagcacggagggatgctggtccgcaaccccctaagtcgtaactctacccacgagatgtactggatcagcaacgggaccgggaacatcgtcgcctccgtcaatatggttagccgcttactgctcaaccggttcaccatgacgcatcgacgtccgaccatcgagaaggacgtggacctaggcgcaggcacccgccacgtgaatgccgaaccggagaccccaaacatggacgtgatcggcgaacggatcaagcgcatcaaggaagagcataactccacgtggcactatgacgatgagaacccttataaaacctgggcctaccacggcagctacgaggtcaaggccaccgggtccgcgtcctccatgataaacggcgtggtgaagctgctcacaaagccctgggatgtcgtgccaatggtcactcaaatggctatgaccgacaccacccctttcgggcagcaaagagtgttcaaggagaaggtggacacccgcaccccacggagcatgccgggcacccgccgggtcatgggaattaccgcagagtggctgtggcggacgctggggcggaataaaaagccccgcttgtgtacccgggaggagttcaccaaaaaagtgaggaccaacgccgcgatgggcgccgtattcacggaggagaaccagtgggactcggccaaggccgccgtcgaggacgaggacttctggaagctggtggatcgggagcgggagttacataagctcgggaagtgcggttcctgcgtctacaacatgatggggaagcgcgagaagaagctgggcgagttcggcaaggcgaaggggagcagggccatctggtacatgtggctaggcgcccgctatctcgagttcgaggccttggggttcctgaacgaggaccattggtttagccgggaaaacagctactcaggcgtcgagggggaagggctccacaagttaggttacattctacgcgacataagcaaaatccccggtggcgccatgtacgcggacgacaccgcagggtgggacacccggattaccgaggacgacctccacaacgaggagaaaatcacgcaacagatggacccggagcaccgtcagcttgcgaacgccatcttcaagctgacctatcagaacaaggttgtgaaggtccagcggcccacccccaccggcacggtgatggacatcatctcccgcaaggaccagcgggggtcaggccaggtgggcacgtacgggctcaacacattcaccaatatggaggcccagctgattcgccagatggaaggcgagggtgtactgtccaaggcggacctcgaaaacccccacctacctgaaaagaagatcacccaatggctggagacgaagggtgtggagcggctcaagcgcatggccattagcggcgacgattgtgtcgtcaagcccatagatgaccggttcgccaacgcactgctggcattaaacgacatgggtaaggtccgcaaagatatccctcagtggcagccctccaagggctggcatgactggcagcaggtcccgttttgtagccaccacttccacgagctgatcatgaaagacggtcggaagctcgtcgtgccctgtcggccccaagacgagctcatcggacgggcgcgcatttcccagggggcaggctggtctctgcgggagacagcgtgtctgggaaaggcctatgcgcagatgtggtccctcatgtacttccaccgccgcgacttgcggctggccagcaacgccatctgttccgcagtgcccgtgcattgggtgccaaccagccgcactacgtggtccatccacgcccaccaccagtggatgacaaccgaggacatgctcaccgtgtggaaccgggtttggatcgaggataacccctggatggaggacaagacgcccgtgacgacctgggaaaacgttccctacctagggaagcgggaggaccagtggtgcggcagcctgatcgggctcaccagccgggcaacgtgggctcagaatattccgaccgccatccagcaggttcgctccctaatcggcaacgaggagttcctggactacatgccctccatgaaacgtttccgcaaggaagaggagtcggagggcgccatttggtga

SEQ ID NO: 26094 - RNA, 9873 nt, synthetic construct
  misc_feature 1..9873: note = derived and/or modified CDS sequence (opt11) from DENV-3__EU482614__SS-prME
  source 1..9873: mol_type = other RNA
accagcctgtgcctgatgatgatcctgcccgctgccctggcattccacctcaccagccgggacggggaaccccggatgattgtggggaagaacgagcggggcaagagcctgctgttcaagacggcctcgggcattaacatgtgcacgctcatagccatggacttgggcgagatgtgcgacgacaccgtgacatacaagtgcccgcatataactgaggttgagcccgaggacatcgactgctggtgcaacctgaccagcacctgggtgacctatgggacgtgcaaccaggccggcgagcatcgacgcgacaagcggtccgttgccctcgcgccccacgtgggcatgggcttggacactcgcacccagacctggatgtctgccgagggcgcgtggcgccaggtggaaaaggtcgagacgtgggccctacgccacccgggtttcaccatactcgccctgttcctggcccactacataggcacctccctcacccagaaggttgttatcttcatcctcctgatgctcgtcacgccctctatgaccatgcgttgcgtgggagtgggaaaccgagatttcgtcgagggcctgtccggggcgacctgggtggacgtggttctggagcacggcggatgcgtgaccaccatggccaagaacaagccgaccctcgacatagagttacagaagactgaagccacccagctggccacgctccggaagctgtgcatcgaaggcaaaatcaccaatatcactaccgacagccgctgccccacccagggcgaggccgtactgccggaggagcaggaccagaactacgtctgcaagcacacctacgtcgaccggggatggggcaacgggtgtggtctcttcggtaagggctccctggtgacctgcgccaagtttcagtgcctggagcccatcgagggcaaggtcgtgcagtacgaaaacctcaaatataccgttatcatcacggtccataccggcgaccagcaccaagtgggaaacgaaacgcagggggtcaccgcagagatcacgccgcaagccagtacaaccgaggcgatcctcccagagtacggcaccctgggactcgagtgctccccgcgcactggtctggacttcaacgagatgatcctgctcacgatgaaaaacaaggcctggatggtgcaccggcagtggtttttcgacctgcccctgccgtggaccagcggggcaacgaccgagacgccgacctggaaccgaaaagagctgctggtcaccttcaagaacgcgcacgccaagaagcaggaggttgtagtgctggggtcccaggagggcgccatgcacacagccctaaccggggcgacggagattcaaaacagcggcgggacctccatcttcgcaggccacctcaagtgcagactgaagatggacaagctcgaactaaagggcatgagctacgccatgtgcaccaatacgttcgtcctcaaaaaagaggtgtccgagacgcaacacggtacgatcctcatcaaggtggaatacaagggggaggacgtcccgtgcaagatcccgtttagcaccgaggacgggcagggcaaggcacacaatggacgtctgatcacggccaaccccgtggtaaccaaaaaggaagagccggtcaacatcgaagcggagcctccctttggtgagagcaacatcgtgatcgggatcggagacaacgcgcttaagattaactggtacaagaagggctcctccatcggtaagatgttcgaggcgaccgcccggggcgcccgccggatggccatccttggcgacaccgcctgggatttcgggtccgtgggcggggtcctcaacagcctgggaaagatggtgcaccagatttttggatcagcttatacagccctgttcagcggggtgtcctgggtcatgaaaatcggcatcggtgtgttgttgacctggatagggctaaacagcaagaacacctccatgagcttctcctgcatcgcgatcgggatcatcaccctctacctgggcgccgtcgttcaagcggacatgggatgcgtgatcaattggaagggcaaagagctgaagtgtggcagcggcatttttgttactaatgaggtccacacatggaccgagcagtacaagttccaggcggatagccccaaacgcttagccaccgccatcgccggcgcatgggagaacggggtgtgcggcatccgcagcacgacccggatggagaacctgctatggaagcagatcgctaacgagctcaattacatcctctgggagaacaatatcaagttgaccgtagtcgtaggggacatcattggcgtgctcgaacaaggcaagcgtacgctcacgccccagcccatggagttgaaatacagctggaaaacctgggggaaggcaaagatagtcaccgcggagacccagaacagctcctttatcatcgatggccccaacacgcccgagtgccccagcgcctcgcgggcgtggaatgtgtgggaggtggaagactacgggttcggagtcttcaccaccaacatctggctcaagctgcgcgaggtgtacacccagctgtgcgaccaccggctaatgtccgcagccgtcaaagatgagagagcagtccacgccgacatgggctactggatcgagagccagaagaacgggtcgtggaagctggagaaggcgagcttaatcgaggtgaaaacctgcacgtggccaaagtcccatactctttggagcaacggcgtgttggaatccgacatgatcatccccaagagccttgccgggcccatctcccagcacaattatcggccgggataccacacacagactgccgggccctggcacctcggcaagctcgagctggacttcaattattgtgagggcacgaccgtagtgatcaccgagaattgcgggacccggggccccagtctacggacgaccactgtatccgggaagctgatccacgagtggtgctgtcgcagctgcaccctgccgccgcttcggtatatgggcgaggacgggtgctggtacggcatggagatccgccccatctccgagaaggaggagaacatggtcaagagcttggtaagtgccggctccggggaggtagataactttacgatgggtgtcctgtgcttggccatcctgttcgaggaggtgatgcgagggaagttcggtaagaagcacatgatcgcaggagtattcttcaccttcgtgctgctcctgtccggacagatcacgtggcgtgacatggcgcacacccttataatgatcggttcaaacgcctccgaccggatggggatgggcgtgacttacctcgccttaatcgccacgttcaagatacagcccttcctggcgctcgggtttttcctgcgcaagctgaccagccgggagaacctcttactgggcgtgggcctggccatggccacgacgctgcagctgcctgaggacatcgagcagatggccaacgggatcgcgctcggattaatggctctcaagctcatcacccaattcgagacctatcagctgtggaccgcccttattagcctcacctgctccaacacaatcttcacactgaccgtcgcgtggcgcacggccaccctgatcctcgcgggggtgagcctgctcccggtctgccagtcctcgtccatgcggaaaaccgactggctcccgatgaccgtagcggccatgggcgtgccgcccctcccgcttttcatattctcactaaaggacacgctgaagcgccgctcctggccgctaaacgagggtgtcatggcggtgggcctcgtgagcatcttggcctctagcctgctccggaacgacgtcccaatggcgggccccctagtggccgggggtctgctcatcgcctgttacgtgatcactgggacctccgctgatctgaccgtcgaaaaggccgcggacgtgacttgggaggaggaggccgagcagacaggcgtgagccacaacctgatgatcaccgtagacgatgacgggaccatgcgcatcaaggacgacgaaaccgaaaatatcctcacggtactgctgaagaccgcgctcctaattgtatcgggcatattcccgtactctattcctgccaccctgctcgtttggcacacctggcagaaacagactcagcggtccggtgtgctgtgggacgtccctagcccgcccgaaacccagaaggccgagctggaggagggggtctacagaatcaaacagcaaggcatcttcgggaaaacccaggtgggcgtcggggtccagaaggagggcgtcttccacactatgtggcacgtgacgcggggagctgtcctaactcacaacgggaagcgcctcgaacccaactgggccagcgtgaagaaagacctgataagctacggcggcggctggcggctctcagcgcagtggcagaaaggtgaggaggttcaggttatcgcggtggagcccggcaagaaccccaagaactttcagaccatgcccggcaccttccagacgaccacgggggaaatcggcgcgattgcccttgacttcaagcccgggaccagcggctctcccatcataaaccgtgagggtaaggtggtcgggttgtacggcaacggggtggtgacgaagaacggcgggtacgtctccggcatcgcccagaccaatgcggagccggacggccccacccccgagctggaggaagagatgtttaagaagaggaaccttaccatcatggatctgcaccccggtagtggcaagacgcgcaagtacctgccggccattgtgcgagaggcgatcaagcgccggctccgcaccctgatcctcgcccccacccgggtagtagctgccgagatggaggaagctcttaaggggctgcccatacgctaccagaccacggcgaccaagtccgagcacaccggccgtgagatcgttgacttgatgtgccatgcaaccttcacgatgcgcctactaagtcccgttcgggtcccgaactacaacctgatcatcatggatgaggcccacttcaccgaccccgctagtatcgccgcgcgtggttacatcagcacccgagtgggcatgggcgaagccgccgccatcttcatgaccgcgacgccgcccggaactgccgacgccttcccgcagtcgaacgcccccatccaggacgaagagcgcgacatccccgagcgcagctggaactcgggcaatgagtggatcaccgacttcgccgggaagaccgtctggttcgtacctagcataaaagcgggcaacgacatcgcaaactgcctccggaaaaacggaaagaaggtgatacaactgtcccgcaagacgttcgatactgagtaccagaagaccaagctgaacgactgggacttcgtggtcacaaccgatatctctgaaatgggcgccaacttcaaggccgaccgtgtcatagaccctcgccggtgcctgaaacccgtgatcctgaccgacggccccgagcgcgtgatcctggccggacccatgcccgtgaccgcggcctccgccgcccagcggcgcggccgggtggggcgcaacccccagaaggagaacgaccaatatatctttacgggccagcccctcaacaacgacgaggaccacgcccactggacagaggccaagatgctgcttgataacatcaatacgcccgaagggattatcccggccctcttcgagcccgagcgggagaagtcggccgctatagacggcgagtaccgcttgaagggggaatcccggaagaccttcgtcgaactgatgcggcgcggggacttgcctgtgtggctggcgcacaaagtcgcctctgagggcatcaagtacaccgaccgcaagtggtgcttcgacggtcagcggaacaaccagatcctagaagaaaacatggacgtggaaatatggactaaagagggcgagaagaagaagctgcgcccccggtggctggatgcacggacgtattccgatccgttagccctcaaggaattcaaagacttcgccgcgggccgaaagagcatcgccctggaccttgtgacggaaatagggcgggtcccatcccacttagcccaccgcacgcggaacgccctggacaacctggtcatgctccacacctcggagcacggggggaaggcgtatcgccacgcggtggaggagctgcccgagacaatggaaaccttactgctgctgggcctcatgatcctcctgaccgggggcgcaatgctcttcctgatcagcggcaaggggatcggcaagacttctatcgggttaatctgtgtcatcgccagctccggcatgctctggatggccgagatcccgctgcaatggattgccagtgcgattgtgctagagtttttcatgatggtcttattgatccccgagcccgagaagcagcggacgccccaggacaaccagctggcgtacgtcgtgatcggaatcttaaccctggccgccatcatcgccgcaaacgaaatgggcctactcgagaccacaaaaagagacctgggcatgtccaaggagccgggggtggtcagccctacgtcctacctggacgtggacctccaccccgccagcgcctggaccctctacgccgtcgcgaccactgtcatcacgccaatgctgcggcataccatcgagaactccaccgccaacgtgagcctggcagctattgcaaatcaggccgtggttttgatgggcctagacaaggggtggcctatttccaagatggacctcggcgtgccgctgctagccctcgggtgctacagccaggtgaacccactgaccctgacggcagccgtcctcctactgatcacccactacgccatcatcggcccgggtctccaggcaaaggcgacccgcgaggcgcagaaacgtaccgccgctgggatcatgaagaacccgacggtggatggcatcatgaccatcgacctggatcccgtgatctatgactctaagtttgagaaacagctagggcaagtcatgctcctggtcctgtgtgcggtgcagttactattgatgcgtaccagctgggcgctctgtgaggccctcacgctggcaacggggcccatcaccaccctctgggaaggctcgcccgggaaattctggaacaccactatcgcggtcagcatggcaaacatctttcggggctcctacctggcgggggccggtctggcttttagcatcatgaagtctgtcgggaccggcaagaggggcacgggaagccagggcgagaccctcggggaaaagtggaagaagaagcttaatcagctgagccggaaggagttcgacctctacaagaaaagcggcatcaccgaggtagatcgcacggaggcgaaggagggattgaagcgaggcgagatcacccaccacgccgtcagccgcggatccgccaagctacaatggttcgtggagcgaaacatggtgatcccggaggggcgcgtcatcgacctcgggtgcgggagaggtgggtggagctactattgcgctggcctgaagaaggtgaccgaggtgcgcggctacacaaagggcgggcctgggcacgaggagcccgtccccatgtccacgtacggctggaacatcgtgaagcttatgagcggcaaggatgtgttttacctccctccggaaaagtgcgacaccctgctctgcgacatcggcgaatccagccccagtccaaccgtcgaggaaagccgtactatacgtgtgctgaagatggtggagccgtggctcaagaacaaccagttctgcatcaaagtcctgaacccctacatgcccactgttatcgagcacctggagagattgcaacggaagcacggcgggatgctggtaagaaaccccctgtcccggaactccacccacgagatgtactggatttcgaacggcaccgggaatattgtggcgagcgtcaacatggtctcccgccttctgctgaaccggttcacgatgacgcaccgccggccgaccatcgagaaggacgtcgatctcggcgcgggcacacgccacgtgaatgcagagcccgagacacccaatatggatgtgattggagagcgtatcaaacggatcaaggaggagcacaattccacgtggcactatgacgacgaaaacccgtataagacctgggcctaccacgggtcctatgaggtcaaggccacggggtctgcctccagcatgatcaacggcgtggtcaagctgctgaccaagccctgggacgtggtgcccatggtgacccaaatggcgatgaccgacaccacccccttcgggcagcagcgggtgttcaaggaaaaggtggacacgagaacgccgcgatctatgcccggcacgcgacgtgtcatgggcatcaccgccgagtggctttggcgcacgttggggcggaacaagaagccacgcctgtgcacccgggaggaattcaccaagaaggtgcgcacaaatgccgccatgggcgcggtgttcaccgaggagaaccagtgggacagtgccaaggccgccgtcgaggacgaagacttctggaagctcgtggacagagagagagagctgcacaagctgggcaagtgtggctcatgcgtgtacaacatgatgggaaagcgcgagaaaaagctgggcgagttcggcaaggctaagggatcacgggccatttggtacatgtggttaggcgcgcgctatctggaatttgaggcactcgggtttttaaatgaggaccactggttcagccgggaaaactcctactccggtgtggagggggagggactgcacaaactcggctacatcctacgcgacatctccaagatccctgggggcgccatgtacgcagacgacaccgcgggatgggatacccggatcaccgaagatgacctgcacaacgaggagaagatcacgcagcaaatggaccccgagcaccgccagttagccaacgcgatcttcaagctgacctatcagaacaaggtggttaaggttcagcgcccaacgcctacaggcaccgtgatggacatcatcagtcgaaaggaccagcggggctccggccaggtgggaacgtacggactgaacaccttcacgaatatggaggcccagctcatcagacagatggaaggagagggtgtactatcaaaggccgacctggagaacccccacctcccagagaagaagatcacgcagtggctagaaacgaagggcgtggaacggctgaagcgcatggctatttccggcgacgattgcgtggtcaagcccatcgacgaccggtttgccaacgcactcctggcacttaacgatatgggaaaggtccgcaaggacatcccccagtggcagccgtctaagggttggcacgactggcagcaggttccgttctgctctcaccacttccacgagctcatcatgaaggacgggaggaagcttgtcgtgccctgccgcccccaggacgagttgatcggacgggctcgcatcagccagggggcgggctggtccctccgggagaccgcctgtctgggaaaggcctacgcgcaaatgtggagcctgatgtacttccaccgccgcgacctcagactagctagtaacgccatttgcagcgccgtgccggtacactgggtcccgacctcccgcaccacatggagcatccacgcccaccaccagtggatgaccaccgaggatatgctgaccgtgtggaatcgggtctggatagaagacaacccttggatggaagataagacgcccgtgaccacgtgggagaacgtgccgtacctcgggaagcgcgaggaccagtggtgcgggagcctgatcgggctgacttcccgggccacttgggcgcaaaacattccgaccgccatccagcaggtccgcagcctcatcggcaacgaggagttcctggactacatgccctctatgaagcggttccgcaaggaggaggaaagcgaaggggccatctggtaa

SEQ ID NO: 26095 - RNA, 9873 nt, synthetic construct
  misc_feature 1..9873: note = derived and/or modified CDS sequence (opt11) from DENV-3__EU569690__SS-prME
  source 1..9873: mol_type = other RNA
accagcctctgtctcatgatgatcttgcccgccgcactggcgttccacctcacttctcgggatggagaaccgaggatgatcgtagggaaaaacgagcgggggaaatcgctgctattcaagactgcctccgggatcaacatgtgcaccttaatcgccatggacctgggcgagatgtgtgacgatactgtgacttacaaatgtccccatattacggaggtcgaaccagaagacatcgactgctggtgcaacctgaccagcacctgggtgacttacgggacctgcaaccaggccggtgaacaccgacgggacaaacggtccgtagcactcgcgccccacgtgggcatgggtctggacactcggacccagacctggatgagcgcggagggcgcctggcgccaggttgaaaaggtcgagacgtgggcattacgtcacccggggttcaccatccttgcgctattcctggcccattacatcgggacctccctaacccaaaaggtagtgatcttcatcctactgatgctcgtcacacccagcatgaccatgcgctgcgtaggggtcggcaatcgggacttcgtggagggcctgtccggcgccacctgggttgacgtagtcctggagcacggcgggtgcgtgactaccatggccaaaaataagcccacgctcgacatagagctacaaaagaccgaggccacacagcttgcgaccctccgcaaactttgtattgaagggaagataaccaacatcacaaccgacagccgctgccccactcaaggcgaagctgtgttaccggaggagcaggaccagaactacgtctgcaagcacacgtacgtggaccgggggtggggtaatgggtgtggcctctttgggaagggctccctagtaacctgcgctaagtttcagtgcctcgaacctatcgagggcaaggtggtacagtacgagaatctcaagtacaccgtgatcatcacggtccacactggggaccagcaccaggtgggcaacgaaacccagggggtaaccgccgagatcacgccccaggcgagcaccaccgaggcgatcctgcccgagtacggcaccctcgggctcgagtgctccccgcgcaccggcctggatttcaacgagatgattctgctcacaatgaagaacaaggcctggatggtccatcggcaatggttctttgatctacccttaccctggactagcggcgctaccaccgagacccccacctggtcccggaaggagctcctggtcaccttcaagaacgcgcacgccaagaagcaggaggtcgtagtcctggggagccaggaaggcgcgatgcacaccgctctcacgggagccaccgagatccaaaattccggcggcacctcaatctttgcgggccacctaaagtgtcgtctgaagatggataagctcgagctgaagggcatgtcctacgctatgtgtaccaacacgttcgtcctgaagaaggaggtaagcgagacacagcacgggaccatcctcatcaaggtggagtacaaaggggaggacgtcccgtgtaaaatcccattctcaactgaggacgagcaagggaaggctcacaacggtaggctgatcacggccaaccccgtggtcaccaagaaggaggagcccgtcaacatcgaagcggagccaccctttggtgaatccaacatcgtgattgggatcggtgataacgcccttaagatcaactggtacaagaaggggagttccatcggaaagatgttcgaggcgacggcccgcggggcccgccgcatggccatcctgggcgacaccgcctgggacttcggtagcgtagggggagtcctcaactctctggggaagatggtgcaccaaatcttcggcagcgcctacacggccttattcagcggtgttagttgggtcatgaagatcggcattggcgtgctcctaacctggatcgggctaaattccaagaacaccagcatgagtttcagctgcattgccatcggtatcatcactctgtacctaggggccgttgttcaggccgatatgggatgcgtgatcaattggaagggtaaagagctgaagtgcggctctgggatcttcgtgacaaatgaggtccacacctggactgaacagtacaaattccaggccgactcccccaagcgccttgccaccgcgattgccggagcctgggagaacggtgtctgcgggatccgctccacgacccgtatggagaatctgctgtggaagcagatcgcgaatgaactaaattacatcctgtgggagaacaacataaagttgactgtggttgtgggcgacattatcggggtcctcgagcagggcaagcgcaccctcatcccgcagccgatggagctgaagtacagctggaagacttggggcaaggccaagatcgtcaccgccgagacccagaacagtagcttcatcatcgatggccctaacacccccgagtgtcccagtgccagccgggcgtggaatgtgtgggaggtggaggactatggttttggagtcttcacgacgaacatatggttgaagttgagagaggtctacacccaactgtgcgaccaccgcctcatgagcgccgccgtgaaagatgagagagccgtccacgcagacatgggttactggatcgagtcccaaaagaacggcagctggaagttagagaaggcaagtctgatcgaggtgaagacatgcacttggcctaaatcccacaccctctggtcaaatggcgtgctagaatcagatatgatcatccccaagagcttagccggcccaataagccagcacaattacaggcccgggtaccatacccagacagccggcccctggcacctaggaaagctagagctggacttcaattactgcgagggtaccacggttgtgatcactgagaattgcggcaccagagggccctccctcagaaccacgactgtgagcggcaagttgatccacgagtggtgttgccgctcctgcacactacctccactcaggtacatgggggaggatgggtgctggtatgggatggagattcgccccatcagcgagaaagaggagaacatggttaagtccctggtgagcgccggcagcggcgaagttgacaacttcactatgggcgtgctttgcttggccatcctatttgaagaggtgatgcggggcaagttcgggaagaagcacatgatagcgggggtgttctttaccttcgtcctgctactgagcggccagatcacctggcgtgacatggcccacaccttaatcatgatcggttccaacgcgagcgaccggatgggcatgggggtgacctatctcgcccttatcgcaactttcaagatccagcccttcctggcgctcggctttttcctgcgcaaattgaccagccgggagaacctcctcctgggggtaggcttagccatggctaccacgctgcagctacccgaggatattgaacagatggccaatggcatcgctctcgggctgatggcccttaaactcataacgcaattcgaaacctaccagctgtggaccgcgttaatttctctgacctgcagcaatacaatctttacgctgaccgtcgcctggcgcaccgcgaccctgattctcgcgggcgtttcgctgctgccagtctgtcagagctcctcgatgagaaagacggactggctgccaatgaccgtggcggccatgggggtgccgcctcttccactgtttatcttctccctcaaggacaccctaaaacgccgctcatggccactgaacgagggagtcatggccgtgggcctcgtgtccatcctggccagctcccttctccggaacgacgtccccatggcgggtcccctggtggctggcgggctccttatcgcctgctacgtgatcacgggcaccagcgccgacctaaccgttgagaaggcagcggacgtgacctgggaggaagaggctgagcaaacgggggtatcccacaacctgatgatcaccgtcgatgacgacggcaccatgcgcatcaaggacgacgaaaccgagaacatcctcaccgtgcttctgaagacggctcttttaatcgtgtcggggatctttccgtactccatccccgccaccctgctggtctggcacacctggcaaaagcagacccagagaagcggcgtactgtgggacgtgccctcaccacccgaaacccagaaggccgaactggaggagggcgtctaccgaattaagcagcaggggatcttcggcaaaacccaggtgggagtgggagtccagaaggaaggggtgtttcacaccatgtggcatgtaacccgcggcgcggtcctcacctacaatggtaagcgcttggagcccaactgggcttccgttaagaaggacctaatttcctatggaggcgggtggagactatcagcccagtggcagaagggcgaagaggtgcaggtcattgccgtggaacccgggaagaaccccaagaatttccagacaatgcccggcaccttccagaccacgacaggcgagatcggagcaatcgctctggactttaagcccggaacaagtgggtcccccatcatcaacagagaaggcaaggtggtcggcctgtacggcaacggcgtggtgaccaagaatgggggctacgtaagcgggatcgcccagaccaacgcggagccggacggccccacccccgagttggaggaagagatgttcaagaagcgcaacctcactatcatggacctgcaccccggctccgggaagacgcgcaagtacctacctgccatcgtgagggaggccatcaagagacggcttagaacactgatattagcccccacacgtgtggtcgcagcggagatggaggaggcactcaagggcctgcccatccgctatcagaccaccgcgaccaagagcgagcacacgggccgggagatcgtggacctgatgtgtcacgccacgttcaccatgaggctcctgtctcccgttcgtgtaccaaactacaacctgatcatcatggacgaggcgcatttcactgacccggcgtcaatagccgcgcgtggttacatctcaacccgggtggggatgggtgaagcagccgcaatatttatgacggcgacgccgcccggcacagccgacgccttcccgcagtctaacgctcccatccaggacgaggagcgcgacatcccagagcgctcctggaatagcggtaacgagtggatcaccgatttcgccggcaagaccgtgtggtttgtgccctccatcaaggccggtaacgatatagccaattgcctccggaaaaacggtaaaaaggtgatccagctgtcccgcaagaccttcgatacggaataccagaagactaagctgaacgactgggacttcgtggtcacaacagatatttccgaaatgggagccaattttaaggccgaccgggtgatcgacccgcgccggtgtctcaagcctgtgatacttacggacggccccgagcgggtcatcttagccggccccatgccggtgaccgcggcaagcgccgcccagcggcgcgggcgggtgggccgtaacccccagaaagagaacgatcagtacatttttaccgggcaacctctcaacaatgacgaggaccacgcacactggacagaggccaagatgctcctggacaacataaacaccccagagggcataatccctgccctcttcgaacccgagcgggagaagtccgccgcaatcgacggcgaatacaggttaaagggcgagagccggaagacattcgtcgagctgatgcgccggggcgacctccccgtgtggctggcacataaagttgcatccgaaggaatcaagtacaccgaccgcaagtggtgcttcgatggtcagcggaacaaccaaattctagaagaaaatatggacgtggagatctggacaaaagagggggaaaagaagaaactccgccccaggtggctggacgcacgtacctatagcgatcccttagccctaaaagaatttaaggacttcgctgcgggtcgcaagtccatagcccttgacctggtgaccgagatcggcagagtacccacccacctagcgcaccgaacccggaatgccctggataatctggtcatgctccacacaagcgagcacgggggcaaggcctaccgccatgcggtggaagaactgcccgagacgatggaaaccctgctactgctggggctcatgatactgctgacgggcggggccatgctgttcctaatctcaggtaagggcatcgggaagacatccatcggcctgatctgtgtcatagccagctccggcatgttgtggatggcagagattccgctgcagtggatagctagcgctatagtgctggagttctttatgatggtcctccttataccagagcccgagaagcaacggacgccacaggacaatcaactggcctacgtcgttatcggcatacttactctagctgccatcatcgccgcgaacgagatggggttactggagaccaccaagagggacctgggcatgtccaaggagcctggcgtggtcagccccacgtcctacctggacgtggacctccacccagcctccgcctggaccctgtacgcggtggcgacaaccgtaataacccccatgctgaggcacaccattgagaactccaccgccaacgttagcctcgccgcaatcgcgaaccaggcggttgttctaatgggcctggacaaaggctggccgatctccaagatggatctcggtgtgcccctgctggccctcggctgctatagccaggtgaaccccttgaccctgacggccgcggtactcctgctcatcacccactacgccatcattggcccgggcctccaggcgaaggccacgcgcgaggcccaaaagcgaacggctgccggcataatgaagaaccccacggtggacggcatcatgaccatcgatctggacccggtgatttacgactctaagttcgagaagcaactgggccaggtcatgctcctggtgctgtgcgctgtgcagctcctgctcatgcgcaccagctgggccctctgcgaggccctgaccctggctacgggcccgatcaccaccctctgggaaggctcccctggcaaattctggaacaccacgatcgctgtttcgatggccaacatattccggggttcgtacctagccggtgcagggctcgcgttcagcattatgaaatccgtgggcactgggaagcgcggcaccggcagccagggggaaaccctcggcgaaaagtggaagaagaagctgaaccagctaagccggaaggagttcgacctgtacaaaaagtccggcatcacagaggtggaccgcaccgaggcaaaggagggcctgaagagaggggagatcacccatcacgccgtctcgcggggctccgccaagttgcaatggttcgtggagaggaacatggtgatcccggagggccgcgtcatcgacctcggatgcggacgcggagggtggagctactattgcgccgggctgaagaaagtgactgaggtgcgtggctacaccaaaggcgggccaggccacgaggagcccgtccccatgtcgacatacgggtggaacatcgtgaaactgatgagcgggaaagacgtgttctacctcccgcccgaaaagtgtgacaccctgctctgcgacattggggagtccagcccctctccaaccgtcgaggagagccggaccatacgcgtcctgaagatggtagagccctggctcaagaacaaccagttctgcatcaaggtcttaaacccgtatatgcctacagtgatcgagcacctggagcgcctccagcggaagcacggaggcatgctggtgcgcaatcctcttagcagaaactccacccacgagatgtactggatctccaacgggactgggaacatagtggccagcgtcaacatggtttcccgcctcttattgaaccgtttcacaatgactcaccgacgtccgacgattgaaaaggacgtcgacttgggtgccggcacccgccacgtaaacgccgagcccgaaacccccaatatggacgtgatcggcgaacggatcaagcgcatcaaggaggaacacaacagcacgtggcactacgacgacgagaacccgtacaagacctgggcctaccacgggagctacgaggtcaaggccacaggtagcgcctcttccatgatcaacggggttgtaaagctgctaaccaaaccctgggacgtggtgcccatggtcactcaaatggcgatgacggacaccaccccctttggccagcaacgggtgttcaaggagaaggtggatacgcgcacacctcggagcatgcccgggacgcgcagggtcatgggtatcacagcggagtggttatggcgcacgctcggccggaacaagaagccccgcctgtgcacccgggaggagttcacaaagaaggtgcgcaccaacgcagccatgggggcggtgttcacggaggagaaccagtgggattccgccaaggctgcagtggaggacgaggacttctggaagctcgtggatcgcgagcgggagctgcataagctgggtaagtgcgggagctgcgtgtacaacatgatgggcaagcgcgaaaagaaattgggcgagttcggtaaggccaaagggtcgcgtgcgatttggtacatgtggctgggggcgcgttatctagagtttgaggccttagggttcttgaacgaggaccattggttcagccgcgaaaactcctactccggggtggaaggggaggggttacataagctaggctacatcctgcgcgacattagcaaaatccccggaggggccatgtacgcggacgacaccgcgggttgggataccagaatcaccgaagatgatctgcacaacgaggagaagatcacgcagcagatggatccggaacaccgccaactcgcgaacgccatcttcaagctgacctaccaaaacaaggtggtcaaagtccagcggcccacccccaccgggaccgtgatggacataatcagccgcaaagatcagcggggttccggacaggtgggcacctatggattaaacacatttaccaatatggaggcgcaactcatcagacagatggagggagagggcgtcctgagcaaggccgacctggagaacccccacttaccggagaagaagataacccagtggcttgagacgaagggcgtggagcggctcaagcgtatggcaatctccggggacgattgtgtagtcaagcccatcgacgaccgcttcgccaacgctctcctggccttaaacgatatgggaaaggtccgtaaggacatcccacagtggcagccctctaaagggtggcacgactggcagcaggtaccgttttgctcccatcacttccacgagctcatcatgaaggacgggagaaagctggtcgtgccctgccgcccacaagacgaactgatagggcgggcccgtataagtcaaggcgccggttggagcctccgggagaccgcttgcctggggaaggcctacgcacaaatgtggagcctgatgtacttccacagacgcgatctccggctagcctcaaacgcaatctgcagcgcagtgcccgtccattgggtgccaacctcccgcaccacgtggagcatccatgcccatcaccaatggatgaccacggaggacatgctgaccgtgtggaaccgggtatggattgaagataacccctggatggaggacaaaacgcccgtcaccacctgggagaacgtgccctacctgggtaagcgagaggaccagtggtgcggcagcttgatcgggctcaccagccgggcgacgtgggcgcagaacatcccgaccgcgatccaacaggtccgcagccttatcggcaacgaggagttcctggactacatgccgtccatgaagcggttcaggaaggaggaggagagcgagggcgccatttggtaa

SEQ ID NO: 26096 - RNA, 9873 nt, synthetic construct
  misc_feature 1..9873: note = derived and/or modified CDS sequence (opt11) from DENV-3__EU569691__SS-prME
  source 1..9873: mol_type = other RNA
acctccctctgtctaatgatgatcctgcccgccgccctggcgttccacctcacttcccgggacggggagccccggatgatcgtggggaagaacgaacggggtaagagcctactgttcaagaccgcctcggggaccaacatgtgcacgctcatagccatggacttaggcgagatgtgtgacgataccgtgacctacaagtgtccccacatcaccgaagtcgagccagaggacatagattgctggtgcaacctcaccagcacttgggtgacatacggaacctgcaaccaggcaggcgagcatcgacgcgacaagcggtccgttgccctcgcgccccacgtaggcatggggctggatacccgcacccagacgtggatgagcgccgagggtgcctggcggcaggtggagaaggtcgagacgtgggcactgcgccacccggggttcactatcctagccctctttctggctcactacatcggcacatccctcacgcagaaggtcgtgatctttatcctactgatgctcgtcactcctagcatgaccatgcggtgcgtgggcgtcggcaaccgtgacttcgtcgaaggcctgtccggggccacctgggtggacgtggtattagagcatggcgggtgcgtgacgacaatggccaagaacaaaccaaccttggatattgagctgcagaagactgaggccacgcagctggcgaccctacggaaactgtgcatcgagggcaagatcaccaacatcactacggacagccgctgccccacccagggagaggcggtgctcccggaagagcaggaccagaactacgtctgcaagcacacctacgtggataggggctggggaaacggatgcgggctcttcgggaagggctccctggtgacctgcgcgaagttccagtgcctggaacccatcgagggtaaggtcgtgcagtatgaaaacctcaaatacacggtgatcatcaccgtgcacactggggatcaacatcaggtgggcaacgagacccagggggtcacggccgagatcaccccacaagccagcaccaccgaggctatcctccccgaatacggcaccctgggtctcgagtgttcgccgcgcacgggactggacttcaacgagatgattctgctcaccatgaagaataaggcctggatggtgcacagacaatggttcttcgatctgccgctgccctggacgtctggagctaccactgagacaccgacctggaaccgcaaggagctcctggtgaccttcaagaacgcccacgccaagaagcaggaggtggtagtgctggggtcccaagagggcgctatgcacactgcgctcacgggagccacagagatccagaacagcggcgggacgtcaatttttgccgggcacttgaagtgtcgtctgaagatggacaaactcgaactgaaaggcatgtcttatgccatgtgtaccaacacgttcgtcttgaaaaaggaggtgtccgagactcagcacgggaccatcctcatcaaggtggagtacaagggcgaggacgtaccttgcaagattccattcagcacggaggacgggcagggcaaggcacacaacggcagactcatcactgcaaaccccgtggtcaccaagaaggaggagcccgtcaatatcgaggccgagccgcccttcggggagagcaacatcgtgatcggcatcggggacaacgccctgaagatcaattggtacaagaagggctccagcattggtaagatgttcgaggcgaccgccaggggcgcacgccggatggctatcctgggcgacacggcctgggatttcgggagcgtgggaggtgtcctcaacagcctgggcaagatggtgcaccagatctttgggtccgcgtacaccgcactgtttagcggggtgagctgggtgatgaaaatcggcatcggggtcctcctgacatggataggcctgaacagtaagaacacctcaatgagcttttcctgcatcgcgatcgggattataacgctctacctgggcgccgtggtccaggctgacatggggtgcgtgatcaactggaagggcaaggagctgaagtgtggtagtggaatcttcgtgacaaatgaggtccatacctggaccgagcagtacaagttccaggccgactcccccaaacgcctcgcgacggccattgccggcgcctgggagaatggggtgtgcggcatccgcagtaccacccggatggagaacctgctttggaagcagatagcgaatgaactcaactatattttgtgggagaacaacatcaaactgacagtggttgtgggggacataatcggagtgttggagcagggcaagcgcacgctgacaccccaaccgatggagttgaagtactcctggaagacctggggtaaagccaagatcgtgactgcggagactcagaacagctctttcatcatcgacggccccaacacccccgagtgcccatctgcgtcccgggcctggaacgtctgggaggtggaagactacgggttcggcgtattcactaccaacatatggctcaagctgcgcgaggtgtacacccagctctgcgaccatcggctcatgtcggcggcagtaaaggacgagcgcgccgtccatgccgatatgggctactggatcgagagccagaagaacggttcctggaagctggagaaggcgtcattaatcgaggtgaagacctgtacgtggccgaagtctcacaccctctggagcaacggcgtcctggaatccgacatgataatccccaagagcctggccgggcccatcagccagcacaactaccgtccgggataccacactcaaacggccgggccgtggcacctaggaaagcttgagctggattttaactattgcgagggcactactgtcgtgattaccgagaactgcgggacgcgcggcccgagcctccggacgaccaccgtgagtgggaagctcatccacgaatggtgctgccggagctgcacgctgcccccgctgcggtatatgggagaggacggatgctggtacggcatggagatccgacctatctccgagaaggaagagaacatggttaagagcctggtctccgccggcagcggggaggttgacaacttcaccatgggcgtcctgtgtttggccatactattcgaagaggtgatgcggggcaagttcgggaagaagcatatgatcgcgggggtgttcttcaccttcgtgctgctgttgtcaggccagatcacctggcgcgacatggcgcatacactgatcatgatcggaagcaacgccagtgaccggatggggatgggcgtgacctacctcgctctgatcgcaacctttaaaatacaacccttcctggcgctcggattcttccttcgcaagctgactagccgggagaacctcctgcttggcgtgggactagccatggccacgactctgcagctacccgaggacatagagcagatggccaatgggatcgctctcgggctgatggctctgaagctcatcacgcagttcgagacctaccagctgtggacggccctgattagtctgacatgctcgaataccatcttcaccctgactgtagcctggcgcaccgccacactgattctcgcaggggtgagcctgctgccggtctgccagtccagctccatgcgcaaaaccgattggctccccatgacggtggcagccatgggggtcccgccgctaccgctttttatctttaccctgaaggacactcttaaaagacgcagctggcccctgaacgaaggggtcatggcagtgggcctcgtctccatattagccagctccctactgcggaacgacgtcccaatggcgggccctcttgttgccgggggcctgctcatcgcatgctacgtgataaccggcacctcagccgacctgacggtggagaaggcagcggacgttacctgggaagaggaggccgagcaaacaggcgtatcacataacctgatgatcactgtcgacgacgacgggacgatgcggattaaggacgacgagaccgaaaacatcctcaccgtgctgctgaagaccgccctcttaattgtgtctggcatcttcccctactccatccccgccacgttgctcgtgtggcatacctggcagaaacaaacccagcggagcggagtgctgtgggacgtgcccagcccgcccgaaacccaaaaagccgagctggaggagggggtctatcgcatcaagcagcaaggcattttcgggaagacgcaggtgggcgtgggggtccagaaggaaggcgtgttccacaccatgtggcacgtgacacggggagcggtcctcacccacaacgggaagcgactggagcccaactgggcatccgttaagaaagacctgatctcctacggcgggggctggcggctcagcgcccagtggcagaagggggaggaagtgcaggtcatcgccgtggagcccggcaagaaccccaagaacttccagacgatgccaggcacgtttcagacaactacgggggagatcggcgcgattgccctcgacttcaagcccggaaccagcggaagccccatcatcaaccgcgagggcaaagtggtcggcctgtacggcaacggggtggttaccaagaacggcggatacgtcagcggcatcgcccagaccaacgccgagccggacggccccaccccggagctagaggaggagatgttcaaaaaacggaatctcaccatcatggacttacaccccgggtccggcaagacccgcaagtatctgccggccatcgtgcgtgaagcgatcaagcgcaggctccgcactctgatcctggcgcccacgcgggtggtcgctgccgagatggaggaggctctcaagggcttacccatccggtaccagaccactgcgacaaagtcggagcatacgggccgggagattgtggacctgatgtgccacgcgaccttcactatgcgcctcctgtcccccgtgcgggtcccgaactacaacctgattatcatggacgaagcccacttcaccgatcccgccagcatcgccgcgcgcggctacatctccacacgggttggcatgggcgaggccgctgctatatttatgaccgcgaccccacccgggactgccgatgccttccctcagtcgaacgcacccatccaagatgaggagcgagacatccccgagcgctcgtggaacagcggcaatgagtggataaccgacttcgccgggaagaccgtttggttcgtcccttccatcaaggctggcaacgatatcgcaaactgcctcaggaaaaacgggaagaaggtgatccagttgagccgcaagactttcgacaccgaataccaaaagactaagcttaacgactgggacttcgtggtcaccacggacatctccgagatgggcgccaacttcaaggcggacagagtcatcgatccgcgccgctgtctcaaacctgtgatcctgaccgacggccccgagcgcgtcattttggccgggcccatgccggtgacagctgcctcggccgcccagcggcgcggccgggtggggcgcaatccccaaaaagagaacgaccagtatatctttacgggccagcccctcaacaacgacgaagaccacgcccattggaccgaagcgaagatgctgctagataacatcaacacccccgaaggaatcatcccggcccttttcgaacccgagcgggagaagtccgcggcaatcgacggcgagtaccgcctgaagggcgaaagccggaagaccttcgtcgagttaatgcgccgcggggacctccccgtctggctggcgcacaaggtcgcctccgagggcattaagtacacggaccgtaagtggtgcttcgacgggcaacggaataaccagatcctggaggagaacatggacgtggaaatctggaccaaggagggtgagaagaagaaactgcgcccccgctggctggacgcccgtacctactcagacccgttagccctcaaggagttcaaagacttcgctgcgggccgcaagtccatcgccctggacctggtgaccgagatcgggcgcgtccctacgcacctagcccaccgcacccggaacgccctggacaatctggtgatgctccacaccagcgaacacggcgggaaggcctaccgccatgcggtggaggagctacccgagaccatggagacgctactcctgctgggcctcatgatcctgctcaccggcggcgccatgctcttcttaatctccgggaaggggatcggcaaaaccagcatcgggctcatctgcgtcatcgcctcttccggcatgttatggatggccgagatccctctgcaatggatcgccagcgcgatcgtgctagagttcttcatgatggttctcctcatcccagaacccgagaaacagcgaacgccccaagataaccagctggcctacgtggtgatcgggatcttaacgctggcagccatcatcgccgcgaacgagatgggactactcgagacgaccaagagagatctgggcatgtccaaggagccgggggtggtcagccccacctcctatctggatgtggacctacaccccgccagcgcctggacgttgtacgccgtggcgaccaccgtcattacccccatgctgcgtcacacgatagaaaacagcaccgccaatgtcagcctcgcggccatcgccaaccaggcggttgtcttaatgggcttagacaaggggtggcctatctccaagatggacctcggagttcccctgttagccctagggtgctacagccaagtgaatcccctgaccctaacggcggccgtcctcctgctgattacgcattacgctatcatcggtccaggcttgcaggcgaaggccacacgcgaggcgcagaagcggaccgccgccggaattatgaagaacccgaccgtggacggcatcatgacgatcgacctggatcccgtgatctacgactccaagttcgagaagcagctggggcaggtcatgctcctcgtgctgtgcgcggtacagctcttattgatgagaacctcttgggcgctatgcgaggccctgaccctggccactggtccgatcacgaccctctgggagggctcccccggaaaattttggaacaccaccatagcggtgagcatggcaaacatttttagaggctcttacctcgctggggccggcctggccttcagtattatgaaatccgtggggaccgggaagagagggacggggagccagggtgaaaccctcggggagaagtggaagaagaaactgaaccagctgtcccggaaggagtttgacctctacaagaaatcaggtatcaccgaagtggacagaaccgaggcgaaagaggggctgaagcgaggcgagattacgcaccacgccgtcagccgcggctcagcgaagttgcagtggttcgtggagcgaaacatggtaattccggaggggcgagtcatcgacctcggctgcggtcggggcggatggagctactactgcgccggccttaagaaagttaccgaggtgcgcggctacaccaagggagggcccggtcacgaggagcccgtcccaatgtccacctacggctggaacatcgtgaagttgatgagcgggaaagacgtgttctacctcccgcccgagaagtgcgacactctgctgtgcgacatcggcgagtcctcaccctcccccactgtcgaggagagccggacgatccgcgtgctgaagatggtggagccgtggctcaagaacaaccagttctgcatcaaagtcttaaacccctacatgcccaccgtgatcgagcacctcgagcgccttcaacggaagcatggcggaatgctggtgcgcaacccgctctcccgcaatagcactcacgagatgtactggatcagcaacggcaccgggaacatcgtcgctagcgtgaacatggtgtcacgattactgcttaaccggttcaccatgacccaccgccgcccgacgatcgagaaggacgtagacctcggcgcaggtacccgccacgtgaacgccgagcccgagacccccaacatggacgtgatcggggagcggattaagcgcatcaaagaggaacacaacagcacctggcattacgacgacgagaatccgtaccgcacgtgggcctatcacggcagttacgaggtcaaagctaccggttcggcctccagcatgatcaacggcgtggtcaagctgcttaccaagccctgggacgtggttcccatggtgacccaaatggcgatgaccgacaccaccccctttgggcaacagcgcgtgttcaaggagaaggtggacactcggacgccgcgctccatgccaggtacccggagagtcatgggaattactgccgagtggctctggcgtaccctggggcggaacaagaaaccccgactgtgcacacgcgaagagttcaccaagaaggtgcgcaccaacgctgcaatgggtgcggtgtttaccgaggagaatcagtgggacagcgcgaaggcggccgtcgaggacgaggacttttggaagctcgtggaccgggagcgggagttgcacaagctgggtaagtgcggctcatgcgtgtacaacatgatggggaagcgggagaagaagctcggcgagtttggtaaggccaagggctcccgcgcgatctggtacatgtggctgggcgcccggtacctggagtttgaggcgcttgggttcctgaacgaagaccactggttcagccgcgaaaactcatactcgggcgtcgagggtgagggcctgcacaagctgggatacatcctccgggatatctccaagatccccgggggagccatgtatgccgacgacacggcggggtgggacacccgcatcaccgaggacgacctgcataacgaggagaagatcacgcagcaaatggacccggaacaccgacagctagccaacgccattttcaagcttacctatcagaataaggtggttaaggtccagcgccccacgcccaccggcaccgttatggatattataagccggaaggaccaacgcggctccggccaggtgggcacgtacgggctgaatacgttcaccaacatggaggcccagctgatccggcagatggagggcgaaggggttcttagcaaggcagatctggaaaacccccacctcccggagaagaagatcacccaatggctggagaccaagggagtagagagactgaagcggatggcgatctctggcgacgactgcgtggtcaagccgatcgacgaccgcttcgccaacgcccttctggccctgaacgacatggggaaggtgcgtaaggacatcccacagtggcagcccagcaagggctggcacgactggcagcaggtcccgttctgctcccaccatttccacgagttaataatgaaggacggccgcaagctggtggtgccctgccggcctcaggatgaacttataggccgcgcacggatcagccaaggagcaggctggtccctcagggaaacggcctgcttaggcaaggcctacgcccagatgtggagcctgatgtactttcacagacgggatttacgcctggcatcaaacgccatctgctctgccgtgcccgttcactgggttccgacctcccggacaacctggagcatccacgcccaccaccagtggatgacgacagaggacatgctgaccgtgtggaacagagtttggatagaggataacccctggatggaggacaagacccctgtgaccacttgggagaacgtgccctaccttgggaagagagaggaccagtggtgcggctccctgatcggtctgacctcacgcgcaacctgggcccagaacatccctaccgccatccagcaagtccggagcctcatcggcaacgaggagttcctggactacatgccgtccatgaaacgcttccggaaggaagaggagagcgagggagccatctggtga

SEQ ID NO: 26097 - RNA, 9873 nt, synthetic construct
  misc_feature 1..9873: note = derived and/or modified CDS sequence (opt11) from DENV-3__EU482452__SS-prME
  source 1..9873: mol_type = other RNA
actagcttatgtttaatgatgatgctgcccgccaccctggcttttcacctcacctctcgggacggcgaaccccggatgatcgtggggaagaatgagcgcggcaagagtctgctattcaagaccgcgtccgggatcaacatgtgcaccctcatcgccatggacctcggcgagatgtgtgacgataccgtgacctacaagtgccccctgattgccgaagtggagcctgaggacatcgactgctggtgtaacctgaccagcacatgggtgacttacgggacgtgcaaccaggcgggcgaacaccggcgcgataaacgctccgtggccctggcgccccacgtgggcatggggctggacacacgcacccagacctggatgagcgcagagggcgcctggcggcaggtcgagaaggtggagacgtgggcgctccggcatcccggcttcaccatactagcactctttctcgctcactacatcggcacatccttgacccaaaaggtggtaatattcatactgctcatgctggtgacgcctagcatgaccatgaggtgcgtgggtgtgggcaaccgcgactttgtggagggcctgtcgggggccacctgggtggacgttgttctcgagcatggcggctgtgtgacgactatggctaagaacaagccaacattagacatcgagctgcagaaaaccgaggcgacccaactcgctacgctccggaagctctgcattgagggcaagatcacgaacataacgacggatagcagatgtcccacgcagggcgaggcgattctccctgaggaacaggaccagaattacgtatgcaagcacacgtatgtagaccgggggtggggcaatgggtgcggtctattcggtaagggttccctggtgacgtgtgccaagtttcaatgcctcgagcccatcgaaggtaaagtggttcagtatgaaaacctgaaatacaccgtgataatcacggtccacaccggggaccagcaccaggtcggcaacgacacccaaggggtgacagtggagatcacgccccaggccagtactgtggaggctgtattacccgagtacggcaccctcgggttagagtgctccccgcgcactggcctcgacttcaatgagatgatcctcttgacgatgaagaacaaggcgtggatggtccaccgtcaatggttcttcgacctgccgctaccatggacctctggtgccacgaccgagaccccaacttggaacaggaaggagctgctggtcaccttcaaaaacgcccacgccaaaaaacaggaggtggtcgtgctcgggtcccaggagggtgccatgcacacagcgctgaccggggccacggagatccagaattcgggcggcacttctatctttgctggacacctgaagtgccggctaaagatggacaaactggaattgaaggggatgtcttacgccatgtgcttagacaccttcgttctgaagaaggaggtcagcgagacccagcacgggacgatcctgatcaaagtggaatacaagggcgaggatgcgccgtgcaagatccccttcagcaccgaggacgggcagggcaaggcgcacaacggacgcctgattacagccaaccccgtggtaaccaagaaggaggagcccgtcaacatcgaggccgagccgcccttcggggagtcgaatatcgtcatcgggatcggggacaaggccctcaaaatcaattggtacaagaaaggctcctcaatcggaaaaatgttcgaagcaacggcgaggggcgcccggagaatggccatcttgggcgacaccgcctgggattttggatcagtcggcggggtgctgaactcactcggcaaaatggttcatcagatattcgggtcagcgtacacggccctgttcagcggcgtctcctggatcatgaaaatcggcatcggggtgctgctcacctggatcggcttaaacagcaagaacacatccatgtctttctcttgcatcgtgatcgggatcatcacactgtatctcggcgccgtagtgcaggccgacatggggtgcgtcatcaactggaagggcaaggagctgaagtgcggtagcgggatattcgtcacgaacgaggtccacacctggacggagcagtacaagttccaggccgactctcccaagagactggcaaccgcaatcgccggcgcctgggaaaacggggtgtgcggcatccgcagcaccacgcggatggagaatctcttatggaagcagatcgccaatgaattaaactacatcctctgggaaaataacatcaagctgacagtcgtggtaggggacgtcataggcgtactggagcaaggcaagcgtacgctcacaccccaaccgatggagcttaaatactcctggaagacatgggggaaggcgaagatcgtcacagccgagacccagaattctagctttatcattgatggcctgaacacccccgaatgccccagcgcctcccgggcctggaacgtatgggaagtggaggactacgggtttggcgttttcacaacaaacatctggctcaagctacgcgaggtctacacccagagctgcgaccaccggctgatgagcgcggcaatcaaggacgaacgcgcagtgcatgccgacatgggctactggatcgaatcccagaagaacgggagctggaagctagagaaggcctcgttcattgaggtaaagacctgcacctggcccaagagccacacattatggagtaacggcgtgctggagagtgacatgattatcccaaagagcctcgcggggcccatcagtcagcacaaccaccggcccggttaccacacgcagaccgcggggccatggcatctgggtaaactggagctcgactttaattactgcgagggtaccacagtagtgatcacggagaactgcggtacccgcgggccctccctgcggacaacaacagtctcagggaagctgatccacgagtggtgctgccgctcctgcaccttgccgcccctcaggtacatgggagaggacgggtgttggtacggcatggagatccggccaatcaacgagaaggaagagaacatggtcaagagcttggtttccgccggctcagggaaggtcgacaatttcaccatgggagtcctatgcctggctatcttattcgaggaggtgatgcgtggtaagttcggcaaaaagcacatgatcgccggggtcttattcaccttcgtcctgcttctctcgggtcagatcacatggcgcgacatggcgcataccctgatcatgatcggtagcaatgccagtgacagaatggggatgggcgttacctatttagccctcattgccaccttcaagatccagccctttctggcattgggatttttcctccgcaagctaacgagccgggagaacctgcttctgggagtcggcctggcgatggcgaccactctccaactgccggaggatatcgagcagatggccaacgggatcgctctgggcctcatgaccttgaagctgattactcaattcgaaacttatcaactctggaccgcgttagtgtccttgacctgctctaatacgatattcaccctcacagtagcctggcgcaccgccacgcttatcttggcgggggtgagcctcctgccactttgccaatctagctccatgcggaaaaccgattggctcccgatgaccgtggccgcgatgggagtcagccccttgcccctgttcatcttctccctcaaagacaccccgaagcgcaggagctggccgctcaacgagggtgtgatggcggtcggtctggtaagcattctagccagctccctcctgcgcaacgacgtaccaatggccggtcccttagtcgccggcggcctgctgatcgcgtgctacgtcatcacggggacctcagccgatctcacggtggagaaagccgccgacgtaacctgggaggaggaagcagagcagacgggggtctcccacaaccttatgatcactgtggacgacgatggcacaatgcgcattaaggatgatgaaacagagaacatattaaccgtgctcctgaagacggctctgctcatcgtgagcggcattttcccatactccatcccggccaccctgctagtgtggcacacgtggcagaagcagacgcagcgaagcggcgtgctctgggatgttcccagtccgcccgaaacgcagaaggccgaactggaggaaggagtttatcgtattaagcagcagggcattttcgggaagacccaggtgggcgtcggcgtgcagaaagaaggtgtattccataccatgtggcatgttacccggggtgcagttctgacgcacaacgggaagcgcctcgagccgaactgggcctcagtcaagaaggacttaatctcctacggaggtggatggcggctcagcgcccagtggcagaagggtgaagaagtgcaagtgatcgccgtagagcccggcaaaaaccccaagaatttccaaaccatgcccggtatcttccaaaccaccacgggggagatcggtgccattgccttggactttaagccgggtacctcaggcagtcctattatcaaccgcgagggtaaagtcgtagggctctacggcaacggtgtggttacgaagaacggcggctacgtgtccggcatcgcgcagaccaacgcggaacccgacggacccacacccgagttagaggaggaaatgttcaagaaacggaatctgacaatcatggacctccaccccgggtccgggaagacacgcaagtacctccccgccatcgtgcgggaggccatcaagcgccgtcttagaacgctaatcttggccccgacgcgggtcgtcgcggcggagatggaggaagccctgaagggactacccattcgctaccagaccacggcgacgaaaagcgaacatacaggccgggagatcgttgacctgatgtgtcacgccaccttcaccatgcgattgctcagtcctgtccgggtgcccaactacaatctgatcattatggatgaggcgcacttcactgacccggcaagcatcgccgcgcgcgggtacatatccactcgtgtgggcatgggcgaagctgcagcaatcttcatgacagccacgccgcccggaacggccgaggcgtttccacagtcgaacgcaccgatccaggacgaggaacgcgacatccccgaacgatcctggaacagcggcaatgagtggataacagacttcgtcgggaagaccgtgtggttcgtgccgtccattaaggctgggaatgacatcgccaattgcctgcggaagaatgggaaaaaggttatccagctcagccgcaaaacctttgataccgagtaccagaagacgcggctgaacgactgggactttgtagttaccaccgacatctccgagatgggcgcaaacttcaaggcggaccgcgtcatcgatccccgacggtgcctgaagccggtgatcctcacagacggacccgaacgggtgatcctggccgggccgatgcccgtcaccgcggcgtcggccgcgcagcgccgtggccgagtgggacgtaacccacaaaaggagaacgaccagtacatcttcaccggccaacctctgaataacgacgaggaccacgcccactggaccgaggccaagatgctcctggacaacatcaatacccccgagggtatcatccccgccctgttcgagccggaacgggagaagtctgcggcgatcgacggcgagtaccggctaaagggggagagccgcaagacgttcgtcgagttaatgagacgcggcgacctgcccgtgtggctcgcccacaaggtggcttccgagggaatcaagtacacggaccggaagtggtgtttcgacggggagcgcaataaccagatcctagaggaaaacatggacgtcgagatatggacgaaggagggtgaacggaagaaattaagaccccgctggcttgacgcgcggacctacagcgaccccctagcgctgaaagagtttaaagacttcgctgctggccgcaagtccatagccctcgatctggtaaccgagatcggccgggtaccgagccacctggcctaccgcactcggaacgcgctcgacaacctggtcatgctgcacaccagcgaacacgggggtcgcgcctacaggcacgcagtggaggaacttccagagaccatggaaaccctcctgctcctggggttaatgatcttactcacgggcggggccatgctgttcctcatatcagggaaggggatcggcaaaacctctatagggctgatctgcgtaatcgtttccagcggcatgctgtggatggccgatatccccctccagtggatagcgtccgcgatcgtactggaattcttcatgatggtcttattgatcccggaacccgagaagcaacgcactccccaggataaccagctggcctacgttgttatcggtatcttaactctcgcagccatcgtggcagccaacgagatgggcctgctcgagacaaccaagcgggatctcggaatgtcgaaggagccaggggtcgtatccccgacgagctatctggacgtggacctgcaccccgcctccgcttggaccctctacgccgtcgccacaaccgtgatcacccccatgctgcgacacacaatagaaaacagcacggccaacgtgtccctggccgcgatcgcgaatcaagcggtagtgctcatgggcttagacaaggggtggcccattagcaaaatggacctgggagtaccgctcttagccctgggatgctactcccaggtcaacccactcacattaactgccgccgtgctcctgctggtgactcactatgcaatcatcggccccggcttgcaagcgaaagccacgcgggaggcccagaaacgcaccgctgcggggattatgaagaacccaacagtcgatggcatcatgacaatcgacctcgacccggtgatctacgactcgaaattcgagaagcagctgggccaggtgatgctgctcgttctgtgtgcggtgcagctactcttaatgcggacgtcctgggccctttgcgaagcccttaccttggccaccggccccatcaccacgctctgggagggcagccccgggaagttctggaatacgaccatcgcggtgtccatggccaatatcttccgcggcagctacctcgccggtgccggcctggcattctccatcatgaagagcgtggggacaggccggcgcggaacggggagccagggcgagacgctgggtgagaagtggaagaagaagctcaatcagctgtcccggaaggagttcgatttgtacaaaaagtccggaatcaccgaggtagaccgcacagaggcgaaggaggggctcaaacggggcgagactacgcaccacgctgtaagtcgcggcagcgccaaactccagtggttcgtggagagaaacatggtgatcccggagggtcgcgtgatcgatctgggctgcggtcgcggcgggtggtcctactactgcgcaggcctcaagaaagtaacggaggttcggggctacaccaagggcgggccagggcacgaggagcccgtgccgatgagcacctacggctggaatatcgtcaagctgatgtccggtaaggacgttttttacctgcctccggagaagtgcgacacgctgctctgcgatataggagaaagctccccctctccaacagtcgaagagtcccgcacaatccgcgtcctgaagatggtagaaccctggctgaagaacaaccagttctgcatcaaagtgctcaacccgtatatgccgaccgtcatcgaacacttggagcgcctgcaacggaagtatggtggcatgctcgtgcgcaaccccctaagccggaatagtacacacgagatgtactggatcagcaacggcacggggaacatcgtctccagcgtcaacatggtttcccgcctgctcctgaatcggttcaccatgacccaccgccggcccacgatagaaaaggatgtcgacctgggcgccgggacgcgccacgtaaatgctgaaccggagacccccaacatggatgtgatcggagagcggatcaagcgcataaaggaggagcactctagtacctggcattacgacgacgagaatccttacaagacgtgggcctatcacggcagctacgaggtaaaagccactgggtcggcgtcgagcatgatcaacggagtggtaaagctactcacgaagccgtgggacgtcgtgccaatggtgactcagatggcgatgacggacaccaccccctttggtcagcagcgggtattcaaggaaaaggttgatacccgcacgccccggccgatgccgggcacacgcaaggttatggagattaccgctgagtggttgtggcgaaccctcggtcgcaacaagaagccccggctgtgcacgcgggaggagttcaccaagaaggtccgaaccaacgccgccatgggtgctgtgttcaccgaggagaaccagtgggactccgcgcgtgcggccgtggaggatgaggagttctggaagctggtcgacagggagcgcgagctccacaaactgggcaagtgcgggtcgtgcgtctataacatgatgggtaagcgcgagaagaaattgggggagttcggcaaggccaaggggtcccgggcgatctggtacatgtggttgggcgcgcggtacctggagtttgaagccttagggttcctcaacgaggaccactggttctctcgggagaactcctacagcggggtggagggcgagggtctgcacaagttgggctatatcctacgcgatatctcaaagatccccggcggggccatgtacgccgatgacacagcgggctgggacacccggattaccgaggatgacctccacaacgaggagaagattacccagcagatggatcccgagcatcgccagctcgccaacgccattttcaagctcacgtaccagaataaggtcgtgaaggtccagcggccgacccccaaagggacagtcatggatatcataagtcgcaaggaccagcggggctcaggtcaggtaggaacctacggcctgaacaccttcactaacatggaagcccagttagtgcgccaaatggagggggagggggtcctcagcaaagccgatctggaaaacccccatctccttgagaaaaagatcactcagtggctggagaccaagggagtggagcggcttaagcgaatggcgatctctggcgacgactgtgtggtcaagccgatcgacgaccggtttgccaatgcattactggcactgaacgacatggggaaggtgaggaaggatatcccccaatggcagcccagcaagggatggcacgactggcagcaagtgcccttctgctcgcaccacttccacgagctcatcatgaaggacggtcggaagctggtcgttccatgccgcccgcaggacgagctgattgggcgggcccggatctctcagggcgcggggtggtcccttaaagagaccgcctgcctgggcaaagcctacgcacagatgtggagcttgatgtatttccatcggagggacctccgcctggcctccaacgcgatctgcagcgccgtgcctgtccactggattcccacgagcagaaccacctggtccatccacgcccaccaccagtggatgaccacggaggatatgctgaccgtgtggaacagggtgtggattgaggacaacccatggatggaggacaagacccccgtcaccacgtgggaggacgttccgtatctcggcaagcgcgaggatcagtggtgcgggagcctgatcggccttaccagccgcgcgacctgggcgcagaacatcctcaccgccatacagcaggtacggtcgctgatcggagacgaagagttcctggactacatgccctccatgaagcgcttccggaaggaggaggagagcgagggcgccatctggtaa

SEQ ID NO: 26098 - RNA, 9873 nt, synthetic construct
  misc_feature 1..9873: note = derived and/or modified CDS sequence (opt11) from DENV-3__EU482453__SS-prME
  source 1..9873: mol_type = other RNA
acgagcctgtgcctcataatgatgctacccgcgacgctggccttccacttaaccagccgcgatggcgagccgagaatgatcgtcgggaagaacgaacggggtaagagcctgctgttcaagaccgcgtcggggatcaatatgtgtaccctaatcgccatggacctaggtgagatgtgcgacgataccgtgacttacaagtgccccttaatcgcagaagtggagcccgaggacatcgactgctggtgcaatctaaccagcacctgggtaacgtacggcacgtgcaaccaggccggggaacaccggcgcgacaagcgctccgtcgcgctggcgccccatgtgggtatggggctggacactcgtacgcagacgtggatgtctgccgagggcgcctggcggcaggtggaaaaggtcgagacgtgggccttacgccacccgggcttcacgatcttagccctgtttctcgcccactacatcggcaccagcctgacccagaaggtagtgatcttcatccttcttatgcttgtcacgccctcgatgaccatgcgctgcgtgggggtaggcaaccgcgacttcgtcgagggcctctccggagccacgtgggttgacgtcgtcctcgagcacggggggtgcgtaactacgatggccaagaacaagcccaccttggacattgagctccaaaagacagaggccacccagttggctacgctgcggaagttatgcatcgaaggcaagataactaatatcaccaccgatagccggtgccccacgcagggcgaggcgatcctgccggaagagcaagaccagaactatgtgtgcaaacatacctacgttgaccggggatggggcaacggctgcggactgttcggaaagggttctctggtgacctgcgccaaattccagtgcctcgagcccatcgagggcaaagtggtacagtacgaaaaccttaagtacaccgtgatcatcacggtgcacacgggtgaccaacaccaggtgggtaatgacacccagggggtgaccgtcgagattacacctcaggctagcactgtggaagccgtcctgcctgagtacggcacccttgggctggaatgctcgccacgcaccggcctggacttcaacgagatgatactcctgaccatgaagaacaaagcttggatggtccacagacagtggtttttcgatctgcccttaccctggactagcggcgccaccacagagacccctacgtggaaccgtaaggagctgctagtcacctttaagaacgcccacgccaagaaacaggaagtggtcgtgcttggctcccaagagggcgccatgcacaccgcgctgacaggggccacggagatacagaacagcggtgggacctccatatttgcaggccacctgaagtgcaggctaaagatggacaagctggagctcaaaggcatgagctacgccatgtgcctcaataccttcgttctgaaaaaggaagtgagcgagacgcagcacggtactatcctaatcaaggtggagtacaagggcgaagacgccccgtgtaagatccccttctcaacggaggacgggcagggcaaggcgcacaacgggcgcttaatcaccgccaaccccgtggtgactaagaaagaggagcccgtgaacatagaggcagagccgcccttcggcgaaagcaacatcgtgataggcatcggggataaggccctcaagattaattggtacaagaaagggtcaagcatcggcaagatgtttgaggctacggcccgtggcgcccgccgcatggcgattctgggcgataccgcctgggactttggcagcgtaggtggtgtgctgaactctctcggaaagatggtgcaccagatattcgggtccgcatacaccgccctcttctctggcgtctcgtggatcatgaagatcggcatcggggtgctgctcacgtggattggtctaaatagcaagaacacgtcaatgagcttctcctgcatcgcgatcggcattatcactctgtacctcggggcggtagtccaggccgatatgggttgtgcgataaattggaagggcaaggagctgaagtgtggaagcgggatcttcgtcaccaacgaagttcacacatggactgaacaatacaaattccaggccgacagccctaaacgcctggcgaccgctatcgccggcgcttgggagaacggggtctgcggcatccgatctaccacccgcatggagaacctcctttggaagcagatcgccaacgagctgaactacattctctgggagaataacataaaactcacggtggtggtcggtgacataatcggcgtgcttgagcaggggaagagaaccctcaccccccagccgatggagctcaagtattcatggaagacatgggggaaggccaaaatcgtgacggcggagacccagaatagctcattcataatcgacggccctaacacccctgagtgcccaagcgcttctcgggcctggaacgtctgggaggtggaggactacgggttcggtgtgttcactactaacatctggttaaagctgcgcgaggtctatacgcaatcctgcgaccaccgtctgatgagcgcggccatcaaggatgagcgcgccgtgcatgcagacatgggctattggatcgagtcccagaagaatggctcatggaagctggagaaggccagcttcatcgaggtgaagacgtgtacatggcccaagtctcacaccctctggtcaaatggtgttctggagtccgacatgataattcccaagtccctggccggtcccatcagccagcataatcaccggccgggctaccacacgcagaccgccgggccctggcacctcggtaagttggagctggatttcaactactgcgagggcacgaccgtggtgataacggagaactgcgggacacggggcccttccctccggaccaccacggtctcagggaagctcatccacgaatggtgttgccgatcctgcaccctgccgcctttaaggtacatgggagaagacgggtgctggtacggtatggaaatccgccctactaatgagaaggaggagaacatggtcaagagcctggtctccgcaggcagcgggaaggtggataattttaccatgggggtgctgtgcctcgcaatcctgttcgaggaggtcatgcgggggaagttcggcaagaagcatatgatcgctggggtccttttcacgttcgtgcttctgctttccggacagatcacctggcgtgacatggcccacaccctcattatgatcggcagcaatgcctccgaccggatggggatgggcgtgacctacctggccctgatcgcgacattcaagatccagccttttctagccctggggttcttcctgcggaagctaaccagtcgggagaacttactgctcggcgtgggactagccatggccaccaccttacagttacccgaggatatagaacagatggcgaacggcatagccctgggcctgatgacgttgaagcttatcactcagtttgagacctatcagctatggaccgccctcgtgtccctgacgtgctccaacacgattttcaccctgaccgtggcctggcgcacggctacgttgatccttgcgggcgtcagcctgctccctttgtgccagtcaagctccatgcgcaagaccgactggttgcccatgaccgtggcagctatgggcgtaccgcccctgccactgttcatcttctcgctaaaggacacgcccaagagacgctcatggcccctcaacgagggggtgatggcagtgggcctggtctcgatcctagcttcctctttgcttcgaaatgacgtgccaatggcgggcccgctggtggccggcggcctcctgattgcgtgttacgtcatcacagggacctctgctgacctgaccgtggagaaagccgcggacgttacctgggaggaggaggcagagcaaaccggcgtgagccacaatttgatgatcacggtggacgacgacggaaccatgcgtataaaagatgacgagaccgaaaatatcctaacagttctcctcaagacagctctactgatcgtttccggcattttcccctactctatccccgctaccctcctggtttggcacacatggcagaaacaaacgcagcggtccggggtgctgtgggatgtaccctccccgccggagactcagaaggccgaactagaggagggggtttatcgcataaagcagcagggcatctttgggaagacccaggtgggcgtgggagtgcagaaggagggagtattccataccatgtggcacgtgacgcggggggcggtgctgacacacaacgggaagcgcctggagcccaactgggctagtgtgaagaaggatctcatcagctacggcggggggtggcgactgtccgcccagtggcaaaagggggaggaggttcaagtgatcgccgttgagccgggaaagaacccgaaaaacttccagaccatgccaggaattttccagacgacgaccggggagataggtgcgatcgccctggatttcaagcccgggaccagcggcagccccatcatcaatcgcgaaggcaaggttgtggggctgtacggaaacggtgtggtgactaagaacggggggtatgtatcgggaatagcacaaacgaacgccgagcccgacggccccacccccgagctcgaagaggagatgttcaaaaagcgcaacctgactatcatggatttacaccccgggagcggcaaaactcgcaagtacttacccgcaatcgtgagagaagcgataaagaggaggttgcgcactctgatcctcgccccgacccgggtggtggccgcggagatggaggaggccctgaaaggcttacccatacgctatcaaaccaccgcgactaaatccgagcacaccggccgggagatcgtggacctgatgtgtcacgccaccttcaccatgcgcttactgagcccggttcgcgtgccgaactataacctaatcatcatggacgaggcccactttacggatcccgcctccatcgctgcgagaggatacatttcgacacgggtgggaatgggtgaggcagctgcaatcttcatgacagcaactccacccgggactgctgaagccttcccccagtccaacgcgccaatacaagacgaggagcgggacatcccagagcgcagctggaactccggcaacgagtggatcaccgatttcgtggggaaaaccgtgtggttcgtgcccagcatcaaggccggtaacgacatagcaaattgcctgcggaaaaacggaaagaaggtcatacagctttcccgcaaaaccttcgatacggagtatcaaaagacccggctcaacgactgggacttcgttgtcaccaccgacatcagcgagatgggcgccaacttcaaggccgaccgcgtcatcgatccgcggagatgcctgaagcccgtgatcctaacggacggccccgagcgggtgatcctcgcagggcccatgcccgtcactgccgcgagtgccgcccagcgccgggggcgcgtcggacgcaaccctcaaaaggagaacgatcagtatatcttcacagggcagcccctgaacaacgatgaggaccacgctcattggactgaggccaagatgcttctcgataatatcaacaccccggaggggataatccctgcgctgttcgagcccgaacgggagaagagtgcagccatagacggcgaatacaggctgaaaggcgagtcccgcaaaacgttcgttgagcttatgcggagaggggacttgccggtctggctggcgcacaaagtcgctagcgagggcatcaaatacaccgaccggaagtggtgtttcgacggggagcgcaacaaccagattctcgaggagaacatggacgtagagatctggaccaaagagggtgaacggaaaaagctgcgcccacgctggctggatgccagaacctacagcgatcccttggccctgaaggaattcaaggacttcgctgccggccgtaaaagcatcgctctggacctcgtaacggagatcgggcgggttccgtcccatctggcctaccgcacccggaacgccctggacaacctagtcatgctgcatacatcagagcacggtggacgcgcctaccggcacgccgtggaagagctgccggagaccatggaaacgttgctgctcctgggtttaatgattctgttaaccggcggcgcgatgctattcttaatcagcggcaaagggatcggcaagaccagcatcgggctcatttgcgtgatcgtcagctccggcatgctgtggatggccgacgtgcccctgcagtggatagcctctgcgatcgtgctcgaattcttcatgatggtattgctcatcccggagcctgaaaagcagcgcaccccgcaggacaatcagctcgcctacgttgtgattgggatcttaaccctagcggccatcgtggcagccaacgaaatgggcctcctcgagaccacgaagcgggatctgggcatgtccaaggagccgggggtggtgagcccaacctcctatctagacgtcgacttgcatcccgcctctgcgtggacgctgtatgccgtggccacgaccgtaatcaccccgatgctccggcacacgatcgagaactcgacggcaaacgtcagcttagccgcaatcgccaaccaagccgtagtcctcatgggcctagataaggggtggccaatttccaagatggatctgggtgtccccttacttgctctggggtgctacagccaggtgaacccccttacgctcaccgcggcagtgctgctgttggtgacgcactacgctatcatcggaccgggcttacaagccaaggccacccgagaagcacaaaagcgtaccgccgcggggatcatgaagaaccctaccgtagacggcatcatgaccatagacttggaccccgtcatctacgactccaagttcgagaagcagctcgggcaggtaatgctattggtgttgtgcgcggtacagcttctgctgatgcggaccagctgggccctgtgcgaagcacttactctggccaccggccctattacaaccctgtgggaaggctccccagggaagttctggaataccaccatcgcggtgagcatggcaaatatcttccgcggttcctatctggccggcgccggcctggcattcagcatcatgaagtccgtgggtacgggccgccgtggcaccggaagccagggcgaaaccctgggtgagaagtggaaaaagaaactgaaccagttaagccggaaagagttcgacctgtacaagaaatccggcatcacagaggtggaccggactgaggctaaggaggggctgaaacggggggagaccacccaccacgccgtcagccgtgggtccgcgaaactccaatggtttgtggagcggaatatggtgatccccgaggggagggttatagacttgggatgcggtcgcggcgggtggagctactactgtgccggcttaaagaaagtcaccgaggttaggggctacaccaagggcgggcccgggcacgaggagccagtccccatgtccacatacggctggaacatcgtgaagttgatgtcaggcaaggacgtgttctatctgccccccgagaagtgcgacactctgctttgcgacatcggggagtctagcccctcgcctacggtcgaggagagcagaaccatcagagtgctcaagatggtcgagccctggcttaagaacaaccagttctgcatcaaggtcctgaacccctacatgcccactgtgatcgaacacctcgaacgcctgcaacggaagtacggggggatgctggtgcggaatccgctatcgcggaacagcacacacgagatgtactggatctccaacgggaccgggaacatcgtctcttccgtcaacatggtaagccggctgctgctaaaccggttcaccatgacccacagacggcccacgatcgagaaagacgtcgatctaggcgccggcacacgccacgttaacgccgagcccgagacccccaacatggacgtcatcggggagcgtattaagcgcatcaaagaggagcactcaagcacgtggcactacgacgacgagaatccgtacaaaacttgggcttatcacggctcttacgaagtgaaggctactgggtcagcaagtagtatgatcaacggcgtggtgaagctgctcaccaagccctgggacgtggttcccatggtcactcagatggccatgaccgacacaaccccgttcgggcagcagagagttttcaaggagaaggtagacacacgcacgcccagaccaatgcccggcacacgcaaggtaatggagataaccgccgagtggctctggcgaaccctgggccgcaacaagaagccgcgcctctgcacccgagaggagttcactaagaaggtacgcaccaacgctgcgatgggagccgtgttcacggaggagaatcaatgggacagcgccagagccgcggtcgaggacgaagagttctggaagctggtcgaccgggagcgggagctgcacaagctcggtaaatgcgggtcctgcgtgtacaacatgatgggtaaaagggagaagaaactaggggaattcggcaaggccaagggatcaagagctatttggtatatgtggttaggggcccgctatttagaattcgaagccttaggattcctgaacgaggaccactggttttcccgggagaacagctactccggggtcgagggcgaagggttacacaaactgggatacatcctccgcgacatcagcaaaatcccgggaggggcgatgtacgccgatgacaccgccggctgggacacccggatcaccgaagacgacctccataacgaggagaagataacacagcagatggatcctgagcatcgacagctggcaaatgctattttcaaactgacctatcagaacaaggtggtgaaggtccagcggcccaccccgaagggcactgtcatggacattatttcccgcaaagaccagcggggctcaggtcaagtgggcacctatggtctcaatactttcaccaacatggaggcgcagctagtccggcagatggagggggagggggtgctttccaaggcagacctcgaaaaccctcacctattggagaaaaaaatcacccaatggctggaaaccaagggggtggagcggcttaagaggatggccatcagcggcgacgattgcgtcgtgaagccaatcgacgaccgcttcgccaacgccctactggcgcttaacgacatgggtaaggtgcgcaaggatatcccccagtggcagccgagcaaaggatggcacgactggcagcaggttcccttttgtagccaccacttccacgagctgataatgaaggatggacgcaagctcgtagtgccctgtaggccccaggatgagctgataggacgcgcacggatatcccagggcgccggatggtcgctgaaggaaacggcttgcctcggcaaggcctacgcccagatgtggtcgctgatgtatttccaccggcgggacttgagactcgcctcgaatgctatctgttccgccgtaccagttcactggatacccacgagcaggaccacatggagcatccacgcccaccaccagtggatgacgaccgaggacatgttaacagtatggaatcgcgtttggatcgaggataatccctggatggaggacaaaacccccgttacgacctgggaagacgtgccgtacttaggcaagcgcgaggaccagtggtgcggttcactcataggcctgacgagccgcgccacctgggcccagaacatcctgacggctatccaacaggtgcgttccctcattggagacgaggaattcctcgactacatgcctagcatgaagcggttccggaaggaggaagagctggagggcgccatctggtga

SEQ ID NO: 26099 - RNA, 9873 nt, synthetic construct
  misc_feature 1..9873: note = derived and/or modified CDS sequence (opt11) from DENV-3__EU482454__SS-prME
  source 1..9873: mol_type = other RNA
acgagcctatgtctcatgatgatgttgcccgcaaccctcgctttccacctgacctcccgggacggagaacctaggatgattgtaggtaaaaatgagcgcggtaaaagcctgctgttcaaaaccgcttccggtatcaatatgtgcaccctcatcgcaatggacctcggcgaaatgtgtgacgacacagtaacttacaaatgtccgctaatcgccgaggtggaacccgaagacatagactgctggtgtaacctaacaagcacctgggttacctacgggacgtgcaaccaagcaggggaacaccggcgcgacaaaagaagcgtggctctcgccccacacgtagggatgggcctggatacaaggacccaaacttggatgagcgctgagggggcctggaggcaagtcgaaaaagtggaaacctgggcactaagacacccaggtttcacgatactagcactcttcctcgcgcattatataggcacatccctaacgcaaaaggtagtgattttcatactgctcatgttagtcacaccctccatgaccatgcgctgtgtcggagtgggcaatagggacttcgtcgaagggctatcaggggcaacatgggtcgacgtggtgctagaacacggaggctgcgtcacaacgatggcgaaaaataaaccaactctggacatagaactccagaaaaccgaggcgacacaactggcaacactaagaaaactgtgtatagagggcaagattactaatataacaacagactcacgatgccccacgcaaggagaagctacgctaccggaagaacaagatcaaaactatgtgtgtaaacacacgtacgtcgaccggggttggggaaacggctgtggcttattcggcaaggggtccctagtcacctgtgcaaagttccaatgcctcgagccaatagaaggaaaagttgtccaatacgagaacctgaagtacacagtgatcatcacggtgcacaccggggatcaacaccaagtaggaaatgatactcaaggtgtgacagtcgagatcacaccccaagcgtcgaccgtggaagccgtgctgccagagtacggaaccctcggactagaatgcagcccacggacgggactcgatttcaatgaaatgatactgctgaccatgaaaaacaaggcctggatggtgcacaggcaatggttctttgatctaccgctcccatggacctcaggggccacgacagaaacaccgacatggaaccgaaaggaactcctcgtgacgtttaaaaacgcgcacgcgaagaaacaagaagtcgtagtgctggggagccaagaaggggcgatgcatacggccttaacgggggcaacagagatccagaactcgggtgggacttctatcttcgccggacacctaaaatgtcgactaaagatggacaagctggaactaaaaggtatgagttatgctatgtgcctcaacaccttcgtactaaagaaagaagtaagcgagactcagcatggtaccatactaataaaagtcgaatacaagggtgaagacgcaccatgcaaaatcccattcagtaccgaagacggccaaggaaaagcacacaatggcaggctgataacagcaaaccctgtggtgaccaagaaagaagaacccgtcaatatagaggcagaacccccatttggcgaatccaacatagtcataggtattggggacaaagcattaaaaatcaactggtacaagaaagggagtagcatagggaagatgtttgaggctaccgcgaaaggcgcgcgccgcatggcgatattaggcgatacagcatgggacttcggatccgtaggaggggtccttaacagcctggggaaaatggtgcatcagatattcgggagcgcctacacagccctcttttcgggagtaagttggataatgaaaataggaattggggtactactgacctggataggcctgaatagcaagaacacaagcatgtcatttagctgtatcgtaatcggtataatcacactatacctgggggccgtagttcaagccgacatgggatgcgtcattaactggaagggtaaagaactcaagtgcggatctgggatcttcgtaacaaacgaagtccacacctggacggaacaatacaaattccaagccgattcacctaaaaggctagctacggccatagccggagcatgggagaacggggtatgcggcattaggtctacgactcgtatggaaaacctactctggaagcaaatagccaacgagctcaactacatactatgggaaaataacataaagctgacagtggtagttggtgacatcatcggcgtgctagaacaggggaaaagaacactcacgccgcagcccatggagcttaaatactcctggaaaacctggggtaaggccaagatagtaacagcagaaactcagaactccagcttcataatcgacggtccaaacacccccgagtgtcccagcgcttcccgtgcgtggaacgtctgggaggtcgaagactacggcttcggcgtgttcacgacgaacatatggctcaagctccgggaggtgtatacgcagtcttgcgaccatcggctaatgagtgcagctataaaggacgaacgcgccgtccacgccgacatgggctactggatagaaagccagaaaaacggctcatggaaactcgaaaaagcgtcatttatagaagtaaagacatgcacttggccaaaatcacacactctctggagcaacggtgtactcgaaagcgatatgataatccccaaatcgcttgcgggacccattagccaacacaaccacaggcctgggtatcacacgcagactgccgggccctggcatctaggaaagctggagttggacttcaattactgcgagggcactaccgtcgtgatcacggagaactgcggcactcgcgggccctcgctcagaaccaccactgtctccggaaagttgatacacgaatggtgctgtagaagctgtaccctgccacccctcagatatatgggtgaagacggctgctggtacggcatggaaatacgacccataaacgaaaaagaagagaacatggtaaagtcacttgtaagtgcaggaagcggaaaagtggacaacttcaccatgggcgtattatgtcttgcaatcttgttcgaagaagtcatgcgaggaaagtttggcaagaaacacatgatcgccggagtactattcacatttgtactactactgagcggacaaattacgtggagagacatggcgcacaccctcatcatgatcggcagcaacgctagtgaccgaatgggaatgggtgtaacatacctggcactcattgcgacattcaaaattcagccattcctcgcgctcgggttcttcctcagaaagctaaccagtcgggaaaacctgcttttaggggtggggctagcgatggcaacaacattgcagctcccagaagacatagaacaaatggccaacggcatcgcacttgggctaatgaccttgaagttaattacacagttcgagacataccagctgtggaccgccttagtgagccttacctgcagcaacacaatctttacactcacagtcgcctggaggacggccacgctaatattggctggggtatcgctactaccactatgccaatcatcaagcatgagaaaaactgactggctacccatgacggtggccgccatgggtgtaccgcccctccctctattcatattcagcctcaaagacacacccaaacgccggtcatggcccctaaacgagggagtaatggccgtcggtctggtatcaatactggcatccagtctactccgaaacgacgtcccaatggcagggccgctagtagccgggggtctactaatcgcgtgttatgttatcacgggaacaagcgcagatctaaccgtagagaaggcggcagatgtaacatgggtagaagaagcagagcaaacgggcgtgagccacaacctgatgatcacggtggacgatgacggcacgatgcgaatcaaagacgatgagacggaaaacatccttacggtcctacttaagacagcactcctaatagtatccggcatcttcccatacagcatccccgcaactctgctcgtctggcacacatggcaaaaacagacccaacggtcaggagtcctgtgggacgtacccagtccacccgagacacagaaggccgagttagaggagggggtctacagaattaaacagcagggaatattcggcaaaacacaagtgggcgttggagtacaacgagaaggtgttttccacacgatgtggcacgtcacgaggggcgcagtccttacacacaatggaaaaagattagagccaaattgggcttcggtaaagaaggacttgatcagttacggcggcggctggagactcagtgcccaatggcaaaaaggcgaagaggtacaagtcatagccgtagaacccggcaaaaatccgaaaaacttccaaacaatgccaggcactttccaaacaaccaccggagaaataggagccatagcgctggatttcaaaccaggcacatccggatcgcccattataaacagggagggcaaagtcgtgggtctctatggaaatggagtcgtaaccaagaatggtgggtacgtcagtggtatagcccaaaccaatgcagagccggacgggcctacgcccgaactggaggaagaaatgttcaagaagcgcaacctgacaataatggacctgcacccggggtcgggtaagacccggaagtacttgcccgcgatagttagggaggcgatcaaaaggcgattaagaaccctgatcttggccccaacacgcgttgtagccgcggaaatggaagaagccctgaaaggcctacctataagataccagacaacggccacgaaatcggaacacaccggccgcgagatagtcgatctaatgtgccacgcgacattcactatgcgactactttcccccgttcgcgtcccgaattacaaccttataattatggacgaagcgcactttactgacccagcatccatcgccgcacgcggctatatatcgacacgagtggggatgggggaagcggctgcaatctttatgaccgcaacacctccagggacagccgaggcgtttccccagagcaatgccccgatccaggacgaagaacgggacataccagagaggtcttggaacagcggaaacgagtggatcaccgacttcgtggggaaaactgtgtggttcgtaccaagcatcaaagcaggaaatgacatcgccaattgcctaaggaaaaacggtaagaaagttatccagctgagcaggaagaccttcgacacggagtaccagaaaacgcggctcaacgactgggacttcgtggtaaccacggacatcagcgaaatgggggcaaacttcaaggccgacagggtcatagaccccagaaggtgtctaaaaccagtaatactaacggacggtcccgaacgagtaattctcgccggaccgatgcccgtcaccgccgcaagcgcggcacagcgccgaggaagagttggtagaaatccacaaaaagagaacgatcaatacatattcacggggcaacccctcaacaatgacgaggaccacgcacactggaccgaggcaaaaatgcttctcgacaacataaacactccagaaggaatcatcccggcactattcgagccagagcgcgagaaaagcgcagccatcgacggcgagtaccgcttaaaaggcgaaagtcgaaaaaccttcgtagagctcatgcggcgcggcgacctacccgtctggcttgcacacaaagtagcatccgaaggcatcaagtacacagaccggaaatggtgcttcgatggagaacgaaacaaccagatcttggaagaaaacatggacgtagaaatatggacgaaggagggcgagcggaagaagctccggccgcgatggctcgatgctcgaacctatagcgatccactcgccttgaaagagttcaaagactttgcagcaggccgaaaatccatcgcgctagacctcgtgacagaaatagggcgagtgccctctcatctagcccacagaacacgaaacgctctggataacctcgtaatgctgcacaaaagcgagcacggaggtcgtgcatatcgacatgcggtagaggagctccccgagaccatggaaacgctgctgctgctcgggctcatgatactcttgaccggcggtgcaatgttatttctaatctctgggaagggtatcggcaagacgagcatggggctcatttgtgtgatagtatcgtccgggatgttatggatggccgacgtaccactacaatggatagccagtgcaatagtgcttgagttctttatgatggtgttgttgatcccagagcccgaaaagcaaaggaccccgcaagacaaccaactagcatacgtggtaattggcatattaactctcgccgcgatcgttgcggcgaacgaaatgggcctcctcgaaaccaccaaacgggaccttggtatgagtaaagaacctggtgtagtatcccctacgagctacttggacgtggatttgcatcccgcatctgcatggacgctgtatgccgtggccaccactgtgatcactccaatgctccggcatacaattgaaaactcaactgcaaacgtgtcgctcgccgccatcgcgaaccaggccgttgtcttgatggggctagataaaggctggccgataagcaaaatggacctgggagtgccactgctggccctcggatgctattcccaagtcaacccactgaccctcacagcagcagtactcctgctcgtgacacattacgcgatcattgggccgggcctgcaagcaaaggcgacgcgagaggcacagaagagaacagccgctgggattatgaaaaacccaacggtggacggtattatgaccattgacctggacccggtgatctacgactctaagttcgaaaaacagttaggccaagtaatgctattagtactctgcgccgtacaactactcctgatgcgcacgtcatgggcactgtgcgaggcactgacgctcgcaacaggccctataaccacgctctgggaaggaagcccagggaagttctggaacacaacaatcgcggtgagtatggccaacatattcagaggaagctacctagcgggcgccggtctagcattttccatcatgaaaagcgtgggcaccggcaggagagggaccggttcgcagggtgaaaccctaggagaaaaatggaagaagaaactaaaccaactctcgaggaaagagttcgacctttacaagaaatcgggcataacggaagtggatcgaactgaggccaaagaagggctcaaacgtggagagacaacgcaccacgcggtaagccggggaagtgcaaaactccagtggtttgtggaacggaacatggtaatcccagaaggtcgagtcatagacctggggtgcgggcgaggaggatggtcgtattactgtgcagggctaaagaaagtgaccgaggtgagaggatacacaaagggaggtccaggtcacgaggaaccggtaccaatgagcacctacggatggaacatagtcaaacttatgtcagggaaggacgtcttctatctaccacccgaaaagtgcgacacgctactctgtgacatcggcgagagtagtccttcccccacagtggaagagtcccgaacaatccgggtacttaaaatggtcgagccttggctgaagaacaaccaattttgcattaaggtgctaaacccatatatgcccacagtaatcgagcacctagaacggctacaacgaaagtacggcggcatgttggtgcgcaaccccctcagcagaaactcaacgcacgaaatgtactggattagcaacgggacaggaaacatagtaagcagcgttaacatggtatcaagattgctactaaacaggttcacaatgacgcaccgccggccgacaatagaaaaagatgtcgacctcggtgcgggtacaagacacgtgaatgccgagcccgaaacaccaaatatggacgtaataggagagaggataaaacgcatcaaggaagaacacagcagcacttggcactatgatgacgagaacccgtacaaaacgtgggcataccatggctcatatgaagtcaaagcgacaggctctgccagcagcatgataaatggggtagtaaagctactgactaaaccatgggacgtagtcccgatggtcactcaaatggcaatgaccgacacgactcccttcggccagcagcgggtgtttaaagagaaagtagacacccggactcccaggccgatgccaggaacacgaaaggtgatggaaataacagcggagtggctctggagaacgctagggcgaaataagaaaccacgactttgcacaagagaggagttcaccaaaaaggtgcggacgaacgcagccatgggggccgtattcacggaggaaaaccaatgggacagcgcacgcgcagccgtcgaggatgaagagttttggaagctagtagatcgtgaaagagagttacacaagctaggaaaatgcggctcctgcgtttacaacatgatggggaagcgcgagaaaaagctgggtgagttcggaaaggctaaagggtcgagagcaatatggtacatgtggcttggcgcacgatatctagaatttgaggcactcggattcctaaatgaagaccattggttctcgagggaaaattcctactctggggttgagggcgagggcttacataaactaggctacatacttcgagacattagcaagatcccgggaggggccatgtacgctgacgacactgccggatgggacacacggataacagaagacgatctgcacaacgaggagaaaatcacacaacaaatggatcccgaacacagacagctagccaatgccatatttaagctcacgtaccaaaacaaagtagtaaaagtccagcggcccacgcccaagggcacggtcatggatataatttcgcgaaaggatcaacgtggaagcggccaagtaggcacgtatggcctaaacacattcactaacatggaggcgcaactcgtgcgacaaatggaaggcgaaggagtattaagcaaagcggacctcgaaaacccccatctgctcgaaaaacgcattacacagtggttggagaccaaaggagtcgaaaggctgaagagaatggctatctcaggagacgactgcgttgtcaagccgatagatgatcgatttgcgaacgcgctgctagcgctcaacgacatggggaaagttcggaaagacataccccaatggcaaccttccaaaggatggcatgactggcaacaggtgcctttttgtagccaccacttccatgagttaataatgaaggacgggcgaaaattggtagtcccttgtcgcccacaagacgaactaataggtcgcgctcggatatcgcagggagccggttggtccctcaaggaaaccgcatgcttgggcaaggcatacgcacaaatgtggagcctcatgtatttccatagacgagacctacgcctggcctccaatgcgatatgttcggccgtacccgcccactggatacccacatctcgaacgacatggtccatacacgcccatcaccagtggatgacaacagaggacatgcttacagtatggaatcgtgtgtggatcgaagacaacccatggatggaagacaagacgccagtgaccacgtgggaagacgtgccctacctaggcaaacgagaagaccaatggtgtgggtcgctaattggcctcacgtcacgagcaacctgggcccagaatattctgaccgctatccaacaggtccgcagcttaataggggacgaagagttcctagattacatgccgagcatgaaacgcttcagaaaagaagaggagagtgagggcgcgatatggtaa

SEQ ID NO: 26100 - RNA, 9873 nt, synthetic construct
  misc_feature 1..9873: note = derived and/or modified CDS sequence (opt11) from DENV-3__EU482455__SS-prME
  source 1..9873: mol_type = other RNA
acatccctctgtctgatgatgatgctgcccgcaacactggcgtttcacctcacctctcgtgacggcgagccgaggatgatagtggggaaaaacgagcgcggcaagagcctgctgttcaagacagcgtcggggatcaacatgtgcaccctcatcgccatggacctgggggagatgtgcgatgacaccgtgacctacaagtgccccttagtggcggaagtggagcccgaggacatcgactgctggtgtaaccttaccagcacctgggtgacctacgggacgtgcaaccaggccggcgagcaccggcgggacaagcggtccgtggctctggcgccccacgtgggcatgggcctggacacccgcacccagacctggatgagcgccgagggagcctggaggcaggtcgaaaaagtcgagacgtgggctctccggcacccgggctttaccattctggcgctgtttttggcccactatatcgggacctcgcttacccaaaaggtggttatcttcatcctcctcatgctggtgacgccgagcatgaccatgcggtgcgtgggggtcggcaaccgcgacttcgtcgagggcctgtcaggggcgacgtgggtggacgttgttctcgagcatggcgggtgtgtgaccacgatggccaagaacaagcccaccctggatatcgaactgcaaaagactgaggccacccagctcgccacgctgcggaagctgtgtatcgagggaaagattacaaacatcaccacagacagccgctgccccacgcagggcgaggcgatccttccggaggagcaagaccagaactacgtctgtaagcacacctatgttgaccgggggtggggcaacgggtgcggcctgttcgggaaaggctcgctggtaacctgcgcgaaattccagtgtctcgagcccatcgagggcaaggtcgtccagtatgagaacctgaaatacaccgtgatcatcacggtacatacgggggaccagcaccaggtgggcaacgacacacaaggggtcaccgtggaaattacgccacaggccagcaccgtggaagccgtactgcccgaatacggcacgcttgggctggagtgtagcccccgcaccggtctggacttcaacgagatgatcctcttgaccatgaagaacaaggcttggatggtgcacaggcaatggttcttcgacctgcccctcccctggacaagcggcgccacaaccgaaactccgacgtggaacaagaaggagctactggtgacctttaagaacgcacacgccaaaaagcaggaggtcgtggtgctcggctcccaagaaggcgctatgcacaccgcactgacgggggccacggagatccaaaattcaggcgggacatccatcttcgcgggccacctgaagtgccgcctcaagatggacaagctggaactgaaggggatgagctacgccatgtgtctaaacaccttcgtcttaaagaaggaggtgtccgaaacacaacatgggacgattctgatcaaggtggagtacaagggcgaagacgccccgtgcaaaatccccttctccaccgaggacgggcagggcaaggcgcataacggccggctgatcaccgccaaccccgtcgtcaccaagaaggaggagcccgttaacatcgaggccgagcctcccttcggggagagcaacatcgttattggtatcggggataaggcactcaagatcaattggtacaagaagggatccagcatcggtaagatgttcgaggcgacggcccgcggtgctcggcgtatggcgatcctgggagataccgcctgggatttcgggtccgtaggtggcgtgctgaatagcctgggcaagatggtacatcagatcttcggctccgcgtacaccgcgctttttagcggcgtgtcatggatcatgaagattggcataggggttctgctcacctggatcggcctgaatagcaagaatacatccatgagcttctcctgcatcgtcatagggatcatcaccctgtacctcggcgccgtggtgcaagccgacatggggtgcgcaatcaactggaagggcaaggaactgaagtgcggctccggaattttcgtcaccaatgaggtgcacacctggacggagcagtacaaattccaagcggactcccccaaacgactggccaccgccatcgctggcgcctgggagaacggggtgtgtggcatccgcagcaccacccgaatggagaacctcttatggaagcagatcgcaaatgagctcaactacatcctctgggaaaataacatcaagctaacggtggtcgttggggacatcatcggcgtcctggagcagggcaaacgcaccctcacgccccagccaatggagctgaagtacagttggaagacctggggcaaggccaagatcgtgacggccgagacccagaacagctccttcatcatcgacgggcccaacacccccgagtgccccagcgcctctcgcgcgtggaatgtctgggaggtggaggattatggtttcggcgtgtttaccacgaacatctggctgaagttgcgggaggtttacacacagagctgcgaccaccgcctgatgagcgcagccatcaaggacgaacgggcggtccacgccgacatgggctactggatcgagtcccagaagaacgggagctggaagctggaaaaggcgtccttcatcgaggttaaaacctgtacctggcccaagtcacacaccctctggtcaaacggcgtgctggagtccgacatgatcatccccaagtccctggccgggcctatctcacaacataaccaccgcccgggataccacacccagaccgccggaccctggcacctcggcaagctggagctggacttcaactactgcgaaggcaccacggtcgtgatcacggagaactgcgggactcggggcccctccctccgcaccaccacggtgagcggaaagctgatacacgaatggtgctgccggtcctgcaccctgccacccctccgctacatgggcgaagacggatgctggtacggcatggagatccgtcccataaacgagaaggaggaaaacatggtcaagagtctggtgagcgcgggcagcgggaaggtggacaactttaccatgggcgtgctgtgcctagccatcttgttcgaggaggtgatgcgcgggaagttcggaaagaagcacatgatcgcgggggtgctgttcaccttcgtactcctgctgtccggccagatcacatggcgggacatggcccacaccctcatcatgatcggcagcaacgcatccgaccgcatggggatgggcgtgacctatctggccctgatcgccactttcaagatccaacccttcctcgcactggggttcttcctgcggaaactcacgagccgcgaaaacctgttgctcggggtgggcctggccatggcgaccaccctgcagctccccgaggatatcgagcagatggccaacggtatcgcgctaggcctgatgaccttaaagctgatcacgcaattcgagacctaccagttgtggactgccctcgtgtcgctgacctgctccaatacgatcttcaccctgaccgttgcctggcggaccgccacactcatcctggccggggtcagcctgctcccgctgtgtcagtccagctccatgcgcaagactgactggctccccatgaccgttgccgccatgggcgtgccgcccctcccactgttcattttctctctgaaggacaccccaaagcggcgctcctggccgctcaacgagggggtcatggccgtggggttggtgtccatcctggcctccagtctcctgcgaaacgacgttccaatggccggcccgttagtggctggcgggctcctgatcgcgtgctatgtgatcacgggtacctccgccgatttaaccgttgagaaagccgcggacgtaacctgggaggaggaggcggagcagacgggagtttctcataacttaatgatcaccgtcgacgacgacgggaccatgcggattaaggacgacgagaccgagaacatcctgaccgtgctgctcaagacggccctactgatcgttagcggcatatttccctactcaattcccgccaccctgctggtctggcacacatggcagaagcagacccagcgttccggcgtgctgtgggacgtgcccagcccgcccgagacgcagaaggcagagctcgaggaaggtgtctatcgcatcaaacagcagggcatctttgggaagacccaggtgggcgtcggggtacagaaggaaggcgtcttccacaccatgtggcacgtcacccgcggcgccgtcctaacccacaacggaaagaggctagagcccaactgggcgtccgtgaagaaagatcttatcagttatggcgggggctggaggctgtcagcccagtggcagaagggggaagaggtacaggtgatcgccgtggaacccggcaagaacccgaagaattttcagacgatgcccggcatcttccagacaaccacgggcgaaatcggtgccatcgcgctcgacttcaagcctgggacctcaggtagccctatcatcaaccgcgaaggtaaggtagtagggctgtacgggaacggggttgtaacaaagaacggtggttatgtttccggcatcgcccagaccaacgccgagccagacggccccacgcctgagctcgaagaggagatgttcaagaagcggaacctgaccatcatggacctgcacccggggtctggcaagacgcggaagtatctaccggcgattgttcgcgaggccatcaagcggaggttgcggaccttaatacttgcacccacgcgcgtggtggccgccgagatggaagaggccctgaaggggctgcccattcggtaccagaccaccgccactaagtccgagcacacgggccgggaaatcgtagacctcatgtgccacgctactttcaccatgcggctgctgagcccggtccgcgtcccaaactacaacttaatcatcatggatgaggcccacttcacagaccccgcttccatcgcagctcggggatacatcagcacgcgcgttggcatgggcgaggcggcagccatcttcatgacggccacaccgcccgggaccgcggaagccttcccccagtccaacgcacccatacaggacgaggagcgggatatccctgagcgaagttggaactccggaaacgaatggatcacggacttcgttggtaagaccgtctggttcgtcccttctatcaaggccggcaacgacatcgctaactgcctacgcaaaaacgggaaaaaggtgatccaactgtcccggaagacttttgacaccgagtaccagaaaacgcgcctcaacgactgggacttcgtcgtaacgaccgacatcagcgagatgggagcgaacttcaaagccgaccgggtgatcgaccccagaaggtgcctgaagcccgtcatattaacagacggccccgagcgcgtgattttggctgggccgatgccagtgacggccgccagcgccgcccagcggcggggccgggtggggcgcaatccccaaaaagagaacgaccaatatatatttaccggccagcctctgaataacgacgaggatcacgcccactggaccgaggccaagatgctgctagacaacatcaacactccagaaggtattatccccgccctgttcgagcccgagcgcgagaagtccgcagcgatcgacggcgagtaccgccttaaaggcgagtcccggaaaaccttcgtcgagctcatgcgccgcggggatctgcccgtctggctggcccacaaggtggcatctgagggaatcaagtacacggaccgcaaatggtgcttcgacggggagagaaacaaccaaatcctcgaagagaacatggacgtggagatttggaccaaggagggtgagaggaagaaattacgaccgagatggcttgacgcgcgaacctacagtgaccccctcgccttgaaagagttcaaagacttcgccgccggccgcaagagcatagccttcgacctggtgaccgagatcggacgcgtaccctcccacctcgcgtaccggacgcggaacgcattagacaacctggttatgcttcacacctcggagcacggcgggagggcttatcgtcacgccgtcgaggagctgccagagacaatggagaccctcttgctgctcggcctcatgattctgcttaccgggggcgccatgctgttcttgatatccggaaagggtataggcaagacctctatcgggctgatttgcgtaattgtcagctccggcatgctctggatggcggacgtccccttgcaatggattgccagcgcaatcgtgctggagttctttatgatggtgctactgatccccgagcccgagaagcaacgcacaccgcaggacaatcagctggcttacgtggtcatcgggatcctcaccctggccgcgatagtggccgcgaacgaaatgggactactcgagacaaccaagcgggacctgggcatgtcgaaagagcccggggttgtgagccccacctcctacctcgacgttgacctccatcccgcctctgcctggacattgtatgcggtcgcgacaaccgtgattacgccgatgctgcgtcacacgatcgagaactccacggccaacgtgagcctcgctgcgatcgccaaccaagccgtcgtgctgatgggcctggataagggctggcccatctctaagatggatctaggcgtgccgctactggccctcgggtgttacagtcaggtgaacccactgactttgacggcagcggtgctcctgctggtgacccactatgccatcatcggcccaggcctccaggccaaggccacaagggaggcccagaagcgtaccgctgccggtatcatgaagaaccccacggtcgacgggattatgaccattgacctggatcccgtgatctacgactccaagttcgaaaagcagctgggccaggtcatgctcctggtgctgtgcgcggttcaactcctgctgatgcgcacgtcgtgggctctctgcgaggccctgaccctggccacgggtcccatcaccacgctttgggagggcagcccggggaagttctggaacaccacaatcgccgtatcgatggccaacatcttcagaggctcctacctggccggcgcgggcttggccttcagcatcatgaagtccgtcggtatcggccgccgtggcaccgggagccagggtgagacgctcggggagaaatggaaaaagaagctgaatcagctcagcaggaaagagttcgacctctacaagaaatccggcatcaccgaggtggaccgaaccgaagccaaggaagggctgaagcgcggcgagacaacccaccacgctgttagccgggggtccgcaaagctgcagtggttcgtcgaaaggaacatggtgataccagaagggcgggtcatagacctcgggtgtgggcgcggagggtggagctactactgcgcgggcctgaagaaagtgacggaggtccgcggctataccaagggcggccccgggcacgaggagcccgtgccgatgtccacctatggctggaacatagtcaagttaatgagcgggaaggacgtgttctacctgcctcccgagaagtgcgatacccttctgtgcgatatcggcgagtcatctccctccccgacggtggaggaaagccggacgatccgtgtcctgaagatggtggagccctggctcaagaacaaccagttttgcatcaaggttctgaacccatacatgcccaccgtgatcgagcatctggagcggctccagagaaaatacggcgggatgctggtgcggaaccctctctcccgcaacagcacccacgagatgtactggatttccaatggcacggggaacatagttagctccgtgaacatggtgagtcggcttctgctgaaccgcttcactatgacccaccggcgaccgaccatcgaaaaggacgtcgacctcggcgccgggacgcgccacgtgaacgccgagccagagaccccgaacatggacgttatcggagagcgcatcaaaagaatcaaggaggaacacagcagcacctggcactacgacgacgagaacccctacaagacctgggcgtaccacggctcgtacgaggttaaggccacgggctctgcgagctccatgattaatggggtggtgaagctgctgactaagccctgggatgtcgtgcccatggtgacccaaatggccatgaccgacacgacccctttcgggcagcagcgcgtctttaaggagaaggtggacacccggacgccccggcccatgccgggcacacggaaggtgatggagatcaccgccgagtggctgtggcgcaccctggggcggaacaagaagcctagactgtgcacaagggaggagttcacgaagaaggtccggaccaacgccgccatgggggcagtgtttaccgaggaaaaccagtgggacagcgcccgcgccgccgtcgaagacgaggagttctggaagctcgtcgatcgggagcgcgagctgcacaagctgggcaagtgcggatcctgtgtgtacaacatgatgggtaagcgggagaagaagttaggggagttcggcaaagcgaagggcagccgcgccatctggtacatgtggctgggggccagatacctggagttcgaggcactcgggtttctcaatgaggaccactggttctctcgcgagaacagctactccggcgtggagggcgaggggctgcataagctgggctacatcttacgggacatcagcaagatcccaggcggagcaatgtacgcagacgatactgcagggtgggacacgaggatcaccgaagacgatctgcacaacgaagagaagatcacccagcagatggatcccgagcatcggcagctggccaacgctatctttaaactgacctatcagaacaaggtcgttaaggtgcagcgccccacgccgaagggaacggtaatggatatcatctctcggaaggatcagcgcggcagcggacaggtcgggacctatgggctgaacaccttcaccaacatggaggcgcagctcgtgagacagatggagggggagggcgtcctgtccaaggctgacctagaaaacccgcacctcctggaaaagaagattacgcagtggcttgagacaaagggggtggagcgcctcaagcggatggccatcagcggcgacgattgcgtggtcaaacccatcgacgatcgcttcgccaacgccctgctggctctcaacgacatgggcaaggtgcggaaggatatcccccagtggcaaccgtccaaggggtggcacgactggcagcaggtcccattctgcagccaccactttcacgaactgattatgaaggacggccgcaagctagtcgtaccttgccggccgcaagacgagctcatcgggcgcgcacggatctcccagggcgccggatggagcctaaaggagaccgcatgcctgggcaaggcgtatgcccaaatgtggtccctcatgtacttccaccgccgggatctgcggctggcgtcgaacgccatctgctcggccgtgcccgtccactggatccccaccagccgcacaacctggtcgattcacgctcaccatcaatggatgaccaccgaggatatgctcacggtgtggaatcgggtgtggatcgaggacaacccctggatggaggacaaaacccctgtcaccacctgggaggacgtgccctacctgggcaagcgagaagaccaatggtgcgggtccctgatcggactcacgagccgggcaacctgggcgcagaatatcctgaccgccatccagcaggtccgctccctgatcggggacgaggagttcctcgactacatgcccagtatgaaaagatttcgaaaggaggaggagtccgagggtgcaatctggtga

SEQ ID NO: 26101 - RNA, 9873 nt, synthetic construct
  misc_feature 1..9873: note = derived and/or modified CDS sequence (opt11) from DENV-3__EU482456__SS-prME
  source 1..9873: mol_type = other RNA
acaagcctgtgccttatgatgatgctgcccgccaccctggccttccacctcacgtccagggacggcgagccgcgtatgatcgtgggcaaaaatgagcgcggaaagtccttgctgttcaagaccgcgtccgggatcaacatgtgcaccctcatcgctatggacttgggcgagatgtgcgatgacactgttacatacaagtgccccctcatcgcagaggtggaacccgaggacatcgactgctggtgtaacctcaccagcacctgggtgacatacgggacatgcaaccaggcaggcgagcatagacgcgacaagcggtccgtggccctggctccccacgtgggcatggggctggacacccgaacccagacatggatgagcgccgagggcgcctggagacaggtggagaaagtagagacgtgggccctaaggcacccggggtttacgattttggcgctgtttcttgcccactacataggcacgtccctgacccagaaggtggtgatcttcattctactaatgctggtcacgcccagcatgactatgaggtgcgttggggtgggcaaccgcgactttgtcgagggcctaagcggggccacttgggtggacgtggtgctcgagcacggcgggtgcgtgaccacgatggccaaaaacaagcccaccctcgacatcgagctgcagaaaacagaggccacacaactcgcgacgctgcgaaaactttgcatcgagggcaagattaccaacatcaccaccgactcgcgatgccccacgcaaggtgaggccatactccctgaggagcaggaccagaattatgtgtgtaagcacacctacgtcgaccgggggtgggggaatgggtgcggcctgttcggtaagggcagtttggtgacctgcgccaagtttcagtgtctcgagcccatcgagggcaaggtggtccagtacgagaaccttaaatacaccgtcataatcaccgtgcacacgggggaccagcaccaagtcggaaacgacacccagggggtgaccgtagagatcacgccccaagcgtcgacggtggaggccgttctgcccgagtacggcaccctcgggctggagtgctccccgcgcaccgggcttgactttaccgagatgattctactgacgatgaagaacaaagcgtggatggttcacagacagtggttcttcgaccttcccctcccctggactagcggcgccaccactgagacgcccacctggaaccgcaaggagttactggtgacttttaagaacgcccacgcaaagaagcaggaggtggtcgtgctcggttcccaggagggcgcgatgcataccgccctgacgggggccaccgagatccaaaacagcggtggtacctccattttcgccggacacctgaaatgccggctaaagatggacaagctggagctgaaggggatgagctacgccatgtgccttaacacgttcgtactgaagaaggaggtctccgagacgcagcacgggactatcctgatcaaggttgagtataagggcgaggacgccccgtgcaagatccccttcagcaccgaagacgggcaaggcaaggcgcacaacggccgcctgattaccgccaaccctgtggtaacaaagaaggaggaacccgtgaatattgaggcggaaccgccgttcggagagtccaacatcgttatcggcatcggagataaggcattgaagatcaactggtacaagaagggctctagcatcgggaagatgttcgaggcgactgcccggggcgcccgccggatggccatcctgggcgacacggcctgggacttcgggagcgtcggcggggtgctgaacagcctcggcaagatggtgcatcagatcttcgggtccgcgtatactgcactgttcagcggcgtctcctggatcatgaagataggtataggtgtgctgttgacgtggatcggcctgaacagcaagaatacatccatgagtttctcctgcatcgtaatcgggatcatcacgctgtacctcggcgctgtcgtacaggccgacatggggtgtgtgatcaactggaagggaaaggaactcaagtgcggcagcggaatcttcgtcactaatgaggtgcatacatggaccgagcaatataagttccaggccgattcgcccaagcgcctggcgactgcaatcgcgggcgcctgggagaacggagtgtgcggtatacgcagcaccacacgtatggagaacctcctgtggaagcagatcgccaacgagcttaattacattctctgggagaacaacatcaagttaaccgtcgtggtgggagacaccatcggcgtactagaacagggcaagcgcacactcacgccccagccaatggagctgaagtactcatggaagacctggggcaaggcgaagatcgtgaccgccgaaactcagaacagctccttcatcatcgacggcccgaacactcccgagtgcccgagcgcctcccgggcttggaacgtttgggaggtcgaggactatgggttcggagtcttcacaaccaacatctggttaaagctccgcgaggtgtacacccaaagctgtgaccatcggctgatgagcgcggccattaaggatgagcgggccgtgcacgccgacatgggctattggatagagagccaaaagaacggcagctggaagctggagaaggcgtcgttcatcgaagtgaagacctgcacgtggccgaaaagccacaccctatggtcaaacggcgttctggaatcagacatgatcattccaaagagcctggcggggcccatcagccagcacaatcaccggccgggctatcacacccagaccgccgggccctggcacctcggcaagctggagctggacttcaactactgtgagggcaccaccgtcgtgataaccgagaactgcggtacacgcggtccgtccctccggacgactaccgttagcgggaagctgatccacgagtggtgctgccgatcctgcactctgcccccgctccggtacatgggcgaggacggctgctggtacggcatggagataagaccgatcaacgagaaggaagagaacatggtgaaatctctggtatccgccgggagcggaaaggtcgacaactttacgatgggcgtactgtgcctcgcgatattgtttgaggaggtaatgagagggaagttcggcaagaagcacatgatcgccggggtgctctttacgttcgtacttctactgtccggacagataacatggcgcgacatggcgcacactctcatcatgattgggagcaacgcctccgaccggatgggaatgggcgtgacgtacctggcgttgattgcaactttcaagatacagccctttctcgccctggggttcttcttgcggaagttaacctcacgggagaacctgctactcggcgttgggctggctatggccactacactgcagctgccagaggacatcgagcagatggccaacgggatcgccctgggcctaatgacacttaagttaatcacccagttcgagacctaccagctgtggactgcgctcgtctccttaacttgctccaacaccatcttcacgctgacggtagcctggcgcaccgccaccctcatactagcgggtgtcagcctccttcctctctgccaatcgagctccatgcggaagaccgattggcttcccatgacagtcgccgcgatgggcgtgcctcccctgccgctgttcatcttcagcctgaaggacacccccaagcgccgctcctggccactcaacgagggggtcatggccgtgggcctggtgagcattcttgccagcagcctcctgagaaacgacgtccccatggcaggcccgttagttgccgggggcctcctgatcgcgtgctacgtgatcaccggaacctccgcggatttgacggtcgagaaggccgccgacgtgacctgggaggaggaagccgagcagactggcgtgagccacaacctcatgatcacagtcgacgacgacgggaccatgcgcatcaaggatgatgaaacagagaacattctgacagtgctgctcaagaccgcactgttaatcgtctccggaatattcccctattctattcccgccacgctcctggtctggcacacgtggcagaagcaaactcaacggtcgggcgtgctgtgggacgtgccaagccctcccgagacccagaaggccgagctcgaggagggggtctaccgcataaaacagcagggcatcttcggcaagacccaggtgggcgtgggggtccagaaagagggcgtgttccacacaatgtggcacgtgacccggggcgcagtcctcacccataacgggaagaggctggagcccaattgggcctcagtgaaaaaggacttaatctcctatggcgggggctggcggctgtccgctcagtggcagaaaggtgaggaggtgcaggtcatcgcagtggaaccgggcaagaacccgaagaacttccagacgatgcccggcatcttccagactaccaccggggagataggagccatcgccctggacttcaagcctggaacctcaggcagcccgatcataaaccgcgaggggaaggtggtcggcctgtacggcaacggggtggtgacgaagaacggaggctacgtctcaggcatcgctcaaacaaatgctgaacccgacggacccacccccgagctcgaggaagagatgttcaagaaacggaacctgaccatcatggacctgcacccggggtctggcaaaaccaggaagtacctgcctgccatcgtgcgggaggccatcaagagacgtctgcgcacgctgatcttagcccccacccgggtggtcgctgccgagatggaggaggcactgaaggggctgcccatccgctaccagaccacggccaccaagtccgagcacaccggccgggagattgtggacctcatgtgccacgccaccttcacgatgcgcctgctgagccccgtgcgcgtccccaactacaacctcatcatcatggacgaggcgcactttaccgacccagcctccatcgccgcccgcggatacatcagcacccgggtgggaatgggagaggccgcagccatcttcatgaccgcgacgcccccggggaccgccgaggctttcccccagagtaacgcccccatccaggacgaagagagagacatacccgaacgcagctggaactccggcaacgagtggatcaccgattttgtgggcaaaaccgtctggtttgttcccagcattaaggccggcaacgacatcgccaactgcctgagaaagaacgggaagaaggtgattcagctttccaggaagactttcgacacagagtaccagaagacacggctcaacgactgggacttcgtcgtgaccacggacatatccgagatgggcgccaactttaaggcagaccgcgtgatcgacccccggagatgccttaagcccgtcatcctgaccgacggccccgagcgggtgatactcgctgggcctatgcccgtcaccgccgccagcgccgcccagcgtcggggcagagtcgggcggaatccccagaaagaaaacgaccaatacatcttcaccggtcagcccctgaataacgacgaggaccacgcccattggaccgaagccaagatgctgctcgataacataaacacgccggaagggataatccccgcactgttcgaacccgagcgcgaaaagagcgccgcgatcgacggagagtaccgcttaaaaggcgagtcccgcaagacctttgtggaactcatgcgacgtggggacctgcccgtctggctggcacacaaggttgcaagcgagggcatcaagtacaccgaccggaagtggtgctttgacggggagcgaaataaccagatactcgaggagaacatggacgtggagatttggaccaaagagggcgagcggaaaaagctgcgaccgcgctggctggacgcccgaacgtactccgaccccctcgcgttaaaggagttcaaggactttgccgcaggtcgcaagtcgatcgcccttgatctcgtcaccgagatagggcgtgttccatcgcatctggcctaccgtacccggaacgcgctggacaacctcgtgatgctacatacgagcgaacacggcgggcgcgcatatcggcacgccgtcgaggagctgcccgagacgatggagacccttctcctgctcggcctgatgatcctgctcaccgggggcgccatgcttttcttgatcagcggcaaggggatcggcaagacctccatcgggctcatttgcgtgatcgtaagctccggtatgctgtggatggccgacgtcccactgcaatggatcgcgagcgccatcgtgttggagttcttcatgatggtgttgctcatccccgagcccgagaagcagcggacaccgcaggacaaccagctcgcctacgtcgtgatcgggatcctgacgctggccgccatcgtggcggccaacgaaatgggcctcctcgagaccaccaagcgggacctgggcatgtcaaaggaacccggggtcgtgagccccacgagttacctcgacgtggacctgcatcctgccagcgcatggacattatacgccgtggctaccaccgtgatcacgccgatgctccgccacaccatcgagaactccaccgccaatgtgagcctggccgccatcgcgaaccaggctgtagtgctgatgggcctcgacaaggggtggcctatctcaaagatggacttaggagtgcccctcctggccctgggatgctacagccaagtcaaccccctgacccttacggccgctgttctgctgctcgtgacccactatgcgatcatcggcccgggcctacaggccaaggccactcgggaggcacagaaacgcaccgccgctggaataatgaagaaccccaccgttgacggcatcatgaccatcgacctggatcctgtgatctacgactccaagttcgagaagcagctcggacaggtgatgctactggtcctctgcgccgtgcagcttttgctcatgcggaccagctgggctctttgcgaggccctcaccctcgccacgggccctatcaccaccctgtgggaggggtcgccggggaagttctggaacaccacgatcgcggtcagcatggccaacatcttccgcggctcctacctggccggggccgggctagcattcagcatcatgaagtccgtcggtaccggccggcggggcaccgggagccagggcgagaccctcggggagaagtggaagaagaagctaaaccagctcagccggaaggaatttgacctgtacaaaaagtccgggattaccgaggttgaccgcaccgaggccaaagagggtctaaagcggggcgagacgacccaccacgccgtgagcaggggctccgccaaactccaatggttcgttgaaagaaacatggtaatcccagagggcagagtgatcgacttaggctgcggccgcggcgggtggagctactactgcgcaggcctaaagaaggtgaccgaggtgcggggctacacgaaagggggacccgggcacgaggagcccgtgccgatgtcgacctacggctggaacatcgtcaagctcatgagtgggaaggacgtgttttacctgccacccgaaaagtgtgacacactgctgtgtgatattggcgagtccagcccctccccgaccgtggaagagagccgtacgatccgggtcctcaagatggtagagccctggctgaagaacaaccagttctgcatcaaggtgttaaacccttatatgcccacagtcatcgaacacctagagcgcctgcagcggaagtacggcggtatgctggtgcgcaacccgctttctcggaacagcacccacgagatgtactggatctccaacggcaccgggaatatcgtaagctccgtcaacatggtgagccgcctgctgctcaacaggttcaccatgacccatcgaagacccaccatagagaaggacgtcgacctgggcgccggcaccaggcacgtgaacgcagaaccggagacgcctaacatggacgtgatcggggagcggattaaacgaatcaaagaggaacactccagcacctggcactacgacgacgagaacccctacaagacctgggcctatcatggctcctacgaggtcaaggccacgggctcagccagctccatgataaacggggtggtgaagttactcacgaagccctgggacgtcgtgcccatggtgacccagatggccatgactgacaccacgccgttcgggcagcagagagtctttaaagagaaggtggacacccgcaccccgcggcccatgcccggcacccgcaaagtcatggagatcactgctgaatggctgtggcgaaccctgggccgcaacaaaaagccgcgcctgtgcacccgagaggagtttactaagaaggtacggacgaatgccgccatgggagccgtattcaccgaggagaaccagtgggacagcgcgagagctgccgtggaggacgaagagttctggaagctggtcgaccgtgagcgggagctgcacaagctgggcaagtgcgggtcttgcgtctacaacatgatgggcaaacgcgaaaagaagctgggggagttcggaaaggccaagggcagcagagccatctggtacatgtggctgggggcccgctacctcgagttcgaggccctgggcttcctgaacgaggatcactggttctcccgggagaacagctattccggggtggagggcgaggggctccacaaactgggctacatcctgcgcgacatcagcaagatccccggcggggccatgtacgccgacgacaccgctggctgggacacccggatcacggaagacgatctccacaatgaggagaagatcactcagcagatggacccagagcaccgccagttagccaacgccatcttcaagctgacctaccagaacaaagtcgtgaaggtgcagaggcccaccccgaaagggactgttatggacatcataagtaggaaagaccagcgggggagcggtcaggtggggacgtacggcctcaacacgtttacaaacatggaggctcagctagttcgccagatggagggggaaggagtcttatccaaggccgacctggagaacccccatctgctggagaagaagatcacccagtggctcgagacaaagggggtggagcggctgaagcgcatggcgatcagcggcgacgactgcgtggtcaagcccatcgacgatcgtttcgccaatgccctgctcgcacttaacgacatggggaaggtgcgcaaggacataccccagtggcagccttccaaagggtggcacgactggcaacaggtgcccttctgcagccaccatttccacgaactgatcatgaaagacggccggaagctagtcgtgccctgccgcccccaagacgagctgataggcagggcccggatctcccagggcgcggggtggtcgttgaaggagaccgcatgcctggggaaggcttacgcccagatgtggtctctgatgtacttccaccgacgggacttacgcctcgccagcaacgctatctgcagcgccgttccggtccactggatccccacgagccgaacgacgtggagcatccacgcccaccaccagtggatgaccaccgaagacatgcttaccgtgtggaaccgcgtgtggattgaggacaacccctggatggaggacaaaacgccggtaaccacctgggaggacgtgccatacctcggcaagcgcgaggatcagtggtgcgggtccttaatcggacttacgagccgcgccacgtgggcgcagaacatcttaacagccattcaacaggtgcggtccctcattggggacgaggagttcttagactacatgccctctatgaaacgctttcggaaagaggaagagtccgagggggctatctggtga

SEQ ID NO: 26102 - RNA, 9873 nt, synthetic construct
  misc_feature 1..9873: note = derived and/or modified CDS sequence (opt11) from DENV-3__EU482457__SS-prME
  source 1..9873: mol_type = other RNA
accagcttttgcctcatgatgatgcttccggctaccctcgcattccacctaacgagtcgggacggcgaaccgcggatgatcgtgggcaagaacgagcggggcaagagcctcctgtttaaaaccgcgtctgggatcaacatgtgtacccttattgccatggacctcggcgagatgtgcgacgacaccgtcacgtataagtgtcccctgatcgcggaggtggagccggaagacatcgactgctggtgtaacctgacgagcacctgggttacctacggaacatgcaaccaggccggcgagcaccggcgcgacaagcgttccgtcgccctcgcgccccacgtgggcatggggctggacacccggacccagacatggatgtcagccgaaggcgcctggcgccaggtggagaaggtcgaaacctgggccctgcgccacccagggttcaccatcctcgcgctctttctcgcccactacatcggcacctccctcacacagaaggtggtaatcttcatcctgcttatgctcgtaactcccagcatgaccatgcggtgcgtaggtgtgggaaaccgcgacttcgtagagggcctctccggggcaacctgggtggatgtggtacttgagcatggcgggtgtgtgactacgatggccaaaaacaagcccacgctcgacatcgagctgcagaagaccgaggccacccagctggcaacgctgagaaagctctgcatcgaaggcaagatcaccaatatcaccaccgacagccgctgccccacgcagggagaggcgaccctgccggaggagcaggaccagaactacgtgtgtaaacacacatacgttgacaggggatggggcaacgggtgcggcctcttcggcaaaggctcccttgtgacctgcgcgaaattccagtgcctcgagcctatcgagggcaaggtggtccagtatgagaatctgaagtacacggtcattatcactgttcacaccggtgaccagcaccaagttggcaacgacacccagggggttacggtcgaaatcaccccacaggccagcactgtggaggccgtgctgcccgaatacggtatacttgggttggagtgctccccacggaccggccttgacttcaacgagatgatccttctcaccatgaaaaacaaggcctggatggtccatcggcagtggttcttcgacctgccgttaccctggaccagcggtgccaccaccgagacccctacttggaaccgcaaggagctcctggtgaccttcaagaatgcccacgccaagaaacaggaggtggtagtgctagggagtcaggaaggcgcgatgcacaccgcgctgacaggggccacggaaatccagaacagcggagggacctccatattcgccggccacctcaagtgcagactgaaaatggaccgtctcgagctcaagggcatgagctacgcaatgtgcctaaacaccttcgttttgaagaaagaagtcagcgagacccagcacggaacgatcctgatcaaagtggagtacaagggagaggacgctccgtgcaagatcccattcagtactgaggacgggcaggggaaggcgcacaacggccgcctgatcaccgccaatcccgtggtcaccaagaaagaggaacccgtcaacatcgaagccgagcccccctttggcgagagcaatatcgtgatcggcatcggggataaggccctgaagatcaactggtacaagaagggctctagcattgggaagatgtttgaggcgacagcccgcggcgcccggcgcatggcaatcctcggcgacactgcctgggacttcggctccgtcggcggggttctgaatagcctgggaaaaatggtccaccagatcttcgggtccgcgtacacagccctcttctctggcgtctcctggattatgaagataggcataggggtgctgttgacctggatcggcttaaactcaaaaaacacgtccatgtcattttcctgcatcgtgatcggtatcatcaccctgtacctgggcgccgtagtgcaggcggacatgggatgcgtgatcaattggaagggcaaggagctaaagtgcggcagcgggatcttcgtcaccaacgaggtgcacacttggacggagcagtacaagttccaggccgactcccccaaacgcctcgcgaccgcaatagccggggcctgggagaacggggtgtgtggcatccgtagtactacccgcatggaaaatctgctctggaagcagattgctaacgagctgaactacatcctttgggagaataacatcaagctcacggttgtcgtgggggacacgatcggcgttttagaacagggcaagaggacattgacgccccagcccatggagctcaagtattcttggaagacttggggcaaggctaaaatcgtgactgccgagacacagaatagctccttcattatcgacggtcccaacaccccggaatgccccagcgcctctcgcgcgtggaacgtctgggaggtcgaggactacggcttcggcgtcttcacgactaacatttggctgaagctgcgggaggtgtatactcaaagctgcgaccaccgcctcatgagcgcggccatcaaagacgagcgagcggtccacgccgacatgggctactggatcgagagtcagaagaacgggtcctggaagctggaaaaagcgtcattcatcgaggtgaagacctgcacctggcccaagagccacacgctgtggtccaacggcgtgctcgagtcagacatgatcatccccaagtccctagcggggcccatctcacagcataaccaccgcccgggctaccacacccagaccgccgggccctggcacctggggaagctcgagctggacttcaactactgcgaaggcaccaccgtggtgatcaccgagaactgcggtaccagaggcccctccctgaggaccacgaccgtgagcggtaagctcatacacgagtggtgctgccggtcctgcaccctgccaccgctgaggtacatgggtgaggacggctgttggtacggcatggagatccggcccatcaacgagaaggaggagaatatggtcaagagccttgtgtctgccggtagcggcaaagtggacaactttaccatgggcgtactgtgcctggccatcctcttcgaggaagtgatgaggggaaagttcggcaagaagcacatgatcgccggggtgctgttcacgttcgtcctgttactgtcgggtcagatcacctggcgggacatggcccacactctgatcatgatcggctccaatgcctccgaccgcatggggatgggcgtgacatatttagcgttgatagccacgtttaaaatccaacctttcctggcactcgggtttttcctccggaagttgacctcccgagagaacctcctgctgggcgtcggcctcgcgatggccacaaccctgcagctgcccgaggacatcgagcagatggcgaacggcatcgccctcggcctgatgacgctgaagctcataacccagttcgagacctaccagctgtggacggctctggttagcctcacatgctccaacaccatctttaccctcacggtggcttggcggacggccaccctgatcctcgcgggggtctcgctgctgccgctctgtcagtccagttccatgcgcaagaccgactggctgccaatgaccgtggccgcgatgggagtgccgccattacccctcttcatcttcagcctgaaggacactcccaagcgacggtcatggcccctgaacgagggtgtaatggcggtgggattagtgagcatcttggcctccagcctgctccgaaacgacgtgcctatggcaggaccgctggtggccggcggtctgctgatcgcgtgctacgtgatcaccgggacctccgccgacctgaccgtcgagaaggccgccgacgtgacgtgggaggaggaggccgagcagaccggagtaagccacaacttaatggtcaccgtggacgatgacggcaccatgcggattaaggacgacgagacagagaatatactcacagttcttctgaagaccgcactcttaattgtctccggcatattcccctatagcattcccgccaccctgctcgtgtggcacacctggcagaaacagacgcagcgcagcggcgtactttgggatgtcccctcgccgccggagacccagaaggccgagctagaggagggggtgtaccggatcaaacagcagggcatctttggcaagactcaggtgggcgtgggggtgcagaaggaaggggtgttccacacaatgtggcacgtcacgcgcggcgctgtactcacccacaacgggaagcggcttgagcccaactgggcctcggtcaagaaggacttaatcagctacggtgggggctggcgcctctccgcgcagtggcagaagggggaagaggtgcaggtgatcgccgtggagccaggtaagaacccgaagaacttccagaccatgccaggcatcttccagaccactactggggagatcggtgccatcgccctggacttcaagccggggaccagcgggagtccgatcatcaacagggagggcaaggtcgtgggtctgtatggcaacggagtagtcaccaagaacggcgggtacgtgagtggaatcgcgcagaccaacgcagagccggatgggcccacccctgaactggaggaggagatgttcaagaagcgcaacctcaccatcatggacctgcacccggggagtggcaagacccggaaatacctgccggctatcgtgcgtgaggccattaagcgacgcctccggactctgattctagcccccacccgcgtcgtggcggcggagatggaagaggccctcaaaggtctgcccatccgataccaaacgacggcaactaagtccgagcacaccggccgcgagatcgtagacctgatgtgtcatgccacattcaccatgcggttactgagcccggtccgcgtgcccaactacaacctgatcatcatggacgaggcgcacttcactgaccccgcctccatcgcagccagggggtacatcagcactcgcgttggcatgggcgaggcagcggccatcttcatgaccgccacgcccccgggcaccgccgaggcgttcccccagagtaacgcccccatccaggacgaggaacgcgacatccctgagcgctcatggaactcgggcaacgagtggattaccgacttcgtcggtaaaacggtatggttcgtgcctagcatcaaggccggcaacgacatcgccaactgtctccgcaaaaacggcaagaaagtcatccagctgtcccgtaagaccttcgataccgagtaccagaagacacgtctgaacgactgggacttcgtagtgaccaccgacatctctgagatgggcgctaacttcaaggcggatcgagtcattgacccccgccggtgcctcaagcctgtgatcttaacggacggccctgagagagtgatactggccgggcccatgccagtaaccgccgcatctgctgcgcagcgccgcggccgtgtgggacgcaacccccagaaggaaaacgatcaatacatcttcaccggccaaccactcaacaacgacgaggaccatgctcactggaccgaggccaagatgctgttggacaacatcaacaccccggagggcatcatccccgccttattcggccccgaaagagaaaaatccgccgcgatcgacggcgaataccgccttaagggggagtcccggaagacgtttgttgagttgatgcgcagaggcgaccttcccgtgtggctggcctataaggtggccagcgaggggatcaaatataccgatagaaagtggtgcttcgatggagaacggaataaccagattctggaagagaacatggatgtcgaaatatggaccaaggagggcgaaaggaagaagctccgcccgcggtggctggacgcccgtacctactccgaccccctggcgctcaaggagttcaaggatttcgcggccgggcgcaagagcatagccctggaccttgtgaccgaaatcggccgcgtaccctctcacttagcccaccggacccgcaacgcgctggacaacctggtcatgctccacacgtctgagcacgggggccgagcttaccgccacgccgtggaggagctgcctgagaccatggagacgctgctcctgctggggctcatgatactgctgaccggcggagcgatgctgttcctgatctcgggaaagggaatcgggaagacctccatagggctgatatgcgttattgtcagctccggcatgctctggatggccgacgtgccattacaatggatcgcgagtgccatagttctggagttctttatgatggtcctcttgatccctgagcccgaaaagcagagaaccccgcaggacaaccaactggcctacgtggtgatcggcatcctcacactcgccgcgatcgtcgcggcaaacgagatgggcctcctcgagaccaccaagagggatctggggatgtccaaggagcccggagtagtgagccccacttcctaccttgacgtcgacctccaccccgcctcagcatggaccctttatgccgtggcgaccaccgtgatcacccccatgctgcgacataccattgagaactcgaccgctaacgtcagcctcgctgcgatcgcgaaccaggccgtggtcctgatggggctcgataaggggtggcccatatccaagatggacctcggggtgcccctcctggccttaggatgctacagccaggtgaaccctttaacactgacggctgccgtactcctgctcgtgacacactatgcgatcatcgggccggggctccaggcgaaggccactcgcgaggcccaaaagcggacagccgcgggaatcatgaagaacccaaccgtggacggaatcatgacgatcgacctggaccccgtgatctacgactccaaattcgagaagcagctgggccaagtcatgctcttagtgctgtgcgccgtgcaactcctgctgatgcgcacctcttgggcactctgtgaggctctgacactggccactggcccaatcactaccctctgggaagggtctccgggaaaattctggaacaccaccatcgcggtcagcatggccaacatcttccgagggtcctacctcgccggagccggcttagcgttcagcataatgaagtccgtaggcacaggccgccgggggacgggcagccagggagagaccctcggcgaaaagtggaagaagaagctgaaccagcttagtcggaaggagttcgacctctacaagaagtccgggatcaccgaagtggacaggaccgaggccaaggagggcctgaagcgcggagagacgacccaccatgcagtcagtcgggggtccgccaaactgcagtggttcgtcgagcgcaacatggtcatacccgagggccgcgtcatcgatctgggctgcggccgcggagggtggagctactactgcgccgggctgaaaaaggtgaccgaggtgagaggctacaccaaagggggacccggccacgaggagcccgtgccgatgtccacgtacgggtggaacatcgtgaagctcatgagtggcaaggatgtcttctacctgccgcccgaaaagtgcgacactctgctgtgtgatatcggcgagagttctccatccccaaccgtcgaagagtcacggacaatccgcgttctgaagatggtggagccttggctcaagaacaaccaattctgcataaaggtcctgaacccctacatgcccacagtcattgaacacctggagcggcttcagcgcaagtacgggggcatgctggtgcggaatccgctgagtcgcaatagcactcacgagatgtactggatcagtaacggcaccggcaacatcgtaagctccgtgaacatggtcagccggcttctgctaaaccgattcactatgactcatcggcgccctactatcgagaaggatgttgaccttggagcggggacccggcacgtcaacgccgagcccgaaacaccgaacatggacgtaattggcgaacgcatcaagcgcatcaaggaagagcattccagcacctggcattacgacgacgagaacccgtacaagacctgggcgtaccatgggagctacgaggtaaaggccactggcagcgcctcctccatgatcaacggggtggtgaagctgctgaccaagccgtgggatgtggtgcctatggtgacgcaaatggccatgaccgacactaccccgttcggacagcagcgcgtgtttaaggagaaggtggacacgcggacgccacggccaatgcccggcactcggaaggtcatggaaatcaccgccgagtggctctggcgcacgctggggcgcaacaaaaagccgagactgtgtacccgcgaggagttcaccaagaaagtgaggactaacgccgccatgggagccgtgttcacagaggagaaccagtgggacaatgcgcgcgccgccgttgaggacgaagagttctggaagttggtggatagagagcgcgagctgcacaagctgggcaagtgcggcagctgcgtgtacaacatgatggggaaacgggagaaaaagctcggcgagttcggcaaagccaaggggtcgagagcaatctggtatatgtggctgggcgcccggtacctggagttcgaagccctcgggttcttgaacgaggatcactggttcagccgcgagaactcctatagcggagtagaaggggagggcctgcacaaactcggctacatcctgcgcgacatctccaagattccaggaggcgccatgtacgccgacgataccgcgggatgggacacgcgcattaccgaggacgatttacataacgaggaaaagatcacacagcagatggaccccgagcaccggcagcttgccaatgccatattcaaactgacctaccagaacaaggtggtgaaggtccagcgccctaccccgaaagggaccgtgatggacatcatcagccggaaggaccagcgcggaagtggccaagtcggtacctacgggctgaacactttcaccaacatggaggcccagctcgtccggcaaatggagggcgagggagtactgagcaaggctgacctggaaaacccccacctcctggagaagaaaatcacccagtggttggagaccaagggcgtggagaggctcaagcggatggccatctccggcgacgactgcgttgtaaaacccatcgacgatcgcttcgcgaacgccctgctggccctcaacgacatggggaaggtccggaaagacatcccgcagtggcagccgagcaagggctggcacgactggcagcaagtccccttctgttcccaccatttccacgagctgataatgaaggatggacgcaagctggtcgtcccgtgtaggccacaggacgagctcataggccgggcgcgcatctcgcagggggcgggctggtcgctgaaggaaacggcctgcctgggcaaagcctacgcacagatgtggtctctcatgtacttccatcggcgcgatctgcggctggcctccaacgcaatctgcagcgccgtccccgtgcattggatccccacctcccgcactacctggagcatccacgcacaccaccagtggatgacgacagaggacatgctcacggtctggaaccgggtgtggattgaggacaatccctggatggaggacaagaccccggtgactacgtgggaggatgtgccgtacctggggaagcgcgaggaccagtggtgcggcagcctgattgggctcaccagtcgagccacctgggcgcagaacattcttacggccattcagcaggtacgaagcctcatcggcgatgaggagtttctcgactacatgccgagcatgaagcggtttcgcaaggaggaggagtcagagggcgccatctggtga

SEQ ID NO: 26103 - RNA, 9873 nt, synthetic construct
  misc_feature 1..9873: note = derived and/or modified CDS sequence (opt11) from DENV-3__EU482458__SS-prME
  source 1..9873: mol_type = other RNA
actagcctttgcttgatgatgatgctgcccgctaccctagccttccacctcaccagtagagacggcgagcctcggatgatcgtggggaagaacgagcgaggtaaaagcttactattcaaaaccgcttccggaatcaacatgtgcaccctcatcgccatggatctgggcgagatgtgcgatgacaccgttacctacaagtgtcccctcatcgcagaggtggagcccgaggacatcgactgctggtgcaaccttacctccacctgggtgacatatggtacgtgtaatcaggccggcgaacaccgtcgcgataaaagatccgtggccttggcgccccacgtgggcatggggctggacacccgcacccagacttggatgagcgccgagggggcgtggcggcaagtcgagaaagttgagacctgggccctcagacatccggggttcaccatcctcgcgctgttcctcgcccactacatcgggacatccttaacccagaaggtagtgatctttattcttcttatgttagtcacaccgagcatgacaatgcggtgcgtaggagtgggcaaccgcgactttgtcgagggcctttcgggggctacatgggtggacgtagtcctcgaacacggcgggtgcgtaaccactatggccaagaacaaaccgacactggacatcgagctgcaaaagaccgaggcgacccagctcgcgacacttcggaagctgtgtatagaggggaagatcaccaacattacaaccgacagccgctgccccacgcaaggcgaggccatcctgccggaggagcaggaccagaactacgtatgcaaacatacatacgttgacaggggatggggcaatgggtgtggcctgttcggaaagggctcactggtgacctgcgccaagttccagtgtctcgagcccattgaaggcaaagttgttcaatatgaaaacctcaagtacaccgtcatcatcaccgtacacaccggggaccaacaccaggtcggtaacgacacacaaggggtgacggtcgaaattacaccgcaggcttcaacggtggaggccgtcttacccgaatacggcaccctggggctggagtgctccccgcgcaccggactggacttcaacgagatgatcctactgacaatgaagaacaaagcgtggatggtccaccggcagtggttcttcgaccttcccctgccgtggacctcaggcgccaccacggagacccccacgtggaaccgtaaggagctgctgaccactttcaagaacgcccacgccaagaagcaggaggtggtggtcttagggagtcaggagggcgccatgcacaccgcccttacgggcgccacagaaattcaaaacagcggcgggacctccatcttcgccgggcacctgaaatgccggctcaaaatggacaaactggagttaaagggcatgagctacgccatgtgcctgaacaccttcgtgctgaaaaaggaggtatccgagacacagcatggcaccatcttaattaaggtcgagtacaagggagaagacgcaccgtgcaagatccccttcagcactgaggacgggcaaggcaaggcccacaatggcaggctgatcaccgccaaccccgttgttacgaagaaagaggagcctgtcaacattgaggccgagccgcccttcggggagagcaacatcgtgatcggcatcggtgacaaagcgcttaagatcaactggtacaaaaaggggtccagcatcgggaagatgttcgaggctacagcacgtggcgcccgccggatggcaatcctgggtgacaccgcgtgggacttcgggtcggtgggcggggtcctgaactctctcggcaaaatggttcaccagatcttcgggtccgcctacaccgcccttttcagtggagtgtcctggatcatgaaaatcgggatcggggtcctcttaacttggatcggccttaacagcaagaacacctcaatgagcttttcgtgcattgtgatcgggattattaccctatatctcggcgccgtggtccaggccgacatggggtgcgccatcaattggaagggtaaggagctgaagtgcgggagcgggatcttcgtgacaaatgaggtgcacacgtggactgaacagtacaagttccaggcggacagtccgaaacgcctcgcaaccgccatcgccggtgcctgggaaaacggtgtctgcggtatacgcagtaccacacggatggagaatctcctgtggaagcaaatagcgaacgagctgaactacatcctctgggagaacaacatcaagctgacggtggtggtcggtgacataatcggcgtgttagagcaaggcaagcgcaccctcacgcctcaacctatggagctgaagtactcctggaagacgtgggggaaggccaagatcgtaacggccgagacccagaacagctccttcataatcgacgggcccaacacacccgagtgtccgagcgcctcccgggcatggaacgtgtgggaggttgaggactacgggttcggagtgtttacgaccaacatctggctgaagttaagagaggtctacacccagagctgtgaccaccggctcatgagtgcagcgatcaaggacgagcgcgccgtgcacgccgatatggggtactggatcgagtcgcagaagaacgggagctggaaactggaaaaggcctccttcattgaagtgaagacctgcacctggcccaagagccacacattgtggtccaacggggtcctagagagcgacatgatcatacccaagagtctggccgggcccatcagccagcacaatcatcggcccggctaccacacccagaccgcgggtccctggcacctcggcaagctcgagctggacttcaactactgcgaagggaccactgttgtgatcaccgagaactgcggaatgcgtggcccctcactccggaccaccacggtgtcggggaagttaatacacgagtggtgctgtcgctcgtgcaccctgcccccgctaaggtacatgggcgaggacgggtgctggtatggaatggagatccgcccgatcaacgagaaggaagagaacatggtcaagagtctggtgtcagccggcagcgggaaggtcgacaacttcacaatgggcgtgctgtgcctcgctatcttgttcgaggaagtgatgcgggggaagttcggaaagaagcacatgatcgcgggagttctattcaccttcgtactcctactgagcggccaaatcacgtggagagatatggcccacaccttaataatgatcggctcgaacgccagtgaccggatggggatgggcgtcacctacctggccctgatagccaccttcaaaattcagccattcctcgcgttagggttctttctgagaaagctcacgagccgcgagaacctgttactcggagttggcctggcaatggccactactctgcagctccccgaagacatcgaacaaatggccaacggcatcgcgttaggcttgatgacattaaaactgattacgcagttcgagacataccaactgtggaccgccctcgtctcactgacttgcagcaatacgatcttcaccctgacggtggcctggcggacggcaaccctcatcctcgccggtgtgagcttattaccgctgtgtcaatctagctccatgcggaaaacagactggctgcctatgacagtagcagccatgggcgtgccgcccctgccgcttttcatattcagcctgaaagacacccccaaacggagatcctggcccctgaacgagggcgtgatggccgtgggcctggtctcgatcttagcctccagcttgctgcggaacgatgtgcccatggccggcccgctggtcgccggcgggttgctgatagcatgctacgtgattaccgggacctccgccgacttgaccgtagagaaggcagccgacgtcacctgggaggaggaggctgaacagaccggagtatcgcacaatctcatgatcacagtggacgacgatgggaccatgaggatcaaggatgacgagacggagaacattcttacggtactgctcaaaacggccctgttaatcgtctccggcatcttcccctacagcatcccggccaccctcctggtatggcacacctggcagaagcagacccagcggtccggcgtgctgtgggacgtccccagcccacccgaaactcagaaagccgagctcgaggagggggtgtaccgcattaagcaacaaggtatattcgggaagacccaggtcggcgtcggggtgcagaaggagggcgtgtttcacaccatgtggcatgtcacccggggtgccgtactgacgcataacggtaagcgactggagccgaattgggcgtccgtcaagaaggacctcatcagctacggcggtgggtggcggctgagtgcccagtggcagaagggtgaagaggtccaagtgatcgccgtggagcccggcaagaaccccaagaacttccaaacgatgcccggcatattccaaaccacgacgggggaaatcggcgccatcgcgctggacttcaagcccgggactagcggctctccgattattaaccgcgaggggaaagtggtagggctttacggcaacggagtggtcactaaaaacggcgggtacgtgtccggtatagcccagaccaacgcggagccagacggacccacgccggagctcgaggaggagatgttcaagaagcggaacctgacgattatggatttgcacccggggagcggaaagacccgcaaatacctacccgcgatcgtccgggaggccatcaagcgccggttgcgcaccctgatcctggcgccgacgcgggtggttgcagccgagatggaggaggccctgaagggtctgcccatccgttaccagaccacggccaccaagtccgaacatacgggccgcgaaattgtggatctcatgtgccacgcgaccttcaccatgcgcctactgagcccggtcagagttcccaactacaacctcattataatggacgaggcacacttcaccgaccccgcctctatcgccgcacggggctacatcagcacacgggtgggcatgggtgaggcagccgccatcttcatgaccgcgactccgcctgggactgcggaggcatttccccagtccaacgccccgatacaggacgaggagcgcgacatccccgagagaagctggaactccggcaatgagtggataacggacttcgtcgggaagaccgtgtggtttgtgcccagcattaaggcgggcaacgatatcgccaactgcctgcggaagaacggcaagaaggtcatccagctatcccgcaagaccttcgacactgagtaccaaaagacgcgtttgaacgactgggacttcgttgtcaccacggatattagcgaaatgggcgctaatttcaaggccgaccgcgtcatagatccccggcgctgcctgaaacccgtaatattaactgacggccccgagcgggtgattctcgcggggccgatgccagtcactgccgcatccgcggcccagcgcagaggacgcgtggggcggaacccacagaaggagaacgaccagtacattttcaccgggcagcccctgaacaacgacgaggaccatgcccattggacagaggccaaaatgctcctcgataacatcaacaccccggagggtatcatccccgccctgtttgaaccagagcgagagaagtccgcggctatagacggcgagtaccggctgaagggtgagtcccgcaagaccttcgtcgagctcatgcgccgcggggacttgcccgtctggctggctcacaaggtggcaagcgagggcatcaagtacaccgaccgaaagtggtgctttgacggggagcgcaacaaccagattctcgaagagaatatggatgttgagatctggaccaaagagggcgagcggaagaagctgcgcccgcggtggctggacgcaagaacctactccgaccccctcgccctgaaggagttcaaggacttcgcagccggcagaaagagcatcgccctggaccttgtgaccgagatcggtcgggttcccagccatctggcctaccgcacgcgcaacgcgctggacaacctggtcatgctgcacaccagcgagcacggcgggcgcgcgtaccggcatgcagtggaggagcttccggagaccatggagacactcctgctgctaggcctaatgatccttctgaccgggggagccatgcttttcctgatctctgggaaaggcataggcaaaacatccatcgggctcatctgcgtgatcgtcagcagcggcatgttgtggatggccgacgtgcccctacagtggatcgccagcgccatagtgctcgagttcttcatgatggtattactgataccagagcccgaaaagcagcgcaccccccaggacaatcagctcgcttatgtcgtgatcgggatccttactctggctgcaatagtcgccgccaacgagatgggcctcctggagactaccaagcgggaccttggcatgtcgaaggagcccggtgtggtgtctcctacctcctatctcgacgtagacctgcacccagccagtgcttggaccctttacgcggtagccacgaccgtgatcaccccgatgttgcgccacaccatcgagaactccacggccaacgtctctctcgccgcgatcgccaaccaggcggttgtgctgatgggcttggacaaggggtggccaatctccaagatggacctgggtgttcccctgctcgctcttgggtgttactcgcaagtgaacccactgaccctcaccgccgcggtgctgctcctcgtcacgcattacgccatcatcggcccgggcttgcaggccaaagccacgcgggaagcccagaagaggaccgcggccggcatcatgaagaaccccaccgtggacggcatcatgacaatcgacctggaccccgtgatatacgactccaaatttgagaagcagctcgggcaggtcatgctacttgtcctctgcgccgtgcaactgctgctcatgcggacgagctgggccctgtgcgaggcactgaccctagcgacgggcccgatcactacgctgtgggagggctccccggggaaattctggaacaccaccatagccgtcagcatggctaacatctttcgcggctcttatctggccggggcggggctagccttctctatcatgaagagtgttggaactggcaggcgtggcacggggagccaaggcgaaaccctgggggaaaagtggaagaagaagttaaaccagctcagccgcaaggagttcgacctctacaagaagtccgggatcacagaagtggaccgcaccgaggccaaggagggattaaagcggggcgaaaccacacaccacgccgtcagcaggggctcggccaagctgcagtggttcgtcgagcggaacatggtaatccccgaggggcgcgttatcgatcttgggtgtggacgcggtgggtggagctactattgcgctggcttgaagaaggttactgaggtccggggctacaccaaaggcggccccggtcatgaggagcccgtaccgatgtcaacctacggttggaacatcgtgaagctcatgagcgggaaagacgtattttacctgccccccgagaagtgcgatactctgctgtgtgatatcggcgagtcctccccctcccccactgtcgaggagagccgtaccatacgagtgctcaagatggtggagccgtggctgaagaacaaccagttctgcattaaagtcctgaatccgtatatgccgactgtgatcgagcatctcgagcgcctccagcgcaagtacggcgggatgctcgtgcgcaatcccctctcccggaatagcacgcatgagatgtactggatctccaatggcactgggaatatcgtcagcagtgtgaatatggtgagccgcctgctgctcaatagatttacgatgacccacagacggcccactatcgagaaggacgtcgacctgggggccggcacccgccacgttaatgcggagcccgaaaccccgaacatggacgtcatcggggagcggattaagcggattaaagaagagcattccagcacctggcactacgacgacgaaaatccgtacaagacatgggcttaccacggctcctatgaagtgaaggccaccgggtctgcctcctccatgatcaacggcgttgttaagctgctcactaagccatgggacgtggtgcccatggtcacccagatggccatgactgataccaccccgtttgggcagcagcgggtgtttaaggagaaagttgacacccgcacgccccgacctatgcccggcaccaggaaggtcatggagataaccgccgagtggttgtggcggaccctgggccgcaacaaaaagccgcgattgtgcacgcgggaggagttcactaagaaggtgcgcacgaacgccgccatgggggcggtgtttacagaggagaaccagtgggacagcgctagagcagccgtagaggacgaggagttctggaagttagtggaccgcgagcgggagctgcataagctcggcaagtgtggttcttgtgtgtacaacatgatgggcaagagagagaagaaactgggggagttcggcaaggcgaagggcagccgggccatctggtacatgtggcttggagcgcgatatctcgagttcgaagcactaggcttcctgaacgaagaccactggttttcccgtgagaacagctacagcggggtcgaaggcgaggggctccataagctgggctacatcctgcgagacatttctaaaatcccagggggggctatgtatgcggacgacacagcgggctgggacacccggatcaccgaagacgacctccacaatgaggagaagattacccagcaaatggatcccgagcatcggcagctggccaacgcgatcttcaagttaacgtatcagaacaaggtggtgaaggtccagcgacccacgccgaaagggactgtgatggacatcatctcacgcaaggaccagcggggcagcgggcaagtggggacatacggcctcaacacgttcacaaacatggaagcgcaactggttagacagatggaaggagaaggcgtgctgtcgaaggctgacctagagaacccacacttactagagaaaaagatcacccaatggctggagaccaaaggcgtggaacggctgaaacgcatggctatcagcggcgacgactgcgtcgtgaagcctattgacgacagattcgctaacgcgctgctcgctctgaacgatatgggtaaagtgcgaaaggacatcccacagtggcagccttccaaggggtggcacgattggcaacaggtccccttttgcagccaccacttccacgagctcataatgaaagacggccggaagctcgtggtgccctgtcgaccccaggatgagcttatagggcgcgctcggatctcccagggagctgggtggagcctgaaggagacggcttgcctcggcaaggcctacgcacagatgtggtccctaatgtactttcaccgccgggaccttcgcctcgcgagcaacgcaatctgcagtgccgttcccgtgcactggatccctacgagccgtaccacatggagcatccatgcccaccaccagtggatgaccacggaagatatgctcaccgtgtggaaccgcgtctggattgaggacaatccatggatggaggataagacccctatcaccacgtgggaggatgtgccgtaccttggaaagcgcgaggaccaatggtgcggctccctgatcgggctgaccagccgcgcgacgtgggcccagaacatcctaaccgccatccagcaagtccgttctctcatcggggatgaggagttcttggactacatgccgtcaatgaagcgcttccgcaaggaggaggagagcgagggcgcgatctggtga

SEQ ID NO: 26104 - RNA, 9873 nt, synthetic construct
  misc_feature 1..9873: note = derived and/or modified CDS sequence (opt11) from DENV-3__EU482459__SS-prME
  source 1..9873: mol_type = other RNA
acgtccctatgcctaatgatgatgctacccgccactctagccttccatctgactagccgggacggggaaccccgcatgatcgtagggaaaaacgaacgaggcaaaagcctgctgttcaagactgcttcggggatcaacatgtgcacgctaatagcgatggacctaggagaaatgtgcgatgataccgtgacgtacaaatgccccctaatcgccgaagtagaacctgaagacatcgactgttggtgtaacttaaccagcacatgggtcacctacggcacctgtaaccaagccggagaacacaggagggataagagaagcgtagcactggcaccccatgtggggatgggcctggatacaaggactcaaacgtggatgagcgccgaaggcgcatggaggcaagtggaaaaggtggaaacctgggcgctacgacaccccggcttcacaatactagcgctattcctagcccactacataggcacaagcctgactcagaaagtggtaatattcattctactgatgctagttacaccctctatgaccatgagatgcgtgggggtgggcaacagggatttcgtcgagggcctgtcaggggccacttgggtggacgtcgttctagaacacggaggctgtgtgacaacgatggcgaaaaacaaaccaacgctggatatagaactgcagaaaacggaggccacacaattagcaacgcttcgcaaactgtgcatagagggaaaaatcacgaacataacgaccgacagccgatgtccaacacagggcgaggccattcttccagaggaacaagaccagaactatgtgtgcaagcatacgtacgtggatcgaggctgggggaacggatgtggactatttgggaaaggcagcttagtaacttgcgctaaattccaatgcctagagccgatagaaggcaaagtagtacaatatgaaaacctgaagtacacagtcattataacagtgcacaccggcgaccaacaccaggtcggaaacgatacacagggagtaaccgtagaaattacgccccaagcctccacggtggaagcagttcttccggagtatggcacactcgggctggagtgctccccgcgaacaggactggacttcaatgagatgatccttttaaccatgaaaaacaaagcatggatggtccatcgacagtggtttttcgatctaccgctcccatggacatccggtgcaaccacggaaacaccaacatggaaccgcaaagaactcctagttacctttaaaaacgcacatgccaagaaacaggaagtagtcgtccttggttctcaagaaggggcaatgcatactgcgcttacgggagccacggaaattcaaaatagcggagggaccagtatcttcgcaggccatcttaagtgccgcctgaagatggataagctggaactcaaaggcatgtcatacgccatgtgcctcaacacgttcgtcctcaagaaagaggtctcagagacgcaacacgggaccatactcataaaagtggagtataaaggcgaggacgcaccctgcaagatacccttcagtacagaggacggacaaggaaaagcccataacggccgactcatcacggcgaaccccgtagtcacaaagaaggaggagccagtaaacatcgaagcagaacccccatttggagagagcaacatagtaatagggataggagacaaagccctgaaaatcaattggtacaagaaagggtcttcaatcggcaaaatgttcgaagccacagcccgaggagcccggcgaatggctatcctcggagacacagcatgggatttcggaagtgtgggtggagtgctgaactccctcggcaaaatggtgcaccaaattttcgggtcggcatacacggccctcttcagcggggtgagctggatcatgaaaataggcatcggagtcctactgacatggatagggctcaactcgaagaataccagcatgagcttctcatgtattgtgattggaataattacattgtacctaggcgcagtcgtccaagccgacatgggatgtgcgataaactggaaaggaaaagaactgaaatgtgggagcgggatctttgtaacaaacgaggtacacacctggaccgaacagtacaagtttcaggcagatagcccgaaacgcctcgcaacagcaatcgctggagcatgggagaatggcgtatgcggaataagaagcacaactaggatggaaaacctattatggaagcaaatagccaacgaactcaattatatcctatgggaaaacaacataaaactcacggttgtagtgggcgacatcataggggtcctggagcaggggaaaaggacactgacgccccagcccatggaattaaagtactcctggaaaacctggggcaaggcaaagatcgtgacagcggaaacacaaaactcatcgtttatcatcgacgggcccaacacgccggaatgcccgtctgcttcccgcgcctggaatgtctgggaagtggaggactacggattcggagtattcaccacgaacatctggctaaagctaagagaggtatacacgcagagctgcgaccaccgcctgatgagcgcggcgataaaagatgaaagggcagtacacgcagatatggggtactggattgagtcgcaaaagaacggaagctggaaactggagaaggcctccttcattgaagtaaagacatgcacgtggccaaagtcacacaccctatggtctaatggcgtactcgagagtgacatgataatccccaaaagcctcgcagggcccatatctcagcacaaccacagaccaggttaccacactcaaactgccggcccctggcacctaggcaagctcgagctagacttcaattactgcgagggaacaacagtcgtaataacagaaaactgcggaacacgaggaccctcgctacggacaacaacagtaagcggcaaacttatacacgaatggtgctgccgaagctgtacactaccacctctccgatatatgggcgaggacgggtgctggtacgggatggaaataagacccattaacgaaaaggaggagaatatggttaaatcgctagtatctgcgggcagcgggaaagtggacaatttcactatgggagtcctgtgcctcgcgatcctcttcgaggaggtaatgcgtgggaaattcgggaagaagcatatgatcgcgggtgttctgttcacatttgtactcctcctttcaggacaaataacctggcgggacatggcacatacgctcataatgataggaagtaacgcctccgacaggatggggatgggcgttacttatctagcactgatagccacattcaaaatacaaccgttcctggcgctaggctttttcctcagaaaattaacaagtagagaaaacttgttgctaggcgtcggactcgccatggcaacaacactgcagctacccgaggacatagaacaaatggccaatgggatagctctgggattaatgacgctcaagctaataactcagttcgaaacatatcagctctggaccgctctggttagcttaacatgctcaaacacaatattcaccctcacagtagcgtggaggaccgcaacgctaatcttagcaggcgtcagtctactcccactgtgccaaagctcatcaatgaggaaaacggattggttaccgatgaccgtagccgccatgggtgttccacccctaccactctttattttctcgctcaaggacacgcccaaacgtcgatcctggccgctaaacgagggcgttatggccgtcggtctagtgagcatactcgctagtagcttattgcgcaacgacgtaccaatggcaggccccctagtagcaggcggcttactcatagcgtgctacgttataacaggcacgagcgcggatctcacagtagaaaaagccgcagacgttacctgggaggaagaagcagagcaaacaggcgtctcgcacaaccttatgataactgtcgacgacgatggcaccatgcggatcaaggatgatgaaacagagaatatactaacggtcctgttgaagaccgccctgcttatagtgagcggtatcttcccttactctatacctgcgacactcctagtttggcatacttggcaaaagcaaacccagcgtagcggggtactgtgggacgtcccatcaccaccagagacacagaaggcagagctagaggaaggggtctaccgcatcaaacaacaagggatattcgggaaaacccaggtcggtgtaggcgtgcagaaagagggggtcttccatacgatgtggcacgttacgcgcggagccgtactcacccacaacgggaagcggctagaaccaaattgggcaagcgtcaagaaagacctaatctcttatgggggaggatggcggctctcggcacagtggcaaaaaggcgaagaagttcaggtaatcgcagtggaacccggaaagaaccctaaaaacttccagacaatgcccgggatatttcagactacgacaggcgagataggagcaatcgccctagacttcaaacccggaacaagtgggtcaccaatcataaaccgagaggggaaagtggtaggattatacggcaatggcgtggtgaccaaaaacggcggctatgtcagcggaatagcgcaaacgaatgcagagccggacgggcccacgcctgagctggaggaggagatgttcaaaaagcgcaacttaacaataatggatctacacccaggttccgggaaaacgcggaaatacctcccagctatcgttcgagaggcgatcaaaaggcgactgcgaacactaatcttagcaccaacccgcgttgtggcggcagagatggaggaagcgctgaaaggcctaccaatcagataccagacaacagctaccaagtcggagcataccggccgagaaatagtggacctgatgtgccatgcaacattcaccatgagactgctatccccagtacgcgtaccgaattacaacctaataatcatggacgaagcccacttcaccgaccccgcgtcgatcgctgcacgcggatacatctctacccgagtaggaatgggagaagcagcggcaatattcatgaccgcgacgcctcccggtacagcggaagcattcccacagtcaaacgcaccgatacaagatgaagaacgggacataccggagaggagttggaactccggcaatgaatggataacggactttgtcggaaaaaccgtctggttcgtaccctcaatcaaagcagggaacgacatagccaactgcctcaggaagaatggcaagaaagtaatacagctgtccagaaagaccttcgacacagaataccagaaaactagattaaacgattgggattttgtagtaacaacggatatttccgagatgggggcgaacttcaaagctgaccgagtcatagacccccgacgatgcctaaagccagttatactaaccgacgggccggagagagtcatactcgcggggcccatgcccgtaaccgcggccagcgcggcgcaacggcggggacgcgtgggccgcaacccgcagaaagaaaatgatcaatacatattcacagggcagccattgaacaacgacgaagaccacgcgcactggaccgaggcaaaaatgctactcgacaatataaacacacccgaaggaatcatacccgccctattcgaaccagaacgtgaaaagagtgccgcgatcgacggtgaatatcgtctgaaaggagagagccggaaaacattcgtcgaactcatgcggcggggcgacttacccgtttggcttgcgcataaagtggcctcagagggaatcaaatataccgaccgaaagtggtgcttcgacggagaacgcaataaccaaatcctggaggaaaacatggatgtggaaatctggacaaaggaaggcgagcgtaagaagctgagaccaagatggctcgacgccaggacctacagcgacccgctggccctcaaagagttcaaagacttcgcggcggggcggaagtcgatcgcactagacttagtaacggaaatcgggcgcgttccaagtcatttagcgtaccgaacgcgaaatgccctcgacaacctagtaatgctacacacaagtgagcacggcggccgagcatatcgacacgcagtagaggagctacccgaaacaatggagacgctactgctgctaggcctaatgatcctcttaacaggaggtgccatgctgtttctgatcagtggaaagggaatcgggaaaacaagtataggactgatatgcgtaatcgtctcgtccggcatgctctggatggctgatgtacccttacaatggatagcgagcgcgattgtcctcgagttcttcatgatggtgctactgatcccagaacccgagaagcagcgtacaccacaggacaatcaactcgcatacgtggtaataggtattcttacgctggcagcaatagtggccgccaacgagatgggcttgctagaaaccacaaagagggacttaggcatgagcaaagagccgggagttgtcagcccgacatcgtatctagacgtagaccttcatccagcatccgcgtggacactctatgctgttgcgactaccgtcataacgcccatgctaagacacaccatagaaaatagtaccgctaacgtctcactagccgccatagcgaaccaagcagtggtcctcatgggattagacaagggctggccaatttcgaaaatggacctcggagtgccgcttctggcgctcggatgttatagccaagtgaacccactcaccctgacggccgccgtacttcttcttgtcacacactacgcgataatcggcccagggctgcaagcaaaagccaccagagaggcacaaaagcgcacagccgccggaatcatgaagaatccaacagtggacggaatcatgacaatagacctggacccagtaatatacgactcgaaattcgagaaacaactcgggcaagtcatgctgctagtactgtgcgccgtgcaattactgctaatgcgtacatcatgggcactgtgcgaagccctaacattagccacaggacctataacaaccctctgggagggaagtccaggtaagttctggaacaccacaatagctgtatcaatggcaaacatcttccgaggatcctaccttgcgggagcgggactcgctttcagcatcatgaaaagcgtcggcacgggaagaaggggaaccggcagtcaaggtgagaccctcggagaaaagtggaagaaaaagttaaaccaattgtcccgaaaggaatttgacctctataaaaagtccggaatcacagaagtggaccgcacggaggccaaagagggattgaagcgcggagaaacgacccaccacgctgtgagccgaggatccgctaagctacaatggttcgtggaaagaaacatggttatacccgaaggacgagtgattgacctagggtgcggcagagggggttggtcgtattactgcgctggattaaagaaggtcacggaagtgcgagggtacaccaaaggaggaccaggccacgaagaaccagtcccaatgtctacgtatggatggaacctcgtcaagctaatgtccggaaaggacgtattttacctgccacccgaaaaatgcgacacgctactatgtgacataggagaaagctcgccctcgcccacggtagaggagtcgagaactattcgcgtcctcaaaatggtggaaccctggctcaaaaataaccagttctgcataaaggtcttaaacccgtacatgcctacggtaatcgagcacctcgagagactacaacgaaaatacggcggaatgcttgtccgcaaccctctatccagaaactcaactcacgaaatgtactggatctcgaatgggacagggaacatagtatccagcgtcaacatggtttcgagattactccttaacaggttcaccatgacacacagacgcccaaccatcgagaaggacgtcgacctcggagccggcacgcgccacgtcaatgcggagccggaaacgcccaacatggatgtgatcggagaaagaatcaaaaggatcaaagaagaacacagctctacctggcactatgacgacgaaaacccgtacaagacgtgggcctaccacggaagctatgaagtaaaagccaccggctctgcaagcagcatgataaacggagtggtgaagctgctgaccaaaccctgggacgtagtgcctatggtcacacaaatggccatgacggatacaacaccattcggtcagcaaagagtcttcaaagaaaaggtggacacgcgtacaccccgaccgatgccgggaacacgaaaagtaatggaaataactgccgagtggctatggcgcacactaggacggaataagaaacccaggttgtgcacacgcgaggagtttacaaagaaagtgaggacgaacgcggcgatgggcgcggtcttcaccgaggagaaccagtgggattcagcgcgggcagcagtagaagacgaggagttctggaagttggtagatcgcgagagagagctgcacaaacttggaaaatgcggctcctgtgtctacaacatgatgggcaagcgcgagaagaagctcggcgagttcggcaaagcaaaaggaagccgagcaatctggtatatgtggttgggagccaggtacctggagtttgaagcattaggattcctaaacgaggaccactggttctcccgagaaaattcctactcaggagtggaaggtgaaggcctacataaactaggttacatcctccgtgatatatccaagataccaggcggggcaatgtatgctgatgacactgcagggtgggatacgcgcataacagaagatgatctccataacgaggagaagataacgcagcaaatggaccctgagcatcgccaactagcaaatgccatcttcaaactgacatatcaaaataaagtagtaaaagtccaaagacccacaccgaaaggtacggtaatggatatcattagccgtaaagaccagaggggcagcgggcaagtcggtacatacggcctaaacacatttaccaatatggaagcccaactcgtgcgtcagatggaaggagaaggggtcctatcaaaagcagatctcgaaaacccgcacttactggagaagaaaattacacaatggcttgaaacaaaaggagtagaaagattaaaaaggatggctatatccggagacgactgcgtagtgaaacctatcgacgacagatttgccaacgcgctactcgccctaaacgacatgggaaaagtacgaaaggatatcccccaatggcagccctcgaaaggatggcatgactggcagcaagtaccattctgcagtcatcacttccacgaactaatcatgaaagacggaagaaagctggtagtaccctgcaggccgcaagatgagctgatcggcagggcaagaatcagccagggagcgggctggagtctcaaagagacagcctgccttggcaaagcgtacgcccagatgtggtcactaatgtacttccatcgccgtgacctcaggctggcatccaacgcgatctgcagcgcggtacccgtccattggatacccacatcgcgcaccacctggtcgatacacgcccaccaccaatggatgacaacagaagacatgctgacagtgtggaacagagtatggatcgaggataatccctggatggaagataaaactccggtcacgacatgggaagacgtgccgtatctgggtaaaagggaggaccaatggtgtgggtcactgattggactcacctcgagggcgacgtgggcacaaaacatcctcaccgctatccaacaggtcagatcattaataggggatgaagagttcctagactacatgcccagcatgaagcgcttccgaaaagaagaagaaagcgagggggcgatctggtag

SEQ ID NO: 26105 - RNA, 9873 nt, synthetic construct
  misc_feature 1..9873: note = derived and/or modified CDS sequence (opt11) from DENV-3__EU482460__SS-prME
  source 1..9873: mol_type = other RNA
acgagcctgtgcctcatgatgatgctgcccgccaccttcgctttccacctgacgagccgcgacggagaacctcgcatgatcgtggggaagaacgaacgggggaaaagcctcctgttcaaaactgcgtccggcatcaacatgtgcaccctcatcgccatggatctcggcgagatgtgcgacgacaccgtcacgtataagtgccccctcatcgccgaggtggagcccgaagacatagactgctggtgcaacttgaccagcacctgggtgacgtatgggacgtgcaaccaggcaggcgagcatcgccgcgacaaacggtcagtggctctcgcgccccacgtgggcatggggctcgatacccgcacccagacctggatgagcgctgagggcgcctggcgccaggtggaaaaggtcgaaacatgggcgcttcgccacccggggtttaccatcctcgccctgttcctggcccactacataggcacttccctcacacaaaaggtggtcatcttcatcctcctgatgctcgtgacgcccagcatgaccatgcggtgcgtgggggtgggcaacagagacttcgtcgaggggctctcaggggcaacctgggtagacgtggtactggagcacggcgggtgcgtgaccacgatggcaaagaataaacccaccttagatattgagctgcagaagaccgaagccacccagctggccacccttcgcaaactttgcatcgagggcaagatcacaaacatcaccactgactctcgctgccccacgcaaggcgaggccatcctgccggaggaacaggaccagaattatgtgtgtaagcacacctacgtcgacagggggtggggcaatgggtgtggattattcggcaagggatccctggtgacctgtgccaagtttcagtgcttagagccgatcgagggcaaagtggtccagtacgagaacctaaagtacaccgtgatcatcacggtgcatacgggcgaccagcatcaggtcggtaacgacacccagggggtgactgtcgaaatcacgccccaggcgagcaccgtcgaagcggtgctccccgagtacggcacgctgggactcgagtgctcaccgcgcaccggtctggacttcaacgagatgatcttgctcaccatgaaaaacaaggcgtggatggtccacaggcagtggttcttcgacctgccgctgccatggacgagcggcaccaccaccgagacgccaacctggaaccgcaaggagctcttagtgaccttcaaaaacgcccatgccaagaagcaagaggtcgtggtgctgggttcccaggagggagccatgcacactgccctcacgggggcgactgagatacagaacagcggcggtacctcgatcttcgcgggccatctaaagtgccggctcaaaatggacaagttagagcttaagggtatgtcatacgccatgtgcctaaacaccttcgtgctcaagaaggaggtatccgagacgcagcacggtaccatactaatcaaggtagagtacaagggcgaggatgctccgtgcaaaatccctttcagcaccgaggacgggcaaggcaaggcacataatggccgcctgataactgccaatcccgtggtcaccaagaaggaggaacctgtgaacatcgaggccgagccgcccttcggggaatctaacatcgttattggcatcggtgacaaagctctgaagataaactggtataagaaagggtccagcatcgggaagatgttcgaggccacggcgcggggcgcccggcggatggctatcctcggagacactgcctgggatttcggctctgtcggcggcgtgctaaattccctgggtaagatggttcaccagattttcgggagcgcatacaccgcgttatttagcggcgtctcctggatcatgaagatcgggataggagtcttgctcacgtggatcggcctcaactctaagaacacctcaatgagcttctcgtgcatagtgattgggattatcacgctgtacttaggcgccgtcgttcaggccgacatgggatgcgccatcaactggaagggcaaagaactcaagtgcggcagcgggatcttcgtgactaacgaggtccacacctggaccgaacagtacaggttccaggccgattcacccaagcgcctggcgacggccattgcgggtgcctgggagaacggggtgtgtgggatccgtagcaccacacgcatggagaacctgctctggaagcagatcgcaaacgagctgaactatatcctttgggagaacaacatcaagctcaccgtggtcgtgggggacatcattggcgtgctggagcagggcaagcgtgcgctcgcccctcagccgatggagctcaaatacagttggaaaacctgggggaaggccaagatcgtaactgcggagacgcagaacagctctttcataatcgatggacccaacacgcccgagtgtccctccgcgtcccgagcgtggaacgtgtgggaggtggaggactatgggttcggcgtcttcaccacaaacatctggttaaagttacgtgaggtgtatacgcagtcctgcgatcaccgcctcatgagcgccgccatcaaggacgagagagcggtgcacgcggacatgggttactggatcgagtcccagaagaacggatcatggaaattggagaaggcctcattcattgaggtcaaaacctgcacctggcccaagagccacaccctgtggtccaacggcgtgctcgaatccgacatgatcatccccaagtctctggccgggcccattagtcagcacaaccatcgcccggggtaccacacccagacggctggcccatggcacctggggaagctcgagctggacttcaactattgcgaaggcaccacagtggtcatcacggagaactgtggtacgcgaggaccctcccttcgcaccaccaccgtgagcgggaagctcatccacgagtggtgctgtcggtcttgtacgctcccaccgctgagatacatgggcgaggacgggtgctggtacggcatggaaatcagacccattaacgagaaggaagagaacatggtgaaatcattagtcagcgccggctcagggaaggtggataacttcacgatgggggtgctgtgcctggcgatcctttttgaggaggtcatgcgtgggaagttcggcaagaaacatatgattgccggggtcttattcaccttcgtactgctcctgtccgggcagatcacctggcgtgacatggctcacacactgatcatgatcggttccaacgcctccgaccggatggggatgggcgtaacttacctcgccctgatagccacatttaaaatccagcccttcctggccttaggcttcttcctgagaaagctgaccagccgcgagaacctcttactgggggtcggtctcgccatggccacaaccctgcagctgcccgaggatatcgagcagatggccaacgggatcgcgctaggcctaatgaccctgaagctcatcacacagttcgagacgtatcaactttggactgccctggtaagcctaacctgctcaaacactatcttcacgctgaccgtcgcatggcggaccgccaccctgatactcgcgggggttagcctacttccgctctgtcagagcagctccatgcgcaagactgactggctgccgatgacagtcgcagcgatgggggtgcccccactgccactcttcatttttagcctgaaggacacccccaagcgccggtcctggcccttgaacgagggggtgatggccgtcggcctagtgagcatcctggcctcttctttactccgcaatgacgtcccaatggcgggaccgctggtcgccgggggcctgctcattgcgtgctacgtgatcacgggcacgagtgctgacctgaccgtggagaaggcggcggacgtcacgtgggaggaggaggcggagcagacgggagtgagccacaacctgatgatcacggtggacgacgacgggacaatgcggataaaggacgacgaaaccgaaaacatcctcacagtcctgctgaagaccgccctcctgatcgtgtccggcatctttccatactccatcccggcgacgctactcgtctggcacacctggcaaaagcagacccaacgctccggtgttttgtgggacgtgccgagcccgcccgagacacagaaggcggagctggaggagggggtgtaccgaataaagcagcagggaatatttggcaagactcaggttggagtgggggtgcaaaaggaaggggtgttccatactatgtggcacgtcacccgcggcgcggtactcacccacaacgggaagcggctggaaccgaactgggctagtgtcaagaaagacctgatcagctacgggggtggctggcgcctctctgcccagtggcagaaaggggaagaggtacaggtgatcgccgtcgagcctgggaaaaacccgaaaaacttccaaacaatgcccggcatcttccagacgaccatgggggagatcggcgcaatcgccttggacttcaagcccgggaccagcgggagtcctatcatcaaccgggagggcaaggtggtgggtttgtacggcaacggggtcgtgaccaagaacggagggtacgtgtcaggtatcgcccagaccaacgccgagcctgatggccccacccccgagctggaggaggagatgttcaagaaacgtaaccttaccatcatggacctgcatccagggagcggcaagacgcggaaatacctccccgcaatcgtccgggaggcaatcaagcgacggctccgtaccctgatactggccccgacgagagtagtagcggcggaaatggaggaggcactcaaggggctgccaatccggtaccagacgacggcgaccaaatccgagcataccggccgcgaaattgtcgacctgatgtgccacgccacattcacgatgagactgctgagccctgtccgcgtgcccaactacaacctgatcattatggacgaggcccacttcaccgaccccgcctccatcgcggcgcgagggtatataagcacccgcgtcggcatgggagaggctgccgcaatcttcatgactgcgacgccaccaggaaccgccgaggccttcccacagtccaacgcgcccatccaggatgaggagagagacatccctgagcggagctggaacagcggcaacgaatggatcactgactttgtggggaagaccgtctggttcgtcccatctatcaaggcgggcaacgatatcgcgaactgcctccgcaagaacggcaagaaagtgattcagctttcccgtaagacgttcgatactgagtaccagaagaccagactgaacgactgggacttcgtcgttaccacagacattagcgagatgggcgccaacttcaaagccgaccgagtcatcgatccccgcagatgtctcaagcccgtgatccttaccgatggaccggagcgcgtgatcctggccggcccgatgcccgtgaccgccgcgtccgccgcccagcggcgcggacgggtggggcgtaacccccagaaagaaaacgaccagtacatcttcaccggacagcccctcaacaacgacgaggaccacgcccactggacggaggccaaaatgcttctggacaacattaacactccagaggggatcattccagcattgttcgagcccgaacgggagaaaagcgccgcaatcgacggtgaataccgtctgaaaggcgagtcccggaagaccttcgtcgagctgatgcgcagaggggacctacccgtgtggctggcccacaaagtggcttctgaaggcataaaatacaccgaccgcaagtggtgcttcgatggagagcggaataaccagatcctagaggagaatatggacgtggagatctggaccaaggaaggggagcggaagaagttgcgcccgcgttggctggacgcccgtacgtatagcgacccgctggccctgaaggagttcaaggacttcgccgccggacggaaaagcatcgcgttagaccttgtgaccgagattgggagggttccatcccacctcgcctaccggacacgcaacgccctggataatctggtcatgttacacacgtccgagcacggagggcgggcgtaccgccatgccgtggaggaactgcccgagaccatggaaaccctgctgctactggggctcatgatcctgctaacagggggtgcgatgctattcttaatcagcggcaaaggtatcgggaagacaagtatcggcctgatctgcgtcatagtgagctccggcatgctttggatggccgacgttcccttgcagtggattgccagcgccatcgtcctggagttcttcatgatggtactcctgatacccgagcccgagaaacagcggacgccgcaggataaccagctggcctacgtggtcatcgggattctcacgctagctgcaatcgtagccgccaacgagatgggcctgctcgagacaaccaaaagggacctgggcatgtccaaggaacccggcgtcgtcagccccacgtcctatttagacgtagacctccaccccgctagcgcatggaccctgtacgccgtggcgacgacggtcatcacgccgatgctgcggcacaccatcgagaactccaccgccaacgtgtcgctcgctgccatcgccaaccaagccgtggtcttgatgggcctagataagggatggcccatcagtaaaatggacctcggcgtgcccctgctggccctcgggtgctactcccaggtcaaccccctgaccctgacggcggccgtactactgctggtgacgcactacgccatcatcggacccggcctgcaggcaaaggccaccagagaggcccagaagagaaccgccgcagggatcatgaagaaccccaccgtggacggcatcatgactatcgacctggaccccgtcatctacgacccgaaattcgagaagcagctgggacaggtgatgcttctggtgctgtgcgctgtccaactcctgctgatgcgcacctcctgggccctctgtgaagcgcttaccctggccacgggcccgatcacaaccctctgggaaggcagtccgggaaaattctggaacaccacgatagccgtgtccatggcgaatatcttcagaggcagctacctggcgggggccggactcgctttctccattatgaaatcagtggggacggggcgcaggggcaccgggtcacagggcgagaccctcggggagaagtggaaaaagaaactgaaccagttgtctcgcaaggagttcgatctctacaagaaaagcggcatcactgaagtcgaccggactgaggcgaaggaggggctgaagcgtggggagactacccaccacgccgtgagtcggggcagcgctaaactgcagtggtttgtggagcgaaacatggtgattccagaggggcgggtgatcgatctcggctgcgggaggggcggatggtcctactactgcgccggcctgaagaaagtgacggaagtccgcggctacaccaagggtggccccggccacgaggaaccggtccctatgagcacctatggctggaacattgtgaaactgatgtccggcaaggacgtgttttatttacctccagagaagtgcgacacgctgctttgtgacattggagagagctccccctcacccaccgtggaagagtctcgcaccatccgcgtgctgaaaatggtggagccctggcttaaaaacaaccagttctgcatcaaggtgctgaatccttacatgcctaccgtgatcgagcacctagaacggctccaacgcaagtacggagggatgctggtccggaacccactgtctcgaaactccacccacgagatgtactggatcagcaacggcacggggaacatcgttagctcagtgaatatggtttcccgtctcctgctgaaccgcttcacgatgacccaccgtcgcccgaccattgagaaggatgttgacctaggagccggcactcggcatgttaacgctgagccggagacgcctaacatggacgtgatcggggagcgtatcaagcggattaaggaggagcatagctccacctggcactacgacgacgagaacccgtacaagacttgggcctaccacggcagctatgaagtgaaggcgactgggtccgcgagcagcatgataaatggcgtcgtaaagctgctgacgaagccttgggatgtggtccccatggtgacgcaaatggccatgacagataccacgcccttcgggcagcagcgcgtgttcaaggaaaaggtcgacacccggacaccccgcccaatgccgggcacacggaaggtaatggagatcacggcggagtggctctggagaacacttggccgcaacaagaaaccccggctatgcacaagagaagagttcactaagaaagtgagaactaatgccgcaatgggcgccgtcttcacagaggagaaccaatgggacagtgccagggccgcggtcgaagacgaggagttttggaagctcgtggaccgggagcgggagctccataagctgggcaagtgcgggtcatgcgtatacaacatgatggggaagagagagaagaagctcggcgagttcggcaaagccaagggatcccgcgccatctggtacatgtggctcggagctcggtacttagagttcgaggccctcggcttcctcaacgaggaccactggttctcacgcgagaactcatatagcggggtagaaggcgaggggctgcacaagctcggctatatcctgcgcgacatatccaagatccccggaggggcgatgtacgccgatgacactgccggctgggacacacgaataacggaggacgacctgcacaacgaggagaaaatcacccagcagatggaccccgaacaccggcagctcgccaacgcaatcttcaaactgacctaccagaacaaggtggtcaaggtgcagcgcccaacccccaaggggacggtgatggacataatcagccgaaaggaccagcgcggctccggccaagtgggcacctacggcctgaacacgtttacgaacatggaggcgcagttagtacggcagatggagggggagggcgtcttgtcgaaggccgatctggagaaccctcacttgctggaaaagaagatcacgcagtggctggaaactaagggggtcgagcgcctcaagcggatggccatctccggggatgactgcgtggtgaagcctattgacgaccggttcgctaacgccctgctagcgctcaatgacatgggcaaggtccggaaggacatcccgcagtggcagccctcaaaggggtggcatgactggcaacaggtacccttctgcagtcatcacttccacgagctgatcatgaaagacggtcgcaagctggtggtcccctgccgcccacaggacgagctcatcgggagagccaggatctcccagggggccgggtggagcctgaaagaaactgcctgcctaggaaaagcctacgcgcagatgtggagcctcatgtacttccatagacgagacctgagacttgcctccaatgccatttgcagcgccgtgcccgtccactggatccccacttcccgcaccacgtggagcatccatgcgcaccaccagtggatgaccaccgaagatatgctcaccgtttggaaccgggtatggatcgaggacaatccctggatggaggataagacaccggtaaccacctgggaagacgttccctatctgggcaagcgcgaggaccagtggtgcggctcgcttataggtctaacctctagggccacgtgggcccagaacatcctaaccgccattcagcaggtacgctcgttgatcggtgacgaggagttcttggattacatgccctccatgaaacggtttagaaaggaggaggagagcgagggagccatatggtaa

SEQ ID NO: 26106 - RNA, 9873 nt, synthetic construct
  misc_feature 1..9873: note = derived and/or modified CDS sequence (opt11) from DENV-3__EU482461__SS-prME
  source 1..9873: mol_type = other RNA
actagcctgtgcctgatgatgatgctacccgctacgctcgcgttccacttgactagccgggacggcgaaccccggatgatcgtggggaagaacgagagaggcaagagcttgctgtttaagaccgcctccgggataaacatgtgcaccctgatcgccatggacctgggcgagatgtgcgacgacacggtgacgtataagtgccctctgatcgctgaagtcgagcccgaggacatcgactgttggtgcaacctcaccagcacctgggtgacctatggtacgtgcaatcaggccggtgaacaccggcgcgacaagcgcagcgtggcactagcgccgcacgtaggcatggggctggacacgaggacccagacctggatgagcgccgagggcgcctggcgccaggtggagaaggtggaaacgtgggccctccgccacccggggttcaccatcctggcgctgttcctagcccactacatcggcacctccttaacccagaaggtcgtgatatttatcttactcatgctggtgacgccctctatgaccatgcgctgcgtgggggtggggaaccgcgacttcgtcgagggcctgtccggcgccacgtgggtagacgtggtcctcgagcacggcgggtgcgtgaccacgatggccaagaataagccgaccctggacatcgagctgcagaagaccgaggccacccaattggcgacgctgcggaagctgtgtattgagggcaagatcaccaacatcaccaccgacagccgctgccccacgcaaggggaggccatcctcccggaggagcaggaccagaactacgtgtgcaagcacacctacgtcgaccgggggtggggtaatggatgcggcctgttcgggaagggctccctagtgacctgtgccaagttccaatgtctggagcccatagagggcaaggtggtccaatacgagaacctaaagtacaccgtgatcatcacggtgcacaccggggaccagcaccaagtaggcaatgacacccaaggggttaccgttgaaatcacgccccaggccagcaccgtggaagccgtgctgcccgagtatggcaccttgggactggaatgttctccgcgcaccgggctggactttaatgagatgattctcctgaccatgaagaacaaggcgtggatggtccaccggcagtggttcttcgacctgcccctcccctggacgagcggcgcgaccaccgagacccccacgtggaacaggaaggagctgctggtgacgtttaagaatgcccatgccaagaagcaagaggtggtcgtgctcgggtcccaggagggcgccatgcacaccgctctgaccggcgctacggagatccaaaacagcggagggaccagcatcttcgccgggcacctcaagtgccgcctcaagatggacaaacttgaattaaagggcatgagctacgccatgtgcctcaacaccttcgtgctgaagaaggaggtctccgagacccagcacgggacgatcctgatcaaggtcgagtacaagggagaggacgcgccgtgcaagatccccttcagtaccgaggacgggcagggcaaagcgcacaatggccgccttataaccgccaaccccgtggtcacaaagaaggaggagccggtgaatatcgaagccgagccgccctttggggagagcaacatcgtgatcggcatcggagacaaggccctcaagatcaattggtacaagaaaggctcctctataggtaagatgttcgaggccacggcgagaggcgcccgccggatggccatcctcggcgacaccgcttgggactttgggtccgtcggcggggtgctgaatagcctcgggaaaatggtgcaccagatcttcgggtccgcgtacaccgcactgttcagcggcgtctcctggatcatgaaaatcggtatcggtgtgctgctcacctggatcggcctgaacagcaagaacacgtccatgagcttctcctgtatcgttatagggatcatcaccctgtacctcggcgcagtcgtgcaggccgacatggggtgcgccatcaactggaagggcaaggagcttaagtgcggcagcgggatattcgtgacgaatgaggtccacacgtggacagagcagtacaagttccaagcggattcgccaaagcggctggccactgccatcgccggcgcctgggaaaatggggtttgtggtatccgctccaccacccggatggaaaacctcctatggaaacagatcgcgaacgagctaaactacatcctctgggagaacaatatcaaactgactgtggttgtgggggacatcatcggagtgctggagcagggcaaacgcacgttgacacctcagccgatggagcttaaatacagttggaaaacctgggggaaagcgaagatcgtaacggccgagacccagaatagctccttcatcatcgacggccccaacacccccgaatgccccagcgcctcccgcgcgtggaacgtatgggaggtggaagactacggcttcggtgtcttcacaacgaacatctggctgaagctccgtgaggtgtacacgcagagctgcgaccaccggctgatgagcgcggcaatcaaggacgagcgcgccgtgcacgcagacatgggctactggattgagtcccagaagaacgggagctggaagttagaaaaggcctccttcattgaggtcaagacgtgcacttggcccaagagccacaccctctggtccaacggggtgctggagagcgatatgataatccccaagtccctggccggaccaatcagccagcataaccaccggccgggctaccacactcaaaccgccgggccatggcacttaggtaaactggagctggacttcaattactgtgagggcaccaccgtggtcatcacggaaaactgcgggacccgcggtccctccctacggaccaccaccgtgagcgggaagctgatccacgagtggtgctgccgctcctgcaccctgcccccgctccggtacatgggcgaggacggttgctggtacggtatggagatccgccccatcaacgagaaagaggagaacatggttaagagcctggttagcgccggcagcggaaaagtggacaacttcacgatgggcgtgctctgcctagcaatacttttcgaggaggtcatgcgggggaagtttggcaagaagcacatgattgcaggggtgctgttcacgttcgttctcctgttgtccggacaaatcacgtggcgcgacatggcccacaccttgatcatgatcggcagcaacgcctccgaccggatggggatgggcgttacctacctagccctgattgctacattcaagatccaacccttcctcgctctggggttcttcctccgtaaacttacgtcccgggagaacctacttttgggcgtcggccttgcgatggcaacgaccctgcagctccccgaagacatcgagcagatggctaacgggatcgcgctgggcctgatgacgctcaaacttatcacgcagttcgagacgtaccagctgtggaccgcactggttagcctgacctgctccaacacgatcttcaccctgacggtcgcctggcgcaccgccacgctcatcctggccggggtgtcgttgctcccgctctgccagtccagctccatgcggaagaccgactggctgcccatgacggtcgcggccatgggcgtgccgcccttaccgttattcatcttcagcctgaaggacaccccgaagcgccgctcctggcctctcaacgagggggtgatggccgtcggccttgtgagcatcctggcttccagcctcctgcggaacgatgtgcccatggcaggtccgctggtagctggcgggttattgatcgcctgctacgtgatcacggggacctccgctgacctgacagtggaaaaggctgccgacgtcacctgggaggaggaagcggagcagacgggggtgagccacaacctgatgatcaccgtggacgacgacgggaccatgagaatcaaggacgacgagaccgagaacatcctcaccgtcctgctgaagacggctctactgatcgtatccggcatcttcccctacagcatccccgccaccctgttagtgtggcacacctggcagaaacaaacccagcggagcggcgtcctgtgggatgtgcccagcccgcccgagacgcagaaggccgaattggaggagggcgtgtaccgaatcaagcagcagggcatcttcggcaaaacacaggtaggcgtaggggtgcaaaaggagggcgtcttccacaccatgtggcatgtaactcggggcgccgtgctgacgcacaacgggaagcgcctggagcccaactgggcgtccgtcaagaaggacctcatcagctacggcgggggctggcggctgtctgcccagtggcagaagggggaggaggtccaggtcatcgccgtggagcccggcaaaaacccgaagaacttccagaccatgccaggcatattccagaccacgacgggggaaatcggcgccatagccctggactttaagcccgggaccagcggtagccccatcatcaaccgtgagggcaaggtggtggggctttacggcaatggggttgtgacaaagaacggcgggtacgtgtccggcatagcccagaccaacgccgagcctgacggcccgacgcccgagctcgaagaggagatgttcaagaagcggaacctgaccataatggacctgcacccaggttcgggcaagacccggaagtacctccccgccatcgtgcgggaggccatcaaaaggcggctgcgcacgctgattcttgcgccgacacgggtggtggcggccgagatggaggaggcccttaagggactgcctatccgctatcaaaccaccgctaccaagtcggagcacacgggccgggagatcgtcgacctcatgtgccacgcgacctttaccatgcgcctgctctctcccgtgcgggtgccgaactacaaccttgtcattatggacgaggcccatttcaccgaccccgcctccatcgccgcccgtgggtacatcagcacgcgggtgggcatgggcgaagccgccgccatcttcatgacggcaacgccgcccgggacggcggaggccttcccccagtccaacgcccctatccaggatgaagaacgcgacatccccgagcgcagttggaactcaggtaatgaatggatcacggacttcgtaggaaagaccgtctggttcgtccccagcattaaagcaggtaacgacatcgccaactgcctgaggaaaaacggtaaaaaggtgatccagctgagcaggaagaccttcgacaccgagtaccagaagacgcggctcaacgactgggactttgtcgtcaccacggacatcagcgagatgggcgcgaatttcaaggccgaccgcgtcatcgaccctcggcgatgcctgaagcccgttatccttaccgacggacccgaacgggtcatcctcgccgggccgatgcccgtgactgccgcctccgcggcccagcgccgaggccgcgtcgggcggaacccccagaaggagaacgaccagtacatctttacgggccagcccctgaacaacgacgaggaccatgcccactggaccgaggcaaagatgctgctcgacaacataaacacgccggaggggatcatccccgccctgttcgagccagagcgcgaaaaatccgcggctatcgacggcgagtaccggttaaagggcgagtcccgcaagaccttcgtggagctgatgcggcgcggggacctgcccgtttggctagcccataaggttgcttccgagggcatcaagtacacggaccgtaagtggtgcttcgacggggagcgtaacaaccagatcctagaagagaacatggacgtggagatctggaccaaggagggcgagcgtaagaaattacggccgagatggctggacgctcggacctactccgaccccctagccctgaaggagttcaaggacttcgccgctggccgcaagagcattgccttggatctagtcacagaaattgggcgggtcccctcccacctggcgtaccgcacgcggaacgcactggataaccttgttatgcttcataccagcgagcacggcgggcgcgcctaccggcacgccgtcgaggagctaccggaaaccatggagaccttacttctgctcggacttatgatcttactcaccggtggggccatgctgttcctgatctctggtaagggtatcggcaagacctccataggtctgatatgcgtgatcgtgagcagcggcatgctttggatggcggacgtccccctgcagtggattgccagcgcaatcgtgctcgagttctttatgatggtgctgctgatccccgagcccgaaaaacaacgcacaccccaggacaaccaattagcctacgttgtgatagggatcctgaccctcgccgcgatcgtggccgcaaacgagatgggcctccttgagacgacgaaacgggatctggggatgagtaaggaacccggggtcgtgagccccacctcctacctcgacgtggacctgcatcccgccagcgcctggaccctgtacgcggtcgctactactgtgatcacccctatgctccgccacacgatcgagaacagtacggccaacgtgagcctggccgcgattgccaaccaggcagtcgtgctgatgggcctcgacaaggggtggcccatctccaaaatggatctgggcgtgcccctgctcgccctgggatgttactctcaggtcaaccccctgaccttaactgccgcggtgctgttactcgtaacccactacgccatcatcggcccgggcctgcaagccaaggctacgcgtgaggcccagaaaaggacagcggccggaatcatgaaaaaccctaccgtcgacggcattatgaccatcgacttggaccccgtgatttatgactccaagttcgagaaacaactcggccaggtcatgctgctggtactctgtgccgtgcagctgctcctcatgcggaccagctgggcactatgcgaggccctgactctcgcgaccggccccattaccacgctgtgggagggctccccggggaaattttggaacacaaccatcgccgtgagcatggccaacatcttccgcggctcctacctggccggggcgggcctcgccttctcgattatgaagtccgtaggcaccggccggcgcggcacggggagccagggtgagaccctgggggagaagtggaaaaagaagctgaaccagctcagccggaaggagttcgacctatacaagaagtccggtatcacagaggtggaccgaaccgaggcaaaagaggggctgaagcgcggcgaaacaacgcaccacgccgtgagccgcggctccgccaaactccagtggtttgtcgagcggaacatggtaatacctgaagggcgcgtgatcgacttagggtgcgggcgcggagggtggtcgtactactgcgctggcctgaagaaggtcaccgaggtgcggggctacaccaaaggcggccccgggcacgaggagccggtgcccatgagcacctacggatggaacttagtcaagctgatgagcgggaaggacgtgttctacctgccgccggagaaatgcgataccctgctctgcgacatcggtgagtccagcccctccccgacggtggaggagagccgtaccatccgggtcctgaagatggtggagccctggttaaagaacaaccaattctgtattaaggtactaaatccctatatgcccaccgtcatcgagcacctggagcgcctgcagcggaaatacggcgggatgctcgtgcgcaacccgctgtcccggaatagcactcacgagatgtattggatatccaacggcacggggaacatcgtcagcagtgtcaacatggtgtcgcgcctgttactgaaccggttcaccatgacccaccgtagaccgacgatcgaaaaggatgtcgatcttggggccggcacgcgccatgtgaatgccgagccagagacccccaacatggacgtaatcggagagaggatcaagcgcatcaaagaggaacactcgagcacttggcactacgacgacgagaacccctacaagacgtgggcctaccacgggtcgtatgaggttaaggccactgggagcgccagctccatgattaacggcgtggtgaagctcctaaccaagccatgggatgtcgtgccaatggttacccagatggcaatgacagacactacaccattcgggcagcagcgggtctttaaggagaaggttgacacccgaacgccccggcccatgccgggtacccgcaaggtgatggaaataaccgccgagtggctgtggcggaccctcggacgcaacaaaaagccgcgtttatgcacgcgggaggagttcaccaagaaagtccgcaccaacgctgctatgggggcggtgtttaccgaggaaaaccagtgggacagcgcccgggccgccgttgaggatgaagagttctggaagctggtcgatagggagcgggagctccacaaactgggcaagtgcggttcatgcgtgtacaacatgatgggcaagcgcgagaagaagctgggagagttcggcaaggcaaaggggagtcgggccatctggtacatgtggctcggcgcccgttacctggagtttgaagccctgggcttcctcaacgaggatcactggttttcgcgggagaatagctactccggtgtggaaggcgaggggctgcacaagctcggctacatcctcagggatatcagcaagattccgggaggcgccatgtacgcggatgacactgccggctgggacaccagaatcaccgaggacgacctgcacaacgaagagaagatcacccagcagatggaccccgaacaccgccagttggctaatgccatcttcaaacttacgtaccagaacaaggtcgttaaggtccagcgtccgaccccaaaggggactgtcatggatatcatatcacgcaaagatcaacggggcagcggacaggtggggacctacggactgaatacctttacaaacatggaggcccaactggtgcgtcagatggagggggaaggagtcctttccaaagcagatctggaaaacccacacctccttgagaagaagataacgcagtggctggagaccaagggcgtggagcggttgaagagaatggcaatcagcggcgacgattgcgtggtcaagccgatcgacgaccggttcgcaaacgcgctgctggccctgaacgacatgggcaaggtgcgcaaggatataccccagtggcagccgtccaaagggtggcacgattggcaacaagttcccttttgtagccaccacttccacgagctgatcatgaaggacggacggaaactggtagtgccctgccgcccccaggacgagctgatcgggcgcgcgcggatcagtcaaggcgccggttggagcctcaaggagaccgcgtgcctgggcaaggcttacgcccagatgtggtccctgatgtacttccaccgccgggacctccgcttagcgagcaacgccatctgctcggcggtcccagtccactggatccccacttcacggaccacctggagcatccacgcccaccaccagtggatgacaacggaggacatgctgaccgtgtggaaccgcgtctggattgaggacaacccatggatggaggacaaaacccctgtcaccacgtgggaggacgtaccgtacctcggcaagcgagaggaccagtggtgcggttccctaattggactgacgagccgcgccacatgggcccagaacatcctcaccgccatccagcaagtccggtccctgatcggggacgaggagttcctggactacatgcccagcatgaagcggttccggaaggaggaggaaagcgagggcgccatctggtga

SEQ ID NO: 26107 - RNA, 9873 nt, synthetic construct
  misc_feature 1..9873: note = derived and/or modified CDS sequence (opt11) from DENV-3__EU482462__SS-prME
  source 1..9873: mol_type = other RNA
accagcctctgcctgatgatgatgctccccgcgaccctggccttccacctcacgtcccgggatggcgaaccacggatgatcgtgggcaagaacgagcgcggcaaaagcctgctatttaagaccgcgagcgggattaacatgtgcaccctgatagccatggacctcggcgagatgtgcgacgacaccgttacctacaagtgccccctgatagccgaggtggagcctgaggacatagactgctggtgtaacctcaccagcacctgggtgacatacgggacatgtaatcaggccggcgaacatcgacgcgacaagcggtcagtggcattggcgccccacgtggggatgggcctagatacccggacccagacctggatgagcgcggaaggcgcttggcgccaggtggagaaggtggagacgtgggcactccgccacccggggttcaccatcctggcgctatttctcgctcactacatcggtacctccttaacgcagaaggtggttatattcatcctgctcatgctggttacgcccagcatgacaatgaggtgcgtgggggtcggcaaccgcgatttcgtcgaaggcctatctggtgccacctgggttgacgtagtcttggagcacggcgggtgcgtgaccacgatggcccgcaacaagccaaccctggacatcgagctgcagaaaacagaggccacccagctcgcgacgctccggaaactttgcatcgaggggaagatcaccaacatcaccacggacagccggtgccctactcagggcgaggccatcctcccggaggagcaggaccagaattacgtgtgcaagcatacttatgtcgatcgcgggtggggcaacgggtgcggcctgttcgggaaaggctcgctggttacttgcgccaagtttcagtgcctcgagccaatagagggcaaggtggtacagtacgagaacctgaaatacaccgtaatcatcacggtacacaccggagaccagcaccaggtcggtaacgatacccaaggggtgaccgtagagataacaccccaggcctcaaccgtggaggccgtgctgcccgagtatgggaccttggggttagagtgctccccgcggaccggcctggactttaacgagatgattctcctgaccatgaaaaacaaagcgtggatggtccaccgccagtggttctttgacctccccttgccttggacatccggcgccacgaccgagacccccacgtggaaccgtaaggaactactggtcaccttcaagaatgcgcacgccaaaaagcaggaggtggtcgtgctcgggtcccaggagggcgctatgcacaccgcgcttacaggggccacggaaatccagaactcgggcggaacctccattttcgccggccacctgaagtgccgcctcaagatggacaagctggagctgaagggcatgtcgtacgcgatgtgcctaaacacgttcgttctaaagaaggaggtcagcgaaacgcagcacggaacgatcctgatcaaggtagagtacaaaggtgaggacgccccgtgcaaaatcccgttcagcactgaggacggtcaaggcaaggcacacaacggccggctgatcaccgccaaccccgtcgtcacgaagaaagaggagccagtgaacatcgaggccgagccgccctttggggagagtaatatcgttatcgggatcggggacaaggcccttaagatcaactggtacaagaaaggcagtagcataggaaaaatgttcgaggcgacggcccgtggcgcccggcgcatggcaatcttaggcgacaccgcctgggatttcgggtccgtcggcggggtcctgaacagcctcggcaagatggtgcaccagattttcggatctgcgtacacggccctgttcagcggcgtctcctggatcatgaagattggaatcggtgtcctgctcacctggatcggcttgaactcgaagaatacgtcaatgagcttcagttgcatcgtgataggtatcatcacactttacctaggcgcagtcgtgcaggcagacatggggtgcgccattaactggaagggcaaggagctgaagtgcggcagcggaatcttcgtgaccaacgaggtgcatacttggacggagcagtataagttccaggcggactcccccaagcgcctggccactgctatcgcgggcgcctgggagaacggggtgtgcggtattcggagcaccacccgcatggaaaacctactgtggaaacagatcgctaatgagctgaactatatcttgtgggagaacaacatcaagctgacagtggtcgtgggggacatcatcggcgtgctcgagcagggcaagcggaccctcacgccccaaccgatggacttaaaatactcctggaagacgtgggggaaggcgaagatcgtgacggccgagacccagaacagctccttcatcatcgacggtcctaacacccccgaatgcccctccgcgtcccgcgcctggaatgtgtgggaagtggaggactacgggttcggggtattcaccacgaatatctggctgaaactccgggaggtgtacacccagagctgcgaccaccgcctgatgagcgccgccatcaaggacgagcgggcggtgcacgccgacatgggctactggatcgagagccagaagaatgggagctggaagttggaaaaggcgtcctttattgaagtgaagacctgtacctggccgaaaagccacaccctgtggtcgaacggtgtgctggagagcgacatgatcatccccaagagcctggccgggcccattagccagcataaccaccgcccgggctaccacacccagaccgcgggcccctggcatctcggaaaactggagctggacttcaattattgcgaaggcaccaccgtggtaataaccgaaaactgcggcacgaggggcccctccttgcgcacaaccacggtaagcgggaaactgatccacgagtggtgctgccggtcctgcaccttaccaccgctccgctatatgggcgaagacgggtgttggtacggaatggagatacgacccatcaacgaaaaagaggagaacatggtcaagagcctggtctccgccggaagcggaaaagtggataatttcaccatgggggtgctgtgcttggccatcctgttcgaggaggtcatgcgggggaagttcggcaagaagcacatgattgcgggggtgctgtttacctttgttctcctgctgagtgggcaaataacgtggaaggacatggcgcatacttttatcatgattggcagcaatgcctccgaccggatgggtatgggcgtcacctacctcgcgctgatagccaccttcaagatccagcccttccttgcgctagggttcttcctccgcaagctgacgagccgagagaatctcttgctgggggtcggactcgcgatggcgacaaccttgcaattaccagaggacatcgagcagatggccaatgggatcgcgctcggcctgatgacattgaagttaatcacgcagtttgagacctatcaactgtggacggccttagtgtcgttaacatgtagcaatactattttcaccctcaccgtcgcctggcgcaccgccacgttagttcttgccggtgtcagcctgctgcctctctgccagtcgagcagtatgcgaaagaccgactggctccccatgaccgtggcggctatgggcgtgccgcccttgcccctattcatcttctctctaaaggacacacctaagcgcagatcctggcctctgaacgagggcgtgatggccgtcggccttgtgagcatcctggcttcatcactcctccggaacgacgtcccaatggccggcccacttgtggccgggggccttctaatcgcatgctacgtaatcaccgggacctccgccgatctgaccgtcgagaaggccgccgacgtgacctgggaggaggaggctgagcagactggggttagccataacctaatgatcaccgttgacgacgacggcaccatgcgcatcaaggacgacgagaccgagaatattctaacggttcttctgaagaccgcattacttatcgtgtccgggatctttccctactccatacccgccacactgctcgtttggcacacgtggcaaaagcagacccagcggtccggggtgctgtgggacgtccccagtccccctgagacccagaaggccgaactggaagagggggtctacaggatcaagcagcaaggcatcttcgggaagacccaagtgggcgtcggggtccagaaggagggcgtgttccataccatgtggcacgtcaccagaggggccgtcctcactcacaacgggaagcgcctggagcccaactgggcgtccgtcaagaaggaccttatcagctacggtgggggatggcggctctcggcacagtggcagaaaggggaggaggtacaggtcatagccgtggagcccgggaaaaacccgaagaacttccagacgatgcccggcatcttccagaccaccacgggggaaataggcgccattgcgttggacttcaaacccgggacatctggcagtccaattattaacagggaaggtaaggtggtcggactgtacggcaacggcgtggtcaccaaaaacggcggctacgtctccgggatcgcccagaccaacgcggagcccgacggccctacgcccgaactagaggaggagatgttcaagaaacggaacctcaccatcatggacctgcaccctgggtcaggcaagaccagaaagtaccttcccgccatcgtccgagaggccatcaagaggagactcagaacccttatcctggcacccacgcgggttgtcgccgccgagatggaggaggccctcaaggggctgcccatccgttaccagaccaccgccaccaaatccgagcacacgggccgggagatcgtagacctgatgtgccatgcgaccttcaccatgcgccttctgagtccggtacgggtccccaactacaatctgatcattatggacgaggctcactttaccgaccccgcctccatagccgcccgcgggtacatcagcacgcgggtaggcatgggcgaggcggccgccatcttcatgaccgctacgccacctggaaccgcggaggcgttcccccagtccaacgctccgatacaggacgaggagcgcgatatccctgagcgcagctggaactccgggaacgagtggatcacggacttcgttggcaaaaccgtctggttcgtgccgagcattaaggccggcaacgacatcgcaaactgtctccgtaagaacggaaagaaggtaattcagctctcccgcaaaacgttcgacacggaatatcagaagacgcggcttaacgactgggacttcgtagtgaccaccgacataagcgaaatgggcgcgaattttaaagccgaccgcgtaattgacccccggcgctgcctcaaaccggtcatccttactgacggccccgagagagttatactcgccgggccgatgccggtcacggctgccagtgcggcacagcgccgtggccgcgtcgggcgaaaccctcagaaggagaatgaccagtacatcttcacgggccagcctctcaacaacgacgaagaccacgcccactggaccgaagccaagatgctgctggacaacatcaatacccccgaggggatcatccccgccctcttcgaacccgagcgcgagaaaagtgcggcgatcgacggtgagtaccggctaaagggggaatcccgcaagacctttgtggagctgatgcgtcgcggggacctccccgtatggctggcccacaaggtcgccagcgagggcatcaagtacaccgaccggaaatggtgcttcgatggggaacggaacaaccagatcttggaggagaacatggatgtggagatatggaccaaggagggcgaacggaagaagctaagaccgcgttggctggacgcgcggacctactccgaccccctggccctcaaggagtttaaggatttcgcggcgggacgcaagagcattgcactggacctggtcaccgagattgggcgggtgccttcccacctcgcgtataggacgcggaacgcccttgacaatctggtgatgttgcacacgagcgagcacggagggcgcgcataccggcacgccgtcgaggagctgccggagacaatggagaccctgctactgttgggccttatgatcctgttgaccggcggggccatgctgtttctgattagcgggaaggggatcggcaaaacctccattgggttaatctgcgtcattgtgagctccggcatgctgtggatggcggacgtcccgctccagtggatcgcttctgccatcgtactggagttcttcatgatggtgctcctaattcccgagcccgagaaacaaagaacaccccaggataatcagctcgcctacgtcgtgattggaatattaaccttagccgcgatagtcgcagccaacgagatgggcctgcttgagacgacaaagcgggacctaggcatgagtaaggagccgggggtcgtgagcccaacctcctacctggacgtcgaccttcaccccgcctcagcctggaccctgtacgcggtagcaacgaccgtgatcaccccgatgctgcgccacaccatcgaaaactccacagccaacgtgagcttagccgctatcgccaatcaagccgtagtgctcatggggctggataaagggtggcccatttcaaagatggacctgggcgtgccgctgctggctctagggtgctatagccaggtcaaccccctgacactgacggccgcggtgctcctcctggtaacccactatgctatcatcggcccgggcctccaggccaaggccacgcgggaggcccagaagaggaccgcggccgggatcatgaagaaccccacagtcgacggtatcatgacgatcgacctggatcccgtgatatacgattcgaagttcgagaagcagctgggccaagtaatgcttctagtcttatgcgccgtccaactgctgctgatgagaacgtcttgggccctgtgcgaagccctgaccctggccaccggtcccataaccacactctgggagggctctccggggaagttctggaacaccaccatcgccgtgtcaatggccaacatattccgcggctcctacctcgccggggcgggcttagccttctcgatcatgaagtccgtcgggacaggtcggcgcggcacggggagccagggcgaaaccctgggggagaagtggaagaagaagctgaatcagctgtctcggaaagagtttgacctctataagaagtccggcatcaccgaggtggaccgcaccgaggccaaggaggggcttaagaggggagaaaccacccatcacgccgtaagccgcggctctgccaagctgcagtggttcgtagaacggaatatggtcatccccgaggggagggtgatcgacctcggttgcgggcgcggagggtggagctattactgcgcgggccttaagaaggtcaccgaagtgcgggggtacaccaaagggggccccgggcacgaggaaccggtgcctatgtccacttacgggtggaacatcgtcaagctgatgtcggggaaggatgtattttacctgccgcccgagaagtgcgatacgctactctgcgacattggcgagtcctcaccttccccgacagtggaggagagccgcaccatcagggtcctgaagatggtggaaccctggctcaaaaacaaccagttttgcatcaaggtgctgaacccctacatgcctaccgtcattgagcatctggagcgcctccagcgcaagtatggagggatgctggtgcgcaacccgctgtcccggaactctacgcacgaaatgtactggatctcgaacggcacagggaacatcgtgtcctccgtcaacatggtgtccaggctcctgctgaatagatttaccatgacccacaggcgccctacaatcgagaaggacgtcgacctcggcgccggcacccgtcacgtgaacgccgagcccgaaactccgaacatggacgtgatcggtgagcgaatcaaacgcatcaaggaggagcacagttcgacgtggcactacgacgacgagaacccctacaagacgtgggcctatcacggttcctatgaagtaaaggccaccgggtctgcgtcttccatgatcaatggcgtggtgaagctgctaactaaaccctgggacgtcgtcccaatggtgacccagatggcgatgacggacaccaccccgttcggacaacagcgtgttttcaaggagaaggtggatacccggacccccagacccatgcccggtacccgcaaggtgatggaaataaccgctgagtggctctggcggaccctgggcagaaacaagaagccacgactttgcacgcgggaggagttcacgaagaaggtcagaacgaacgcggccatgggggcggttttcacggaagagaaccagtgggacagcgccagagccgccgtggaggacgaagagttttggaagttagtcgatcgcgagcgcgaactgcacaagctgggcaagtgcgggtcctgcgtatataacatgatgggcaagcgcgagaagaagctgggagagtttggtaaagcaaaaggaagccgagcaatctggtatatgtggctgggtgcccgctaccttgagttcgaggccttaggatttctgaatgaggaccactggttctctcgggagaacagctattccggcgtggagggcgaggggctgcacaagctgggctatatactgcgcgacatcagcaagatacccggtggggccatgtacgcggatgacactgctgggtgggacaccagaatcaccgaggacgatctgcataacgaggagaaaatcacccagcagatggaccccgagcaccgccagctcgcaaacgcgatcttcaaacttacgtaccaaaacaaggtcgtgaaggttcaacggcccacgcctaaggggacggtcatggacataatatcccgcaaggaccaacggggtagcggccaagtgggtacatacggcctaaataccttcaccaacatggaggcccagctcgtcaggcaaatggaaggggagggggttctgtccaaggcggacttagagaacccccacctactggaaaagaagataactcaatggctggaaacaaagggagttgagcggctcaaacgcatggcaatcagcggcgacgactgcgtggtcaaacccatcgacgaccggtttgccaacgccctgctggccttaaacgacatggggaaggtgagaaaggacataccccagtggcaaccgtccaaggggtggcacgattggcagcaggtccccttctgcagccaccacttccacgagctgatcatgaaggacggccggaagctggtcgtgccctgccgcccccaagacgagctcatcgggcgcgctcggatctcccaaggcgccgggtggagcctcaaggagacagcatgcctgggcaaggcctacgcccagatgtggtcactgatgtatttccaccgccgggacctgcgcttggcctctaacgccatctgctccgccgtcccggtccactggatccccatcagccggactacatggtctatccacgcacatcaccagtggatgaccacagaggacatgctcacagtgtggaacagagtgtggatcgaggacaacccgtggatggaggacaaaacgcccgtcaccacctgggaggacgtgccgtatctcggaaagcgtgaggaccagtggtgcgggtccctgatcggcctcacgagccgcgcgacctgggcccagaatatcctgacagccatccagcaagttcggtcccttatcggggacgaggagttccttgactatatgccctcgatgaaacgcttccggaaggaggaagaatccgagggcgccatctggtga

SEQ ID NO: 26108 - RNA, 9873 nt, synthetic construct
  misc_feature 1..9873: note = derived and/or modified CDS sequence (opt11) from DENV-3__EU660407__SS-prME
  source 1..9873: mol_type = other RNA
acctccctgtgcctcatgatgatgctccccgccactttggccttccacctcactagccgggatggagagccgcgtatgatcgtcgggaaaaacgaaaggggcaagagcctcctgtttaaaacggcgtctgggatcaacatgtgcaccctgatcgccatggacctcggcgagatgtgcgacgacaccgtgacgtacaaatgccccctgatcgccgaggtggagcctgaggacatcgactgctggtgcaatttgaccagcacctgggtgacctatgggacctgcaaccaagccggcgagcatcgacgggacaagcggtccgtcgccttagcgccccacgtgggcatgggcctggacacccgcacgcaaacctggatgagcgccgagggcgcctggcgccaggtggagaaagtcgagacttgggccctccggcacccggggttcactattctggcgttattcttggcccactacatcgggacaagcctgacccaaaaggtggtgatcttcattctgttaatgttagtcacgcccagcatgaccatgcggtgcgtcggggtgggtaatcgcgatttcgtcgagggcttgtccggcgccacatgggtggacgttgttctcgagcacggcgggtgcgttaccacgatggccaagaacaagcccaccctggacatcgagctccaaaagactgaggccacccagttagcgacacttcgaaagctgtgtatcgagggcaagatcaccaacatcaccaccgactctcgctgccccacgcagggcgaagccattctcccggaggaacaagaccagaactacgtatgcaagcacacctacgtcgatcggggctggggcaacgggtgcggcctgtttggtaagggctcgctggtgacctgcgcgaaatttcagtgcctcgagcccattgagggcaaagtggtccagtacgagaacctgaagtataccgtcatcatcacggtgcacaccggggaccagcaccaggtaggcaatgacacccagggggtgaccgtggagatcacgccccaagcctccacagtagaagccgtgctgcccgagtacgggacactcgggctggagtgctccccgcgcactggcctggacttcaacgagatgatcctcctaacgatgaagaataaggcttggatggtccaccgtcagtggttcttcgacctgcccctcccatggaccagcggcgccaccaccgagacccccacgtggaatcgcaaggaactgctcgtgaccttcaagaacgcccacgccaagaagcaggaggtcgttgtgctcgggtcccaggagggcgccatgcacacagccctgaccggggccacggagatccagaatagcggcgggacatcaatcttcgccgggcacctgaaatgccggctcaagatggacaagttagagctgaaggggatgagctacgcgatgtgcctcaacaccttcgtgctgaagaaggaagtatcagagacccaacacgggacaatcctgatcaaggtggaatacaagggagaagacgccccgtgcaaaattcctttcagcacagaagacgggcagggtaaggcgcacaacggccgcctgatcacggccaaccccgtggtcactaaaaaggaggaacccgtgaatatcgaggccgagccgcccttcggtgagagcaatatcgtgatcggcatcggggacaaagcgctcaagatcaactggtacaagaagggatccagtatcggtaagatgttcgaggcgacggcccggggtgcccgccggatggccatcctcggcgacaccgcctgggacttcgggagtgtcggaggggtgctcaacagcctcggcaagatggtgcaccaaatcttcggatccgcctacacggccctgttcagcggagtctcctggatcatgaagattggaattggggtgctgcttacctggatcggtctgaactcgaagaacacgtcaatgtctttctcctgcatcgtgatcggcattatcaccctgtatctcggcgccgtcgtgcaggccgatatggggtgcgtcatcaactggaaggggaaagagctgaagtgtggtagcggtatctttgtcaccaacgaggtacatacctggacggagcagtacaaatttcaggccgacagtcccaagcgcctggccacggctatcgcaggcgcctgggagaacggggtgtgtggcatccgctctaccacccggatggagaacctcctgtggaagcagatcgcgaacgagctgaactacatcctgtgggagaacaatatcaaactgactgtcgtggtgggggatatcattggcgtcctggagcagggcaagcgcaccctaaccccacagccgatggagctgaagtactcttggaagacatgggggaaggcgaagatcgtaacggccgaaacccagaacagcagcttcatcatcgatggcccaaacacgcccgagtgtccatcagcctcccgggcctggaacgtgtgggaagttgaggactacgggttcggtgtgtttacgaccaacatctggctgaaactccgcgaagtttatacccagagctgcgatcaccggctcatgagcgcggccatcaaagatgagcgcgccgtccacgccgacatgggatactggatcgagagtcagaaaaacgggagctggaagctggagaaggcttccttcattgaagtaaagacatgcacatggccgaaatcgcacaccctctggtccaacggcgttctggagaacgacatgatcatccccaagagcctggcggggcccatctcccagcacaaccaccgcccgggataccatactcagacagccgggccctggcatctcggaaagctggagctggactttaactattgcgaaggcaccacagtcgtcatcaccgagaactgcggaacccggggcccctcgcttaggaccaccacggtgagcgggaagctgatccacgagtggtgctgccgcagctgcaccctgcccccgctacggtacatgggcgaggacgggtgctggtacggtatggagatcagacccatcaacgagaaggaagagaacatggtcaagtccctggtgtccgccggatccgggaaagtggacaacttcacgatgggagtcctgtgcctcgccatcctgttcgaagaggtaatgcgggggaaatttggcaagaagcatatgatcgccggggtactcttcacttttgtccttctgctcagtggccagataacgtggcgcgacatggcgcacaccctgatcatgataggctccaacgcaagcgaccgtatgggaatgggagtaacgtacctggccttaatcgccacattcaaaatccagcccttcctcgccctggggttcttccttcgcaagctcacgtcccgggagaacctcctgctcggcgtgggtctggcgatggccaccaccctgcagctccccgaggacattgagcagatggccaacggaatagccttaggcctgatgaccctcaagctgatcacgcagttcgagacataccagctgtggaccgcgctcgtatcgctgacctgctccaacacgatcttcacactaaccgtggcatggaggaccgccacgctcatcctggccggcgtctcccttctcccactatgccagagctccagcatgagaaagacagactggctgcccatgacagtggcggcgatgggcgtgccacccctcccactgttcatcttctccctgaaggacacccccaaacgccgcagctggcccctcaacgagggtgttatggcggttgggctggtgtccatcctggccagctccctcctgaggaacgatgtccccatggcaggacctctggttgccggcggtttactgatcgcatgctacgtaatcacggggaccagcgccgacctgaccgtcgagaaggccgccgacgtcacgtgggaggaagaggccgagcagacgggcgtgtcccacaacctcatgatcaccgttgatgacgacgggaccatgcgcataaaagacgatgagaccgagaatatcctaacagtgctgctcaagacggctttactaatagtgagcggcatcttcccctactccattcccgccaccttactggtctggcacacctggcagaagcaaacccagagaagcggcgtgctgtgggacgtgccttcccctcccgagacgcagaaggccgagctcgaggagggtgtctaccgcatcaaacagcagggcatcttcgggaaaacccaggtgggcgtgggtgtccagaaagaaggcgtattccacaccatgtggcatgtaactagaggggccgtcctgacgcacaacggtaagcgcctggagccgaactgggctagcgtgaagaaggacctcatctcctatggcgggggctggcgtctgagcgcccaatggcagaagggggaggaagtgcaagttattgccgtcgagccaggcaagaatcccaagaacttccagaccatgccaggcatcttccagaccacgacgggggagatcggcgcgatcgccctggacttcaagcccgggacctccggcagccctatcatcaatagggagggcaaggtcgtcgggctgtacggcaacggggtggtgaccaagaacggcgggtatgtgtcgggtattgcacagaccaacgccgagccagatggccccacaccagagcttgaggaagaaatgttcaagaagcggaaccttaccatcatggacttgcatccggggtccggcaagaccagaaagtacctccccgccatcgtgcgggaggccatcaagcgccggttgcggacgctaatcctcgcccccacacgggtggtcgcggctgagatggaggaggccctgaaaggactgcccatccgttaccaaaccaccgccaccaagagcgagcatacgggccgagaaatagtcgatcttatgtgccatgccaccttcaccatgcgcctgctgagcccggtacgcgtccccaactataacctcataattatggacgaggcgcacttcaccgaccccgccagcatcgccgcccgtgggtacatttcgacacgggtgggaatgggagaggccgcggcaatcttcatgaccgccacgcctcccgggaccgcggaggcgttcccccagtctaacgcccccatccaggacgaggaacgcgacatcccagagcgctcttggaactctggcaatgaatggatcacggacttcgtggggaagaccgtctggttcgtgccctccatcaaggcgggcaacgacatcgccaactgcttacggaagaacggcaagaaagttatccagctatctcgcaaaaccttcgacaccgagtatcagaaaactaaacttaacgactgggactttgttgtaaccactgacatctccgagatgggcgctaatttcaaggcggatcgggtgatcgacccacgcagatgcctgaaacccgtcatcctaaccgacggcccggagcgcgtgattctcgctgggccgatgcccgtgacggccgccagcgctgcgcaacggagaggccgggtcgggcgcaacccccagaaggaaaacgaccaatatatctttaccggccagcccctaaacaacgacgaggaccacgcccactggaccgaggccaagatgttgctcgacaacatcaacaccccggaggggatcatcccggctctgttcgagcctgagcgggagaagtccgcggcgatcgatggcgagtatcgactgaaaggcgagagccggaagaccttcgtggagctgatgagacgcggggacctgcccgtctggctagctcacaaagtggcctccgagggcatcaaatatacggaccgcaagtggtgctttgacggggagcggaacaaccagatactcgaagagaacatggacgtggaaatctggaccaaagaaggggagaggaagaaacttcggccgcgctggctggacgcccgcacatacagcgacccgctcgctctgaaggagttcaaggatttcgctgccgggcggaagtccatcgccctggacctcgtgaccgagatcggcagagtccccagccacctggcctacagaacccgcaacgcgttggacaacctcgtgatgctgcatacctccgagcacggagggcgggcctatcgccacgctgtcgaggaacttcctgagaccatggagaccctcctcctgctcggcctgatgattttactcacgggaggcgccatgctgttcctcatcagcgggaagggcatcggcaagacctcgatcggcttgatctgcgtgatcgtaagcagtggcatgctgtggatggccgacgtaccgctgcagtggatcgcgtccgccatcgtgcttgagttcttcatgatggtgctgctgatccccgagccagagaagcagcgcacccctcaagataaccagctcgcctacgtcgtgatcgggatcctgaccctagccgctatcgtggccgccaatgagatgggactcctggagacgaccaagcgcgacctgggtatgagcaaggaacctggggtagttagtccgacgtcatatctggatgtggacttacatcccgcgtccgcctggaccctgtacgctgttgcgacgaccgtgatcaccccaatgctccggcacaccattgagaatagtacggccaacgtgtcactggccgccatcgcgaaccaggctgtggtgctgatgggcttggacaaggggtggcccatctcaaaaatggacctaggcgttcccctcctcgccctgggttgctattcccaggtcaatcccctgaccttaaccgccgccgtgctgctgttagtgacccattacgcgatcatcggtccgggcctgcaggccaaggccacgcgcgaggcccagaagcggacagctgcgggaatcatgaagaatccaactgttgatggtataatgacaatcgatctagaccccgtgatctatgacagcaagttcgagaagcagttgggccaggtgatgctgctggtcctctgcgccgtgcagctgctgctcatgcgcacctcctgggccctgtgcgaggccctgacgttagccactggccctatcaccacgctgtgggagggcagcccggggaaattctggaacaccaccatcgcggtatccatggccaacatcttccgggggagctacctggctggtgccggcctcgcattctccattatgaagtccgtcgggaccggtagacgggggacggggtcccagggcgagaccctgggcgagaagtggaagaagaaacttaaccagctcagccgcaaggagttcgacctgtataagaagtccggcatcaccgaggtggaccggacagaagccaaggaggggctgaagaggggtgaaaccacgcaccacgctgtgtcccgtggctccgccaagctccagtggtttgtcgagagaaacatggtgatccccgaggggcgggtgatcgacctagggtgcgggcgcggagggtggtcctactactgcgccggactgaagcgcgtcaccgaggtacggggctacactaagggcggacccgggcacgaggagccagtgccgatgtcaacctacggctggaacatcgtcaagctcatgagcggtaaggacgtattctacctgcccccggagaagtgcgatacgctactttgcgatataggcgagagttcccccagcccgaccgtggaagagtcccgcaccatccgtgtcctcaaaatggtagagccctggctgaagaacaaccagttctgcatcaaggtgctgaacccctacatgcccacggtcatcgagcacctcgagcgcctgcagaggaaatacggcggcatgctggtgcgcaacccgctcagccgtaactcgacgcatgagatgtactggattagcaacggcaccgggaacatcgtgagcagcgtcaatatggtgtcccgcctgttattaaatcggtttaccatgacccaccgccggcccacgatcgagaaggacgttgacctgggagcgggcacacgccatgtgaacgccgagcccgaaacccccaatatggatgtgataggggagcggatcaagcgcatcaaggaggagcacagctccacctggcactacgacgatgagaacccgtacaaaacgtgggcctaccacggcagctacgaggtcaaagccacagggtccgccagcagcatgattaacggcgtggtcaagctgttgaccaagccctgggatgtcgtgcccatggtaacccagatggcgatgacggacaccacccccttcggacaacagcgggtcttcaaggagaaggtggatacccgcacgccgaggcccatgcccggcactcgcaaggtgatggagatcaccgcagaatggctgtggcggaccctcggccgcaacaagaagccgaggctatgcacgcgtgaggagttcaccaagaaggtccgcacgaatgcagccatgggcgccgtgttcaccgaggagaaccagtgggattctgcgcgggccgcggtggaagacgaggagttctggaaactggtggaccgcgagcgggagctgcacaagctcggcaagtgtgggagctgcgtgtacaatatgatgggcaaaagggagaagaaactgggtgagttcggcaaggctaagggctcccgggccatctggtacatgtggctcggggccagatacctcgagttcgaggctctgggcttcctgaacgaagatcactggtttagccgggagaacagctatagcggggtagagggcgaggggctccacaagctaggctacatcttacgggacatttcaaaaatccctggcggggcgatgtacgccgacgacacggcgggctgggatactcggatcaccgaggacgacttgcacaacgaggagaaaattacgcagcagatggaccccgagcatcgccaactggccaacgccatctttaagctgacgtaccagaataaggtcgtgaaggtgcagcggcccaccccgaaagggaccgtcatggacatcatcagccgcaaggaccagcggggctccggacaggttgggacctatggactcaacaccttcaccaacatggaggctcagctggtgcgccaaatggagggggagggcgtcctgagcaaggccgacctcgagaaccctcacctcctagagaaaaagatcacgcagtggcttgagaccaagggcgtggagcggttaaagcgcatggcgatctcaggcgatgactgcgtagtcaagcccatcgacgatcgattcgccaacgccctgctcgccctgaacgacatggggaaggtgaggaaggacatcccccagtggcagccgagcaaggggtggcacgactggcagcaggttcccttctgctctcatcatttccacgaactaatcatgaaggacggccggaagctcgtcgtgccctgtcgcccccaggacgagctgattgggcgcgccagaatcagccagggcgcagggtggagcttaaaggagacggcttgcttaggcaaggcttacgcccagatgtggtcgctgatgtactttcaccgccgggacctgcgactcgcgtccaacgcgatctgcagcgccgtgccagtgcactggattcccacgtcccggactacttggagcatccatgcgcaccaccagtggatgacaaccgaagacatgttaaccgtgtggaatcgagtgtggatcgaggacaatccctggatggaagataaaaccccggtcaccacgtgggaggacgtgccctacctgggcaagcgggaagaccagtggtgcggtagcctcataggcctgacatcacgcgctacctgggcgcagaatattctgaccgccatccagcaagtccggagcctcatcggggacgaggagttcctggactacatgcccagcatgaaacgcttccgcaaagaggaggagagcgaaggcgccatatggtga

SEQ ID NO: 26109 - RNA, 9873 nt, synthetic construct
  misc_feature 1..9873: note = derived and/or modified CDS sequence (opt11) from DENV-3__EU660409__SS-prME
  source 1..9873: mol_type = other RNA
accagcctgtgcctcatgatgatgctgcccgccaccctggccttccatctcaccagccgggacggcgagccccggatgatagtggggaaaaatgagcggggcaagtcattgctgtttaagaccgcgtcggggattaacatgtgcaccctgatcgctatggacctgggcgagatgtgtgacgacaccgtgacctacaaatgcccattaatagccgaggtggagcctgaggacatagattgctggtgtaaccttactagcacctgggtgacatacgggacgtgtaaccaggcaggcgagcacagacgtgacaaacggtccgtcgccctggcgccccacgtgggcatggggctggacacccggacacagacgtggatgtcggcagagggcgcctggcgccaagtggagaaggtcgagacgtgggccctccgtcatcccgggttcaccatcctggcgctgttcctcgcgcactacatcgggacctccctgacccagaaggtggtgatcttcatcctgctcatgctggtcacgcccagcatgaccatgcggtgtgtaggggtgggcaatcgcgactttgtcgaaggcttatctggtgcaacctgggtggacgtggtactcgagcacggcgggtgcgtgacgacgatggccaagaacaagcctacgctggacatcgagctgcagaagaccgaggccacccggctcgcgacgctgcggaagctgtgcatcgagggcaaaattacaaacatcaccaccgacagccgatgtcccacgcagggcgaggccatcctcccggaagaacaggaccaaaactacgtgtgcaagcacacctacgtcgaccgagggtggggcaacgggtgcggcctgttcgggaagggttccttggtgacctgcgcgaagtttcagtgccttgagctgattgagggcaaagtggtccagtacgagaacctgaagtacaccgtgatcatcacggtgcacaccggggatcagcaccaggtaggcaacgacacccagggcgcaaccgtggagatcacgccccaggcctctaccgtcgaggcggtgctccccgagtacggcaccctggggctggagtgcagcccgcggaccggcctcgacttcaacgagatgattctgctgaccatgaagaacaaggcctggatggtccaccgtcagtggttctttgacctcccgctgccctggacgagcggcgccaccaccgagacacccacctggaatcggaaggaactgctcgtcaccttcaagaacgcccatgctaagaaacaggaggtcgtagtcctggggtcccaggagggcgcgatgcacaccgcactgaccggggccacggagatccaaaactcaggcgggacgagtatcttcgccggccacctcaagtgcaggctgaagatggacaagctcgagctcaaaggcatgtcgtacgccatgtgcctgaacaccttcgtgctgaagaaggaggtgtccgagacccagcacgggacgatcctgattaaggtcgagtacaagggcgaagacgcgccctgcaagataccgttcagcaccgaggacgggcagggcaaggcccacaacggccggcttatcaccgccaaccccgtcgtgaccaagaaggaggaacccgtgaatatcgaggcagagcccccgttcggggagagcaacatcgtgattggcatcggggacaaggcgctgaaaatcaactggtacaagaagggctcctccatcgggaagatgttcgaagccacggcccgcggggcccggcgcatggccattctcggcgacaccgcgtgggacttcgggtccgtcggcggggtcctcaatagcctgggcaagatggtgcaccagatcttcggatcagcctacactgccctgtttagcggcgttagttggatcatgaagattggcatcggggtcttacttacgtggatcggcctgaatagcaaaaacacgagcatgagcttctcctgcattgcaatcgggattatcaccttataccttggcgccgtggtgcaggcggacatggggtgcgttataaactggaagggcaaggagctgaagtgcggcagcggcatctttgtcaccaacgaggtacacacctggactgagcagtacaagtttcaggccgactcacccaagcgcttggctaccgccatcgcaggcgcatgggagaacggtgtctgcggcattcggagcacaacccgcatggagaacctgctgtggaagcagatcgcgaacgagctcaactacatcctgtgggagaacaacatcaagctcacggtagtggtcggggacatcatcggcgtacttgagcagggcaagcggactcttacgccccagccaatggaactgaagtactcgtggaagacctgggggaaggccaaaatcgtaacggcagagacccagaacagtagcttcatcatagacggcccgaatacccccgagtgcccgagcgcctcccgcgcctggaacgtctgggaagtggaggattacggattcggcgtgttcaccactaacatctggctcaagctgcgcgaagtctacacacagagctgtgaccaccgattgatgagcgcagccataaaggacgagcgggccgtgcacgcggatatgggctactggatcgagtctcagaagaacgggtcatggaaacttgagaaggcctccttcatcgaggtgaagacctgcacgtggcccaagagccacaccttatggtccaacggggtgctggaaagcgacatgatcatcccgaagtccctcgctgggcccatcagccagcacaaccaccgccccggctaccatacgcagaccgccgggccgtggcatctcggcaagttggagctcgacttcaactactgcgagggcaccaccgtggtgatcacggagaactgcgggacccggggcccctccctgcgcaccactacggtcagcgggaagctgatccatgaatggtgctgcagatcctgcaccctgccgcccctccgctacatgggcgaggacgggtgctggtacgggatggagatccggccgatcaatgagaaagaggagaacatggtaaagtccctcgtgtccgctgggtctgggaaggtcgacaactttaccatgggcgcgctctgcttggctatactgttcgaagaggtcatgcgcgggaagttcggtaagaaacacatgatcgccggggttctgttcaccttcgtcctgctactgtctggccagatcacgtggcgggacatggcccacaccctgatcatgatcggcagcaatgcctccgatcgcatgggtatgggcgtgacctacctggcgctcatagccacgttcaagatccagccattcctggcccttggattcttcctccggaagctgactagccgcgaaaacctgctcctgggcgtggggctggccatggcgaccaccctgcagttacctgaagacatagaacaaatggccaacggaatcgcattgggcctcatgaccctgaagctgatcacgcagtttgaaacctaccagttatggaccgcgctggtcagcttgacctgctccaacacgatcttcacgctcaccgtcgcctggcggactgcgacgctgatactggccggggtgagcctcctgcccctgtgtcagtcgagctccatgcgcaagacggactggctcccgatggccgtcgccgccatgggagtgccgcccttgcccctgttcatattcagcctaaaggacacacccaagcgccggtcctggcccttgaatgagggggtcatggcggtcggactggtgagcatcctcgcctccagcctgctgcgcaatgatgtgcccatggccggccccctcgtagccggagggctgctcatcgcttgttacgtgatcaccgggacgtccgcggacctaactgtcgagaaggttgctgacgtgacatgggaggaggaggccgagcagaccggagtcagccacaacctgatgatcacggtggacgacgatgggaccatgcggatcaaggacgacgagacggagaacatcttgaccgtgctcctgaagaccgccctgctcatcgtctcaggcattttcccgtacagcattcccgcaacgctgctcgtgtggcacacctggcagaagcagactcagcgatccggtgtgctttgggacgtccccagcccgccggagacccagaaggcggagctcgaggaaggggtgtaccggataaagcagcagggcatcttcgggaagacccaagtgggcgtcggggtgcagaaggagggcgtgttccacaccatgtggcacgtaacccgtggtgccgtcctaacccacaacgggaaacggctagagcccaactgggcctccgtgaagaaggacctgataagctacggcgggggctggcgcctgtccgcccagtggcagaagggggaagaggtacaggtgatagcggtggagcccggcaaaaaccccaagaacttccagacgatgcccggcatcttccagaccacgaccggggagattggcgcgatcgccctggatttcaagccaggaaccagcggaagccccatcatcaaccgcgagggcaaggtcgtgggtctctacggcaacggggtggttaccaagaatggcgggtacgtgagcgggatcgcgcaaaccaacgccgagccggacggtcccacgcccgaactggaggaggagatgttcaaaaagaggaaccttacgatcatggacctccaccccgggagcggcaagacccggaagtatctgccggcgatagtccgcgaagctataaaacggcgcctgcggaccctaatcctggcccccacccgcgtcgtggccgccgagatggaggaggcgctgaagggtctccccatccggtaccagacgaccgccaccaagtccgagcacaccggtcgcgagatcgtcgacctgatgtgccacgccacgttcaccatgcggcttctcagcccggtccgcgtgccgaactacaacctgatcataatggacgaggcccatttcaccgaccctgcctcgattgcggctaggggttacatcagcaccagagtcggcatgggcgaagccgccgcaattttcatgacggctacgccgcccgggaccgccgaagccttcccgcagtccaacgcccccatccaggacgaggaacgcgacatccctgagcggtcgtggaactctggcaacgaatggatcacagacttcgtcgggaagaccgtgtggttcgttccctcgatcaaggcgggcaacgacatagccaactgcttacgcaagaacgggaagaaggtcatccagctctcccggaagacgttcgacaccgagtaccagaagacccgtctgaatgactgggacttcgtggtgacgaccgacatttctgagatgggtgccaacttcaaggccgatcgcgtcatagacccgcgccggtgcctgaagccggtgatcctcacagacggtccagagcgcgtgatcctagcggggcccatgccagtcacggcagcctctgccgcccagaggcgcggccgggtagggcgcaatccccagaaggagaacgatcagtacattttcaccggccagcccctgaacaacgacgaggaccacgcccactggaccgaggcgaagatgctcctggacaatatcaacacccccgaggggatcatccctgcactgttcgaacccgagcgggagaagtccgccgctatagatggcgagtaccgattaaagggcgaatcccggaagaccttcgtcgagctgatgcgccgcggggacctgcctgtctggctcgctcacaaggttgctagtgaaggcatcaagtacaccgaccgcaagtggtgctttgatggggagcggaacaaccagattcttgaggagaacatggatgtggagatctggacgaaggagggagagcgcaaaaagctgcgcccccggtggctcgacgcccgcacctactccgacccgctggcactgaaagaatttaaggatttcgccgcgggccgcaagtccattgccctcgacctggtgaccgagatcgggagagtaccctcccacctggcgtaccggacccgcaacgccctcgacaacctggtcatgctgcacacgagcgagcacggcgggcgtgcctaccgccacgctgtggaggagcttcctgagactatggagacacttctgctcctgggtttgatgatcctgttaaccgggggcgccatgctgttcctgatcagcggcaaaggtatcggcaagacgtctatcgggctgatctgcgtgaccgtgagttccggcatgctgtggatggccgacgtgcccctccagtggatcgccagcgccatcgtgctggagttctttatgatggtcctgctcatccccgagcccgagaaacagcggacgccccaagacaaccagctggcgtacgtagtaatcgggatcctgaccctggcagccatcgtcgccgccaatgagatgggactgctggaaaccactaagcgcgacctcgggatgtccaaggagccgggagtggtgtcaccgaccagttacctggacgtcgacctgcaccccgcgagcgcgtggaccctctacgctgtggccacgaccgtgatcacccccatgttacggcacaccatcgagaactccacggcgaacgtcagcctagcagccatcgccaatcaagccgtggtgctcatggggctggacaaggggtggccgatctcgaaaatggacctgggtgtcccccttcttgcgctgggatgctacagccaagtgaaccccctcaccctgaccgcagcagtgctgctcctcgtcacccactacgccatcattggccccggcctgcaggccaaagcgacgcgcgaggcccagaagcggaccgccgccgggataatgaagaacccaacggttgacggcatcatgaccattgacctcgaccccgtgatttatgactccaagtttgagaagcagttagggcaggtcatgctgctcgttctgtgcgcagtgcagctgctcttgatgagaacgagctgggcgctgtgcgaggccctcacactggccaccggtcctatcaccacattatgggagggctcccccgggaagttctggaacaccaccatcgccgtcagcatggcgaatatcttccggggctcgtacttagccggcgccggcctggccttctctatcatgaaaagcgtgggcaccggccgccggggcacggggagccagggcgaaacccttggggagaagtggaagaagaagctcaaccagctgtcgcggaaggagttcgacctgtataagaaatccggaattaccgaggtggaccggaccgaggccaaggaaggactcaagcgcggcgagactacgcaccacgcggtcagccggggatccgccaaactgcagtggttcgtggagcgcaacatggtaatcccggaggggcgcgttatcgacctgggctgcggacggggagggtggagctactactgtgcgggactcaagaaagtaaccgaagtgcgcggctacaccaagggcgggcccgggcatgaggagcccgtccccatgtccacctacggctggaacatcgtgaagctgatgagtgggaaggacgtcttctacctgccgcccgagaaatgcgacacgctgctctgcgacatcggagagtcctctccctcccccaccgtcgaggagagccggaccatccgcgtgctcaagatggtggagccgtggctgaagaataaccaattctgtatcaaggtcctcaacccctatatgcccaccgtgatcgagcacctggagcggttacaacggaaatacggcgggatgttagtgcggaatcccctgtcccgcaactcgacgcacgagatgtactggatatccaacggaacagggaacatcgttagctccgtaaatatggtgtcccggctgctgttaaacaggttcaccatgacccaccggcgcccgacgatcgagaaggacgtcgatctgggcgccggcacccggcatgtgaacgccgaacccgagacccccaacatggacgtcatcggcgagcgcatcaagaggatcaaagaggagcactccagcacttggcactacgacgacgagaacccgtacaagacctgggcgtaccacggctcctacgaggtcaaggccacagggagcgcctcatccatgatcaacggcgtggtaaagctcctgaccaagccctgggacgtggtgcctatggtcacccagatggccatgacggacaccacccccttcggacagcaacgcgtgttcaaagagaaggtggatacaaggaccccgcgccccatgcccggcacccggaaggttatggagatcaccgctgagtggctgtggcgcaccctcggccgcaataagaagccacggctgtgcacgagggaagagtttaccaaaaaggtgcggaccaacgcggccatgggggccgtgttcaccgaggagaaccaatgggatagcgcccgcgcggccgtcgaggacgaggagttttggaaactggtggaccgggagcgcgaactccataaactgggcaagtgcggctcctgcgtgtacaatatgatgggcaagcgcgagaagaagctgggcgaatttggaaaggccaagggcagccgcgcgatctggtacatgtggctcggtgcccggtacctggagttcgaggcgctgggcttcctcaacgaggatcactggttttcccgcgaaaacagctactccggggtcgagggtgaggggctgcataaactgggctacatcctgcgggacatcagcaagataccaggcggggccatgtatgccgacgacactgctggctgggacacgcgcatcacagaggacgacctgcacaacgaggagaagatcacccagcagatggatccggagcaccggcagctggccaacgcgatctttaagctgacgtaccagaacaaggtcgtgaaggtacagcgccccacgcccaaggggaccgtgatggacatcatcagccggaaggaccagcgcggctcgggccaggtgggcacctatggcctgaacaccttcacgaacatggaggcgcagctagtccggcaaatggagggggagggcgtgctctccaaagccgacctggagaacccgcaccttcttgagaagaaaataacccagtggctggaaaccaagggtgtggagcgcctgaagcgcatggccataagcggcgacgattgcgtcgtgaagcctatcgacgaccgcttcgccaacgcgctcctggcgctgaacgacatggggaaggtgcggaaggacatcccacagtggcagccctccaaggggtggcacgattggcagcaggtcccgttctgcagccaccacttccatgagctcatcatgaaagacggacgcaagctggtggtgccctgccgccctcaggacgagctgattgggcgggcccgcatctcgcagggcgccgggtggtctctaaaggagaccgcttgcctgggcaaggcgtatgcccaaatgtggtcgctgatgtacttccatcggcgcgatctccggctggccagcaacgctatctgctccgcggtccccgtgcactggatcccgacgagccgcaccacgtggagcatccacgcccaccaccagtggatgaccacggaggacatgctgaccgtgtggaaccgggtctggatcgaggacaacccctggatggaggacaagacccccgtgaccacgtgggaagatgtgccctacctaggcaagagagaggaccagtggtgcggctccttaatcggcctgaccagcagggcaacatgggctcagaacatcctaaccgctatccagcaggtcagatccctgatcggggacgaggagttcctggattacatgccgagcatgaagcggttcaggaaggaggaagagtccgagggcgcaatttggtga

SEQ ID NO: 26110 - RNA, 9873 nt, synthetic construct
  misc_feature 1..9873: note = derived and/or modified CDS sequence (opt11) from DENV-3__EU660410__SS-prME
  source 1..9873: mol_type = other RNA
acgtcactatgcctcatgatgatgttaccggcgacgctagcttttcacctaacgagccgtgacggggaaccaagaatgatagtgggcaaaaatgaacgagggaaatcactactctttaaaacggcttcaggcatcaacatgtgcacgctaatagcgatggatctcggcgaaatgtgcgacgatacggtcacctacaagtgccccctgatcgcagaagtagaacccgaagatatagactgctggtgtaacctcacttcgacttgggtaacatatggtacgtgcaaccaagcgggcgaacaccgaagagacaaacgctccgtggccctagctcctcacgtcgggatggggctcgacacccgtacacaaacttggatgagcgcagaaggggcatggaggcaggtcgaaaaggtagaaacatgggccctgcggcatcccggcttcactattttggcactattcctggcgcactatattgggactagcttaacacaaaaggtcgtaattttcatactcctcatgctagtcaccccctctatgactatgcggtgtgtgggggtcggaaaccgagacttcgtcgaagggttaagcggggcgacatgggtagacgtggtactagaacatggcggttgcgtcacaacgatggcacgcaataagccaactctagacatagaactccagaaaacggaagcgacacaattggcaaccctaaggaaactgtgtatagaaggcaaaataactaacataaccactgacagcagatgccccacgcaaggagaagcaatcttgcccgaagaacaagaccaaaattatgtatgtaagcatacatacgtcgacagggggtggggaaacggctgtggactcttcggaaaagggagcctggtaacgtgcgccaagttccaatgcctagaaccaattgaaggcaaggttgtacaatatgaaaatctaaagtacacggtcataataaccgtacatacaggcgatcaacaccaagtaggaaacgacacccaaggagtgaccgtggaaatcactccgcaggcgtcaaccgtggaagccgtgctgcctgaatacggtaccctaggcctcgagtgcagccccaggaccggcctagacttcaacgaaatgatcctattgacgatgaagaacaaggcttggatggtacaccgacagtggttcttcgacctcccactcccgtggacgtcgggggccacaacagaaacgccgacctggaatcgaaaagagctactggtcacgttcaaaaacgcgcatgccaagaaacaagaggtcgtagttttgggctcccaagagggagccatgcacaccgcccttacgggagcaaccgaaatccaaaatagcggagggacgagcatcttcgctggccacttgaaatgcaggttaaaaatggacaagctagagcttaaaggcatgagctatgctatgtgtctcaatactttcgtgctcaagaaagaagtctcagagacacagcacggaacgatactgatcaaagtagagtacaaaggcgaggatgcaccctgcaaaatccctttcagcaccgaagacggccaagggaaggcacataatggaagactaattacagctaaccccgtagtcactaagaaagaggagcctgtaaacatcgaagctgagccacccttcggcgagagcaacatagtcatagggattggggacaaggccctgaagatcaattggtacaagaaggggtcgtccatagggaaaatgttcgaagctaccgcaagaggcgcacgccgtatggccatactaggggatacggcgtgggacttcggaagcgtagggggtgtcttaaactcactaggaaaaatggtacaccaaatattcgggtccgcatacacggcattatttagcggggtgtcctggatcatgaaaatcgggataggtgtcctcctcacatggatagggctcaacagcaagaacacaagtatgagcttctcgtgtatcgtcattggaatcataacattatatctgggggccgtagtacaagcagacatgggatgcgccatcaactggaaaggaaaagaactaaaatgcggtagtgggattttcgtaaccaacgaggtacacacatggacagagcaatacaaattccaggcggattctccaaagcgcctcgcaaccgccatcgcaggagcctgggagaacggcgtgtgcggcatacgatcaacgacccgtatggagaacctgctatggaaacaaatagcaaacgagctgaactacatactgtgggaaaacaacataaaattgacagtagtggtcggagacataataggcgtactcgagcaaggaaagcggaccctgacaccacaacccatggaactcaagtacagctggaaaacctggggcaaggcaaagatagtgacggcggaaacacaaaattcctccttcattatcgatggccccaacaccccggaatgtcccagcgcaagcagggcctggaacgtctgggaagtagaagactacggtttcggtgtgtttacgactaacatctggctcaaattacgcgaggtgtatacgcagagctgcgaccacaggcttatgagcgcagccatcaaagacgaacgggctgtccacgcggacatgggatactggattgaatcacaaaagaacggtagctggaaattggaaaaggcgtccttcatagaagtcaaaacatgcacgtggccaaaatcacataccctctggtccaacggcgtcttagagtcggatatgattatccctaagagtctggcggggccaatcagtcagcacaaccacagaccaggttatcacacacagacggcaggaccctggcacctcgggaagctggagctggacttcaattactgtgaaggtaccaccgtcgttattacggagaactgcggcacacggggacccagtctgaggaccacgacagtgagcggcaagctaatccacgaatggtgttgccgatcatgcacactaccaccgctccgctacatgggggaagacggatgttggtacggcatggaaatccgccccataaatgagaaggaagaaaacatggtgaaatcgctggttagcgcaggatcgggaaaagtcgataacttcaccatgggagtactatgcctggccatcctttttgaagaagtaatgagaggaaagttcgggaaaaagcacatgatcgccggtgtgttattcacatttgtactacttctgagcgggcagataacgtggcgagatatggcgcacaccttcataatgataggaagtaacgcgagcgacaggatgggcatgggagtgacatacctagccctcatagcaaccttcaagatacaaccattcctcgctttgggattcttcttaagaaaactcacgtcacgcgaaaatcttttattaggagtagggctcgcaatggcaaccacgctacaactcccggaagatatcgaacaaatggcaaacgggatcgcactgggtctgatgacactaaagctcatcacacagttcgaaacgtaccaactctggacggcgttagtatcgctgacctgctctaacacaatttttaccctaacggtagcctggagaaccgcgaccctagtactagcaggcgtcagcctactccctctctgccagtcctcatcgatgcggaaaaccgattggctgcctatgaccgttgccgcaatgggagtaccgccactccctttgttcattttcagcctaaaggacacaccaaaaagaagaagctggcccctgaatgaaggcgtaatggcagtaggtctcgtatcgatactcgcatcatcgctactacgcaacgacgtcccaatggccggacccctagtcgcagggggcctactcatcgcatgctacgtcatcaccgggacatccgcagatctcacggtggagaaagcagcagacgtcacctgggaagaggaggcagaacaaacgggagtcagccacaatctaatgatcacggtggacgacgatgggacaatgcgcataaaagacgacgagaccgagaacatcctcactgtcctactaaagaccgccctccttatagtctcggggatattcccatactctataccagccaccctcctagtatggcacacatggcagaaacagacacagagaagcggggttctctgggacgtgccctccccaccagagacacagaaagccgaactggaagaaggcgtatataggatcaaacaacaaggaatattcggaaaaacgcaggtaggcgtgggcgtccaaaaagaaggcgttttccacactatgtggcacgtaactagaggcgcagtactgacccacaacggcaaaaggctcgaaccaaattgggccagtgtaaagaaagaccttatatcatacgggggaggctggcgactctccgcccagtggcagaagggcgaggaggtacaggtcatcgctgttgagccgggaaagaaccccaaaaatttccagacaatgcctggcatattccaaacaaccaccggggagataggtgcgatagcgctagatttcaaacccggtaccagcgggtccccaatcatcaaccgagaagggaaggtcgtaggcctctatgggaacggcgtagtaactaagaacggtggctatgtgtcagggatcgcgcagacgaacgcggaacccgacggaccaacaccggaactagaggaagaaatgtttaagaagcgcaacctgacaataatggacctccaccctggatccggaaaaacacggaagtaccttccagcaatcgttcgagaagccataaagcgacgcctgaggaccttgatcctagctccaacgagagtggtcgcagcagaaatggaagaagcactgaaaggactacccatcaggtaccaaaccaccgcaacaaaaagcgagcatacaggtcgcgaaatcgtggacctaatgtgccatgcgacgttcaccatgagactgctatcacccgtccgtgtacccaactataacctcataataatggatgaggctcatttcactgatccggcgagcatagccgcacggggatacatttccacacgagtcggaatgggcgaggcggcggcgatttttatgactgccacacccccaggaacggccgaggcctttccacaaagcaacgcgcccatacaagacgaggaacgcgacataccggagcgcagctggaactcaggaaacgagtggattactgacttcgtgggtaagaccgtttggtttgtaccaagtataaaggcggggaatgacatcgcgaactgcctccgtaaaaatggcaagaaagttatacaattgtcacggaaaacatttgataccgagtaccaaaagactcggctaaacgactgggactttgttgtgacgacagacatcagtgaaatgggggcgaacttcaaggcagaccgagtaatagaccccagaaggtgcttaaagcctgtaatactgacagacgggccggagagagttatcctcgcaggaccgatgccagttacagcggcatcggcagcacagaggagagggcgcgtaggaagaaacccccaaaaggaaaacgatcaatacatattcacagggcagcccttaaacaacgacgaggatcatgcccactggacagaagccaaaatgctattggataacattaatacacccgagggaattattccggcgctatttgaaccggagagagaaaagagcgccgccatagacggggaataccgacttaagggagaaagccgaaaaacctttgtagagctgatgcggagaggcgatctccccgtatggctggcacataaagtagcgagcgagggcatcaagtatacagaccgtaaatggtgcttcgatggagagcgcaacaatcaaatcttagaagaaaacatggacgtcgaaatatggacgaaagagggggaacggaagaaactacggccccgctggctggatgccaggacgtacagtgacccgctggcgttaaaagagttcaaggacttcgccgccggtagaaaaagcatcgcgctggacctcgtcacagaaattggacgagttcccagccatcttgcctaccgaaccagaaatgcgctggacaatctcgtaatgctccacacatccgaacacggaggacgagcgtaccgccacgctgtggaagagttgccggaaacgatggaaacattactcttactaggcctaatgatactgctcacaggaggggcaatgttgttcctaataagcggcaaggggatcgggaaaacatccatagggctgatctgtgtcatcgtcagtagcggaatgctgtggatggcagacgtccctctccaatggatcgcaagtgcaatagtcctagagttctttatgatggtacttctcatcccagaaccagaaaagcagaggacgccacaagacaaccagttggcctacgtcgtaatcgggatcctgacacttgcagcaatagtagcggcgaacgagatgggcttgctcgagaccaccaaacgagacttaggcatgagtaaagaaccgggcgtcgtcagcccgaccagttacctagacgtggacttacacccagcctcagcctggacactatacgcagttgcaactacagtaatcacgccaatgcttcggcacaccatcgagaacagcacggcaaacgtctcgctggcggccatagccaaccaggccgtagtgttgatgggcctagataaaggatggccgatttccaaaatggacctcggggcgcccctcctggcccttgggtgttattcacaggtcaatcccttgaccctgacagcggctgtacttctactcgtgacgcactatgccataattggaccgggcctacaggcgaaagcgacgagggaagcacagaaacgcacggcagcgggcataatgaagaacccaacggtagatggcattatgacaatagacttggaccccgtcatatacgacagtaaattcgaaaagcagttgggccaagtgatgctactcgtcttgtgcgcggtccaactactactgatgcgaaccagctgggccctgtgtgaggccctcacccttgcgaccggaccgataaccacgctatgggagggaagcccaggtaaattctggaacaccaccatagcagtcagtatggcaaatatcttcagagggtcatacctagcgggtgctggcctggccttcagcatcatgaaaagcgtcggcacaggaaggcggggcacaggttcacaaggggaaactctgggagagaaatggaagaagaaactcaaccaactgtcaagaaaggagttcgacctctacaaaaagagcggaataacggaagttgataggacagaagcaaaagagggcttgaaacggggagagacgacacaccacgccgtcagtagaggcagcgcgaaacttcaatggttcgtggagcgcaatatggtaatcccagaagggcgtgtaatcgacctgggttgtggacggggtggatggtcttactattgtgccggcttaaagaaagtaacagaagtcagaggctacacgaaagggggccccggccacgaggaaccagtcccgatgtcaacatatgggtggaacatagttaagctcatgagcggaaaggacgtgttttacttaccgcctgaaaagtgcgatacactcctctgcgacatcggagagagctcgccctcacctacagtagaagaaagccggacgatccgggtccttaaaatggtcgagccgtggctcaaaaataaccaattctgcatcaaagtgctcaatccgtacatgccgacggtcatcgagcacctcgaacgactacaacggaaatacgggggcatgctcgtgagaaatcccctgagcagaaactccacacatgaaatgtattggattagcaacggaaccggcaacatcgtaagttccgtgaacatggtgagccgtctcttactaaacagatttactatgactcataggcgacccactatagagaaagacgtggacctcggcgcaggtacgagacatgtaaacgcggaaccggagacaccgaacatggatgtcatcggagagcgcatcaagcggatcaaagaagaacacagcagtacatggcactacgacgacgaaaacccgtacaaaacatgggcgtaccacgggtcgtacgaagtcaaagcgaccgggagtgcgtcctcgatgatcaacggcgtggtaaaacttttaacaaagccgtgggacgtcgttccgatggtaacacagatggcaatgaccgacacgactccattcggacagcaacgcgtcttcaaggagaaagtggacacacggacgcctagacccatgcccggtaccagaaaggtaatggaaatcacagctgagtggctatggcgtacgctaggtcggaataagaaacctcggctatgcaccagagaagagttcaccaagaaagtaaggaccaacgctgcaatgggtgcggtgttcacagaagaaaaccaatgggactccgcgcgagctgcggtagaggacgaggagttctggaaattggttgaccgggagagggaattgcacaaactcgggaaatgcgggagttgcgtgtataatatgatgggaaagcgagaaaagaaacttggcgagttcggcaaagcaaagggctcgcgggcaatatggtacatgtggcttggagcgagatacctcgagttcgaagcgctcggatttctaaacgaagaccattggttcagcagagaaaattcgtactccggagtagagggagaaggccttcacaaactggggtacattttacgcgacatctccaaaatcccgggaggggccatgtatgcagacgacacagccggttgggacacaagaatcaccgaagacgacctacacaacgaagagaagataacccagcagatggaccccgagcaccggcaactcgccaacgccatatttaaactaacataccagaacaaagtagtcaaagtccagcgacctacaccgaagggcaccgtaatggacattataagtaggaaagatcaacgtggatcaggacaggtaggcacctatggactgaacactttcacaaacatggaggcgcaactcgtaagacaaatggagggtgaaggcgtgctctcgaaagcagacttagaaaacccacatcttttggagaagaaaatcacccaatggctagagacaaagggggttgagaggctgaaaagaatggcgattagcggggacgactgcgtagtcaaaccaatagatgaccgctttgccaacgcgctcctggccctgaacgacatggggaaggtacggaaagacataccacaatggcagccctcaaaaggctggcacgactggcaacaagtgccattttgtagtcaccactttcatgagctaatcatgaaagacgggcggaagctagtagtcccgtgccgacctcaagacgaattgatcggccgagcgagaataagtcaaggtgctgggtggtcgttaaaggaaaccgcctgcctagggaaggcctacgcccagatgtggagtctaatgtatttccaccgtcgtgatctacgactagcgtcaaacgcgatttgcagtgcggttccagtacactggatccccatcagccggaccacatggagcatccacgcgcaccaccaatggatgacgacggaagacatgcttaccgtatggaaccgcgtatggatagaagataatccttggatggaagacaagacaccggtcacaacgtgggaggacgtaccctatctgggaaaaagagaggatcagtggtgcgggtcattaataggcctcacaagccgagccacatgggcgcagaatattttaacagcgatccaacaggtacgtagtctgataggagacgaggagttccttgactatatgccatcgatgaaacgattccgtaaagaagaggaatccgagggcgccatctggtga

SEQ ID NO: 26111 - RNA, 9873 nt, synthetic construct
  misc_feature 1..9873: note = derived and/or modified CDS sequence (opt11) from DENV-3__EU660411__SS-prME
  source 1..9873: mol_type = other RNA
acaagcctttgcttgatgatgatgctgcccgcaaccctagccttccacttgacaagccgggacggggagccacggatgatcgtgggtaaaaatgaacgcggaaaaagcctgttgttcaagacagcgtccgggatcaacatgtgtaccctcatcgccatggacctgggcgagatgtgcgacgacaccgtgacgtataaatgccccctgatcgctgaggtggagccagaagatatcgattgctggtgcaatctcacaagtacctgggtgacctacgggacatgcaaccaggccggggagcaccggcgcgacaagcgaagtgtggccctggctccccatgtaggcatgggtcttgatacccgaacccagacctggatgtcagccgagggcgcgtggcgccaggttgagaaggtcgagacgtgggcgctgaggcaccctggtttcaccatccttgcgctcttcctcgcgcactatatcggcacatcattaacacagaaggtggttatctttatcctgctcatgctggtcacgcctagcatgaccatgcgatgcgtgggggtgggcaaccgcgacttcgtcgagggcctgtccggagccacctgggtggacgtggtcctagagcacggcgggtgcgtgaccactatggccaagaacaagcccaccctcgacattgagctgcaaaagacggaggccacccagctcgcgacgctgcggaagctgtgtatcgagggcaagattacaaacataaccaccgacagcaggtgccccacccagggagaggccatcctccctgaggagcaagaccagaactacgtttgcaagcacacctacgtggacagggggtggggcaacgggtgtggactgttcgggaagggcagtctggtgacgtgcgccaaatttcagtgcctcgagcccatcgagggtaaggtggtccagtacgagaacctgaagtacacggtgatcattacggtacataccggggaccaacaccaggtaggcaatgacacccagggggtgaccgtagaaatcacgccccaggccagcaccgtggaagctgtgctgcccgagtacggcacgcttgggctcgagtgctccccgaggaccgggctagactttaacgagatgattctactgaccatgaagaacaaagcgtggatggtccaccggcagtggttcttcgacctgcccctcccttggacttccggcgccaccaccgagactcccacttggaaccgcaaggaacttctagtgacctttaaaaacgctcacgccaagaagcaggaggtggtcgtactcggttcccaggagggcgccatgcacaccgcgctgaccggggcaacggaaatccagaacagcggcgggacctccatcttcgccggccacctgaagtgccggctcaagatggacaagctggaactgaagggtatgtcttacgcaatgtgtctcaacaccttcgtgctgaagaaagaggtctccgagacccagcacgggactatactgatcaaggtggagtataagggcgaagacgccccttgcaagatccccttcagcacagaggatgggcagggcaaagcgcacaacggtcgcctgatcacggccaacccggtggtgaccaagaaagaggaacccgtgaacatcgaggctgagccgccattcggggaaagcaacatcgtcatcgggattggtgataaggcgctcaagattaattggtacaaaaagggctccagcatcgggaagatgttcgaggcgacggctcgtggcgcccgccggatggccatcctgggcgacaccgcctgggattttggctccgttggcggggtgctgaactcgctcggcaagatggtgcaccagatcttcgggtccgcgtataccgccctcttcagcggcgtctcctggataatgaagattggcatcggggtgctgctcacctggatcggactgaacagcaagaacacgtccatgagcttttcctgcatcgtgatcgggatcataaccctctatctcggtgccgtcgtgcaggccgacatggggtgtgtgatcaactggaaaggaaaggagctgaagtgtgggagcgggatctttgttacgaacgaggtacatacctggacggagcagtacaaattccaagccgactcccccaagcgcctggcgacagccatcgccggcgcttgggagaatggagtgtgtggcatcaggagcaccacccggatggagaatctgctgtggaaacaaatagctaacgagctgaactacatactctgggaaaacaacatcaagctgacggtagtcgtgggtgacatcattggcgttctggagcaaggcaagcgcaccctcacgccccagccgatggagttgaaatactcctggaagacgtggggcaaggcgaagatcgtgacagccgaaacccagaactcttccttcatcatcgacggtcccaacacccccgagtgtccaagcgcctcccgggcctggaacgtctgggaggtagaggattacggcttcggtgttttcaccacgaacatctggctcaagctccgcgaagtgtatacccagagctgcgaccatcggctgatgagcgcggccatcaaggacgagcgcgccgtccacgccgacatgggctactggatcgagtcccagaagaacggtagctggaaactggaaaaggcttccttcattgaggtgaaaacctgcacctggcccaagagccacaccctatggagtaatggcgtgctggagagcgacatgataattcctaagtcgctggcgggacccatcagtcagcacaaccaccggccgggctaccacacgcagactgctggaccctggcacctcgggaagctcgagcttgacttcaactactgcgagggtaccaccgtcgtgattacggagaattgcgggacccgcggcccctctctacggactaccaccgtgtcggggaagttgatccatgagtggtgctgccgctcctgtaccctgcccccgctccggtacatgggcgaagacgggtgctggtacggcatggagatccgccccataaacgaaaaggaggagaacatggtcaaaagcctggtgtcggccggaagcgggaaggtggacaacttcaccatgggcgtcctgtgcctcgccatcttattcgaggaagtgatgcgggggaagttcggcaagaagcatatgatcgccggggtgcttttcaccttcgtactcctgctgtccggccagatcacgtggcgcgatatggcgcacaccctcatcatgataggcagcaacgcctccgaccggatgggaatgggcgtgacctacctggcgctgatcgctaccttcaagatccagcccttcctcgccctggggttcttcctgaggaagctcacgagccgggagaacttgctgttaggcgtcggtctggctatggccactaccctccagctccccgaggatatagagcagatggccaacggtatcgccctggggttaatgacactcaagctgatcacgcagttcgaaacctaccagctgtggaccgcgctcgtctctctgacatgttccaacacgatctttacactgaccgtggcctggcggaccgccaccctcatcctggccggtgtcagccttttgccgctctgccagtcctcttccatgagaaagaccgactggctcccaatgaccgttgctgcaatgggcgtgccgcccctgccgctctttatcttcagtctgaaggacaccccgaaacgccggtcctggcccctcaatgagggggtcatggcagtggggctggtaagcatcttggcttccagcctattgcgtaacgatgtccctatggccgggcctctggtggcaggcggcctcctgattgcatgctacgtgatcacggggacgtccgccgacctgaccgtcgagaaggccgccgacgtgacctgggaggaggaggccgagcagactggcgtaagccacaacctcatgatcactgtcgatgatgacgggaccatgcgcatcaaggacgacgagaccgagaatatcctaaccgtgctgctcaagaccgcgctgttgatagtgtccggcattttcccctacagcatccccgccactctcctggtctggcacacctggcaaaagcagacccagcggtccggtgtgctgtgggacgtaccctcgccgccggagacccagaaggccgagttggaggagggggtctaccgaatcaagcagcagggcatctttgggaagacccaagtgggcgtgggggttcagaaagagggcgttttccacaccatgtggcacgtgacccggggcgccgtcctgacgcacaacgggaagcgcctagagcccaactgggcctccgtaaaaaaagacctaatctcatacggcgggggctggaggctgtccgcgcaatggcagaaaggggaggaggtgcaggtcatcgccgtcgagcccggcaagaacccgaagaacttccaaaccatgcctgggatcttccagacaaccactggggagatcggcgcaatcgccctagactttaaacccggtacctcgggcagcccgatcatcaaccgcgagggcaagatcgtggggctgtacggcaatggtgtcgtgacaaagaatggcgggtacgtgtccggcatcgcgcagaccaacgccgagccagacggaccaaccccagaattggaggaggagatgttcaagaagcgaaacctgacgataatggacctgcaccccgggagcggcaagacgcgcaagtacttacccgccatcgtccgggaggccatcaagcgccggctgagaacccttatcctcgcccccacgcgggtggtggcggccgagatggaagaggctctgaagggtctgcccatcagataccagacaaccgccatcaagtccgagcacaccggacgggagattgtcgacctcatgtgccacgccacgttcacaatgcgcctgttgagcccggtgcgggtgcccaactacaacctcatcatcatggacgaggcgcacttcaccgacccggccagcatcgccgcacgcgggtacatcagcaccagagtcggcatgggcgaagccgcggccatcttcatgaccgccacgccaccgggtaccgccgaagcgttcccccagtccaatgcccccatccaggatgaggagcgcgacatcccggaaaggtcgtggaactccggcaacgaatggatcaccgactttgtaggcaaaacggtttggttcgttcccagcatcaaggccggcaacgacatcgccaactgcctgcgtaaaaacgggaagaaagtcatccagctgtctcgcaaaaccttcgacaccgagtaccagaagacccggctcaacgactgggacttcgtggtcacgacagacatcagcgagatgggcgccaacttcaaggctgatcgcgtgatagaccctcgacgctgcctaaagccagtgatcctcaccgacggaccagaacgggtcatcctagccgggccaatgcccgtgaccgccgcctccgccgcgcagagacggggccgcgtggggcggaatccgcagaaggaaaacgatcagtacatcttcacgggacagcccctgaataacgacgaggaccacgcccactggaccgaggccaagatgctgctagacaacatcaacaccccggaggggataatacctgccctgttcgagcccgagcgcgagaagtcagctgcgatagacggtgagtaccggctgaagggcgagtccagaaagaccttcgtcgagctcatgcggcgcggagacctgcccgtgtggctcgcccacaaggtcgcctcagagggaatcaagtacaccgacaggaagtggtgcttcgacggagaacgcaacaatcagatcctcgaagagaatatggacgttgagatttggactaaagagggagagcgcaagaagttgcgcccccgctggctggacgcccggacctattccgatcccctggcgctgaaggagttcaaggatttcgcggcgggccgcaaaagcatagccctggatctcgtgaccgagatagggcgggtccccagccacttggcctaccgcacccggaacgcgctggacaatctcgtgatgctgcatacaagcgagcacggcgggcgcgcctataggcacgccgtcgaggagctgccggagacgatggagaccctcctactgctcggattgatgatcctgctcaccgggggcgccatgctgtttctgattagcggtaaggggatcggcaagacgtccatcgggcttatctgcgtcatcgtgtcttcgggcatgctatggatggctgacgtgcccctgcagtggatcgccagcgcgatcgtcctggagtttttcatgatggtcctgctgatccccgagcccgagaagcaacgtaccccgcaggacaaccagttagcctacgtggtcatcgggatattgacgctggcagccatcgtggcggcgaacgagatgggcctcctggaaaccacgaagcgggacctgggcatgtccaaggagcccggggtagtgagccccaccagttacctcgacgtggatctgcaccccgccagcgcttggaccctgtacgccgtggcgaccacggtcatcaccccgatgctcaggcacaccatcgaaaactccaccgccaacgtgagcctggcagctatcgcgaatcaggctgtcgtcctgatgggcctagacaaggggtggccaatctccaagatggacctgggtgtgcccctgctcgccctggggtgctacagccaagtgaaccctctgacgctcactgccgccgtcctgctgctcgtcacccactacgcgatcatcggaccgggcctgcaggccaaggcgaccagggaggcacagaagagaacggccgccggaatcatgaagaaccccaccgttgacggcatcatgaccatagacctggaccccgtaatctacgactccaaattcgagaagcaattaggccaagttatgttgcttgtgctctgcgccgtccaactgctactcatgcggaccagctgggccctgtgcgaggccctgactctggccacgggcccaatcactaccctgtgggagggctccccgggtaagttctggaatacgaccatcgcggttagcatggccaacatatttcgcggatcctacctggccggggccggcctcgcgttcagcatcatgaagtcggtggggacaggccgtcgagggaccggaagtcagggcgagacgctgggggagaagtggaagaagaaacttaaccagctcagtaggaaggagttcgacttatacaagaagtctggaatcaccgaggtcgacagaaccgaggccaaggagggactgaaacggggtgagacgacccaccacgctgtgagtcgcggctccgccaagctccagtggttcgtggagaggaacatggtcatcccggaggggcgcgtcattgacttaggctgcggtcgcggtgggtggagctactactgcgcaggcctgaagaaagtgacggaggtccgtggctacaccaagggcgggcccgggcacgaggaacctgtgccaatgtctacctatggctggaacatcgtgaagctgatgtcggggaaggacgtcttctatctgccgccggaaaagtgcgacaccctgctgtgcgacatcggtgaatccagcccctccccgaccgtggaggagagcagaacaatccgtgtgctcaagatggttgagccctggctgaagaacaaccaattctgcattaaggttctgaatccctacatgcccaccgtgatcgagcacctcgaaagactgcagcgaaagtacggtgggatgctggtccgcaacccgctctccaggaactcgacccacgagatgtactggatctcgaacggtaccgggaacatcgtgagctccgtgaacatggtctcgcgcctgcttctcaaccgcttcacgatgacccaccgccggcccactatcgagaaggacgtggacctgggtgccggcacgagacacgtcaacgccgagcccgagactccgaacatggacgtgatcggggagcggataaagcgcatcaaggaggagcactcctccacctggcactacgatgacgagaacccctataagacctgggcgtaccacggctcctacgaggtcaaggccacggggagcgccagctctatgatcaacggcgtggtgaagctcctcactaagccatgggacgttgtccccatggtgacccagatggcgatgaccgacacgaccccgttcgggcaacagagggtgttcaaggagaaggtcgacacccgaacgccccggcctatgcccggcacacgcaaggtgatggagataaccgcagagtggctgtggaggactctgggtcgtaacaagaagccgcgcctctgcacccgggaggagttcacgaaaaaggtgcgcaccaatgccgccatgggggccgtcttcaccgaggaaaaccagtgggactctgcgcgggccgccgtggaggacgaggagttctggaagcttgtggatcgcgagcgggagctacataaactcggcaagtgcgggtcgtgcgtctacaacatgatgggcaaacgcgagaagaagttgggtgagttcggcaaggcgaagggcagccgggcgatctggtacatgtggctgggggccagatatctagaattcgaagccctcggcttccttaacgaggatcactggttctccagggagaacagctactccggggttgagggcgaggggctgcacaaactgggctacatcttgcgcgacatcagcaaaatacccggcggggccatgtacgccgacgacaccgcgggctgggacacgcgcataaccgaggacgaccttcataacgaggagaagatcacccagcagatggatccagagcatcgccagctggccaacgccatattcaagttaacttatcagaacaaagtggtaaaagttcagcggcccacaccgaaagggaccgtgatggacatcatctcccgcaaggaccagcggggcagcggccaagtggggacttacggactcaacactttcaccaacatggaggctcaactggtacgacagatggagggagagggcgtactgtccaaggccgacttagagaatccccatctcctggagaagaagattacgcaatggctcgagaccaaaggggtcgagaggctgaagcgaatggccatctcgggcgacgactgtgtggtgaagcccatagacgatcggttcgcgaacgcactgttggccctgaacgatatgggcaaggtccgcaaggacatcccccagtggcaaccgtccaaggggtggcatgactggcagcaggtgcccttttgtagccaccactttcacgagctcatcatgaaggacggcagaaagttagtggtcccctgccgcccccaggatgagctgatcgggcgcgcccgaataagtcagggcgcggggtggagcctcaaagaaaccgcctgcctcggcaaggcctacgcccaaatgtggtccttaatgtactttcatcgcagagatctgcgcctagccagcaacgcgatctgttccgccgttccggtgcactggatccccaccagccggacgacctggtctatccacgcccaccaccagtggatgaccactgaggacatgctgacggtctggaaccgcgtgtggatcgaagacaacccttggatggaggataagacccccgtgaccacatgggaggatgtcccctatctggggaagcgcgaggaccagtggtgtggctccctcatcggcctgacaagccgcgcaacctgggcgcagaacatactgacggcgatccagcaggtccgttccctgatcggggacgaggagtttctcgactacatgcccagcatgaagcgcttccggaaggaggaggagtccgagggcgccatctggtaa

SEQ ID NO: 26112 - RNA, 9873 nt, synthetic construct
  misc_feature 1..9873: note = derived and/or modified CDS sequence (opt11) from DENV-3__FJ432722__SS-prME
  source 1..9873: mol_type = other RNA
acctcactttgtctcatgatgatgctgcctgcgacactggccttccatctcaccagccgggacggcgagccgcgcatgatcgtgggcaagaacgagcggggcaagtctctgctgttcaagaccgcgtccgggatcaacatgtgcaccctcatcgccatggacctgggcgaaatgtgcgatgacaccgttacgtacaagtgccccctgatcgccgaagtagagcccgaggacatcgactgctggtgcaacctcaccagcacctgggtgacctacgggacttgcaaccaggccggcgagcaccggcgggacaaacggtccgtcgccctggcgccccacgtgggaatggggctggacacccgcacccagacctggatgagcgcggaaggtgcctggcgccaggtggagaaggttgaaacttgggccctgcgccacccgggcttcactatcctggcgctgttcctcgcccattacatcggcacctcccttacgcagaaggtggttatcttcattctgctcatgctggtgacgcccagcatgacgatgcggtgcgtgggggttggcaatcgcgacttcgtcgaaggactgtccggggccacctgggtggacgtggtcctcgagcacggcgggtgcgtgaccacgatggcgaagaacaagcccactctggacatcgaactgcagaaaaccgaggccacccagttggccacgctgcggaagctgtgcattgagggcaagatcaccaacatcaccacagacagccgctgccccacgcaaggagaggcaatcctcccggaagagcaggaccagaactacgtgtgtaagcacacctacgtcgatcggggctggggcaacgggtgcggcctcttcgggaagggctccctggtcacctgcgccaagttccagtgcctcgaacctatcgagggcaaggtggtccagtacgagaacttaaagtacactgtgatcatcacggtgcacaccggggatcagcaccaggttggaaacgacacccaaggggtgaccgtagaaattacgccccaggcaagcaccgtcgaggcggtgctgcccgaatacgggacactcggcctggagtgctcaccgcgcacaggcctagatttcaacgaaatgatcctcctgacgatgaagaacaaagcgtggatggttcaccgacagtggtttttcgatttacccctcccctggacgagcggcgcgaccaccgagacccccacgtggaaccgcaaggagctgctggtgaccttcaagaacgcccacgccaagaagcaggaggtggtcgtgctcgggtcccaggagggagcgatgcacaccgcgctgaccggggccacggagatccagaacagcggcgggacctccatcttcgccggccacctcaagtgtcggctcaagatggacaagctagagctgaagggtatgagctacgccatgtgtctcaacaccttcgtgctgaagaaggaggtcagtgagacccaacacggcacgatacttatcaaggttgagtacaagggcgaggacgccccgtgcaagatccccttcagcaccgaggacgggcagggcaaggctcacaacggccgcctgataaccgccaatcccgtggtcaccaagaaagaggagcctgtgaacatcgaggccgaaccgcccttcggggagagcaacatagtgatcggcataggggacaaagccctcaagatcaactggtacaagaagggctcgtcaatcgggaagatgttcgaggcgacggccaggggcgcccggcggatggctatcctgggcgacactgcctgggactttgggtccgtcggcggggttcttaacagcctcggcaagatggtgcaccagatcttcggttccgcttataccgccctgttcagtggcgtcagttggatcatgaagatcggcatcggcgtactgctcacctggataggcctgaactccaagaacacgagcatgtccttttcgtgcatcgtaatagggattatcaccctgtatctcggcgccgtcgtgcaggccgatatggggtgcgtgatcaactggaagggcaaggagctgaagtgcggcagcgggattttcgttaccaacgaggtgcacacctggacggagcagtacaaattccaggccgattcacccaagcgcttagcgaccgccatcgccggcgcctgggaaaacggagtgtgcgggatccgcagcacgaccagaatggagaacctcctgtggaaacagatcgccaatgagctgaactacatcctctgggagaacaacatcaagctaacggtcgtggtaggtgacatcatcggcgtcttggagcaaggtaagcgcaccctcacgccccagccgatggagctgaagtactcctggaaaacctggggcaaggcgaagatcgtgactgccgagacccagaatagctcgttcataatcgatggccccaacacacccgagtgcccctctgcctctcgggcctggaacgtgtgggaggtcgaggactacgggttcggcgtgttcacaacgaacatttggctgaagctccgcgaggtgtatacacagagctgcgaccaccggctgatgagcgcggccatcaaagacgagcgtgccgtccacgcggatatgggctactggatcgaatcccagaaaaacggtagctggaagctggagaaggcgtccttcatcgaggtgaagacctgcacctggcccaagtcccacaccctatggtcaaatggcgtgctggagagcgacatgatcatccccaaatccctggcggggcccatcagccagcacaaccaccggccgggctaccacacgcagaccgccgggccctggcacctcggcaagctggagctcgatttcaactactgcgagggcactaccgtcgtgataacggagaactgcgggacccggggaccttctttgcggaccaccacggtgagcgggaagctgatccacgaatggtgctgccgctcctgcactctaccgccgcttcggtacatgggcgaagacgggtgctggtacggcatggagatacgccccattaacgagaaggaggagaacatggtcaagagcctggtgtccgccggctcggggaaggtggacaactttaccatgggggtactgtgtctcgccatcctgtttgaagaggtgatgcgggggaagttcggcaagaagcacatgatcgccggggtgctgttcaccttcgtcctcctcttgtccggtcagatcacatggcgtgacatggcgcacactctcatcatgatcggcagcaacgcctccgaccgtatggggatgggagtgacatacctggcactgatcgctaccttcaagatccaaccctttctcgccctggggttcttcctgcgcaagctcacaagccgggaaaacctgctgctcggcgtgggcctggccatggccaccaccctgcagcttcccgaagacatagaacaaatggccaatgggatcgccctgggcctgatgaccctcaagctgatcacgcagttcgagacctaccagctgtggacggcgctcgtcagcctgacatgctcgaatacgatcttcaccctgacagtggcatggcgcaccgctacactgatactggccggtgtcagcctgctcccgctgtgccagtccagctccatgcggaagaccgactggcttcccatgaccgtggccgctatgggcgtgccgcccctgccgttatttatcttcagtctgaaggatacccccaagcgccgctcctggcccctcaacgagggggtaatggccgtgggcctggtaagcatcttagcctccagcctcctgcgaaatgacgtccccatggccggcccgctggtagcaggtggcctcctgatagcgtgctacgtgatcacggggacaagcgccgaccttaccgtcgagaaagccgccgacgtaacctgggaggaggaggccgagcagacgggcgtgagccacaacctcatgatcaccgtcgacgacgacgggaccatgcgcatcaaagacgacgagaccgagaacatcctgactgtactgctgaagacggcgctgctgatcgtgtcaggaatcttcccctacagcatccccgccaccctcctggtctggcatacctggcagaagcagacccagcggtcgggtgttctgtgggacgtgccatcgccgccggagacgcagaaggctgagctcgaggagggcgtataccgcatcaagcagcagggcatctttgggaagacccaggtaggggtgggggtccagaaggagggcgtgttccataccatgtggcacgtcacccgcggcgcggtcttaactcacaacgggaaaaggctggagcccaactgggcctccgtgaaaaaggacctcatcagctacggcggcggctggcgtctgtccgcgcagtggcagaagggcgaggaggtgcaggtcattgccgtggagcccggcaagaacccgaagaacttccagaccatgcccggcatcttccagaccaccacgggggagatcggcgccatcgccctggacttcaagcccggtaccagcggcagtccgatcatcaaccgcgaaggcaaggtggtcgggttatacggcaatggggtggtgaccaaaaatggcggctacgttagcggcatcgcgcaaacaaacgcggagcccgacggcccgacgcccgagctggaggaggagatgttcaaaaagcggaacctgaccatcatggacctgcacccggggagcggcaagacccgaaaatacctccccgccatcgtgcgggaggccattaagcgacggctgcggaccctgatcctagcgcccactcgggtggtagcggccgagatggaggaggcgctgaaagggctccccatccgctaccagacaacagccaccaagagtgagcacacgggccgcgagatcgtggacctcatgtgccacgccaccttcacaatgcgcctgctgagcccggtgcgggtccccaactacaacctcatcattatggacgaggcgcacttcaccgaccccgcctccatcgccgcccgcgggtacataagcacgcgggtgggcatgggcgaggccgcggccatctttatgaccgccactccgccaggaaccgcagaagcgttcccccagtccaacgctccgatccaggacgaggagagggacatccccgagcgcagctggaactccggcaacgagtggataaccgacttcgtggggaagaccgtctggttcgtgccgagcatcaaggccggtaacgacattgccaactgcctgcggaagaacgggaagaaggtgatccaactgtccaggaagacctttgataccgagtaccagaagactaaactcaatgactgggatttcgttgttacaacagacatcagcgagatgggcgccaactttaaggcggaccgggtgattgacccccgcaggtgtctgaaaccggtcatcttaaccgacgggcccgagcgcgtgatcttggccgggccgatgcccgtgaccgccgcctccgccgcccagcgacgcggccgggtcgggcgcaacccccagaaggagaatgaccaatacatcttcactggccagcccctgaacaacgacgaggaccacgcgcattggaccgaggccaagatgctgctcgacaacatcaacacccctgaagggatcatccccgccctgtttgagcctgaacgggagaaatccgcagcgatcgatggggagtacaggctgaagggcgaatcccggaaaaccttcgtggagctgatgcgccgaggggacctgcccgtttggctggcccacaaggtggccagcgagggcatcaaatacacggaccgaaagtggtgcttcgatggggaacggaacaaccagatcctcgaagaaaacatggacgtcgagatctggaccaaggagggcgagcgcaagaagctgcggccgcgctggctggacgcccgcacctactccgaccctctcgctttaaaggagttcaaggacttcgccgcaggtcgcaagagcatcgccctggacctcgtcaccgagatcgggcgcgtaccctcccatttggcctaccggacgcgcaacgcgctggacaatttggtgatgctgcacaccagcgagcacggcgggcgagcttaccgccatgccgtcgaggagctgccggagaccatggagaccctcttgctgctcggcctgatgattctgctcaccggcggggccatgctgttcctgatcagtgggaaggggatcggcaagacctccatcggtctcatctgcgtgatcgtgagctccggcatgctgtggatggccgacgtccccctgcagtggatcgccagcgccatcgtgctcgagttctttatgatggtgctattgatccccgagccggaaaagcagcggaccccgcaggacaaccagctcgcctacgtcgtgatcgggatcctgaccctggctgccatcgtggcggccaacgagatgggcctcctggagacaaccaagcgcgatctggggatgtccaaggagcccggcgtcgtgagccccacgtcctacctcgacgtggacctgcatcccgcgtcagcctggaccctgtacgccgtcgcgacgaccgttatcacccctatgttaaggcacaccatcgagaactccacggctaacgttagcctggccgctatcgcgaaccaggccgtcgtgctgatgggcctcgacaaggggtggcctatcagtaagatggacctgggcgttccgctgctcgctctggggtgttacagccaggtcaaccccctgaccttaacggccgccgtgctgctcctagtgacccactacgcgatcatcggccccggcttacaggccaaggccacccgtgaggcccagaagcggacagccgcggggatcatgaagaaccccaccgtcgacggaatcatgaccatcgacttggacccagtgatctacgacagtaagttcgagaagcagctcggacaggttatgctgctggtcctctgtgcggtgcaactgctgctcatgcgcacgagctgggccctgtgcgaggccttgaccctcgcaaccggccccatcaccacgctgtgggagggctcccccgggaagttctggaacacaaccattgcggtgagcatggcgaacatattccgaggctcctacctggccggggctggcctcgcgttcagcatcatgaagtcagtcgggaccggccgcaggggcacggggagccaaggcgagaccctgggggaaaagtggaagaagaagctaaaccagctgtctcgcaaggagttcgacctttacaagaagagcgggatcactgaggtggatcggaccgaagccaaagaagggctcaagcgcggcgagaccacgcaccacgccgtgagccgtggcagcgccaagctccagtggttcgtcgagcggaacatggtgatccccgagggccgggtgatcgacctgggctgcgggcgcggtgggtggagctactactgcgccgggctgaaaaaggtcaccgaggtgcgcggctacaccaaaggtgggcctgggcacgaagagcccgtgcccatgtccacctatggctggaacatcgttaagctcatgtctgggaaggacgtgttctacttgccgcccgaaaagtgcgacacgctgctgtgcgacatcggtgagtcctcaccctctccgaccgtggaggagagccggaccatccgtgtcctcaagatggtggaaccctggctgaagaataaccaattctgcatcaaggtgcttaacccctacatgcccaccgtcatcgagcacctcgagcgcctgcagcggaagtacggcgggatgctggtgcggaatccgctcagtcgcaacagcacgcacgagatgtactggatttcaaacggcactgggaacatcgtgagctccgtaaacatggtgtcccggctgctgctcaaccgcttcaccatgacccaccggcgccccacgatcgagaaggacgtcgacctgggcgcgggcacgaggcatgtgaacgccgaacccgagaccccaaacatggatgtaatcggggagaggatcaagcggataaaggaggaacacagcagcacgtggcactacgatgacgagaacccctacaaaacgtgggcctaccacgggtcctacgaggttaaggccactgggagcgcctcgtccatgatcaacggtgtggtgaagctgctcaccaagccgtgggatgtcgtgcccatggtgacccagatggcgatgacggacaccaccccgttcggtcagcagcgcgtcttcaaggagaaggtggacacgcggacgccgagacctatgcctggcacccggaaggtgatggagattaccgccgagtggctgtggcgcaccctgggccggaacaagaagcctcgcctctgcacgcgcgaggagtttaccaagaaagtaagaaccaacgccgccatgggtgccgtgttcaccgaggagaaccaatgggacagcgcgcgcgctgccgtggaggacgaggagttctggaagttagtcgaccgtgagcgcgagctacacaaactcggcaagtgcgggtcttgcgtgtacaacatgatgggtaagcgcgagaagaagctgggggagttcggaaaggcaaagggcagccgcgcgatatggtacatgtggctgggggcccggtacctcgagttcgaagccctaggcttcctgaatgaggaccactggttctctcgcgaaaactcctactctggggtggagggcgaagggctccacaagctgggctacatcctgcgggacataagcaagatcccggggggggccatgtacgcggacgatacggcgggctgggacacccgcatcaccgaggacgacctccacaacgaggagaagatcacccaacagatggaccccgagcatcggcagctcgccaacgccatcttcaaactgacgtaccagaacaaggtcgtgaaggtacagcgcccaacccccaaagggacggtcatggatatcatctcccggaaggaccagcgcggctcaggccaggtggggacatacggcctcaataccttcacgaacatggaggcccagctggtccggcagatggaaggcgagggcgtcttatccaaagccgacttggagaatccccacctcctggagaagaagatcacccaatggttggagaccaagggggtggagcgcctgaagcggatggcgataagcggcgacgactgcgtggtcaaacccatcgacgatcgcttcgccaatgccctgctcgccctgaacgacatgggcaaggtgcgcaaggacatcccccagtggcagccgtctaagggctggcacgactggcagcaggttcccttctgcagccaccacttccacgagctgatcatgaaagacggccgtaaactcgttgtgccgtgccggccccaagacgagctgatcgggcgcgcacgaatctcccagggcgcggggtggagcctgaaggagaccgcctgcctcggcaaggcctacgcccagatgtggtctctgatgtacttccaccggcgcgacctgcggctcgcctccaacgcaatctgctccgccgtcccggtacattggatccccacaagccgcaccacgtggagtatccacgcccaccatcagtggatgaccacagaggacatgctgaccgtttggaaccgggtgtggattgaggacaacccatggatggaggacaagacccctgtaacaacgtgggaggacgttccgtacctgggaaagcgcgaggaccagtggtgcgggtctctcatcggactgaccagccgggccacgtgggctcagaacatcctcaccgccatacagcaggtccgatccctcataggggacgaggagttcctggactacatgcccagcatgaagcggtttcgcaaggaagaggagtccgagggcgtcatttggtga

SEQ ID NO: 26113 - RNA, 9873 nt, synthetic construct
  misc_feature 1..9873: note = derived and/or modified CDS sequence (opt11) from DENV-3__FJ432728__SS-prME
  source 1..9873: mol_type = other RNA
acctcactgtgcctcatgatgatgctgccagcgaccttagccttccacctcactagccgggacggcgagccgcgtatgatcgtggggaagaacgagaggggcaagagcctgctgttcaagactgcgtccggaatcaacatgtgtaccctcattgctatggacctgggcgagatgtgcgacgacaccgtaacgtacaaatgccccctgatcgccgaggtggagcccgaggacattgactgctggtgcaacctcaccagcacctgggtcacctatgggacttgcaaccaggccggcgagcatcggcgcgataagcggagtgtggcgctggcgccgcacgtgggcatggggctggacacccgcacccagacctggatgagcgccgagggcgcatggcgccaggtggagaaggtagagacgtgggccctccgccacccggggttcaccatcctggcacttttcctcgcccactacatcggcacctccctcacccaaaaggtggtgatcttcatcctgctcatgctggtgacgcccagcatgaccatgaggtgcgtgggcgttgggaaccgcgactttgtggagggcctctccggtgccacctgggtagacgtggtcctcgagcacggcgggtgcgtgaccactatggccaagaataagcccaccctcgacatcgaactgcagaagactgaggcgacccaactcgcgacgctgcggaagctgtgcatagaggggaaaatcaccaacatcaccaccgacagcaggtgccccacccagggcgaggccatcctaccagaggagcaagaccagaactacgtgtgcaagcacacttacgtggaccgggggtggggaaacgggtgcggcttgttcgggaagggctccctggtgacctgcgccaaattccaatgcctcgagcctatcgaaggcaaggttgtgcaatatgagaaccttaagtacaccgtgatcatcacggtgcacacaggggaccagcatcaagtcggcaacgacacccagggcgtgaccgtcgagatcacgccccaagcttcaaccgtagaagccgtgctgcctgagtacggcaccctcgggttggagtgctccccgcgcacaggcctggacttcaacgagatgatactgctgaccatgaagaacaaggcgtggatggtccaccgacagtggttcttcgaccttcccttaccctggacgtctggcgccaccaccgagacccccacgtggaaccgcaaggagctgctggtgaccttcaagaacgctcatgccaagaagcaggaggtggtggtgctcgggtcgcaagagggtgcaatgcacaccgcgctgaccggggccacggaaatccagaacagcggcgggactagtatcttcgccggccacctgaagtgccgactcaagatggacaagcttgaactgaaggggatgagctacgcgatgtgcctaaatacctttgtgctgaagaaggaggtatccgaaacccaacatgggacgatcctgatcaaggtggagtacaagggcgaggacgccccgtgtaagatccccttctcgaccgaggatgggcagggcaaagcgcacaacggacgcctgatcaccgcgaaccccgtggtcaccaaaaaggaggagcccgtgaacattgaggccgagccgcccttcggggagagcaacatcgttatcggcataggtgataaggccctcaagattaactggtataagaaggggtccagcatagggaagatgtttgaggcgacggcccggggcgcccgtcggatggccattcttggcgacaccgcctgggacttcgggtccgtcgggggtgtgctgaatagcctcggcaaaatggtgcatcaaatcttcgggagtgcgtacaccgccctgttctcgggcgtctcttggatcatgaagatcgggatcggggtgctgctcacctggatcggcctgaacagcaaaaacacatccatgagcttctcatgcatagttattggcatcatcaccctgtacctcggcgccgtcgtgcaggccgacatggggtgtgccatcaactggaagggcaaggaactgaagtgcggcagcggcatcttcgtgaccaacgaagtccacacgtggaccgagcagtacaagttccaagcggacagtcccaaacgcctggccaccgccatcgcaggcgcctgggaaaacggggtgtgcggcataagaagcaccacccggatggagaacttactttggaagcagatagcaaacgagctaaactacatcctatgggagaacaacatcaaactcacggtggtcgtgggggacatcattggcgtgctagagcagggcaagaggaccctcacccctcagcctatggaactgaagtactcctggaagacctgggggaaagccaagatcgtcacggccgagacacagaacagctccttcataatcgacggccccaacacccctgagtgccccagcgcatcgcgggcgtggaatgtctgggaggtagaggactacgggtttggcgtcttcaccacgaacatttggctgaaattacgcgaggtctacacccagagctgcgaccaccggctgatgagcgcagccatcaaggatgagcgcgccgtccacgccgacatgggctactggatagagtcccaaaagaacgggagctggaagctggagaaagcgtccttcatcgaagtcaagacctgcacctggcccaagtcccacaccctctggtccaacggagtgctggagagcgacatgatcatccccaagtccctggccggccccatctcccagcacaaccatcggccgggctaccacactcagaccgccgggccgtggcacctaggcaaactggaactggactttaattactgcgaaggcaccaccgttgtcatcacggaggactgcgggacgcgcggcccctcactccggaccaccacggtgagcggaaaactgatacacgagtggtgttgccgctcctgcactctacccccgctccggtacatgggtgaggacgggtgctggtacggcatggagatccgccccataaacgagaaggaagagaacatggtcaagagtctggtttcggccggcagcggcaaggtggacaatttcaccatgggtgtgctgtgcctcgccattctgtttgaggaggtcatgcgggggaagttcggcaagaagcacatgatcgctggggtgttgttcaccttcgtgctcttgctgtccggccagatcacgtggcgcgacatggcccacaccctcatcatgatcggcagcaacgcgagcgaccggatgggaatgggagtcacctacctggccctgatcgccaccttcaagatccaaccctttctcgcgctgggattctttctgaggaagctaacaagccgggagaacctgctgctgggcgtgggcctggctatggccaccacactgcagctccccgaagacatcgagcagatggccaacgggatagcgctgggcctgatgaccctaaagctgatcacgcagttcgagacctaccagctgtggaccgcgctcgtgagcctgacctgctccaacacgatcttcaccctgaccgttgcctggcgcaccgcgaccctcatcctggccggggtctcgctgctcccgctgtgccagtccagctccatgcgtaagaccgactggctgcccatgaccgtagcagcgatgggcgtgccgcccctgccgctgttcatcttcagcctgaaggacacccctaagcgccgtagctggcccctcaacgagggggttatggccgtcggcctggtaagcattttagcctctagcctcctgcggaacgatgtgcccatggcaggcccgctggtagccggggggctcctgatcgcctgctacgtgatcacggggacgtccgccgacctgaccgttgagaaggcagccgacgtcacatgggaggaggaggcggaacagacgggggtgagccacaatctcatgatcactgtggacgacgacggcacgatgcgcatcaaggacgacgaaaccgaaaacatcttaaccgtcctgctcaagacggccttgttaatcgtctccggcatcttcccctacagcatacccgccaccctcctggtgtggcatacctggcagaagcagacccagagatccggtgtcctctgggatgtgccctccccgcccgagacgcagaaggccgagctcgaggagggggtctatcgcatcaagcagcagggcatattcgggaaaacccaggtcggtgtgggggtacagaaggagggggtctttcacacgatgtggcacgtcaccagaggcgccgtgctgacgcacaacgggaagcgcctggagcctaactgggcgtccgtgaagaaggatctcatcagctacggcgggggctggcggctgtccgcacagtggcaaaagggcgaggaggtccaggtgatcgccgttgagcccggcaagaatccgaagaacttccagactatgcctggcatcttccaaaccaccacgggggagatcggcgctatcgcactggactttaagcccgggactagcggcagcccgatcatcaaccgcgagggcaaggttgttgggctgtacgggaacggtgtggtgaccaagaatggcgggtacgtgtccggcatcgcccagacgaacgccgaacccgacggccccacgcccgagctcgaggaggagatgtttaagaagagaaacctgaccatcatggatctgcacccggggagcgggaagacgcgcaaatacctccccgccatcgtccgggaggcaatcaagcgccgactgagaaccttaattctcgctccaacgcgagtggtcgccgccgagatggaagaggccctgaagggtctgcccatccgctaccagaccaccgccaccaagtccgagcacacgggccgggagatcgtcgacctcatgtgccacgcgacctttaccatgcgcctcctcagccctgtgcgggtgcccaactacaacctcataatcatggacgaggcccacttcaccgacccggcctccatcgcagcgcgcggctatatcagcacgcgcgtcggcatgggagaggcggccgccattttcatgaccgccacgccgccggggaccgcggaggccttcccacaatccaacgcccccatccaagatgaggagagggacatccccgagcgcagttggaactccggcaatgagtggatcacggactttgtgggcaaaaccgtctggttcgtacccagcatcaaggccgggaatgacatcgccaattgtctgcgcaagaacgggaagaaagtgattcagcttagtcgcaaaaccttcgacaccgagtaccagaaaacgcggctcaatgactgggacttcgtggtgaccaccgacatcagcgaaatgggcgcgaacttcaaggcggaccgcgtgatcgacccccggcgctgcctgaagcccgtgattctgaccgacgggcccgagagggtcatcctcgccgggccgatgcccgttacggccgcctccgcggcccagcgccggggcagagtagggcggaacccacagaaagaaaacgaccagtacatcttcaccggccagcccctgaacaacgacgaagaccacgcccactggaccgaggcaaagatgctgctcgacaatatcaacaccccggaagggatcatccccgccctgttcgagcccgagcgcgagaagtctgctgccatcgacggcgaataccggcttaagggcgagagccgcaagaccttcgtcgaactcatgcggcgcggggatctgcccgtgtggctagcccacaaggttgcgagcgagggcataaaatacacggaccggaagtggtgcttcgacggggagcgcaacaaccagatcctcgaagaaaacatggacgtggagatctggacgaaagagggcgagcgcaagaagctgcgtccgcggtggctggatgcgcggacctactccgacccgcttgccctcaaggagttcaaggatttcgccgccggccgcaagagcatcgctctggacctcgtgacggagatcggacgggtaccctcccacctggcgtatcggacacggaacgcgctggacaatttagtgatgctgcacacctccgagcacggcgggcgcgcctaccgtcatgccgtcgaggagctgccggagaccatggagaccctcctactgctcggactaatgatcctgttaaccggtggggccatgttgtttctgatctcggggaaggggatcggaaaaacctccatcgggctcatatgcgtcatagtcagctccggcatgttatggatggcggacgtgcccctgcagtggatcgccagcgccatcgtattagagtttttcatgatggtgctgctgatccccgagcccgagaaacagcgcaccccgcaggacaaccaactcgcctacgtggtcatcgggatcctgactctggccgcgatcgtggccgctaacgaaatgggcctcctggaaacgacgaagcgggatctgggcatgtccaaggaacccggggtagtcagcccaaccagctacctcgacgtggacctgcaccccgccagcgcatggaccctgtacgcggtggccacaacggttataaccccgatgctcaggcacaccatcgaaaactccactgccaacgtgagcctcgccgcgatagccaatcaggctgtggtccttatgggcctcgacaaggggtggcccatctccaagatggacctgggcgtgcccctgctagccctggggtgctacagccaggtgaacccccttaccttaaccgcagcggttctgctgctcgtgacccactacgccatcatcggcccgggcctccaggccaaagccacgcgggaagcccagaagagaaccgcggccgggatcatgaagaaccccacggtggacggtatcatgaccatcgacctggacccagtcatatacgatagcaagttcgagaagcaactcggccaggtaatgctgcttgtgctctgtgccgtccagctgctcctcatgcggacgagctgggccctgtgcgaggccctgactctcgcgaccggccccatcaccacgttgtgggagggctcccctggcaaattttggaacaccaccatcgccgtgagcatggccaatatcttccgcggatcctacttggccggggcggggctcgccttcagcatcatgaagtctgtggggacaggccggcgcggcaccgggagccagggcgagaccctgggtgaaaaatggaagaagaagctgaaccagctcagccggaaagagttcgacctgtacaagaagtctggcatcacggaggtcgacaggaccgaggccaaggagggtcttaagcggggcgagaccacgcaccacgccgtgagcagaggctccgcgaaactccagtggttcgtggagcggaacatggtcatccccgaagggcgagtgattgacttaggttgtgggcgcggagggtggtcctactactgcgcgggccttaaaaaagtcaccgaggtccggggctacaccaagggaggcccagggcatgaggagcccgttccgatgtccacctacggctggaacctggttaagctgatgagcgggaaggacgtcttctacctgccgccggagaagtgcgacactctactatgcgacatcggcgagtctagcccatccccgaccgtggaggagagcagaaccatccgggtgctgaagatggtcgagccctggctgaagaacaaccagttctgcatcaaggtgctcaacccctacatgcccaccgtgatagagcatctggagcgcttgcagcggaagtacggcggcatgctcgtccgcaacccgctgtcccgaaactccacgcacgagatgtactggatatccaacggcaccgggaatatcgttagctcggtgaacatggtttcgcgcttactcctgaaccggttcactatgacccatcgccggcccacgatagagaaggacgtggatctgggcgctggcacccgccacgtaaacgccgagcccgagaccccgaacatggacgtgatcggggagcggatcaagcgcataaaggaggagcacagcagcacttggcactacgacgacgaaaacccctacaagacgtgggcgtaccacggctcctacgaggtgaaggcgaccgggagcgcgagctctatgatcaacggcgtggtgaagctcctgaccaagccttgggatgtggtccccatggtgacccagatggccatgacagacaccaccccgtttggacagcagcgagtgttcaaggagaaggtcgacacccgaacgcccagacccatgccgggcacgcgcaaggtgatggagatcaccgccgagtggctgtggcggacgctcggccgcaacaagaagccacgcttatgcacgcgggaggaattcaccaagaaggtgcgcactaacgccgctatgggggctgtctttacggaggagaatcaatgggactctgcccgcgccgccgtggaggacgaggagttctggaagcttgtcgaccgcgaacgcgagctccacaaactaggcaagtgcggatcctgcgtctataacatgatgggcaagcgcgaaaagaagctgggggaatttggcaaggcgaagggaagccgtgccatctggtacatgtggctgggggcccgctacttggagttcgaagcacttggcttcctcaacgaagaccactggttctcccgggagaacagctactccggggtcgagggtgaggggctgcacaaactgggctacatcctccgcgacatctcgaagatacccggcggggccatgtacgcggacgacacggccggctgggacacccgtatcaccgaggacgacctgcacaatgaggagaagatcacacaacaaatggatccggagcaccgccaactggcaaacgctatcttcaagctcacgtatcagaacaaagttgtcaaggtgcagcggcccaccccgaaggggaccgttatggacatcatctcacggaaggaccagcggggcagcggccaggtagggacatacggcttaaacaccttcactaacatggaggcccagctggtgcgccagatggagggagagggagtgctctccaaggcggacctggagaacccgcacctcctcgagaagaagatcacacagtggctggagaccaagggcgtggagcggcttaaacgcatggcaataagcggcgacgactgcgtggtgaagccgatcgatgaccgatttgctaacgccctcctggcattaaacgatatgggcaaggtccgcaaggacataccccagtggcagccatccaaagggtggcacgactggcaacaggtccccttctgcagccaccacttccacgagctcatcatgaaggacggccggaagttggtggtgccctgccggccccaggacgagctgatcgggcgggcgcggatctcccagggcgctgggtggagcctcaaggagaccgcctgcctgggcaaggcatacgcccagatgtggtccctgatgtacttccaccgccgggacctccggctggcgagcaacgccatctgctccgccgtgccggtgcactggatccccaccagccggaccacttggagcatccacgcccaccaccagtggatgacgacggaagacatgctgaccgtttggaatcgcgtgtggatcgaggacaacccctggatggaggacaagaccccggtgacgacgtgggaggacgtcccatacttggggaaaagggaggaccagtggtgcggatcccttatcggtctgaccagccgcgcgacctgggcccagaatatactcaccgccatacaacaggtccgctccttgatcggagacgaggagttcctggattacatgcccagcatgaagcgcttcaggaaggaggaggagtccgagggggccatctggtga

SEQ ID NO: 26114 - RNA, 9873 nt, synthetic construct
  misc_feature 1..9873: note = derived and/or modified CDS sequence (opt11) from DENV-3__FJ432731__SS-prME
  source 1..9873: mol_type = other RNA
acgagcttatgcctcatgatgatgctcccagccaccctggccttccacctgacaagccgggacggggagccgcggatgattgtggggaagaacgagcgcggcaagagcttattattcaagaccgcttccggcatcaacatgtgcaccttgatcgctatggacctgggcgagatgtgcgatgacactgtgacgtataagtgccctctgatcgccgaggtggagccagaggacatagactgctggtgcaacctcacctccacctgggtaacttacggtacgtgcaaccaagccggcgaacaccggcgcgataagcggtccgtcgcccttgcgccccatgtgggcatgggattagacacccgcacccagacatggatgagcgccgagggggcctggagacaggtggagaaggtcgagacctgggccttacgccacccggggttcaccatcctggcgcttttcctcgcgcactacatcggcacctctctgacccagaaagtggtgatcttcatcctactgatgctggttacccccagcatgaccatgcggtgcgtaggggtgggcaaccgggacttcgtggaaggcttgtccggggcgacctgggtggacgtggttcttgagcatggcggctgtgtgaccacgatggccaaaaacaagcctaccctggacatagagctccaaaagaccgaggcaacacaactcgcgacgctgcgaaagctgtgcatcgagggcaagattacaaacattactactgacagccgctgcccgacgcagggagaggccatcctcccggaggagcaggaccaaaactacgtgtgcaagcacacctacgtcgaccgggggtggggaaacggctgcggcctgttcgggaaaggctccctggttacgtgcgccaagttccaatgcctcgagcccatcgagggcaaggtggtacagtatgagaacctgaaatacaccgtgatcatcacggtacacaccggggaccagcaccaggtcggcaatgatacccagggggtgaccgtcgagataactcctcaggccagcacagtggaagctgtgctgcctgagtacggcaccctcgggctagagtgctccccgcgcaccggcctggactttaatgagatgatcctacttaccatgaagaacaaagcgtggatggtccaccgacaatggttcttcgatcttcctctcccctggacgagcggcgccacgaccgaaacccccacgtggaaccgaaaagagctgctcgtgacatttaaaaacgcccacgcgaagaagcaggaggtggtcgtgctcggatcccaggagggcgccatgcacaccgctcttacgggtgcaactgagattcaaaacagcggcggtacatccatcttcgcgggccacctgaaatgccgtctcaagatggacaagctggagctgaagggcatgtcctacgcaatgtgcttgaacacgttcgtgttaaagaaggaggtctccgagactcagcatgggacgatcctgataaaggttgagtacaaaggcgaggacgccccttgcaagatccccttcagcacggaagatgggcagggcaaggcgcacaacggcaggttgatcaccgcaaacccagtagtcaccaagaaggaggaacccgtcaacatcgaggccgagccgccctttggcgagagtaacatcgtgattggcatcggggacaaggccctcaagataaactggtacaagaaaggttcctcaattgggaaaatgttcgaagcgacggcccggggcgcgcgtcgcatggcgatcctgggagataccgcttgggacttcgggtccgttggcggggttctgaacagcctcggtaagatggtgcaccagatcttcgggtccgcctacaccgctttgtttagcggcgtgtcgtggatcatgaagattgggattggggtgctgctcacctggataggtctgaacagcaagaacacatccatgtcattctcctgcatagtcatagggatcatcaccctgtacctcggcgccgtcgttcaggcggatatggggtgcgccatcaactggaagggcaaggagctgaagtgcgggtctgggattttcgtcaccaacgaggtacacacctggacagaacaatacaaatttcaggcggactctccgaaacgcctggccaccgccatcgccggcgcctgggagaatggggtatgcggcatcaggagcaccacccgtatggagaacttgctgtggaagcagattgccaacgagctgaattacatcctctgggagaataacatcaagctaaccgtggtcgtaggggacatcatcggagtgctggagcagggcaagcgcaccctcacgccgcagccgatggagttgaaatactcttggaagacctgggggaaggccaagatcgtcaccgccgagacccagaacagctcattcatcatcgacggccccaacacccccgagtgtccctcagcctcgcgggcgtggaacgtgtgggaggtagaggactatgggttcggcgtcttcactacgaacatctggctaaaactccgtgaagtgtacacccaaagctgcgatcaccggctgatgagcgccgccatcaaggacgagagggccgtccacgcggacatgggctactggatcgagtcccaaaagaacgggagctggaagctggaaaaggcgtccttcatcgaggtaaagacttgcacttggccaaagagccacacgttgtggtccaacggagtgctggagagcgacatgatcatacccaagtccctggctggccccatcagccagcacaatcaccggccgggctaccacacacagaccgctgggccctggcacctcggcaagctggaactggacttcaactactgcgagggcaccacggtggtgataacggaaaactgcggtacgcgcggcccctccctccgcaccacgacagtaagcggaaagctgatccacgagtggtgctgccgttcatgtacgttgcccccgctccggtacatgggcgaggatggttgttggtatggcatggagattcgccccataaacgagaaggaggagaacatggttaaaagccttgtctccgcgggcagcgggaaggtggacaacttcaccatgggagtgctctgcctcgcaattctgtttgaggaagtcatgcgggggaagttcgggaagaagcatatgatcgcgggggtgttgttcatgttcgtactccttctgtccggtcagatcacctggcgcgatatggcccaaacgctcataatgatcggcagcaacgcctcagaccggatgggaatgggagtcacttacctggcgctaatcgccaccttcaagatccagcccttcctcgcgctggggttcttcctgaggaagctcaccagccgggagaacctgctgctcggcgtcggcctggccatgaccaccacactgcagttgccagaggacatcgagcagatggccaacgggatagccctgggcctaatgacgcttaagctgatcacacaatttgagacctatcagctgtggaccgcgctggtcagcttaacctgctccaacacgatcttcaccctgacggtcgcttggcgcaccgcaacgttaattctggccggcgtgagtctgctcccactatgccagtccagctccatgcggaagaccgattggctgccaatgaccgtagccgcgatgggcgtgccgccactgccgttattcatcttctcactgaaggatacccccaagcgccgctcgtggcccctcaacgagggggtcatggccgtgggcttggtgagcatcctggcgtccagcctccttcggaacgacgtaccgatggctggcccgctggtggccggtggactattaattgcgtgctacgtgatcacgggaacctccgccgacctgaccgttgagaaggccgccgacgtcacctgggaggaagaagccgagcagaccggagtgagccataacctcatgattacagtggatgatgacggaaccatgcgcatcaaagacgacgagaccgagaacatcttaaccgtcctgctcaagacggcactgctgatagtttccggcatcttcccctacagcatcccggccacccttttagtctggcacacttggcaaaaacagacgcagagaagcggcgtcctgtgggacgtgcccagtccgcccgagacgcaaaaggccgagctcgaggaaggggtgtaccgcatcaagcaacaggggatcttcgggaagacgcaggttggcgtcggggtgcagaaagagggcgtattccacaccatgtggcacgtgactcgtggagctgtgctgactcacaatgggaagcgcctggaacctaactgggcctcagtcaaaaaggatttaatatcgtatgggggtggctggcggctgtccgcgcagtggcagaagggggaggaggtccaagtaatcgcggttgaacccgggaagaaccccaaaaatttccaaaccatgcctggcatcttccagacgacaacgggggaaataggcgcaatcgccctagacttcaagcccggcacctctggcagccctataatcaaccgcgaaggcaaggtagtggggctctacggcaatggtgtggtcaccaagaacggcggttacgtgtccggaatagcgcagaccaacgccgaaccggacggacccacgcccgagctggaggaggagatgttcaagaagcggaatcttaccataatggacctgcacccgggttcgggcaaaacccgtaagtacctacccgccatagtccgggaggcgattaagcgacggctgcggactctgatcctcgcccccacccgggtagtagctgccgaaatggaagaggccctgaagggcttgcccataaggtaccagaccactgccactaaaagtgaacatactggtcgggagatcgtggacttaatgtgccatgccaccttcacgatgcgtctgctgagtcccgtgcgggtacctaactacaacttgatcatcatggacgaggcgcatttcacagaccctgcctcgatcgccgcccgagggtacatcagcacccgggtcggaatgggtgaggctgcggcaatcttcatgactgcaaccccgcccgggacagcagaggcgttcccccaatccaatgccccaatccaggacgaagaacgcgacatcccagagcgcagctggaactcaggtaacgagtggatcacggacttcgtagggaaaaccgtgtggttcgtcccgagcattaaggctggcaacgatatcgctaattgcctgcgtaagaacggcaagaaggtaatccagctgtcccggaaaaccttcgacaccgagtaccagaagacccggctcaacgactgggacttcgtagtcaccaccgacatctcagagatgggcgccaacttcaaggcggatcgcgtcatcgacccacggcgctgccttaagccagtgatcctgaccgacggccccgagcgcgtaatcctagccggcccgatgcccgtgacggctgccagcgccgctcagcgccggggccgtgtggggcgcaaccctcagaaggaaaacgaccaatacatctttaccggtcagcccctgaataacgatgaggatcacgcccactggaccgaggccaaaatgctgctagacaacatcaacacccccgaggggatcatccctgccctgttcgagcccgagcgcgagaagtccgctgcgatagacggtgaatataggctgaagggcgagtcccgaaagacttttgtcgagcttatgcgacgtggagatctgccggtgtggctggctcataaggtcgcctcagagggtatcaaatacacggatcggaaatggtgcttcgacggagagaggaacaatcagatcctagaggagaacatggatgtggagatctggaccaaggagggcgagcgcaagaaacttcgtccgcgctggctggacgcacggacctactccgacccgctcgctctgaaggagttcaaggacttcgccgctggccgcaagagcatcgcgctggaccttgtgaccgagatcggtagagtcccatcccatctcgcctaccgcaccagaaacgctctggacaacctcgttatgttgcataccagcgagcacggaggtcgtgcctatcgccacgctgtagaggaactgcctgaaaccatggagaccttgctcttactcggcctgatgattctgctcaccggcggggcaatgctgttcctgatcagcgggaaggggatcgggaagacgtccattgggctcatctgcgtcatcgtctcgtccggcatgctgtggatggccgacgtccccctacagtggatcgcgtctgctattatccttgagtttttcatgatggtcctgcttatccccgagcccgagaagcagaggaccccgcaggacaaccagctcgcctacgtcgtcataggaatactgaccctggccgccatcgtcgcggccaacgagatgggcctcctggagacaacaaagagggatttggggatgtccaaggagcctggggttgtatcaccaacgtcctacctcgacgtcgacctgcaccccgcgagcgcttggaccctgtacgccgttgcgactacggtaatcaccccgatgctccgccacacaatagagaactccactgccaatgtcagcctggccgccatcgccaaccaggccgtggtgctaatgggcctcgacaaaggatggcccatatcgaagatggacctcggcgtcccattactcgctctggggtgctacagccaggtgaaccctctgaccctcaccgccgccgtgctgctcttagtcacccactacgcaataatcggcccgggcctgcaggccaaggccactcgcgaggcgcagaagcgcacggcggcggggatcatgaagaaccccaccgtcgacggcataatgaccatcgacctggacccggtgatctatgactccaaattcgagaagcagctcggacaggtaatgttacttgtgctctgcgccgtccagttgctcctgatgcggacgagttgggctctgtgcgaagccctgaccctggccaccggcccaattacgacgctgtgggaaggcagtccggggaagttctggaacacaacgatagcggtctcgatggcaaatatcttccgcggctcttatctagccggggccggcctcgcgttcagcataatgaagtcggttggaaccgggcggcgcggcacggggagccagggcgagacactgggtgagaagtggaagaagaagttaaatcagcttagccgtaaggagttcgatctatacaagaaatccggcatcaccgaggtggaccggactgaggcaaaggagggtctgaaaaggggcgagaccacgcaccacgcagtcagccgcggctccgccaagctccaatggttcgtggagcgtaacatggtgatccccgaagggcgcgtgatcgacctggggtgcgggaggggcgggtggtcctactactgtgcaggcctcaaaaaggtgaccgaggtgcggggctatactaaaggcggtcccggccatgaggaacccgtcccgatgtccacttatggctggaacctagtgaaacttatgtcggggaaggacgtgttctacctgccaccggagaagtgcgacactttgctgtgcgacatcggcgagtccagcccgtctccaaccgtcgaggaaagcaggaccattcgagtgctgaagatggtggagccctggctgaaaaacaaccagttctgtatcaaagtcctaaacccgtatatgccaaccgtgatcgagcacctggagcgcttacaaaggaagtacggaggtatgttagtgcgcaacccgcttagtcggaacagcacgcacgagatgtactggatatccaacggaaccggcaacatagtctcgtccgtaaacatggtaagccggctcttacttaaccgcttcacaatgacgcacagacgacccacgatcgaaaaggacgtcgacctgggagcgggaacccgacacgtgaacgcagagcccgagaccccaaacatggacgtgatcggggagcggatcaaacgcatcaaggaggaacattcctccacctggcactacgacgatgaaaacccctataaaacgtgggcctaccatggctcctatgaggttaaggccacagggtccgccagctccatgataaacggtgtggtgaagctcctgactaagccctgggacgtggtgcccatggtcacgcagatggcaatgacggacaccaccccgtttggacaacagcgggtgttcaaggagaaggtggatacgcgcacgccccggccgatgcccggcacacgcaaagtaatggagatcacggccgaatggctgtggaggaccctcgggcgcaacaaaaagccgcgcctttgtacgcgggaggagttcaccaaaaaggtgcgcaccaatgcagcgatgggggccgtgttcaccgaggagaaccagtgggattccgcgcgggcggcagtcgaggacgaggagttttggaagctggtggaccgagagcgggagctccacaagctgggaaagtgcggatcctgcgtgtacaacatgatgggcaagcgcgagaagaagctgggtgagtttggcaaggcgaaaggcagccgggcgatctggtacatgtggcttggggcccgctacctggaatttgaggcccttggcttcctcaacgaggaccactggttttcccgggagaactcttacagtggagtcgagggtgagggtctgcacaagctgggctacattctccgcgatatctctaagatccccggtggggctatgtacgccgacgacacggcgggctgggacactcgcatcacggaagacgacctgcataacgaggaaaagataacacaacagatggatcccgaacaccgccagctggccaacgccatctttaagctcacgtatcagaacaaggtagtgaaagtccagcggcccaccccaaagggtacagtaatggatataatctcacgcaaggaccagcggggttcaggccaggtgggaacctacggcctgaacactttcacaaatatggaagcccagctggtgcgccagatggagggggagggcgtgctctccaaggccgacctcgagaaccctcacctcctcgaaaagaagatcacccagtggctggagaccaagggggttgagcggctgaagcgaatggcgatcagtggcgacgactgtgttgtaaagccaatcgatgaccgtttcgccaacgccctcctggcgctgaacgacatgggcaaggtgcgcaaggatataccgcagtggcagccgagtaagggatggcacgactggcaacaggtcccgttctgcagccaccatttccacgagctcatcatgaaggacggcaggaaactggtcgtcccctgccgtccccaagacgagctaataggacgcgcacggatttcgcagggcgcggggtggagcctcaaggagactgcctgtctcgggaaagcctatgctcaaatgtggtccctcatgtacttccaccgccgggaccttagactggctagcaacgcgatttgctccgccgtcccggtgcactggatccctacctctcgtacgacctggagcatccacgctcatcaccagtggatgaccacagaagacatgcttacggtgtggaaccgcgtctggatcgaagacaacccctggatggaggacaagactcccgtgaccacgtgggaagacgtgccgtatttaggcaaacgggaggaccagtggtgtgggtccctcatcggcctgaccagccgcgccacctgggcgcagaacatattaacggctatccagcaggtccgttctctgatcggggacgaggagtttctggattacatgccatctatgaagcgcttccgaaaagaggaggagtccgagggggccatctggtag

SEQ ID NO: 26115 - RNA, 9873 nt, synthetic construct
  misc_feature 1..9873: note = derived and/or modified CDS sequence (opt11) from DENV-3__FJ562097__SS-prME
  source 1..9873: mol_type = other RNA
acctccctatgcctgatgatgatgctcccagctacgctggcattccacctgactagccgagacggggaacctcgtatgattgtaggcaaaaacgaacgcgggaaaagtcttttattcaaaacagcctccggcataaatatgtgcacactaatagccatggaccttggggaaatgtgtgatgacacggtcacatacaaatgccctcttatcgcagaagtggaaccagaagacatcgattgctggtgcaatcttactagcacatgggtaacatatgggacatgtaaccaagctggggaacaccgccgagacaaacggtcagtagcactcgcaccgcatgtcggcatgggcctagacactcggacacaaacatggatgagcgctgaaggagcatggaggcaagtcgaaaaagtggagacctgggcgctccggcaccccggattcacgatcctcgccttattcctcgcccattatataggtacgtctttgacgcaaaaagtcgtgatattcatcctactaatgctggtaacacccagcatgaccatgaggtgcgtgggcgtcggcaacagagacttcgtcgaaggcctcagcggagcaacctgggtcgatgtggtgctagaacacggagggtgcgttacaacaatggccaaaaacaaaccgaccttggatatcgaacttcagaaaaccgaggccacgcaactagcaaccctacgaaaactgtgcatagagggtaaaatcacaaacataacaaccgactcgcgatgccccacgcaaggcgaagcgatattacccgaagaacaagatcaaaactacgtctgcaaacatacatatgtggaccgaggctgggggaacggctgcggcctctttggcaaagggtcactggtaacctgcgctaaatttcaatgccttgaaccaatcgaaggaaaagtagtccagtacgaaaatctaaaatacacggtgatcataaccgtccacacaggagatcagcaccaagttgggaacgacacgcaaggagtgacagttgagattacccctcaagcaagcaccgtagaagcagtactgccagaatacggaaccctaggccttgaatgctcaccacgcacaggactcgacttcaacgaaatgatactgctcacaatgaagaacaaagcatggatggtgcatcgacaatggttcttcgacctacccttaccctggaccagcggtgcgactaccgaaacgccaacgtggaatcgtaaagaattactcgtcacattcaagaacgcgcacgccaagaaacaggaagtcgtcgtgctaggcagccaagaaggggccatgcacaccgcattaacaggtgccacagaaatccagaatagcgggggtacatcaatcttcgcggggcatcttaagtgtcgtctcaagatggacaagctagagttgaagggcatgagctacgcgatgtgtttaaacaccttcgtgctaaagaaagaagtgtctgagactcagcacggtaccatactaattaaggttgagtacaaaggagaagacgccccctgcaaaatacccttttccacagaagacgggcagggaaaagcacacaacgggaggcttataacagccaacccagtggtcaccaagaaggaagaaccagtaaatatcgaggccgaaccccctttcggcgaaagcaatatagtcatcggcatcggcgacaaagctctcaaaataaactggtataagaaaggatcatccataggaaagatgttcgaggcaacggcaagaggtgcgcgccgcatggccatactcggagacacggcatgggacttcgggtctgtcggaggagtactgaacagcctcggtaaaatggtccaccaaatattcggaagcgcctacacggcactgttttccggagtaagttggatcatgaaaataggtattggagtcttgcttacctggatcggcttaaacagcaagaacaccagcatgagcttctcgtgcattgtgataggtattataaccctgtacctcggcgccgtcgttcaggccgacatgggctgcgtcatcaactggaagggtaaagaactcaaatgcggaagtggaatcttcgtcacgaacgaagtccacacatggaccgaacagtacaaattccaagcagacagccccaaacgcttagccaccgcaatcgcgggagcctgggagaatggagtctgcggaatccgctccacaacacgcatggaaaacctgttatggaaacagatcgcgaacgaactcaactacatcctctgggagaacaacataaagttaactgtagttgtgggcgacataatcggagtcctagaacaagggaaacgaactctaacaccccagcccatggaactgaagtactcctggaaaacctggggcaaagccaaaatcgttactgcagaaacccaaaattccagcttcataatcgacgggccgaacactccagagtgcccctccgcgagtcgtgcgtggaacgtctgggaagtcgaagactacggcttcggggtgttcacaacgaatatatggttgaaactgagagaagtctacacgcaatcctgcgaccaccgtctgatgtcagcagctatcaaggatgagagagccgtacatgcagatatggggtactggatagagtcacagaagaacggctcatggaaactcgagaaggcctcattcatagaagtgaagacatgcacgtggccgaaatcccataccctttggtccaatggcgtactggagagcgacatgattatcccaaagagcctcgcgggccccattagccaacacaatcaccgaccaggttaccacacgcagacagcgggaccgtggcatctcggcaagctggagttagatttcaactactgcgagggcaccacagtggtgattacggaaaactgcggaacgcgaggcccgtcgcttcgtaccaccacggtgtccggtaaactaatacacgaatggtgctgccgaagctgcacgctcccacccctccggtacatgggtgaagatggatgttggtacggcatggaaatacggcccattaacgaaaaagaagagaacatggtaaaaagtttagtcagcgccggttccggcaaggtagacaatttcacaatgggggtcctatgtctcgcgatcctattcgaggaagtaatgcgaggcaagtttgggaagaaacacatgatagcgggagtgctgtttacgttcgtcctcctcttatctgggcagattacctggcgcgacatggcgcacacgctcataatgattgggagcaacgcaagtgaccgcatgggaatgggcgtaacctacctggcgttaattgctacattcaaaatccagcccttcctggcacttggattcttcctgcgtaagctgacatcacgcgagaatctactactaggcgtgggcctggcaatggcggcgacactacagttaccggaagacatagaacagatggcgaacggcattgccctaggcctaatgaccctaaaattgatcacgcaattcgagacctatcagctctggaccgctctcgtcagcttgacatgctcgaacaccatctttaccctcaccgtggcatggcgcaccgcgacactgatcctcgcgggggtaagcctactccctctctgccaatcgagtagcatgcgcaaaaccgactggcttcccatgactgtcgccgcaatgggggtgccaccactaccgctattcatattcagtcttaaagatacacctaaacgacgaagctggccattgaacgaaggtgtaatggccgtcggcctagtgagcattcttgcatcgagcctactgagaaacgatgtcccgatggctggaccattagtagcaggaggtctcctcatcgcctgctacgtgataacggggacctcggcagacctcaccgtagaaaaggctgccgatgtaacgtgggaagaggaggcggaacaaacaggcgtaagtcacaacctaatgatcacggtcgacgacgacggcacaatgcgcatcaaagacgacgagacggaaaacatactaacggtcttactcaaaacggctcttttaattgtgtcaggcgttttcccatactcaatccccgccaccctgctcgtgtggcatacctggcaaaaacagacacagcgatccggggtgctatgggatgtgccatccccgcccgaaactcaaaaagcagaactagaagagggcgtctacagaattaagcaacagggaattttcggcaagacgcaagtaggagtcggggttcagaaagaaggcgtattccacacaatgtggcacgtgacgagaggggcggtactcacacacaacggaaaaagacttgaacccaactgggcgagcgtaaagaaagacctgatctcctacggaggaggatggaggttatctgctcaatggcaaaaaggggaagaggtgcaggtaatcgcagtggagccagggaaaaatcccaagaacttccaaacaatgcccggtatattccagacaaccacgggagaaataggcgcgatagccctggacttcaaaccggggacaagcgggagcccaataataaaccgtgaagggaaggtagtgggcttgtacggaaatggcgtcgttactaaaaatggcggttacgtcagcgggatcgcacagaccaatgccgaaccagatggacccacaccggaactcgaggaggaaatgttcaagaaaaggaatctgaccatcatggacctgcaccccggcagcgggaaaaccagaaaatacctccccgccatagtccgggaagcaataaagcgtcgactgcgcacactcatactagccccaacgagagtggtagctgcagaaatggaagaagccctcaaaggcctacccataagataccaaaccaccgccacaaaaagtgaacacaccggccgcgagatcgtcgatctgatgtgtcacgccactttcaccatgcgtttgctctcgcccgtgcgagtcccaaattacaacctcataataatggacgaagcccacttcacagaccccgcgagtatagccgcgaggggatatatctcgacaagggtaggcatgggcgaggcggctgccatcttcatgaccgccaccccacccggcacggcagaggccttcccccaaagcaacgcccccatacaagacgaggaacgcgacatcccagaacggagctggaatagtggaaacgaatggataactgatttcgtgggaaagacagtttggttcgtgccctctataaaagctggaaacgacatagctaattgccttcggaaaaacggaaagaaggtgatccagctctcacggaaaacattcgatacggagtaccagaagactaaactaaatgactgggatttcgtagttaccaccgacatcagcgaaatgggagcgaacttcaaagctgaccgcgtcatagacccacgccgatgtttgaaacccgtaatattaacggatggcccagagcgcgtgatactggccgggcccatgccagtcacagcagctagcgcagcccagaggaggggccgagtaggcaggaatccgcaaaaagaaaacgaccagtacattttcactggccagccattgaataacgatgaggaccacgcacactggacagaagcaaaaatgctccttgacaatataaacacccctgaaggcataatacccgccctctttgagccagaacgcgagaaaagcgcggcgatcgacggcgaatacagactaaaaggagaatcaagaaaaactttcgtcgagctcatgagacgaggcgatctaccggtctggctagcacacaaggttgcgagcgaagggatcaagtataccgacagaaagtggtgtttcgacggcgagagaaacaaccagatactggaagagaatatggatgtagaaatctggaccaaagagggagaacggaagaaactccgcccaagatggttggacgcgaggacctactctgatccgcttgcattaaaagaatttaaagacttcgcagcaggcaggaaatcaatcgcactagatctcgtaaccgagataggccgggtgccctcgcatctggcgtaccgaacaagaaacgccctggacaaccttgtcatgctccacacaagtgagcacgggggacgcgcctaccggcatgccgtcgaggaactacccgaaactatggaaacgctcctgctgctagggttgatgatacttctaacaggcggcgccatgctgttcctgatcagcggcaaaggaatcggcaagacgagcattggcttgatctgtgtcattgtctccagcggaatgctatggatggcggatgtcccactccagtggatcgcgtccgcaatcgttctagagttcttcatgatggtgctacttatcccagaacctgagaaacaacgaacaccgcaagacaatcagctcgcctatgtagtcataggcatcctgacactcgcagctattgtggccgcaaatgaaatggggctactcgagacaacaaaacgagacctgggaatgagcaaagaacccggggtcgtcagcccgactagctatctagatgttgacctacatccagccagcgcctggacactctatgccgtcgccactactgtcattacgcccatgctgcggcacacaatcgaaaattcaacggcaaatgtaagtttagccgcgatagcaaaccaagcagtcgtcctaatgggactcgataagggatggccaataagcaaaatggatctgggcgttcctctactcgcgctaggctgctactctcaggtgaacccactgaccctaacagctgccgtcttattactggtgacacattacgccataatcggccccggtctacaagcaaaggctacaagagaagcgcagaaaaggaccgcagcaggcatcatgaagaatcccactgtggacggcataatgaccatagaccttgacccagtgatctacgacagcaaattcgaaaaacagctaggacaggtaatgctactggtcctgtgcgccgtacaacttctcttaatgagaaccagctgggcgttatgcgaggcactcacactagcaacaggccctattaccaccctctgggaggggtctccgggtaagttttggaacacgaccatagctgtcagcatggccaatatattccggggatcctacttagcaggagcgggcctcgcattcagcatcatgaaaagcgtagggacgggccgtcgtggaaccggaagtcagggagaaacactgggggaaaagtggaagaagaaacttaaccaactcagccgaaaggagttcgacctctacaagaaaagcggcataacggaagtcgatcggacagaagcaaaggagggactcaagcgcggcgaaactacccaccacgccgtctcacgcggcagcgccaaattgcagtggtttgtagaacgtaatatggtgatcccagaaggccgggtaatcgatcttggatgtggcaggggcggctggtcctattattgcgcaggactaaagaaagttacggaggtcagagggtacacaaaaggagggccagggcatgaggaaccagtccccatgagcacgtatggctggaatattgtaaagttaatgtccggaaaagacgtgttctatttgcccccagaaaagtgcgacactttgctgtgcgacataggtgaatcctcaccctcacccacggtcgaagaatctcgcacgatacgagtcctcaagatggtcgaaccatggcttaaaaacaatcaattctgcataaaggtactaaacccctatatgccaaccgtaatagagcatctggagcgtctccaaagaaaatacgggggcatgctcgtccgaaatcctctctcgcggaacagcacccacgagatgtactggatctcaaacggaacaggcaacattgtttcaagcgtaaatatggtcagcaggctcttgctcaaccgtttcactatgacacaccggagacccacaatagagaaggacgtcgacctcggcgccgggacccgtcacgtaaacgccgaaccggaaacgccgaacatggacgtcatcggagaacgcataaagcggatcaaagaagaacactcctcaacctggcattacgacgacgaaaacccctacaaaacttgggcgtatcacggctcatacgaagtgaaagccacagggtcagcaagttctatgataaacggggtagtcaaactactcacgaaaccttgggatgtcgtccccatggtaacacaaatggccatgaccgacacaactccgttcggccagcaacgagtattcaaagaaaaagtagacactaggacaccacgtcctatgcccggaacgcgcaaggtaatggagattacagcagagtggttgtggaggacattaggaagaaataagaagccgcggctgtgcacaagagaagagttcactaagaaagtacgtaccaacgcagcaatgggcgctgtcttcacagaggaaaatcagtgggactcagcccgagccgcagtggaggacgaggagttctggaaactcgtagaccgagaacgggaacttcacaaactcggaaagtgcggatcatgtgtgtacaacatgatggggaaacgcgagaagaaacttggagaatttggaaaagctaaggggtctagagccatctggtacatgtggctcggggccagatacctagagttcgaagccctcggattcttaaatgaagaccactggtttagccgtgaaaatagctactcaggcgtagaaggcgagggcctgcacaaactcggctacatcctgagggacatctcgaagatacccggcggcgccatgtacgccgacgataccgcagggtgggacacaagaatcacagaggacgacttacacaacgaggagaaaataacacaacagatggacccagagcaccgccagttggcgaatgccatatttaagctgacttatcaaaacaaagtggtaaaggttcagagacccactccgaaaggcaccgtgatggatataataagccgcaaagatcaaagagggtcaggtcaagtgggtacttatgggctaaacacgttcactaacatggaggcacagttagtacgtcaaatggaaggcgagggagtccttagtaaagccgaccttgaaaatccacatctgctggagaagaaaataacgcagtggctcgaaacgaaaggtgtcgagcgcctaaagaggatggccatttccggcgacgactgcgtggtgaagccaatagatgaccggtttgcgaacgccttactagccctgaatgacatgggcaaagtgcgaaaggatatcccacagtggcaaccttcaaaagggtggcatgactggcagcaggtccctttttgctcccaccacttccatgagttgatcatgaaagatggtcggaagctagtcgttccatgtcgcccccaagatgagctgatcggtcgagcacgaatcagtcaaggcgccggctggtcgctcaaagaaacagcctgccttggaaaagcatacgcgcagatgtggagcctaatgtacttccaccgtcgcgatctccggctagccagtaacgcgatatgctcggcagtaccggtccattggataccgacttcaagaacgacctggtccattcatgcgcaccatcagtggatgacgactgaagatatgctgactgtatggaaccgagtctggattgaagacaacccatggatggaagataagacacccgtaacaacgtgggaggatgtaccatacctgggcaaacgagaagaccaatggtgcggaagcctgataggactcaccagccgagccacttgggcacaaaacatcttaacagccatacaacaagtacgatcgctcataggtgacgaagagttcctggactacatgccgtctatgaagcggttccgcaaggaggaggaaagcgagggggcaatttggtaa

SEQ ID NO: 26116 - RNA, 9873 nt, synthetic construct
  misc_feature 1..9873: note = derived and/or modified CDS sequence (opt11) from DENV-3__FJ432741__SS-prME
  source 1..9873: mol_type = other RNA
acctccttatgcctgatgatgatgctacccgcgaccttagcttttcacttgacgtcccgggatggggaaccgcggatgatcgttgggaagaacgagcgaggcaaaagcctgcttttcaaaaccgcgtccgggattaacatgtgcacgctcatcgcgatggacctgggcgagatgtgcgacgacaccgtgacgtataagtgccccctgatcgccgaggtggagcccgaagacatcgattgctggtgcaacctgacctctacctgggtgacctacgggacgtgcaaccaagccggtgaacaccgtcgcgacaagcggtccgtggcactggcgccccacgtgggtatggggttggacacccgcacccagacctggatgagcgccgagggggcctggcgccaggttgagaaggttgaaacgtgggcactccgccacccgggattcaccatcctggcgctgttcctggcgcactacataggcacgtccctgacgcagaaagtcgttattttcatcctgctcatgctggtcacgccctctatgaccatgcggtgtgtgggggtcggcaaccgcgacttcgtagagggcctctccggggccacgtgggtagacgtagtccttgagcacggcggttgcgtgacaacgatggctaaaaataagcccactctggatatagagctgcaaaagaccgaggccacacagctcgccacgctgcgaaaactatgcatagagggcaagatcacgaatataaccactgacagccgatgccccacgcagggcgaggccatcctaccggaagagcaggaccagaattacgtgtgcaagcatacttacgtggaccgggggtgggggaacggttgcggccttttcgggaagggctccctagtaacctgcgcaaaattccagtgcctcgaacccatcgaggggaaggtggtgcagtacgagaacctgaagtataccgtaatcataacggtgcacacaggcgaccaacaccaggtcggcaacgatacacagggggtgaccgtggagataaccccccaggccagcaccgtcgaggccgtattgcccgagtacggcaccctcggactggagtgctccccgcgcaccggtctggacttcaacgagatgatcttactcaccatgaaaaacaaggcgtggatggtccatcggcagtggttctttgacctgccactcccctggacgagcggcgccaccaccgagactcccacgtggaatagaaaggagttactggtgaccttcaaaaacgcccacgccaagaagcaggaggtggtagtgctcgggtctcaggagggagcgatgcacactgccctgaccggcgccacggagatacagaacagcggcgggacttctatctttgccggccacctgaaatgccgactcaagatggacaaattagagctgaagggcatgtcgtacgcaatgtgcctcaacaccttcgttctcaagaaggaggtctccgagactcagcatgggactattctaatcaaggtggaatacaagggcgaggacgccccgtgcaagattcccttcagcaccgaggacgggcaaggcaaagctcataatggtcgcttaatcactgccaacccggtggtcgccaagaaagaggagccggtcaacatagaagccgagccgccctttggggagagcaacattgtgatcggcattggtgacaaggcgctcaagatcaattggtacaaaaagggcagtagtatcgggaagatgttcgaggctaccgcccggggcgcccgccggatggccatactgggcgacactgcgtgggacttcgggtcagtcggcggcgtgctgaacagcctcggcaaaatggtacaccagatattcgggtccgcctataccgccctcttctctggcgtctcctggatcatgaagatcggcatcggggttctgttgacctggattggcctgaactcaaagaacactagtatgagcttctcgtgtatcgttatagggatcattacactgtacctcggcgccgtggtgcaagcagacatggggtgcgcgatcaactggaaaggcaaggagctgaagtgcggcagcgggatcttcgtgacaaacgaggttcacacatggaccgagcagtataagttccaggccgattcccctaagcggctggcaacggccattgccggcgcatgggagaacggggtgtgcggaatccgctcaaccacgcgcatggaaaacctcctttggaagcaaatcgccaacgagctgaactatattttatgggagaacaatatcaagctgactgtggtcgtgggggatatcataggagtgctagagcaggggaagcgaacgctcacgcctcaaccgatggagctgaagtattcatggaagacgtgggggaaggccaagatcgtcaccgccgagacgcagaactcctcctttatcatcgacgggcccaacacccctgagtgcccaagcgcgtcccgggcctggaacgtgtgggaggtcgaggactacggattcggagttttcactacgaatatctggctgaagctccgcgaggtgcacacacaaagctgcgaccaccgcctgatgagcgccgccatcaaggatgagcgcgcggtgcatgcggacatgggctactggatcgagtcccagaagaacggtagctggaagctggaaaaggcctccttcatcgaggtcaagacatgcacctggcccaagtcacatactctctggtccaacggggtgctagagtctgacatggtgatacccaagtctctggcagggcccatcagccagcacaatcaccggccggggtaccacacgcagacggccgggccgtggcacctaggcaaactggaactggatttcaattattgtgaggggactacggttgtgatcacggagaactgcgggacccgcggcccctccctccggacaaccacagtgagcggtaagctgatccatgagtggtgctgtcgaagctgcacgttgccccctctccggtacatgggcgaagacgggtgctggtacggcatggagatcaggcccatcaacgagaaggaggagaatatggtaaaaagtctggtgtccgcagggagtgggaaggtggacaattttaccatgggcgtcctctgtttagccatattgttcgaagaggtgatgcgggggaaattcggcaagaaacacatgattgcgggggtactgttcacttttgtactcctgctgtcaggccagatcacttggcgcgacatggcacacactctcataatgatcggcagcaacgcgtctgacaggatgggaatgggcgtgacctacctcgccctaatcgcgaccttcaagatacagccattcctagccctggggttcttcttacgcaagctcacctcacgggagaacctgttactcggggtgggcctggcaatggcaactaccctgcagttacccgaggatattgagcagatggcgaacgggatcgccctgggcctgatgacgctcaagctgataacccagttcgaaacgtaccaactgtggaccgcactagttagcctcacctgctccaacaccatcttcacgctaaccgtggcatggcgtaccgccaccttaattctcgcaggggtatcactgctcccactatgccagtcgagtagcatgagaaagacggactggttgcccatgaccgtggcagccatgggggttccgcccctgccgctgtttatcttcagcctgaaggacacccccaagcgccgctcctggccccttaacgagggggtcatggccgttggcctggtgtcgatactggcaagcagcctcctgagaaacgatgtccccatggcgggaccgctggtggctgggggcctcctgatcgcatgctatgtgatcacagggacgtcagccgacctgaccgtcgagaaggcggcggatgtgacttgggaagaggaagccgagcagaccggcgtgtctcataacctcatgatcacggtcgacgacgacggtaccatgcgcataaaagacgacgaaaccgagaatatcctgaccgtgttactcaaaactgcacttcttatcgtcagtggcatcttcccctacagcatcccagctactctcctggtttggcacacctggcagaagcagacccagcggtccggtgttctttgggacgtgccttcgccgcccgaaacgcagaaggcggagctcgaggagggggtctaccgcatcaagcagcagggcatcttcggtaagacccaggtgggcgtgggcgtacagaaagagggagttttccacaccatgtggcacgttaccaggggcgcggtcctgacccacaacgggaagcgtctggaaccaaattgggcgtcggtgaaaaaggacctcatctcgtacggcggcggctggcggctgtccgcccagtggcagaaaggggaagaggtgcaggtcatcgccgtggagcccggaaagaacccgaagaacttccagacgatgcccggcatcttccagacgaccaccggagagatcggcgcgatcgctttagacttcaagcctgggactagcggcagcccgatcattaatcgagagggcaaggtggtcgggctgtacggcaacggggtggtaactaagaacggtgggtatgtctctggcatcgcccagaccaacgccgaacccgacggccccaccccagagcttgaggaggaggttttcaagaagcggaacctgacgatcatggatctgcacccggggagcggcaagacgcgcaagtatttgcccgccatcgtccgggaggcgatcaagcggaggctgcgcaccctgatcctcgcccccaccagagtcgtggctgcagaaatggaggaggccctgaaagggctgcccattcgatatcagacaaccgcgactaagtccgaacacaccgggagggagatcgtggacctcatgtgccacgcaacttttacaatgcgcctactgagcccggtccgggtacctaactacaacctgattatcatggacgaggcccacttcaccgaccccgcctccatagctgcgcgagggtacatctctacccgggtgggtatgggcgaggccgcagccatcttcatgacggcgacgccgcccgggactgcggaggccttcccccaatccaatgcacccatccaagatgaggagcgcgatatccccgagcgcagctggaactccggcaacgaatggatcaccgatttcgtcgggaagacggtgtggttcgtgcccagtatcaaggcgggcaacgatatcgcgaactgtctgcggaagaatgggaagaaggttatccaattatcccgcaagaccttcgacactgaataccaaaagaccaggttaaacgactgggatttcgtcgttacgaccgatataagcgagatgggagcaaacttcaaggcggaccgcgtcatcgacccccggcgctgtttaaaacccgtgatcctgaccgacggaccggagcgggtaatactcgccggtccgatgcctgtcaccgctgcgtcagccgcccagcgccgaggccgcgtcgggcgaaacccccaaaaagagaacgaccagtatatcttcaccggccagccccttaacaacgacgaggaccacgctcactggaccgaggccaaaatgctgctcgacaatataaataccccggaagggataatcccggctctgttcgagcccgaacgcgaaaaatccgccgccatcgatggcgagtaccggctgaaaggcgaatcccgcaagaccttcgtagagctcatgcggcgcggggacctgcccgtatggctggcccacaaagtggctagcgagggcatcaaatacaccgaccgcaaatggtgctttgacggggagcgcaacaaccagatcctcgaagagaacatggatgttgagatctggacaaaagagggggaacggaagaagctgcgaccacgttggctggatgcccggacatactcagaccccctcgcacttaaggagttcaaggacttcgccgccggccgcaagagtattgcgctggatcttgtcacggagataggtcgtgtgccctcccacttggcctaccgcaccaggaacgctctggataacctcgttatgctccacacaagcgaacacggcggaagagcatatcggcacgcagtggaagagctgccggagactatggagaccttactgctccttggtctgatgatcttgctcaccgggggcgcgatgcttttcttgataagcggcaaggggatcggtaaaacttccatcgggctcatctgtgttatcgtcagctccggcatgctgtggatggctgacgtgccgctgcagtggatcgcctctgccatcattctggagttctttatgatggtgctcctgatacccgagcccgagaagcagcgtaccccgcaggacaaccagctcgcctacgtcgtaattgggattctgaccctcgcggccatcgtggcggccaacgagatgggcctcctggagactacgaagagagacctgggcatgagtaaggagcccggagtcgtaagccccacctcctatcttgacgtggatctgcatcccgccagcgcgtggaccttgtacgccgtcgccactacagtgatcactccgatgttaaggcacaccatcgagaactccaccgctaacgtcagtttggcggccatcgccaaccaggcggtcgttctgatggggctcgacaaaggttggcctatctcgaagatggacctgggcgtccccctgctcgccctaggctgttactctcaggtcaatcccctgacgctcaccgctgccgtgctgctattggtgacccactacgccatcattggccccggcctgcaggccaaggccacccgagaagcgcagaaacgcacggccgccgggatcatgaaaaaccccaccgtcgacggcatcatgaccatcgacctggaccccgtgatttacgacagcaagtttgagaagcagttaggccaggtgatgttgttagtcctctgcgccgtgcagcttctgttgatgcggaccagctgggcgctgtgcgaggccttgaccctcgccaccggccccatcaccaccctctgggagggatccccgggtaagttctggaacactaccatcgccgtgagcatggccaacatcttccgcggctcctacttagcgggggccggccttgcattcagcatcatgaagagtgtcgggacagggcggcggggcaccgggagccagggagagacgctgggggagaaatggaagaagaagctcaaccagctcagccggaaagaatttgacctatacaagaagtccggaatcaccgaggtggatcgcaccgaggctaaggaagggctgaaacggggcgagacgacccaccacgcagtgagccgcggatctgccaagctccagtggttcgtcgagaggaacatggtcatccccgagggacgggtgatcgatctgggctgcgggcgcggcgggtggagctactactgcgccggtttaaaaaaggtcacggaggtcagaggatacaccaagggcggccccggtcatgaggagccagtgccgatgtccacttatggctggaacctcgtgaagcttatgagcgggaaggatgtgttctacctgccgcccgaaaagtgcgacacactgctttgcgacatcggagagagttcaccctcaccgacggtggaggagagccgcactatccgggtcctgaagatggtggagccctggctgaagaacaaccagttctgcatcaaggtgctcaacccctatatgcccaccgtaatcgagcacctggaacgtctgcagagaaaatacggcgggatgcttgtccgcaacccgctgtcccggaacagcacccacgagatgtactggatcagcaacggcacagggaacatcgtaagcagtgtgaacatggtatctagattactcctgaaccggttcaccatgacccaccgccggcccaccatcgagaaggacgtcgatctaggtgcaggcacgcgacacgtgaacgccgagcccgagaccccgaacatggatgtgataggggaacggataaagcggattaaggaggaacactcctcaacctggcactatgacgacgagaacccctacaagacctgggcctaccacggcagctacgaggtcaaggcgacggggagcgccagctccatgatcaacggcgtagtgaaactcctgaccaagccctgggatgtcgtacccatggtgacacaaatggcaatgaccgacacgaccccgttcgggcagcaacgggtcttcaaagagaaagtagacacccgtacgccccggccaatgcccggcacgcgtaaggtgatggagatcaccgcagaatggctgtggcggaccctaggtagaaataaaaagccgcgcctgtgcacgcgggaagagttcacgaagaaggtccgcaccaacgccgcgatgggtgccgtctttaccgaagagaatcagtgggacagcgcccgtgccgccgtggaggacgaagagttctggaagttagtggaccgcgaacgtaagctccacaagctgggcaaatgcgggagttgtgtctataacatgatgggcaagcgcgagaagaagctgggtgagtttggcaaagccaagggcagtcgggccatctggtatatgtggctcggggccagatacctggagttcgaggcactggggttcctaaacgaggaccactggtttagtcgggagaacagctacagcggggtggaaggggagggtttgcataagctggggtatatcttacgcgatatctccaagatccccggcggggcgatgtacgccgacgacaccgcgggttgggacactcggatcaccgaagacgatctgcacaacgaagagaagatcacccagcagatggaccccgaacatcgccagcttgccaacgccatttttaagttaacataccagaataaggtcgtgaaagtccagagacctacgccaaagggcaccgtaatggacatcatctcacggaaggaccaacgcggtagcggccaggtggggacctacgggctgaatacttttactaacatggaagcccagctagtacgccagatggaaggggaaggcgtactctccaaggccgatcttgagaatccgcatctattagagaagaagataacacagtggcttgaaacaaagggcgttgaacgactgaagcgcatggcgatcagtggggacgactgcgtggtcaagcccatcgatgataggttcgccaacgccctcctggcgctcaatgacatgggcaaggtgcgcaaagacatcccccaatggcaaccgtccaaggggtggcacgactggcagcaagtacccttctgttctcaccactttcacgagctcataatgaaagatgggcgtaaactcgtagtgccctgccgaccccaagacgagctcatagggcgcgcccggatctcccagggcgctgggtggagcctcaaagagacggcgtgcttggggaaggcctacgcgcagatgtggtccctgatgtacttccaccgacgtgacttgcgcctggcctcaaacgccatctgctccgcggtgccggtccattggatacccaccagccgcacgacctggagcatccacgcgcatcaccagtggatgaccaccgaggatatgctaaccgtatggaaccgagtctggatcgaggacaacccgtggatggaggacaagacccccgtcaccacttgggaggatgtgccgtacctcggaaagcgggaggaccagtggtgtgggtccctgataggcctgacaagccgcgcgacttgggcccagaacatcttgacagccatacagcaggtccggtccctgatcggggacgaggaattcctggactacatgccttcgatgaagcgcttccggaaggaggaggagagcgagggcgccatctggtga

SEQ ID NO: 26117 - RNA, 9873 nt, synthetic construct
  misc_feature 1..9873: note = derived and/or modified CDS sequence (opt11) from DENV-3__FJ562099__SS-prME
  source 1..9873: mol_type = other RNA
accagcctatgccttatgatgatgctgcccgcgaccctggccttccacctcaccagcagggacggcgagccgcggatgatcgtggggaagaacgaacggggcaaaagcctcttgtttaagaccgcatccgggattaacatgtgcactctcatcgccatggacttgggtgaaatgtgcgacgacaccgtcacgtataaatgccccctgatcgcggaggtcgagcccgaggacatcgattgctggtgcaaccttactagcacatgggttacctatgggacgtgcaaccaggccggcgagcaccggcgagacaagcggtctgtcgccctcgcgccccacgtggggatggggctggacacccgtacccagacctggatgagcgccgagggcgcctggcgtcaagtggaaaaggtcgagacgtgggccttgcgccacccggggttcaccatcctggctttgttcctcgcacactatatcggcaccagcctgacccagaaagtggtcatattcatcctgctcatgctggtaactcccagcatgaccatgcggtgcgtgggggtgggcaaccgagatttcgtcgagggcctgtctggcgccacctgggtggacgtggtcctcgagcacggcgggtgcgtgaccacgatggccaagaacaagcccactctggacatcgagctgcagaaaaccgaggctacacagctcgcgacgttgcggaagctgtgtatcgagggcaagatcaccaacataaccaccgactctcgctgccctacgcaaggagaggccatactcccggaggagcaggaccagaactacgtgtgtaagcatacctacgtcgaccgggggtggggcaacgggtgcggcttgttcgggaagggctccctagtgacatgcgcgaagttccagtgcctcgagcccatcgagggcaaagtggtccaatacgagaacctcaagtacaccgtgatcatcacggtgcacaccggggaccagcaccaggtcggcaacgatacccagggggtcactgtggagatcactccgcaggccagcaccgtggaggcggtgctgcccgagtatggaaccctcgggctggagtgctccccgcgcaccggcctagactttaacgagatgatcctcctcactatgaaaaacaaggcgtggatggtccatcggcaatggtttttcgacctgcctcttccgtggacttcgggcgccacaaccgaaacccccacgtggaacaggaaagagctgctggtgacattcaagaatgcccacgccaagaagcaggaagttgtcgtgctcggtagtcaggagggcgccatgcacaccgcgctgaccggtgccacggagatccagaactctggcggtacctcgatcttcgccggccatctgaagtgccgtttgaagatggacaaattggagctgaagggaatgagctacgcaatgtgcctcaacacctttgtgcttaagaaggaggtctccgagacccagcacgggacgattctgatcaaggtggagtacaagggcgaggacgccccgtgtaagatcccctttagcaccgaggacggccaaggcaaggcgcacaacggtcgcctgatcacggccaaccctgtggtgaccaagaaggaggagcccgtgaacattgaagccgagccgccctttggggagagcaacatcgtgatcggcattggagacaaggcgctcaagatcaactggtacaagaagggctcgtcaatcggcaagatgttcgaggcgacggcccgaggcgcccgccgaatggctatactgggcgataccgcctgggacttcgggagtgtcggcggtgttctgaacagcctcggcaagatggtgcaccagatattcggatccgcgtataccgccctattcagcggcgtgtcctggatcatgaagatcggcatcggggtgctgctcacctggatcggcttaaacagcaaaaacacgagcatgtctttctcctgtatagtgatcgggatcatcaccctgtacctcggcgccgttgttcaggccgacatggggtgcgtgattaattggaagggcaaggaactgaagtgcggctctggtatattcgtcaccaacgaggtgcacacttggacggaacagtacaagtttcaagccgattcacccaagcgcctggccaccgccatcgccggcgcctgggaaaacggggtttgcggcatccgcagcaccacacgcatggagaacctcctttggaagcagatcgcaaacgagctgaactacatcctctgggagaacaacatcaagctgacggtcgttgtgggggacatcataggcgtgctcgagcaggggaagcggaccctcacgccccagccgatggagctgaagtattcctggaagacctggggcaaggcgaagattgtaacggccgaaacccagaactcctccttcatcatcgatggtcctaatacccccgagtgcccatcggcctcccgggcctggaacgtttgggaggtcgaggattacgggttcggcgtgtttaccacgaacatctggctaaagctccgcgaagtatacacccagagctgcgaccaccggctaatgagcgccgccatcaaagatgagcgcgcagtgcacgccgacatgggctactggatagaatcccagaagaacggttcgtggaagctggagaaggcctcattcatcgaggtaaaaacctgcacctggcccaaaagccacacgctgtggagtaacggcgtgctggagagcgacatgatcattcccaagtccctagccgggcccatcagccagcacaaccaccggcccggctaccacacgcagactgccgggccgtggcacctagggaagctggagcttgacttcaattactgcgagggcaccacggtcgtgatcacggagaactgcgggacccgcgggccctccttacgcacaaccacggtgagcgggaagctgattcacgagtggtgctgccgctcctgcaccctgccaccgctccggtacatgggcgaggacggctgctggtacggcatggagattcgccctatcaacgaaaaggaggagaacatggtcaagagcctggtatccgccggctccggcaaggtcgataacttcaccatgggcgtcctgtgcctcgccatcctgttcgaggaggtgatgcgggggaagttcggaaagaagcacatgatcgcaggcgtactcttcacctttgtcctcctcctttcgggacagatcacatggcgcgatatggcacacaccctcatcatgatcggcagcaacgccagcgaccgtatggggatgggcgtaacgtacttggccctgatcgccacctttaagatccagccattcctcgccctggggtttttcctgcgcaaactcacgagcagagagaatctgctgctcggcgtgggtctggcgatggccactacgctacagctacccgaggatatcgaacagatggccaacgggatcgcactgggcctgatgacactcaagctgatcacacagttcgagacctatcagctgtggaccgcgctcgtcagcctgacctgctccaacacgatcttcaccctgaccgtggcctggcgcaccgccacgctcatcctggccggtgtcagcctgctaccgctgtgccagtccagctccatgcggaagaccgattggctgcccatgactgtcgccgcgatgggcgtgccgcccctgccactgtttattttcagcctgaaggatacccccaagcgtcgctcctggcccttgaacgagggggtcatggcggtgggtctggtgagcattctggcctccagcttactgcggaacgacgtccccatggccggcccgttggtggccgggggcctcctgattgcgtgctatgtgataactggaacctccgccgacttaaccgtcgaaaaggctgcagacgtcacatgggaggaggaggccgagcagacgggcgtgagccacaatctcatgatcaccgtcgacgacgacgggaccatgcggatcaaggacgacgagaccgagaatatcctcacggtgctgctcaagacggcgttactgattgtgagtggcgtcttcccctacagcatccccgccaccctgctggtgtggcacacttggcagaagcagacccagcggtccggcgtgctgtgggacgtccccagcccgccagagacgcagaaggccgagctcgaggagggggtatacagaattaagcagcagggcatcttcggtaaaacccaggtgggcgtcggggttcagaaggagggcgtatttcacaccatgtggcacgtgacgcggggcgccgtgctgacgcacaatgggaagcgcttagaacccaactgggcctccgtgaagaaggacctcataagctacggcgggggctggcggttatccgcgcagtggcaaaagggggaagaggtccaggtgattgccgtggagcccggcaagaacccgaagaacttccagaccatgcccggcatcttccagaccaccacgggggaaatcggtgcaatcgccctggattttaagcctgggaccagcggcagtccgatcatcaacagggaaggaaaggtagtgggtctgtacggcaacggcgtcgtcaccaaaaatggcggctacgtgtccggtatcgcacaaacaaacgccgagcccgacggccccacgcccgagctcgaggaggagatgttcaagaaacggaaccttaccatcatggacctgcatccgggttctggcaagacccgcaagtatctccccgccatcgtgcgggaggccatcaaacgccggctgcgcaccctgatcttggcccccacgcgggtcgttgccgccgagatggaggaggcactcaagggccttcccatccgttaccagacaaccgccaccaagtccgagcatacggggcgggagattgtagacctcatgtgccacgccactttcaccatgcgcctgcttagcccagtgcgggttccaaactacaacctcatcataatggacgaggcgcacttcactgaccccgcctccatcgccgcccgggggtacataagcacacgggtgggcatgggcgaggcggcggccatcttcatgaccgcaaccccgccggggactgcagaggccttcccgcagtccaatgcccccatccaagacgaggagcgcgacatccctgagagaagctggaacagtggcaacgagtggatcacggacttcgtggggaagaccgtgtggttcgtacccagtatcaaggccggcaatgacatcgccaattgtttaaggaagaatggcaagaaggtcatccagctgtcccggaaaaccttcgacaccgagtaccagaagacgaaactaaacgactgggacttcgtggtcaccaccgacatcagcgagatgggcgccaatttcaaggccgaccgggtaatagacccccgccggtgcctaaagcccgtcatcctgaccgacggacccgaacgggtaatcctcgccggcccaatgcccgtcacggccgcctccgcagctcaacggcgaggccgggtgggcaggaacccccaaaaggagaacgaccagtatatcttcaccggccaacccctgaacaacgatgaagaccatgcccactggaccgaggctaagatgctgctcgacaacatcaacactccggaggggatcatccccgccctgttcgagccagagcgggagaagtccgccgccatcgatggagagtaccgcttgaagggcgaaagtcggaagaccttcgtggagctcatgcgcagaggggacctacccgtgtggctggcccacaaggtggccagcgaaggcatcaagtacacggatcgcaagtggtgcttcgacggggagcggaacaaccaaatcctcgaagaaaacatggacgtcgagatctggacaaaggagggcgagcgcaagaaactgcggccgcgctggctcgacgccagaacctactccgacccgttggcgttgaaggagttcaaagatttcgcggccggccgcaaaagcatcgcccttgacttagtgaccgagatcgggcgcgtgccctcccatctggcctatcggactcgcaacgcactggacaacttagtcatgctgcacaccagcgaacacggcggccgggcttaccggcatgccgtggaggagctgcctgagacgatggaaacactactgttgctgggcctgatgatcctgttgaccggcggggccatgctgtttctgatcagtgggaaagggatcgggaagacgtccattggactcatctgcgtgatcgttagctctggcatgttatggatggccgacgtccccctgcagtggatcgcgagcgcgatcgtgctcgaatttttcatgatggtcctgctgatacccgagcccgagaagcagcggacgccccaagacaaccagttagcctacgtggtaatcggaatccttaccctagccgccatagtcgctgccaacgagatgggcctcctggagacgaccaaacgcgacctgggcatgagtaaggagcctggggtggtgagccccacctcgtatctcgatgtggatctgcaccccgcaagcgcatggactctgtacgccgtggcgacgaccgttatcacgccgatgctacggcacacgatcgagaactccacggccaacgtgagcctggccgccatcgcaaatcaggccgtggtgttaatgggtctcgacaaagggtggccaatctccaagatggacctgggcgtccccttactcgccctggggtgctactctcaggtgaacccacttacgctaactgccgccgtcctgttactcgtcactcactacgcgataatcggccctggcctccaggccaaggccacgcgcgaagcccagaagagaacggccgcgggcatcatgaagaaccccacagtggacggcatcatgaccatcgacctggaccctgtgatctatgacagtaagttcgagaagcagctcggacaggtgatgctgctggtgctctgcgctgtgcagctgctgctcatgcgcacaagctgggccctgtgtgaggccctgaccctcgctaccggcccgatcaccacgctgtgggagggctcccctgggaagttctggaacacaaccatagcggtcagtatggcaaacatctttcggggatcctacctggcaggggccggcctcgcattcagcatcatgaaatctgtggggacgggacgcaggggcacggggagccagggagagaccctcggcgagaaatggaagaagaagctgaaccagctctcacgcaaggagttcgacctatacaaaaagagtggcatcaccgaggtggaccggactgaggctaaagaagggcttaagcgcggtgagaccacccatcacgcagtcagtcggggctccgccaaactccagtggttcgtggagcgtaacatggtgattcctgagggtcgggttattgatctggggtgcgggcgcggcgggtggagctactactgcgccggcttgaagaaggtcaccgaggtgcgaggctacaccaagggcggcccgggccacgaagaacccgtcccaatgtccacttacggatggaacatcgtgaagctcatgagcgggaaagacgtgttctatctgcctccagagaagtgcgacacgctgctttgcgacattggcgaatcctcaccctccccgaccgttgaggagagccggacaatcagggtgctcaagatggtggagccttggctgaagaacaaccagttttgtatcaaggtcctgaacccatacatgcccaccgtgattgagcatctcgagagactacagcgcaagtacggcgggatgctggtgcgcaacccgctctccagaaacagcacgcacgaaatgtactggatttccaacggcaccggcaacatcgtcagctccgtgaacatggtcagccgtctgctgctcaaccgcttcaccatgacccaccgtcggcccactatcgagaaggacgtggatttgggcgcgggcacccggcatgtgaatgccgagcccgagaccccgaacatggacgtcattggcgagcgtatcaagcggatcaaagaggagcacagcagcacctggcactatgacgacgagaacccctacaagacgtgggcttatcacggctcctatgaggtgaaggccaccggatcggctagctccatgatcaacggcgtggtaaaacttctcacaaaaccatgggacgtggtgcccatggtcactcagatggcgatgacggacactaccccgttcgggcagcagcgggtgttcaaggagaaggtggacactcgtacgccccgacctatgcccggcacccggaaggtcatggaaatcaccgccgagtggttgtggcgaacactaggtcggaacaagaaaccacgactgtgcacccgcgaggagttcaccaaaaaggtgcggaccaatgcagccatgggggccgtattcaccgaggaaaaccagtgggacagcgcgcgtgccgccgtcgaggacgaggagttctggaagctggtagatcgggagcgcgagctgcataagctaggcaagtgtggttcctgcgtgtacaacatgatgggcaagcgcgagaagaagctgggagagttcggcaaggctaagggttcccgagccatatggtacatgtggctgggggcccggtatctcgagttcgaggccctgggattcttaaatgaggatcactggttctcccgcgagaacagctactccggggtagagggcgaggggctgcacaaacttggctacatcctgcgggacatcagcaagatccccggcggggccatgtacgctgacgacactgctggctgggacaccaggataacggaggacgacctccacaacgaggagaagatcacccagcaaatggaccccgaacaccggcagctggctaacgccatctttaagctgacctaccagaataaagtagtcaaggtacagcgccccaccccgaagggaacggtgatggacatcatcagtcggaaagatcaacgcggcagcggccaggtaggaacctacggcctcaacaccttcacgaacatggaggcccaactggtccggcagatggagggggagggagtcctgtccaaagcagacttggagaatccccacctcctggaaaagaaaataacacagtggttagagaccaagggggtggagcgcctgaagcggatggccataagcggcgacgactgcgtagttaagcccatagacgatcggttcgctaacgccttactcgcactgaacgacatgggcaaggtgagaaaggacattccgcagtggcaaccgtccaaagggtggcacgactggcaacaggtccccttctgtagccaccacttccacgagctgatcatgaaggacggcaggaagctcgtcgttccctgtcgtccccaggacgaactgatcggtcgcgcccgcatctcgcagggtgcgggatggagcctgaaagagactgcctgcctcggcaaggcctacgcccagatgtggagcctgatgtacttccaccggcgcgacttgcggctcgccagcaacgcgatctgctctgccgttccggtgcactggattcctacatcccgcaccacctggtcaatccacgcccatcatcagtggatgaccacggaggacatgctgaccgtttggaaccgtgtctggatcgaggacaacccctggatggaggacaagactcctgtgaccacctgggaggatgtgccgtacttgggcaagcgggaggaccaatggtgtgggtccctcatcggcttaacctcccgggccacctgggcgcagaacatcctgaccgcaatccagcaagtccgctccctcataggtgatgaggagttcctggactacatgccctcgatgaagcggttccgcaaggaggaagagtccgagggcgccatctggtga

SEQ ID NO: 26118 - RNA, 9873 nt, synthetic construct
  misc_feature 1..9873: note = derived and/or modified CDS sequence (opt11) from DENV-3__KF955457__SS-prME
  source 1..9873: mol_type = other RNA
actagcctctgcctcatgatgatgctaccggctacactagcattccacctaacgagccgagacggggagcccagaatgatcgtagggaaaaacgaacgcgggaaatccttgttattcaaaaccgcctcgggaattaacatgtgcacactgatagcgatggacctgggggaaatgtgtgatgacacggttacctacaaatgtcctttaattgcggaagtagaacccgaagatatagattgttggtgcaatttgacttcaacatgggtaacttacggaacctgtaaccaagccggggaacatcggcgagataaacggagcgtagcgctagccccacacgttgggatgggactggatactcggactcaaacttggatgagtgctgaaggagcctggcgccaagtggaaaaagtagaaacatgggcgctccgacatccaggatttacaatcctagcactgttcctggcccactacataggtacgtccttgacgcaaaaagtcgtaatattcatcctcctcatgctcgtgacacccagcatgactatgcgatgcgtcggagtaggaaaccgtgactttgtcgaagggttgtccggagcaacatgggttgacgtcgtcctagagcacggagggtgcgttaccacgatggcgaaaaacaaacccacacttgatatcgaactccagaaaaccgaagctacgcaactggccacactgagaaaactttgcatagaagggaaaataacgaacatcaccacggacagtaggtgccccacccaaggagaagccattctcccagaagaacaagaccaaaattatgtatgcaaacacacatatgtcgaccgcggctggggaaacgggtgcgggctattcggcaaagggtcattggtcacatgcgccaagtttcaatgtctagaacccatagaaggaaaggtggtccagtacgagaacctcaaatacacagtaatcataacagtgcatacaggggatcagcaccaagtcggcaacgacacacaaggtgcaaccgtcgaaataaccccacaagcgagtacagtcgaggcagtgctcccagaatacggcacccttggactcgaatgttccccacggaccggcctcgattttaatgaaatgatcctgctcactatgaaaaacaaagcgtggatggtccatcgacaatggttcttcgacttaccccttccatggacaagtggggcaaccacggaaactcccacatggaaccgaaaagaattattggtaacattcaagaacgcccacgccaagaaacaagaggtggtcgtactaggaagtcaagaaggagccatgcacacagctctaaccggtgcaacagagatacagaacagcggcggaacctccatctttgccggacacctcaaatgccgccttaaaatggacaaactagagctaaagggcatgagctatgccatgtgcctaaacacattcgtactcaagaaagaagtcagtgagacacaacacggaaccatactaatcaaagtcgaatacaaaggtgaagacgccccctgcaagatccctttttcaacagaagatggccaaggcaaagcgcacaatggccgcttaatcaccgccaacccagtcgttaccaagaaagaggaacccgtaaacattgaggccgagccaccctttggcgagagcaacattgtaataggcattggagataaggcacttaaaataaactggtataagaaagggagttcgataggtaaaatgtttgaagcaactgcaagaggtgccagacgaatggccatacttggagacacagcgtgggacttcggctccgtcggcggtgtcctaaattcactggggaaaatggttcaccagatattcggaagcgcctacacagcactcttctctggagtgtcgtggataatgaaaataggaatcggagtgctactgacgtggatcgggctcaatagcaagaacaccagcatgagcttcagctgcatagttatcggcatcatcacgctctacttaggcgccgttgtacaagccgacatgggatgtgccatcaactggaaaggcaaagaactgaagtgcggttccggaatatttgtgacaaacgaggtccacacttggacagagcaatataaattccaggctgactccccgaaacgtctggccacggcaattgcgggtgcctgggaaaatggtgtctgtgggatccgctccacaaccagaatggagaaccttctctggaaacaaatcgccaatgaactgaattacatattatgggaaaataacataaaactaacggtagtagttggcgacatcatcggcgtcttggaacagggtaagagaacgctaacaccacagcccatggagctaaaatactcgtggaaaacctggggaaaggcaaagatagtcaccgccgagacccagaacttctcatttattatagatggccccaacactcccgaatgcccgtccgctagtcgggcatggaatgtatgggaagtggaagactacggctttggagtgttcacaaccaatatctggctgaaacttagagaagtctatacacagtcatgcgatcacagactaatgagcgcggcaatcaaggacgaacgagctgtccacgccgatatggggtactggattgaatcacagaaaaacggatcatggaagctggaaaaggcgtcgtttattgaagtaaaaacctgtacatggccaaaatctcacacactctggtccaatggcgttttggagagcgacatgataataccaaagagcctcgcgggtcccatatcacaacacaaccacaggcctggctaccacacacaaacagcaggaccatggcacctaggaaaactggagctggatttcaactactgtgaaggaacaacagttgtcataacggaagattgcggaacccgcgggcctagcctccggacgacaacggtgtctggcaaactcatacatgagtggtgctgccggtcatgcacattaccaccactacggtacatgggcgaagacgggtgctggtacggcatggagattcggcccataaacgagaaagaagaaaacatggtaaagtcactcgtttcggcaggatcaggaaaggtagacaacttcacaatgggggtcctctgtctcgcgatcctcttcgaagaggtgatgaggggcaagttcggcaagaaacacatgatcgccggggtgttattcaccttcgttctgctcttgagcggacagattacatggagagacatggcccacactttaataatgatcggcagcaacgccagtgaccgcatgggcatgggagtgacatacctggcccttatcgcgaccttcaagatccagccctttctggcccttggattcttcctgcgcaagctcacgtcccgtgaaaacttgctcttaggagtaggactagcaatggcgaccacacttcagctccccgaggatatagaacaaatggccaacggcatcgcgttggggctcatgaccctgaaactaatcacgcaattcgaaacataccaactctggacagccctcgtcagtttgacatgcagcaacacaatattcactttaaccgtggcctggcgtaccgcaacccttattcttgcgggagtcagcctattacctctatgccagagctcatccatgcgcaaaactgattggctccctatgacagtcgcagcgatgggcgtccctcccctaccactcttcattttctcgctaaaagacactcccaagcgtagaagctggccactcaacgagggggtgatggcggtcgggctggtcagcatactggcctcaagcctcttgcgcaatgacgtcccgatggccggtcccctagtcgctggagggctactcatcgcatgctacgtgatcacaggtacgtccgccgacctaaccgtagagaaagcggcagacgtgacctgggaggaagaagcagagcaaaccggcgtgtcgcacaatttaatgatcaccgtggacgacgacggaaccatgagaataaaggacgacgaaacagaaaacatactcacggtgctcctaaaaaccgcacttctaatcgtgagtggcatattcccctactctatccccgcgacactattggtgtggcatacatggcaaaaacagacgcaacgctccggagtactatgggatgtaccgtcacctcccgaaacacagaaggcggagctagaagaaggcgtatatcggataaaacaacagggcatatttgggaaaacccaagtgggggtaggagtccaaaaagaaggggtcttccacactatgtggcacgtcacacgcggcgcagtcctaacacacaacgggaagcggctcgagccaaattgggcatcggtaaagaaagaccttataagttacggcggaggttggcggctctcagcacaatggcagaaaggggaggaagtccaggtaatcgccgtagagccgggcaaaaatcccaaaaatttccagacaatgccaggaatattccaaacaaccacgggggagataggcgctatcgccttagacttcaagccaggaacatcaggatcaccgattatcaaccgcgaagggaaagtggtgggactgtatggaaacggagtcgtgaccaaaaatggaggatacgttagcggcattgcacagaccaacgcggagccagacggaccgactccggaactagaagaagagatgttcaaaaagcgaaacctgactataatggatcttcaccccggaagcggcaagacaaggaaatatctacccgccatcgtccgggaggcaattaagagaagactaaggaccctcatattggcgcccacaagggtcgtcgcagccgaaatggaagaagctctgaagggcctcccaatacggtatcagaccacagccactaaatcggaacacacgggacgggagatagtagatctgatgtgtcacgcaaccttcaccatgcgcctgctaagtccagttagagtacccaattacaacctcataattatggacgaggctcactttacagacccagcctcgatcgctgcccgaggatacatcagcacccgcgtcggcatgggcgaggcggcggcaatattcatgacggcaacaccaccgggaacagcagaggccttcccacaaagtaatgcccccattcaagacgaggaacgagacatcccagagaggagttggaatagcggaaacgaatggataacagatttcgtaggaaagactgtatggttcgtcccgtcaataaaagcaggcaacgatatcgctaattgcctacgaaagaacggcaagaaagtaatacagctaagtagaaaaaccttcgacacagagtaccaaaagacgcgcctcaacgactgggatttcgtggtgactacagacatctcagaaatgggcgcaaacttcaaagcggatagagtcatagacccaaggcgttgcctgaaaccagtgatcctaacagatggcccagagagggtaatattagcggggccaatgccagttacagcggcgagcgctgcgcagagaaggggccgcgtcggaagaaacccgcagaaggaaaacgaccaatacatctttacagggcagccgctaaacaacgacgaagatcacgcccattggacagaagccaaaatgctactggacaatatcaacacaccggaaggaataataccggcgttgtttgaaccggagcgggagaaatccgccgctatagatggggaataccgactaaagggcgaaagcagaaaaacattcgtcgaactcatgagacgcggcgacctcccagtatggcttgctcataaggtagcgagcgagggcatcaagtacacagacaggaaatggtgcttcgatggggaacgcaacaatcagatattggaagaaaacatggacgtagaaatttggacgaaggaaggcgagcgaaagaaacttcgcccacgatggctagacgcacggacgtattcggacccgttggcactcaaagagttcaaagacttcgcggccggcaggaaatccattgcgctcgacctcgtgacagagatagggcgagttccctcccacctagcgtaccggacacgtaacgcactagataacctagtcatgctacacaccagcgagcatggcggacgagcttaccgacacgcggtagaggaacttcctgaaacgatggagaccctccttttgcttggcctcatgatactacttacaggaggggcaatgctattcctaatatccggcaaaggcatcggaaaaacgagcatcggcttgatatgcgtcatcgtaagcagcggaatgctctggatggcagacgtacccctccaatggatagcctcggcaatcgtgctagagttcttcatgatggtgttgctcatcccagagccggaaaaacaacgaacaccacaagataaccagctcgcatacgtggtgataggaatcctcaccctcgcagcaatagtagccgctaacgaaatggggttgctcgaaaccaccaagcgtgacctcggaatgtcaaaggaacctggagtagtctcgcccacgagctatctcgacgtagacctccaccctgcatccgcgtggaccctctacgccgttgcaaccacggttataacccccatgctcaggcacacgatagagaacagcacggctaacgtctcgctagcggcaatagcaaaccaggcggtcgtcctgatgggtctcgataagggctggcccatatcaaaaatggacctaggagttcccttactggcgcttggctgctacagccaagtaaatcccctaacacttaccgctgctgtactcctacttgtgacgcactatgcaataatcggccctggactacaagccaaagcgacccgggaagcgcagaagcgcacggcggccggaatcatgaaaaatcccacagtagacgggatcatgaccattgacctcgacccggtcatctacgacagcaagttcgagaagcagctaggacaagtgatgctgctagtactctgtgctgtccaacttttgcttatgcgcacatcatgggctctatgcgaggccctcaccctagcaacagggcccataacaaccctatgggaaggctctccaggcaaattttggaacactacaattgcagttagcatggcgaatatattccgtggatcctatctcgccggcgccggcctggccttttctatcatgaaatcagtgggcacaggccggagggggaccggtagccaaggcgaaaccctaggcgaaaaatggaagaaaaagttaaaccaactgtcaagaaaggaatttgacttatataaaaagtccggaatcacagaagtcgaccgaacggaagcaaaggagggcttaaaacggggcgaaacgacccaccacgccgttagcaggggttccgccaagttacaatggtttgtcgataggaatatggtgatccccgaaggacgcgtcattgacctgggatgcggacgcggaggatggagctactactgtgctgggctcaagaaagtaaccgaagtgcgcggatacacaaaaggcggacccgggcatgaagaaccggtgccgatgtccacctacggctggaacctggtcaagctcatgtccggaaaggacgtattctacctaccacccgaaaaatgcgacacattattgtgcgacataggagagtcatcaccgtcgccaacagtggaagagagcagaacgataagagtgttaaaaatggtcgagccgtggctgaagaacaaccaattctgcatcaaagtacttaacccctatatgccaacagtcatagagcacctcgaaagactccaaagaaaatacggagggatgctggtccgaaatcctttaagtaggaactctacgcacgagatgtactggattagtaacggaacaggcaatatagtttcatccgtcaatatggtaagcagactcctcctcaaccgctttaccatgacccatagacgcccgaccatagagaaagacgtcgacctgggcgccggtacgcgccacgttaacgccgaaccagagactcccaacatggacgtcatcggggaacgaatcaaacgaataaaagaggaacacagttccacttggcactacgatgatgagaatccatataaaacttgggcttatcatggaagctacgaagtgaaggctacggggtcagcctctagtatgatcaatggggtcgtaaagttgctaacgaagccctgggatgtcgtcccaatggtcacacagatggccatgactgatacaacgccgttcgggcaacagcgggtattcaaagagaaggttgacacaagaacaccacgcccgatgccagggacacgcaaggtgatggagattacagcggaatggctatggcgaaccttaggaagaaacaagaaaccccgtctctgcacccgcgaggagtttacaaagaaagtaagaaccaacgccgcaatgggggcggtgttcacggaagagaaccagtgggattctgccagggcggccgtcgaagacgaagaattttggaaactcgtcgacagggagagagaattacacaaactggggaaatgcggctcctgcgtatataatatgatgggaaaaagagagaagaaactcggggagttcggaaaggccaagggctcacgagccatttggtatatgtggctaggggccagataccttgagttcgaggcgctcggcttcctcaacgaagaccattggttctccagagaaaattcctactcaggagtagagggcgaagggctccataagctcgggtacatacttcgggatatcagtaaaatacctggcggtgcaatgtatgcagacgacacggcgggctgggacactaggataacggaagacgacttgcataacgaagagaaaataactcagcagatggatcccgaacaccggcagctcgcgaacgcaatctttaagctaacatatcaaaacaaagtcgtaaaagtgcagaggccaacaccaaaaggaaccgtgatggatataatctctcgcaaggaccagcgcggatcgggccaagtggggacatacgggctgaacaccttcacgaatatggaagcacagctagtgcgtcaaatggagggagagggcgtgctcagcaaagccgacctagagaaccctcacctattagagaaaaagatcacccaatggctcgaaacgaagggtgttgaacgattaaagcgcatggcgatctcgggcgacgactgcgtagtgaagcctatagacgaccggtttgctaacgcgctactcgccttaaacgacatgggaaaagtacgaaaggacatacctcaatggcaacctagcaaagggtggcacgactggcagcaagtacccttttgcagccaccattttcacgaactaataatgaaggacggccgaaagctggtggtaccttgtcgtccgcaagacgagctgatcggaagggccagaatctcacagggggcaggctggagcctaaaggaaacagcctgcctaggaaaggcctacgcccaaatgtggtctttaatgtacttccaccgacgagacctgcggctagcctcaaacgcaatttgcagcgccgtgccggtccattggatcccgacgagccgaacgacgtggtcgatacacgcgcaccatcaatggatgaccaccgaagacatgctcacagtatggaacagagtttggattgaagacaacccatggatggaagacaaaacacctgtcacaacatgggaagacgtgccatacctcggcaaaagggaagaccagtggtgtggcagcttaatcggattgacgtcccgagccacgtgggcacaaaacatccttaccgcaattcagcaagtacgctcgctcataggggatgaggagttcctcgactatatgcccagcatgaagaggttccggaaagaagaagaaagcgaaggggcaatctggtag

SEQ ID NO: 26119 - RNA, 9873 nt, synthetic construct
  misc_feature 1..9873: note = derived and/or modified CDS sequence (opt11) from DENV-3__FJ562100__SS-prME
  source 1..9873: mol_type = other RNA
acgagcttatgcctaatgatgatgctacccgccacactcgccttccatctcacatcgcgagatggtgaacctcgcatgatagtcgggaaaaacgaacgcggaaaatccctgctgtttaaaacagcctcaggcatcaacatgtgcacccttatagccatggacttgggggaaatgtgtgacgataccgtcacgtacaaatgcccgctaattgctgaagtggaaccagaggacattgattgctggtgcaacctcacctccacatgggtgacttatggcacatgcaaccaagcaggcgaacacaggcgcgataaaaggtcggttgctctcgccccacatgtagggatgggcctagatacacgtacacaaacgtggatgtccgccgaaggagcctggcgacaagtcgaaaaagttgagacatgggcactacggcaccctggcttcactatcttagcgcttttcctagcacattacataggcacctcactcactcagaaagttgtgatattcatactccttatgctagtaacacccagcatgacaatgcgatgcgtcggagttggcaatcgagattttgtcgaagggctttcaggtgcgacgtgggtagacgtggtgctagaacacggcggttgtgtaacgaccatggccaagaataaacccactctagatatagaactccagaaaactgaggcgacgcaattggcaactctacggaagctgtgcatagaaggcaaaatcaccaatatcacaaccgactcccgatgcccaacacaaggggaagcaatcctgcccgaggagcaagaccaaaactatgtatgtaagcacacctatgtggatcgtggttggggcaacggttgcggtctttttgggaaagggtcattagtaacctgcgcgaaatttcaatgtctcgagccaatagaaggcaaagtcgtgcaatacgaaaacctgaagtacaccgtaataataacggtccatacaggagaccagcaccaggtaggaaacgacacacagggcgtgacagtagaaatcacgccacaagcaagcacagtggaggcaattctacccgagtatggcacactagggttggaatgtagtccgcgaacaggtctagattttaacgagatgatcttactcacaatgaaaaataaagcatggatggtccatcgccaatggttcttcgatctcccgctaccgtggacttccggcgcaacaaccgaaaccccaacatggaaccgaaaggaattactcgtgacattcaagaacgcccacgctaagaaacaggaggtagtagtgttagggagtcaggaaggcgcgatgcacacggcactaacaggcgcaacagaaatccaaaactccggaggcacctcaattttcgctggacatctcaaatgtcggctcaagatggataaacttgaactaaaaggcatgagctacgccatgtgcctcaacacatttgtccttaagaaagaggtgtcagagacccaacacggaacaatactaataaaagtcgaatacaagggagaagacgcaccctgcaaaataccgttcagtacggaggatggtcagggaaaagcccacaatggacgcctcataaccgctaacccggttgtgacgaagaaagaggaacccgtgaatattgaggctgagccaccatttggagaaagtaatatcgtcataggaataggagataaggccctaaaaatcaactggtacaagaaggggtcaagtataggcaaaatgttcgaggccaccgcccgaggtgcaagacgcatggcaatcctaggcgacaccgcctgggatttcggttcagtcgggggagtcttaaacagtttgggtaaaatggtacaccaaatatttggctctgcatatacagccctattctccggggtaagctggatcatgaaaataggcataggagtcctactcacgtggatcggcttaaacagcaagaacaccagtatgtcgttctcgtgtatagttattggaatcattaccctatacctgggggccgtagtccaagcggatatgggctgcgcaattaactggaaaggcaaagaacttaaatgcggcagcgggatattcgtaaccaacgaggtacacacatggaccgagcaatacaagtttcaggccgatagcccaaaacgcctagcgaccgcaatagcaggagcgtgggaaaacggcgtctgcggaatccgcagcaccacacgaatggaaaatttactttggaaacagatagcaaacgaactcaactacatattatgggaaaacaacataaagctcaccgtcgttgtcggagacatcataggcgtcctagaacaaggcaagcggaccctcaccccgcaaccaatggaacttaaatacagctggaagacgtggggaaaggcgaagatcgtgacagccgaaacacaaaactccagcttcatcatagacggcccgaatacgccagagtgcccgtcagcatcccgagcgtggaacgtctgggaagtggaagactacggcttcggagtattcacaaccaacatatggctaaaacttagagaggtttacactcagtcgtgcgaccaccgcctcatgtctgcagccatcaaggatgaaagagccgtccacgctgacatgggctactggatcgagtcgcaaaagaatggctcgtggaagctagagaaggcatcattcatagaggtgaagacctgtacatggccgaaatcccacacattatggtccaacggggtgctcgaaagtgacatgataatcccaaaatcactggcaggccccatctcccaacacaaccaccggccaggatatcacacacaaaccgccggcccttggcatctcgggaaactggaactcgactttaattactgtgaaggcacaacagtagtgatcacggaaaattgcgggacgaggggcccttcactgcgaaccacaacggtcagcgggaagctcatacacgaatggtgttgccgaagttgcacactcccaccgctcagatacatgggcgaagacggttgctggtacggaatggagatcaggccaattaatgaaaaggaggagaacatggtcaagagcctggtgagcgcgggaagcggcaaggtcgacaacttcacaatgggagtcctgtgcctagcgatactattcgaggaagtaatgagaggtaagttcgggaagaaacacatgatagccggagtccttttcacattcgtgctgctcctaagcggacagatcacctggagggacatggcccatacattgataatgataggaagcaatgctagcgaccgaatgggcatgggggttacgtacctcgctctcatagccactttcaaaatacagccgttcctagcccttgggttcttcctccggaaactaacctcccgcgagaacctattactaggcgtagggctggctatggccacaacacttcaactccccgaagacatcgaacagatggctaacggcattgcgcttgggctaatgactctgaagctaatcacccagtttgaaacgtaccaactttggacagcgctcgtttcactaacttgctcaaacactatattcacgcttacagtcgcctggcgcaccgccaccctcatactagccggcgtatcgctcctgcccctatgccagagcagctccatgaggaagaccgactggctccccatgaccgtcgcagcgatgggcgtaccgcccctacccctgttcatctttagcctgaaggacacaccgaaaaggcggagttggcccctaaacgagggcgtaatggccgtaggcctagtcagcatactggcctctagcctactacgcaacgatgtcccgatggcaggccctttagttgcgggaggcttgctaattgcgtgctacgttatcactggaacatcagcagaccttaccgttgaaaaggcagcggacgtaacgtgggaagaagaggcagaacagaccggagtatcccacaatttaatgataaccgtggacgacgatggaacaatgagaataaaagatgacgagaccgagaacatcctcacagtgctattgaaaaccgcgttgctgatcgtaagcggaatcttcccgtattccatcccagcgacactcctggtttggcacacttggcaaaagcaaacgcaacgctcgggagtactgtgggacgtccccagcccaccggaaacacagaaagccgaactagaggaaggagtatatcgcatcaaacaacagggaatctttggcaaaacacaggtcggagtcggagtgcagaaagagggagtcttccacaccatgtggcacgtcacgagaggggcagtccttacccataacggaaaacgcctagaaccgaactgggcctcagtaaagaaagaccttatctcgtacgggggtgggtggcggctctcagcccagtggcaaaaaggcgaagaagttcaagttatcgcggttgagccggggaaaaaccccaaaaattttcaaaccatgccaggcatattccagactacaacaggagagataggagcaatcgccttagacttcaagcccggcactagcgggtcgccgataatcaaccgagagggaaaggtagtaggactctatggtaacggtgttgtcacgaagaacggcggctacgtaagcggcattgcacaaaccaacgccgagccggacgggccaacaccagaactagaggaagaaatgttcaagaaacgcaacctcaccatcatggacctacaccccggctcgggcaagacgcgaaaatacttgccagcgatcgtacgcgaagcgatcaaaaggcgactaagaacccttattcttgcaccgacacgagtagttgccgccgagatggaagaagccctcaagggtctaccgatccgctaccagaccacggcaaccaaatccgaacacactggacgcgagatcgtagacctgatgtgccacgcaactttcacaatgcgactgctttccccggtccgcgttccgaattataacctgataattatggatgaggcccacttcaccgaccccgctagcatcgcagcgcgcgggtacatatcgaccagggtcggcatgggtgaagctgcggctatattcatgacagccaccccgcccggcacggctgaagcctttccccagagcaacgcacctattcaggacgaagagagagatatccccgagcgaagttggaacagcggaaacgaatggataaccgacttcgtgggtaaaacagtctggtttgtgcccagcatcaaagccgggaacgacatcgcgaattgcctacgtaaaaacgggaagaaagtcatccaattgtccagaaaaaccttcgatacggaataccagaaaactagactcaatgactgggactttgtagtcacaacagacatatccgaaatgggagctaacttcaaagccgacagggtgatagacccaaggagatgcctcaaaccggtaattttaaccgacggccccgaacgcgtaatactcgcggggccaatgccagtgacagcagccagcgcggcccaacgtcggggccgcgtaggacgaaacccacagaaagagaacgatcagtacatattcaccggacagccactgaacaacgacgaagaccacgcacactggaccgaagcgaaaatgcttctggacaacatcaacaccccagaaggaatcattcccgccctcttcgaacctgaacgcgagaaatccgcagcaatagacggagaataccgactaaagggggaatcccgtaaaaccttcgtagaattgatgcggagaggggacctccctgtgtggttagcacataaggtagccagtgagggaataaaatacacagacagaaagtggtgcttcgatggcgagcgaaacaatcaaattttggaagagaacatggacgtcgaaatctggacgaaagaaggagagagaaagaagctacgaccgcgttggctggacgcaagaacatacagcgatcccctagcactcaaagaatttaaagacttcgccgcggggcgtaaatcaattgcgcttgacctggtaaccgagatcggtcgagtaccctcacacctagcctatcgcacgcggaatgcgttagacaacctagttatgttgcacaccagtgaacatgggggaagggcatatcgccacgccgtggaggagcttcctgagaccatggagacactactgctgctcggtcttatgatactcctaaccggtggagcgatgttatttctgatatcaggcaaggggataggtaaaacgagtataggacttatatgcgtaaccgtgtcgtcagggatgctgtggatggctgacgtccccttacaatggatagcgagcgccatagtcctcgaatttttcatgatggtgctgctaataccggagcccgagaaacaacggacgccacaagacaaccaactggcttacgtagtgataggcatcctaaccttagcagcgatcgtcgcagccaacgaaatgggactgctcgaaaccacaaagagggatctaggaatgagcaaggagccaggagtggtatcgccaacgagctacctcgacgtcgacctacaccccgcatcggcctggacactctacgcagtagccaccaccgtaatcacaccgatgctacgtcacactatagaaaactcaaccgctaatgttagcttagctgccatagcaaaccaggcagtcgttcttatggggttggacaaaggctggccaatttcgaaaatggacctcggggtgcccctcctagccctcggatgttactcacaagttaacccactcacattaaccgcagccgtcctactcctcgtcacacactacgcgataattggacccggactgcaggcgaaagccaccagagaggcacagaaaagaacggccgcgggcataatgaagaaccccaccgtagatgggatcatgacgattgacttagacccagtcatatatgacagcaaatttgaaaaacaacttggacaagtcatgctacttgtgctctgtgctgtccagctactcctgatgaggacaagctgggcgctatgtgaggcgctaaccctcgccactggccccataaccactctatgggagggctcgcccggaaaattttggaacacaacgatcgcggtctccatggcaaacatcttccgcggaagctacctcgccggcgccggccttgcgttcagcattatgaaatccgtcgggacgggtagaaggggcacgggtagtcaaggggaaacgcttggagagaaatggaagaagaaactcaaccagcttagcaggaaagagttcgatctgtacaagaaatcaggtattacagaggttgatagaaccgaagcgaaagaaggactaaagagaggagagaccacgcaccacgccgtttccagagggtccgccaagctacaatggttcgtggagcgaaatatggtgattccagaggggcgagtaatcgaccttgggtgcggcaggggaggatggtcatactattgcgcagggctcaaaaaggttacggaagtaaggggctataccaagggcgggcccggacatgaggaacctgtcccgatgagcacctatggctggaacctggtgaaactcatgtcaggaaaagacgtattctacttaccgcccgaaaagtgtgacaccctactgtgtgatatcggagaatcgagtccaagcccaactgtcgaggagagccgcacgataagagtactcaagatggtagaaccctggctgaaaaacaaccaattctgcataaaagtgttgaacccctacatgcctacggtaatagaacacctcgagagattgcaacgcaagtatggcggaatgctggtgaggaatcccctttcaagaaactcaacccacgaaatgtactggatcagcaacggcacgggtaatatcgtctcgagcgtaaacatggtctcgcgccttttactgaacagattcaccatgacgcatcgacggcccacaattgaaaaagacgtagacctcggagcaggtacccgccacgtcaatgcagagccggaaactccgaacatggacgtaatcggagagcgaataaagcgaatcaaagaagaacacagctcgacctggcactacgacgacgagaacccctacaaaacatgggcataccacggtagctatgaagtgaaggcaacgggcagcgcgagctctatgatcaatggcgttgtgaaactgctcaccaaaccctgggacgtagtgccaatggtcacacaaatggccatgaccgacacaacaccattcggccagcagcgcgtattcaaagagaaagtggatacccgtaccccgcgaccgatgccgggaacaagaaaagtcatggaaatcaccgctgagtggctatggagaacactaggccgcaacaagaagccgcgactatgcacccgagaagaatttacgaaaaaggtccgaacaaatgccgccatgggagccgtgttcacggaggaaaaccaatgggactccgcgcgtgccgccgtcgaagacgaagagttctggaaattagtcgaccgtgagagggaacttcacaaactcgggaaatgcggtagctgcgtatacaacatgatgggaaagagagaaaagaagctgggagagttcggcaaagcgaaagggagccgcgctatctggtatatgtggttaggggcgcgatacctcgagttcgaggctctaggtttcctcaacgaagaccactggttcagcagagaaaactcctactccggggtagaaggcgagggactacacaaactgggctacatactaagggacataagcaaaatacccggaggagcgatgtatgccgacgacacggccggatgggacaccagaataacagaagatgacctacataatgaagagaagatcacccaacaaatggacccggaacaccggcagctcgccaatgccatcttcaaactgacataccagaacaaagtcgtcaaggtccagagacccacacccaagggaacagtgatggacatcatctctagaaaagaccagcgaggaagcgggcaagttggaacgtacggactaaacactttcacaaacatggaagcacagctagtacgccaaatggagggagagggcgtgctatccaaggcagacctggaaaacccccacctccttgagaagaaaataacacaatggttagagacgaaaggcgtcgagcgactgaaacgaatggcgatatcaggcgacgattgcgtcgtgaaaccaatcgatgatcgctttgccaacgccctattagccttaaatgatatgggaaaggtccggaaggacatcccccagtggcagccgtcaaagggatggcacgactggcaacaggtgccgttctgctcacaccacttccatgagctgattatgaaggacggacgtaaactcgtcgttccgtgcagaccacaagatgagctcattggacgcgcacgaatcagccaaggcgccggctggtcgctaaaagaaactgcctgccttggcaaggcatatgcccaaatgtggtcgttaatgtactttcaccgtcgagacctacgactcgcatcaaacgcaatctgctccgccgtacccgtccattggataccaacatctaggacaacatggagcattcacgctcaccaccaatggatgaccacagaagacatgctaacggtatggaatagggtgtggatagaagacaacccgtggatggaggacaagacccccgtaaccacctgggaagacgtcccatatctagggaaacgggaagaccagtggtgtggcagcttgataggactgacttcacgggcgacctgggcacaaaacatactgacagcaatacaacaagtgcgctccctaatcggagacgaagagttcttagattacatgccctccatgaagcggttcaggaaggaagaagagagcgagggagctatatggtga

SEQ ID NO: 26120 - RNA, 9873 nt, synthetic construct
  misc_feature 1..9873: note = derived and/or modified CDS sequence (opt11) from DENV-3__FJ547062__SS-prME
  source 1..9873: mol_type = other RNA
accagcctttgtctaatgatgatgctgcccgcaaccctggccttccatctcaccagccgggatggtgaaccccggatgatcgtgggtaagaacgagagaggcaagagcctgctgttcaaaaccgcgtccgggataaatatgtgtacgctgatagccatggacctgggcgagatgtgcgacgacaccgtgacctacaaatgccccctgattgccgaggtggaacccgaggacattgactgttggtgcaatttgaccagcacctgggtcacgtatgggacgtgtaaccaggctggggaacatcggcgggataagcggtccgttgccttggcgccccacgtggggatggggttggacacccgcacccagacatggatgtcagcggagggtgcctggagacaggtggagaaggtcgagacctgggcactccgtcacccggggttcaccatactggcactcttcttagctcactacataagcaccagcctgacgcagaaggtggtgatctttatactgttgatgctggttacaccttccatgaccatgcggtgtgtgggcgtagggaaccgcgacttcgtagaggggctgtccggtgccacctgggtcgacgtggtccttgagcacggtggctgcgtgaccacaatggccaagaacaagcccactctagacatcgaactgcagaagaccgaagccacccagctagcgacgctacggaagctgtgcatcgaggggaagatcaccaacataacgaccgactctcggtgccccacgcagggggaggccatcctccccgaagaacaagaccagaactacgtatgcaaacatacatacgtggaccgggggtgggggaacgggtgcggtctgttcggcaaagggagcctagtcacatgcgccaagttccagtgtctcgagcccatcgagggcaaagtggtacagtatgagaaccttaagtacactgtgatcataactgtgcacaccggcgatcagcatcaggtaggaaacgacacacagggggtgaccgtggagatcacaccccaggcaagcaccgtcgaggccatcctgcccgagtacgggacactagggttagagtgctccccgcgcaccggtctggacttcaacgaaatgatcctgctgactatgaagaacaaggcatggatggtgcatcggcagtggttctttgacctgcctttgccatggaccagtggtgccactacagagacccccacgtggaaccgcaaggagctgctggttacttttaaaaatgcccacgctaaaaagcaggaggttgtggtccttggtagccaggagggggctatgcacacggcgctcaccggggccacggagatacagaactccggtggcaccagcatctttgctggccacttgaagtgccggctcaagatggacaaactggagctgaagggcatgtcctacgccatgtgtcttaacacgttcgtgctgaagaaggaggtgagtgagacccagcacgggacgatcctgatcaaggtggaatacaagggggaagacgccccgtgcaagattccattctcaacagaagacggccaggggaaggcccacaacgggcgattgattaccgccaatcctgtggtgacgaaaaaggaggagcccgtaaacatcgaggctgagccacctttcggtgagtccaacatcgtgatcggcatcggcgacaaggcacttaagatcaactggtataagaaagggagttcaattggcaagatgtttgaggcgacggcgcggggcgcccgccgcatggccatcctgggggataccgcatgggattttggctcggtagggggcgtcctaaattccctcgggaagatggtgcatcagattttcggctcggcgtacacggccctcttctccggcgtgagctggattatgaagatcgggatcggcgtccttcttacctggatagggctcaactcgaaaaacacaagcatgagtttctcttgcatcgtgatcggcataatcacattgtatttgggggccgtcgtacaagccgacatgggttgcgcaatcaattggaagggcaaggagctgaaatgtgggtccggcatttttgtgacgaacgaggtgcacacctggacggagcaatataagttccaggcggactcacccaaacgccttgcgaccgccatcgccggggcctgggaaaacggcgtctgtgggattcgctccaccacccggatggagaacctactttggaaacagatcgccaacgaactgaactacatactatgggagaacaacatcaagctgacggtagtggtcggggatatcatcggggttttggagcagggcaagaggaccttgacaccccagcccatggagcttaagtacagctggaagacttggggtaaagccaagatcgtgacggcagagacccaaaattccagctttatcatcgacggcccgaacacacccgagtgcccctccgccagcagggcgtggaacgtctgggaggtggaagactacggctttggggtcttcaccacgaacatttggctgaagttacgcgaagtatacacccagtcctgtgaccatcgtctgatgagcgcggccatcaaggacgagcgcgccgttcacgccgatatgggctactggatcgagtcccagaagaatggctcgtggaagctcgaaaaggcctctttcatcgaggtgaaaacctgcacctggccaaaaagccacactctctggagcaacggggtcttagagtccgatatgatcatccccaagagcctagccggcccgatcagtcagcacaatcaccggccgggttaccacacgcagaccgctgggccctggcacctaggaaagctggagctggattttaattattgtgaggggacgacggtggtgatcaccgaaaactgcggaacacgggggcccagcctcaggaccaccacggtatccggtaagctgatccatgagtggtgctgtcgcagctgcacactaccacccctccggtacatgggtgaggacggctgctggtacgggatggagatccgccccattaacgagaaagaggagaacatggttaaaagtctagtatcggccgggtccggcaaggtcgacaactttactatgggcgtactttgtctagcaatattatttgaggaggtgatgcgtggcaaattcgggaagaagcacatgatcgcgggtgtcctgttcaccttcgtcttactgctgtccggccaaatcacatggcgcgacatggcacacaccctcatcatgatcggctcgaacgccagcgacaggatgggcatgggggtgacctacctggcactgatcgcgacttttaaaattcagcccttcctagcgctgggcttcttcctccggaaattaactagccgcgagaaccttctgttgggtgtcggtctggctatggctaccaccctgcaactccctgaggacatcgagcagatggccaatggcatcgcgctgggtttgatgaccctcaagctgatcacacaatttgagacatatcaactgtggaccgcactggtatcgctgacctgctctaacacgatattcaccttaacggtggcctggcgcaccgccacactcatcttagcaggcgtcagtctgctccccctgtgccagagcagtagcatgcggaagaccgattggctcccgatgacagtggcggctatgggcgtaccacccctcccgctgttcatcttctcgctgaaggatacccccaagcggcgcagctggcctctcaatgagggcgtaatggccgttgggttagtctccatactggctagctctctcttgcggaacgacgtgccgatggccggtccgctggtagctggcggactcttaatcgcttgttatgtcatcacgggcacctcagccgacctgaccgtggaaaaggccgccgacgttacgtgggaagaagaagcggagcagacaggggtatcccataacctcatgataaccgtcgacgacgacgggaccatgcgcatcaaagatgacgaaacggaaaacatcctgacggtgctgctcaagacggccttactgatagtctccgggatcttcccgtacagcatacccgcaacgctcctagtgtggcacacgtggcaaaagcagacccaacggagtggcgtattatgggatgtcccgagcccgcccgagacgcagaaggccgaattagaggagggagtataccgcattaaacaacaggggatcttcggaaagacccaggtcggcgtaggcgttcagaaagagggggtattccataccatgtggcacgttactcggggcgccgtgctgacacacaacggtaagcgcctggagccaaactgggcgtccgtgaagaaagatctcatctcttacgggggaggctggcgcctcagcgctcagtggcagaagggcgaagaggtccaggtcatcgccgttgagccaggtaagaatccgaagaactttcagaccatgcccggcatattccagaccaccacgggggagataggggcgattgcgctggatttcaagcccggcacctcgggcagtccgattatcaacagagaaggaaaagtagtaggactttacgggaatggcgtggttacgaaaaacggaggttacgtgtcagggatcgctcagaccaacgccgaacctgacggaccgacccccgagctagaagaggagatgttcaagaagcggaacctgacgatcatggaccttcacccgggtagtggcaagacccgcaagtacctccccgccatagtgcgggaggccatcaagcgccggctgcgcaccctgatattggctcccacaagggtcgtggcggcagagatggaagaggcccttaagggcctgccgatcagataccaaaccaccgctacaaagtccgaacacacggggcgggagatcgtggaccttatgtgccatgcgacattcacaatgcgcctgctgtccccggttcgggtgcccaactataatctcataattatggatgaagcccacttcaccgaccccgctagcatcgccgcccgcggatacattagtaccagggtgggcatgggcgaggccgccgccatattcatgaccgccacgccgcccgggaccgcagaagcatttccccagagcaacgcgcccatacaggacgaggagcgcgatattccagaacgctcctggaatagtgggaacgagtggattaccgatttcgtcggcaaaacggtgtggttcgtgccttccatcaaggcgggaaacgacatcgccaactgcctcaggaagaatggaaagaaggtcatccagttaagccgtaagactttcgacaccgagtaccagaagacgcggctcaacgactgggacttcgtggtgaccaccgacatttccgagatgggggcgaattttaaagcggaccgcgtaatcgaccccagacgatgtctgaagcccgttatcctgacggacggccccgagcgtgtcatcctcgctgggccgatgcccgtcactgcagcctcagcggcccaacgccgcgggcgcgttgggcggaacccccagaaggaaaacgaccagtatattttcacagggcagcccctaaacaacgacgaagatcacgcgcactggaccgaggctaagatgctactcgataatatcaacacccctgagggcatcattcccgcactgtttgagccagaacgcgagaaatccgcggccatcgacggtgaataccggctgaagggcgagagccgcaagacgttcgtggaactgatgagaagaggggacctgccagtctggctggcccacaaggtggctagcgaggggataaaatacacagatcgaaaatggtgctttgacggcgagcggaacaaccagattctcgaggagaacatggacgtcgaaatatggaccaaggagggcgagagaaagaagctgcgcccgcggtggctggacgcgagaacttattcagaccctctcgcgttaaaagaatttaaggacttcgcagccggcagaaagagtattgccctggacctagtaaccgagatcgggcgggttcccagccacctggcgtatcgcactcggaacgccctagacaacttagtcatgctgcacacaagcgagcacggagggcgcgcctaccgccacgccgtggaggagttaccggagactatggaaaccctcctgttactcggcctgatgatcctgctcacaggaggggccatgctgttcttgatcagtggcaaggggatcgggaagaccagcataggccttatctgcgttatcgtttccagtgggatgctttggatggctgacgtgcccttacagtggatcgcttccgccatagtactcgagtttttcatgatggtcttgttaattcccgagcccgagaagcagcggacgccgcaggacaatcagttggcctatgtggtgattggcatcctgaccctagcggccatagttgctgccaacgagatggggctgctcgagacgacgaagcgtgacctagggatgtccaaggagcccggagtggtgtccccgacgagctacctcgacgtagacctgcaccctgccagcgcctggactctgtacgcggtggcaacaacggtgatcacccctatgcttagacatacgatagaaaattccaccgccaacgtctccctggctgcaatcgccaaccaggctgtggtgctgatgggactcgacaagggctggccaattagcaagatggatctgggggtccccctgctcgcgctgggctgctactcccaggtgaaccccctgaccctaaccgcggctgtactcctgctcgtcacacattacgctattatcggtccaggcttgcaagccaaagctactagagaggcacaaaagcgcactgcggccggcatcatgaagaacccaacggtggacgggatcatgaccatcgatctggacccggtcatctatgatagtaagttcgagaagcagctaggccaggtaatgcttctggtgctctgcgcggtgcagctgctccttatgcggacatcctgggcactatgcgaggccctcaccctcgctaccggccctataaccacgctttgggagggaagcccgggcaagttctggaacacgaccatcgccgtctccatggcaaacatcttccgcggctcgtacctggctggtgcgggtctcgcgttctcgatcatgaagtcagtggggaccgggcggcgcgggacgggtagccagggggaaacacttggcgaaaagtggaagaagaagctgaaccagctttcccggaaggagttcgacctgtacaagaaatctggtataaccgaggtggacaggaccgaggccaaggaaggcctgaagcggggtgagaccactcatcacgccgtctcccgcggctctgcaaagctgcagtggtttgtggagcggaacatggtgatacccgagggccgcgtaatcgacctgggatgcggtcgcggaggctggtcgtactactgcgcggggctgaagaaagtgacagaggtacggggctacacgaagggtgggcccggccatgaggagccggtcccgatgtcaacctacgggtggaacctcgtgaaacttatgagtggcaaagacgtgttctacctgccgcccgagaaatgcgacacccttttgtgcgacataggtgagagctcgccttctccgaccgtggaagagtcccgcaccatacgggtgctgaaaatggtggagccctggttgaagaataaccaattctgcatcaaggtcctcaacccctacatgcccaccgtgatagagcatctagagaggctgcagcggaagtacggtggcatgcttgtgcgcaacccactctcccggaactctacccacgaaatgtattggatctcgaacggcaccggcaacatcgtatcctccgtgaatatggtctccagacttctccttaaccgattcactatgacccaccgcaggcctacaatcgaaaaagacgtcgacctcggtgccggtactcgccatgtgaatgccgaacccgagaccccgaacatggacgtcatcggcgagagaatcaagcgcatcaaggaggagcactcctccacctggcactacgacgacgagaacccctacaaaacgtgggcctaccatggctcgtacgaagtcaaggccaccggatccgcgtccagcatgatcaacggggttgtcaagctccttaccaagccctgggacgtggtgccaatggtcacccagatggccatgactgacaccaccccattcggccagcagcgggtgttcaaggagaaggtggacacccgcacgccacggcccatgcccggtacccgcaaggtcatggagataaccgccgaatggttgtggcggacgttgggaaggaacaagaagcctcgactgtgcacgcgggaggagttcaccaagaaggtacgtactaacgccgcgatgggtgccgtgtttacagaggagaatcagtgggactccgcccgggccgcggtagaggacgaagagttctggaagctggtcgaccgtgagcgggagttacacaaacttgggaagtgcggctcgtgcgtgtacaacatgatggggaagcgcgagaagaagctgggtgagttcgggaaggcgaaaggctcacgggccatctggtacatgtggctgggggcccgctacctggagttcgaggccctggggttcctcaacgaggaccactggttcagccgggagaacagctactccggcgttgaaggcgagggcctgcacaaactgggttacattttacgtgacatctccaagatccccggtggggctatgtacgcggacgacacggcagggtgggacacccggatcaccgaggacgacctgcacaacgaagaaaagataacccaacagatggatcccgagcacagacaactggccaacgccatcttcaagttgacgtatcagaataaagtggtgaaggtccagcgccccaccccgaaaggcacagtgatggatatcatatcccgcaaggaccagcggggttccggccaggtggggacctacgggctgaacacctttacgaatatggaagcacagctggtccgccagatggagggcgaaggagtcctctcgaaagcggacctggagaatcctcatctcttagagaaaaagatcacccagtggctggagacaaaaggcgtagagcggttgaagcgcatggccatctccggcgatgactgcgtggtcaagcccattgatgacagattcgccaacgccctcctagccctaaatgacatggggaaagtgcgcaaagatatcccccaatggcagccttcgaagggctggcacgactggcaacaagtacctttctgcagccaccacttccacgagctcataatgaaggacgggcgtaagctggtggtaccctgccggccacaggacgagctcatcggtcgtgctcggatctcacagggggctggctggtccctaaaggagaccgcttgcttaggaaaggcatacgcccagatgtggagcttaatgtacttccaccgccgggacctccgcctggcttccaatgccatctgtagcgccgtgccggtgcactggatccccacgagccggacaacctggagcatccacgcacaccaccaatggatgacaacggaggatatgctgacagtgtggaatcgcgtctggattgaggacaatccctggatggaagacaagacgcccgtcaccacatgggaggatgtaccgtatctcggcaagcgggaagaccagtggtgcggcagcctgattgggttaacgagtcgcgcgacctgggctcagaacatcctcacggcaatccagcaagtgaggtcgctcatcggtgatgaggagttccttgactacatgccctcaatgaagagatttcgcaaggaggaggaaagcgagggggccatctggtga

SEQ ID NO: 26121 - RNA, 9873 nt, synthetic construct
  misc_feature 1..9873: note = derived and/or modified CDS sequence (opt11) from DENV-3__FJ461322__SS-prME
  source 1..9873: mol_type = other RNA
accagtctgtgcctcatgatgatgctgcccgcgaccctggccttccatctcacgagccgggacggtgagccccggatgatcgtgggaaagaacgagcgcggcaaaagcctgctgttcaaaaccgcgtccgggataaacatgtgtaccctcatcgccatggacctgggcgagatgtgcgacgacactgtgacatacaagtgccccctgatcgccgaggtggagcccgaggacatcgattgctggtgcaacctcaccagcacctgggtgacctacgggacctgcaaccaggccggcgagcaccggcgcgacaagcggagtgttgcactggcgccccacgtgggcatgggactggacacccgcacccagacatggatgtcagccgagggcgcctggcgccaggtcgagaaagtagagacctgggcccttcgccacccgggctttaccatcctggcgctattccttgcccactacatcggcacctccctcacgcagaaagtggtgatcttcatcctgctcatgctggtcactcccagcatgacgatgcggtgcgtgggggtgggcaaccgcgacttcgtcgagggcctgtccggggccacctgggtggacgttgtgctcgagcacggaggatgcgtgaccacgatggccaagaacaagcccaccctggatatcgagctgcagaagactgaggccacccagttagcgacgctgcggaagctgtgcatcgagggcaagatcactaacatcactaccgacagccgctgccccacacagggcgaggccatccttcccgaagagcaggaccagaattacgtttgcaagcatacctacgtcgatcgagggtggggcaacggctgtggcctgttcgggaaaggctctctggtgacttgcgccaaattccagtgcctcgaacctatcgagggcaaagtggtacagtatgagaacctgaaatacacggtgatcatcacggtgcacaccggggatcagcaccaggtgggcaatgacacccagggggtcaccgtagagatcacgccccaggctagcaccgtagaggccgtcctccccgagtacggcaccctcgggctggaatgctcgccgcgcaccggcctggacttcaatgaaatgatccttttaaccatgaaaaacaaggcgtggatggtccaccggcagtggttcttcgatctgcctctcccctggacgagcggcgccaccacagaaacccccacgtggaaccgcaaggagctgctggtgaccttcaagaacgcccacgccaagaagcaggaggtggtcgtgctcgggtcccaggaaggggccatgcacaccgcgctgaccggggcaacggagatccagaacagcggcgggacttcaatctttgccggacacttgaagtgtcggctcaagatggacaagctggagctgaagggcatgagctacgctatgtgcctcaacacttttgtgttgaagaaggaggtctccgaaacccagcacgggacgattctgatcaaggtcgagtacaagggtgaggatgccccgtgcaagatccccttcagcaccgaggacgggcagggcaaggcgcacaacggccgcctgatcaccgccaatccagtcgtcaccaagaaggaggagcccgtgaacatagaggctgaaccgcccttcggcgagtccaacatcgtgatcggcatcggggacaaagccctcaagataaactggtacaaaaagggctccagcatcgggaagatgttcgaggcgacagcccgcggcgcccgccgaatggccatcctgggagacaccgcttgggacttcgggtccgtcggcggggtgctgaatagcctgggtaagatggttcaccagatcttcgggtctgcgtacaccgccctgttcagcggcgtctcctggatcatgaagatcggtatcggggtgctgctcacctggataggcctaaacagcaagaacacgtccatgagcttctcctgtatcgtcatcggaatcatcaccctgtaccttggcgccgtggtgcaggctgacatggggtgtgccataaactggaagggcaaagaactcaagtgcggcagcggaatctttgtgaccaacgaagtccacacctggactgaacagtacaagttccaggccgactccccaaagagactggcgacagccatcgcgggcgcctgggaaaacggggtgtgcggcatccgctcgaccacccgcatggagaacctcctgtggaagcagatcgcgaacgagcttaactacatcctctgggagaacaatataaaattgaccgtagtcgtcggggacatcatcggcgtgctggagcaaggcaagagaaccctcacgccccagccgatggagctgaagtactcctggaagacctgggggaaggccaaaatagttacggcagagacccagaacagctcgttcattatcgatggccccaacaccccagagtgccccagcgcctctcgggcgtggaacgtgtgggaggtggaggactatgggttcggcgtcttcacgacgaacatctggctgaagttgagagaagtgtacactcagagctgcgaccaccggctgatgagcgccgccatcaaggatgagcgcgccgtgcacgctgacatgggctactggattgagtcccagaagaacggaagctggaagctggaaaaggcgtccttcatcgaagtcaaaacgtgcacctggccaaagagccataccctctggtccaacggcgtacttgagagcgatatgatcatccccaagtccctggctgggcctatcagtcagcacaatcatcggccgggctaccacacgcagaccgctggcccctggcacctaggcaagcttgagctggacttcaactactgcgagggcacaaccgtggtcatcacggaaaactgcgggacccgaggcccctccctccggacgaccacggtgagcggcaagctgatccacgagtggtgctgccgctcctgcaccttgcccccgctcagatacatgggcgaagacgggtgctggtacggcatggaaatacgccccatcaacgagaaggaggagaacatggtaaagagcctggtctccgccggctcggggaaagtggacaacttcacaatgggcgtgctgtgcctggccattctgttcgaggaggtcatgagaggaaagttcggcaagaagcacatgatcgcgggggttctgttcacattcgtgttactgctgtccggccagatcacgtggcgtgacatggcccacaccctcatcatgatcggcagcaacgcctccgatcggatggggatgggagtcacatacctggcgctgatcgccaccttcaagatacagcccttcctcgccttggggttcttcctgcgcaagcttacgagccgagagaacctgctgttaggcgtcggcctggccatggctacaaccctccagttgccagaggacatcgagcaaatggccaacgggatcgctttaggccttatgaccttaaaactgataacgcagttcgagacctaccagttatggaccgccttggtgagcctgacatgctccaacacgatcttcaccctgacggtggcatggcgcaccgccacgctcatcctggccggggtctcactgctcccgttgtgtcagtctagtagcatgcgtaagaccgactggctgcccatgaccgttgccgcgatgggggtgccgcccttgccgctcttcatcttcagcctgaaggacaccccaaaacgccgctcctggcccctcaatgagggggtaatggccgtgggacttgtgtcaatcctagcctccagcctcctccggaatgacgtgcctatggctggcccgctggtagccggcgggctcctgatcgcctgctacgtgattacggggacatccgctgacctgaccgtggaaaaagccgccgacgtcacctgggaggaagaggcggagcagactggggtgagtcacaacctcatgatcaccgtggacgacgacgggaccatgcgcatcaaggatgatgagaccgagaacatactgacagtcttgctcaagacggccctgctgatcgtctccggcatctttccctatagcatcccagccacccttctggtgtggcacacctggcagaaacaaacccagcggtccggcgtactgtgggacgtgcccagcccgccggagacgcaaaaagccgagctcgaggaaggggtgtacagaattaagcagcaggggatcttcgggaaaacccaggtcggcgtaggggtgcaaaaggagggcgtcttccacaccatgtggcacgtgacccggggcgccgtgctgacccacaacgggaagcgcctggagcccaactgggcgtccgtcaagaaggacctcatcagctatggcgggggctggagactttccgcccagtggcagaagggggaggaggtccaagtgatcgctgtcgagcccggcaagaatccgaagaacttccaaacaatgcccggcatcttccagactaccacgggggagataggcgccatcgcgctggacttcaagcccgggaccagcggcagcccgattattaaccgcgagggcaaggtggtaggactgtacggcaacggggtcgttacaaagaacggggggtatgtgtccggcatcgcccagaccaacgccgagcccgacggccccacgcccgaactcgaagaggagatgttcaagaagcggaacctgaccatcatggaccttcatccggggtcggggaaaactcgcaagtaccttcccgccatcgtcagggaggccatcaagcgccggctgcgcacactgatcctcgcgcctacgcgggttgtggccgccgagatggaggaagccctgaaggggctgcccatccgctaccagacaaccgcaaccaagtccgagcatacagggcgcgagatcgttgacctcatgtgccatgctacttttacgatgcgcctgctgagcccggtgagagttcccaactacaacctcatcatcatggacgaggcgcatttcaccgaccccgcctccatagccgcccgcggctacatcagcacgcgggtaggcatgggggaggcggccgctattttcatgaccgccactccgcccggtaccgcggaggcgttcccccagtccaacgcccccatccaggacgaggagcgcgacatcccggaacgcagctggaactccggcaacgagtggatcacggacttcgtgggcaagaccgtgtggttcgtgccctcaatcaaggccggcaatgacatcgccaactgcttgcgtaaaaatgggaaaaaggtgatccagctgtcccgcaagacctttgacaccgaataccagaagacgcggctcaacgactgggatttcgtggttaccaccgacatcagcgagatgggcgcaaacttcaaggccgatcgcgtgatagacccccggcgctgcctgaagccggtgatccttaccgacggacccgagcgggtcatccttgccggtccgatgcccgtaacggcggcgtctgccgcccagaggcggggccgcgtggggcgaaacccacagaaggagaacgaccagtacatctttaccggacagcccctgaacaacgacgaggatcacgcccactggactgaggccaagatgctgctcgacaacatcaacacccccgaggggatcatccccgccctgttcgagccggagcgggaaaagtccgcagccatcgacggcgagtaccggctaaagggcgagagtcggaagaccttcgtcgagctcatgcggagaggggacctacccgtgtggcttgcccacaaggtcgcgagcgagggcatcaaatacacggacagaaagtggtgcttcgacggcgagcgcaacaatcaaatcctcgaggagaatatggacgtggagatctggaccaaagagggcgagcggaagaaactgcgcccgcgctggcttgatgcgcggacctactccgaccccctcgcacttaaggagttcaaggacttcgccgccggccgcaagagcatcgctctggacctcgtgaccgagatagggcgggtcccctcccatctggcgtatcgaacgcggaacgccctggacaacctcgtgatgttgcacaccagcgagcacggcggtagagcatataggcacgccgtagaggaactaccggagaccatggagacccttctgttactaggactgatgatcctgctcaccggcggggctatgctattcctgataagcgggaagggcattggcaagaccagtatcgggctgatctgcgtaatcgtgagttccggcatgttgtggatggccgaggtgccccttcaatggatcgccagcgcgatcgtcctcgagttcttcatgatggtgctgctgatccccgagcccgagaagcagcgcacgccgcaggacaaccagttagcctacgtggtcatagggatcctgacgctcgccgcgatcgtggccgcaaacgagatgggcctcttagagaccaccaagcgggacctgggcatgagcaaggagcccggggtggtctcccccacatcctacctcgatgtagacctgcaccccgcttccgcctggaccctgtatgccgttgccacgaccgtcattaccccaatgctccgccatactatcgagaactccaccgccaacgtgagcctggccgcgatcgccaaccaggccgtggtgctgatgggcctcgacaagggatggcccatcagcaagatggacttaggcgtgccgctgctcgccctggggtgctactcccaggttaatcccctgaccctcaccgccgctgttctgctgctcgtgacccactacgcgatcatagggcctggcctgcaggccaaggctactcgggaggcccagaagcgaaccgcagccgggatcatgaaaaaccccaccgtagacggcatcatgaccatcgacttagaccccgtcatttacgattcgaaattcgagaagcagctcggccaggtgatgctgctggtgctctgtgctgtccagctgttgcttatgcgcacgagctgggccctatgcgaggccttgaccctcgcgacggggcccatcacgacactgtgggaaggctcgccagggaagttttggaacaccaccatcgccgttagcatggccaacatcttccgcggctcctacctggcaggggctggcctcgccttcagcatcatgaagtctgtggggactggccggcgcggcacggggtcccagggtgagacattgggcgagaagtggaagaaaaaactgaaccagctttcacggaaggagttcgatctgtacaagaagtccggcatcaccgaggtcgaccgcaccgaggcgaaggaggggctgaagaggggcgagacgacccaccacgctgtgagtcgcggctctgcgaaactccagtggttcgtggagcgaaacatggtcatccccgagggtcgcgtgatcgacctgggctgcgggcgcggaggctggtcgtactactgcgcgggcctgaagaaggttactgaagtccggggctacaccaaaggaggccccggtcacgaagagcccgtcccgatgtcgacctacggatggaacatcgtgaagctaatgagcgggaaggacgtcttctacctgccgcccgagaagtgcgacactttgctgtgcgacatcggggagtccagcccttcccccaccgtggaagaatcgcgcaccattcgggtgctcaagatggtcgagccctggctgaagaacaaccagttctgcatcaaggtgctgaatccctacatgccaactgttatcgaacacctcgagcgcctgcagcggaagtacggcgggatgctggtccgcaacccgctttcccggaacagcacgcacgaaatgtactggatatccaacggcacagggaacatcgtgagctccgtgaacatggtcagccgcctactgttgaaccgcttcaccatgacccaccgccggcccacgatcgagaaggacgtagacctgggcgccggcactcgccacgtcaacgccgaacccgagaccccgaacatggacgtgatcggggaacggatcaagcgcatcaaggaggagcactcctcgacctggcactacgacgatgagaatccctacaagacgtgggcctatcacggctcctacgaggtgaaggccaccgggagcgcgagctccatgatcaacggcgtcgtgaagctgctcaccaagccctgggacgtggtcccgatggtgacccagatggcgatgacggacaccaccccgttcgggcagcagcgggtgttcaaggagaaggtcgacacccgcacaccccggcccatgcccgggacccgcaaggtgatggagatcacggccgaatggctgtggcggaccctcggccgcaacaagaagccgcgactctgcacgcgggaggagttcaccaagaaagtgcgtaccaacgcagcgatgggggcggttttcaccgaggagaaccagtgggacagcgctcgggctgcagtggaggacgaggagttctggaagcttgtggaccgcgagcgggagttacataagctcggcaagtgcgggtcctgcgtctacaacatgatgggaaagcgcgagaagaagctgggcgagttcggcaaggcgaagggcagcagagctatctggtacatgtggctgggagcccgctacctcgaattcgaggccctgggcttcctgaacgaggaccactggttttcccgggagaatagctactccggggtggagggggaggggctccacaagctgggctacatccttcgcgacatcagcaagatacccggcggggcgatgtacgcggacgacacggcaggctgggacacccggatcaccgaggacgacctacacaacgaggagaagatcacccagcagatggaccctgagcaccgccaactggcgaacgccatcttcaagctgacgtaccagaacaaggtggtcaaggtgcagcggcccaccccgaaggggacagtgatggacatcatctcgcgcaaggaccagcggggatcaggccaggtcgggacctacggcctcaacaccttcacgaatatggaggcccagctggttcgccagatggagggggagggcgtgctgtccaaagcggacctcgagaacccccacctcctggagaagaagatcacccagtggctcgagaccaagggggttgagcggctaaagcgtatggccatctccggcgacgactgcgtagtgaagcccatcgacgaccggttcgccaacgccttgctcgccctgaacgacatgggaaaggtaagaaaggacataccccaatggcagccttcaaaggggtggcacgattggcagcaggtccccttctgtagccaccactttcacgaacttatcatgaaggacggccggaagctcgtggtcccctgtaggcctcaagacgagttgatcggacgcgcgcggatctcccagggtgccgggtggtccctgaaggagaccgcctgtctcggcaaggcctacgcacagatgtggagcctgatgtactttcaccgccgggacctgcgcctcgcaagcaatgcgatatgctccgctgtaccggtgcactggatccccacgtctcggactacctggtctatccacgcccaccatcagtggatgaccacggaggacatgctgacggtctggaatcgcgtatggatcgaagataacccctggatggaggacaagacccccgtgacgacgtgggaagacatcccgtacctgggcaaacgggaggaccagtggtgcggttccctcatcggcctgactagccgcgcaacatgggcccagaacatcctaacagctatccagcaggtccggtctctcatcggggacgaagagttcctggactacatgccctctatgaagcgcttccggaaggaggaggagtccgagggtgccatctggtga

SEQ ID NO: 26122 - RNA, 9873 nt, synthetic construct
  misc_feature 1..9873: note = derived and/or modified CDS sequence (opt11) from DENV-3__KF955458__SS-prME
  source 1..9873: mol_type = other RNA
acaagcctgtgcttaatgatgatgctgcccgcgacgctggctttccatctcaccagccgggacggagagccccgtatgatcgtggggaagaacgagcgcggcaaaagcctcctgttcaagaccgcgtccgggatcaacatgtgcactcttatcgcaatggacctgggggagatgtgcgacgacaccgtcacgtacaagtgccccctcatcgccgaagtggagcccgaggacatcgactgctggtgtaaccttacaagcacctgggttacctacgggacgtgcaaccaggcaggagagcacaggcgcgacaagcggagtgtggccttggcaccccacgtgggaatggggctggatacacggacccaaacttggatgagcgccgaaggcgcctggcgccaggtggagaaggtggagacgtgggccctccgccacccggggttcaccatactggccctgtttctcgcccactacatcgggacctctctgacccaaaaagtggtgatattcatcctgctcatgctggtcacgccaagcatgaccatgcggtgcgttggggttggcaacagagactttgtcgagggcctgtccggggccacatgggtggacgtggtccttgagcatggcgggtgcgtgaccacgatggccaagaataagcccaccctggacatcgagctgcagaaaaccgaggccacccagctcgcaacgctacggaagttgtgcatcgagggtaagatcaccaatatcaccaccgacagccgctgccccacgcagggcgaggctatcctcccggaagaacaggaccagaactacgtctgcaagcatacctacgtcgaccggggttggggcaacgggtgcggactgttcgggaaaggctccctggtgacctgcgccaaattccagtgcctcgaacccatcgaagggaaggtcgtccagtacgagaatctgaagtacaccgtgataatcaccgtgcacaccggagaccagcaccaggtgggcaacgacacccagggggtgaccgtcgagatcacgccccaagcaagcaccgttgaggccgtgctgccagagtacggcacgctcgggctggagtgctctccgcgcacgggcctggacttcaacgagatgatcctcctgaccatgaagaacaaggcgtggatggtccatcggcagtggttcttcgacctgcccctgccgtggactagcggggccaccaccgagacccccacgtggaacagaaaggaactgctggttaccttcaagaacgctcacgccaagaagcaagaagtggtcgtgctcgggtcccaggagggcgccatgcatacagcgctgaccggggcgacggagatccagaacagcggcgggacgtccatcttcgccggccatctgaagtgccggctcaagatggacaagctcgagctgaaggggatgagttacgccatgtgtttgaataccttcgtgctgaagaaggaagtctccgagacccaacacggcacgatactcatcaaggtggagtacaagggcgaggacgccccgtgcaaaatccccttttccaccgaggacggccaaggcaaggcgcacaatggccgcctgatcaccgcgaatcccgtggtcacaaagaaggaggagcccgtgaacatcgaagccgagccgcccttcggggagtcgaacatagtgataggcattggggacaaggcccttaagataaactggtacaagaagggtagcagcatcggtaagatgttcgaggcgacggcccgaggcgcacgtcgtatggccatcctgggcgacaccgcatgggacttcggctccgtcggaggggtgctgaacagcctcggcaagatggtgcaccagatattcgggtccgcgtataccgccctgttcagcggcgtctcctggatcatgaagattggcatcggggttcttctcacctggatcggcctgaacagcaagaacacgtccatgagcttctcctgtatcgtcatagggatcatcaccctgtatctcggtgccgtcgtgcaggccgacatggggtgtgctataaattggaagggcaaagagttgaagtgcggcagtgggatcttcgtgaccaatgaggtacacacctggaccgagcaatacaaattccaggcggacagtcccaagaggctggccactgccatcgcaggcgcctgggagaacggagtgtgcgggattaggtcaacaacccggatggagaaccttctgtggaagcaaattgcgaacgagctgaactacatcctctgggagaacaacattaagctgacggtcgttgtgggtgacatcatcggcgtcttagagcagggcaagcgcaccctcacgccgcagccgatggagctgaagtactcctggaagacatgggggaaagccaagatcgtcacggccgagacccagaacagctccttcatcatagacgggcctaatactcccgagtgccccagcgcctcccgggcctggaacgtgtgggaggtggaggactacgggttcggcgtcttcaccacgaacatctggctgaagctccgcgaggtgaacacccagtcttgcgaccaccggctgatgagcgccgccatcaaggatgagcgcgcagtgcacgcggacatgggctactggatcgaatcccagaaaaacgggagctggaagctggagaaggcgtcctttattgaggttaaaacgtgcacatggcccaaaagccacaccctctggtccaacggcgtgctggagtccgacatgatcatccccaagtccctggccgggcccatcagccagcacaatcacagaccaggctaccacacgcagaccgccggtccctggcacctcggcaagctggagctggacttcaactactgcgaggggaccaccgtggtcatcacggaaaattgcgggactcggggcccctccctccggaccaccacggtgagcgggaaacttatccacgagtggtgctgccgcagctgcaccttaccgcccctccggtacatgggcgaagacgggtgctggtatggcatggagatccgccccatcaacgagaaggaggaaaacatggtcaagagcttagtttccgccggcagcgggaaggtggacaattttaccatgggcgtactttgcctcgccatcttgttcgaggaggttatgagggggaagttcggcaagaagcacatgatcgcgggggtcctgttcaccttcgtactgttgctgtccggccagatcacgtggcgcgatatggcccacaccctcataatgatcggcagcaacgcctccgaccgcatggggatgggcgtcacttatctggccctgatcgccaccttcaagatacagcccttcctcgcgctgggattcttcctgcgcaagcttactagtcgggagaacttactgctaggcgtgggcctcgccatggcgaccaccctgcagttgcccgaggacatcgagcagatggcgaacgggatcgcgttaggcctgatgaccctcaaactgatcacgcagttcgagacctaccagctgtggaccgccttggtgagcctgacatgctccaacacgatcttcaccctgaccgtggcctggcgtaccgccacgttaatcctggccggggtgagcctgctcccgctgtgccagtccagctccatgaggaagaccgactggctgcccatgaccgtagcggccatgggcgtaccacccctcccgttatttatcttcagccttaaagacacccccaagcgccgcagttggccccttaacgagggggtgatggccgtcggcctggtgtcgatcctggcctcctctctcctgcggaacgacgtgccaatggccggaccgcttgtcgccggcgggctcttgatcgcatgttacgtgatcacgggcacatccgccgatctgaccgtagagaaggcagccgacgtcacctgggaggaggaggctgagcagacgggggtgtcgcataatctcatgatcaccgtcgacgacgacggaactatgcgcatcaaggacgacgagaccgagaacatcctgactgtcctgctgaaaacagccctgctgatcgtctccggcatcttcccctactcgatccccgcgaccctcttagtgtggcacacctggcagaagcagacccagcggtccggcgtactgtgggacgtcccctccccgcccgagacgcagaaggccgagctagaagagggggtgtaccggatcaagcagcaaggcatctttggaaagactcaggtgggcgtgggagtgcagaaggaaggcgtctttcacaccatgtggcacgtgacgcggggcgccgtgctgactcacaacggcaagcgcctggagcccaactgggcgtctgtcaagaaagacctcatctcttacggagggggctggcggctgtccgcccagtggcaaaagggtgaggaggtccaggtgatcgccgtcgagcccggcaaaaacccaaagaatttccagaccatgcccggcatcttccaaaccacaacgggggagattggcgccattgcgctggacttcaagcccggtacctcgggcagcccgataatcaaccgcgaggggaaggttgtggggctttacggcaacggggtcgtgaccaagaacggcggatacgtctccggcatcgcccagactaacgccgagcccgacggccccactcccgagctcgaggaggagatgttcaagaagcggaacttgacgatcatggacctgcatccgggatccggcaagacacgcaagtatctcccggccatagtccgggaggccatcaagcgccgtctgcgcactctaatcctcgcgcccacgcgcgtagtagccgccgagatggaggaagcccttaaggggctgcccatccgctaccagaccaccgccaccaagtccgagcacacgggccgggagatcgtcgacctgatgtgtcacgcaaccttcaccatgcgcttactgtcaccagtgcgggtgcccaactacaacctaatcatcatggacgaggcccatttcactgaccccgcctccatcgccgcccgcgggtacatcagcacgagagtcggcatgggcgaggcggccgccatcttcatgaccgccacgccgcccggtaccgcggaggccttcccacagtccaacgcccccatccaggacgaggagcgcgacatccctgaacgcagctggaactccggcaacgaatggataacggacttcgtggggaagaccgtgtggttcgtccccagcatcaaggccgggaacgacatcgcgaactgcctgcggaagaacgggaagaaggtgatccagctgtcccgcaaaaccttcgataccgagtatcaaaagacacgcctcaacgactgggacttcgtggtgacaaccgacatcagcgaaatgggcgcgaacttcaaggccgaccgcgtgatcgacccccggcgctgtctgaagcccgtgatattgaccgacggccccgaacgagtcatccttgccgggccgatgcccgtcacggccgccagcgcggcccagcgccggggcagagtggggcggaacccccagaaggaaaatgatcagtacatttttaccggccagcctctgaacaacgacgaggaccacgcgcactggaccgaagccaagatgctgctcgacaacatcaacaccccggaggggatcatccccgcgctgttcgagcccgagcgcgagaagtccgcggccatcgacggggagtaccggttgaaaggcgagagccgcaagacgttcgtcgagctcatgcgtcgcggggatctgccagtgtggctggcccataaggtcgcgtcagagggcatcaagtatacagaccggaaatggtgctttgacggggaacgcaacaaccagatactcgaggaaaacatggacgtagagatctggaccaaggaaggcgagcggaagaagctgcgtcctaggtggttggacgcgaggacgtacagtgatcccctcgcactgaaagagttcaaggacttcgccgccggccgcaagagtatcgccctggacctcgtgaccgagatcgggcgggtcccatcgcacctggcgtaccgcacgcgtaacgccttggacaacctcatgatgctgcacacaagcgaacacggcgggcgcgcctacagacacgccgtggaggaactgccggagaccatggagacgttgctgctgctcggccttatgatcctgctcaccggcggcgccatgcttttcctgattagcggcaaggggattggaaagacctcaatagggcttatctgtgtgatcgtcagctccgggatgctgtggatggcggacgtgcccctgcaatggatcgcgagcgccatcgtgctcgagtttttcatgatggtactgctgatccccgagcccgagaagcagcggaccccgcaggacaaccagctcgcttacgtggtgatcgggattctgacactagcggcaatcgtcgccgccaacgagatgggcctcctagagactaccaagcgggacctgggcatgagcaaggaacccggcgtggtgtcaccaacgtcctatctcgacgttgacttgcatcccgcctcggcctggaccttgtacgcggtggccactaccgtgatcacaccgatgctccgccacaccatcgagaactcgacggccaacgtcagcctggcagcgatcgccaaccaggccgtcgttctgatgggcctagacaaggggtggcccatctccaagatggacctcggggtacccctgctggccctggggtgctactcacaggtgaaccccctgaccctcaccgcggcggtcctgctgttggtcacccattatgccatcatcggccctggcctgcaggccaaggctacgcgtgaggcccagaagcgcaccgcggctgggatcatgaaaaaccccaccgtggatggcatcatgaccatcgacttagaccccgtgatatacgactcgaagttcgagaagcagctagggcaggtcatgttactggtgctctgcgctgtccagctactcctcatgcggacaagctgggccctgtgcgaggccttaaccctcgcgaccgggcctatcaccacgctgtgggaggggtctccagggaaattctggaacaccaccatcgctgtaagcatggccaacattttcagagggtcctacctagccggggccggcctcgctttcagcatcatgaagtccgtgggcacgggccggcgcggcacgggaagccagggcgagacactaggggagaaatggaagaagaagcttaaccagctctcgcggaaggagtttgacctttacaagaagtccggaatcaccgaggtagaccgcaccgaggctaaggaggggctgaagcgtggagagaccacgcaccatgccgtctctcgcggctccgccaagctgcagtggttcgtggaacggaatatggtcatccccgaagggcgcgtaatcgacctcggctgtggacgcggcgggtggtcttattactgcgcgggccttaagaaggtgaccgaggtgcggggctacaccaaaggaggccccgggcacgaagagcctgtccccatgtccacctacggctggaacctcgttaagctgatgtccgggaaggacgtgttctacttgccgcccgagaagtgcgatacgttactctgcgacattggcgagagtagccccagcccgaccgtcgaggagtctcgcacgatccgggtgctaaaaatggtggagccttggctgaagaataaccagttctgcataaaggtactcaacccatacatgcctaccgtgatcgagcaccttgaacgcctgcagcggaagtacggaggaatgcttgtgcgaaacccgctatcgaggaacagcacgcacgagatgtactggatctccaacggcaccggtaacatcgtcagctccgtgaacatggtgagccgcctactcctgaaccggtttacgatgacccaccgccggcccacgatagagaaggacgtggacctgggcgccggcacccgccacgttaacgccgagcccgagaccccgaacatggatgtcatcggggagcggatcaagcgcatcaaggaagagcactcgagcacctggcactacgacgacgagaacccgtacaagacgtgggcctaccacggctcctacgaggttaaggctaccgggagcgcgagcagcatgattaatggtgtcgttaagctcctcaccaaaccctgggacgttgtgcctatggtcacccagatggctatgaccgacaccactccgttcgggcagcagcgggttttcaaggagaaggtagacacccgcacgccacggcccatgcccggcacccgcaaagtcatggagatcaccgccgagtggctgtggcggaccctcggccgtaacaagaagccgagactgtgcacacgggaggagttcaccaagaaggtacgcaccaacgcggccatgggggctgttttcaccgaggagaaccaatgggatagcgcacgggctgctgtcgaagacgaggaattctggaagctggtggaccgcgagcgggagttacacaagctgggcaagtgcgggtcctgcgtatataacatgatgggaaagcgcgagaagaagctgggggagtttggcaaggcgaagggcagccgggccatctggtacatgtggctcggggcccgctacctggagttcgaggccctaggtttcttaaatgaggaccactggttttcccgtgagaatagctactccggggtcgagggcgaggggcttcataaactgggctacatcctccgcgacattagcaagatccctggcggggccatgtacgcggacgacacggccggttgggacacccgaatcaccgaagacgacctgcacaatgaggagaagattacccagcagatggaccccgagcatcgccagctggccaacgccatcttcaagctcacgtaccaaaacaaggtggtcaaggtccagcgaccaaccccgaaggggaccgtgatggacattatctcccgtaaggaccagcgaggcagcggacaggtggggacctacggcctgaatacctttaccaatatggaggcccagctagtacgacagatggagggagaaggagtgctctccaaggcggacttagaaaacccccatctactggagaaaaagatcacccagtggctagagaccaagggggttgagcggctgaagcgcatggccatcagcggcgacgactgtgtcgtaaaacccatcgacgaccgattcgccaacgccctcctggcccttaacgatatgggcaaggtcagaaaggacatcccccagtggcagccgtccaaggggtggcacgactggcagcaggtccctttctgctctcaccacttccacgaactcatcatgaaggatggccggaagctcgtggttccctgccgcccccaagatgagctgatcggacgcgcacggatttcccaaggcgccgggtggtcactcaaggagaccgcttgcctgggtaaggcatacgcacagatgtggtccctgatgtacttccacaggcgggacctccgccttgcgagcaatgccatctgctccgcggtcccggttcactggatccccacgtcacggaccacctggagcatccatgcccatcaccagtggatgaccacggaggacatgctgaccgtgtggaaccgcgtctggatcgaggacaacccttggatggaggataagacacccgtgaccacttgggaggacgtgccgtacctcggcaagcgggaggaccagtggtgcggcagcctgatcggcctgactagccgcgcgacctgggcccagaacatcttgacagctatccagcaggtccggagcctgataggggacgaagaatttttggactacatgcctagcatgaaacgcttcagaaaggaggaggagagtgagggcgccatttggtga

SEQ ID NO: 26123 - RNA, 9873 nt, synthetic construct
  misc_feature 1..9873: note = derived and/or modified CDS sequence (opt11) from DENV-3__FJ562102__SS-prME
  source 1..9873: mol_type = other RNA
accagcctgtgtctcatgatgatgctaccggcgacactggccttccaccttacgtcccgggacggcgagccgcggatgatcgtagggaagaacgagaggggcaagagcttactgttcaagaccgcgtccgggattaacatgtgtacactaatcgccatggatcttggagagatgtgcgacgacacggtgacctacaaatgcccccttattgccgaggtggagcccgaggacattgactgctggtgcaacctcaccagcacctgggtgacttacgggacgtgtaatcaggccggcgaacaccggcgcgacaagcggtccgtggcgctggcgccacacgttggcatggggctggacacccgcacccagacatggatgtctgcggagggtgcgtggcgccaggtggagaaggtcgagacttgggccctccgccacccgggtttcaccattttagctttatttttagcccactacatcggaacctccctgactcagaaggtggtgatcttcatcctgctcatgctggtcacccccagtatgaccatgcggtgcgtgggggtgggtaaccgcgacttcgtcgagggcctctccggggcaacctgggtggatgtagtcctcgagcacggcgggtgcgtgacaaccatggctaagaacaagcctaccctggacatcgagctgcagaagaccgaggccacacaacttgcgacgttgcggaagctttgtatcgagggcaagataaccaacattaccaccgacagcaggtgtcccacgcagggcgaggccatcctcccggaggaacaggatcagaactacgtgtgtaagcacacttacgttgatcgggggtggggcaacgggtgcggcctgttcggtaagggctcgctggtgacctgcgccaagttccaatgcctcgagccaatagagggcaaggtggtccaatacgagaacctgaagtacacagtgattatcacggtgcataccggagaccagcaccaggtcggcaacgacacccagggcgtgactgtcgagatcacgccgcaggccagcaccgtggaggcagtcctgcccgagtacggtactttggggctagagtgctccccgcgcaccggcttagacttcaatgaaatgatcctgttaaccatgaagaacaaggcctggatggtccaccggcagtggttcttcgacctgcctcttccatggacgtccggcgccaccaccgagacacccacttggaaccgcaaggagctgctggtgaccttcaagaacgcccacgcaaagaagcaagaggtggtagtcttagggtcgcaagagggcgccatgcacaccgcgctgaccggggccacggagatacagaacagcggcgggacctccatcttcgcgggccacctgaaatgccgcttgaagatggacaagctagagttaaagggtatgtcttacgccatgtgcctcaacaccttcgttctgaagaaggaagtctccgagacccagcacgggaccatcctgatcaaggtggagtacaagggcgaagacgcaccatgcaagatacctttcagcactgaggacgggcaaggtaaggctcataacggccgcctgatcaccgcgaaccccgtggtcaccaagaaagaggagcccgtcaacatcgaggccgagccgccgttcggggagtctaacatcgtgatcggcattggggacaaggccctcaagataaactggtacaagaagggctcctcgatcgggaagatgttcgaagcaacggcgagaggcgcccgccggatggccatcctgggcgataccgcctgggacttcggcagcgtggggggggtgctgaattcactgggcaagatggtgcatcagatcttcgggtcagcgtataccgcgttgtttagcggcgtgtcctggatcatgaaaataggaatcggggtgctgctcacctggataggcttaaacagcaagaacacgtccatgagctttagttgcatagtgatcgggatcatcacgctgtatctcggcgcagtggtgcaggcagatatgggctgcgcgatcaactggaagggaaaggaactgaagtgcggcagcgggatctttgtgacaaatgaggtccatacatggaccgagcagtacaagttccaggcggattctccgaagcgtcttgcaacggccattgctggcgcttgggaaaatggtgtgtgcggcatccggtcaaccacccggatggaaaacctcctgtggaaacagatcgcgaacgagctaaactatatactctgggaaaacaacatcaagctgacggtagtcgtgggggacatcatcggcgtgctggagcagggaaagcgcaccctgactccacaaccgatggagttaaagtactcctggaaaacttggggcaaggcgaaaatcgtaacggctgagacccagaacagctccttcatcatcgacggccccaacacgcccgagtgtcctagcgcctcccgcgcatggaacgtctgggaggttgaggactatgggttcggcgttttcaccactaacatttggctaaagctccgcgaggtgtacacccagagctgcgaccaccgccttatgagcgcggctatcaaggacgagcgcgccgtgcacgcagacatgggctattggatcgagtcccagaagaacgggtcgtggaagctggagaaggcgtccttcatcgaggtaaagacctgtacctggcccaagagccacaccctctggtccaacggagttctggagagcgacatgatcattcccaaatccctggccggccccatctcgcagcacaaccaccggccaggctatcatacgcagaccgccggcccctggcatctcggcaaactggagctggactttaactactgcgaggggaccaccgttgtaatcacggagaactgcgggacgcgcggcccctcactcagaaccaccacagtatctgggaagctgatccacgagtggtgctgccgctcctgcaccctgccccctctacggtacatgggtgaagacggatgctggtacggcatggagattcgccccatcaacgagaaagaggaaaacatggtaaagagcctcgtctccgccggcagtgggaaggtggataacttcactatgggagtgctgtgcctagcgatcctcttcgaggaggtcatgcggggtaagttcggtaagaagcacatgatcgcgggggtactgttcactttcgtccttcttctatccggccagattacgtggcgcgacatggcgcacactttcatcatgatcggcagcaacgcctccgaccggatggggatgggcgtcacctacctcgccctgatcgccaccttcaagatccagcccttcctggctcttgggttcttcctgagaaagttgacgtctcgggagaacttactgctgggcgtgggcctggccatggccaccaccctgcagctgcccgaggacatcgagcagatggccaacgggatcgctctaggcctcatgacactcaagctcattacgcaattcgagacctaccaactgtggacagcactggtgagcctgacctgctccaacacgatctttacactgaccgttgcatggcgcaccgccacgctgattttggccggggtgagcctgctgccgctctgccagagtagctcaatgcgtaagactgactggttaccgatgaccgtagcggccatgggcgtaccgcccctccccctctttatcttctccctgaaggatactcccaaacgccgcagttggcccctgaatgagggggtgatggccgtcggattagtgagcatccttgccagttccctcctccggaacgacgtgcccatggccggcccgctggtcgcgggcgggctgctaatcgcatgctacgtgataacgggaacttccgccgacctgaccgttgagaaggctgcggacgtcacgtgggaggaggaggcggagcaaacgggagtcagccacaacctaatgatcaccgtggacgacgacgggaccatgcgaatcaaggatgatgagaccgagaacatcctaaccgtcttgttgaagacggccctcctgatcgtgtccggcatcttcccctacagcatccccgcaaccctgctcgtgtggcacacctggcagaaacagacccagcggtccggcgtcctgtgggatgtgccttcacctcccgagacgcagaaggccgagttagaggagggggtgtatcgcatcaagcagcaaggcatctttgggaagacgcaggtcggcgtgggcgtgcagaaggagggcgttttccacaccatgtggcacgtgacccggggcgcggtgcttacacacaacgggaagaggctggagcctaactgggcttcggtcaagaaagacctgatcagctatggcgggggctggcggttgtccgcccagtggcagaagggagaggaggtccaggtgatcgccgtcgagcccggcaaaaacccgaagaacttccagaccatgcccggcatcttccagacaaccacgggggaaattggcgcaatcgcgctggattttaagcccgggacgagcggcagcccgataatcaaccgcgagggcaaggtggttggactgtacggtaacggggtcgtgaccaagaatggggggtacgtatcaggaatcgcacagactaacgccgagcctgacggcccgacgcccgagctagaggaggagatgttcaagaagcggaacctcaccatcatggacctgcacccggggagcggcaagacccggaagtacctgcccgcaattgttcgggaggccatcaaacgcaggctccgcactctgatcctggcgcccactcgggtggttgccgccgaaatggaagaggccctcaagggcctgccaattaggtaccagaccaccgccactaagtccgagcatacgggccgggagatcgtagacctgatgtgtcacgcgacctttactatgcgcttgctgtctccagtgcgggtgccaaactacaacttgatcataatggacgaggcccatttcactgacccggcgtccatagcggctcgtggatatataagcacgcgtgtcggcatgggggaagcggccgccatcttcatgaccgccacgccccccggtaccgcggaagccttcccccagtccaacgcccccatccaagacgaggagcgcgacattcccgaacgcagctggaactccggcaatgagtggatcacagacttcgtgggaaagactgtgtggttcgtcccgagcatcaaggctggcaatgacatcgcgaactgcctccggaaaaacgggaagaaggtgatccagctgtcccgcaaaacatttgataccgaataccaaaagactcggctgaacgactgggacttcgtggttaccaccgacatcagcgaaatgggcgcgaacttcaaggccgaccgcgtgatcgaccccaggcgctgcctcaagcccgttatcctgacggacggccccgagcgcgtaatcctggccgggcctatgcccgtgactgccgcatccgcggcccagcggcgggggcgcgtggggcggaatccccagaaggagaacgaccaatacatcttcaccggccagccgctcaacaacgacgaggaccacgcccactggaccgaggccaagatgctgttggacaacattaacacccccgagggcatcatccccgccctcttcgaaccagagcgtgagaagtccgctgccatagacggggagtatcggctgaagggtgagtcccgaaagacattcgttgagctgatgcgacgcggggacctccccgtgtggctagcccacaaggtcgccagcgaaggcatcaagtacacggatcggaagtggtgcttcgatggggagcgcaacaaccagatactggaggagaatatggacgtggagatctggaccaaggagggagaacggaagaagctccgcccgcgctggctggacgctcggacctactcagatcccctggccctcaaagagttcaaggacttcgccgcaggccgcaagagcatcgccctggacctagtgacagaaatcgggcgtgtcccctcgcatctcgcctaccgcacgcggaatgccctcgacaatctggtcatgttacataccagcgagcacggcgggcgcgcttaccggcacgccgtagaggaactgccggagaccatggagaccctcctcctgctaggcctcatgatactgctgaccgggggcgccatgctgtttctgatcagcgggaaggggataggcaagacctccatagggttaatttgcgtcatcgttagctccggcatgctctggatggcggatgtgcccctgcagtggatcgccagcgccatcatcctggagttcttcatgatggtcctcctgattcctgagcccgagaagcagagaaccccgcaggacaaccagctggcttacgtggtgatcgggatactcaccctggccgcgatcgtcgccgcaaacgagatgggcctgctcgaaacgaccaagcgagacctgggcatgtccaaggagccgggggtggtgagccccacctcctacctggacgtggacttacacccagctagcgcctggacattatacgcggtggccacgactgtgatcaccccgatgttacgccacacgatcgagaacagcacggccaacgtcagcctcgccgcgatcgctaaccaggcagtggtgttaatgggcctggacaaggggtggcccatctccaaaatggacttgggcgtcccgctgctggccctcgggtgctacagccaggtgaaccccctgacactaaccgccgcagtgctcctgctggtcacccactacgccatcattggtccgggactccaagccaaagccacgcgggaggcacagaagcgcaccgctgccggtataatgaagaaccccaccgtagacggcatcatgacgatcgacctggaccctgttatctacgactccaagttcgaaaagcagctcggccaggtcatgctcctcgtgctgtgcgccgtgcagctcctgcttatgcggacgagctgggccctatgcgaggccttaaccctcgcgacaggccccatcaccacgctctgggagggctcaccggggaagttctggaacacgaccatcgccgtcagcatggcaaacatctttcgcggctcatacctggccggggcgggcctggcgttctcgatcatgaagtccgtagggacgggccgccggggcacggggagccagggcgaaactctcggggagaagtggaaaaaaaagctgaatcagctgagccggaaggagttcgacctttacaagaagtccggcatcacagaggtggataggaccgaggccaaggagggcctgaagcggggtgagaccacgcaccacgccgtcagccgcggctccgccaagctgcagtggttcgttgagcggaacatggtgatccccgaggggcgagtcatagacctgggctgcgggcgcggtgggtggtcatattactgcgcgggcctgaagaaggtgacggaggtccggggctacaccaagggcggccccgggcacgaggagcccgtacctatgtcgacctacggctggaacctggttaagcttatgagcgggaaggacgtgttctacctgccgcctgagaagtgtgacacgctactctgcgacatcggagagtccagcccctcacctaccgtcgaggagagccgtaccatccgtgtgctcaagatggttgagccctggctgaagaacaaccagttctgcatcaaggtcttaaatccctacatgcccaccgtgatcgagcacctcgagcgcctgcagcggaagtatggtgggatgctggtgcgcaacccgctgtcccggaacagcacgcacgagatgtactggatctcgaacggcaccgggaacattgtaagcagtgtgaacatggtaagccgcctcctactcaaccgattcaccatgacccaccggcggcctacgatcgaaaaggacgtcgaccttggggccggcacccggcacgtgaacgccgaacccgagaccccaaacatggacgtcatcggagagagaattaagcgcattaaggaggaacactcaagcacatggcattatgacgacgagaacccctacaagacgtgggcgtaccacggatcgtacgaagtgaaagccaccgggtcggcgagcagcatgatcaacggagtggtcaagctcctcaccaagccctgggacgtggtgccgatggtgacccagatggcaatgacggacaccacaccgttcgggcaacaacgggtgttcaaagagaaggtagacacacgcaccccccggcccatgcccggcacacgcaaggtcatggaaatcaccgccgagtggctgtggcggaccctggggcgcaacaagaaaccgcgcctctgcacgcgggaggagttcaccaagaaggtgcgaaccaatgcggccatgggcgcggtgtttacagaggagaaccagtgggacagcgcccgggccgccgtggaggatgaggagttctggaagctggtagaccgcgagcgggagctccataagcttggcaagtgcgggtcatgcgtgtacaacatgatgggcaagagagagaagaagctgggggagtttggcaaggctaagggcagcagggccatttggtacatgtggctgggagcccggtatctcgagtttgaggctctgggcttcctgaacgaagaccattggttctcccgggagaacagctattccggggtggagggcgaggggttgcataagctgggctatatccttcgcgacatcagcaaaatccccggcggtgccatgtatgcagacgacacggcaggctgggacacccggatcactgaggacgacctccacaacgaggagaaaatcacccagcagatggaccctgagcatcggcagctggcaaacgccatctttaagctcacgtaccagaacaaggtcgtgaaggtacaacggccgactccgaaggggactgtaatggacatcatctccagaaaggaccagcggggctcaggacaggtgggcacctacggcctcaacaccttcacgaacatggaggcccagctggttcgtcagatggagggagagggcgtgctgagcaaggcggacctcgagaatccccacttgctggagaagaagatcacacagtggctcgagaccaagggtgttgagcggctaaagcgcatggccataagcggcgatgattgtgtcgtgaagcccatcgacgatcgatttgcgaacgccctgctcgccctgaacgacatgggcaaagtgcgcaaggacataccccagtggcagccgtccaagggctggcatgactggcagcaggtccccttctgcagccaccattttcacgagctgatcatgaaggacggccggaagcttgttgtcccctgcagaccccaggatgagttgatcgggcgcgctcggatcagccagggcgccggttggagcctaaaggagaccgcctgcctcggcaaggcatacgcccaaatgtggtccctgatgtacttccaccgccgggacctgaggctcgcgtcaaatgccatatgctccgccgtccctgtgcactggatacccacgagccggaccacctggagcattcacgcccaccaccagtggatgaccacggaagacatgctgacagtgtggaaccgcgtgtggatcgaagacaacccctggatggaggacaagactcctgttaccacgtgggaggacgtgccgtatctgggcaagagagaggaccagtggtgcggatccctgataggcctgaccagccgcgcgacctgggctcagaacatcctgaccgcgattcaacaggtccgatccctcatcggagacgaggagttcctggactatatgccaagcatgaaacgcttcagaaaggaggaggagagtgagggagccatctggtga

SEQ ID NO: 26124 - RNA, 9873 nt, synthetic construct
  misc_feature 1..9873: note = derived and/or modified CDS sequence (opt11) from DENV-3__FJ410229__SS-prME
  source 1..9873: mol_type = other RNA
acgagcctatgcttaatgatgatgctgcccgcaaccctggcatttcacctcaccagccgagatggggaaccccgcatgatcgtggggaaaaacgaaaggggaaaaagtctactctttaaaacggcatccggaatcaacatgtgcacactcattgcgatggacctgggagaaatgtgtgacgacactgtcacatataaatgcccactgatagccgaagtagaaccagaagatattgactgctggtgcaacctcacgtccacatgggtcacatacggcacatgtaaccaagcaggggaacaccggcgcgacaaaagaagtgtcgctctggccccgcacgtgggaatgggtctcgacacacggacccagacgtggatgagcgcggaaggtgcctggcggcaagtcgaaaaagtcgagacttgggccctcagacaccccggcttcacgattctagccctcttcctggcccactacatcggtacaagcctaacgcaaaaagttgtcatattcattctactcatgctcgtgacacccagcatgaccatgcggtgcgtcggggtgggcaacagggactttgtcgagggcctaagcggggctacgtgggtcgacgtcgtgctagaacacggaggctgtgtcacaacgatggccaaaaacaaaccaacactggacatcgagctacagaaaacggaagcaacccaactcgcgacactccgcaagctgtgcatcgaggggaaaattacaaacattaccaccgactcgcgctgccccacccaaggtgaagccatcctccccgaagaacaagaccagaactacgtatgtaagcacacctacgtggaccgaggctggggcaacggttgcggcctgttcgggaaggggtcactcgtcacgtgtgccaagttccagtgcttagaaccaatcgaaggaaaggtagtacagtacgagaacctaaagtacacagtcatcattactgtgcacacaggagaccagcaccaagtcggcaatgacacgcaaggggtgacggtagaaatcacaccgcaagcctcgacagtagaagccgttctcccggagtacggaactctagggctagaatgcagcccccggacgggactagatttcaatgaaatgattctgctaacgatgaaaaacaaggcttggatggtacaccggcaatggtttttcgaccttccccttccgtggacgtcgggggccaccaccgaaaccccgacctggaaccgaaaagaacttcttgtaactttcaagaacgcacacgccaagaaacaagaagtcgttgtgcttggttcccaagaaggggcaatgcataccgcgctcacaggcgctacggaaatccagaactccgggggaacaagtatatttgcggggcacctcaaatgccggctcaaaatggataaactggaactgaaagggatgagttatgcaatgtgtttaaacaccttcgtactcaagaaagaagtgagcgaaacgcagcatggcacgattttaataaaggtggaatacaaaggagaggacgccccctgcaaaataccgttctcaacggaagacggccaaggtaaagcccacaacggacgtctaatcacggctaaccctgtcgtgactaaaaaggaagaacctgtaaacatagaggcagagccgcccttcggggaatcgaacatagtgataggtataggtgataaagcgctgaaaataaactggtataagaaaggtagcagcataggcaagatgtttgaggcgacagcgcggggcgcacgacgaatggccatcttaggcgacacagcgtgggacttcggaagcgtaggaggggtcctgaactccttaggcaaaatggtccaccagatcttcggatccgcttacaccgccctattttcaggcgtatcatggattatgaaaatagggatcggggtcctcttgacatggatcggactaaatagcaagaataccagcatgagtttcagttgtatcgtgatcggaataatcacactttacctaggggcagtagtgcaagccgacatggggtgcgccattaactggaaagggaaggagctgaaatgcggaagtgggatattcgtcactaacgaggtgcacacgtggacggagcagtacaagtttcaagcggacagccccaagcgcctcgcaaccgcgatagcaggagcgtgggagaatggtgtctgcggcatacgaagcaccacgagaatggaaaacctactctggaaacagatcgcaaacgagctgaattacatactgtgggagaacaatataaaactgactgtcgtggtaggagatataataggtgtcctggagcaaggaaaaaggaccttgacaccccaaccaatggagttaaaatattcctggaaaacatgggggaaagctaaaatagtgaccgcagaaacgcagaacagctcctttatcatagacggaccgaacacaccggagtgtccctccgcgtcaagagcctggaacgtctgggaggtcgaagactacggattcggcgtgttcacgacaaacatatggctaaaactacgagaggtgtatacacaaagttgtgaccataggttgatgtcagcagctattaaggacgagcgcgccgtgcacgctgatatggggtactggatcgaaagccagaaaaacgggagctggaaactagagaaagccagtttcatcgaggtaaaaacatgcacatggccaaagtcacacacgctgtggtcgaatggcgtattagaatccgacatgattatccccaagtcactagcgggaccaatctcccaacacaaccatcgacccggttatcacacacagacagccggaccctggcacctgggtaaactcgaactagactttaattactgcgagggcaccacagtcgttattacagaaaactgcggaacccgcggaccctcactaagaacaacaacagtctccggtaaactaatccacgaatggtgttgcaggtcctgtacattgccaccactcagatacatgggtgaagacggctgctggtatggaatggagattaggccgataaacgagaaagaagagaacatggtgaagtcacttgttagcgcaggctcaggaaaagtcgataacttcacaatgggggtcctgtgtctggcgatcctatttgaagaagtaatgcgtggcaaattcgggaaaaagcatatgattgccggggtgctattcaccttcgtacttttgctcagcggacagataacctggcgggacatggcacatacactgattatgattggcagcaacgcgagtgacagaatgggtatgggcgtaacttacctcgcgctcatagcaacattcaagatacaacctttccttgccctggggttcttcctacgaaaacttacgagtcgagagaacctcctactaggtgtaggactcgcgatggcaaccaccctccaactcccagaagacatagaacagatggcaaatggaatcgcactcggactaatgaccctgaaactcattactcagttcgagacataccaactgtggaccgcattagtcagcctgacgtgctcgaacacgatctttacgttaaccgtagcgtggaggacagcgacccttattctggccggcgtcagcctcctccccctttgccagtccagtagtatgcgaaaaaccgactggcttcccatgacagtagctgcaatgggggtacccccactgccactatttatcttcagcttaaaagacactccaaagaggaggtcgtggcccttgaatgaaggcgtaatggcagtaggcttagtgtcgatactagcgtcttcactactacgaaacgacgtgcccatggccgggcccctcgtcgccggcggcttgttgattgcatgctacgtgataacaggaacctcagctgatctcacggtggagaaagccgccgatgttacatgggaagaagaagccgaacagacgggtgtaagccacaacctgatgatcaccgtcgatgacgacggaaccatgcgaataaaggatgacgaaaccgagaatatcttaacggtcctactcaagacggcacttctcattgtgtctgggatcttcccgtacagtattcccgcaaccctgctagtatggcacacgtggcagaaacagacccagcgtagcggggtactctgggacgtaccgagtccacccgaaacccagaaggcggaactggaggagggcgtataccgaataaaacaacaaggcatcttcgggaagacccaggtgggtgttggcgtccaaaaggaaggtgtcttccacacgatgtggcacgtcacgagaggggcagtgttaacgcacaacgggaaacgacttgaaccgaactgggcatcggtcaagaaagaccttatcagctatggaggaggatggcgccttagcgcacaatggcaaaaaggtgaggaggtgcaagtgatcgccgtcgaaccgggcaaaaacccaaagaatttccaaacaatgccgggaattttccaaacaacgaccggcgaaatcggggcaatagcactagacttcaaacccgggacgtccggctcgcccatcatcaaccgggaaggaaaagtcgtcggactgtatggcaacggagtcgtcacaaagaacggtggatatgtcagtggcattgcgcaaacgaacgcagaaccggacggtccaactccggaactagaagaggaaatgtttaagaaaagaaaccttaccatcatggatctccacccagggtcagggaaaaccaggaaatacctgcccgccatagtaagggaggcaattaaacgaaggcttcgcaccctcattctggcaccaaccagagtggtcgccgcagaaatggaggaagcattaaagggtctgccgatccgatatcaaacaacggccaccaaaagcgagcatacgggcagggaaatcgtagacctaatgtgccacgcgacattcaccatgcgcctgctcagtcccgtccgcgttccgaattacaacctaatcatcatggacgaggcccactttacagaccccgccagcatagccgcaagagggtacatctccacacgcgtcggcatgggagaagcggcagcaatcttcatgaccgcaacacccccgggaacggccgaggcattcccccaaagcaatgcgccgatacaggacgaagaacgtgacatacccgaaaggtcatggaactcaggcaatgaatggattacggactttgtcggtaaaactgtctggtttgtaccaagcataaaagcaggcaacgacatagccaactgccttcgcaaaaatggcaaaaaggtcatccagttgagcagaaaaacattcgataccgaataccagaaaactcgactcaatgattgggacttcgtggtcaccaccgacatatccgagatgggtgcgaacttcaaggcggacagggttatagaccctcgccgatgcctgaaaccggtcatactaactgacggccctgaacgagtaattctagcaggacccatgccagtcacagcagcaagcgctgcgcaaagacgagggcgggtgggccgcaacccgcaaaaagagaacgaccagtacattttcacgggccagcctctaaataacgacgaagaccatgcacattggacggaagcaaaaatgctcttagacaacataaatacaccagaaggtatcataccagcgcttttcgaaccggagcgagaaaaatctgcggccatcgacggtgaatacaggctaaaaggagaatcccggaaaacgttcgtggaattaatgcgccggggagacctgcccgtctggttagcccacaaggtggctagtgagggcataaagtacaccgataggaagtggtgcttcgatggcgaaaggaataaccaaatcttggaagaaaatatggacgtagaaatatggaccaaggaaggcgaacgcaagaaactgcgcccgcgatggctcgacgcccgcacctatagcgacccactagctctaaaagagttcaaagacttcgccgctggacgaaagagcatagccctcgacttagtgaccgagatcgggcgcgtccccagccacttggcatatagaacccgaaacgcgctagataacttagtcatgctccacacgagcgaacatggcggcagagcttatcgacacgcagtcgaggaactcccagaaacaatggaaaccctcttactactgggactaatgatcctgctaacaggtggcgcaatgttatttctaataagcggcaaaggaataggtaaaacgtccatcggactaatctgcgtcatcgtctcaagtggaatgctttggatggccgacgtccccctacagtggattgcttcagcgataatattagagttctttatgatggtccttctaatcccagagcccgagaagcagcgaacccctcaagacaaccagctcgcctatgtcgtcatcggcattctcacgctggcggcaatcgttgcagcgaacgagatgggtctactggaaacaaccaaacgagacttaggaatgtccaaggaaccaggcgtggtaagtcccacctcctacctcgatgtcgacttacacccagccagcgcgtggaccctttacgccgttgcaacaaccgttatcacaccaatgcttaggcacaccatcgaaaacagcaccgccaacgtatcattagcagctatcgcgaaccaggcagtagtacttatgggactagacaaagggtggccgatcagcaagatggacctgggggtaccgctactagctctcggctgctacagccaggtcaaccccttgacgttgactgcggctgtactcctgctcgtaacacattacgcaatcataggtccaggtctccaggcaaaagcgacgcgggaagcacaaaaacgcacggcagcgggtatcatgaaaaacccaaccgttgacggcataatgaccatagaccttgaccctgtaatatacgatagtaaattcgaaaaacagttaggtcaagtcatgctactcgtactctgcgccgtgcaattgctgctcatgcggacatcatgggcgctatgcgaggccctcaccttggccacgggcccaatcacaacgctttgggaggggagccctggcaaattctggaacaccacgatcgcagtatcgatggctaatatattccgaggatcatacctagcaggagcgggcttagcattctctatcatgaaatccgtagggactggccggcgcggtacaggcagccaaggggaaacactaggagagaaatggaaaaagaaactaaaccagctatcacgcaaggagttcgatctctacaagaaatccggcataaccgaagtcgaccgaacagaagcaaaagagggactgaaaagaggggaaaccacccaccacgccgtgtccagaggaagcgccaaactacagtggttcgtggagagaaatatggttatcccggaaggacgggttatagacttgggttgcggccgcggcggttggagctactactgcgccggacttaagaaagtcacagaagtacggggctacacaaaaggaggaccaggacacgaggaaccggtccccatgtcaacgtacggctggaacctggtaaagctaatgagcggtaaggacgtcttctatctacccccggagaagtgcgacacactactgtgtgacatcggcgagagctcaccgagccccacggtcgaagaaagccgtaccatcagagtgctaaagatggtggaaccgtggcttaaaaacaatcagttctgcatcaaggtcttaaacccctacatgcctacagtcattgaacacttggaacgcttgcaacgaaaatacggcggaatgctggtacgcaaccctctcagtcggaactcgacccatgaaatgtactggatttcaaacggcaccggtaacatcgtaagttccgttaacatggtctcgcgcctactgttgaaccgcttcaccatgacacatcggcgtcctaccatagaaaaagacgtagacctaggagcgggaacccgacatgtcaacgcagagccggagacacccaatatggatgtcatcggcgaaagaattaagaggataaaggaagaacactcttcaacatggcactatgacgacgaaaacccctataaaacctgggcataccacggaagctacgaagtcaaagcaacagggagcgcatcaagcatgatcaatggtgtggtgaaactcctgacaaagccatgggacgtagtcccaatggttacccaaatggcaatgaccgacaccaccccattcggtcaacaaagagtttttaaggaaaaggtagacaccagaacgccaagacccatgcctggaactcggaaagtgatggagatcacagcggaatggttgtggagaacgctcgggcgcaataagaaaccacgcttgtgcacccgggaggagtttaccaagaaggtccgaaccaacgcagcgatgggtgctgtattcacggaagaaaaccagtgggactcagcccgagcggccgtggaggacgaggagttctggaagttggtggatcgcgagcgtgaactgcacaaactaggaaaatgcggaagttgcgtatataatatgatgggaaaacgagagaagaaacttggagagttcggcaaagccaaaggatcacgagccatatggtacatgtggttaggcgctcgttatttagagttcgaggcgctaggtttcttgaacgaagatcactggttcagtcgagaaaacagttacagcggcgtcgagggagaaggactacacaaactgggctatatactccgagacataagcaagataccaggcggggcaatgtacgccgacgacactgccggatgggacacacgaataacggaggacgatctacacaacgaggagaaaatcacccaacaaatggacccagaacacagacaactagctaacgctatcttcaagctgacctaccaaaacaaagtagtaaaggtccagcggccgacacccaaaggcacagtaatggacatcatatcacggaaggaccaaaggggaagcggacaagtgggcacatacggtctaaatacttttacaaacatggaggcccaactcgtgaggcaaatggaaggtgaaggagtcctcagcaaggcagacttggaaaacccacacctactggaaaagaaaatcacacaatggctcgagacgaagggagtcgagcgtttgaaaaggatggccatctctggcgacgattgcgtagtaaaaccaatagatgatcggttcgcgaacgctctattggccctgaatgacatggggaaggtacgaaaagacatcccgcagtggcaaccttccaagggttggcatgactggcaacaggtgccattctgttctcatcatttccatgagcttataatgaaagacggtcgaaagctagttgtaccatgccgtccccaagacgagctgatcgggagggcccgtatatcccaaggagcaggatggagtctaaaagaaacagcctgccttggaaaggcttacgcacaaatgtggagcctgatgtatttccacagaagggacctccgactcgcctcaaatgcgatatgctcggcagtacccgtgcactggatccccacatcaagaaccacgtggagtatacacgcgcatcatcaatggatgacaacggaagacatgctgaccgtttggaaccgagtatggatcgaagacaacccctggatggaggacaaaacaccggtcacaacctgggaagatgtaccttacttgggaaaaagggaggaccagtggtgtggcagcctaatagggctaactagccgggcgacctgggcccagaacattcttacagcaattcaacaagtaaggtcactcataggggacgaggagtttttggactacatgccctcaatgaagagattccggaaggaagaagagagcgaaggagccatttggtag

SEQ ID NO: 26125 - RNA, 9873 nt, synthetic construct
  misc_feature 1..9873: note = derived and/or modified CDS sequence (opt11) from DENV-3__FJ461326__SS-prME
  source 1..9873: mol_type = other RNA
accagtttgtgcctaatgatgatgctcccggccactctagccttccatctcacttcaagagacggagaaccccgaatgatagtaggcaaaaacgaaagaggtaaaagcctcctgttcaaaacggcgagcggcataaacatgtgcacgcttatagcgatggatctcggggaaatgtgtgacgacaccgtaacatacaaatgcccactaatagccgaagtcgaaccggaagatattgactgttggtgcaacctcacctcgacgtgggtaacttatggtacatgcaatcaagccggggaacacagacgcgacaaaagatcagtcgccctagcaccccatgtagggatgggcttagacacccgcacccaaacctggatgtctgcagaaggagcctggagacaagttgagaaagtggaaacttgggccctgcggcaccctgggttcacaatactcgccttattcctagcacattacatctcaacatcgctcacccaaaaggtagtgatttttatccttcttatgctcgtgacccccagcatgaccatgaggtgcgtaggggtgggtaacagagacttcgtggaaggactgagcggcgccacatgggtcgacgttgtcttagaacacggaggatgcgtcaccacaatggctagaaacaagcccaccctagatatcgaacttcagaagacagaggcgacgcaacttgcaacacttaggaaattatgcattgaaggaaaaattacgaatataacaaccgacagccgctgcccgacgcagggtgaggcgatactaccggaggagcaagaccaaaactacgtgtgcaaacacacatacgtagaccgcggctgggggaacggatgtggactattcgggaaagggtcgctggtaacatgcgcgaagtttcagtgcctggaaccgatagaaggaaaggtggtacaatatgagaatctgaaatacacggtcatcattacagtacacaccggagaccaacatcaagtaggcaatgacacacaaggtgtgactgtggaaataacacctcaagccagtacggtggaggcggtcttaccggagtatgggacacttggtttggaatgttccccacggacaggactcgacttcaatgaaatgatcctactcactatgaaaaacaaagcgtggatggtacaccgccagtggttcttcgacctgcccctcccatggactagcggcgcaaccaccgagaccccaacgtggaacagaaaggagctactcgtcacgttcaaaaacgcccatgcgaaaaagcaagaagtcgttgtcctaggctcacaagagggagcaatgcacactgccctcacaggtgcgacagagattcaaaactcaggaggcacatctattttcgccggacatttaaaatgcaggctaaaaatggataagctagagcttaaagggatgtcgtacgcaatgtgcctgaataccttcgtactcaagaaagaagtcagcgaaacccaacacggcaccattctaatcaaagtggaatataaaggagaagacgccccatgcaaaatacccttctcaacggaagacggccaaggcaaagcgcacaacgggcgtctgatcaccgcaaaccccgtggtcacgaagaaagaagaaccagtgaatatagaagcagagcccccgttcggagagagcaacattgtcatcggcataggggataaggccctgaaaatcaactggtataagaaaggaagttcgattggtaaaatgttcgaagcaacggcacgaggcgcccggcgtatggcgatactaggcgacacagcatgggacttcggctcagtaggtggcgtactgaacagcctcgggaagatggtccaccaaatattcgggagcgcttacacggcgctattcagtggagtatcctggataatgaaaatcggcataggagttttgttgacctggataggccttaactccaaaaacacaagcatgagttttagttgcatagtcatcggcattataacactgtacctgggggcagtggtccaggctgacatgggctgtgcaataaattggaagggaaaggaactaaagtgcggctccggcattttcgtaactaacgaagtccacacgtggaccgagcagtacaaatttcaagcggattccccaaaacgcctagccaccgcaatagcaggcgcttgggagaacggcgtatgcggcattcgaagcacaacgagaatggagaacctgctatggaagcaaatcgcaaacgaactgaattacatactatgggaaaacaacataaaattgacagtagtcgtaggagacataataggagtgctcgaacaaggcaagagaacgctgacacctcagcctatggaacttaaatactcctggaaaacctggggcaaggcaaaaatagtaaccgcggagacgcaaaactcctccttcataatagacggccccaacaccccggagtgcccgtctgcgagccgggcgtggaacgtgtgggaagtcgaggactacggattcggagtattcaccaccaatatatggctaaaactcagggaggtttatacgcaaagctgtgatcaccgcctcatgagcgcagccataaaggacgaacgcgccgtccacgcagacatgggatattggatcgaatcacagaaaaacggatcgtggaaactggagaaagcaagtttcattgaagtgaaaacctgtacgtggccgaaaagccacacactgtggagcaatggtgtactggaatccgacatgattatccccaagagcctagcgggaccaatcagccagcacaaccaccggcccggatatcatacacaaaccgcgggaccatggcacctgggcaagttagagctcgactttaactactgcgagggaacaacggtggtaataaccgagaactgtgggacacgcgggccctcactgaggacaacgaccgtttcaggcaagctcatccacgagtggtgttgccgcagctgcacactaccacccctgcgttacatgggggaagacggatgctggtatgggatggagataaggcccataaacgagaaagaggaaaacatggtgaaaagcctcgtctccgcgggatctggcaaggtagacaatttcaccatgggcgttctctgcctagccatattgtttgaggaagtaatgagaggaaaatttggcaagaaacatatgatcgccggagtcctctttaccttcgtattattattgagcggccagatcacgtggcgcgacatggcccatacactgatcatgatcggatcaaacgcatcagacaggatgggtatgggggtcacctacctcgcactaatagccacctttaaaatacaaccctttctagctctgggattcttcctgaggaaactaacctcaagagaaaacctccttctaggcgtaggcctcgccatggcgacgacactacaactgcccgaagacatagaacagatggcgaacgggatagccctaggacttatgaccctgaaattgatcacccaattcgagacctaccagttatggaccgctcttgtgtccttgacttgttcgaacacaatattcactctcacggtcgcctggcgaaccgccaccttaatcctcgccggcgttagcctattgcctctgtgccagagctccagtatgcggaaaaccgattggctaccaatgacagtagcagccatgggggtaccgcccctaccactcttcatattttcactaaaggacacccccaaaaggagatcgtggccgctcaatgaaggagtaatggccgtcgggctagtcagcatcctagctagctcgctacttcggaatgatgtcccaatggctggccccctggtggctggaggattactcatagcctgctatgtcatcacaggaacttccgcggacctgactgtcgagaaagcagccgacgtgacgtgggaagaggaagccgagcaaacaggagtaagtcataaccttatgataacagtggacgacgacggcactatgagaataaaggatgacgaaaccgaaaacatcttaaccgtactactaaaaactgctctcctcatagtatcaggcatatttccatactcaataccagcaaccctactcgtgtggcacacttggcaaaaacagacacaaagaagcggagttctgtgggacgtcccatcacccccggagacccaaaaggcagaactagaagaaggagtataccgaataaagcaacaggggatcttcggaaaaacgcaggtaggagtcggcgtccaaaaagaaggagtgtttcatacgatgtggcatgtaacccgaggtgcggtcctgactcacaacgggaaacggctcgagcctaattgggcttccgtgaaaaaggacttgatcagttacggaggagggtggagactcagcgcacaatggcagaaaggcgaggaggtccaggtaatagcagtcgaacccggcaaaaaccccaagaactttcaaacgatgcctggtatcttccaaacaactacgggcgaaataggggcaatagccctcgacttcaaaccgggcacaagcggaagcccaattataaatagagaaggcaaagtagtgggactatacgggaacggggtggtcactaaaaacggcggatatgttagcggcatagcgcaaacaaacgccgaaccagatggcccgacccccgaactagaggaggagatgttcaagaaacgtaacctgacaattatggacctccatccggggagcgggaagaccagaaaatatctaccggctatagtaagagaagcgatcaaacggcgcttgcgcacattaatccttgcgccaacacgagtcgtcgcggcagaaatggaagaagccctgaaaggcttaccaatccgctaccaaacgactgccacaaaatcagaacacacgggacgagagatcgtcgacttaatgtgccacgccacgttcacgatgcgccttctaagcccagtgcgcgtacccaactacaacttaatcataatggatgaggcacactttacagaccccgcatcgatcgccgcacgcggctacatatcaacccgagtcggaatgggagaagcggcggcaatttttatgacagcgaccccgcccggcaccgctgaggcattcccccagtcaaacgcgccgatccaagacgaagagagggacatccccgaaagatcctggaactcagggaacgaatggattacagacttcgttggcaaaacagtgtggtttgtcccgtccatcaaagcgggcaatgatatcgccaactgccttagaaagaacgggaagaaagttattcagttgtcccggaaaaccttcgacactgaataccagaaaacaaggttgaacgactgggacttcgtcgttactaccgatatcagcgaaatgggcgcgaatttcaaagccgatcgagtcatagatccacgccgatgcctgaaaccggtaattctgacggacggacccgaaagagtcattttggcagggcccatgccagtgacggcggcttcagcagcccaacggcgaggacgggtgggacgcaacccacaaaaagaaaacgatcagtacatattcacaggccagccactgaacaacgacgaagaccacgcacactggaccgaagcaaaaatgctgttggacaatatcaacaccccggaaggcattatacctgcattattcgaacccgaaagggagaaatccgccgccatcgatggagaatacagactaaagggagagtccaggaagacttttgtcgagttaatgcgcagaggggacctccccgtgtggctcgcccataaggtagcaagcgaaggcatcaaatacactgatcgcaagtggtgttttgacggggaacggaacaaccaaatcctagaagagaacatggacgtagagatatggaccaaagaaggagagcggaaaaagctaaggcctcgatggttggacgcccgtacttattcagatccactggcacttaaagagtttaaagacttcgcagctggcagaaaatcaatagcactagacctggtcaccgaaataggacgcgtaccgagtcacctcgcataccgcacgcgtaatgcattggacaatctggtaatgctccacacaagcgagcacggaggccgtgcgtacaggcacgccgtagaagaactccccgaaacaatggaaaccctcttactactgggcttaatgatcttactgaccggtggcgcgatgctatttctcataagcggcaaagggattggaaagacctcaataggactaatctgcgttatagcatcatcgggcatgctctggatggccgacgtcccattgcagtggatagcgagtgccataattctcgagttcttcatgatggttctgctaattccagaacccgaaaaacaacgaaccccacaagacaaccagctcgcatacgtcgtgataggcatactaacgctggccgcgattgtggccgcaaacgaaatgggtctcctggaaaccacaaagcgcgacctgggcatgagcaaagaacccggagtcgttagcccgacctcatacctcgacgtcgacctacaccccgcgagcgcatggactctttatgccgtcgccacgaccgtgatcacgcccatgctcagacacacaatcgaaaattctaccgctaacgtgtcgctagctgcaattgctaaccaggccgtagttttgatgggcctcgacaagggttggccaatcagcaaaatggacttaggcgtcccgctactggcactaggctgctactctcaagtaaaccccctgacccttaccgcggccgtactacttctggtgacacactacgcaataataggacccggactccaggcaaaagcaactcgggaagcccaaaaacgaacagccgcaggtatcatgaaaaacccgacagtcgatgggatcatgacaatagatcttgatccagtgatatacgacagcaaatttgagaaacaactcggacaagtgatgttgctagtactatgcgctgtccaactactactcatgcgcacaagctgggcactatgcgaggcactcacgctggctacaggacccatcaccaccctgtgggaaggaagccccggaaagttctggaacacaaccatcgcggtctccatggccaacatcttccgcggaagttacctagcaggcgcagggctcgcgttcagcataatgaaatccgtaggtacggggagacgggggactgggagccagggagaaacactgggcgagaagtggaagaagaaactaaaccagcttagtagaaaggagttcgacttgtacaagaaaagcgggattacggaagtggaccggaccgaagcaaaagagggacttaaacgaggcgaaaccactcaccatgccgtcagccgggggtcagccaaactgcaatggtttgttgaaaggaacatggtcattccggagggtcgcgtcatcgaccttgggtgcggccgcggtggatggagttactactgcgcgggacttaaaaaggtgaccgaggtacgcggctacaccaaaggcggaccagggcacgaagaaccggtaccgatgtcaacctacgggtggaacctggtaaaactaatgagtgggaaggacgtcttttacctgccgccagaaaaatgcgacactctactgtgcgacatcggggaatcaagtccgtcaccgacagtggaggagtcccgaacgattcgagtcctaaaaatggtagaaccatggctgaaaaataaccagttttgcattaaagttctcaatccgtacatgccaaccgtcatagaacacttggagagacttcaacgtaagtacggtgggatgctagtcaggaatcccttaagccgcaacagcacacatgaaatgtactggataagcaacggaacaggcaatatagtaagctcggtaaatatggtgtctcgtctgctgctcaacaggttcaccatgacacacagacggcccacaatagaaaaagatgtcgatctcggagcaggaacccgacacgtcaacgctgaacctgagacgccaaacatggatgtcataggcgaaagaataaagagaatcaaagaggaacactcatccacatggcattatgacgacgaaaatccatacaagacttgggcataccacggcagctacgaagtgaaagccacgggaagcgcctcctctatgataaacggggtcgtcaaactactcactaaaccgtgggacgtcgtccccatggttacgcaaatggcaatgaccgacaccactcccttcgggcaacaacgcgttttcaaagagaaggtagacactagaaccccacgaccaatgcccggcacacggaaagtgatggaaataacggccgaatggctgtggaggaccctagggagaaacaagaaaccgcgactgtgtacgcgagaagagttcaccaagaaggtgcgaaccaacgcagcaatgggagccgtcttcaccgaagaaaatcaatgggactcagcccgagcggcagttgaagatgaagagttctggaaactcgtagaccgagaaagagagctgcacaaactaggtaaatgcggtagctgcgtttacaacatgatgggaaagcgtgagaagaaattaggagagttcggaaaggcgaagggcagccgggctatctggtacatgtggctaggcgcgcgatacctcgagttcgaagcgctaggtttcttaaacgaggaccattggttcagcagagaaaattcctattccggcgtggagggagaagggctgcacaaactaggctacattctccgagacatctcgaagatacccggtggcgccatgtacgcagatgacacagcaggctgggacacaagaatcaccgaggacgacctacacaacgaagagaaaattacacaacaaatggacccagaacatcgaaaactggcgaacgcgatattcaagttaacctaccaaaacaaggtcgtaaaagtacagaggcccacaccgaaaggcacggtaatggatataataagtagaaaggatcagaggggcagcgggcaagtaggcacgtacggcctgaacacgtttacgaacatggaagcgcaactggtccggcaaatggaaggcgagggagtactttccaaggcagacctagaaaacccccacttactagagaagaaaatcacgcaatggctagaaactaaaggagtcgaacgactgaaaaggatggctatatcaggcgatgactgcgtcgtaaagcccatagatgaccgattcgctaacgcactcctcgccctgaacgacatgggcaaagttagaaaggacataccccaatggcaaccatcaaaagggtggcatgactggcaacaggtacccttctgttcacaccacttccacgagctcattatgaaggacgggcgcaaacttgttgtaccatgcaggccccaagatgagttgatcggccgagcacggatctcacagggcgccgggtggagcctcaaagaaacggcgtgtctgggcaaggcttatgcccagatgtggagccttatgtatttccatcggagagatttgagactcgcatccaatgcaatatgcagtgccgtaccagtgcattggataccaacgtcacggacgacatggagcatccacgctcaccaccagtggatgaccaccgaagatatgctcacggtgtggaatcgggtgtggatagaagataatccctggatggaagacaaaactcctgtaacgacatgggaagatgtgccatacctcggaaagcgcgaagaccaatggtgcggctcactgatagggcttacgagccgcgcaacttgggcacagaacatattgacggcaattcaacaggtccgtagcctgataggtgacgaggagttcctagactacatgccgtctatgaagcgattcaggaaggaagaggaaagcgaaggggcaatctggtaa

SEQ ID NO: 26126 - RNA, 9873 nt, synthetic construct
  misc_feature 1..9873: note = derived and/or modified CDS sequence (opt11) from DENV-3__FJ461329__SS-prME
  source 1..9873: mol_type = other RNA
acctctctgtgcctcatgatgatgcttcccgccactcttgccttccacttaacaagccgggacggagagccacggatgatcgtggggaagaacgaacgcggcaagagcttgctgttcaagaccgcgtccgggatcaacatgtgtaccctcatcgccatggacctgggcgagatgtgcgacgacaccgtgacgtacaagtgccccctgattgcggaggtagagcccgaagacatcgattgctggtgcaacctcacaagtacctgggtgacctacgggacttgtaaccaggccggcgaacaccggcgcgacaagcggtccgtggccctggcgcctcacgtagggatgggactggacacccgcacccagacctggatgagcgccgagggcgcgtggcgccaggtagagaaggtcgagacgtgggccctccgccatccgggttttacaatcctggcgcttttcctcgcgcactacatcggcacctccctgacccagaaggtggtgatatttattctgctcatgctggtcaccccctccatgaccatgcggtgcgtgggggtgggcaaccgcgacttcgtcgagggcctgtccggggccacatgggtagacgtcgtcctcgagcacggcgggtgtgtgaccacgatggccaagaacaaaccgaccctggatatagagctgcagaaaaccgaggccacgcagctcgccacgctacggaagctgtgcatcgagggcaagatcacgaacatcaccacagacagcaggtgccccacgcagggagaggccatactcccggaggagcaggaccagaactacgtttgcaagcacacctacgtcgaccgcggctggggtaatgggtgcggcctgttcgggaaaggttccctggtcacctgcgcgaagttccagtgcttggagcccatagagggcaaggtggttcagtacgagaacctgaagtacacggtgatcatcacggttcacaccggggaccagcatcaggttggcaacgatacccagggagtaacagtcgaaatcactccccaggccagcaccgtggaggccgtgctgcccgagtacggcacccttgggcttgagtgctcgccgcgcaccggcctggacttcaatgagatgatcctgctcactatgaagaacaaggcgtggatggtacaccgtcagtggttcttcgacttacctttgccctggacgagcggagccaccactgagacacccacgtggaaccgcaaggagctgctggtgacctttaagaatgcccacgccaaaaaacaggaggtggtcgttttggggtcccaagagggcgccatgcacaccgcgctgacaggggccacggaaatccagaacagcggagggacctccatattcgctggtcacctgaagtgccggctcaagatggataagctggagctgaaaggtatgagctatgccatgtgtctcaacacctttgtgctgaagaaggaggtttcagagactcagcacgggactatcttaatcaaggtggagtacaaaggcgaggacgcgccttgcaagatccccttcagcaccgaggatgggcaaggtaaggctcacaatggccgcttgattaccgcaaaccccgtggtcaccaagaaggaggagcccgttaacatcgaggccgagccgcctttcggggagtcgaacatcgtgataggcattggtgacaaggcgctcaaaatcaactggtacaagaagggctccagcatcgggaagatgttcgaggctacggcacggggcgcccgccgtatggccatcctgggcgacaccgcatgggatttcgggagcgttggcggggtgcttaactcgcttggtaagatggtgcaccagatctttgggtccgcatacaccgccctgttctcaggcgtcagctggatcatgaagatcggcatcggcgtacttctcacctggatcggattaaactcaaagaacacgtccatgagcttctcctgcatcgtgattgggataattacactatacctgggcgccgtcgtgcaggccgacatggggtgtgccatcaactggaagggcaaggagctgaagtgcggcagcgggatcttcgtgaccaacgaggttcatacctggacggagcagtataagttccaggcggattctcccaagcgactggctaccgccatagccggcgcctgggagaacggggtgtgcggcatcagaagcaccacccgtatggagaacctcctgtggaagcagatcgcgaatgagctgaactatatactctgggagaacaacatcaagctcacggtggtcgtgggggacatcatcggagtgctcgagcagggcaaaaggacattaacgccccaacctatggagctgaagtactcctggaagacctggggcaaggcaaagatcgtcacggccgagacacagaatagctccttcatcatcgacggccccaacacgcccgagtgtcccagcgccagtcgggcgtggaatgtttgggaagtggaagactacgggtttggtgttttcaccacaaacatctggctgaagctccgcgaggtgtacactcaaagctgtgaccaccggcttatgtctgccgccatcaaggacgaacgcgccgtgcatgccgatatgggctactggattgagtcccagaagaatgggagctggaagctggaaaaagcatccttcattgaggtcaaaacgtgcacctggcccaagagccacaccctctggagcaacggcgtcctggagtccgacatgatcattcccaagtcgttagcggggcccatcagccagcacaaccaccggccgggctaccacacgcagaccgccgggccctggcacctaggaaagttagagcttgatttcaattattgcgaaggcaccaccgtggttatcacggaggattgcgggaccagaggcccctccctccggaccactacggtaagcgggaagctaatccatgaatggtgttgcagatcctgtacactgccccccttgcggtacatgggcgaggacgggtgctggtacggcatggaaatccgccccatcaacgagaaggaggagaacatggtaaagtcactggtgtccgccggaagcgggaaagtagacaacttcacgatgggcgtgctatgccttgccatcctgtttgaggaagtaatgagaggtaagttcggcaagaagcacatgatcgctggggtgctatttacttttgtcctcctgctctccggccagatcacctggagggatatggcccacaccctcatcatgatcggcagcaacgccagtgaccggatggggatgggggttacctacctggccctgatcgccacgttcaagatccagccattccttgcgctggggttctttctgcgcaagctcacgagccgggaaaacctgttgctcggagtaggcctggccatggccaccacccttcaattacccgaggacatcgagcagatggctaacgggatcgcgctgggcctgatgaccctcaagctgatcacgcagttcgaaacctaccagctgtggacggccctcgttagcctgacctgcagcaacacgatatttaccctgactgtagcctggcgcaccgccactctcatcctggccggtgtgagcctgctcccgttgtgccagtccagctccatgcggaagaccgactggctgcccatgaccgttgccgcgatgggagttccgccactgcccctgttcattttcagcctgaaggacacgcccaagaggcgctcctggcccctcaacgagggggtgatggccgtgggccttgtgagcatcctggcctccagcctcctgcgaaatgatgtacccatggctgggccgttggtagccggcgggttgttgatagcctgctatgtgatcacggggacctcagcggacctcaccgtcgaaaaggccgccgatgtcacgtgggaggaggaagcggaacaaacgggcgtgagccacaacctcatgatcaccgtcgacgacgacgggacgatgcgcatcaaggacgatgagaccgagaacatcctgacggtccttctcaagactgcgctgctgatcgtttccggcatatttccctactcgataccggcgaccctactggtgtggcacacctggcagaagcagacccagcggtccggcgtcctgtgggatgtgccctcacctccagagacccagaaggctgagcttgaagagggggtgtaccgcataaaacagcagggcatcttcgggaagacccaggtcggggtcggggtgcagaaggagggagtctttcacacaatgtggcacgtgactcgtggggcggtgcttactcacaacggaaagcgactagagcccaactgggcttcggtcaagaaggacttaatcagctacggcggtggttggcggctgtcagcccagtggcagaaaggggaggaggtccaggtgatcgccgtcgagcctggcaagaatccgaagaacttccaaaccatgcccggcatcttccagaccaccacgggggagatcggagccatagccctggactttaagcccgggaccagcggcagcccgataataaaccgcgagggcaaggtagtagggctgtacggtaacggggttgtgaccaagaatggcgggtacgtgtccgggatcgcccagactaacgccgagcccgacggtcccacgcccgagctcgaagaggaaatgttcaagaagagaaacctgaccatcatggatttgcacccgggcagtggcaagacccgtaagtatctccccgccatcgtccgggaggccatcaagcgccggctccgcactcttatcctcgcgcccacacgcgtggtggctgccgaaatggaggaggcgttgaagggcctgcccatccgctaccaaaccaccgccaccaagtccgagcacacgggacgcgagatcgtcgacctcatgtgccacgcgacattcaccatgcgcttgctatccccggtgcgggtgcccaactacaacctcatcattatggatgaagcccatttcaccgaccccgcctccatcgcagccagagggtacatctctacgcgggtcggaatgggcgaggcggccgccatcttcatgaccgcgacgccgccgggaaccgcggaagcgttcccccagtccaatgcgcccatccaagatgaggagcgtgatatccccgaacgcagctggaactctggcaacgagtggattactgacttcgttgggaagaccgtttggttcgtcccctcgatcaaagccgggaacgacatcgccaattgccttcggaagaacggaaagaaagtgatccagctttcccgcaaaactttcgacaccgaataccagaaaacgcggctcaacgactgggatttcgtggttacaaccgatataagcgaaatgggcgctaacttcaaggccgaccgagtaatagacccccggcgctgtctgaagcccgttatcctgactgacgggcccgagagggtcatcctcgccgggcccatgccggtgacagccgcctccgcggcccagcgccggggcagagttgggcggaacccccagaaggagaacgaccagtatatcttcacaggtcagcccctgaacaacgacgaagaccacgcccattggaccgaggccaagatgctgctcgataacatcaacacaccggaggggatcatcccagctctgtttgagcccgagcgcgaaaagtccgcggctatcgacggcgagtaccggctgaagggagagagtaggaagacattcgttgaactcatgcggcgcggggacttgcccgtttggctggcccacaaagtggcaagcgagggcatcaaatacacggaccggaagtggtgtttcgacggtgagcggaacaaccagatcctcgaggagaacatggacgttgagatttggactaaggagggcgagcggaagaagctgcgcccgcgatggttagacgcccgcacttactccgacccgctcgccctgaaggagtttaaagactttgcggccggacgcaagagcattgcgctggatcttgtgaccgagatcggtcgggtcccctcccacttggcataccgcacgcggaacgcactggacaacctcgtcatgctccacaccagtgagcacggcgggcgcgcctaccggcacgccgtagaggagctgccggagaccatggagaccctcctgctactcggcctgatgatcttattaaccggaggagctatgctgttcttgatctcgggcaagggtatcggcaagacgtccatcgggctcatttgcgtgatcgtgagctccggcatgctgtggatggcggacatccccctgcaatggatcgccagcgctatagtgctagagttcttcatgatggtgttacttattccggagcccgagaaacaacgcaccccacaagacaaccagttggcttacgttgtaatcgggatactgactctggccgcgatcgtcgcggctaacgagatgggcctacttgagacgaccaagcgggacctgggaatgtccaaagagcccggtgtggtgagtcccacctcctatctcgacgtcgatttgcacccagcctcagcctggactctgtatgcggttgccaccacggtgatcaccccgatgctccgccacaccatcgagaacagcacggccaatgtcagcctggcggcgatcgccaaccaggccgtggtcctgatgggcctcgacaaggggtggcccatctccaagatggatctgggggtccccctgctcgccctggggtgctactcccaggtaaatccgctgaccctcacagccgcggtgctgctgctcgttacccactacgccatcataggcccgggcctgcaagccaaggccacgcgggaggcccagaagcgcacagcggctggaatcatgaagaaccccaccgtggacggaatcatgaccatagaccttgatcccgtgatctatgacagcaagttcgagaagcagcttgggcaggtaatgctgctggtgctctgtgcagtgcagctgctactcatgaggacgtcctgggctctgtgcgaggctcttaccctcgcgaccggccccataacaacgctgtgggaaggttcaccgggtaagttctggaacaccaccatcgccgtcagcatggctaacatcttccggggctcctacctggccggggcgggtctcgcctttagcattatgaaatccgtgggtaccggccgccgtggaacgggatcacagggcgagaccctgggggagaagtggaagaagaagctgaatcagctcagccggaaggagttcgacctatacaagaagtccggcatcaccgaggtggaccgtacagaagccaaggagggtctgaagcggggcgaaaccacacaccacgccgtcagccgtggctccgccaagctccagtggttcgtggagcggaacatggtgatcccagaagggagggtgatcgatctgggctgcggacgaggcggatggagctactactgcgcgggtctgaagaaggtgaccgaagtacggggctacaccaagggcggtcccgggcacgaggagccggtcccaatgtccacctacggctggaacctcgtaaagctgatgagcggtaaggacgtgttctacctgcctccggagaagtgcgacacgctactctgcgacattggcgagtcaagcccttctccgacggttgaggaaagccgcaccatccgggtgctgaagatggtagagccatggctgaagaacaatcagttctgcatcaaggtcttgaacccctacatgcccaccgtaatcgaacaccttgagcgcctgcagcggaagtatggagggatgcttgtaagaaacccgctctcaaggaacagcacgcacgagatgtactggataagtaacggcaccgggaacatcgtcagctccgtcaacatggtgagcaggctgctcctgaaccggttcaccatgactcaccggcggcccacgatcgagaaagatgtcgacctgggggcaggcacgagacacgtaaacgccgagcccgagaccccgaacatggatgtcataggggagcgaatcaagcgcataaaggaggagcactccagcacctggcactacgacgacgagaatccctacaagacgtgggcctaccatggctcctacgaggtgaaggccactggcagtgcctcctccatgatcaacggtgtggtcaagctcctcaccaaaccttgggatgtggtacccatggtaacccagatggcaatgacggacaccaccccgttcgggcagcagagagtgttcaaagagaaggttgacacccgcacgccccggccgatgcccggcaccaggaaggtaatggagatcaccgccgagtggctttggagaaccctcggccgcaacaagaaaccacgcctctgtacgcgggaagaattcaccaagaaagtgcgcaccaacgccgcgatgggggcggtgtttaccgaagagaaccaatgggacagcgccagagctgcagtcgaggacgaggagttctggaagctggtggaccgcgagcgggagctacacaagctgggcaagtgcgggagctgcgtgtacaacatgatggggaagcgcgagaagaaactgggggaattcggcaaggcgaagggcagccgggccatctggtacatgtggctaggagcccgctacctggagttcgaggccctgggcttcctcaatgaggaccactggttctcgcgggagaacagctacagtggggtcgaaggcgagggactgcacaagctaggctacatcctccgcgacattagcaagatccccggcggcgccatgtatgcggacgacacggccggctgggacacgcgaatcaccgaggacgatctgcacaacgaggaaaagataacccagcagatggacccagagcaccgccagctggccaacgctatctttaagctcacgtaccagaacaaggtggtgaaggtccaacgccccacaccgaaggggacagttatggacataatctcacgcaaggaccagcggggttccggccaggtggggacctatggcctaaacaccttcacgaacatggaggcgcagctcgtgcgccagatggagggggagggggtgctctcaaaggcggacctggagaacccccacctcttggagaagaagataacccaatggctggagaccaagggggtggagcggctgaagcgcatggctatcagcggcgacgactgcgtcgtgaaaccgattgacgaccgtttcgccaacgccctcctcgccctgaacgacatgggaaaggtaagaaaggacatcccccagtggcagccgtccaaagggtggcacgattggcagcaggtccccttctgcagccaccattttcatgagctcattatgaaggatggccggaagctagtggtgccctgccgcccccaggacgagctgatcgggcgtgcgcgcataagccagggcgccggttggtctttaaaagagaccgcctgcctgggtaaggcctatgcccagatgtggtcgttaatgtacttccatcgtcgggatctccgcctggcaagtaacgccatctgctccgcagtccctgtgcactggatcccgacttctcggaccacctggagcatccatgcccaccaccaatggatgaccacggaggacatgctgaccgtgtggaaccgcgtctggatcgaagacaacccctggatggaggacaagacccccgtgactacatgggaggacgtgccgtatctaggcaagcgggaggaccagtggtgtggttccttaatcggccttacctcccgcgcgacatgggcccagaacatcctaaccgccatccagcaggtgcggtcattgattggaaacgaggagttccttgactacatgcccagcatgaaacgcttccggaaggaggaggagtccgagggggccatctggtag

SEQ ID NO: 26127 - RNA, 9873 nt, synthetic construct
  misc_feature 1..9873: note = derived and/or modified CDS sequence (opt11) from DENV-3__KF955459__SS-prME
  source 1..9873: mol_type = other RNA
accagcctgtgcctcatgatgatgctgcccgccaccttagcatttcacctcacttcgcgggacggcgaaccgcggatgattgtggggaagaacgaacgcggcaagtccttactgttcaagaccgcgagcgggatcaacatgtgcaccctaatcgccatggacttaggcgagatgtgcgacgacacagtcacctacaagtgccccctgatcgccgaggtcgaacccgaggatatcgactgctggtgcaatttgaccagcacctgggtgacttacgggacctgcaaccaagccggcgagcacaggcgcgacaagcgctcggtggccctggcaccccacgtgggtatggggcttgacacccgcacccaaacctggatgagcgccgagggcgcctggcgtcaggttgagaaggttgagacgtgggccctccgccacccggggttcaccatcctggcgttatttctcgcccactacatcggcacctccctgacccaaaaggtggtgatcttcatcctgctcatgctggtcacgcccagtatgaccatgcggtgcgtaggtgtgggcaaccgcgacttcgtcgagggcctgtccggggcgacctgggtggacgtggtcctcgagcatggcgggtgcgtgaccacgatggctaagaacaagcccaccctcgacattgagctgcaaaagaccgaggccacccagctcgcgaccctgcggaagctgtgcatcgagggtaagatcacaaacatcaccactgactcccggtgtcccacgcagggcgaggccatcctccccgaggagcaggatcagaactacgtctgcaaacacacctacgtagaccgcgggtgggggaatgggtgcggcttgttcgggaaggggtccctggttacctgtgccaagttccagtgtctcgaacccatagaggggaaggtggtccagtacgagaacctgaagtacaccgtgatcatcacggtgcacaccggggaccagcatcaggtcggtaacgacacccaaggggtgaccgtggagattacgccccaagcgagcaccgtggaggccgtactacctgagtacggcacactcgggctggagtgctccccgcgcaccgggctcgacttcaacgaaatgatcctcctcaccatgaagaacaaggcgtggatggtccaccgtcagtggttcttcgacctgccgctgccctggacgtctggcgccacaaccgagacacccacgtggaaccgcaaggagctgctggtcacgttcaagaacgcccacgctaagaaacaagaggtagtcgtgctggggtcgcaggagggcgccatgcacaccgcactgacaggggccacggagatccagaacagcggagggaccagcatattcgcaggacacctaaagtgtaggctcaaaatggacaaacttgagctgaaaggtatgagctacgccatgtgcttgaataccttcgtgctgaagaaggaggtttcagaaacacagcacgggacgatcctgatcaaggtagagtacaagggcgaggatgccccttgcaagatccccttcagcaccgaggacgggcagggcaaggcgcacaatggacgactgatcactgcgaaccccgtggtcaccaagaaagaggagcccgtaaatatcgaggccgagccaccctttggggaatcgaacatcgttataggcattggggacaaggccctcaagatcaactggtacaaaaagggctccagcattgggaaaatgtttgaagcgacagcccggggcgcgcgcaggatggctattctgggcgacaccgcttgggacttcgggagcgtgggcggagtgctgaacagccttggcaagatggtgcaccagatcttcgggtccgcgtacacggccctattctctggagtcagctggatcatgaaaatcggcatcggggttcttttgacctggatcggattgaacagtaagaacacctccatgtcattttcctgcatagtgattgggatcatcaccctgtacctgggcgccgtagtgcaagcagacatggggtgcgccatcaactggaagggaaaggaactgaagtgtggcagcgggatcttcgttaccaatgaggtccatacctggacggagcagtataagttccaggcggactcccccaagagactagcgaccgccattgccggcgcctgggagaacggggtatgcgggatccggagcgcgacacggatggagaacctcttgtggaagcaaatcgcgaatgagctgaactacatcctatgggagaacaatatcaaactgaccgtggtcgtgggggacatcatcggcgtgctggagcagggcaaaaggacgctcactccccaaccgatggagctgaagtattcatggaagacctgggggaaggccaaaattgttaccgctgaaacgcagaacagcagtttcatcatcgacggccccaacacccccgagtgccccagcgcgtcccgggcctggaacgtgtgggaagtcgaggactacgggttcggcgttttcactaccaatatctggttgaagctccgggaggtatacactcagagctgcgatcaccggttaatgagtgccgccatcaaggacgagcgcgccgtccacgcggacatggggtactggattgagtcccagaagaacggaagttggaagctggagaaggcttccttcatcgaagtgaagacgtgcacctggcccaagagccacacgctctggtccaacggcgtgttggagagcgacatgatcatccccaaatccctggcagggcccatctcacagcacaaccaccgaccgggctatcacacacagacggccggaccctggcacctcgggaagttagagctggacttcaactactgcgagggcaccacagtggttattaccgagaactgcggtacgcgcggcccctccctgcggactaccaccgtgtcagggaagctgattcacgagtggtgctgccgctcgtgcacgctgccacccctccggtacatgggggaggacgggtgctggtacggcatggagatcaggcccattaatgagaaggaggaaaacatggtcaagagcctagtcagcgcgggctcggggaaggtggacaacttcaccatgggagtgctgtgcctagcgattctgttcgaggaggtgatgcgggggaaattcggcaagaaacatatgattgctggcgtcctgttcaccttcgtgctactgttatccggccaaatcacctggcgcgacatggcgcacacactcatcatgatagggagcaacgcctccgaccggatggggatgggcgtcacctatcttgccctgatcgcgacgttcaagatccagcccttcctcgccctggggttctttctgagaaagctcacaagccgggaaaacctgctgctcggcgtgggcttggccatggccacgaccctgcaactccccgaggacatagaacagatggcgaacgggatcgccttgggcctgatgaccctcaagctgattacgcagttcgagacgtatcagttatggaccgccctcgtgtcgttaacttgttcgaacaccatcttcacgctgaccgttgcctggcgcaccgccaccctcatcctggcgggcgtgtctctgctaccgctgtgccagtccagttctatgcggaagacggattggctgcccatgaccgtggccgccatgggcgtgccgcccctgccactcttcatcttcagcctgaaggatacccctaagcgacgctcatggccgctaaacgagggggtgatggccgtcggactggtgagcatcctggcatccagcctcctacggaatgacgtgcccatggcgggaccgctggtcgccgggggcctcctgatcgcctgctacgtgattaccgggacgtccgccgatctgaccgtggagaaagccgcagatgtcacgtgggaggaggaggccgagcagaccggcgttagccataacctcatgatcacggtggacgacgacggcacgatgagaatcaaggacgatgaaactgagaacatcctaaccgtcctactcaagaccgcactgttgatcgtgtccggcatctttccctactcaatccccgcgacgctcctggtgtggcacacctggcaaaagcagacccagcgttccggcgtcctgtgggacgtgcccagcccgcccgagacccagaaggcagagctcgaggagggggtgtacagaatcaagcagcagggcatatttgggaagacccaagtcggcgtgggggtgcagaaggagggcgtcttccacactatgtggcatgtcacccggggcgccgtgctgacccacaacggaaagcgactggagcccaactgggcctccgtcaagaaggacctcatctcctacggcgggggctggcggttgtccgcccagtggcaaaagggggaggaggtccaggtgatcgctgtcgagcccgggaaaaatccgaagaatttccagacgatgcctggcatattccagaccaccaccggggagattggcgcgatagccctggactttaagcccggtacgagcggcagcccgatcatcaacagggagggcaaagtggtgggcctgtacggcaatggggtggtgaccaagaatggagggtacgtgtccggcatagctcagaccaacgccgaacccgacgggcccaccccggagctcgaggaagagatgttcaagaagagaaacctgacgatcatggacctgcacccggggagcggcaagacccgcaagtacctccccgccatcgtccgggaggcgatcaagcgccgactccgcacactgatactcgcccccacacgtgtggtggccgccgagatggaggaggccctgaaaggcctgcccatccgctatcagacgactgctaccaagtcagagcacaccggccgcgaaatcgtcgacctcatgtgtcacgccacatttaccatgcgactgctaagccccgtgagagtgcccaactacaacctcatcatcatggacgaggcgcacttcaccgatcccgcctccatcgctgcgcgtggatacatcagcactcgtgtcggaatgggcgaagccgccgccatctttatgacagcaacgccgcctgggactgctgaggcctttccccagtccaacgccccgattcaggatgaggagcgtgacatacccgagcgctcatggaactccggcaacgagtggatcacggatttcgtggggaagacagtgtggttcgtaccgagcatcaaggccggcaacgatatcgcgaactgcctgcgtaagaatgggaagaaagtgattcagcttagccgaaagacctttgataccgagtaccagaaaacccggctcaatgactgggatttcgtggtcacgaccgacatcagcgagatgggcgctaactttaaggccgaccgcgtgatcgacccccggcgctgccttaaacccgtgatcttaaccgacggccccgagagggttatattagccgggccgatgccagtgaccgctgcatccgccgcacagcgccggggccgcgttgggcggaacccccagaaggaaaacgaccaatacatcttcacggggcagccactgaataacgacgaggaccacgcccactggaccgaggcgaagatgctgctcgacaacatcaacaccccggaggggatcattcccgcgctgttcgagcccgagcgcgagaaaagcgccgccatagacggggaatacagacttaagggcgaatcccgcaaaacatttgtggagttaatgcggcgcggggacctgccggtgtggctggcccacaaggtcgcgtcggagggtatcaaatacaccgaccggaagtggtgtttcgatggggagcgcaataatcagatcctcgaggagaatatggacgttgaaatatggacaaaggagggagagcggaagaagctccgcccgcgttggttggacgccaggacctattccgaccccctcgcgctgaaggagttcaaagacttcgccgcaggccgcaagagcatcgcgctggacctcgtgaccgagatcgggcgggtccctagccatctggcctacagaacgagaaacgccctggacaacttagtgatgctgcatacgagcgagcacggcgggagagcctaccgacacgccgtggaggagcttcccgagaccatggaaacactcctgctgctcggcttgatgatcctgctcaccgggggcgcaatgctgtttctcataagcggcaaggggattggcaaaacgtccatcgggctcatctgcgtcatcgtcagctccggcatgctgtggatggcggacgtgcccctgcagtggatcgccagcgcaatcatcctcgagttcttcatgatggtcttactaatccccgagcccgagaagcagagaaccccacaggataaccaactcgcatacgtggtgatcgggatcttgaccctggcagccatcgtcgccgcgaacgaaatgggcctactcgagaccactaagagggatctcggcatgtccaaggagcctggggtcgtgtcccctacaagctacctcgatgtcgacctgcaccccgccagcgcgtggacactatacgctgtggccaccacggtgatcaccccgatgctccgccacaccattgagaactccaccgccaacgttagtctggcggccattgctaaccaggccgttgtcttgatgggactcgacaaggggtggccaatatcaaagatggacctgggtgttcccctgctcgccctgggatgctacagtcaggtgaatcccttgaccctcaccgcggccgttttactgctggtcacccactacgccatcatcggcccgggccttcaggccaaggccacccgggaagcgcagaagcgcacagccgccgggatcatgaaaaatcccaccgtggacggcatcatgacgatcgacctggatcccgtcatctacgattccaagttcgagaaacagctcgggcaggtcatgttactggtgctatgcgccgtgcagctactgctcatgcggaccagctgggccctgtgcgaggcactgacattggccaccggccccatcacgaccctgtgggagggctcgccggggaagttctggaataccaccatagccgtcagcatggccaacatcttccgtggctcctacctggcgggggccggcctcgccttcagcattatgaagtccgttgggaccggccggagaggcaccggaagccaaggcgagacgctgggtgagaaatggaagaagaagctgaaccagcttagccgtaaggagttcgacctgtacaagaaaagcggcatcaccgaggtggaccgcaccgaggccaaggaggggctgaagcggggcgagaccacccaccacgccgtatcacgtggctccgcaaagctccagtggttcgtggagaggaacatggtgattcccgagggacgcgtcatagacctaggctgcgggcgcggagggtggagctactactgcgccggcctgaagaaggtgacggaagtgcgagggtacaccaaaggcggtccggggcatgaggagcccgtcccgatgtctacctacggatggaacctcgtgaaactcatgagcgggaaggatgtgttttacctgcctcccgagaagtgcgataccttactctgcgacatcggagagagcagcccctcccctacggtcgaggaaagccgaaccatccgggtattgaagatggtggagccctggctaaagaataaccagttctgtatcaaggtcctcaacccctacatgcccacggtgatcgagcacctggagcggctgcagcggaagtacggcgggatgctcgtgcgcaacccgctgtcccggaatagcacccacgagatgtactggatctccaacggcacgggcaacatcgtctcctccgtgaacatggtgtcccgcttgctcctgaataggttcaccatgacccaccgtcggcccaccatcgagaaagacgttgatttaggcgccggcacgcgccacgtgaatgctgaacccgaaaccccaaatatggacgtcataggggaacggatcaaaaggatcaaggaggagcacagctccacctggcactacgatgacgagaatccctacaaaacctgggcctaccacggctcctacgaggtgaaagcgacagggtctgcctctagtatgataaacggcgtggtcaagctcttaaccaaaccctgggacgtggtaccaatggtcacccagatggcgatgaccgacacgacacccttcgggcagcagcgggtgttcaaggaaaaggtggacacacgcacgccccggcccatgcccggcacgcgcaaggtcatggagataaccgccgaatggctgtggcggaccttaggccgcaacaaaaagccacgcctgtgtacccgggaagagttcacgaagaaggtgcgcactaacgcggccatgggggccgtcttcaccgaggagaaccagtgggactctgcccgggcggcggtcgaggacgaggagttctggaagttggtggaccgcgaacgggagctccacaaactgggcaagtgcgggtcatgtgtctataacatgatgggcaagagggagaagaagctgggggagtttggcaaggccaagggcagcagagccatatggtacatgtggctcggggcccgctacctggagttcgaagccttaggctttcttaacgaggatcactggttctcgagagagaacagctactccggggtcgagggcgaggggctccataagctgggctacattctccgcgacatcagcaagatccccggcggggcgatgtacgcggatgacacagccggatgggacacgagaatcaccgaagacgacctgcacaatgaggagaaaatcacccagcagatggaccccgagcaccgccagctggccaatgccatcttcaagttgacctaccagaataaggtggtgaaggtgcagaggcccacgccgaaggggactgtaatggatatcatctcacgcaaggaccagcggggatcaggccaagtggggacatacggactgaacacctttactaacatggaggcgcagctggtgagacagatggagggggagggcgtgctctccaaggccgacctggagaatccccaccttctagagaagaaaatcactcaatggctggagaccaagggggtggagcgcctgaaaaggatggctattagcggtgacgactgcgtcgtcaagcccatcgacgaccggtttgccaacgcccttctcgcgctgaatgatatgggtaaggttcgcaaggatatcccccagtggcagccgtccaaagggtggcacgactggcagcaggtccccttttgcagccaccacttccacgagctcatcatgaaggacggccggaagctggtcgtgccttgccgcccgcaggacgagctgatcgggcgcgcccggatctcccagggagccggctggagcctcaaggagaccgcctgcctgggcaaggcttacgctcagatgtggtctctcatgtatttccaccgccgcgacctacgcctggcaagcaatgccatctgctctgccgtcccggttcactggatcccaacatctcgtaccacctggtcgatccacgcgcaccatcagtggatgaccaccgaggacatgctgaccgtgtggaaccgcgtctggattgaggacaatccctggatggaggacaagacccctgtgaccacgtgggaggacgtgccgtacctcggcaagcgagaagatcagtggtgcgggtccctaataggcctgaccagccgcgccacctgggctcagaacattctcaccgccatccagcaggttcgaagtctgatcggagacgaggaatttctagactacatgcccagcatgaagcgcttccggaaggaagaggagagtgagggcgccatctggtga

SEQ ID NO: 26128 - RNA, 9873 nt, synthetic construct
  misc_feature 1..9873: note = derived and/or modified CDS sequence (opt11) from DENV-3__FJ547066__SS-prME
  source 1..9873: mol_type = other RNA
accagcctgtgcctaatgatgatgctgcctgcgaccctagcgttccacctaacctcgagggacggagagccgcgtatgatagtggggaagaacgagcgaggaaagagtttgttgttcaagaccgcgtccgggatcaacatgtgtacgttgatagctatggacctgggagaaatgtgcgatgataccgtaacgtacaagtgcccgcttatagccgagatggagcccgaagatatcgactgttggtgcaacttaacttcaacttgggtcacttacgggacgtgcaaccaggcgggcgagcaccggcgtgacaagcggtccgtagccctagcacctcacgtgggaatgggtctggacacgcgcactcagacctggatgtcggccgagggcgcttggagacaggtcgaaaaggtggagacgtgggctctgcggcacccgggctttacgattttagcgctgtttctcgcacactacatcggcacatcccttactcagaaggtcgtgatcttcatcctgctcatgcttgtgacgccgtccatgaccatgcggtgtgtcggggtggggaacagagacttcgtggagggcttatccggcgccacctgggtggatgtggtcctcgagcacggaggctgcgtcaccactatggccaaaaataagcccacgcttgacatcgagcttcagaagacggaggccacccagctcgcgacgcttcgtaagctgtgcatcgaaggcaagatcaccaacatcaccacggatagccgctgccctacgcagggcgaggctatcttacccgaggagcaagaccaaaactacgtgtgcaagcacacttacgtggaccgggggtggggcaacgggtgcggtctattcgggaagggatccctggtcacctgtgccaagtttcagtgcctcgagcccattgaaggtaaagtcgtgcaatacgagaacctgaaatacaccgttatcattacggtgcatacgggggatcagcaccaggtaggcaacgacacccaaggtgtgacagtggagataacgccccaggcctcaacagtcgaagccgtcctgcccgagtacggcacgctggggctggaatgcagcccacgaaccggcctcgatttcaacgaaatgatcctcttgaccatgaagaacaaggcgtggatggtgcaccggcaatggtttttcgacctccccctcccgtggactagcggcgccacaaccgagacaccaacgtggaaccgcaaagagctgctggtaacctttaagaacgcgcacgccaaaaagcaggaggtggtggttctcggttcacaggagggagccatgcacaccgccctgacaggggccacggagatccagaactcaggcggtacctcgatcttcgccggtcacctcaagtgccggttgaagatggataaactggagctaaagggcatgagctacgccatgtgcctcaacactttcgtgctgaaaaaagaagtgagcgagacccagcacggtacaatactgataaaggtcgagtacaagggcgaggatgccccgtgcaagatcccattcagcacagaggacgggcagggcaaggcgcacaatggcagactgatcacggctaatcccgtggtcaccaagaaggaggagcccgtcaatatagaggccgagccgccttttggggaatctaacatcgtaataggcatcggggacaaggcccttaagatcaactggtacaagaagggctcctccatcggcaagatgttcgaagcgacggcccggggcgcgcgacggatggccatcctgggagacaccgcctgggatttcggttccgtgggcggggtgctgaacagcctcggaaagatggtacaccagatcttcgggtcagcgtacaccgctctgttctctggcgtatcctggatcatgaagatcggtataggggtcttgcttacctggatcgggctgaacagtaagaacacgagtatgtcgttctcctgcatcgtaatcggcataatcacactgtacctcggtgcagtggtccaggccgacatgggatgtgctattaactggaaggggaaagagttaaagtgcggtagcggaatctttgtgacgaacgaggtacacacctggacggagcaatataaattccaagcggacagtccgaagcgcctcgctaccgccatcgccggcgcctgggagaatggggtctgcggcattcgtagcaccacccggatggagaacttactgtggaagcagattgctaacgaattgaactacatcctctgggaaaataacataaagttgacggtggtggtaggcgacatcatcggcgtcctcgagcagggcaagcgtaccctcacgccacaaccgatggaacttaagtactcctggaagacctgggggaaggccaagatagttacggccgagacccagaacagctcattcataatcgacggccccaatacccccgagtgcccatccgcttcccgggcgtggaatgtctgggaggtggaggactatgggttcggagtgttcacgaccaacatctggctgaagttgcgggaggtctacacccagtcgtgtgaccaccggctgatgagcgccgccatcaaagatgagcgagctgtgcacgcagatatgggctactggatcgagtcccaaaagaatgggtcatggaagctggaaaaggctagtttcatagaggtgaagacatgcacctggcccaagtctcacacactatggtccaacggcgtccttgagtccgacatgatcattcccaagagtcttgccgggcccatcagccagcataaccataggccgggctaccacacgcagacggccggaccctggcaccttgggaagctggagctggatttcaactactgcgagggcaccacagttgtaataacagagaattgtgggactcgtggcccctccttacggactaccacggtatccgggaagctcattcatgagtggtgttgccgctcctgtaccttgcccccactccggtacatgggtgaagacggatgctggtacggtatggagatccgcccgattaacgagaaggaggagaacatggtcaagagcttggtctcggctggcagcggaaaggtagacaacttcacaatgggcgtcctttgccttgcaatcttgttcgaggaggtgatgcgtggcaagttcggtaagaagcacatgatcgcgggggtcttattcaccttcgtgctcctgctctccggccagatcacctggcgcgacatggcccataccctaatcatgatcgggtcaaacgcctccgaccggatgggaatgggcgtgacttacctagccctgattgccaccttcaagatacaacccttcctcgcgttggggtttttcctccgcaagctcacctcacgggagaatctgctgttaggtgtcgggttagccatggccacgacccttcaattacccgaggatatcgagcaaatggccaacgggatcgcgctaggattgatgaccctaaaactgatcacgcagttcgaaacctaccagctgtggaccgccctcgtgagtctcacatgctcaaacacgatcttcacattgactgtggcctggcgtacggccacgctcatccttgccggggtttccttattgcccctgtgccagtccagcagtatgcggaagacggactggctgcctatgaccgtggcagcaatgggcgtgcccccgctaccactttttatcttcagcctgaaggacacccctaaacgccgctcctggccactcaacgaaggggtgatggccgtgggtctggtgagcatcctagcctctagcctccttcggaatgacgtgcccatggccggaccactggtggcagggggtttgctgatcgcatgctacgtcatcaccggcaccagtgctgacctgaccgtcgagaaggcagccgacgtgacctgggaggaagaggccgagcagacgggggtgagccacaacctcatgataacagtggacgacgacggaaccatgagaatcaaggacgacgagactgaaaatatccttaccgtcttactcaagactgccctcttaatcgtctccggaatattcccctatagcatccccgccacactactggtgtggcacacctggcagaaacagacccagcggtcaggcgtgctctgggacgtccccagtcccccggagacccagaaggcggagcttgaggagggagtgtaccgcataaagcagcagggtatctttggaaaaacccaggtgggagtcggggtgcagaaagagggagtgttccacactatgtggcacgtcacccggggcgccgtgctgacacacaatgggaagaggctggaacccaactgggcgtccgtgaaaaaggacctcatcagctacggaggcggctggcggttaagtgcccagtggcagaagggggaggaagtccaggtgatcgccgtcgaacccggcaagaaccccaagaatttccagacaatgcccggcatcttccaaaccaccacgggggaaattggcgccatcgcgctggactttaagcccggaacgagcgggtccccgatcataaaccgcgaaggcaaagtcgtagggctatatggcaacggggtggtcaccaaaaacggcggatatgtgtctggcatcgcccagaccaacgccgagcccgatggacctacgcctgaactcgaggaggagatgttcaaaaagcggaacctgaccatcatggacctgcatcccggaagcggcaagaccagaaagtatctgcccgctattgtgcgcgaagccatcaaacgaagactgcgcactctaatacttgcgcctactcgggtcgtggctgccgagatggaggaggccctgaaggggctgcctatcagataccagacgacggccaccaagagcgagcacacgggacgggagatcgtcgatctgatgtgccacgctacatttaccatgcgcttgctatcgccggtgcgggttccaaactacaacttgatcatcatggacgaggcccacttcacagaccctgccagtatagccgcccgcggatacataagcacgcgggtgggaatgggtgaggcggccgccatcttcatgaccgccacgcctcccgggacagcggaggccttcccgcagtccaacgcccctatacaggacgaagaaagggacatccccgagcgcagctggaactccggaaacgagtggataacggacttcgtcgggaagacagtgtggttcgtacccagcatcaaagccggaaacgatatcgctaattgcctgcggaagaacgggaagaaggtaattcagctgtctcgcaagacattcgataccgagtatcaaaaaacgcgtctcaacgactgggacttcgtggtcacgaccgacataagcgagatgggtgcgaacttcaaggccgacagagtaatagaccctcggcgttgcctgaagcccgtgattttaacggatggccccgagcgggttatcctcgcaggacccatgcccgttacggccgcctcggcggcccagaggcgcggacgcgtggggcggaacccgcagaaggaaaacgaccagtacatcttcaccgggcagcccctaaacaacgatgaggatcacgcccactggactgaggccaagatgctgctcgacaacatcaacacaccggagggaataatcccggctctgtttgagcccgagcgcgaaaagtcggcggccatcgacggcgagtatcgactgaaaggggagtcccgcaaaactttcgttgagctcatgaggcgcggcgacctcccggtctggctcgcccacaaggttgcgagcgagggaatcaaatatacggaccggaaatggtgttttgacggggagcgcaacaaccagattttagaagagaatatggacgtcgagatctggaccaaggagggcgagcggaaaaagctacgcccacgctggctggacgctcggacgtactccgatcccctggctctcaaggagtttaaggacttcgcggccggccgcaaaagcattgccctcgatctcgtgacagagatcggaagggtgccttcccatttggcgtaccgcactcgcaacgctctggataacctcgtaatgctgcacacctcggagcacggcggacgagcttacagacacgccgtggaggagctgccggagacgatggaaaccttgttattgttaggcctgatgatcttgctaaccgggggggcaatgctgttccttatcagcggaaaggggatcggtaagacttccatcgggctcatctgcgtgatagttagctcaggaatgctgtggatggcggacgtgccactgcagtggatcgcctcggccatcatcctcgaattcttcatgatggtactgctgatccccgagccggagaagcaaagaaccccgcaggacaaccaactagcctacgtggtgatcgggatcctgactctggcggctatcgtggccgccaacgagatggggttgctagaaactaccaagcgggaccttggtatgtcgaaggagcccggcgtcgtttctcccacctcctacctcgatgtcgatctgcatcccgctagcgcctggaccctttacgcagtcgccacaaccgttatcacaccgatgctccgccacaccattgagaattccaccgcaaacgtgtccctagccgcgatcgccaaccaagccgtcgtactgatgggccttgataaggggtggccgatttccaaaatggacctgggagtccccctgttagccctaggttgctacagtcaagtcaaccccctcaccttaactgccgcggtgctactgctcgtaacccactacgccattattggcccgggcttacaggccaaggcaactcgggaagcccaaaagagaaccgcggccgggatcatgaagaaccccacagtcgatggcatcatgaccatcgacctggaccccgtgatctatgactccaagttcgagaagcaactcggccaggtaatgctgctcgtcctctgcgcggtgcagctgctgctaatgcggacgagctgggccctgtgtgaagccctgactctggcgacgggtcccatcaccacgttgtgggaaggctctccggggaagttctggaacaccaccatagctgtgagcatggccaatatcttccgtgggtcatacctggccggagcagggctcgcgttttcaatcatgaagtccgtggggaccggccgtcgcggcacggggagccagggagaaaccctgggagagaagtggaagaagaagttaaatcaattgagccggaaagagttcgacctgtacaagaaatccggcatcacagaggttgaccgtaccgaggccaaagaggggctgaaaaggggcgagactacgcaccacgctgtgagccgcggctcagccaagctccagtggttcgtcgagcgcaatatggttataccagaaggacgcgttatcgacctgggatgcggccgcggagggtggagctactactgcgcgggcctgaagaaggttaccgaggtgcggggctacactaagggcgggccgggtcacgaggagcccgtgccgatgtccacctacggctggaaccttgtcaagctgatgagcggcaaggacgtgttctacctgccgcctgagaagtgcgacacgctgttgtgcgacataggcgagtccagcccctccccgaccgtggaggagagcaggaccatccgggttctaaaaatggtggaaccctggctgaagaacaaccagttctgcatcaaggtgctcaacccctacatgccaaccgtaatcgagcatctcgaaagattgcagcggaagtacggcgggatgctcgtgcgcaacccgctatcccgcaatagcacgcacgagatgtactggatttctaacggaaccgggaacatcgtgtcctccgtgaacatggtatcccgtctgctacttaaccggtttacaatgacccaccgccgacccaccattgagaaggacgtggaccttggggccggcacacgccacgtaaacgctgagcccgagaccccaaacatggacgtgatcggggagcggatcaagcgcatcaaagaggagcattcgtctacctggcattacgacgacgagaatccctacaagacgtgggcctaccatggctcctatgaagttaaggccaccgggagcgcgagctccatgatcaatggggtagtgaagctcctgactaagccatgggacgtcgtgcccatggtgacccagatggccatgacggacacgacccccttcgggcagcagcgggtcttcaaggagaaggtggatactcgcacgccacggcccatgccgggcaccaggaaggtgatggagatcacagcggagtggctgtggcgaaccctcggcaggaacaaaaagccgcgcctgtgcacacgagaggaattcaccaagaaggtccgcacgaacgccgccatgggggcggtcttcaccgaagagaaccaatgggacagtgcccgggctgcagtggaggatgaaggcttctggaagctcgtcgaccgcgaaagagaacttcataagcttggcaagtgcggctcgtgcgtctacaatatgatgggaaagcgcgagaagaagctgggagagttcggcaaggcgaaggggtcccgggcgatctggtacatgtggctcggagcacggtacctggagttcgaagcgctgggatttctaaacgaggatcactggttctcccgggagaacagctacagcggcgttgaaggtgagggcttgcacaaactaggctacatattacgcgacatcagcaagatccccggaggagccatgtacgcggacgacactgcggggtgggacacccggatcaccgaggacgacctgcacaatgaggagaaaataacccagcaaatggaccctgagcacagacagctggccaacgcaatctttaagctcacatatcagaacaaggtagtgaaagtgcagcggccaaccccgaagggcaccgtcatggacatcataagtcgcaaagatcagcgggggagcggccaagtaggcacctacgggttaaataccttcaccaacatggaggcacagctggtgcgccagatggagggtgagggggtgctctccaaggcggatctggaaaatccccacctcttagaaaagaagatcacccagtggttggagaccaagggggttgagaggttaaaaaggatggccatcagtggcgacgactgcgtggtcaagcccatcgatgaccgatttgccaacgctctcctggcccttaatgacatgggaaaggtgcgcaaggacatcccccagtggcaaccgtccaaggggtggcacgactggcagcaagtcccgttctgttctcatcatttccatgagctgatcatgaaggacgggcggaagctggtggtgccatgccgtccccaagacgagctgatcggcagggcgcgcatctcccagggagccggctggagcttaaaggaaacggcgtgcctgggaaaggcgtatgctcagatgtggtccttgatgtacttccatagaagggacctcagactggcgagcaacgccatttgctcagccgtaccggtgcactggatccccacgagccgtaccacctggagcattcacgcccaccaccagtggatgaccacggaagacatgcttaccgtttggaaccgcgtgtggatagaggacaacccgtggatggaggataagactccagtcaccacgtgggaggacgtgccttatttagggaagagggaggaccagtggtgcggctccctgattgggcttacaagtcgcgctacatgggcccagaacatcctcaccgctatccaacaggtccggtccctgatcggcgacgaggagttcctggactacatgccatcaatgaagcgcttccgaaaagaagaggagtccgaaggggccatctggtaa

SEQ ID NO: 26129 - RNA, 9873 nt, synthetic construct
  misc_feature 1..9873: note = derived and/or modified CDS sequence (opt11) from DENV-3__KF955460__SS-prME
  source 1..9873: mol_type = other RNA
acctcactgtgccttatgatgatgttacccgcgacccttgccttccacctcacaagccgggacggcgagccacggatgatcgtagggaagaacgagcggggcaaaagcctgctgtttaagaccgcgtccgggataaacatgtgcaccctcatcgcgatggacctgggcgagatgtgtgacgataccgtgacctacaagtgtcctctaatagccgaggtggagccagaagacatcgactgttggtgcaatctcaccagcacctgggtgacctacgggacctgtaatcaagcaggcgagcaccggcgcgataagcggtcggtcgccctggcgccccacgtaggtatggggcttgacacacgcacccagacctggatgtccgccgaaggcgcctggcgccaggtggaaaaggtggagacctgggctctgcggcacccggggttcacaatactggcactgttccttgcccactacataggcacctccctgactcagaaggtggttatctttacgctgctcatgctggtcaccccctccatgaccatgcggtgcgtgggcgtcggaaatcgcgactttgtcgagggactgtccggggccacctgggtagacgtggttctcgagcacggcgggtgcgtgacgaccatggcgaagaacaagcccacgctggacatcgaattgcagaaaaccgaagccacccagctagcgaccctgcggaagctatgcatcgagggtaagattaccaatatcaccacagacagtcgctgcccgacccagggcgaggccatcctcccggaggagcaggatcagaactatgtgtgcaagcacacctacgtggatcgggggtggggcaacggttgcggcttattcgggaagggttccctggtgacctgcgcaaagttccaatgtctcgagcccatcgagggcaaggtggtccaatacgagaacctgaagtacacggtgatcattaccgtgcacacaggggaccagcaccaagtcggcaatgacacccagggggtgacggtagagatcacgccccaggccagcactgtggaggccgttctgcccgagtacggcacactagggctggaatgctcaccgcgcaccggcctggatttcaacgagatgatactcctgacgatgaagaacaaagcctggatggtccaccggcagtggttctttgaccttcccctaccttggacctcgggcgccacgaccgagacgcccacctggaaccgcaaggagctgctggtcactttcaagaacgcccatgccaagaaacaggaagtagtcgtgctagggtcccaggagggcgccatgcacaccgcgctgacgggagccaccgaaatccagaacagcggcgggacctccatcttcgccgggcatctgaaatgccggttaaagatggacaagcttgaactgaaaggcatgtcgtacgccatgtgtctaaacaccttcgtgctcaagaaggaggtttccgagacgcagcacgggaccatcctgataaaagtagagtacaagggggaggacgccccatgtaagatccccttcagcaccgaggacgggcagggcaaggcgcataatgggcgcctaatcaccgcgaaccccgttgtcacgaagaaagaggagccggtgaacatcgaggccgaaccgcccttcggggagtcaaacattgtgatcggcatcgggaacaaggcccttaagatcaattggtacaaaaaagggtctagcatcgggaagatgttcgaggcaaccgcccggggagcccgcaggatggctatcctgggagataccgcctgggacttcgggagcgtcggcggggttctgaatagcctcggcaaaatggtgcaccagatcttcgggtcagcgtatacggccctgtttagcggcgtctcctggatcatgaagattgggatcggggtgctgctcacgtggattggtcttaatagcaagaacacctctatgtcattctcctgcatagtgatcggcatcatcacactgtacctaggcgcagtcgtgcaggcggacatgggatgtgccataaactggaagggaaaggaactgaagtgtggatcggggatcttcgtgactaacgaggtccacacttggacggagcagtacaagttccaggcagactcccccaagcgcctcgccactgccatcgccggcgcatgggagaacggggtgtgcggtattcgcagcactacgcggatggaaaatctcctgtggaagcagatcgcgaatgagctgaactacatactgtgggaaaacaatatcaagctgaccgtagtcgtcggtgatataatcggcgtgttagagcagggtaagcgcacccttactccccagccgatggagctgaagtactcctggaagacgtggggtaaggccaagatcgtcaccgctgagacccagaacagcagtttcatcatcgacggacccaacaccccagagtgccccagcgcctcccgagcgtggaacgtgtgggaggttgaggactacgggttcggcgtcttcacgacgaatatctggctgaagctacgcgaggtgtacacccagagctgcgatcatcggctgatgtccgcagcgatcaaggatgaacgcgctgtacatgctgacatgggctattggatcgagtctcagaagaacgggtcctggaagttagaaaaggcctccttcatcgaggtaaaaacttgcacctggccaaagtcccacacgctctggtcaaacggcgtgctggagagcgacatgataatccccaagtccctagccgggcccattagccagcacaaccaccggccgggctaccacacccagaccgcaggaccttggcacctcggcaagctggagcttgactttaactactgcgaaggaacaacggtggtaatcactgagaactgtggtaccagaggcccttccctccgcaccacgaccgtatccgggaagctgattcacgagtggtgctgccgctcctgcaccctgccacccctccggtacatgggcgaagacgggtgctggtacgggatggagatccgccccatcaacgagaaggaggagaacatggtcaaatcccttgtctctgccggcagcgggaaggtggacaacttcacaatgggcgttctgtgccttgccatcttgttcgaggaggtcatgcgggggaagttcgggaagaagcacatgattgcgggtgtgcttttcacgttcgtgctcctgctgagtggccagataacctggcgcgacatggcccacactttgatcatgatcggtagcaacgccagcgaccgaatggggatgggcgtcacatacctcgccctgatcgccacgttcaaaatccagccctttctggccctggggttcttcctgcgcaagctcaccagccgcgagaacctgctgctcggtgtgggcctagcaatggccaccaccctgcaattgccggaggacatcgagcaaatggccaatgggatcgctttaggcctgatgacgctcaaattgatcacccagttcgagacttaccaattatggaccgcattagtgagcttgacctgctccaacaccatcttcacccttaccgtcgcttggcgcacggcgaccctcatcctcgcgggggtttcgctgctccctctgtgccagtcctcatcaatgcggaaaaccgactggctgcccatgacagtcgccgcgatgggtgtgccgcccctgcccttattcatcttctcactgaaggacacgccaaagcgccgctcctggcccttgaatgagggagttatggccgtcggcttagtgagcattctcgcctcctccctcctacggaatgatgtgcccatggctggccccctggtcgctggcgggctcctgatcgcgtgctatgtaatcacggggacctccgccgacttgaccgtggagaaggccgccgacgtcacgtgggaagaggaagcggagcagaccggggtgagccacaatctcatgatcaccgtggatgacgacgggaccatgcgcatcaaggacgacgagactgagaacatcctgacggtcctgctcaagaccgcactgctgatcgtaagcggcattttcccctacagcatcccggccaccttgctggtttggcacacctggcagaagcagacgcagcggagtggcgtgctctgggacgtgccatctccgccggagacccaaaaagctgagctcgaagagggggtgtaccgaatcaagcagcagggcatcttcgggaagacccaagtcggcgtgggggttcagaaggagggcgtctttcacaccatgtggcatgtgactcgtggcgccgtgctgacccacaacgggaagcgcctggaacccaactgggccagcgtcaagaaggatttgatctcatacggaggcggctggaggctctctgcccagtggcagaagggtgaggaagtccaggtaattgccgtggagcccggcaagaacccgaagaatttccagaccatgcccggcatcttccagaccaccaccggggaaatcggcgccatcgccttagacttcaaaccagggaccagcggcagcccgatcatcaacagagagggcaaggtggtcggattgtacggcaatggagtggtgaccaagaatggcgggtacgtatccggcatcgcacagacgaatgccgaacccgacggccctacgcccgagctcgaggaggagatgttcaagaagcggaacctcaccataatggacttgcaccccggaagcggcaagacccgcaagtacttacccgccatagtccgggaggcaatcaagcgcaggctgcgcaccctgatattagcgcccacccgagtggtggctgcggagatggaggaggccctgaaaggacttcccatccgctaccagacaacagccactaagagtgaacatacgggccgggagatcgtcgacttgatgtgccacgcgaccttcaccatgcgcctgctgagcccagtccgagtgcctaactacaatctcattatcatggacgaggcccacttcacggaccccgcctccatcgccgcccgcgggtacatctcgacacgagtaggtatgggagaggcggccgccatctttatgaccgcgacgccgcccgggacggcggaagccttcccccagtccaacgcacccatccaggatgaggagaaggacatacccgagcgcagctggaacagcggcaacgagtggatcaccgatttcgtgggaaagaccgtctggttcgtgccctcgataaaggccggcaacgacatcgccaactgcttacgcaagaacggaaagaaggtcatccagctgtcccgaaagaccttcgacaccgaataccaaaaaacgcgccttaacgactgggatttcgtggtaacgaccgacatcagcgaaatgggagcgaactttaaagccgaccgggtcatcgacccacgccggtgcctgaagcccgttattctgacggacggcccggaacgcgtcatcctcgccggcccaatgcccgtgaccgccgccagcgcggcgcaacggcggggacgggtggggcgcaacccccagaaggagaacgaccagtatatcttcaccggccagcccttgaacaacgacgaggaccatgcccactggaccgaagccaagatgctcctcgataacatcaacaccccggaggggatcatacccgctttattcgagcctgagcgggagaagtccgcggccatagatggcgagtaccgcctgaaaggcgagtcccggaaaactttcgtcgagctaatgcgccgcggggacctgcccgtgtggctggcccacaaggtcgcctcagaaggcatcaagtacactgaccgcaagtggtgcttcgacggcgagcgcaacaatcagatactagaggagaatatggatgtggagatctggactaaggaaggcgagcgcaagaagctgcggccgcgctggctggatgcacgcacctattccgaccccctcgccctgaaggaattcaaggactttgccgcaggccgcaagtcaatcgccttagacctcgtgacggagataggacgcgtgccctcccatcttgcctaccggacccgcaacgctctggacaatctcgtcatgctgcacaccagcgagcacggcgggcgagcctaccgccatgcggtggaggagttgccagagaccatggagacgctcctgcttctgggcttgatgattctgctcaccgggggcgcgatgctgtttctgatcagcggaaaggggatcggcaagacctccatcgggctgatctgcgtcatcgtgagctccggcatgctgtggatggcggacgtgcctctacagtggatcgcttcagccattgtgctagagtttttcatgatggtgttactgatccctgagccagaaaagcagcggaccccgcaggataaccagctcgcctacgtggtgatcggcatcctgaccctggcggcgatcgtagcggccaatgagatgggcctcctggaaaccaccaagagggacctgggcatgtccaaggagccgggcgtggtcagccccacctcatatctcgacgtggacctgcaccccgccagcgcctggacactgtacgcggtcgccaccaccgtcatcaccccgatgctccggcacacgatcgagaattccaccgcgaacgtcagcttggccgcaatcgccaaccaggccgtggtcctgatgggattagacaagggttggcccatctccaagatggacctgggcgtccccctgctcgccctggggtgctacagccaggtgaatcccctgacgctcaccgccgcggtcctgctgttagtgacgcactacgcaattatcggcccgggcctgcaggccaaggctacccgcgaggctcagaagcggacagcggccgggatcatgaagaacccaactgtagacggcatcatgacgatcgacctggaccccgtcatctatgactcgaagtttgagaagcagctcggccaggttatgctgctggtgttgtgtgccgtccagctgctgctcatgcgcacctcatgggcgttatgcgaggctctgaccctcgccaccggccccatcaccaccctgtgggagggctccccggggaagttttggaataccactatcgcagtgtcgatggccaacatcttccggggatcctaccttgccggggcgggcctcgccttctccatcatgaaatccgtggggacgggtcgacggggcactgggagccagggcgagaccctgggcgagaagtggaagaaaaagctaaaccagctcagcaggaaagagttcgacctgtacaagaagtccggcatcaccgaggttgaccggaccgaggccaaggaggggctgaaacgcggagagacgacccaccatgccgtgtcccgggggtccgccaaactgcaatggttcgtggagcgcaacatggtcatcccagaagggcgagtgatcgacctaggctgtgggcgcggcgggtggagctactactgcgccggcctcaagaaggtgaccgaggtccgcggttacacaaaaggcgggcccgggcacgaagagcccgtaccgatgtccacgtacggctggaacatcgtgaaactaatgagcgggaaggacgtcttttacctgccccccgagaagtgtgacaccctactgtgcgacatcggcgagtcctccccctccccgactgtcgaggagagccgaaccatccgcgtcctcaagatggtcgagccgtggcttaagaacaaccaattttgtatcaaagttctgaacccctatatgcctacagtgatcgagcacctcgaacggctgcagcgcaagtatggagggatgctggtccggaacccgttatcccggaacagcacgcacgagatgtattggatatctaacggcacggggaacatcgttagctccgtgaacatggtcagccggctgctgctcaacaggtttaccatgacgcatcgccgccccaccattgaaaaggacgtggacctgggagcgggcacacggcacgtcaacgccgagccggaaacgccgaacatggacgtgatcggggaaagaatcaaaaggatcaaggaagagcactctagcacgtggcattacgacgacgagaacccttacaagacctgggcctaccacggctcctacgaggttaaggccaccgggagcgcgagctctatgatcaacggcgtagttaagctgctcacgaagccgtgggacgtagtcccaatggttacgcagatggccatgaccgacaccacccccttcggccagcagcgcgtgtttaaggagaaggtcgacacgagaacgcccagacccatgcccggcacccgaaaggtgatggaaatcaccgccgagtggctctggcgcacgctgggccggaacaagaagccgcgactctgcactcgcgaggagttcactaagaaggtacggaccaacgccgccatgggggcggttttcacagaagagaaccagtgggacagcgcccgcgctgccgtggaagacgaggagttctggaagctggtggaccgggagcgggagctgcacaagctcggcaagtgcgggagttgcgtttataacatgatgggcaagagagagaagaagctgggggagttcggcaaggcgaaaggcagccgcgccatctggtacatgtggctcggggcccggtacttagagtttgaggcgctgggcttcctgaacgaggaccactggttttcccgcgaaaactcatactcgggggtggagggcgaggggctccacaagctgggctacattctgcgtgatatcagcaagatccccggcggggctatgtacgcggacgacaccgccggatgggacactcgcatcaccgaagacgacctccacaatgaagagaagatcactcagcagatggatcctgaacatcgccagctggccaatgctatcttcaaactcacctaccaaaacaaggttgttaaagttcagcgacccaccccgaaggggaccgtgatggacatcatttcccgtaaagaccaacgtggaagcggacaggtcggtacctacggcttgaacacgttcaccaacatggaggcccagctggtgcggcagatggagggggagggcgtgctgtccaaggcggacctcgaaaatccgcacctcctagagaagaagatcacccagtggctagaaaccaagggggtcgagcgcctgaaacggatggccatcagcggcgatgattgcgtggtaaaacccatcgatgatcgctttgccaatgctttactcgcgctgaacgacatgggcaaggttcggaaggacatcccccaatggcagccgtccaaggggtggcacgactggcagcaggtcccattctgcagtcatcacttccatgagctcatcatgaaagacgggcgcaagctcgtggtcccctgccggccccaggatgagctgatcgggcgagcgcgcatttcccagggcgccgggtggagcctcaaggagacggcttgcctcggcaaggcctacgcgcagatgtggtccctgatgtacttccaccggcgcgacctgcggctcgcgagcaacgccatctgctccgccgtgccggtgcactggatacccaccagccgaaccacctggagcatccacgcccatcaccagtggatgacgaccgaggacatgctcacggtgtggaatcgggtttggatcgaagacaacccatggatggaggacaagacacctgtcacgacctgggaggatattccgtatctaggcaagagggaggaccaatggtgtgggtccttgatcggcttgacctctcgggcgacctgggcccaaaacatactgacagccatccagcaggttcgctccctcatcggggatgaagagttcctggactacatgccctccatgaagcggttccgcaaggaggaggaatcggagggcgcaatctggtag

SEQ ID NO: 26130 - RNA, 9873 nt, synthetic construct
  misc_feature 1..9873: note = derived and/or modified CDS sequence (opt11) from DENV-3__FJ461334__SS-prME
  source 1..9873: mol_type = other RNA
acctcgctgtgtctcatgatgatgctgccggcgaccctggcttttcacttaaccagccgggacggcgaaccgcggatgatcgtggggaagaacgaacgcgggaagtctctgctattcaagacggcgagtggtatcaacatgtgcaccctcatcgccatggacctgggcgaaatgtgcgacgacactgtgacctacaagtgccccctgatcgcagaagttgagccagaggacatcgactgttggtgcaacctcaccagcacctgggtgacctacgggacctgcaaccaggccggcgagcaccggcgagacaagcggtccgtggcccttgcaccgcatgtgggcatggggctggacacccgcacacagacttggatgagcgcggagggcgcttggcgccaggtggagaaggtcgagacttgggcactacgccacccggggttcaccatcctggcgctgttcttggcccattacatcggcacgtccctaacccagaaggtggttatcttcatcctgctcatgttagtcacgccctcaatgacaatgcggtgcgtgggggtgggcaaccgcgacttcgtcgaggggctgtccggagcaacctgggtggacgtagttttggagcatggcgggtgcgtgactacgatggccaagaataagcccacgctggacatcgagttacagaagacagaggcaacccagcttgcgacgctacggaagctgtgcatcgaagggaagatcaccaacatcaccaccgactcccggtgccctacgcaaggagaggccatcctccctgaggagcaagaccagaactacgtgtgcaagcacacctacgtcgaccgcgggtggggcaacgggtgcggcctgttcgggaagggatccctcgtgacctgcgccaagttccagtgcctcgagcccatcgagggcaaggtggtccagtacgagaatttaaagtacaccgtgatcatcacggtccacaccggggaccagcaccaagtcggcaacgacacccaaggggtgaccgttgagattacgccccaggccagcaccgtggaggctgtgctgcccgagtacggcacccttgggctggagtgctcccctcgcacaggcctggactttaacgagatgatcctcctgaccatgaagaacaaggcctggatggtccaccggcagtggttcttcgacctacccctcccttggacgagcggcgccaccaccgagacccccacgtggaatcgcaaggagctgctggtgaccttcaagaacgcacacgccaagaagcaggaagtggtcgtgctcgggtcccaggagggcgccatgcacaccgcgctgactggggcaacagaaatccaaaattcaggcgggacctccatcttcgccggccacctcaagtgccggctcaagatggataagctagagctgaagggcatgagctacgccatgtgcctcaacaccttcgtgctgaagaaggaggtctccgagacacagcatgggacgatcctgataaaggtagaatacaagggcgaggacgctccttgcaagatccccttcagcaccgaggatgggcagggcaaggcgcacaacggccgactgatcacggccaaccccgtggtcaccaagaaggaagaacccgtgaacatcgaggccgagccgccctttggggagagcaacatcgtgatcggcatcggggacaaggctttaaagatcaactggtacaaaaagggctccagcatcgggaaaatgtttgaggcgacggcccggggcgcgcgccggatggccatcctgggcgacacagcctgggacttcgggtccgtcggtggggtgctcaacagcttgggcaagatggtccaccagatcttcggttccgcgtacaccgccctgttcagcggcgtctcctggatcatgaagatcggcatcggggtgctgctcacctggataggcctgaacagcaagaacacgtccatgagcttctcctgcatcgtgattgggattatcaccctgtacctgggcgccgtcgtgcaggccgacatggggtgcgccatcaactggaagggtaaggaactgaagtgcggcagcggcatcttcgtgaccaatgaggtccacacctggacggagcagtacaagtttcaggcggactcgcccaagcgcctggccaccgccatagccggagcgtgggagaacggggtttgcggcatacgcagcaccacacggatggagaatctcctgtggaagcagattgcgaacgagctgaattacatcctctgggaaaacaacatcaaactgacggtggtcgtgggcgacatcatcggcgtcctggagcagggcaagcgcaccctcacgccgcagccgatggagctaaagtattcatggaagacctggggcaaagcaaaaatcgtcacggccgaaacccagaacagctccttcatcatcgacggccccaacacccccgagtgccccagcgcttcccgggcgtggaacgtgtgggaggtggaggactacgggttcggcgttttcacaacgaacatctggctgaagctccgcgaggtgtatacccagagctgtgaccaccggctgatgagcgccgcaatcaaggacgagagggccgtgcatgccgatatgggctactggatcgagtcccagaagaacgggagctggaaactggagaaagcgtcattcatcgaggtcaagacctgcacctggcccaagagccacaccctctggtccaacggtgtgctggagagcgacatgatcatccccaagtccctggccgggcctatcagccagcacaaccaccggccgggctatcacacgcagaccgccgggccctggcacctcggcaaattagagctggactttaactattgcgagggaaccaccgtggtcatcacggagaactgcgggacccgcggccccagcctccggaccacgacggtgtcagggaagctgatccacgaatggtgctgccgctcctgcaccctgcccccgcttcggtacatgggggaggatgggtgttggtacggcatggagatccgccccataaacgagaaggaggagaacatggtcaaaagcctggtcagtgccggcagcgggaaggtggacaacttcactatgggcgttctgtgcctcgcgatcctgttcgaggaggtcatgcgggggaagttcggcaagaagcacatgatagcgggggtactgttcaccttcgtgctgcttctgagcggccagatcacgtggcgcgacatggcccataccctcatcatgattggcagcaacgcatccgaccggatggggatgggcgtcacctacctggcgctcatcgccacgttcaagatccagccctttctcgcgctgggtttcttcctgcgcaagctcacgtcgcgggagaacctactgttgggcgtgggcctggccatggccaccaccctccaactccccgaggacatagaacagatggccaacgggattgctctgggcttgatgacgctgaaacttatcacgcagttcgagacctatcagctctggaccgccctcgtgtcactgacctgctccaacacgatctttacactgactgtcgcctggcgcaccgccacgctaatcctcgctggcgtgagcctgctccccttgtgccaatcctcctccatgcgaaagaccgactggctgcccatgaccgtcgcggccatgggcgtcccaccgctgccgctgttcatcttctctctgaaggacacccccaagcgccgctcctggcccctcaatgagggggtgatggccgtgggcctggtaagcatcctggcctcatccctcctgcggaacgacgtgcccatggccggcccgctggtcgccggcggtctcctcatcgcctgctacgtgatcactgggacgtccgcagacctgaccgtggagaaagccgccgacgtcacctgggaagaagaggcggaacagacgggggtgagccacaacctcatgataacagttgacgacgatgggaccatgcgcatcaaggacgatgagaccgagaacatcctgacggtcctgctgaagacggccctgctgatcgtgtctggcattttcccctacagcattcccgccaccctcctggtgtggcacacttggcagaagcaaacccagaggtccggcgtcctatgggacgtgcccagcccacccgagacgcagaaggccgaactcgaggagggtgtgtaccgcatcaagcagcaaggcatattcgggaagacccaggttggcgtgggcgtgcagaaggaaggcgtctttcacaccatgtggcacgtaacccggggcgccgtgctgacacacaacgggaagcgcctggagccgaactgggcatctgtcaagaaggacctcatcagctacggcggagggtggcggctgtccacccaatggcagaaaggcgaagaagtccaagttatcgctgtcgagcccggcaagaatccgaagaacttccagaccatgcccggcatcttccagactacgaccggggaaatcggcgcgatcgctctggactttaagcccgggaccagcggctcccctatcatcaaccgtgagggaaaagtagtggggctgtatgggaacggcgtcgtgacgaagaacggcgggtacgtgtccggaatcgctcagacgaatgccgagcccgacggcccgacccccgagttggaggaggaaatgttcaagaaacggaacctgaccatcatggacctccacccgggatcaggcaaaactcgcaagtacttgcccgccatcgtccgggaggccatcaagcgtcggctccgcacgctgatcctcgcccccacccgggtggtggcggcagaaatggaagaggccctgaaggggctgcccatccgctaccaaaccacagccacgaagtccgagcacaccggccgagagatcgtggaccttatgtgccatgccaccttcacgatgcgattactgagtccagtgcgggtgcccaattacaatctcatcatcatggacgaggcacacttcacggaccccgcctcaatcgccgcgcgcgggtacattagtacccgggtgggaatgggcgaggccgcggccatattcatgaccgccacgccgccaggcacggctgaggcatttccccaatccaacgcccccatacaggacgaggagcgcgacatcccagagcgcagctggaacagtggcaacgagtggatcaccgactttgtggggaagaccgtgtggttcgtcccaagcatcaaggccggcaacgacatcgccaactgcctgcggaagaacgggaagaaagtcatccaattgagtcgcaagaccttcgacacggagtaccagaagacccggcttaatgactgggacttcgtggtcaccaccgacatcagcgagatgggcgccaacttcaaggcggaccgcgtgatcgatccccggcgctgcctgaagcccgtgattcttacggacggcccggagcgggtcatcctcgccgggccgatgcccgtgaccgccgcctccgccgcgcagcgccggggccgcgtggggcgcaacccccagaaggaaaacgaccagtacatcttcaccggccaacccctgaacaacgacgaggaccatgcccattggaccgaggccaagatgctgctcgacaacatcaacaccccggagggaatcatccccgcattatttgagcccgagcgcgagaagtccgctgccatagatggagagtaccggttaaagggcgagtcccgcaagacgttcgtcgagcttatgcggagaggggacctgcccgtgtggttagcccacaaggtagccagcgagggcatcaagtacacggaccgtaagtggtgcttcgacggggagcgcaacaatcaaattctcgaggagaacatggacgtggagatctggaccaaggagggcgagcggaaaaagctgcgcccgcgctggctggacgcccggacctattctgatcccctcgcgctgaaggagttcaaggacttcgcagccggccgcaagagcattgcactggacctcgtgacggaaatcggccgggtcccatcccacctggcctacaggacccggaacgcgttggacaacctcgtaatgctgcatacctcggagcacggcgggagggcataccggcacgccgtagaggagctaccggagaccatggagacgctcctgctgctcggcttaatgatcctgctcacaggaggggccatgctgttcctgatctctggcaaggggattggcaagacctccatagggctcatatgcgtcatcgtaagctcaggcatgctgtggatggccgacgttcccctgcaatggatcgccagtgccattattctcgagttcttcatgatggtcctactgatccccgagcccgagaagcagcgcacccctcaggacaaccaactcgcctatgtggtgatagggatcctgacgctggccgctattgttgcggccaacgaaatgggcctcctggagactacgaagcgagacctgggcatgtccaaggagcccggggtggttagccccaccagttatttagacgtcgatctgcatcccgccagcgcctggacgctgtacgccgtagcgaccaccgtgatcaccccgatgctgcgccacacgatcgagaactccaccgccaacgtcagcctggccgccatcgcgaaccaggccgtggtgctgatgggcctcgacaaggggtggccgatctccaagatggatcttggcgttcccctgctagccttaggttgctacagccaggtgaatcccctaaccctcacggccgccgttctactgctcgtcacgcattacgcgatcatcggccccggcctgcaggccaaggccactagggaggcgcagaagcgcaccgccgcgggcatcatgaagaaccccaccgtggacgggatcatgacgatagacctcgaccccgttatctacgactccaagttcgagaagcagctcgggcaggtcatgctgctggtgctctgcgccgtacagctgttactcatgcggacctcatgggccctttgcgaggccttgactttagccaccggccccatcacgaccctgtgggagggctccccggggaagttctggaacaccaccatcgcggtcagcatggccaacatttttcgcgggtcctacctggccggggccggcctcgcgttcagcatcatgaagtccgtggggacagggcggcgcggcaccgggagccagggagagacactgggggagaaatggaagaagaaactgaaccagctcagccggaaggagtttgacctgtacaagaagtcaggcataaccgaggtggatcgcactgaagccaaggaggggctgaagcggggcgagacgacgcaccacgccgtatcgcgcggctccgccaagctccagtggttcgtggagcggaacatggttatccctgaggggcgcgtcatcgacctgggctgcggacgcggcgggtggtcatactactgcgccggcctgaagaaggtgaccgaggtccgcgggtacaccaagggcgggcccgggcacgaggagccggtcccgatgtctacgtacggctggaatctcgtgaagctgatgagcgggaaggacgtgttttacctgccgcccgagaagtgcgacaccctgctttgcgacatcggcgaatccagcccttcccctaccgtggaggaatcgcgcaccatccgggtgctgaagatggtggagccgtggttaaagaacaaccaattctgcatcaaggtcctcaacccctacatgcccacagtaatcgagcacctggagcgcctgcagcggaaatacggcgggatgctcgtgcgcaatccgctgtcccggaacagcacacacgagatgtactggatctcaaacggcaccgggaacatcgtcagctcggtgaacatggtcagccgcctgctccttaatcggttcaccatgactcacagacggcccaccatcgagaaggacgtcgacctgggcgcaggcacacgccacgtgaacgccgagcccgagaccccgaacatggacgtcatcggagagcggatcaaacgcatcaaggaggagcactccagcacgtggcactacgacgacgaaaacccctacaaaacatgggcgtaccacggctcctacgaggtgaaggccaccgggtcagcttcatccatgatcaacggcgtggtcaaactcctcaccaagccctgggacgtggtccctatggtcacgcagatggcgatgaccgacaccacccccttcggtcagcagcgggtcttcaaggagaaagtggacacgcgcacgccgcggccgatgccggggacccgcaaggtcatggagataaccgccgagtggctgtggcggacgttgggccgcaacaagaagccgcgcctgtgcactagagaggagttcactaagaaagtgcgcaccaacgcagctatgggggcagtttttactgaggagaatcagtgggacagcgcgcgtgccgccgtggaggacgaggagttctggaagctggttgatcgagagcgggagctccacaagctgggaaagtgcgggtcctgcgtgtacaacatgatgggcaagcgggagaagaagctaggagagttcgggaaggcaaaggggagccgggcgatatggtacatgtggctcggggcccgctacctggagttcgaggctctgggcttcctcaacgaggaccactggttctccagggagaacagctactccggggtcgaaggagaagggctacacaagctgggttacatcctgcgcgacatcagcaagatccccggtggggccatgtacgccgacgacacggcgggctgggacacgcggattacggaggacgatctacacaatgaggagaaaatcacgcagcagatggaccccgagcaccggcagctggccaacgccattttcaaattaacctaccagaacaaggtggtgaaggttcaacgccccaccccgaaggggaccgtgatggacatcatctcacgcaaggaccagcgggggtcgggccaagtagggacatatgggctgaacacgttcaccaacatggaggcacagctggtccgccaaatggagggcgagggcgtgctcagtaaggcagacctagaaaacccacacctactcgagaagaagatcacccagtggctggagacaaaaggtgtggagcggctcaagaggatggcgatcagcggcgacgactgtgtcgtgaagcccatcgacgaccggttcgcaaacgctctcctcgctctgaatgacatgggcaaagtgcgcaaggacatcccccagtggcagccctccaaggggtggcacgactggcagcaggtacccttctgcagccaccacttccatgagctcatcatgaaagacggccggaagctggtggtcccctgtcgcccccaggacgagcttatcgggcgcgcaaggattagtcagggcgcggggtggtccctcaaggagactgcctgcctgggcaaggcctacgcacagatgtggtccctgatgtatttccaccgcagggacctccgcttagcaagcaacgcgatttgctccgccgtcccggtccattggatccctactagccggaccacctggagcatccatgcgcaccaccagtggatgactaccgaggacatgctgaccgtctggaaccgagtctggatcgaggacaatccatggatggaggacaagacccccgtgacgacatgggaggacgtgccctacctcgggaagcgggaagaccagtggtgcgggtccctgattggcctgaccagccgcgccacctgggcgcagaacattctcacggccatccagcaggtacgctcccttatcggtgacgaggagttcctggactacatgccctcgatgaagcgctttcgaaaggaggaggagtccgagggtgccatctggtga

SEQ ID NO: 26131 - RNA, 9873 nt, synthetic construct
  misc_feature 1..9873: note = derived and/or modified CDS sequence (opt11) from DENV-3__FJ461337__SS-prME
  source 1..9873: mol_type = other RNA
acgtcgctgtgcctaatgatgatgctgcccgctaccctggccttccatctaaccagccgggacggcgagccacggatgatcgtcgggaagaacgaacgcggcaagagcctgctgttcaagaccgcgagcgggataaacatgtgcacccttatagccatggatctgggtgagatgtgtgatgacaccgtgacatacaaatgccccttaattgctgaggtggaaccggaagacatcgactgctggtgcaacttaacctcaacctgggtgacgtacgggacctgcaatcaagccggagaacaccggcgcgacaaacggtccgtcgccctcgcaccccatgtgggcatgggactagacacccgcacccagacctggatgagtgccgaaggcgcttggcggcaggttgaaaaagtggagacgtgggccctccgccaccccgggttcaccatcctggctctgttcctcgcccactatatcggcacatcgctgacgcagaaggtggttatcttcatactcctcatgctggttacgccgagcatgaccatgcggtgtgtgggggtcggcaaccgcgacttcgtcgagggcctgagtggggccacctgggtggacgtggtgctcgagcacggcgggtgcgtgaccacgatggccaagaacaaaccgaccttagatatcgagttacagaagacagaagccacgcaacttgccacgctgcggaaactgtgcatcgagggaaagatcaccaatatcaccaccgacagccgctgtcccacgcagggcgaggcgatcctcccggaggaacaggatcagaactacgtgtgtaaacatacctacgtggaccgggggtggggcaacggatgcggactcttcgggaagggcagtctggtgacctgcgcgaagttccagtgcttggaacccatcgagggcaaggtggtccagtacgaaaacttaaagtataccgtgataatcacggtgcacaccggggaccagcaccaggtcggaaacgacacccagggggttacagtggaaataacgccccaagcgagcaccgtggaggctgtgcttcccgagtacggcaccctcgggcttgagtgctccccgcgaacgggcctggacttcaacgagatgatcttactgactatgaagaacaaggcgtggatggtccatcgccagtggttcttcgacctgcccctcccctggaccagcggcgccaccaccgagacccccacgtggaaccgcaaggaactgctggttaccttcaagaacgcacacgccaagaaacaggaggtggtcgtgctcgggtctcaagaaggtgccatgcatacagcgctgaccggagccacggagatccagaacagcggaggaacctccatcttcgcaggccacctgaagtgccggctgaagatggacaagctggagctgaagggaatgagctacgccatgtgtctcaacaccttcgtcctcaagaaggaggtctccgaaacccagcacgggacgatcctgatcaaggtggaatacaagggggaggacgccccgtgcaagatccccttcagcaccgaggacgggcaaggtaaggcgcacaacggccgcctgatcaccgccaaccccgtggtcaccaagaaggaggagccggtaaatatagaggccgagcctcccttcggggagagcaatatcgtcatcggaataggggacaaggccctcaagatcaactggtacaagaaagggtccagcatcgggaagatgttcgaggcgaccgcccggggagccaggcggatggcgattctgggcgacaccgcctgggatttcgggtcaatgggtggggtccttaactcgctcggcaagatggtgcatcagatcttcgggagtgcgtacaccgcactattcagcggcgtttcctggataatgaagatcgggatcggggtcctcctcacctggatcgggctgaactcaaagaacacgtcaatgtcattttcctgcattgtgatcggaatcatcaccctgtacttaggggccgtggttcaggcggacatgggctgcgcgatcaattggaagggcaaagagcttaagtgcggcagcgggatttttgtgaccaacgaggtgcacacctggactgagcagtacaagtttcaggcggactcccccaagcgcctggctacagctatagcgggcgcctgggaaaacggggtctgcggcatccgcagtaccactcgcatggaaaacctcctgtggaagcaaatcgcaaacgagctgaactacatcctctgggagaacaatatcaaacttacggtggtggtaggggatataataggcgtgctggagcaaggtaagcgcactttgactcctcagccgatggagctgaagtactcgtggaaaacctgggggaaggctaagattgtgacggcagaaactcagaacagctccttcataatcgacggccccaacaccccagagtgtccgagtgcctcacgggcctggaacgtatgggaggtggaagactacgggttcggggtattcaccacgaacatctggctgaagctccgagaggtctacacccagtcctgcgatcaccggttaatgagcgccgccatcaaagacgagcgggccgtacatgcagatatgggctactggatcgagtcccaaaagaacggtagctggaagctagagaaggcgtccttcatcgaggtgaagacatgcacatggcccaagagccacaccttgtggtccaacggtgtacttgagtccgacatgatcatcccaaagtccctggccggccccatcagccagcacaaccaccgtcctggctaccacacgcaaacagccgggccctggcacttaggcaaacttgagctggacttcaactactgcgaaggcaccaccgtagttatcactgaggattgcggaacgcgcggcccctcccttcgaaccaccacggtcagcgggaagctgatccacgagtggtgctgtcgctcctgcaccctgcctcccctccggtacatgggggaggacgggtgctggtacggcatggagatccggcccatcaacgagaaggaagagaatatggttaaatccctcgtgagcgccggcagtgggaaggtcgataactttaccatgggcgtgctgtgcctcgccatcctgttcgaggaggtgatgcgggggaagttcggcaagaagcacatgatcgcgggagtcctcttcaccttcgtgttattattatccggccagatcacatggcgcgacatggcccataccctcataatgattggctctaacgcatccgaccggatgggtatgggcgtgacctacctggcactgatagcaaccttcaagatccagcccttcctagcacttggtttctttcttcggaaacttacgagccgggagaacctcctgttaggcgtcggcttggcaatggccaccacgctgcaactccctgaggatatcgagcagatggcaaatgggatcgccttgggcctcatgacactcaagttgatcactcagttcgagacctatcagttatggacagctctcgtatcactaacctgctccaatacgatcttcacccttactgtagcctggcgtaccgccacactcattcttgcgggggtgagcctgctcccgctgtgccagtccagctccatgcggaagaccgattggctccctatgaccgtggcggctatgggcgtgccgcctctgccgctgttcatcttcagcctaaaggacactcccaagcgcaggtcctggcccttaaacgagggggtgatggccgtgggactggtcagtatcttggcctccagcctcttgcggaacgacgtgcccatggcaggcccgctggtggccggcggcctcctgatcgcatgctatgtcatcacagggacatccgcggatcttaccgtggaaaaggccgcagacgttacctgggaggaggaggcggagcagactggagtctctcacaatctcatgatcaccgtggacgacgacgggaccatgcgcatcaaggacgacgagaccgagaacatcctgaccgtgctgctcaagacagccctgttaatcgtctccggcatattcccatacagcatacccgccaccctcctggtgtggcacacctggcaaaaacagactcagcgatccggtgtcctgtgggacgtccccagccctccagaaacgcagaaggcagagttagaggaaggagtgtaccgcatcaagcagcaaggcattttcggtaaaacccaggtgggcgtcggggtacagaaggaaggcgtgttccacacgatgtggcacgtgacccggggcgcagtgctgacgcacaacgggaagcggctggagcctaattgggcgtcggtgaaaaaggacctcatctcatacggtggcgggtggcggctgtccgctcagtggcagaagggggaggaggtccaagtgatcgccgtggagcccggtaagaaccctaagaacttccagaccatgccaggcattttccagaccaccgcaggggagatcggcgcgatcgcgctggacttcaagcctgggacttcaggaagtccgataattaaccgcgagggcaaggtcgtggggttgtacggcaacggcgtggtaactaagaacggcggctacgtctccgggatcgcccagaccaatgccgagccggacgggcccacgcccgagctcgaagaggagatgttcaagaaacggaacctgacgatcatggacctgcacccagggtcagggaagacccggaaatacctccccgctatcgtgcgggaagctattaagcgccggctgcgcaccctcatcctcgcgcccactcgggtagtggcggccgagatggaggaagcactcaaggggctgccgatccgctatcagacgaccgccacaaagtctgagcacaccggtcgggagatcgtagacctcatgtgccacgctaccttcaccatgcgcctgctgtctccggtccgagttccaaattacaatctcatcataatggacgaggcgcacttcacggaccccgcctcaatcgcggcgcgcggttacataagtacccgggtaggtatgggcgaggctgccgctatcttcatgacagcgacgccacccgggaccgccgaggctttcccccagtccaatgctcccatccaggacgaggagcgcgacatccccgagcgctcgtggaactcagggaacgaatggatcacagacttcgtcgggaaaacggtatggttcgtacccagcatcaaggccggcaacgacattgcgaattgcttacgtaaaaacgggaagaaggtgatccaactgtcccgcaagacgttcgataccgagtaccagaagacccggttgaacgactgggatttcgtggtcacgaccgacataagcgagatgggcgccaacttcaaggccgaccgtgtcatcgacccccgccgctgtcttaagccggtaatcctgactgacggcccagagcgggtgatcctcgccgggccgatgcctgtcaccgccgcttccgctgcccagcgccggggccgcgtcgggcggaacccccagaaggaaaatgaccaatacatcttcacgggccagcccttgaacaatgatgaggaccacgcccactggactgaggccaagatgctcctcgacaatatcaacaccccagaggggatcatacccgcgttgttcgagcccgaacgcgaaaagtccgccgccatcgacggcgagtatcggctgaagggcgagtcccgcaagaccttcgtggagctcatgcgacgcggggacctgccggtctggctggcccataaagtggcatcagagggcatcaaatatactgaccggaagtggtgcttcgacggggagcgcaacaaccagatactagaggaaaacatggacgtcgagatctggacgaaagagggcgagcggaagaagctgcggccgcgatggctggacgcccgaacgtacagtgatcccctcgccctgaaggagttcaaggacttcgcggctggccgcaagagcattgcgctggacctcgtgaccgagataggccgggtgccctcccatcttgcctatcgcacccggaatgcactggacaacctagtcatgctgcacacgagcgagcatggagggcgggcgtatcggcacgccgttgaggagctgccagagaccatggagaccctactgctactcggtctgatgatcctgctgaccgggggcgcgatgctatttctgatcagcggcaaggggatcggtaagacttcgatcgggctgatctgcgtgatagtcagctccggcatgctgtggatggcagacgtgcctctgcagtggatagccagcgccatcgtgctcgagttcttcatgatggtcctgctgatacccgagcccgagaagcaaaggacaccgcaggacaaccagctcgcctacgttgtgatcggcatcctgaccctggctgccatcgtagcagcaaacgaaatgggcctcctggagacaacgaaacgggatctgggcatgagcaaggagcccggcgtggtgagccccacctcctatctcgacgtagacttgcatcccgcctccgcttggaccctgtacgccgtggccacaacggtgatcaccccgatgctcaggcacaccatcgagaactccaccgccaacgtctctctggcggccatcgctaaccaggctgtggtgttaatgggcctcgacaaggggtggcctatatccaagatggacctgggcgtcccactgctggccctggggtgttacagccaggtgaaccctctgacgctcacagccgccgttctgctcctagtcacccactacgccatcatcggacccggcctgcaagcaaaggccacccgagaagcgcaaaaacgcacggccgcaggtatcatgaaaaacccgaccgtagatggcatcatgacgattgatctggatcccgtaatctacgattcaaagttcgagaagcagttaggtcaggtcatgctgctggtgctttgcgccgtgcaactgctgctcatgcgaaccagctgggccctgtgcgaggcgctgaccctcgcgactggccctatcactaccctgtgggaaggctccccgggaaagttctggaatacgactatagcagtcagcatggcaaacatctttcgcggatcttacctcgcgggagccggcctcgccttcagtatcatgaaaagcgtggggaccggtcggcgggggaccggcagccagggcgagactctgggggagaaatggaagaagaagctgaaccaactaagccggaaggagttcgatttgtacaagaagtcgggcatcactgaggtggatcgcacagaagccaaggaggggctgaaacggggcgagaccacccaccacgccgtcagtcgtggctccgcgaagctccagtggttcgtggagcgtaacatggtgatccccgaaggtcgcgtcatcgaccttggatgcggacgaggcgggtggagctattattgcgctggcctgaagaaagtgacagaggtgcgtggctatacgaagggcggccccgggcacgaggaaccggtcccgatgagcacctacggctggaacctcgtgaaactaatgtcgggcaaggatgtgttctacctgccgcccgagaagtgcgacaccctgctctgtgacatcggtgagtcctctccctccccgacagtcgaggaaagccgcacgatccgggtgctgaagatggttgagccttggctgaaaaataaccagttctgcatcaaggtcctcaacccctatatgccgaccgttatcgagcacctcgaacggctgcagcggaagtacggcgggatgctcgtgcggaatcctctgtccagaaattcaactcacgagatgtactggatcagcaacggcacggggaatatcgtcagttccgtgaacatggtgagccggttgctcttgaaccgtttcactatgacacaccgccggcccactatcgaaaaggacgtggacctgggcgcgggcacgagacacgtgaacgccgagcctgagacgcccaacatggacgtcatcggggagcgtatcaagagaatcaaggaggagcatagctctacctggcactatgatgacgagaacccctacaaaacttgggcatatcacggttcctacgaggtgaaagccaccgggtctgccagctccatgatcaacggggtggtcaagctcctaaccaaaccctgggacgtagtgcccatggttacccagatggccatgaccgacacgactcccttcggccaacaacgggtatttaaggagaaggtggatacccgcacgccccgccccatgcccggcacgagaaaagtcatggaaatcaccgccgagtggttatggcggaccctcggccgtaacaagaagccgcgattatgcaccagagaggagtttactaaaaaggtgaggactaacgccgcaatgggcgctgttttcactgaggagaatcagtgggacagcgcacgggcagctgtcgaggacgaggagttctggaagttagtggacagagagcgcgagctgcataagttaggcaagtgcggctcctgcgtctacaacatgatgggcaagagagagaagaaactcggagagttcggcaaggccaaaggctcccgggccatctggtacatgtggttgggggctcgctacttggagtttgaggcgctcggctttttaaatgaggaccactggttctccagggagaacagctattccggggtcgaaggcgaggggctacacaagttgggctatatactccgcgacatcagcaaaatcccgggaggcgcgatgtacgccgatgacaccgcgggatgggacacgcggatcacggaggatgatttgcacaacgaggagaaaataacccagcagatggaccccgagcaccggcagctggcaaacgctatcttcaagctcacctaccagaacaaagtcgtgaaagtccaaagacccacgccgaaggggaccgtcatggacatcatctcccggaaggaccaacggggttcaggccaggtggggacctacggcttaaatacctttaccaatatggaggcgcagctggtccgccagatggagggggagggcgtgttatcgaaggccgacctggaaaacccccaccttctcgagaagaaaataacccagtggctggagacgaagggggttgagcggctgaagcgcatggccatcagtggcgacgactgcgtcgtgaagccgatagacgataggttcgcaaacgctctcctggcgctgaacgatatgggaaaggtacgcaaggacatcccccagtggcagccgtccaagggctggcacgattggcagcaagttcccttctgcagccaccacttccacgagctgatcatgaaagacggaaggaagctggttgtgccctgtcgccctcaggacgaactgatcggtcgggcccgaatctcccagggcgcaggttggagtctcaaagaaaccgcctgcctgggcaaagcctacgcgcagatgtggtcccttatgtacttccatcgccgtgaccttcgcctggcctcaaacgccatttgctctgctgttccggtccactggattcccaccagtcggacgacctggtccatccacgcgcaccaccagtggatgacgaccgaggacatgctgacggtatggaatagggtctggatcgaggataacccctggatggaagacaagacccccgttaccacctgggaggacgtaccgtacctcggcaagagggaagaccagtggtgcgggagcctgatcgggcttacaagccgcgccacttgggcccagaacatcttaacagccattcagcaggtacgatccctgatcggggatgaggagttcctggattacatgccctctatgaaacgcttcaggaaggaggaagaatcggagggcgcgatctggtga
